United States Patent 9,328,346 (POLYCOMB-ASSOCIATED NON-CODING RNAS) - sequence listing, part 22

SEQ ID NO: 3498 - RNA, 150529 nt, Mus musculus
cagucggcugugcugcgcugcgaggcucggugggguuuuggauuugcuccuccccuucccuaccucccugcauucugaguggcugagaggaagaggaccaguuggaguccgcaucugugugcacuggcugccgcagggcccagcaagcagguggagcucagccucccacggagcauugggcgguggaccgcagugacgcggccugagacauggcggccacgcgccucugaggccgcagaaccggagucucuugcugcgcgaguugccccuuggccaugcagcuuggcugcugacugccccggcgcguggcccggaggaucccggcugcggucaucaccuugcagucuccaugcugcaggguauauuccucccauauuccauguauuccuccucagugcuuccggccguguagccgcagcugccggccgggccucagggcgcucuaccuauuauucaucaggcacuuuucuuuuccauuuuuauuuucauuccuauuugcuucuccuuuucccuucugcuuugcgucuaucuccgccaccccgcuauggccgcagaggaggcgcugaagacgguagaccaauauaagacugaaauagagagacugaccaaggagcucacagaaacgacccaugagaagauccaggcugcagaguaugggcugguggugcuggaggagaaacugacucucaagcaacaguaugacgagcuggaggccgaguaugacggccucaaacaagagcuggagcagcucagagaggugagcaacccgucuccuauuucccucuccagguuuggcauuucucagugccagucaucacuguaaagaagucagaagggauauggccagaaggacuucaucuuagagcccuuuguugauaagagaauauugaaagaguccauuguuuucaccaauagaaaaauuacccaagaaaugaaugcauaagcuggaaugggaagcucuuuauuaugugggggagggagagucacaagaagucuucaggcauccgugcuggcagguaacauugaauuggguugaaaugcauaaaucaaacuucucaaacugcuguuauuucaaacccagauaucaaugaccauaauccauccaauugaugagguuugugccugaggaccuacaauuucaggaugguagaauuugguacuucagucgucugcugaguaauugcuccuuggugaaauaggaacuaguuauuaggacucaccagucccguuugacguuggcuuuaguccuugucauggggcuguaggagcaaaacaacuuugcugggugguuuugcugcccuuaauuucaccucugugcaaggcugggcuaugcuuaugucuuauagaaggcacccugagacugaggaaaaucaaaaucaucuccauauggugagacaugagaaagaaauguaaaauauauggauaucuaugccuugccuaucaaauauggcccuucagguugaaauuacuguauuuauaaaaucagaauaucaccaauguucugugaauaacauuucccccccuauuuuuauauuuccuucuucuaaggguaauguacugaaauguccaaccaaauauucauaaggauuauacauacuauuuaagacacuggaaauagcaagcagucguguauaaauguuaguauacauaaacacagauuuucugugugacaagucuuuauuuuuaggugcauacuaacauuuuaaauguuaggcauaucauacauaaauagaaauacuuuucuuauaaucuaagcuuauuuuagggaaaggggaggcccaguuuuguauugucacaguuaaaaaaacaugaguaugacauucuaaucaacucaccuaacuuauaaauaauacauauuuaaaccuuuaauuaugcuauuuuauuuagaugcuuaaauaccaaaauauguaaauagauauaguugaaaacaauagauagagauauaauuuuuauauaccgggcuauaaauucuaguucaugcuuuucuugcuauauucauaucuggauuuaaugguaucuguacuuauauuuucuaaauaugucuuagauuaugucuuagacugacauguuuuagaugcuaaaucuuaggaaguaaggaaauagaugauuauuguaauucucagagauguuuccaugaugucuuuauuuauugacugugcuuugccaagguggagaaaugcaaaccaauguuaugucaucacuuucuugauaaaagagguggacuuauuugaugauauaaaauaugauuguuaauagaccuuucuucuugagcuaaacaacacuuucagggauauuuauguguuguuguacuuaacacacuaaaccuuaauacaguugccuuuugucuuuaguaaacaauacuuaaaauaaugaguuugccuuuuauuuauuuaaaguugauagauaaaauuguauguauuuauuaugugcagaauuauguuuugcaguguacauauguuaugccuuuuugggcauuauauugcuucauauaauuaucuuuuuugugauaacucaacauucauucuguauuuuuaaagaguaaauauauuggcauuauaaucaucauggugcacagugaauuucuuaaacuuauucuucuuaucuaacuguaauaaugaccuuuucaucaauaucucuucuuucaagcaaucaacacuucuaguaacuaucacuuacaucucugauuccuuauaugaaugagauaaugaaauguuuguuuccugugccuggcuuauuuuaaaauaauacaaagucuuaacacagagcuuagcacauaauaaaaauaaaaauaaauauuuuauaaaauaaauuuauauuagaagaauuuacaccuuuaucaaguguucagaagucaauauugcuuaguguuagagaaagacugagaaaauugaagaguguagaaagugaccacuguuuuagucucauugucagucaagggaaaagggggaaauguuuuauaagaaugaugaaaguucuuaacaaaauaauacaaaugccaauuauauuuuuuaaaauaaaagauuuaagaaauuuuguucuauauagcaagaaaaaauauaaggaguuuuucuuuuuaucaaaugacacuugcuauuacacauauuuugacuuacauuuagcauaaagauaacucaaagcugggcagugguggugcaugccuuuaaucccaguuuaaucugaguucaaggcgagccuggucuacagaaugaguuccaggacagccagggcuacacagagaaacccugucucaggaaaaaaaaaaaaaaaaaaaaaaaaaaagaaaaggaaagaaaaaagaaagaaagaaaacgcaaaugacaaauccuaguaaacaggauuuuagcuauauagaaguguauuuuaagguaguaaaaauaguuauaugcuauuauuagauaauaauacuuauuuuaucuuuuaaauauguuuuauuuucguugagauuauuacuuaaaugaauugagucauguuuugaauuaaauacaaaacaacaguguaaaacaauguaaucuaaugaugaugucacauacaagccauuuaguguguguguguguguguguguguguguaggucagaggacacucaaauguuauuccuuagacuacuugucuuuugagauaguaucucuuacuggccugaaacuugcugaguaugcuaaguuagcuggucagugaacucuagggacccaccuguaucugccuccccagugcugagguuacaaguguguacugccaugcuaugcuuuuuaaagcauugaauuuagguccuaaugcuuguacaauagauuuuuuuuuaaaccaaauaagccuuuucucaacccuggaagucauugcuuuaaaauauucuggggagaagggacagauggcucagaggguaagggguuuuguugccaggcuugaugaguuccauuacucucccuccacccuguuucuacaugguagagaaagagagcccacucuuguaaguuguuucccuaucucacaugagugguacauacaugcacacgcacgcacacacacacacacacacacacacacacacacacacacacacacacacauuauuaaaauguaauuaaaauuuucauaguaacagaaaguaaauuaggacaacaacauaguacauguucuucuauguguucucccuucugacuaccauuaccauugcuccuuugguaaauacucuuuguacuacuuuaaaugucuuugaacauaugaaucuauauguaggauuuucuuuuuauucuuuauuuuuauaaagucaguugugaagaauaugguacuauuuagggaggauugauaagguggcucaaguucuguccugauaguuuggaagguugucagaaaggaaaaaugaguaguuguguauggaagacuguaauuugcuuugaugacccuaaagcagccuuguguguugauaugaagggaauagauggauaguucuguuggugaauuauuggugauuuugcuuccuugucucauuggcugaugaugggaauaugugcaucagcauaaugccuggcugguuuccacaguccugcagugugaccacauccugcccacucuagaucuuggugugaagccaggaugauucaggcaguuggacauuauuaguacacuacuccuuauuucuucucugacaguugacauauauuauaaauaugacugcuaugaacauaguggagcauguguccuuauuacauguuggagcaucuucuggguauaugccuaguaucuuauaagcacuucagaucuuguacagcaucucauaagauagggagaaaagaguagaaacaugaaucugccagcaaguaucuuagucauuaaaauggagagaaaagaaaggauggcuauuggugccuuuuccuccuggaaucuagucacuuuggcuauaaaacccaguaacugaauaaucuuaaaauauuuacuguaauauaccuggcccgcuguguuuuaccugguuuguuuauuugucuaucuacuuuuuccuuuucaaauuccuucuacuuuuuccaaaauauaaaauaaucuugcuugguuguauuaacuuucauccagccauuuucuauauuuucuuucaguuaugcucauucaguuccagccauaauauuucacuguuugauagccuuuucuaaaguaauuaauaguucucauaugaacaccuggcccauacacguuucccuuugaauucauuuauuuuucuaauuuuccauauuuuauuuuagaacugauucacggaguuuguuauugaaauaccugcaccuggcuucauagaaggagggagaaaaugaauaugaauauaaacauggagugagauuauacuccagaaccauuguaaaaacuuuugacuccuaauguuauccccuuuccuguuuuccccccaagaacccuccuaucccauucccccucccccugcuucuaugaggguacuccuccucccaccuuaccgcccuggcauuccccuauacuggggaauucagccuucacaggaccaagggccucuccucccauugaugcccaacaaguccacccucugcuacauauguggcuggagccaugggucccuccauguguagucuuugguuggugguuuagucccugggagcucuagggggucugguugguugacacuguugcuccucccauggggcugcaauccccucagcuccuucagucccuucuccaacuccuccauugggauccccaagcucaguccaaugguuggcugcaagcauccgccucuguauuugucaggcucuggcagagcuucucaggagacagcuauaacaggcuccugucagcaagcacuucuaagcaucugcaauuguguuuggauuuggugucuguauauggguuggauccccagguggggcagucucuggauggccuuuccuucagucucugcuccacacuuuguuccuguauuuccuuuagacaggagccauucuggguuaaaaaucuggagaugaguggguggucccauucccccaaccgggggcuuugccuaaccucuagaugucucuacagguucucucuccccuuuguuaggcauuucagcuaaucucauuccuguuggguccugggagccucuuguuuuccuggcaucugggacuugcugguggcuaucucuagcuccccaucccccauugcuacauaccucuguucaaauuccugacccucuguauaucauuucugucucuuuccauaccugauccugccccaucuuuucccucuuccccuccucucuuccucccaagucccucccacccucuacuuccccugaguauuuuguucuuccuucuaagagugacugaagcauccacauuuuggucuuccuucuugagcuucauauggucuaugaauuguaucuuggguauucugagcuaauaucagugagugcauaccauguguguucuuuugugacuagguuaccucacucaggaugauauuuucuaauuccauccauuugccuaagaauuucauuaagucauuguuuuuaauagcugaguaguacuccauuguguaaauguaccacacuuucuguauccauuacucuguugagggacaucuggguucuuuccagcuucuggcuauuauaaauaugacugcuaugaacauaguggagcguguguucuuauuacguguuggagcaucuucuggguauaugcccaggaguggucuagcuauguccuaagguaguacuauguccaauuuucugagaaacugccagacugauuuccagagugguuuuaccagcuugcaguuccaacaauggaggaguguuccucuuucuccacauucucgccagcaucugcugucaccugaguuuuugaucuuagccauucugacugguguaagauggaaucucaggguuguuuugauuugcauuucccuguugaacauuucuuuaggugcuucuuggccauucgauauucuucaguugagaauucuuuagcucuguacuccauuuuuaaaauagaguuauuugguucucuggagucuaacuucuugaguucuuuguauauauuggguauuaacccucuaucggauauagaauugguaaagaucuuuccccaaucuguugguugccauuuuuuccuauuaacaguguccuuugccuuacagaagcuuuaguuuauuguuuuuaaacguuacauaaauucuuaauguuggaggaauauuagaaauuaacuuuuuuauuuuuuauuauuuguguguguuugaguguuuugccuggaugaauccauaucauguguauaccuggugccuguggaaguuugaaguggaaaauaguaucagauuucuuguaacuggggucauaaauagcaccaugugggugcugagaauugaacugaaauccucugcaagagcgacaagugcugucagcaacuaagucaugucucuagcccugaaauuaucugguuaagugaucuggugaucagaauuauaagaagguaauuuuuguuaauauuuuaaaauaauuuagaacuacaaaucuuucuuaagugaauccucaggcauucuauauuaaccacuguaguuauuucuaaucuaguuuuauauucaagaagguuuuucauugcagcaaaaggaaaugguuuaucuuugcaauaagauaugcaacuuauaaaagaaaauauuugggucuggagauggcucagggguuaagagcacugacugcucuucugaagguccugaguucaaaucccagcaaccacaugguggcucacaaccaucuguaaugagaucugacgcccucuucuggcgugucugaagacagcuacaguguacuuauuuauaauaauacaaaaaucuuuaaaaaaagaaaacauuugauuggagacuuguuuauaguuucagaauguuaaucuaugaucaucuccauggagagcauggugguuggcaaguaggccuggcacuugaguaguaacuaagagcuuacauucugauccagugguaguagagauagaugauagauagauagauagauagauagauagauagauagauagauagauaggugauaguuagauccugagccuggcuuggccuuuugaaaccucagguccccuucccugccacugacacaccuucuucaacaaggccacaccuucuaauccuucccaaacaguuccacuaauuggggaugacauaaucaaacauaugagcuuauggggucauucucauucaaaugaaaacaccgcaggcuucaaaacuaacaauuacauuuuuagagaauugucaugguaaaguauuucagaaaaauauaaugaaagcaagagaaauauagacagauaauauuuuaguuaucaucgaccacuuccaaauuuaaaaaaaaugugaugcuaauaugauuuagaaauuugaaaauggcuauaaaagaagugcuguaaauaaauagauuuucacauaaaaauaaaugauuguucauuucugcaauaacauuaauguauuuaauauuucuacugugugagaguuagagaucuguguguugaagauacagcaaugaacaaggagaaagcuccauguucaugaaguuuguauucuguguggaauaaagaaaauaguaaaaaugaacaagaaaacuagauacgauauuaaaugguccuuaauguuguagagacaauaacaaaacaaaaggauggcauguaugucuggggcaccugcugcuuguuaacaucugugcuguuguagugagcaguagauugaaaaaaaaaaggagugagaggugagagaugggacuggagagaugauuuuagccagaugguaaaggucguuucagucagccuuugcuagcaaaugccucaucauagcugguuauaaggacauugggcuacaggaaggaucucccccuaacaaagagucuggaaauagcugucagucuauuuccuaauaaguguccuugaacaucuggggcucuuguaaauuagaaaguggcuaugccucacucuugugaugguguauuaggaaauuuggaauuuugcauuuuucucugugcuacacaaaugugaacauuuuguaauauaaaacuaacuucuguggcuguggguauagcuuaguacaaguguuugccuaacauaugcuagacccuagguucuauucucaguauagcaagaaccaaacuaaaugaaaacaaagaagucaaagcaacuccauugcaaaaauguagcuugacagaggaaaaagcaacuagagauguugguuacuuuaagauuaaagaaaucuuaaucuuaaauaagaaaaaguauucuagauauuuauucauuacacauauuaugacuaaccauuauauuguagagacuguuaggugcugcagguuauuuauuuagacauuauuucuugucuuuggagaauuuaauuaacauuuauuuguuuauuauuuuauguguaugaauauuuugucugcauauaugucuguguaccacaggcaugucugaugccugcagaagccagaggaggacauucucuggaacuggaguuuuagaugcucaugagcugccuuguggauguugagaauugaaucuugguucuauggaagaacagcccgugcucuuaccugcugaacaguuuuuccagcccccucggagaguuuauuuuugacagaggaagaaaaguaacagaagaguaggcaauaaauaauuuuguauagggauaugugcuuaaaaacaaagcaagguuauggaauaauaaaccuaucaggagcuagugggagagguaauauuagaaaugagagucagggaaagccuuuuugagagauugauauuuaagcuaagucccaggugaugagaauuaacaaaccaggaagggauuguccuggccugaaagcaccagcaauguagaaaucauuuguugggaacaagcuuuguguuugugaaaacugcauagcuuuauuggcauuugauaugcaaugacccuguguaguauagaacucugcugugcauuuugguucucuguggaaugauuaggauccuggcccugccuacuaacaaccaguggcggcacuuuucccaagucaauguaauaauaaaacacugucacauauucuaaacauacuuuuucuguucuuccaugaggcaguacugccauucauugaggaccucagaagacuucagucaugacuggaguggaagggguggauacgggaggaaaugauagugaauuagacuggaacugagcccugagaugugucuccuaggugacuacaaauccagucaaguugacaugaauauugaguaucauagcaggcucuguggccuuuugggaacccaagguaacuguaauauuccacuaaucugugauugcugaauuuuaugucuuuuuuguccuguucaacuuugaauuauuaaauacuagaauaacauucugauuaauaagaggaggagagaaaagagagaugucgggaccuuugggauagcauugaaaauguaaacgaggaaaauaccuaauuaaaaaaaaaaaaaaaaagaaaaagaaaagggagaugucugggcauuucuugucuucucuuuccacagauccuuagucuccuaauaugaacuuucuauaucacuaggaagacaucuaucuauaucacuuuugggccaggccugaccauuuuaaaaaauaaggauauaguccuuugcuaaauauaacccaguucuuuuagaacuuuuaauuagcuuuguuuacaucucuagaaauagcuauuaguacuuguagcuaaaacauugaauuaacauaaaucuuguuuucaccuaauacuuuuguguguuuuaaaguuaguauugcuaacacauuugucuauguauuuauuuguguauauuuguuuguuuauuuauguaugguuuuuggagacaguuucucuguguagcccuggcugucuuagaacucacucuauagaccaggcuggacaacaaacucaagagaucuaccugccucugccuccugagugcugugauuaaaggugugcaucaucucgggauguaaagugcauaaauaaauuaauuaaugggaaaaaaaggugugaaucaucacugcccagauauuuuuuaaaaagauguauuuauuauuauauguaaguacacuguagcugucuuuagacacaccagaagagggcaucagaucucauuacagaugguugugagucaccaugugguugcugggauuuggacucaggaccuucagaagagcagucaaggcucuuacccgcuaagccaucucaucagcccccugcccagauauuuuuauauuuuaaaguucuacacucaguuauuuccucaaacaaucuauuacucggaacauaguuuuucaagaagaaaaaaaaaaugacaaaaugaauagaauagcugugaguggcucauauuuguaauuuuaguauucagaaggcagagccaggaggaucaagaauuugagcccagccuggguugcauggcuacauccuaucccaagcaaacauauaucugugacaagauaacaagaugaccagauaaguugcaaaccuagcaaauguucugauggaaaaccugacacugucaucugcagcacacaaggccuuugacauucaguaucagcauguagcuuuuuuauguauuaacaacaacaauaaaauaagacuuagcuguguguguugauuacaugacuuuuuuuccuuuuguuuuuugagacaagaucuuucuauaugacccagacuggccucaaacuugauaucuuucugccucagcuuaacacugagguggauuauuaugaugccaccugacuuaauauuuuuuaaauguuucuuuguggucuggcuauacaaaguacucuuucuuuuucaugagaucugaguuuuaauucaaauucccuguuuccuggguaggagagcaagccaaacaucaaaaucaggguuagaauugaaaaaaaaaaaaaaaaaaacccagcuaaauuguguucuucacuuagcauauaccagcuauugggcugaauacuuuauacauuaagguacagccuuagcagaauaugaaaauagauauuaccauccucccaucucccuuccucccacccaagacugggccuugcuauguaugaccuugaacucacagaggucuuuuggagccugucuucuaagugcugggauuaaaggcaugcaucauuaugcuuagcuugaaaguaggaauuacuauuauuuacauuauauggauuaaaaaaauugaagcacaugggcuggugagguggcucaguggguaagagcacccgacugcucuuccgaagguccggaguucaaaucccagcaaccacaugguggcuaacaaccaucuguaacaagaucugacacccucuucuggggugucugaauacuuacauauaauaaauaaauaaaucuuuaaaaaacaauugaagcacagauagauuauauauaaucugccuaguuacugagaaaaccaaaauuugagccaagcaauguaacgccaauacuucgugguuuuuuuguuuauuuguuugguuuuguuguuguuguuguuguuguuguuguuuuucuagacagggcuucucuguauagcccugacuguccuggaacucacuuuguagaccaggcuggccucaaacucagaaauccaccugccucugccucccaagugcugggauuaaaggugugugccaccaccgcccggcucuuuuuuucuugagacaaaaaucuuacuauguagcccuccuugucuuguuucaaaacuucguauauagaucagauugguuuuaacucacagagaucugccagccucuuuccacaacaacaauaaaaacaucaauaacaauaaucucucugggguggggugugaugaaggaagaugaggggagcagagagaagcaggauguggggccuugccaggguuuuaaaagagugguauaguuaugaaagggagggaggaguggaaucuggaacagccuggaaguuaggguagaaaggaaggaauuugccaguggcuuugauauuacacauugcagggguguguuaauagggaccaaaggagccuggagguuauuguggggcuuugauuuguguuacagguauaauaugccuuaucugcaguaauugguuguaggaaagaggugagaaaugauggcuucuaccugaguuucugaggaauguuguguguaggcuuuuaucucuuugccagcaauacuuuucuguuuaacuugucaguuucauccugagcugacuccagacucucauuuuaggacauaguggcaaggccuuuuuugggagguuugggacuuaacaaaauuaugugaauauguguguuucuauauacaugugugagggugcauauagauccagagguauuagaacuucugggacuggaauuauaagggguugugaacaaucuagcauggauuuaguuucauguuggaacuccaguccucugaaagagcagcaacuauuaacuacugagccaacauccagccuucauuguuuugaaagauggaauuuccauaucaccuaaaaucuguauuaucacuucauaauuugggguccuaauuguccacuugugcucugguccaugugguugcuauaguaacugcuuuaaaaagauucaguuagcuuuguuaguguuuuagauuucaauguacuaaugugucuaaagccagauuuuuauguggauuuacuuuuuuuguuacugucucuuagcauuuccaaagcaguggcuuuguuuacuuauuuauugcaaagcacuauaauauguuggaaaauacuccaacaguucuuaaguuaaaucaguuuaguuuaugcucuuagccuagaugauaagcucauuuaaacuuuucucuugucuguugcucagucaaaguuuaguaaaauuguuaacuggcucccccauuaaggauaacuuucagaguaucauguaauaccauggaacuuauuaaaaaacaaaacaaaacaacugguaccaaaaacuucuugggaugugucuauuuuuagacuuuucuggaaggugucauaccccagaagacgcugcagagucaucugugucuguaucuaggauagaugucaguagccuugagcacugcaauuguaguagauucuguccccgugcuguaauuaagucagccacagaagucccuauauuagaggggccucuuccugcuguauagugcugcugacuuuguauuauaggccauguuauuauggacuggguaauuauuuuccugcaugggucuugguuuaacagacugauccucugagccucuuccagaaaguguuguguuuccuugaaaaugagugguggaaaaaaauuuuucuugaaauuaugaaaauuuccuagauaaaaaguuuuucuuuuuucauacucaaaacaaugcuaacauuugaaguauacuucaaaugaaugaucuguuuuaccaacuucuuuuaucugacaaagauagauuuuguuucauagcagagaagcauaaaagugaauuauuuuagauuauaucuugugcuuguuuagguggcacuugugcuaaagucagagugagacagauacauguagccauugucuuccucgacuuguccuuuugaagucuguuauuauuucuagaauguaugagaaauaacaaaggguuccaaauguaaauuaagggacugaagagauggcucagugguuaagagcacuggcugcucuucuggggcacccaaguuugauucccaguacucacauaacagcuugcaacugcugguccugguauacuuuugccuuugggguauccagacaccacugcacaccaggcugaacuggaaggaguggaguuuauccagcaggugauuuacacaggaccuuggcuggcaaugagugugaggagaaacagcuuucuccaagacuguuuucagugaaauagcucucuuuauugggggugaauaagagcuauauaaaccuuggggaguggguaggggguuugggagugaguguacaucauuggcauggcugagguggugugaaugcuucauuugcaagaagaggaauucuaggugcuagcuagacauaucuuuaaagggagagaggaauuuaaaccuguaauuugccacuaggcuaugugacuuccucaaggguaguggaggugggacauguaaucccagagcaagaagggaacaguccuacuccugccagucucaggaugagauuuuccagguuugaacacuuaucgaccucacucuugcuccagacuggcacccccagucacaugacuuucuggccacacacacaacugucuauaacuggagucucaggggaucugauaccuucuggucacuguggacaaaggcauguaugaaggcaaaaucauucauacacauaugaaaugacaauuuuggaauauuuuuaaaauagaaauguuguaagaaugugcuuucauuuuaaucccagguguagggaugugaggcugcuuuggacugucugcagcagaugacuaugauuuguuucaugcucuagcagaagcauaguuuugccagucauuuagguagguugguuucaguuuguuaguagccauggucaaagaagaaacaaagggaaaauaggcucaaauucugcuucccccucuauccuuguugcuguccuaucuaguguuaguggguaaaaccagggcacugggaggaggguaaaguguggguaaaagaagaaucuacaaaguaucgaaggccaccuacacauaagauaaaaggaaagauaaauuaagacaaaugcuggaauuuaccuguagucuucaguuuuguugacguguguaugauauauagaaauauauuaucuuuucacucaaaauaucuuucuuauagguaaaacauaguauaucauaccuuuaaacuugauacauacuagaggaaauaauaugccuuuaagucugauuagaaacagucuuucuacaaaacuaaaaucuuccucagagcaugcauguuuucuucacugagaaaggaaagcauacuggagaauguuacacuggguauuuuauaauucugugaaagccuuuugaauccaauuaucugcuaaccuucuaggggcacaacaguccagaacccuuucuuuugacuuacccucuuuucugugauuaaguuaccuuucuaaguacuuggcuuuccucuugugaacauaagguguuccaucugccaguuuaucauggagacuuaaaauggaaacaagaauaguuuaaugacuucuguauacucacuuaauaaaagacaagcuuaaaaugaagagaguagaauuauuuaagacuuuaucuagcuuauucccaauuuuuaguuauuuuuauucugauguccaauuuugaacaauguuguauuuuuauuauuaaguuaaaguauguaauguggcaaaaaugaaaucuugaacuuugaaugcccaugaaaaaguugaaucgaacugaccuguguauccuggauauauugguuuucuuuccuuuuuauucacccuucuuguaaauuuuugaagccagugacccuugucuugaucccuccucuccccaaacgugggccuagcaacuuaagugaucaacacaugccuauuaaauauaugagcuaagaaugauuuagcacaucuacauaucucaucaguguuuaacauuuuguaguucagaaacaauagaaugggaauuccacaugguucaaacuaauacauuaaguaguuaguguaaugugagggcauagagccuaauccauuuugaaaauuuuuauuaucugagaacaacugacauauagaaaaagucgaaggaaaaugaauaaacuugaacuggggacuaguuuguuuaguagguaggaaaaaagugcuggcuagaacauuuuauuaaaauacguauacauauaaaaucauauuggucaaaauaaguuaacuaauuguuugcauuaaaaugcuuuauugccguuuguggcaugauuuuauuuuucuguuuaaaaggacucguuauagucuucaucuaugucugaucuuuaaccauauuaguuauuuuuuccauccuuuaagaaagcacuuuaucauugaacuugaagcaauuguacuauacacagccuuucuuauuuucuuuaacuguuaacuuuaacaauugcuagcagcauuacauuucaggguuuuuggaugguauuggaguuauuuuugaggaguuuauaaaguuuaugcauauaggagaguuuuaauuucauugcauauuccguuugcauuggcuuugcccuguccauuucagcauucuaugagccuauggagaugcugauuguuuaggcugcagauaguuuucucucuuaaacauuuucccuuguccugauucauaguacuuacuuccaaauuauuuuauuaguuuuauuucuuccuguuucuggaauaucuagauuuauauaucuguguaauguuccuaacaaacaucuaauauaacauacacacugagaaaaguacagaaacacgaauggauaguucaucaaguaguauaagacuaacaccaaggagaaggaaauaaaagcaaugggcaucucagagucacccuuuaugcacgucuccauuguagcuccucaccuuugccaauugcuauacauacuuuagccauaauaacuuuccuucauaauuuuccauccauaacuuaguuuuuaaaaucuauuuuuaaacuuuauauggguagaaucguauucuauauauuuuucaugacugaugucuuuuauguuucaugagguuuucugguuguuauauauaauaguaacuuuauuauauuauuacaaaaucuauuguacaguuauaccuuucuuuggcugauggagauuucuguuguuucuauuauagaguuaugaauagugcugguaugaauauuucacauauaugaucuggguaguauacauguucaugaauuucuaugaauauaaucauuaugguguaaaauauguuuguucuuaaccuuguucuaguaucuuuguuuucuaucucuuuaauaggagaaaauuuuuaguuugguuuuaaagauuucuauucaaugacugaucgucauugcuuuggguauagaugaaguguguagcagagcagaacuacucaguuuauugccagggagcaaaagagaggaaaauggagggacuaggguccuacuauccacuuuuagggugaccuuaauaaccugaagucucaucauucggccacauuucuuaaaguucuaacacuuccugauagcuuguguuggcagaaaaacaaaaacaacaaacaaacaaaccccagucaucucaguuaguuauagagauuggugauacauggcuaucaagggggcuaaagauagcccaagauaauuauggcucuggaucuguaauauuucuacugaccaaauauaaacucccauucccuccccuggaauuccuccuuuaucgccugcaucagaauuucaguuuaguuauucauuuuuguaggcauaaauauuuugcaaccuacuuuuaauaaggguccaaucucucuucuugcccacuacccaccagagauaauggaaaagaaaaguuauuaggauuuggggaaacugggucuguucagcaauaguucuuugggggcgagcuucuuugccagcaguucagucccguagcaaacaccaaauaugacucagcagcugcagaucagcccucuaggcagucagauaccacacaugaacuggcagguauagaccaguccuuuaggcaggcagacaccaggcaggaaccagcaacuguaguucgauccuaaagaaacugucaggcucuccaacuggucugaagugaggucacugaagcagcaaguuaccacaggaaccucauaagcaguucuugggugaguuucucucauggaugcauuaccacaaguugagcucaacaacacuauguaaggcaaaccgauacaugugugucguuagugaagaauagcuagguggagcaaaccaaaccaaugcucauugcuugucucccacuauccaugggggucacauuuauacucauaugcauccuuucauguguuugcuacaucaaaacauccuuucaccugugucuccuuuuucaggaaaacauucuuuuaugugccugcuccagcaaaauauucuuucaccugugugcuccagcaaaacauuguuugacauaacugacuuuccaaacaaaccagaaguuuccacuuuacauuucuauuuuguucuuuuauuuuuuuuuuaauauaccacuaaaacaacauaaguuaacaauuacuugucaggcuuaauaaugaguuuuacauuuuucuuucacauuauuaacaaugauuauuacauaaaaucacucacaaauuggccaucaaugccucacauucauaauggcuuccaaauucuccauuugggaauacaagguggagggugauaccaugaacucaaauauaggucacagaguaaaauauuugagacaaauauguacaugcacacacacagagcgagagagaaagagagggagagaggaaguggagggaagggaagggagagagagagagaaguaugagcaugaucaagcuagagucuucaugcaugccacccaaaugcugucucagugauuuauccucuuaguguugaugauuagagauugcuuuuaaaaauauuuuagccauaugaauugaccucaaaguaaagauacugaguaggcaauuucagguacacuucaaucucaggacugauaagugaaaaagcaagaaaauuaaugaggagccauugauaugugauucucuaguuacacacuuggucugguacaaauacuuguauaugaguagauuuuggagucauaaagaugagugagauuugguagaggaagaagaaaauaggugugaaagaacucucauucaccagcacaucagggcaggcagaggaagaaaacucagagaaugcugagaggugcaguuaaagccccaugugaaggauaagagguuuauacaaaccaaugcuggaaguucagaaucagagcagccggagugagauaaggcuuagaaaacaucuguauugagagacugauuagugucacaguagaaacuucuggauccugacaucuguaacucauuucacuaacagguaaguuggguguuaccuuuguguuagcugucagacaguuaaauguucuucuugguaguuaagauuucuaugcuauuaaaagccaaaugauaugugauuauaaaaucauucaaauuguuuugggauucaguggccagcugggagguagguuauuuccuugaaggucauuuccuucugagaaacucauucauaaauaucagucucuucucagcuuuaucuggaauaaggacauaauauacugagguggaaauaggagaauguugaacuuguagcuagucuggacuauguagugacacucuguuucagaacaaaacagaagaagagguagaagaagaaagaaagucuaauuagcuaaucaaaaauaugaaaaagguuuugaaauauaccuucaugugauuguaauucuauauggauucaaaucuuacaaugucuuucuugacccaaaguuuaugaaagaagaacaaauuuuacaggucaaacucacucuucccuugaaggugugaagauggucuggacuuuaaguguacaauauucugugaggagacugagaauauaguuuauauccucccuggaaaugcuacugugaucaugauugguacuucuauugauauacuugugacagugacuguuugacauuuaaguuuuucauuuccaguuuuauuucaguuuggguuuuuuuuuuuuuuuuagugguucuauuucuuuguuaaauuucauguucauuucuugaauuguuuuaauuauuucacuccacuguuuagguuuuauggucuuaguuaaggcaucuauucauauccucuuuaauauuacuugcuauuuugaagucccugucuuaugcuuaagcuaaauuacuuuucucagagccucuugcaacaagguugcuggcuucuggaggagacauauugucuugauuguuuauguuugugguuagaaccuugcagugagggaaaacaaaaguauacuguaaagaugcaggagcaggcuaaacugagaaauugauagcagugagagaccuuaggcuuauuuauuuguuuauuuguauauuacuuuaaaauuaaaauauaguuacauuacuucccucucccucaccucccuccaaccauucucaugccucucccuccccuacucccuuucaaauggaugaccucuuauucuuuuauuacuaucauuacauauauauguauuuaugugaauaaauauaaauauaaccuaauaagucuguuuaguauugcuuguauguauaugcuuuuagggcugguuauuugguauuggauaacaaauuaggguuuauuuauuuauuuauaguaucuauuuauauuauuucauuuuauguguuauguuuacuugcauguaugucuauaccccacuuguguacauaguucccacaaagaauuaugcuagaagagggcauuggacuuccugcaacuggaguuauggaugguugugagccacuuuguggugcugaaaaucaaacccaaguucucaagaaaugcaaccaguacacuuaaacuuaaguuccuaaccuucuuaccagucccauagagacaugacaaaucaauccauccuuuugucugaggaauuccuuaucauuuccauuauaguuauuccuuguaaccauaauauaaacauaaauuuucuuagaaagucuggcaaauuuuuguauuuuagucaacaauugaaaaauauaggauauacugcauuauaacuucauguagauaucaaaaaaugguucugggauagugggaaaggugguaguagacauuuuguugaauauaggacuucauugauaucaaagaguguuugagauuuauauaacagaaauuucaguaaaaagcaggagacaaugcauguucccagacugaagugcagguucucaguuccuucauauagaacugcauacuggugacuggguccacauagauaccaccaguagacaggcacuuagcuuucuuggacuaucuaugccuugaaaacccuucuggcuauuccagaaccccuagcugaguaguaucugcuuaccagaugcaguucauucaauacuuauagacuaagucuauuggauuauggcacaacuuuguucaaaguccuuaauguuucauuuuuauuaaguuggagauaggugcaugacaccacaagcacaauaaauaauaaauaguacauaauaaauaaauaaauaauaaacaguauuuauuucaagaguagaagaauuaaagguuagguucccaggcacuccuaugcuuccuauuggacaugguggugaauucaguccaaccacuggacugagugagggguccccgauggaggaguuggagaagggacugaaagagcugaggggguuugcagccccauggggggagcaacagugucaauuugccagaccccccggagcuccuggggacuggaccaccaaugaaagaguacacauggagggacccauggcucuggccgcguauguggcagaggauggccuugauggacauacgugggaggagcagcccuugggccugagggguucgaugccccaguguaggggaaugccaggguggaaaggcggggagugggugggugagugguggagaggcagggggagcggggaugggauaggggguuccggaggguagaccuggaaaggggauaacauuagaaaauacccaauaaaagaaaaggaaaacaaaaacaaaaacaaacaaaacaaacaaacaaacauugauucuuccucugggacuuuguuagacucccagagaauaucauagaggaucaaaaaugccagaguugguggcagaaacagcagaaaaaggaguaucagauacaggaguaacuaggacaccccucagaacaauaucugaguaguaucacgaguuuggauaacauccuuaccucugacuacauccugcucugucuccaguuuagcuuuguucucuuucuuugacucucagaaaauaaacucuuuagaguccucagguuguuuuguugaguuaaaaaaaacauuuaaaaauuuuuuauuugccuaagaauguuuuaaugaauauauauuugcacuaugugugcgccagguauuaccagagguuagaagguguuuaguagaaggcaccagaucccuuggaaccagaguaauggaugguugugcacaauugugugggugcggggaauugaacuuagguucucugcaagagcaaaaaguacucuuaacuguggagccaucucugcagcccugucuuaagugcuaagcaggaaaguccuccucccuuuaccccauccuacugugaugcuggggauacaaauauucuaccagugaacuguauuguuagccaaugaacuauaauauuagccuagcugaugacaaguuccagcuaccauggagggagaaauuaauugacccaccugggaucaguuguuugcuggcaaacuguuccccaauaucaaggauaaagguuuguguauauaaacauacucucuaagccaaaccuugaaacaauaagaaauugaagcauauagugauaauguaguuagagaaauacauaguuguguauagccagauguguuuuguuuuacugucuugaagauuaaacuuuagugccugaacaugcuauguuguguucuaccaaugaguuacauucuugaccccuaaauggcuaaauuugaucucuucuuuaacacuuagaucugagaggauuguucaguuacauuccagaaauuuuaguagcaaaacuuuucuuauuaagugcauuuucaaggucuacuugacagauggaggaaauuuaaggauauucaaucagccaggcagugguggugcacaccuuuaaucccagcacuugggaggcagagacaggcggauuucugaguuugaagccagccuggucuacaaagugaguuccaggacagccaggacuauacagagaaacccugucuugaaaaaaaaaaaaaaaaaaccaaacaaacaaaaaaaaacaaacaaaagaaaagaauauucaaucaaugaaggugauuuuuuagaucucaaguguuggaaaucagggaguaaauuuaagauuuagccaguuguaaaauuuugguuucuccaaaguucauuauacucuuucuuccuuccuuccuuccuuccuuccuuccuuccuuccuuccuuccuuccuuuccuuccuuccuuccuuccuuccuuccuuccuuccuuccuuccuuccuuccuuccuucuuucuuucuuucuuucuuucuuucuuucuuucuuucuuucuuucuuucuuucuuucuuucuuucuuuccuuuuugaaugcaccaaacacauucacauuuauuuuuuuuaagcauaugacaaaaauccaaauuaccagcuuuuuuaaaccuaagcuuaacauuacauauuuaaacaauagucaaacugacgagguugccgacauccaugcacaacuagaaaacauccuuaguguacacuaaaccagaaauguauuaccauugaugcaguaauagcuuucaucacuaaauacugaaaauaaaauugaaguauuucuguagauucaucuggcaauguuuucacagcaggcugacacuacucacaauucaccacaaugggaagcagauccaugcugguguuacagacaaucucauccuaucacuacucaaaagucacagggcucgccucagauuacgauuuguuuaaagcaaagugcauacagagauuacaacaauuuaaaggacaaaagaaauagaaaguaagguccuauuuuguggucccaacaacaaacucaaaaaucugauagauagaggcuccaacgagcuuuuuuauaaauacuuuaguuuagguacaguuauacagaaagucgaguucguuucaaaucuucaaaaaaaaaaaguuccuguuauuccucaaauggugcuuguuaugguuuaacauuucuguuaaaugcgugcguugaguuacuuguuaucgaagcguagcaggugcuccuuaccauuuauugucaaggacuuuaacugcccaucuucuucaacuucuacucuuucuugaccguucuccacaauucucuuugucgugauuuuuuugccauuaacuaucuuaguugaaguugauauugauuugaaguugcccauuccacugccgccaaauaacguugaagaaaauggccuagugacccaaauggaguaaagccuguaucaaaagcaggaaauccacuuccaaaagaaggaaauccacugaagguagagaaaaaugagccagcaccuuggcuucuacuuccucggggaccccuucgguuuccaaaaaaagucaucaaaugggucuucaaagaagucaaaugaaaaugggucccuucuaccaaaaaauucccugaagacaucaucuggguuccggaaugugaagccaaacucaaauggacuguccuccaccaccauuuaauccuucuuugccauauuugucauagauguuccgcuuuuuagcauccgauaacacuucauaugccucagcuacuuguuugaacuucugcucugcuucuucuuuauuuuuaggauuuuuguccgggugccauuuaagugccuguuuucgauaugccuuuuuaauguccucaggugaggcaugucucugcacgcccagcacuucauaguaauccaccauguuuuaacugauuguuagaauaaauccgaggacacggcggccagcaaggagggaagucgggcggccggucuccucgcggcuguggcacagcugcgcugguggcgguggcggcgguggcgucucccauuauacucuuucuuaaaaaggauuuauuuauuuauguauuuuauguauaugagugcucuguuuguauguauaucugcaugccagaagagggcauuggaucccauuguagauguuugcgaaccaccauguggcugcuggaaauugaacugaagaccucuagaagagcagccaguacucuuaacugcugaggcaucucugcagcuuccauuauaacugugucuuuaaaguucaucaauaauuuucuucaguauuaaauauucuggacuuagugauuuauuuaaauacugagguuuauuuauuucauuaauuuuuuauucacuuugugucccuaucacagccccacucucuccuggucccaccccacacagucucuccuccaucccccuuucuuuucuucucugagaaggggaaguuccuugaccccaccucuguaccaacccacucuggcauaucaagucacuacaggacuaggcaauccucuccuauugaggccagacaggagucccagcucagaggaaugagauccacaggcaggcaaaauagucagggacagccccuacuccaguuguugggggacuugcaugaaggccaagcugcacaucuacuacauauguucaggaggucuaguuucaccccaugcuugcauuuugauuggugguucaguuucugggaggccucaaaaauccagguuaguugaaucuauugguguucuaguagagcuccuauccucuucuggucccucaguccuucccccaacucuuccacaagacuucucaagcucugucuaauguuuggucuuggguuucugcauguuucuaucaacugcuagguggaaccccucagaagacagcaaugcuaggcuccugucugcaagcaaaacagaguaucauuaauagugucagggauugguucuugcccaugggaugggucucaaguugggccagucauugguuugccauuuccucagaaucugcuccaucuuugucccugcauaccuuguagggacacauuuuggguugaaaguuuuguggguugguuaguguucuuaucucuccacugggagucuagcuacaggaggugaccacuucaggcuccguaucuccuacugccaggagucuuagcuauaguaacucccagaaacuuccuagagccccccaucccuggucucuggcaucauccuagagaugcccaccuucauucucuccucugcucuccuuacaccugagccagcuguuccauuccccuucccagccccuuuccuacucaguucccuccauccaucuaccuccaaugacuauuuuauuucccuuucugagaaugcaagcauccucccuugagcccuccuuguuauuaggcuucuuugcaucuguggauuauauugugguuauccuaugcuuauggcugaauaguuugaggaguauugguauuagcucuucuuugaaaggcugguagaauucugugcuaaaaccauuuggcccugggcuuuuuuuuuucuucuucuuuuaauugggagacuuuuaaugacugcuucuauuuccuuagggguuauaggacuauuuagauuguuuaccugaucuugauuuaaguuugguaaguggaaucuauccugaaaaucauccuuuuaguuuagauuuucuaauuuuguggaguaaagacuuuugaaguaagacuuaaugauucuuugaauuucccaagugucuguuguuaggaugccuuuucauuucugauuuuguuaauuuggauauuaacaaacugccuuuugguuaguuuggcuaaggauuugucuaucuuguugauuuucucacagaaccagcucuugguuuuguugaauccuuguuucuuguuguuucuaacuagucaauuagaguuuguuucuaaucaguuaaaaagcccaggaccagaugguuuuagcacaggauucuaccagacuuuugaagaagaguuaguaccaauacuucucaaacuauuccacaaaauagagacagaaggaacauugccaaacucauucuaugaggccacaguuacccugauaccaacaccacacauacucaacaaggaaagaauuucagacuuauuucccuuauaaacauugauguaaaaauguugcaauuugaucccugaauuugauuauauccuguggucuacuccucuuggguguguuugcuucuuuuuguuuuagguguguuauuaaguugcuagcaugguaucucuccaauuucuuuaugaaggaaauuagugguagggauuuuccuuuuagcacugcuuucauugugucccauaaauuuugauauguuaugccuucauuauucuuugaauucuagaaagucuuucauuucuuuauuucuucuuugauccagcggucauugaguaaagcauuguucaguuuccaugaguuuguaggcuuucucuuauuucugauguugaagcccaugguggaaugauaagaugcaagggguuauuucaaucuuuuuguaucauugaggcuugcuuccugacuagguauauggucaauuuuggagaagguuccacgaggugcugaaaguauauucuuuuguguccuggugaaacauucuauagauaucuguugaguccauuugauucauaauguuaguuucauuauuucucuguuuaguuucugucuugauaaccuguccauuggugagagucgauguugaagucucccauuauuaaauuguaggguuugauguaugauuuaagcuuuaguaauguuucuucuacaaaagugggugcccuggaauuagggguauagauguucagaauugagaugucaucuugguggauuuuuccuuugaugggugugaaguguccuuccauaucucuuuuaauuacuuuugguugaaagucuauuuuauuaggcauuagaauggcuacuccagcuuguuucuuguuucuguuugcuuggaagacauuuuucuagcccuuuccucugaggauuaccuauccuuguugcugagguugcuuguaugcagcagagugauggauccuguuuacucauccacauuagccugugucuuuuaguugguacauuguguccauugauguugagagauauuaaugaccaaugauuguuaauuucuguuauuuugauguuggugauggucguuuaaguguguuucucauuuuuugguuuugcugguguggaauuauuucuuguguuuucauggguguaguuacccuccuuguguugaaguuucucuucugguauccuucguagagcuggauuaguggaaagauauugcuuaaauuuggucuuuucaugaaauaucuuguuuucuccaccuauggugauugaaaguuuugccgguauauaguagucugaucuggcauuugugaucucuauagcagaucuguccaggcccuucuggcuuuuagagucucuguugagaauuaugauguaauuuuaauaagucugcuuuuauauguuacuuggccuuuauccuuugcagcuuuuaauauauuuucuuuguucaguacauuuaauguuuugauuauuaugugguaagaguuuucuuuuuugguucaaucuauuugguauccuguaagcuucuuguauuuuuaagguuagagaaauuuucuucuaugauuuuguuaaauauauuuucugggccacugagcugggaaucaucuucuucuauuccuauuauucuuagugucccaaauuucuaggauguuuguguuagaauacuuuuagauuuagcauuuucuuugaccaaugugucaauuuguucuauuguaucuucuaccucagauucucucuuccaugucuuguauuccguuggugaugcuugcgccuauacuuucuguucuuuuuccuagguuuuucguuuccaugauugccucaguuuuuuguuuucuuuguuucuauuuccauuuucaagucuugaacaguuuuguucauuuccuucaccuauuugauuguauuuuccucuauuucuuuauauuuauuuguuuccgcuuuaaggaccuuugccuguuugauugguuucccccccauguuucuuuaauugauuuauuuguuuucucuccaaaaguccucuauuaucuucauuagauaagauuuaaggucauuuucuugcacuucagguguguuaggauauccagggcuugcuguagcaggguagcuggguucuuguggugccauauugcccuggcuuguguggauugaguuuuuauucuagccuuuagacauuuguuuguccauuguguuggcaggccugguagucccugauggcagcaggccuccagagauguaggcagagcuuuaacccgagaaauggaguauuucagguuuauuuuuauuuuauuuauuuuuuguguguauggguauuuuacuuucauguguacuauuuguguaccuggugccuagagauaccagaagagagcaucagauucccuggaacagaaguuacagaagguugagcugcuagguaggcacugggaauaaaaccuaaguccucugaaaagcagccagugcucuuaagugcuaagcuaucucuugucgcaauuuucaguuuuuuaaauauuucuuuuaugugagugugugugugugugugugugugugugugagugugugugugugagugaguguacacacaucacguauauauauaugcauacaaagggugagugugaacaauaauucuugggaguuuguuucucuuucugggaauugaacucaguuugccaggcuuggcugcacaagccuuugucuucugagccaccuaguggccacuuaaugcuuuuuuaaaaaaaaaauuacucauacuucagaaucacaaauucucuguucucuuuauucuccucugauugcuauuccuccuguuuucugauuucucuuuauucauccugcucugcaguggguugaggaucauaacuugagcucugcuuuuuuguuuuuacugaauuucauagauuuuccagaaucaccaacuggauaacuuaacauccuauaaugaguaucauuccaaugaaauuaccaauaucagcaguauucuugguuuaccuaggguagauacaaugaacuuuucuuugacacuuuugagugucugaucaagaugagagaaguuuuucuuuguggagauucuagaaauauuucuuuuccuuaauucccauugucgugacugcauaccacuggaaacgcuucuucaaucaucucuuacaguuuuacugcaguuuuucuaagacuuucauucagggguucacagccaggaaucacaccugaauuaugaaugcugcaggcuccauuaaaauuuguaucuuugcaguagugagaaggauaaaagcaaggucuauuguagauaugagggagaguacagccagagacaucuggaagacuucagugcagggagaaaaugugacagacugaacauggccacuagacugaacugggccauggguggagggacauaaaagugaaagagcagugagaggggacugagagccaagagcagaagaccaagagaccucuuuccuauauagccuaaaauggcaagguguauuagucaggguucucuagagucacagaacuuauggguagucucuauauaguaaaggaauuuauugaugacuuacagucugcaguccaauucccaacaaugguucaguaguagcugugaacggaaguccaaggaucuagcaguuacucagucccacauggcaagcaggcaaaggagcgagagcacgacuuccuucuuccaauguccuuauauggucuccagcagaagguguagcccagauuaaaggugugugccaccacaucuuuaaaccuagaugacuuugcacucggagaucucccugucuucaagaucuccauaccaagauccaggucagaaacuuuuaucuccuagccuccagauuagggucacuggugacccuuccaauucuggauuguauuucauuccaaauguagucaaguugacaaccaggaauagccacuacacagaauuauauaggaaagagaagcugggggaagggaagugaagcuccugagcugaagauguuuaggguugguguggggugagaagaugugagaggaggcacaggaacucagugagccuaaagacuagcuugugcuuugguaaugcuaauaggcaucaguuagccauuuguucugaguuuuuuugggaccugacaucaaugcuucuuuuauggaccacauuuguguuauuuaccucuacccuuaacccccucccaaccaccuuuuaaagacagggucuuccuaugaagcccugguuaguuuagaaugcacuauguagaccaggauuaccucauacucacagagauucaucugccucccaagugccaggagaaagcuguaugccaccauacccagccauucaugcucauuuuuaugauuuuuuacugguuucauuaaaauaggucuuauuuacguuuccccaagaacuacuuucuccaucaagcauucucaacauguguggcuuauguucuuucuccuccaaauuuauuuacucuuaucauuuauagugcuugaauuacauuauaauauuuaauuauauacuauuuuuuugaauuuuuaaauuuuauucaugauuuauaagagacaggaugaauaagagggaaaagucaaugugcauguccaugcaaugcauguggagguuggaagacagcuuacuagaguuggcgcucuccuucagccaugugggucccagggaugaaacucaagccaugaggcuuguggcaagugcuauuagugagaguggcuaagccaucucacuagcccauuuucaccaaaacacucuuaaaauacucacccuuccuuauuagucaggcacacuccugggaauauagcgguuauuauaguauuaaagaauuuaaaagucugcaucacugggagcuugaugugagacuuggcauguccuugguguguuuugaaggacuuuauguguaucggguuggagaaguuaagauggggaacuauagcuuauagcugauucuuacuaagugcccagcauuauuugguauuacaguuugauuugguuugguuuugaggugcugagaaucaaagucagacccucacacauacuaagaaagugcuuuauccuugaacuacauuuacauuccuugucaugagcaauguuuuuuuuaucuuuuuuucuuuuaaaaauuuuuuuuauuauguauuuuccucaauuacauuuccaaugcuagcccaaaagucccccaugcccucccccccccacuccccuacccacccauucccacuuuuuggcccuggcauuccccuguacuggggcauauaaaguuugcauguccaaugggccucucuuuccagugauggccgacuaggccaucuuuugauacauaugcagcuagagucaagagcuccaggguacugguuaguucauaauguuguugcaccagcaggguugcagaucucuuuagcuccuuggauacuuucucuagcuccuccauugggggcccugugauccauccaauagcugacugugaucauccacuucuguguuugcuaggccccggccuagucuuauauacuauuuaaaacauguuuauuagcaucuauuacauauaauaguggguuuuauuaugacauuuuaauaaauguuuauagugcacugauuauguacuaucuuauaauaauugaauauuucuucauaagaggagauuuuuaguauauugaaugauggaacuagguggcagguucuuacaugggagguuuauuaaggaaggggacacaguggcugcccucugggaaagggaggaaaggagagaugggggaggaaaaacgcggcucuuuuauagggacccuggugccgugggggaacuugcaacagagguaacagugagaauuugcugccucugggaagcuaaugauggugucuugucccuggguugucugauggccccauugcugccagguggggcuggcugcagagguugccugauugcuaauauugagaauaagaaaugccuggcaaggugacacauaccuauaauuuuagcauuugagaaauggagaaggaggaucaggaugaugcugucucaaaaaaggaaaauaaaacaaaaugaaaauauaggaaagacuuggguguccuauacacaaucuggcauagccuaauauuucauauuaacuauacuguuuuacucagcuucaaguuuucuuucuauuaacauguucuacccuacauuacuucugcaaugaggcagaaaaaugaggauuugugaagccaaugauuuugcuuuucuuucccagaaacauuacuacauuuguguuaagcuauaguuuauuaagauauaagaaaaaaaaucacuaacuugaauggcauuuauuuuuaaucagcacauuuuaaacuuucauuaauccacaguauaaauaaggaagacccuucaagcagagguacacuuugcucacagcugcacuucaucugcuacugacagcuucaguuucaaaggcacagccugucauuuacacucuucauuacccaggggcauuucaaacuguuaccaagagucauccaucccuggaguaaccaucuggcgauaguaacaccauaagguagaaagacugaaucuaauugauaugcagaauggagaauuucagcuguccagcaauggaaaugaaaauugaaccucauugguuuaggauuuuagauaauuaaaaaaaaaaaaagaaagaaaaaaaagaaaagaaaagaaaaaaaaaaaaaagaaaucaugauaucuaacuugagaacucauuguuugaguuuuguuuuuguuuuuguuuuguuuuuuuuuuuuuuuuuuuuuuuuuuuugguuuuucgagacaggguuucucuguauagcucuggcuguccuggaacucacuuuguagaccaggcuggccuugaacucagaaauccuccugccucugccucccaagugcugggauuaaaggcgugugccaccaugcccggcuuguuuaagauuuugaauacagaaacauagcccuuuucccugcugugaacaucucaaaguuaaaggauuaucuauaauauguuuauaguaaaaacuauagggaaagacaaguccuuauaaaaugcaaggacuuuauaguuguuucuauagcacaacaaaucaucaguguguuuuguuuguguauacauuuacaugcuucucaaauuucccugaaauaaaagagaaugccuugcuuuaacauuucuucuucuagagccuggggccauacccagggucuugagcaugguaggugaucacucuacaacuaagcuacauucucaaccucaauaaugucuuauuuuaacaucucagcuacauuagaacaaaaugaaugauacugggagcaacacuuacugauauauuaagauuuauucaauaugugaaguauaguuucuaaaauggcauaaaaaauuuaaaaguuuauuauggcguacaacccugaaagcauuauuuauauguacaucuuagcaagaugugugacuccucagugauuguagcccaucuggaaacaucgugcaguucuauagaccagcacauguuucagaaggaugcaguacagugauuuauaauuuguccaaguagacaaacacuuuuaaaguauagugaagucuugaaauauuuaugcuguugugcuuugagagagaacuguuuucuugaauucguccccugaaguaaaauagcuggaaaaaaaaaaagcaauuucuuuccauuugugacaaaagcagauuaucagacacuugggaaaagacaacaguagacuugggcccuucugcaauaaaauugugcuuaaaaaugaucacagggcccccaguggaggagcuagagaaaguacccaaggagcugaagggaucugcaauccuauagguggaacaacaauaugaacuaaccaauacccgccccccccccccaagcucgugucucuagcugcauaugaaucagaagauggccuagucagccaucaguggaaagagaggcccauugguugugcaaacuuuauaugccucaguacucaguacaggggaacaccagggccaagaagugggaguggguggguagggaaguuggugggggagcgugugggggacuuuugggauagcauuggaaauguaaaugaaauaaauacccacuuaaaaaaaaagaaaaaaaauuauuucccuuccauuuuuaugcaggauuuuuaugcaguauuaaggcuacagucaagcagcuccuuuugaaugucgggagaauauaauuaccauauuccaugcuuugcauugugucucaguccucugucuuggauuaauuaauaaggagacccagccaaggcaaucauagcuggggaucaaguuucuagcuaucguauuguuuagaucuaaggguguccuaaucaaaauuaaaguaaagcacagccaacuuuuucuggcuuaagaugggauacucugggagauauugugacagcugucuggaaaaauuuagacuggaaaucaagauaauuucaguuuccuuuuggugcaugucuucuguguucuuguuuaucuuuucuuaaaauccauuaaccaucuuuacauuuuucaacaguacauuuugaaaugucaugaugauaucauugaauguuuuuugaaacuaccuacuauaagcacaucuauauauugcagaacacucauguucagauuaaucaaaggaacugcuuaugauauaguccuuggguagucaaggaaacuuucuguauuguuuacagauuacuugaaaauuacaugugguuaaagaaauucugucuaggacaaguucuguaaaauuguuuauauacaucauauauauaccaugagaugacuuagcagguaaaagguucuugccuccaagucugacaaucuaauuucaauacuccagauccacaugguagaaagagaaucaacuucuccaaguuguccucugaccuucacacaucauguagcauacauguagcacugcauauacauguaaauaaauguaauuuaaaauguauauaauuuuaauaaugcauacauaugaagucauguaugagagaaacauuuugcuuauuacuuuguaguauaugacacuguguuuuuuaauauaagguauuuauguauugauuauauauuuuuauguauuuauguauugauuauguauuuauguauugagguaugcauaaucauauuucuuuacgauuaugcccuucaaacaguauuaaaacauuaguaaagcucuggaaauuuuaaauuuuuaacucuuaaaacaacugcucauaaaaagagaugauauugaaagaaaauacaguauuuuuuuacauucaauaaugaaacuaccuacuauagaaacaauaauuuuaacauuuacacuaugagaauauuuuuuguguguaugugugcacauuuauuguugggcacugagugugggggaguaaaaggagugggagaaaacccgugucucgucagaguuccggugcucugggcaggcggaugugggaggacagcugcaugcauguggucccgggugggcgucuggcugugggaagccacagaacuccagcuuggugcgggguggacaaggggcaauccuaggucucugggccucacggaagccagagauaacagguucucagucucggacaucccaaacaccucuggacaccucagaagagcugagaauaaaaugggggccccgggguuggcucagucagccccagggccgaagggaggagagggcagggugagagggggcgcugggugguucccacaugggugagagucuuugguccaguggcaggagugcaggaaaucccuccugcaggagguuagacauggcucuuuaggggaaagccuaucccaucauucaagcacagcaggccuugaugguuuuagagcuuuauuguagaaaggcagagagaaagagagaagguagaaagagggagagaggccagccacugccacguggagagagguguggaagggagagagagagagagagaaggagggcuagagaugagaguaagaaaggugagagcuuaaagagagagaggaguggccccuuuuauagugggcugggcaaucuuguaguuguaggguagcuguggggaggagcauaccuggcuauagucagguaacuuuugggggugaagucuagccagaaugccagaagcuugggacauugucugcgugacuuauagucacagaauuauggaguugggagcucuguggugucaggcaccugucucugggaacauggcucacuguuccgucccuuguaguuuccuacugugucucuacugggucacuggagcaagccucauucaaccaaaauaggcugccuuucacagccccacaauucaugucugugaauaugaacaugugucugugacagugugaguguggaagccuuggggauuaauuuccagcuuguuugaggcagucuuuguugguuuuccacuauguaugcaagacuagcuggcucaagaacuucugggaauucuccugucugugauuuaucuccugguggaaacacuggaauuucagaggcuuuugcuuugcuucuggcuuuuaugugauuugggagagugguuaaagucaagucuuccuauuuguguauuaagugcuuuuucccaaugaguuauuuuccaauccuuauucuguuuauaguucuauaaaucaaaccaauggccccaugcaugcuagauauauauucuacaauugacuuauaucuccaggccaagaaauauuuuuguagaugcgcuaagucuuugacucccagauaacuuuucacuaugauaugcaucauuuaaucuuuacagcuaucuugaagcauaacuauuaucccuguguuaagaaaauuguaaguaaauaauauuuguguaaggaacacaaaagccagcauuaggguagaauaccccgauagaguacccaaaaucucagccaucaaauaugguuucuuuuuuuaaaaaucuauugugcauguguguguguguauauauauugugagacugcaggggugggguauuggugggaauuuguacucacacauauugugugacagugcacuuguggaaguugguucucuucuucuacuaugugaucucagagauuuuaguuuuuuuggcuugguggaauguacucuuacccacugagccaucuugcuccuccaauugcaauucuuauaccauguuauauuacaagaaagagauggguaguuucuaguuuauacuuuugaauugugauucccugaacaguugaauguuuaagaacauuguuucuagaguauaaauuuauuuauuugcaugaacuuggauaaauugcuuaacaucucuuuuccucaguuuucucauuuaugaaauacauaauuaauaauauauacauuugguuuaauguauuuauuugucuacauagcauguauugugucuugaagaugagauaccucccagacauuuauguguuugaacauuuaaucuccaguugauagcauugauugagaagguuaugaaaacuuuucaggagucuugcuggaggacaugggucacuugagauuuuauagcuuguucucacuuccuauuccuucucugcuucgugguuauagaugcaaugugacuaagugcuucuugguucuacugucaugccaucuccaucaauauuggaauguaucucuuugaaccguaaaccuaauaaccuuuccucucuuaaguugcuucuuguaaggaauuuugccacaggaacaugaaaagcaucuaacuaacauauuguacuaucaggaucuaguguguagaggccauagaugccacugaaugcccaacagcgcacagucaaaauguaaaauguaaacagugcugauauuuauuaucucuggacuacuauaggucaaauuuuaucaauguaaguaugugacuauguguauauaacuugacauguuuauauguauacauaucuauauacaauaauauuuauguauuuauccaucugccuucacauaguuauacacaauuuuucuuuuugcugucucaaaauguauaauagaauaauaaaguacauacacacauccuacuacauauaaacacauacacguguaaagauaauuaucauuuuucaguuuucuuuagcuaggauuaauuugcccucaccucuccauuccuggauaaguuugguugucacaucugggggauuaucgggaucuaguguguggaagacauggaugccacugaauguccaacaaucaggauuagggcuaggguuagggcagagacaaaauguaagauguaaauagugcugauauuuauuaucccuggacuacuauauaucaaauuuuaucaaucuaaguaugugacuauguguauauaauuuuacaucuuuguaugcauacauaucuauauacagagagagacagauaugcuaaguuaaugagucuaaaauaucuugaauguugcuuggaauguaauugcugacaucugugcuaauuaacaucguuuuaaaccaaggacugauuuucauaggcuuuagaccagugguucucaacuuguaaguugugaccgcauuggagguuguauaucagauauccuguauauuagguauuucuauuaaaauucauaacaguagcacaauuauaguuaugaaauagcacugaaguaauuguugagguuaccacaacacgaagaacuggauuaaaggguugcagcauuaggaaaguuuaguauuggugauuuagacuaaacuaagcggucauuuuuggcauacauuuugaagacacuagaaacugauuuagcacgugaaauuuauuagaaacugcuuuugucaguuauaacuacucuuuuugguuuuuuucuucuuuuuccuuuccuuuuuuuuuuuuuuucaagacaggguuucucuuuguagcucuggauguccugaaacucacucuguggaacaggcuggccucagaauuaagagaucuguugaaugacccuaguggcccuucagccaaaaauaaagacaaagacuguuuuguuuuguuuuguuuuguuuuuuaauuucaaaccuuaagccuuagcuagcagacucucaacuagcucauauaaguuuacccaacaaucuagccccauccugccacauagcuagguauaccuuucaggccucaaaucauuggucuacucuccuaucuccugaugaaaagucauacucuuucuucuucaaggagucccuuucucccuaccaggaaguucugccuuccauggaguaaccagauauuggccaucagaucuuuauuaaagccaaucagagaggauagagaacauucuuuauauauuaauacaggagaugguucgauaauuaugacaguaccaauguccugacuguaaccagaucucugguacugaaaucagcaucugaauacacagugcauaaaacuaacccccaauagacaucugccugaaccugcuucuugacugcuggaaauaaagauauagaggaaauuuaauccagcaacauggcuacucuggcaaggaucacauccaaagaacuagguccaugugaucuggguggaauacagauaugcccuuaguagacauuuuuaaucccuuugaguggaaugcacacccuuaaucccucuggaauuuagugcaccuuuaauuccagacaaugacuuuaacugagggguagacaaagugacgaaucagagaaagcuuuuacagaaugagucagagauaggauaugccuaacucucacaagaagagucaggaaggagagcuuacuuaagagcagugcagggagaaagaagggggacuugaguuuggugcaguuuaguugaauacaguugaguuuaagcaauucuguucuguuugugcagucagugaaguucaguuuguggagcacacaggcaauuuuuccaagcagagcaauucagugagcagcugagagaaguuaguuugaaucagucaucugggagaggaguuuugagcaagaacagcugaguugaacuagucagaguucggaaagaacuagaaagaauaagcuuaauucagcaauaagucuuggaggcugaaaauauucuaggccuagauaagauuguauggagucuggaaauugaagucuucaaggucuuacagaagauuagauuguauggaggcuagaagcuuccaggccuagcagagguagauaugcucugggcucagcccaaaccauguauucauaaagcuuggguguggcucucaucucauccacucaccagaggaaauaaaaauacuuacauuuucugaucucagaagauggucaccuugauuacucccuuuauauagggaaaguauugaacuuuuuacagugggaaaccaucauucugcuacuuuuauggaugaugcuuucaucuguuuaccuuuccauugguauaaugcuguuagaaucuuugcuacaucuugugguggaaugucguuuuuuuuccaggcucucuaucacaccggaaucaaaagcagguaugacugucuuuguuuugauuuccuguggccuugcacauuuuuugcacucuugauucagaauacuuaagaaauguauaucaaguaagugaaugaaagaaugagaccaaaaguuuauaggcuauuuauacacuaucauacaaauuuggcuuaccagcuguuagcauauugacuagcugccaagaugcauagaucuuaauauguguuuuuugagaaauuuguuagggacagugagggaggcagaauuugcucucagucaaacggacagaaaaaaaaaacaaaaaacaaaauaaaaaaacccaacuaaacaaaacaagaccccaacaacuaguaggguugcuagggaagaaagaaagacaagcuauaaaaagcauaaugguaaaaguuauuuagcauaacuacagucaugcuuacacuucaauagcuaacucaggcaacuuuauacauuauggugcaauaacgguacuuuccuagucuugcuuagcugucagugauguauaagucaugugaaugcuaaaagccugcagaaggauugagggggaaaccauuucaccaaccuugggaucgaaaauagucuuucagcagagacuaguuauuacaggugcuuccauuaucaccuggcaucuaugucucuguguguaaauuuucaaguucacucucuccaugccuggggcucuagauugaauuucaccuuugccuggacuuugaccuucuacucagcuuauuuugcuaacucccuuucuagagaggaaagaguaaucuuuuuuaaagaggaugcacaaagucauuuguuugcuuacaccuucuuuuuagaaugguuuauaccugauauacugauguuugaguucaaacuccaccaguuuuuaguucuaucacccucagcaaauaaugcauuuucugagucucauauuuuuaaaaauuauuuauuauuacaaaauggugaugaugcucaguuuuuacaaguucagauaacauucaugagucuaauauguaguuagcguguauguuugucugcaucauacuugguguuuggcaaaaagagauaacuacuaucucuuuccuggacacauccuaccuacuagaccagcucacucuggacacuuuucuuuucuggaagcaagcccaccuuuccuaggcaguuuuggcuaauuucuuaagauaggaaccacagcaagaaggcucucuucuaacacuuaauacuaucccuuucaauaacauuuuuaugauucucuggguuguuaagagguguuagcuuuaaaaagcuagguggugucaagcuaaacuagcuuuagaaaucauauaguuuuauacuuugacaaauuuggcuaaaauaaaacuagcuacucugggagauuguuuguuacuuauuuagguuuugagacagucuuccuauguauuccaggcuggccucaaauuugcaguccucuugucucagccuccugaggcacaccccuggcuuucauuuaucuugaaauuauaaguauauauauauauauauauauauauaucuuuuaaaaauugagccuuuguacagauuauuagaaauuagguagaaaaugugaguuuuucagugucaaguuuauagaagagcuaucugauucaaauuauuuuugauccuuguaaugaaguauaaaaugugaaucaucuugaaaacugcuuuuguauuuaguauuuguacuggcuaguuuugugucaacuugacacagcuggaguuaucacagagaaaggagcuucaggugaggaugacuccaugagauccaacuguaaggcauuuucucaauuagugaucaagggggaaaggcaguagcuggaagauagauuauaacauccaaagauaacacugcuucaacccaaacuugauuuuuuuuuuucuccuuuuauggaguaucaagcuugggugccacuguaauuuucuucuuggaaaaaauuauucaaauguauguaguuaucagauauauuuaccuaaaguguccuaagaacuuacauauguuuauauacuuucuugaaauaaauauugaugggauaaaugaauguaaaauuuucaggaacuguuuauuccacaagucuuaaccaaaacuuccagagacuauuuucauaugaaaacagaaaacagaagucuaguguacuuauucccacagagccuucacauucugaacauauuuuaaucuuguuuauggcauaaauaaaaaugcaucaucacauuucuuuucuuuugguuguucuuuguuuccccuaugacuucacagaaguucuuuguuauggacuucacuguaguuuuccucauagaaaaguuauuuaaauauagaucauuaccagauaaauuuaccuaaaauuuccuaagaacuugcauaguuuuacauuacuugaaauaaauauugauuggauaaguggaugugauucuucaggaauuauuuauuucacaaauuaucucaauaccaagagaucauuaucccuuuguuugucuugaaaauaucuuugcuuucuauaccuuuaaauuuuuuuauaccuuuaaauuuuuaaauauuuuaaaauaaaauguacaagugaauuuaauuuuuuaucuccaaucuauuuuaugacaggaacuaaauuaaauguaaacucuugaauuguauuugcuaguuaaauuuacuguaaauuaugguuuauuuucugaaauuaugguuuauuuucuucuaauuuaauaaccaauuauaucauaaaaguauccuaccauuugaaaucugaugacuuaccaugucuaucuauucacaucuuucccuagauuuuuuuuucugcuccacugauuuauuuauuguagaguaucauauuuaacaaugauucugauagaaaauuuuaaaauagcaaagauuuuauuuuucuuguuuuaaauauaauuaucuaguuauuuucaaaauuuuguuuuaaaauuuuuuaauuauuauuuuaugaguguuuugccugcauauauauaugugcaccacauguauucccggugccugcugaagucagagagggaauuggauaucuugggacuggaguuauagacacuuaugagccaccauaugggugcugggaaucaaacacagguucuuuucaagagaugcucuuaaccuuugagucaucucucuaguccccagauuuuuguuuuugauaugugaaauuauaaaucauguuauugaaagucuaaaugaaauaaaaucugauucaaaaauguagaauuuacuuucacuuaucaaaucccguuuuuccuuuucuuucuuucucucucucucucucucucucucucucucuuucuuucuuucucuuuccuucuuuccuguuuucuauguauuuccagcuggucuagaacucacuauguagaucaggcuggccuugaacucacauauaucuguuuaccugcucugucagauuaauggcaugcaccaccauguugggucuuuuuuuuuuaaugaguuuuaugcguuuuuaaaauguagaacauauauauuacuauauauuauuauauauauaaugcuuaauguauauacaaagugcuugauauauaauguauacuaauauauacaaaacauguuauauauaacauauuaagcauuuuguauuuuuaugucaauaggacugaagaguuuuauuucuauauguuauuaauauaauaaaauacauuuuucuaaccuuuuacuuuacugcauuuauuacaugaaauuggacaaacuuucugucauuaagcuauaucccuucucuaagaugaccauuugaaauacuguauuucuguuuggugucauggaacugauuaaggagacacagaagaggugaauuuuuuuaaaaggaagcaauacauuaacugauuauagauauuugcauagaacaauaguuauugaaaagauuuauagggcuggagagauggcucagcgguuaagagcacugucuguucuuccagagcuccugaauucaauucccagcaaccacaugguggcucacaaccaucuguaaugggaucugaugcccucuucuggugugucugaggacagcuacaguguacuuauauauaauaaguaaauaaaucuuuaaaaaaagaaaagauuuauaaugaugaaauauuuggaaacagcauaaaaacaaaucaaaugaaaguauuugaaguuguuaaagauaacacuauauacauguuuagaauguguuuuaacugaaaauuagcuagcaagucuuuuuaucucaagcuggauuauuuuauauucauaugauuuugugauuauagacuguuuuguuuuauaaccauaaaggagaaaugagaaguuauuucuaccaguaaaaaaaagcacaguuacaucucuucaaauaaacuguacuuuucuugggguagcuguaauuuuacgaacuuugaucauugcuuuaauuagauggaaggauaguugaggauaguagucccuucagaacccacugaauucacccauucauaguauacagaggucaaauugcauguggcagugaugagagagacacagcacaacauuacggugagagggcaugaauguacaagaacagaaaaaaaaaaaaaagcccuggucagaguuucuucuauuggacuucaguucuugcuaacccugugucagcuaaacagacaugaccaugauuguuacuagggcuaagcuacaguuuuaaggaaaaugcuuaaaguuuuauggccugaaucguauuuccaucauagaguuggccugcguaggccuauuaagaucugagagcuuauuacauuugacccccauuacauauuuucauauaucauauuuuauuuuuucuaacuuaccucuaacucucaaaauuuauuaguuuuguuuuuguuuguuuguuuguuuguuuguuuguuucaagacaggguuccucuguguagcccuggcuguccuggaacucacucuguagaccagacuguccucgaacucagaaauccgccugccucugccucccaagugcugggauuaaaagcaugcaccaccacugcccuguugcaguauaucuccucccaaauaugcccaggcaaugaaaacacaacacaguuaauuugauuacauacugugcgccuagauugggcagaucuacugcuauacuaccaucuuccacgcuuaugagaccccuuagaacuugcaguuucuccaagccauguguuucugcucugcuuuucuucaucuuccuccucugcauccucucccuuuuccauuuucuccuucuucucucucccaccaucuguuccacuuuuccuuuuaucugcccaaucaucagcucuccuuuauuuuacaaauuaaggugggaagcagguuuacagggaauuaccuaagugcugacucauuccuuguucacaaccccucacaggagaagggaauuaacaucaaauauaauuagccccagggcuauacacaacacugcccagccaguuuuaaaaaauauuuuuauuuuuuugaaaauaucaaacuuguauacaauguauuuuuuuaucacauuucucaaccaguccucccccuaauuuuuccacucugguuguuauucugucucacacaguucauaccugggcaagaauauugauaacuuuuuucaacuaguagcaugcagagcacuuucugguacuauaaaagcuagccggcagaaggaagcuuugaggucaauaacaacuugauguggugccuucaccaauagggccucaaaguucuguugggaaaagaaauagccuguauuauuuuggggucuuugguaucaacuacuugagggaaaauagccuacaucugccacugggcuuuauuuugcaacauaagcuccgagcauuauacucuuuguaagguaacucaaauuaaguucuuuaauaauaggauucaguaugcccuuuuaaauuucucuagcauuagcuaucucuccccucacuaccucuuuuaacagaggggagcuccuuuuauuuucuuuucccuuuccaccuuucucuuagacagcguaucauuauguagcccuuguugauaugggacucgauauauaaaccaggcugauuaugaacucacaaagauccaucugcuucugccuccugagugcugagauuaaaggccuacaccaccacaccugacuuuuuuuuuucuccguguaaaguaggaaacauauggaaaauauacaauauuaacuaaaaagaacauuguguuuucauaguuuuguaaaggucaccgaaacauaaauaaaucugaaaggauauaccuuuuuuaaagggcucauuccccacaaagaagacacuuugcuuagcaguuuucuguguaaaguuuucuguagaggguuaaaaaggccuugugcacacagauauugauuaaacacacagcuuaucucuucaaugaaaugagguguguagcugcucuucuuggaauaucuaggaaugauauaguuuuacaacccagugauccuuuguugucugaugagauagacucugccuguauuucccagaauguguuuuuacuuauccuagauccuuuccaccuaaguccugagcauugcuucuaggccauaaaaccauccuuaaguccugagcauugcuucuaggccauaaaaccauccuucugagugauaucacuuguacuuuacaacagccuaaaugacuuuuauguuaucuuagguccugggcaaucuuaacacucacaggcauuacauuuaucacaguuaagcucccuagagccuaaaucuugggcauuaucuuugaguaaauaguacccauuuugugaaagaagccagauacacuuuguacagaaucucaauguaaacauguuuuaaauuguguacgugggauugaguucauuauuaucagaaaaccccuuuuucaaaauugugcugugcuuaaauauggcuaaaggaaaaugaucugagccagucucuagaagugcugauuacaacaaaauuggacuaaguuucauucuugucuuuucugugaaucuuuuucgccuggucugcugugaagccugcagggaaccaagaagacaucugcaugucuuuguguuuuguaccaagccuggaugcugcuuuugccagaaacaauuccaagaucuuauucauauuuuaaauacauugcgaaaucaauuucuagaugaauuucacauuacaaaguaaaagcuuuguguuauugauauauuuaugauucaguauuaacuaaaguuaaaacugacagaaaauuagugauucccucuuaaaauagauaguauacauuuugaaguaaauuguuuuucuuccuacccaguacuuaaagucugauaaugugauagguugaauauuuaaagaauauauuuuuuuucuuuuuuuuuucuuuuuuuuugguuuuuucgagacaggguuucucugcgcagcccuggcuguccuggaacucacucuguagaccaggcuggccuugaacuaagaacucugccugccuuugccucccgagugcugggauuaaaggcgugcaccaccaccaccuggcaagaauauaaauuuuugcuuccuuauuucccaguguguuaauuuuacuaaaauugggaugauuaaauauuuuucauagugaucauacuauuaguuaaaagauugugguaauuguauauugggugagguaauuaauaucccuggaauaggauggagaguauuuauuuuacucuuguuuuggagacacucucacuuuguagccuagguugcucuuagcucuuuaucuuucugccucagcuuccugaguguugagguaacaggugugucccuccacuccugguucuaaagagcauuuaaaguggaggacuucuuuuuacacuggguaaagaagcagagacgugcauaaucacagccccaguccagacuugauucucauuugcucauucaugccuuuuauaaaguggcagagcccauuacguauacagacuucuaucucugaaacuccaguguuugucuuuauugcuccccuccauaaacuaagugaauccccuuacuaguccuugcagucacauacauaaggccuuuuuccugauucuguuuuucugccagguucaugauugaugucuucuuuucuuaggccucuaaggaaucucagcuacaugcagccugcuaucuauacagguaccagguauacaaccugcuuagaauuaugucuugugacuucuggcuucguguuuuuacuuugucagauuuuuaaaaaugcuauuccuuggcuguuuucaugucuucaacagaggauuuucuaggcaaguuauucuaguucuggaauuccagcuuucuggaagagucugaaauagagucuacccuuuuucuuuagguaguuauucaucauuccaagauuacccauuuauaaacauuuuaucaauaacaaaagcaaacauuaauugauagugaaagaacucaguggggaaacccccacucagcucccgauucggugugcacccaagaaucacgaauagaacacaacaccuugauguaacaacaagagguuuuuuaauggcggagcuccgggucgaaacguaucucacacaacaggagacaguggauucgaccacgaggcuuggaagcuagggguuuuuauagaaaaggaguggggcugggggaggaauuggcacgguuucacaugauugguccauuuaaacaucagcagccuguaacauuuaacuuaggucagaggggugggagcuagggaggcgaugggccugcccgggcauguccuggucuguucugcuauguucucagccccagguuucaaagcucacaaacaacucuuugggcuauuugacauacauuacaugaauuacaguuuuauuuucuuucaauagugaguuuauaauauuucaauuaaucuuagaauaguauaauuauguaaguuacuuuacuuucucagguuacucucugucuugacuuuugaacuguugugauugauauuuauacucuuguuggcauugaaguuuucuuuaucaauguugcuauaguuuuagaggggagaguaagaauaaagauacuuucaaaccauguuuccucagaaguuagaacaaguagaaccaaaaaugaaccugggaauacuuuuaucauuugaagaaaugcacaaagauacuaacaaaguauuuauagaaaguucuauuuaaauuucuuuuuagauuuauuuuauuuuaugaguaugaugcuuugcuuacauguaagacugugugccauguggaagauuaaggcagacacaucaaagaccuaaauaaggucuaugccccaguauaggggaaugccagggucaggaagugggagugggugagguggggagcaagaggagaggggaggauuuaggagauuuucggagaggaaacuaggaaaggggauagcauuugaaauguaaaugaagaaaauaucuaauaauaaauaaauaaaaauaaguuacauaauuaaaaaauaauaaaaguuauagcagaaaauaguaaaauguggguuaaucagaagcaagagucuauugauauggaaguguagaauucuauuguguuacuuagauuucaggguuuugcaucuuuauaggucuagaaaaguauuuguagcuaaauuauaaagaggaaugaugaaauucaagauuucuaucaucuucuuccuuccaucuuucuucccucucauauuccucccuccuucguuucugcuuacuucugccauuggugggguggauuuagaaaagacuguuuuuccaaauuuaguguccaagagaccagaaacaucacuuugaacauggacuggaacaaacacagcaaaguguuaagacacugaaauuuugugguucauuguuguugugcuacuauauauguccugaccuugcuuuguuguuauuuaguuauuagcauuuacugggguguuauauauucaguaguuaaaugcccaaauacagaccuaaacauuucugaaaguagaaguuauauuuuuacucuaaaacuauaaaaaaugugacugaagaauuuucaauuuucuuuuuuaaauuaauuguaacuuaaauggucauauguggcuaguaguuacugcuuugaaccacagaauuuuagguaguaaguaaccaagccaguucaguagucaacagguucuccagggcaggagugaggauugaaaagaacaaagacaaugagacagcucugcagcuucaccccagccaguucuggggcugaagagggcuuauuguuuuccaguccguuuuuauaccacuucaugcaaaaugauaagaucaguucugggucaaggaacaagcaaagcaauaaacaaaauccaguaaacaacuuucuaguggcuagucaggacacaagccucagcugagccugcucugagcuuugccucaacucaaauguaaauguucuuaaucugagccuauuuccugaguccuggcccaaaguuagauuucugccuucaguuuacuucuuuuguucuggcuccaugucaaauucccgccaaguuucuagaagcgucccccaaaagcucuccacaaguaagaagcuccccccccccccugugugaaauauuauaauauaauauaaaaaaaauauaauuauaaagaccagcuuugacauccaggguaaacugagguggggcacauagucagcaauugacugggccagaccagaaugcucccugaggggcuaaugaagaauuccuuugguagcccacaagaggcuggugaaaacacuucuugggggccacaaaaggucacugaaaaaacucuuugagggggucacaaaaugcugguuaaaaaaaaaaaagaaagagaaaaugggaggaaugacucucucucucucucucucucucucuagaugaagcaaacuucaacaagcuccaacaauuucacacauacacauauguacauacauacauacauacagacuuuauauauauacacauacauuuuuugauggauggaacaaauaccaaugagcugacucuaaccacuuuacauauacaugcauacaugcauauauacauacaugaaauacauuuuggguggauggaauaaauuccaacgaggaggcuccaacguuuuauuucucccacagcuuaucuaucccagcaaaaucuuucaagcaguagagaauuacaaugugauuauuucuucuagugaaugacuauguaaaagcaguaugcucccugauaccuuuacaugaaaaaccauuguguagugcagguuaaaaaaauuauucccaagaacucauguacauuuguaacuaacuaagcaacuuguuauagguuaacaaaguauaaacaaacaagguaauuauuauuauuauuauuauuauuauuauuauuauuauuauuuugguuuuucaagacaggguuucuuuguguagccuuggcuguccuggaacucacuuuguagaccaggcuggccucgaacucagaaauccgccugccucugccucccaagugcugggauuaaaggcaugcgccaccaccgcccggcaggauuuauuuuuuuuauauuuacaacuauuacaaagcuggagcuaaguguauaaaauauugaauuaggaaacaaaacuaccugaguauacuuacugauauauauuugagcagauuaugaacuguaugugucucaguuuauucuaaagcaaaccuguagguuuagguaacuuauacucuuuacaaaucugugguugaaaauuuuauuucaaucagacuuuuccuccuuaaccaucuuguaaucacacaugcaaugugagguaucagacuguguauauuugugucaacauaaucuaauucuuuaucccaagaaguacuugccuaggaagauaagacaguaaguuaauaaauaauuccaauacuuacuuuaggaaacucuuacaaaucaauuuaucaggacaaacaguuuugucuuuugggcaaacaacuuucauauuauaacaaugguuuauucacuugggcaaacaguuugauaaguauguggaagaauaauaauuaugaauuguguuaaaagugaaucugugugcacaugcguguguguguguguguguguguguguguguguguguguguguguuugagacaggacuuaaugcaguccaguuugaccucaaauuuaccauguuacagaggauggccuauugauccuucuuuuucuaccuccuaaguucuagaguuauagaacacaucuagcuuauaagugaaguuuauaguaguaaauauuuagauuaaaaaagaacaaaagaauuuagguucuuuagcagacauguuaaauacaaagaguggggguacagagcuaaacaaagaauuuucaacugaggaauauugaauggccaagaaucaccuaaagaaauguucaacauccuuagucaucagugaaaugcaaaucaaaacaacccugagauuccaccucaccagucagaauggcuaagauaaaaaacucagaugacagcagaugcuggugaagauguggagaaagaugaacacuccuccauuguuggugggauugcaagcugguacaaccacucuggaaaucagucuggaaguuccucagaaaauuggacauaguauuaccugaggaccuagcuauacaaguccugggcauauacccaaaagauucuccaauauauaacaagaacacgugcuccacuauguucauagcagccuuacuuauaauagccagaagguggaaagaacccagauguccuucaacaaaggaauggauacagaaaaugugguacuuuuaaugaugaauucaugaaaugcuuagacaaauggauggaacuagaaaauaucauccugagugagguaagccaaucaaaaaagaacacacaugguaugcacucacugauagauggauauuaguccaagauacgguucacggaccacaugaagcucaagaagaagaaaaaccaaaguguggguauuuugguccuucuuagaaaggggaacaaaauacucaugggagcaaauauggagacaaaguauagaacagagacugaaagaaaggccauccagagacuuucccaucuggggauucaucccauauacagucaccaaacccggacacuauuguggaugccaagaaaugcuugcuaaaaggagccugauauagcugucuccugaugaauuauaaauacagaggcggaugcucgcagccaaccauuggacugagugugagauucccaacggaggaguuagagaaaggacugaaggagcugaagggguuugcaaccccauaggaagaacaacaaugucaaccaaccagaccccccagagcucccaaggacuaagccaccaaccaaggaguauacauggcuccaacugcauaugaggcagaggauggccuugucaggcauaaaugggaggagagguccuugguucuaugaaggcucgauggaugccccacaguauaggggaauugaugggggggggggaggugagagugaguggguggauggguggaggaacauccucauagaagcagggggaagggaauaggggaugggauagaggguuucugggaggggggaaaccgggaaaggggauagcauuugaaauguaauaaagaaaauauauauauuacaaagaguggaaaacauuuuucuugaugaucaggcagcuuuaagguuaaagauuauauugcauaagaaauaggaucagccaagcagugguggcacacaccuuuaaucccagcacuugggaggcagaggcagguggauuucugaguucgaggacagccuggucgacagagugaguuccaggacagccaaggcuacacagaggaacccugucucgaaaaaccaaaaaaaaaagaaaagagagagagagagagagagagagagagagagagagagagaagagaagagaagagaaaggaaggaaggaaggaaggaaggaaggaaggaaggaaagaaaggaaggaaagaaaggaagaaugaacaaaggaauuuaggcucuuuaccagacauguuaaauacaaagagaggaagacaaauuuauaguaguaaauauuuagauuaagaccauuuaucucaaaaguuuccauaggcuucaaaaaaauucuuauggaguuggguguaauggcacauacuuuuaaucccagcacugggaagcagaggaagguagaucuguguuugaaaaaccaaaaccaacccauuccccccaacucccuaucaaaaucuaaucaagccaauccgaaauccaaagaaauucuuauggggagggggaaugauaggaugcuuauaaagcauucuuggccccccccccaaaaaaaguuccaaaaugcugucaaacauaaugaggaaccugaauaacuaccauaaaguucaaguaagccaugaaugucucauugauaauaaacaucagcaguugucuaguuugauggauugccagaauguucacauucuggugcuggauauucuuuuuuguagguuugcucugccugcacauacacaguguuuuuguuuuuuguuuuuuuggauagaugauugacuaauaccucuauaccuacuuaccucauuauuucauguuucccuuugaguccuuuaaacuguaaaaggacuuuuuuauguucccuaacuuccauguauccugauuacuauuaggcuagcugagcaaaguuuuauagaauaaaaaagaucuuguacuggauggcagcaguuugcaguaacugugugcagacuuuuguuuuuguuuuauucuacaaagcuuugcugagcuagccuaauuaaccaucuacuuucuuuuuuccuacucauauugggguaauuuuuuuccucuuacaacucuguuuucuugaggugcuuuaacaauaguaauacuauugcuauuacuuauuuccuucuuucuccaagcccuuuguaaacuugucacucucagcuagaagcuuuuuccuccuucucuuucuuccucuuuccuccucuuccucuuccuccuuccucaucugcauuuuauugucaguuauaaaccaauaucaaaauugacuugaaucugagcccuggugucaccaauuaauugcccaugauuuuuuucuucuucagaauuucaggcccuuuuuuuuuuuuuuuugacccauccagcagguucaguuacucgagggucucgaggggaccuucuccuaagaaccaaauugggggcuagagagagacgagaaccuugugugaauaaugacacggaaauguucugaguugcaucaaggccccaauguauuagccaggcccaagguuuaaaugcacaagcaaaaggggaagugccuuucagcaggaaggauggggcaguagaauugcacaagcaaaagaggaaguacagguacuuaucagcgggagggguggggcaauagaauugcacauucuuuaggcaguuacacggggaagcaggaacuuggcaguaucaggguaucuucaggucaggacauccggcacugacuuagggcuggaacaaucugugguuguucucagaacggugugucguggcccgcuuuugacccccuuuucuucucgggagggagaggcccaauucagagauaaggacaauuguguugucuuaauggcucccaacaucuccccuguuuuaauauuuuuauaaaggcauauuguauaauaaauuuguagccacguuuuuaacgaccgccuaaaugucuguuugcucaccaggugauucucuaaaaccucaaaggacacaaggacaagucaucuaugaugcuugaauuaaugguuccagucuguuggguauaaccugggcuagccaagggauuuaggaacaaagcaagcuccguggguagagguagaggucugauccccaguguguaauguuaggggccauguacaggauugacucucaggcccacagauuuuuacccagaguaacccugaccugcucccgugccguuuuucuuuggggaaggacccuagggcacucaaccuucaugcaaucagacaugccucucagagacugucuaacagcuuccagacuaaucucugugcaguacuuagucuuacaacucucacuggcaacgacuucaaguuccaauuuuucaaugugucuagccugggaugacuguuuaguuugcaauguggugagaauguauauguaaugaacugaaacaaaugagcuugaaagaaauuaauuaauuugagauuuaacaaaucgggucaauuucugaaaugcccaaggaccgaaggaaaucaauaauaggaguuccaauaggggucccaaaagggagggcaacaaggucgaaagccagggggagguugaaaaccaguuuugguaguccaccuucccccuaguucauuguaaauacguguguauggguguaacucagcuaucuauaguucuaaguaucuacucugguucuucuuuaggucucaaacuuccuucuuccuagaugaugguaaauuccuguguagggcagugacuuaacuuuuauucaaagugauaguguaaugccagaggcaagucugaaugucacugaauaggcaacauucuuccugaauucuaagcccaugguggagauaggaaguuucuucaucuguuuguaaguggcugcucuccgauuuguccucuuuugugcacucaacacagcuuucuggucaccacugucagggcacucacaggucacaggucagccugucacauuggaagcuagcaugcucuuguagcauucuguggaaaaaacagaaacauucccccuuuuccccauauuaaguaucugaacaggaucauggcaugugccaauaaguggaucuuuuuuauuugcccuagacauuauuauaucuaguuuuuuuuuuaaauaaaaaugugaccuaaauaaugugcacaaggauauaauuucccccuucucuguuuuuaaagaagguauaguuuuuaaaguuuuacaauacccugucuuugagaauuauaaaauaucucaguaacauguguaacaguaaauuguugacaaagcaucucuuggagguuuugaaaauaaaaauuuuugaagcaaauaaauuuuucuuucuuagauuuucuguaacuaaaaucuuaaauauuaaaaauauauuguucuugcgcgcgcucgacuggccaggaagaacgacgcugcaacaggauccuucugcacacguuuauugggagagcucgauuguagaggcgaaaagacccugagcccagaacuggugcugcuuacauaggccuaggagaggcgugucucacaucugauugguuaacuugucuuggcaaaagaaccuucacugccuauguaugugugguggccagcaguagccaacugccacucugcaacugccacucugcaacggcuucccacauauuuucucugaauuuuauggagcaauaacuacuccccagaacuuuaaacuucccuuuagauauacugaaagauuuaaacuuuuugcuucuuguauugaagcagacaauaaaaauuucuuacauauuguaaagcuauguuagccauaccuacaggcaaaauuaucuagugauuacugaaagcaaaacucuuugaauuuaagcauuauuuuaaacaucugaauagaucugcaacaaagcuaaaaagaaauucccuugaacacaggggaaacuuucuuaggcacuguuugcaaaauaaaagaaggccacaagcuuccuucaggcugucuugagcccugcauuaacauuaaucugagcaucuuggcccuccuacaauaagaaccgguuuuagaggaacaauuuaacuguuuaugccucuaauuuuugauacucuuucuuaagaugaccuacaguuaaaacguucuucacaacuuuagugcugugaaaaaauugucuguauugcaguuuccugccaggcagcaacuauagccaaacugauugucugagggucuaaucuauguacaaagaaaaacauagcuagauaacucugucucaguuuuguaugaagugagcuguauuagcacuggcauaagaugauuacucuuauaauuaucuuaauuauaauauacaggugaauuaaagaucuuaaauuugaaaucaaacugcaagcuauagucaauggaacacuggcaauuuuaaccauaauuuuuaaguuuccguugcaauauuagaauauaucuauaacuuuuggaaagcaagacacaauuuuaaacaauguauucuccuuaaaaucaauacuagaaacaucacuaucauguuacgaaguuuggcugccaauucaugaaugcaugacagugcaaauuuuaauguuucauuaaagaaacauuguuuuaaaaaucuuaucucuauaagucuacuuucuaggauaagaauuacauaaaauuuuaucucaauuuagaaguaucuuuagaggacuaguuuucugggcugguuuaugccaggugcuuuuguuugaaaaugacucuagcccugaguuacuacuuuuaagcuaacuuuguaaccaguguuacaccuuuuaaaucauacccaaauaacuuauaagccaauucucuaugaccaagacaugcagaucauauuuauaccuuuaagaccaaucaaaaaccaaaugaaguggcuccacgaaucuuauaaauuuagaucaaucaaagaauuuuacuuuuuauaguuauaauuauaagauaaaaacacacuuugucauuugcuaaacacaauaaucacaaaauugcagagaauuuuuuaggaaaaaaaaaacaacuaucagcuuauuugccuuagaacuaagaaguugcagauuccuuuucuuuaaaaacaguuuuuucagcaggaccucuccugcugugcuugauuuuuugcuaaagugaggggccucucucagccucuguuguauaaacugagagugaaucagcagguaaaguuuuaaccauuuuuuuuucuuuucaacaugaaacauaaaacagucagucauucagacaaugaaacaaucauucagacaacaaaacagaaaauaugcaugaauugacacgugauuggugcaccaaacauagacaauacaaagaggguagagaacuucuccuguaggggccauagaggauaaaacagggcgucccccucccccccgcaccccccccccccgauuucucucugucccuggaagaguucuaaaauccauuuuccucucucccuuccuuuccuuuccugcuuguaaaaggcagcuugucaaaccaagauuaaaauccaaaauuuucuaacagcuucuggcaagcauccaaaacuucuaauuuauuuaaucugagggcaauuuuuugagaaaacacacaaucucuauacacuaaaugucucaaauagccuaaaaguuuaccaugcugaaucuuuuuugaagccaucaucaguccacacuuagucaaauauuuuauagccaucugcaaaaacgcucucuauuuucugcaaccaacaaaaacaccaucgacaaaaugaauuauauauuuuaggaaaugauuucuuaacuuccaauaaaaccuaaucuaugaauuuuuugacacaauguaggauuggggaguuguaaauaagguaacaguaagaauugagcuauauuuugaccuuuaugaagucucuuuuuauacuuuaaccauaauuuaaccauaauuuuuaauuuuaccuaaaguaucagaauccacaacuugaaguuuuucuuauaacuugggcuguguccuauaaugagcuccaccuaagauccacuuaaucuuagaagccagggucuaagauucgugcccuugccauaguuuucaagagcaaguugucggacuaacagacccucacuuuucuuaggucccaaaauucucucagcugcuuccugcaaucuggcaacgaacugcacauaggacucuugaggcccuuguauaaucuugguuaggggcauaguuagugccccugugauccguccagcauauagacauagacaauacaaagaggguagagaacuucuccuguaggggccauagaggauaaaacagggcgucccccccgauuucucucugucccuggaagaguucuaaaauccauuuuccucuaucccuuccuuuccuuuccugcuuguaagaggcagcuugucaaaccaagauuaaaauccaaaauuuucuaacagcuucuggcaagcauccaaaacuucuaauucauuuaaucugagggcaaauuuuugagaaaacacacuuuaauaauaagucaucugacuuaugaauacuaaaauuuggaaaaagcugagccaagacacaauaaucucuauuauuuauaaaaucuuguauaauaauguaccguguaaggcccguggaacaugccaaaaagguaucauuuggggcaagaagauaagaaaacccauuuuuauuuacucuaaacguguuauugcaaaucucuagcaagggcugcugcggaagcaugccugggcccaacacacaacuuccuaucccagagaguucugucaagguaaguugaacugacucgaagggaagcugccuagcaucugaaagcaggguaaaauuuccaaauaaggcuaugcucucauaaaagggcggggaagcgaaaagcacauccaacaaucuucaaauucugacgcauuaucucuuugugucuuauccaauaaggcuaaagcagaagcauucaauauagaccacaguaaaucaguggaagaggggggccgcucacuuucguccaggcccaucgaggccuaaguucauccaggucugugugcucggccaugggccggccucccguucugugccagcgauggcagaguguucuugcucagacccaccgccucaggcugcagaagccccgaaggcccagcuuuggugagggcuccuggugucugcaggguaggggcgugggccgagggugugaggggcccagggcgaagaaggccacauuccugagcucacugcgcacucugcuggaacccugcaccaucucccgugggggguaggggguugucugcaguuguuaguuguaaggcagccccgauagccagguugauagacuuagaaacaucuaccucauuacaaagcuugaucauaccauuuauaucuaaacucuugguuuuaccucucagggcagcccuacaugccgaauuggaguuuucaagagcaaguugucggacuaacagacccucacuuuccuuaggucccaaaauucucucagcugcuuccugcaaucuggcaacgaacugcgcauaggacucuugaggcccuuguauaaucuugguuaggggcguaguuagugccccugugacccguccagcagguccaguuauucgagggucucgaggggaccuccuccuaagaaccaaaugggggguagagagggacuaaggccuugugcgaauaacgacacggagauguucuggaaugcaucaaagcccccaaauguauuugccaggcccaagguuuaaaugcacaagcaaaaggggaagugccuuucagcaggaaggauggggcaguagaauugcacaaggaaaaggggaaguacagauacuuaucagcgggagggauggggcaauacaagcaaaaggagaaguauuuaucagggggggggaauagaauugcacauucuuaggcaguuacacggggaagcaggaacuuggugguaucaggguguggacaggacaucggagaugacuuagggcuggaacaucccaugguuguucuuggaaucgaugugucgguggcccgcuuuugaccccuuuucuucuuggggggggggggagaggcccaauuuagagaucaggacaauaguguugucuuaauagcucucaacaccccugcagcagggacagcacgccaagcucccagggcugccugugccaucugggcaaggauaccaggggagagcucuaauuguuuuaugucugcagcgaaauugccuuuaccacagauuuuaucagcaguccaggaggcugucuuacuaguaggauucuuucuauuauuugcagccaaauuuucuccuuuguccacaaacucugacuuccaaguuaaauauuggccucuagugagacagacugaacaacuuuauuccauucauuggguaucaaguagccuuuuccugcuaaaccuucuaauauagauacugugaauggggcaucgauaaucgaugacggcugaucgggaguuuucuaaaaagucuucaguaagggcuaagaggcgggcgccuucucugcccucuccugacuguuuaaggagaucucugaugauuccccaauugcuaaaaaaggacucagggacaucuucuccuuguuuuaucaaagcauuaauaucuuugccuacuuuauuccaaguuaaaagguauauuucagaaccauucaauaccagccauggacaucucucguccacaaaacaaaaaauuauuaaauccuuuuucuuuagcucuuaucccucucuccuaaagagaccccuucaucucuugacuaaaaacugucucuuuggacagaacauuccccaugguuaaugggacaacaacugaaugcccaggcuuaccucucaacgugacacucaagcaaaguggcaggggaacugucuuacugucucauugucuguaugguaccucuugaauccauuguccggagggcggucguaccucgugccccacgucuggcgccacuugacccauccagcagguccaguuauucgagggucucgaggggaccuucuccuaagaaccaaauuggggggggggguagagagagaugagaaccuugugcgaauaacaacacggaaacguucugaguugcaucaaggccccaauguauuagccagacccaagguuuaaaugcucaagcaaaaggggaagugccuuucagcaggaaggauggagcaguagaauugcacaagcaaaaggggaaguacagguacuuaucagcgggagggguggggcaauagaauugcacauucuuuaggcaauuacacggggaagcaggaacuuagcaguaucaggguaucuucaggucaggacauccagugcugacuuagggcuggaacaaucugugguuguucucagaaccgugugucgugacccgcuuuugacccccuuuucuucuggggggagaggcccaauucagagaucaggacaauuguguugucuuaauggcucccaacauuuuuuguuuuuuuguuuuguuuuguuuuguuuuguuuuuuguuuguuuguuuuuuugagacaggguuucucuguauagcccuggcuguccuggaacucauuuuguagaccaggcuggccuugaacucagaaauccgccugccucugccacccaagugcugggauuaaaggcgugugccaccacucccggccaggcccaguuuuuaacuuucacauccauugcuuauuuagaucuuuauugauauucuuuuuuucuguuaacaauguaugcucugaaccuuaauaccauacuuuuauguaggacagagagauaaagauguaugaauauaugaggucaguggaggugaauuguagagaauaaaaauauguguuagaaaagaauaagaacaauauuuuuaagaguucuuguaaauuucuggcaagaagcuaucccagaguucagcuucagcagcucagggauuccaaggagaaaauguagagucgacuacaagaauacgcagagacauguuauggaucuaggaagcucgaauuuucucugauuuuauuuuuucuuuuaucccucauauacuacucagaacaaaagucuuuaugcagaaaaaaaucaucucauagucacaagacauauauuaaaaauaauuuccucagaaacccacaugugguuaaacaccccccccauuuuuucccauaauuacaucuuuaccccaaaacaauaauucugucauuauugauugacaaaguuaauguaagccaaguauauuucagccaguuuucuuguacuggauggccucaguuugcaguaacuguaugcagaccuuugguuuuguuuuauucuacaaagcuuugcucagcuagccuaauuaaccaucuacuuucuuuuuuccuacucauauuaggguaauucuuuuccucuuacaacucuguuuucuugaggugcauaacaaaaacuuguaauuacauuuguaagcuacauagccagaagacacagaccuaaccauaguuacaggaacuugauugcuuucuuugaucacuggccuaucucccacaggcaagacuugugggcuuacaaugucugaaacuuccuuguucuuauuuucuauuaccaauaagucuugcauccaguugggggaagguauuaucuaggcuuacugcuaucuucuauauaucccucauuagaagcccuaaccaccugucuuuaaacuauucccagaguucaacugaaucaucaucauucagucuuaacauuacccuggagauaucacuuuuauuauuauauacuacaguaaauugaaaagaggagaauggggaucuuccaugaaguaaucacaccaugcuaaauacaagaagaacacgauagcaucaagcaugaugaggcccggcagcaagugccauucuaggcaaucauuucuccuacucauccuggccuucccuguguaagguacacucaucacagcucugcuaacaggugagccauacuacacaagcuucaucagugacugugguuccuccagcaggcccauuaccauagcuacugacaauaauuaggaguucaaagauuauguaagacauaacauuauuuguaguuaagauuaggucauguauuauaagagauucacagaaaaguaguuuggguuuucuguggcaauucuacaaucacaaacuuucagauuuauuuuuccucucccauuuguaggacuggcuuacaugacaaaaaauuauguuucuaaaugcuucugugcucuagccauuauguuuguauccuacacuggaagaaaguagauaccucaaaugaauugguucauuuuacacagcuucucugccuucuauccacuaacuucuguuuacccccagaaaacagcaaaguuagggaaaguagcuuuguagcuugggaacauguuaucccaaggggcaucaacauuauugaauaagaggugggaaaauaauaugucaauaacuuacaauccuauucaccguggccggcaaggcuagagauaaaggaguaauggguuaacuuuagucaagccuauuucuuacguugccugccuuuuguuuguuuguuuucucauuggaccugagaaaaaguuuuaugcauauauuuuugugguuuuuguuuugucagacagaaucucacuaugcagcguaggcuagccuggaacuuauuacagucuuuugagugucucacacuugcuuaucuuuugcauuuaauugaaguggaaacuucuaguucuuugaaaaguuaguuaugccaaaugguauuuuacuggggcacacaggugaaaugaugucuugcuaaagcaaaugugaaagaaucuuuuccugaagcagacauaggugaaaggauguuuggauauagcaaacacaugaaaggacccaggaugaacaaauauaaauaugaccucacagacaauggagcacugagcuuugguuugauuugcuccaccucacuauucuucgcuaaagacaugcauguguugguuugccuuacauaucauuguggaacucaacuugugauaacuccaacauugagagaaacucacccaagaacuaacugcuuuagaaguuccugcggcaguugcugcucugcagcuuugccucaggcugguuggcaagccugguaguuucuucagaauugaauuacagaugucuggugucugcuugcugaaaggacuggaugguagcugcugguuugugccuggggucugucugccuagagggcuggucugcggcugcugaaucauauuugauguuugcuaugggauugaacucacccccaaagaacuauugcugaacagguccacuuuccccauguccuaauaacuucucucuuccucugcuggguggaaggcuagagaagaguugaacccuuguuauaaguagguugcaaaaaauuuaugccuccauuuacugaguucuuuuacuuggcacaggucugucauagacagacaacaugguguaguugguagguagauucugcuacuuaucuuugaauacugucugugcuacuuuauucacccacaggcaacuaaaccuugaauaccaaauuaaaauaauacucucucuuacuauaagacauuacuuugggccuaggcagcuuuuaaaaauugaaguaaugaaguaaaacauccuguuuuaugagaacaauaagaaacacucaaaacauauagccagugcauauuauuaaccaauaauaaugcaaaugccuaaauucagaagaaaacaauaaaaccaagaaugcuucauuuucuucuucuucuucuucuucuucuucuucuucuucuucuucuucuucuucuucuucuucuucuucuucuucuucucucuuccuccucuucuuccuccucuucuucaaacauacguguguguguguguguguguguguaucuguacaugugugugugugcugagguuagaggucaacaauaggguuacuuuauuuugggaaagggucuuucagugagccucaaucucacagauugagacagacugauuauccagcaaaccucaggaauucuuccauuucugccuaccccuuccacccccauguagaggaauuuuaauccagcaauuuggcuauucuggcaagggaucauauccaaagacccaagucuugugugauuuggcuggaauacagucauacccuuaguguacaccuuuaaucucucugguugaaauauacauaugucuuuaguacacacuuuuaaucccaaacaauggcaucuaauugagggauagacaaagugauaaaccagagauuugacagaaugagucaaagauaacacacacccaacucucacaagagaguacacaagcagugcagagagagaauaagacaguuuguggagauaguauaguagaguuuggaaguguuguacaguucagcacaguugauuuuguagaguucagaggcaauuuuuccaaacugagcaauucagagagaagcugagagaagccaguuugcuuggagaggaguuuugagccagaacagcuuaauugaaccagucagaaugcagaaagauuuagaaagggcaagcuuauucagcaguaagucuuggaggcugagagcauucuagaccuaaguuaccagauggagacuggaaacugaagccuucaaggucugggcuggcagaagauuugauuguauggauacuagaagcuuccaggcuuaugccuggauagauagaaaugcucugggcucagccuaugccaugcauuuguaaagccuguguacagcucucaucucaucuccucuucugaggaaauaaaaacauuuacacccuuaguguugggauugcagaugugugcugcuuugccugacauuuuuuacacagguacugaggauugaauucaaguuuaauauauguguggaaagcacuuacccauugagucaucuuuguaacccucuuuuuuguauuugaugaaaaugacuuuauuuguucuacauugacaaaagugaauuacaaaaaaaaaaauacacuucaccuugauaauucaacaucaauacuaauuacuguuaauaagggaaguccaaacauucccucauuauuuucuuguuuggguuuucacaaaagacuuuuuuuuucucccuggaauaguuugaaauagcuguuuuccagaaaacaaaacaaaacaaaccucuuuucuaugguucuaucuucagaaaagaagcuuuccuuuucugagucuuaagcuagaauaacucccucugagacaaacuuuuuguguaggcagacuauaguaaaggcugauuccaguaugauuucucagcugaguggaaugaaugguuuaauaaguucuccaaagagauaggcuugcuuuaacauaaaauuuguauauaaauaaaacaucuagauuucuucauacaguuuaaugaagccagcaauuuuguguucuagugaauaggcauucaacaaauaccuauuagcaagaaagauggaagaaagaaagugccggaaaacuacggaaaaauguaauuggggauaaacacuugauuuuuaaucgagaaaaggaacaugaaauauuccuguuauaguuagggcaucaggaaauaacacaaugaucuaaaaaauaguuucuuuuuaaugugcauuuaguaaccaagauauucacuggagaagacagagaaaaaauagccaccuaaguuauauguguguguguauauauauauuugauuuuaaaacuggauguugguucggcacugacugcuuuuccagaggacucagguuuaauucucagcacccacugaguggcuuacaaccaucuguaacucuauuuccagagggaucagagacccucuucugguuucuguggacaccagaccuauaagugaugcacagguauacauguagacaaaaugcccuuauacauaaaauaauaaaauaaaaauuaaaacaugacucuguaagauaucuagagaauuuccuucuaguuauaauacuacaaaguauguguauuucacuuuuauuucuagauagauauguuuugcuaaguaagcaggguuuuuuuuggauuucuuguuacacauauguuuuuccuuguguugauuauuaaaguuuauguauuuguauggcuuaaguaguaguaagagucuagguucuaauguaauagaaagaagcugauauaaagccucagaaauacaccagccauauaauuaugggauuauagucaucuauauuuuaauaucaagauuuauugaugaauaacacugacagaaaagauaagaacuggaaauuucaagagggauuaaggaaagaaagcuucgaauaucugucagaggcacuuuacuagguuagauuacagauucuacuaugagacccauaguugggcaacaaugaauguucaggacugagcaagugauuucaggcaaagauuuggaaaucuugaguuuaucuguuuucaagguagaagaugacacaagugggagcuuuuuguauuacccacauauucuuuaauuacuuuacaaguauaaaauaaauacauaaauauauacaaaucuaaaaacaaauaaauauaaaaauacuauuuuauaaauaaaaauacaaaaguuguaaauauuuuauaaguauaaauuauaaaugucaauauacauuacucucagaaagaaaaauucuaagauuuguagucauauuuuuccuuuaauaguaauauauuuaaaaauauguguauauuacagaaagaaaauacuucuauguucauuaaauucaacaugagaacaaguuuacucuuguacaaauguuauuaucuguagauugccacuuguaugucuuaaaagagacuuucaguuagauacugaaaauucaaauauuaaagaauuuaaugaauaaauauaguuauguuagauuccucuuccuucucaguggaacucuccuaacuucaguaccuucugaauaccagugagauaucaugggauauccuugaagcagacacacaccauuaugauuuauggcugacuuggaaaggaguggcauuaaagagauugagagaaauugauguuuuauacagaaaauaauuagaaucuguauuuuaugucaucagcagaaauaaauuucagguggauuagaagacuuaaacauuagguuauagcagugaaagaugcaauauuguaagcaaaaggaauagauuuuggaaauuuguaauacaaaagcaaauugcaacagaauacauaaggaagauuuccaauauguaaauuuaaaaguaauauacaauauauuuuaacauguauacacaugcaaugaagaauaaauaaaaugaaaaaugugauauuuggauuguguuaauuugggcagaagcugagaguacaaugagggagauaggagcaauaaaauguggacagacuuuuggggcuaacaaagucugcugugguugcuggaauuugaacuuaggaccuucagaagagcagucagugcucuuaccugcugagucaucuccccagcucuguuuuuuuuuuuuuuaaguuauaaacauuuguuuauuuuuguuuaguuugucauauguuuucuuuuauguguauuuacaaacuaucaaggaaaggaaaaaaaaauuucuuguggcuugagagaugguucaacuguuaaaagugcuucaugcucuuucagaggguuugaguuaaauucccagcauccauacuggguagcccacagcuuccuguaauuuuagcuucaggauauuuuauguccuuuuccagacucugaagguaccugcacucacauaugcacagacaacugucuaauagacacaauuaaaaauaaagcuuaauuuaaaaaaaaaccaaacaaccaaacaaccaaacaaaaaacaagcuuguccagauucagaaagauaaauggcacauauuuacuuguggaaccuguauuucaaauuugugugugucugugugugugugugagagagagagagagagacagagagacagaaagagagacacagagacacagagacacaaauacacacacacacagagagaaagagaaagagagagagaacuagaugugaucaugaaagaugaaagggaaggaaaaggaucuuaaggggguaggaaauagagaagauaguggaauccauaugacauaugaguaguaggacugugugaaggaagagaaccacugggaggaaggguaagagagcacaggagagggaaguggggaaaaggaacaaaugagaacaaagaaaagaauucacguauaaagaugcacaaugaaacccgauuacuuuacaugguaaccuaaaaauuaauagcaaaaaugaaaaaaauuaggccuuaaauugacauauuuaaucaagaagcuauuggguauugaauugcgauaaaaauuuucaggagugcuaaauuaacuuagaggcuauuuaagaaguaaugaaaguaugguccaugcuaucguuggcuguuauggacagggcagcuucuuuuguaguguuauagaugaguguagauucacaauugagaauuaaagacauuaaagucuucaguggcaaugccccacccccaccccaggaaaaaagaaagaaagaaagaaacugucuagucaggaagcuauugaagagaguuuuuaaaaauugugauaaaaaugcuuaaguguagcucuucacagauuauggcuucuggcaggaguguuguagggaaggacucaguuauuuuaaggggcuggccacugggaguuugaccaugagucauugugaacgcccgacuugccagcaagaaagacgccacaacaggauccuuuugcacgcuuuuuuuuuuuuuuuuuuuuuuuuuuuuugagacaggguuucucuguguagcccuggcuguccuggagcucacucuguagaccaggcuggccucaaacucagaaacccgccugccucugccuccugaguacugggauuaaaggcgugcgccaccacgcccagcucugcacacuuuuauugggagagcauuacugcgaaggugaaagaccccaaacccuagaaauggcgcugcuuauauaggccuaggaguggcgugucuauaccugauugguuaugcuuucaguaccuuauuuacaugccucgggccaggcagugacuccgcaaaaaacucuauugcacaugcgcacauugguuguuuacccauauucaugggcgucagcuuauugaaacuagcgccaucuuguaauggcguuuguggcuucccacaagucauggucaugaguauauggguaacacaaauugaaugugauuuguuuguuuguuugggagagcgagcacaaggaugggagggugucaaaggauaagcaauacacaaacacagagaagcuaaguaacaggggggaggaaucuaguggggaacacacugaucuccuugaaaaucucccuggggaaauagaauagauuuuaugugugcaguggugguggggacuggaacaggaggaucaggugggcagggggaaggaaugcagggagagacagcuagaauugagggguggcaugguaacacaguacaauggaagcuuucuaaaauuuauggaaacaauccuaaagaaacuuccuaggaagaacaacaauaucaaccaaccagaccuccccagagcucccacugacuaagccaccauucaaggagaacacaauggcuugucaggcauaaaugggaggagagguccuuggucuuaugaaggcucaauggacgccccaguauaggggaauugauggcugggaggugggaguggguggguggguggaggaacacccucauagaagcagggggaggaggaugggagauaggacaggagguuucggggguggagggugauccagaaaggggauaacauuugaaauguaaauaaagaaaauauccaauuuaaaaaaauaaaagaaaccuccaaaaaacaggggauacugagucccugugaauuuuuuuucuuuuaagucuaucacccauuauuggucuagcauuauugccaauguacuaaagaauugaugcaauuauuauuuucuuucuuggaaaauuauuuguggguguuuucuagaaagaaaacuauaacauaaaauuugaugaacuacaggaugugucuaaacaauguagcauaaagaaccuaagaauauuucuaaguuuucuuugacucauacauuuuuucaagauauuuacuuuuuuuuuuuuuuuuuugguuuuuuugagacaagguuuuucuguauagcccuggcuguccuggagcucacucuauagaccaggcuggccucgaacucagaaaucugccugccucugccucccgagugcugggauuaaaggugugugccaccacgcccggcugauauuuacauuuuuuguuuaccuuacaauugcauuugaagagguuagagguauagcuuauaacauguacuuagucuaagugagagccagguuucaauccucccagacuggguaugaguuauuacacauguauguauguauauauguauguacacauguauguauguauauucauuuauuauuuuuuuaaucuagcaguauuucagaguagcuuuucuuauaugaaaaaccaaauaaaauauuugccuaaaucuguucaauaaucuugggaugcacucucucuuuccaaauuugcaggcauuugggcaguccuucucuauccaccguaaaguagcugaggauggagagacucgggaggaaacacuucuucaggagucugcauccaaagaagcuuacuaucuaaacaagaucuuggagaugcagaaugagcugaagcagagccgggcugugguuacaaauguccaggcagaaaaugagaggcucucggccguuguacaggaacugaaagagguaaacaagacaguucccuuuaagauuugucuuucaagaucuaauugucuuuagaaauccccuuacagagacauguguuucaccaacacuagauguuuuuaauccaguuagguuaacaaucaaacuaaccaauagugccaaacuauagaccaacucuuuuaacacauggguuauaguauuuuuuauuuauuuauuuuauuuauaugaguacacuguagcugucuucagacacaccagaagaaggcauaggauuccauuacagaugguugugagccaccaugugguugcugggaauugaacucaggaccucuggaagaacagucagugcucuuaaccacugagccaucucuccagcccccacauggguuauaguaguaagcuucuuucuauucagcaugaagaugauauuccaucaccacaaccagagagagagagagagagagagagagagagagagagagagagagagagagagauaugaaacagucuugcaaucuugucaggaagccauuaaaaagaacucuuaaaaacugugagaaggauccugaaguguugcuccucacaacugauggcuuuugacaggggugagguagggugggagggacacagaagaccucaguuuucuuuaagcaacuggccacugggagugugaucaugcuccagugaacaugggcaacacaaaugaacuugcuuucuuuucuucuuuuuuuuggggggggggcggguggggggaucacaaagggagaggaugguccugggaaagagagugugauuggaugaauuaugugaaauuuccaaacagucaguaaaaauacuauauuggaaaaaguguaguucuuauuuuucuaucuccugcuucccuccaagguuuccauacuaguguuuggccagucuacuuguuauuuuuugguuaaaugaagaguugauucccuuuguuuugcuaacuguguuucuaguuuuugaauauauagagaauaauuucuugaauuuucuauuugucuggaccgguuuagccuaccacuaacaauuuuauuuuaauaaaacugucuuacauuuccuucuuagaguguggucugaggccagacccuggacauucuucuuuaguuugacuugcaucaucuguguagugaaauguuuaauaaagcuuuugugucuggcuuuaaaugaaauguauaguaaagccuuugcuauguuuggguuaaucaauagagacugaaaaauuguuaugagauuguuugaaccuugaagaaauguugucuuuauagaggucugcacuuggugcuaaaugagagcuuacagcugcacuaauccuaguccuaagacacuccuggcaaacuugaaauuuuuauuuuugauuaugauuagccauugucaaaagagacugagauuuguguggguugucugcucuuaugaacagcaaaggcaagauaacuuugccaguggaacauuucccagccccgguuaacuuuguaugauguuugaauaaaguaacuggagugagauaaccaggugucacucuucccugagugacugcaccccucuccaccuccggaaaaugaaggcuuagcaucuuggugaguuucucucucuacugccaauaugaucuauggccaauaucagucaauacauguguuuacaauguguuuaaaaagaggaagaagggguagaaaaagaggaggaaggaggagaaagagaaggaggaggaggaagagcaagaagaggaagaaaagaagaaggaggaggaagagcaagaagaggaagaaaagaagaaggaggaggaagagcaagaagaggaagaaaagaaggaggaggaagagcaagaagaggaagagaagaaggaggaggaagaggaggaagaggaggaggagaagaagaagaagaggaggaggaggagaaggaggaggaggaggaggaggaggaggaagucgucauuagucacuacugacuacuaccaaccuuuaccuuuguuggaaauccuuaaaaaugcaaaccauugggucuauauauuggcuuucuccuuaaauguucaacucaguuuuaauuuuucaguuucaaauuuuaauuuguuuauucauuaucuuuaauaccuauaguaaccuaggcagaugccuuuaaaacaaauaauaugugcucuucuacuagagcuuuuauuuucuuuuucaagaagugcacaaaagugaaaucguuuagcauguaguuuuugagacugaauccuuuuuuccugucguaaugcauuugagauucaucuuuguuggauacuucaaccucaaauuuguuccuuuuuauagcuggauauuauucuacuauauuaaaauauuacaguucuuuuaacugauugcccuggcuuugauucccaacauccacaugaugucuggcaaacaucuguaacucuaauucuagugcccucuucuggccuuucugggcacuaggcauguaagugguguauauauauacauacaggcaaaacacacaugcauauaauaaacaugaaauaaaacuaucauuugccaguguguaauucugugcuuuuuauuacuauaauaagguaccugagauaagcuauuuugcaaagaaaagagaaugauuuaguuuauaguucuggagauucagggauauccacucagcucuggugaggacccuguggugaugguaggaaugucuguaugagagagggaucacauuaucaaagaggaagccagagacauuuuggucccauaauaccuucuaaggguacaccuccagcuaaccuaagaaucucacgcuaugccuaccccuuaaauguucuacuuuccuagacugucacauggaggaccaagcucccaacacaugcccuugagaaacaaaccauauucaaacuguagcauagaguaaaauaauuuuucauuguaaugaagccuaauauauaaaaaguaaguguagauagagaaacgaaguccaagcacugagcuuugggcuacaucagcauggagagauuggauaagagaaggggaaguaguggaauaaacuaaaauaauagugggguagaaggaaaauaaagggagaaugguuccuugacagcaaaugaaaaaaguaguuuuuaagaagagagugaucaauaguacagugauauuaaagggacaaagaagaaucugaauugaccauuggauuuagcaacauguugcuauugguuaccuuaaugagagaauuacaaaauaccuugauuagaguugaccuaaaaggaaauacaggaguccuauuauaaaagaucuuaauaauuacuaacauuaauaauaauauuaauaauuuuaggaaaucuuauggaaucaucauuaauaauuaagaauucaucuauuugucuauauagcaucacuacaagacaucuuuguuguucugcagaaaucugcucaaaggggugggcuaauaccuagugauuguuguaucuauuuaauaauagcaggaaaagcauauuaauagcaggaaucuuuccuaaaaugaaauucuucucggccuugccuagagaaucaaauccaucauuaacuuuacaguccaugguggaaccaugucaggacgaucacuugcuaguuuuuagcuucuccuugauggcuccuggcagaauaaauuuccuuucuuuuauaaaguaccuaaucucgggcauucuguuauagcauaaaaaggguccauaaucauuauagaaauugaauucaacaaguauuuuuugaaaucaaaguagauuauugaugugcugauuuaacuacuguuagaccugaauuuucuuuaauauauucuaccaaguugcaagcuaaaaccaucuuauuugaccuauucuuggucuuggcugcccauaauuuaucuuaagcuacaauaucaggaaauuuguuaaagcuauaaacauaccauuucauauuaaguaagaauaauguauuuacuaaaacuuguuuauguuucuuacuuaaaacuuuuuaaauaauugaaauuagaaguuuagugcaaacuuuauaaguagguucaccuccauauuagcauuuaaucaucacauauuagcugaauaaccuuagacaggugguuuaucuugaaccucaguauuguugucuaacaaaugagacuaguggcagcaccugcuuuaugagacuguuguauuaguaagugggaaacacuuggaacaguaacuauugcagagcuaacuuuaguuguuauguuaucugaaugcuguuugugugaguuuauuagauauauuuaagguuuucuucaauauaucacucuaaaaguagaguugcuauaucagaucaaaaacuuuuaaaagaagaccuguagaaaguuauaucacuuuuauaagugaucaaacaacuguauguuucuauuaguaagagaaaaaaguuuuccauuccuggcagccugugguucaugauuggacuccuagcaacuuggaauguugaggcagcacuaacaaguuugaagcuagcuuggguacauugugaaauccuaucuuuaaaaaaagaaaagggaaauauaucuauaaaaagaaagccagguauaaugauugcagaauuuaagagguggaagcaggaaauaagacaucaaagguccucuucaguuacauagggaguuuugggcucuucugaguacaugagucuuuagaaaauuauucccauuucaccaaaccccacguauuaaucagcuuucugucacugacaaaauaccugacucaaauaccuuuuaaggaagaaaaggucauuuuagagcaugauuuuaaagauuuauguccauggccaauuguuccucuuccuucugggccuguggcaagguggccccacauaggagagcuuauagcagaacaaaaugcucaaaacacaguaucugggaggcaaaggaaaacagagaagugggauuagaauccaguauucuccuaaaggaugugucccagugaacuaacuucuucagucuucuaaagguuucaccacuucccaaagcccucaagaugcgaguuauuaggggacauauaagguccaaauaagaugccugacaugcacuaagcauuauaauuuuuuuagguuacuuauuucauagauaaacagugaauuuguuuuaaagagacagagucucauuuuagccuggauuggccuuaaacuggcuacauaauuuuaauucuugaucuuccugauccuaugcccugaauacugggcuuagagguauguaccaucaugccuggcacaauaaugauuuuuuaaaagauuuguuuauuuauuuauuuauuuauuuuauguauauguguacacuguggcuguuuagaugguugugagucaucaugugguugcuaggaauugaaugcaggaccucugcuugcuccaaccccacucccuccagcccaaagauuuauuuauuauuauauauaaguacacuguagcuguucucagacacaccagaagagggcgucagaucucauuauggaugguugugagcuaccauaugguugcugggauuugaacucaggaccuucagaagagcagucagugcucuuaaccacugagccaucucuccagcccucaauaaugauauuuugaaaugaguuuuugagaucauucuugcacaaagguuggcaugcaguagauauccagaaaagaaaaagagccaaagaauaagaagcauaccacuuuuauucauguguagaguaaauaucauaaauuaaauaugaaauuaaggaauaauuuaugccuuaaaguuuacaccuuuauuggauuuuaguguuauacuauuagugugugcuaaaugcuaauugaguuuuccuaauguuuugguaugaguuuuccauccugccuaucauuggccuauuggauuuguuuuucucauugagguuuuggugauuuuguuuuuaaauuuacugacuauuuccuauugacuauguuauagcaauuuuaaauuaguaucuuacccugucuuuuucuuuugacccuucucaaauuacagaaauucacugcccauuguuauguucuaauuuucacuuuugaguucuucaucauucuguuguguuuuuauauucuggacuucucucuuugagagauaucucccuauuucuauucuguuuuguuguuauuuguaucuacucugacaucaaggaacacuauuuaauuauuacuauaucaucauguguauuaaguuuauaaguguuauguuaucuuuuuuucuuauguuucaguuauuugguagcucuucuauucuuaaugcaucucuaaauggucugauuuaguuuuuaaguuaucagugcccauguguucuugauagacuaguuucaaagacagguucaaguuuuuuguuucaaacugcuauuguuaguaucuugauagucauagcuuuaagaaaguggguacaccgggagugguggcgcacgccuuuaaucccagcacucgggaggcagaggcaggcagauuucugaguucgaggacagccuggucuacaaagugaguuccaggacagccagggcuacacagagaaacccugucucaaaaaaaaacaaaaaacaaaaaaacaaaaaaacaaaaaaaaagaaaguggguacaucuaugaaacacuuccugcaccuaaggcuaagagaucauuucagaagagaaggcaggaaauacuauaggagucagaggaucaggaaguuugcugugagacugugucuucuaggaauaucagaaacuacauucguuaagacucaccaacaugagugccuaaacagaaguugaacauagacaacaauagacauaauaaaguggaugggggaaagacccugaagcuucaguccuacacaaagaacuacagaccacuaaggaaugcugagaguggaagaaauacccuuuucuagagaagagccuaccaauugguuaucuuguaccauauggucauuccugaaaacacacauaaaaguagcauuguacagacugagcuugugguauuuauauauuuaagaaucuguguguguguguguguguguguguguguguguguguguguguaaaauaaaaauuaaugaaaaagagccuguaaguuuacaggagaguaaggaaagguauaugggaggguauaaagggaggaaagggaagggggacaugauguaauuauauuauaaucucaaaaauaaaaaaauaauuaaaaaagaaauauuuguuucaguugucuaaaggaaagaauuauguuuaucaccugcuccaaauuaaauuaauugcuuuucauaugaauuuucuaaaauaaaauauggaaaccaaugauuuuuuaaauuuuuauuuauuuuuauuuuaugugcauucauguuuugcccgcauguauagcuguguagauccuggaguuacacacagcugugaacugccccaugugggugcugggaauugaacuuggguccucuggaagagugcucuuaaccacggugucaucucuuuagcccccaauuuauagccaguuauugaaaacaaaauaugaaguuucuuuaguauuuuaaauauagaaagcuaacaauaccuaaauauuccagucuuaccuuuuuuguugguuuuguuuuuugggacaggucacacuauguauucuuuacuggccuggaacuugcuauguaggccaggcuggccucaaacucauagagcuuuuucugccucugccuuuacugaaguuuuuaacccagugaauugugggaaauuagacuuaccuuaguagcuuguuuguauaaacccauuucagcaugauuuuugucucugaugauaagaauguucuucucccauauagaaggauaagacuuuucucuacuggacacuuuagguugaaaaggaagggcaggaagcccuuccugagucuguugguucucuagugcuuucaacugaaaauaaucaagaugugaacaugacauauacugauuccuacacaggcccugaucaucuugucuuaccuuuuuacauuuuacuuaguuuuuugcuuuuuaauuuuaugccacauuuaaaucaugguuggcuagcuuugugguuuaugucauccacccuguuuuuaaggagagagagggaaagagaggagagggaagggggagggggaaagacaagaggugggagggaggaagggaaggggaggggcuauaagucgaacuguccuuuaggcaagaggguuauuaacaucauugacacacacacaaaaaccacagcuuguuguaacccccgaauuacugauacuagagagacuucaguauuguacaguuugccucugcguuucccgccagaggcucccauccucccuccccaucccccagcugcaagcaggauaugcagagagcugguuucugugcuguguccuccugcaguagccucuuccccuccccuagcuguagagcaccacuacccauaaaacuccccuuaaugaggacauucugaguagaccacacuucucccugccuuugugucuccaaaauccaacacuccuccugguaacucuccaggagccuguccuggagaccuuagagaaaugacaagggaaaccuuggaaaaaguaaaaaguaaacagaggucaggucacagacaguuaugacugaccauaaaauuaguccuugaacagacagccauuaacccccacucccgcuucaguacuauuccacccucuacucuccuuuucugugaauauucacacuauuccuccuaacuauacuguauauaaacccaaugcuuucuggacucaggggcuugccagcauucacgcagugaaugaucgcuaggugagcgauccaacuugaaccucuuuuuauuugaggaugucuauuuaucuuucaagcuaugggacacaaagauguuucucccucucucauuaacugcacucauucuuuuuuuuuuuuuaagauuuauuuauuauauguaaguacacuguagcugucuucagauacuccagaagagggcgccagaucuuguuacggaugguugugaaccaccaugugguugccgggaauugaacucaggacuuuaggaagagcaaucagugcucuuaaccgcugagccaucucuccagccccaacugcacucauucuuaagagcgaugcccuaucaaucauaaauuagaaugggugaaucauuagugcauguuucuacagagauggaaacugaauaaagaaugaagauauguggaguggaggucaacaauaaagaguuuuuaaacaauggagaauuuuacauagggcuuccauagguuauaaaauuaauuggccuucuucuuauugcuaugaucugccuagcccuaccccugcuaaauaaucacuauugacaguuuggggagaauuuucacaaauauauuuaaauaacacgaaagugaaguuuguuuguauaugcauguacacauguaugcacuucuuuaauuuuauucauuuuuacuguuuuguuuuuugaaauaggcugcuauauagcccaaccugugcaugagucccugauccuccuccuucugcccucuaugcccuggaaauccagauguguaccauaauacccagacccucccccuuauuaauuuauuuuuaaauauaaauuuuuacuuuacaaauauuuguuuuuauuuuaugaguauggauaucugaguugcaugccuguugccuguggagacugaagacggcauggaauaugcugaauuggaguuacagaugguugcgagcugucuugugaguucuaggaauccaauccauguccucuggaagagcagcaaaugcucuuaaccacugagccaucucucuaguccacucccuuauuuuuaauucacaugagauccuacugugcauacuaguguacagcuuacuuucacauguaaugauauacuguagcuauacuucucuuuuaauacauuaaaguuucuucugauuuuuaaauaguuuugcaauuuaaagauauuaauuuauuucagcauucucuaaauagcaaaaacuauagccuauuucccauucuuugugugaauaaacaugaauuugcuuagcuuuuuauuuauuucuuugaaaauauguuuaagaauaauuuuuaaaugucagauugcugggucagguauuugugauuuaaaaguuuuaauagauaucauuaaauugucaucuuaaaaggcaguaccaggcuggugagauggcucaguggguaagagcacccgacugcucuuccgaagguccggaguucaaaucccagcaaccacaugauggcucacaaccauccguaaugagaucugacucccucuucuggagugucugaagacagcuacaguguacuuacauauaaccaauaaauaaaucuaaaaaaaaaaaaaaaggcaguaccaauuuaaauguaggaaaucauucuauuauauaacugccaguuuuuuuguguacauuuaccgaaaccuagaauagggaagcuuuauucugauuuuuguauuguuucagaacaacgagaugguggagcuacagagaauacgaaugaaagaugaaauccgagaauauaaauuccgggaggcccgacuccuucaggacuacacagaauuggaagaagaaaauaucacauugcagaaacuaguguccacauugaagcagaaccaggugagacuuaagauuuuuaaaaaauuauaccacagauggauucacauguucuaauaaaugagguucacucuuaccuuucuuuuuuucaaaagauuugucuuuacuauuuguggucuguguaugagcacacacagaaguccucuuaacugcugagucaucgcuucggcucuauacauuauuucuuaagaaagagccugccaggauuuuuuucuuauacuccuuuaauuuguauacuggaauuucucaauuuuccuuugucagcuaaauuguauaagaaaaaaaaagccauauaaguaguauacuuuacaauacuguuuauaaguaagaagaaugcucauuuauuuuagcuccaugcuaauuuguuuuaguaguaagucaaauucauucuaauaaauuuaacuuagcaacuucucauuguugcuggguauacucacuuguuuuacauggcauccucaagaucuuccuauaaauacuugucuuccuccucuucuccuuccuuuccuuuuccuucucugugccccuccacucucuucccuuuacuuucaugccuccuccccauucucccuuccuuuacccaauuccuucuuucuucccuuuccuuccuuucucucuucccucuuucuuucauuucuuuccuuuuuugucuccuuugccuuucucucaucaucucuccucccccucccuuccuucccuucuuuuucuuuguuuucuuuccauuuccuucaucucuccuucuuuucuuccuuaucauccuccuccuucuugucugucugucugucucauuuuugggacaaauuguucucagugcauauagaaaaguauaaauugauaggaagaaaauugugagaaaaaaauguucaauuuguuuuuuagcuguaacuucauuauaaaagucccuuguaauuuacauuuuuuuccuggaaugaggccuagauguugucuuaguuucuuuuuguugcuguaauacaauguccuuuauaaggcaaaaacaaaggagaaaggauuuguuuugguuuacaguuguuggggacauaguccauaaugggagagaaugcauaguaacaaucaugaaagacauggcaacagaaacacgagguugaauggucauauuacauuugccucuggaaagcagagagugaucagguaguaagccugggcuauaacgccucaagguauaaccccagugaacaacuucuaccaucaagacaaucuucuaaaaguuccacaaccuucccaagcagaaccacuagguaggagucaugaauucaaacaugugaccauguagggugcauuuaacauucaaaccacaacauucuugccccucuaggcucaugaucaucucuuggugcaaauguauuuagucuaacuaaauccugcagccucaugucugccaucuggagcuuguggugaaauuggcugggccccauucuucuagcucugccuucugcagcacacacagccuacagcuuuccuuagcaaaugucuccugguccuuguaucuucaauauucugagucucugcuauaacuuaguauucaccuucacagcuuccuucacacaggagucucucaaggccuucuuucuggaacuuuauucauagcacauacucuuuugucucaguaguucuuugaaacuguagaaggagacuucaugaacuuuucaguauugcaucucucaugccugcaaagccagugccacaugguacuagcagacacuaguaaguucuggugccacuuuggauggaaucuggcuccuucauaucacaguuguuaucagauucugugugcugacccuugggaaguauuucccuauguaauugcuuuccagaagcugaagucacaugaaccguggcgcuuagacuuucuccuuuugaaaagaacacuuuuuaaaaacaccucuuuaccucaauuauuauucuuuaucacuucagaccuacacaaaaaaaguaauagccaugccacauguagaauucugucaugccuacuuaucucacuaacaaaacauggcaaguucauuacauuuuaauucaggccuaaacaaauucucaggacauaggcagaacgucccuagaugcuuucuaggcuaucacaugaauagccuggugccuaguuccugauagacucuguuccccucugaaauaucauaagccaucucacuacuaucagcauuucucucuuuauuugguuuuccaaauucccaccagaacaacccauuaaucuuuguuuacaccauucaagagcuuuuguagauucucccaacaaaccaguucccaaugcuuaagaaucucauggucagguuuaugacaacaguaaccuuacuucuuggugccaaauucugucuuaucuacuuucuuuuugcugugauuaaaauacucuguaaaaaagcaacuuaguggaaaaaagguuuguuuugucuuuuagaacuuggaggcuaacaguccaucacaauggagaagacaugguugcagauagagaaggcauaaaagccagagcaugaagcuagccagauuauaaguacuuaaggucuaucccuaguaacucacuuuucuaccucccaaugguuccauaaccuuuccaaauaacgccuccaucaggugacuaaguguuuaaacaugaguauauugggggauauuucacauucaaaucacaauagaugguuuaguguuccuaauugguuugcacugugaguuuucacaauuacuguuguuuguauucuuggauuugcaauaugauaauuugucuaugaauuuucucaaauaauuuauuaaagaugaacuaaaaguucaaaucucucagagggucuugcucuauaaaauaaauuuaaagcuauuuacaucuaauuuaaaccuauuauagucacucagucaggagaucaaccaaguaccagacacaguauuaagccggugagauaugggaaucuauagaguaugacucuugacuuugguaaauuuggaaacaacccacaaugcaugauucuacuuuucucccuuuuuaguuugguaccuaggucuaaaauguugaguuuuagaaaaguaagggucaacgggggauggaaaaacucaaaagagaaaauaaauccaaaggcugacaaaauugaaaauugauuucugaucauagcuucuauccucuucccuuucucccugccuccagcuuuugaguguugcagaaauaagaugucuucuuaggaaugugagggaaggcacugauucagccaaucaagaggguuacuaggauaccccauguauauucacaucauucuuuccacuauguguacugaguuuccuaugcaacagcugauagacaaucacacacacaaggcacuuaggucugauguggcuggaauaaguaaguucuaauggagaaauuuagacuugagaaauacauuuuuuuuuucuaaauagaauccucagauacuuaaaaacuauaaggauauauuuguugguauguauauuuguguguggagcacuuagugauaaagaacacagaagauuuuaagacaaguucacuuaaauuaguaguguuuuacgugguuauuccauugacuucugugguccuaauggcaccucugcacaggcaggaaugaacaguguguggaguaucugaaacugcauguaauuugccuagacaguuaauuaggccacuguuagguauccuuagaagagugccaagaugccugggaguguuuauuagcccagaugauaguugaaacaugagaacucaguuuuaagagaaauuuaucccauauacagacaccaaacccagacacuauugcgaugccaggaagugauugcugacaggagccugguauagcugucuccagagagggucugcgagagccugacaaaucagaggcauaugcucacagccaaccauuggacuuaaaggacugaaggagcugaagggguuugcaaccccauaggaagaacaacaauaccaaccaaccagaccucccagagcuuccagagacuaaaccaucaaccaaagaguacacauggaggggcccauggcuccaguuguauauauagcagaggaugaccuuaucuggcaucagugguaggggaggcccuugguccugugaaggcucgaugucccaguguaggggaauaccagguggugaaauggaagugugggugggugagggagcauccucauagaagcaguggaguuggggugagauaggggguuuacagaggggaaaccaggaaaggggauaacauuugaaauguaaauaaauaaaauauccaauaaaaaaagaaaaaaauaguacagcauuaaaaaaagagagaaaugaggcaagagccacagagcuucugaggcggcgccauuuucggcuccagacaaccggccaccuuccuggccaaagcaacacagcuucugggaaagauccuguuuugggccuucaucuucagccaggaggagguccaaacaccaaauaacugugcaccuucccugaaagaggagagcuugccugcagagacugcucugaccacugaaacucagaggagagagcuagucucccaugucugcugauagaggguaacaaaaucaccagaggaacaaucucuaaacaaagacaacuauaacaacuaacuccagagauugccagauggcgaaagguaaacguaagaauccuacuaacagaaaccaggaccacucaccaucaucagaacccagaacgcccacuucgcccaguccagggcacccuaacacaccugaaaagguagaccuggauuuaaaagcauaucucaugaugaugguagaggacauaaagaaggacuuuaauaacucacuuaaagaaauacaggagaacacugcuaaagaguuacaaguccuuaaagaaaaacaggaaaacacaaccaaacagauagaaguccuuauagaaaaacaggaaaacacaaccaaacagaugauggaaaugaacaaagccauacuagaccuaaaaagggaaguaaacacaauaaagaaaacccaaagugaggcaacgcuggagauagaaacccuaggaaagaaaucuggaaccauagaugcgagcaucagcaacagaauacaagagauggaagagagaaucucaggugcagaagauuccauagagaacaucggcacaacaaucaaaaaaaaaauggaaaaugcaaaaagauccuaacucaaaacauccaggaaauccaggacacaaugagaagaccaaagcuacggauaauaggaguggaugaaaaugaagauuuucaacucaaaggaccagcaaacaucuucaacaaaauuauugaagaaaacuucccaaaucuaaagaaagagaugcccaugaacauacaagaagccuacagaacuccaaauagacuagaccagaaaagaaauuccucccgacacauaauaaucaggacaucaaaugcacuaaauaaagauagaauacuaaaagcaguaagggaaaaaggucaaguaacauuauaaaggcaagccuaucagaauuacaccagauuuuucaccagagacuaugaaagccagaagagccuggacagauguuauacagacacuaagagaacacaaauuccagcccaggcuacuauacccagccaaacucucaauuuccauagauggagaaaccaaaguauuccacgacaaaacuaaauucacccauuaucucuccacgaauccagcccuucaaaggauaauaacagaaaaaaaccaauacaaggacgggaaccacgcccuagaaaaaacaagaagauaaucccucaacaaaacuaaaagaagacagccacaagaacaaaaugccaacuuuaacaacaaaaauaacaggaagcaacaauuacuuuuccuuaauaucucuuaauaucaauggacucaacuccccaauaaaaagacauagauuaacaaacuggcuacacaaacaagacccaacauuuugcugcuuacaggaaacucaucucagagaaaaagauagacacuaccucagaaugaaaggcuggaaaacaauuuuccaaggaaaugguaugaagaaacaagcuggaguagccauucuaauaucuaacaaaaucgacuuccaacccaaaauaaucaaaaaagacaaggagcggcacuucauacucaucaaagguaaaauccuccaagaggaacucucaauucugaauauuuaugcuccaaauacaaggacagccacauucauuaaagaaacuuuaguaaagcucaaagcacacauugcaccucacacaauaauagugggagacuucaacacaccacuuucaccaauggacagaucauggaaacagaaacuaaacagagacauagugaaacuaacagaagugaugaaacaaauggacuuaacagauaucuacagaacauuuuauccuaaaacaaaaggauauaccuucuucucagcaccucaugguaccuucucuaaaauugaccacauaauuggucacaaaacaagccucaacagauacaaaaauauugaaauugucccaugcauccuaucagaucaccauggacuaaggcugaucuucaauaacaaaauaaauaauagaaagccaacauucacguggaaacugaacaacacucuucucaaugauaccuuggucaaggaaggaauaaagaaagaaauuaaggacuuuuuggaguuuaaugaaaaugaagccacaacauucccaaacuuaugggacacaaugaaagcauuucuaagaggaaaacucauagcucugagugccuccaaaaagaaacuagagagagcacacauuagcagcuugacaacacaccuaaaaggucuagaagaaaaggaagcaaauucacccaagaggaguagaaggcaggaaauaaucaaacucagggcugaaaucaaccaaguggaaacaagaagaacuauuuaaagaaucaaccaaucaaggagcugguucuuugagaaaaucaacaagauagauaaacccuuagccagacucacuagggggcacagggaaagcauccuaauuaacaaaaucagaaaugaaaagggagacauaacaacagauccugaagaaauccaaaacaccaucagauccuucuacaaaaggcuauacucaaaaaaacuggaaaaccuggaugaaauggacaaguuucuagacagauaccagguaccaaagcuaaaucaagaucagguuaaugaucucaacaguccuauauccccuaaagaaauagaagcagucauuaauagucucccagccaaaaaaagcccaggaccagacggguuuagugcagaguucuaucagaccuucaaagaaaaccuaauuccaguucuucacaaacuauuccacaaaauagaaacagaagguacucuacccaacucauucuaugaagccacaauuacucugauaccuaaaccacaaaaagacccaacaaagauagagaacuucagaccaauuucccuuaugaauaucgaugcaaaaauacucaauaaaguucuugcuaaccgaauccaagaacaugucaaaacaaucauccauccugaccaaguagguuuuaucccagggaugcagggaugguucaauauacggaaauccaucaacguaauccaguauauaaacaaacucaaagacaaaaaccacaugaucaucucguuagaugcugagaaagcauuugacaaaauccaacacccauucaugauaaaagucuuggaaagaucaggaauucaaggcccauaccuaaacaugauaaaagcaaucuacagcaaaccaauagccaacaucaaaguaaauggugagaagcuggaagcaaucccacuaaaaucagggacuagacaaggcuguccacucucccccuaccuauucaacauuguacuugaaguccuagccagagcaauuagacaacaaaaggagaucaaggggauucaaauuggaaaggaagaagucaaaauaucacuuuuugcagaugauaugauaguauauauaagugacccuaaaaauuccaccagagaacuccuaagccugauaaacagcuucaaugaaguagcuggauauaaaauuaacucaaacaagucaauggucuuucuguacacaaaggauaaacaggcugagaaagaaauuagggacacaacacccuucucaauagucacaaauaauauaaaauaccuuggugugacucuaacuaaugaagugaaagaccuguauaagaacuucaaaguucugaagaaagaaaucaaagaagaucucagaagauggaaagaucucccaugcucauggauuggcaggaucaacauuguaaaaauggcuaucuugccaaaagcaaucuacagauucaaugcaauccccaucagaauuccaacucaauucuucaacgaauuagaaggggcaaucggcagauucaucuggaauaacaaaaaaccgaggaaagcaaaaacucuucucaaggauaaaagaaccucugguggaaucaccaugccggaccuaaaacuguacuacagagcaauugugaucaaaacugcaugguacugguauagugacagacaaguagaccaauggaacagaauugaagacccagagaugaauacacacaccuauggucacuugaucuuugacaagggagcuaaaaccauccaguggaaaaaagacagcauuuucaacaaauggugcuggcacaacuggcgguuaucaugcagaagaaugcgaauugauccauuucuaucuccuuguacuaaggucaaaucuaaguugauuaaggaacuccacauaaaaccagagacacugaaacuuauagaggagaaaguagggaaaagccucgaagauauggguacaggggaaaaauuccugaauagaacagcaauggcuugugcuguaagaucaagaaucgauaaaugggaccucauaaaauugcaaagcuucugcaaagcaaaagacaccgucaauaagacaaaaaggccaccaacagauugggaaaggaucuuuaccuaucccaaaucggauaggggacuaauauccaauauauauaaagaacucaagaagguggacuccagaaaaucaaauaaccccauuaaaaaauggggcucagagcugaacaaagaauucucaccugaggaauaccgaauggcagagaagcaccugaaaaaauguucaacauccuuaaucaucagggaaaugcaaaucaaaacaacacugagauuccacuucacuccagucagaauggcuaagaucaaaaacucaggugacagcagaugcuggcgaggauguggagaaaggggaacacuccuccauuguuggugggauugcaagcuuguacaaccacucuggaaaucagucuggcgguuccucaaaaaauuggacauaguacuaccggaggaucccgcaauaccucuccugggcauauauccagaagaugucccaaccgguaagaagaacacaugcuccacuauguucauagcagccuuguuuauaauagccagaagcuggaaagagcccagaugccccucaacagaggaauggauacagaaaaugugguacauuuacacaauggaauacuacucagcuauuugaaaaaaugaauuuaugaaauuccuaggcaaauggauggaccuggaggguuucauccugagugaaguaacccaaucacaaaggaacucgcacaauauguacucacugauaaguggaaauuagcccagaaacuuaggauacccaagauauaagauacaacuugccaaacgcaugaaauccaaaaagaacgaagaccaaaguguggacacuuuacccuuucuuagaaaugggaacaaaacacccauggaaggaguuacagagacaaaauuuggagcugugacgaaaggauggaccaccuagugauugccauaugcagggauccaucccauaaucagcuuccaaaugcugacaccauugcauacacuagcaagauuuugcugaaaggacccagauauagcucucucuugugagacuaugccggggccuagcaaacacagaaguggaugaucacagucagcuauuggaugggucacacggcccccaauggaggagcuagagaauuuacccaaggagcuaaagggaacugcaacccuauagguggaacaacaauaugaacuaaccaguaccccggagcucuugucucuagcugcauauguaucaaaagauggccuagucggccaucacugcaaagagaggcccauuggacuugcaaacuuuauaugccccaguacaggggaacgccagggccaaaaagggggagugggcggguaggggauuggggggguggguaugggggaccuuugggauagcauugaaaauguaaacgaggaaaauaccuaaaaacaaacaaacaaacaaacaaacaaacaaaaaacaauuagacacaaacucuucaaaugcuaguagugaccaggacugucacuuacaccaccagggccuuggugcccauuuucuaaaaaaaaaaaaaaaagagagagagagagaaauuugugcaucucuuuuuuucuagauaaauauuuuauauuuuauagacuauauaaucucccuuaaacaauuaccuuacucugcaccauuuaguaugcaacucagccauaggcaaagcaguaacguaucaguguguuuguguuuuaauaacacuuuacucacagaaauacuuagugggcuagauuugguccauaaucauaguaauauuuugcaaucccugaccuagggcucaauuuuuuugaccaaaauuacaaauaagagaucuacaaugcaaaugaacuuaaugucuagaaauauagguccaugacaccaucugaugauagucaguggguugguugaaaugcuaggggaaguuugcaagagggaaagaaaagaauguaaagagaugacaacuuuauaguaaaagaaguggguuuggaagaaauugugauauaacaccuuauugucccaaguaaauuucuaugcuagcuuuccccaaaccaaucuaauauaaucuauuauuuuucuguaauuggguaaacccuucugaaccccaagcucccuugauacuaagucauuaguagguauuagaauaaucucaagggugauguuuuaaaaucuuugucuuucuacuuuuuccucaauuucuuucacauuauugcuaauaugaucgggaaaugaauucugaucuacuaaaagugauaaagugugggaaggaguagcaguauaguugaaaccgagcccagugagcuacugugaaggaaaaggguuuggauuuugcuuggcaggaaaggcugaagaguucuggucggaaucacaaaaccagauaaaucagggguugggggaagauccuaaauagcauugaucaguauacagauguaaagaagaaacaaucacuguuuagcuaguagugauuuuuguucuuuggaaagauggccugacauugucugaauucuuuccuuucuuuuccuucuuuuuauuuuuaaugagaaauuacauguuuuaaaaaauauuuggucauucaauuucuaaauauugccaaccaaggaaaauaauauuuugaaugucaaauaucuaacauuuauuuauaggcuacauugucuauggcuaccauuuuguauucacuaccuugaaaucauuugauauccaaagggacacuacaauauguaccuuuuugggcccacuauaguacagaaugcaaacaaaggacuauguuaauuuggcaaauugguccagggucauccagguuauuggaugcuccagacuagguacuaauguuuuuuagagaaaaguuugucugcacauuguuauagcuaugcugcauuguuuaaaacgaucuguuauguguuuucuccaaagagcuauuuauuauucuguaaucuuuuuuccauuuuuuauugguuauauuauuucuuuacauuucaaauguuaucccccuuccagguuuccuucugcaaagcuccuaguucaucccccguccccccgcuucuaugagggagugccucugcaaucuuuuaaaaauuauuuauuauucuagguauauuuacauuguguguguacacgugugugugugugugugugugugcuacagugugcaaauaggggucaguuuauggggucaguuuuuuuuaauuuuuuuuuuauuuuuuuuucaguuuucuauuuccaacuuugcaaacguuuuauggauuagacucaaguuaccaggcuugcauggcauguacauuuacccauugagcaacucacuggaccaaauacuuauaaucuuacauaaugauguguaacacaaaaauuccuccuuuaaauauaauuauguaccgguccaggggagugaggauuauaggaagaacggaagacucagagacaaagguuagaaacugggagggcuguccagugaguauuuggacagcaccaaauauauuucucauagccuuaaaugcuuuacaguauugugggaaacaaaguuacaagccaacagagaccauggcugauguacauucaauaucuguaccuaucugggggcccccuaucgcucccuguuccuuccucgaagauuaacagaacauucagcccucaacuugagcuucaaguguaucccacccccucuuauuguuccaugcgucagcaggccaggaaaccucccaguagacccuggcuugacuugacucuuucugaaaugcaggcuuucacagaagcaggcaaaaauggcucuugacacauuuagaaggcaauuauugguaguaugcagugagaagauuuuuuuuuuauauuuacucaaaucgacauuuagaauaaaacauuagcaugauaauugacauguguggugguuuaaaugagaaugcccuuuagaggcucauauauuugaauguuugauuccuaguggguggaacuauuugagaauaauuaugggguguggcuuuguugaaggagaugugccacuggaggcaugcuuugagauuucaaaagcccgcacuguuuccaguuaguucucucucucucucucucucucucucucucucucucucucucucucucucucucucucucucucucucucucucucucucucucucuccuuagugcuuguggauaaagauguaagcucuuauuuaccacuccaucaucaugccugccuaccuggcuacugccacacucuccaccauaaucauuacaaacucuaacucuuugaaacuguaagcuccaauaaauuauuucuucuguaaauugccuuggucaugauaucuuguucacagcaacagaaaaguaacuaagacagaagucaguaccagggggugagcuauuuauguaaaaggcauggccaugcuauuuauuagagaaauguggaagauuugggggauuuagacuaagaaagugauugaauauuuuaaaugggacauaaugggccauccuuaauaggagcuucaaaggcaguaguguugaggucaguguggacuacagagacccaacuuaagaaauuucagaggagaacaauauuaacaacuagacuaaaagcaauugugauauuucuggcaaauaauguggcugcuuuuuggcuuuaucccaagaaucuaccugaagcuaaauugaaaaguuugggaauauuuuuguugacagaagaaauuucaagacaaccuuuauacucaucaugugguuauuagugauuacucuuaugcaggaccucaaugaaaaacaguaagcagggaaaaaaauacaaaauguacaguuuggggagaaaaaagaacaccuagaaauuuaguauuggagcaaggcuuguucugaaagcaaguaaggagagagaucugaugcaaaauggaguaaaggaaguuuuacccuuagggcaaggccccaccaaacuaacacugcaacuugugaaaggaaggcauucauguaaagaagccauuaugucaaguugugaaagugacacagccuggguuguguuggagacccaaagauguuaaaaauguuauagucuugugauaucugccaaggaaaucugcaggcagggaaugagaaagcuugaaagauaaguguguuacagucagcaaaagcuagaagugugaagguaucuacacccuuugacaucagacauggacuuagaggguuugaaguuuucucugcuagguuuuggucugacuuugguccaauauauccuuacuaugccuccuuuuuggaauaguacguauaguuugugccaucggauuaagaaaguaugcaauuuuuuauuuuugcuuugauuuuacugaggauuauaguuaagagauuuccuugauucucagaagagacuuuggacuuuuaaacuguauugagacuguaaaagauugugaggacuuuugaaguuggacuaaaugcaugagccuacgggaguggaagacaacgguuugaaagagaaugacuuugagggguuuauaugcuugauaacuuggacucuaguugguaaaacaguuugggaaggauuaggagguaugaccuuauuggaggagguaugccacuguaguagcuuuaagguuccaaagcccacacaauuccuaguuagcucucucuuugccucacacuuguggaucaagaugcaagcucucagauacugcuucagugucauucuuacuuuccugcuaccaugcucaccacuguaguagucauaaacccuaauccucugaaauuguaaccccucaacaaacccuuccuucuauaaguguucuuggucauugugccuuucacagcaacaaauaaguaacuaagacaacacauuuuuuucuacuuaacuuuuuugaguaauucuguuauggaaauguugaaauuauaaugacauuuguuuuuucuuuagaaguauuuuugcuguauuuuuauauaauguauacucugccucacagugugaugaagauauucuuacaaacauuauuuauucauaugccuuacaaaguuuauuacaagcuguaggguggcgaacauucuguuaagaguuaauacucggggcagcggggaacuaaaaaaaaaaaaaaaaaaaaaaagaguuaauacucuuggagccgggagugguggcacaugccuuuaaucccagcagaggcaggcggauuucugaguucgaggccagccuggucuacaaagugaguuccaggacagccagagcuauacagagaaacacugucucgaaaaacaaaacaaaacaaaaaauaauuaauacucuucucauucccauauguaauuaagucuuagaaacacacuauggaucuuccauagugugcuccaugaaccauuggucuagugaccuucuauaacacuuaaugcugcuucuuucauaucuaugcaagccuuauccuacuagagauuacauuuuuacuuuccuuacagcagaauguuauauguuugugaagaaaagcaauaugggaaacuuuaagacauccuuaaaaggaaaggauauauacuuuccuucaaucuuccggugacauaaucaaaauggcaugccuacuacuaccugccguauugcaugaacuauaguaggagguuauguagcaagagacaagccuuguucacagacagacucaugaagcugagauuccaagcuugccuuggcuaucuguccuuacuuguuacauagguuaaaauccuuuuaucucaacuaaggcacuuuuaaauaggucuuguuuauaucagucaaaucuauaucccaacuaaacugaugccucaaauuuuuucaaaauaagcaauuacguuaagaaaagagaggagggggaguaaaauguauaugaaaaugauaauggucuaagauacugguuucaauuuaaacaaugaaaauacaaauacauauaaaacuaaaugcacaauuuauguuaguaucuaauaguauguuuguuauuuauucuaguuuuuucagaguagcuauuuauuaagcaaauuccuuacugaagagcagaauuugguuuuaaacuuuacagagggagcauuggcauacugagggauacuuaagagaauaaaaaaguauuuuugguuuguuuguuuguuuugugacagggucucacuauauaacucuuacuggccuguaaacuuacuauguagucaaagcuggccucaaucucacagagaucugcuugccucugccuccagagugcugggauuaaagguacauaccacuauguguggcccagauaaaaugcuuuauuuguuugcuuguuugcuugcuugcuuguuuuuguuuguuuguuuguuuguuuguuuuuucaagacaagguuucucuauguagcccuagguagccuggaacucacuuuguagaucaggcugaccucaaagucagagauccaccugucucugucuccugaaagcugagauuaaaggcaugugccaccauacccagccagauaauauguuuuuaaaggguggcaucugguuaguaccauggaaaagucuccagaaaggcauaucagcucacagugacacuaucaucaaugguucuuaugaccaaagguuguuugagcaggcucuuguuuauuauaauucaaaagaauauuacauuacuaauacuauauauauauuuauuauuugggauuaauuauuuugggauuuuuuaaaucuuaaucucaaacauauuuuauugaaauuuugcuuuuuuguaaucuuuuaaacaaauguuuguaugcauacuaaaaccuucuuuucauuaaugaaguaaaagugaugguaaaaaaauauuucuuggguugugaauauugaaaauuuugauaaaauauuaccaaauauauuuuaucauuauuuguuaggaaaacaacucugucuucuucauuggcucuuuaaaaauguccuaauacaguaaaaaccguuuccucucuuuuaaguguuaaauuauauauauauauauauauauauauauauauauauauauauuuuaaauauggcuaguuguauauauauuuauacagauauauauauauagauauguguguauauguacauuuguaacugucuauuguguauugccauaagaauaugauauauacuuuuuauuauuuauuuuguagacuguuauacuuuucuuauguuuaauaggaauuuuauaaagcucaaauuuuaguuuuaucaaucuucuuuaaccuaucuaauuuagguugaauacgaaggcuuaaagcaugaaauuaagcgauuugaagaagaaacaguauuacugaauagccaacuagaagaugccauucgacugaaagagauugcagagcaucaguuggaagaagcccuugagacacugaagaaugaaagagagcaaaagaacaaccugaggaaggagcugucccaguacaucaaccucagugauagccacaucagcaucucaguagaugggcucaaguuugcugaggauggaagugagccaaauaacgaugacaagaugaauggacauauccaugggccucuugggaaacugaauggagacuaucguacucccacuaccaggaaaggagagucccuacacccugugucugacuuauucagugaguugaacauuucagaaauacagaaauugaagcagcagcuuauucagguaagagcuucauuuaaaucugcaagaauaaauucauguugaugguauguagcauguuaugggauuuuugacacacaaaggggagaacauguucuguugauuuuuuuuuuccuguaguugcuauaaugaagaaacugauagauuuuagaaaaugucauauuaaauucuaacaaauuacaaaauagaccccaaacuguuuuaaauauauuaucucauuuaucaagguauucuaucccuauaauaagcuugagagacauccaguauuuuuuauuuugauuaaaauuuauaaaaagucuuuucuagaagaaaaagcuaguuggaaaaagcuucaguuuguuuuaauagugcuuaaacuauucauuuaguuuucaaagaaaaaagaacacagaaguccccaaauucaacauauauauauuugcugagaucauaaucccaacaauagaagauuguuucccguuuucuucaugaaaaauucaaguggcuuggcuuccauaaaauuccauauuaugaauuagguauuuuuagauugacuuaccagaacucaaacaaggagacauuugaauuuaauuuuaaauaauggaaguguuggcucugcuguauacaugucuguccaacugcauugaguucauuauuggcuuuucccugaagugauucagacauugucuucugucauuacagguagagagggaaaaagcuauucuucuggccaaccuccaggagucacaaacccagcuagaacauaccaagggggcacugacagagcagcaugagcgagugcaccggcucacagagcaugucaaugcuaugaggggcuugcaaaacagcaaagagaucaaggcugagcuagauugugagaagggccggaacucagcggaggaagcucaugacuaugagguggacaucaauggcuuagagauccuugagugcaaauauagaguggccgucacagaagucauugauuugaaagcagaaauuaaggccuuaaaggaaaaauauaauaaaucuguagaaaauuauacagaagaaaagaccaaauaugagaguaagauccaaauguaugaugaacaagugacaaaccuugagaagacaucuaaggagaguggugagaagauggcccacauggagaaggaguugcaaaagaugacuggcauagccaacgaaaaucacaacacccucaauacagcccaggaugaguuggugacauuuagugaggaacuagcccagcuuuaccaccaugugugucuauguaauaaugaaacucccaauagagucauguuggacuacuauagacaaagcagaguuacucgaaguggcagccucaaggggccugaugaucccagagggcuuuugucgccaagauuauccaggaggggugugucauccccuguagaaucaaggacaucaucugaaccaguuucaaaggaaaauacagagacuaguaaagagccaaguccaacuaagacucccacaaucucuccuguuauuacugccccaccaucaucuccaguuuuggauaccagugauauucgcaaagagccaaugaauaucuacaaccucaaugccauaauccgggaccaaaucaagcaucugcagaaggcaguggacagguccuuacagcugucucgucaaagagcagcagcccgagaguuggcccccaugauugauaaggacaaggaagccuuaauggaagagauucucaaacugaaguccuugcugagcaccaaacgggagcagauugcgacacugagggcaguguugaaagccaauaagcagguaauacgcuuuuguuuuaguaugaaagcauacuaguaaaaagcuuucuuaauuuauuuccuuaauuuuguuaaaauuuuaguucaaagguaaguguucaaauuccugggcaauagagcaacaaaauacauuccaauaucaauuaaaauguaguuuuauuuuaaaguguguaagggaccaaggagauagcuugugauaaaggugcauugcugccaagccuaauggccugaguuuuauaguuaguuaguuaguuaguuaguuaguuaguuaguuaguuaguuaguuguguuauuaguguacuugagucaaaacugaagcauuagggaguuuuucuuaaauaccagucauuucccucuggaauaggauaauucaauaugaaucuaccugacaaauucuuugaugacugauuuauuuuccauuuuugaguuuuaccugagugugaguauucagauauguuuuuuucugguguguguguguguguguguguguguguguguguguguguguguguaugaaaauaaaacuguuuaucugaaacccauuuaagaggaaugcugaacagauauugguaugaugaaaagcagcagcaacauaugaacuccuuuuuuuuugcaaacacaggcaaugucaagaaauagaguaugcguguguaugcucuuuagagaaugaagauucauuaccuuuucagagugucuuuuucuuuuacucaaaucugagugaaacuauaccaauaugucaucuacuuucuauucgucaucuguuuccauuaauccauugauagaaauuggaugucuguaccacaagcagaaauauuuucacaauauaaacaugcuuuauauaaauuuaaggggaaaaugacuuaaaaucaucacuuuagagagguagaaaauguuaaggugaaugaagaaauuaugagaaaucugauuuuacuuugaaaucagaaaaaaagauuauugauguacugcuauaauucaaagacuauacaauguagaguaguaacuuuuugcuaggucugacucauauaauuuauuuuggagaauucucagccaagacauucagauaacuuuccuaaccucuuucugaaggaaaaaaucuaauaggaauagaaauagaaaucuagcuuguuugguugguuuuuuuuuuuuuuuuaaaugugaagaggcuuaauugaaaaggcaaguccuaccgggugugguggcacaugccuuuaaucccagcacucgggaggcagaggcaggcggauuucugaguucgaggccagccuggucuacaaagugaguuccaggacaaccagagcuauacagaaaaacccuggcucaaaaaaacaaaaaaccaaacaaacagaaaaggcaaguccuaacuuauaaauaagcauucauauagggguacaaaauaggacauaaaaauguuauuaguaaucuaucgugaauuuaauucaugucuuucuguacuuacaagacagaauauauaaaacauuuuagauugcuauaaacugugcuauaggaauucagaagagaacagagcauuccuaaagaaguguguauuuucacuguacacuacauucaagccaugacuuguaauggcuuaguaaauuuugugaaaauauuucuugcuauauauuugguacucauuuaaauaauguugaacaacugccauggauugauauagugcuuaugagccauuaauaauuucaaguaucaaaagaugacaucaguuagauauaggcauugugaaguguuaauuauuaagucuaauguggaaauuaugugguuuaggaaaagugggaaucaucuuguuuuacaacaaacaugauauauucucuaugagccuuguuuuauaauuuaggauuuuuuccccagaagcauggugucuucagauggaguaagauaguuguuauaaaguaucagcuauguacuuaauugugucaggugugaagauucaacaauauaugcauggucccuaccuuucagaagaggacucacacccccuugggaugagcaaauaauuagugugauguuacauauuuuuguauucaaguugugggaauauugccuucgaacaacuaacauugccuauaggaauuaacaaaaguuuuccaaagcaauuauaauuggguuuguucuuaagggguaagaaguauucuuccaugggaugaagaaauaauuucacacaaaagaacaguaaguagagggggacagauguguuagaaagaggguguucuaugcaccuaucuugugcuguauaaacaggcuguuuucagacauuugccaguggcaccuacugauucaauuuauguuuuucuuuaaucuccuacugugcuaggcuagcuuuugauuugaaacaauauucauucaaggaacuucagaaaugccccaaucccaaauucagacaacuauguuaauccauuaaacauguccacacuuucuuuuuuuucucugucacacacccacaaacacacaaaggaauaauuugaccacaauucauuguuuugagcaaguuuuauuuaaaaauuuagaaaauucuugauuucuuauuacuucuuugacuugaacauauaguucauuauauacucaugucauaaguggcuuauaucuuuuacuccauguuuugggcccccagaauaauaugggugacauaaaguauuugauuuuucacauacuucacuuggaauugguauuuuuucaaagagaauagcuucuugauaacaaccuguauguuuaaaguuucauuuuggcucucuaaaucucugaaaaucauacacugucaacaacuagcaugaacuguuuacuaaacuacugccaccacacugaauucugauacuuacugacucauaccaggcuuuaaagacaauuauugaaucaugacaugauuugacauuaaaggaaaaugucucuauguccaguguaugcauaugcuuaugcaaaauccaaccuaaucaguuuguuuccuuuuauaagagcaaagaauagauuugauauaaagaagugugugggccaguuguuucugaugugaggugguaagcacugugauuuuaugcuucagacagcugaaguggcuuuagcuaaccugaagaacaaauaugaaaaugaaaaggcaaugguuacugaaacaaugacaaaacugaggaaugaacuaaaggcuuugaaggaagaugcugcaaccuucucaucccugagagcaauguuugcaacaagguaacuuuuuucucucuaaaauuaaguauuccacaugggaagagcauugucgauacucaugaauaaauauauuuaauuugcaugaagaaaaugaugagauaccacguugacaaaucuaagauuagaauuauguuuuuggagcucaaggucacaugcaacugaaucucauggagaugacaaagagaaaccuuagacugcaaggcugcagguauugguuucuggguuuccccacaagauucauuggcauuuaguaauauauauauauauauauauacacacacacacacuauagaggcaggacaaagaauggaaagggaggcaagaucccauuuuuauuaaagaaauuaggguaauauucagaauuaagagaauacacauuucuucuuugggaaagaaauuuaaagggauauuuaaaugcucaguuuagaucauauuuuaaguauuauucccuugcauuccauuuucacagacauuaguuuguuucagguaacaauugccuuacuuuauauuuuaaaaauauuuucauguuaccaaaaauaauuaauccaagguccuagacuucauuuuauuuuucaguaagcucugauuuuucucauaauccacauagcccccauagucuugacauuaaagguuuguggaaauggguaccccgugaaccuaauguauuuuaaucauagauccuguuuuggguuuuuuguuguuuuguuuuguuuuucuguauaauaccucaaggauaugcugauuucaguuuguauaauauauuuuggauaauucucugagcucaucagcuaucugguagaacaugaaaaauaacuuaccaguaucuuaaacucaguagaaauucagugugaguuuucuucucauccgacuuuuuccaaauguguguggauggacucaggcuuuaauuucaguuaggaaauagcacagaacuugucuuugugccuccauauaaaaauuaagcugaaugaagauguccccaauggccugcuguaccugaaucaaacaaaaaucuuuauuuuuuuuuuuuuugacaacucacuguuuaauuauuugguugaaaacucacugaaauuuugauuuuuuuuuuuaacgugggggaaaucugccauauugaaaacauauuugcugccauuuaaaauaaaaccuguaaauacauauaaaagggaaaauauucuuuuuauuaauauuaucacuuuugauauaguagauauacuauagguauaacauauaacaaacuuuuugcaaaggauacaauguuauacaauagagacaaugauuguaauauaccuaaaguagugguggauauuaugugacauuguauuaucaccccaagcuuccauaauaacugucuuugagguuuaugcugcuuauuuagaauguccccuuacagauuccauugugaggcugaaucaccaauuacuaaucaugaucuacuguuuccaguugucuguuauuauagaguauuuccaaucuauugcuaggaagaucaguguucuacauuccagucaaauuuauuauaaucccuuuaucuaugggaaauauaucucaagacccccaguggauuucugaaacuaguaccaaacuuuauagaccacuauguuccccuuauauguagaugucccugaugaggcuuaaaugauauuauugacuauaauauauaauauugcuauauaaucauucuaacaguauugcauaauaaaaguuuugagacuacaauggacaucaauaucuggguugaggguaagagaggaauaccuuucuaauuaaauucuaauuuagcuuugccaggauuccuuccucaccucuuugcuuggguuccagaugcgaugaauaugucacacaguuggaugagaugcagagacaguuagcagcugcagaagaugagaagaagacucuaaacacuuuauugcgaauggcuauccagcaaaaacucgcccugacacagaggcuggaggacuuagaguuugaccaugagcagucccgacgcagcaaaggcaaacuuggaaagagcaagaucggcagcccuaaaguaaguggggaggcgccagacaccgugccuaccauagacacuuaccuccugcauagucagggcccacagaucccuaccauucgggucagcaguggcacucagaggaaaagguaugcaugcagcuauugucauagugugguacagugcacaggcuuuaguugauuguaaaaaauuaugugcuuuuacuguguagaauggagaaaagaaaagaaaaaggaaaaaaauuaaagcuguuaagagcuuugcuaaugcuggucuuucugccaccccauccacacauacugauuaaccauaacauaauuuucaacaucuguuaauguuuuugcugcuguuugugugcauaaauaugucucuuccuagccuccaaccuaaaaauggauaaaguggauauuaaaaaugaauaucagugaacauggacuguaaccauaucucuggaaauuaugcuuuugucauuuuuuauguaauugggcaaagauaugaguuuguucucuuagggaacacuuguccauaagacuaaacgugaugacuaauugaaaggucgugguuauauuucauaaaauggaauagaauauguauaguccuuuucuuaaaagcaaguuuuugugccuuuuuucauuggucagguuaguauugcucaaaaaccacuuuuaaggauuuuagugacuugaccuugugaccucuuaccaaguucuuuuuuuuuuuuuuaauauuuuuaaagauucauuuauuuauuauauguaaguacacuguagcugucuucagacaauccagaagagggagucagaucuuguuauggaugguugugagccaccaugugguugcugggauuugaacucugaaccuucggaagagcagucgggugcucuuacccacugagccaucucaccagcccucuuaccaaguucugguuguugaguuacuugcccuguuuuuaguuacuauaguuaaaguuguucauuugaggagcuuucauuuaagaaucaaauaauacauauauuuucuauuugugguucaaaaugucuauaauaaacuucuauuccaguauucagaguaguuuucaaaaaaggguuguauccugauaugaaaacuaaagaauuaccaaaaaaaaccuugauuuuucauauuuaaaagauaauuaaaugccaauauaacuaauguugucauuggugaggugcugaaagguaauuaaagucaaacuuuuuuguuuccuguauguauuuuucuuggaucuccugcaagacaauuuucaccuucccuuugugaucagagucgucccaggacuucaggggcuuccuaccuacagaauuuauuaagaguucccccugaucccaccuccacagaaucauuucuucugaaggguuccccuuccaugagugaacucauccaagggcaucggcucagcaaggaaaaaagguuaaccguggcuccaccagguaaacacuuuuuccuugggugcaugugaugcaaauggcaguuaagucaacagaucuccucuucucuagcccacaguuggacugugacaugugacuucuaccacugaagugaaagcucccuuauaguuagcuuccuguuuucucuuuccauagucagaacucaggcaugucuuaggauucuucaguuuuccaguagccuaggaaggagaaggagaguuggauaaugggauaggcagagagaaugaacaguagauacaacacagaacgcgcgugcaccugucuacaguucuguuguucauggcuguuccaucuugguaguuuuguuuucucuuaacauuaaaauuaauuuagcaaaagaagccauacuuauaacaaauuuuuagggguaauuucuuuuuuguaguaaccagaauguccaaauccuugacagugcuacuccuugggaacauucauauuuucauaucauacucucauggugacauuugauugauguuuaccagugugccccaguuuacuuuagcuucacuguuuuguacuuuucuauuuucccucaugaaaaggccuaauguggguaaugcagacuaucccuuaugaagucccugcacagaucaaagauggaaaacaaauccauaaagcaaaauaagcacaaggacagacauuaguuuucuacugcagggaacauaaaauuaaaaugaguuaaaauaguuguuagcauuuacaagaucaggaaugacacacgaacaucuguauuucuggccucuuuugcaagauuuuugaauguguggcagcuccuggcuggaucugucuuugagccugucagcugugcuguuagacacagcagguucuacccuuggcuguaguccccuaucacuuccuauugguuauaaccaucuuucuguacuugcuccuccacuuagccucugagagugccaccuuugccaaauuuuacuuuaauuuuuuuuaaacuucaaacuuaucuuaauuccuuuugaaaccccaaccuuugaaucucuuuuuuucucauuugauuuaugcuguuaacauacuaaucuggauuaaauauguggucaacgaggcuggagagauggcucagugguuaagagcauuuguuggucuugcagagaaccugauuuuguuucccagaacccauauaguagguaggugcagauccagggaaccaggcaccuucuucugaccuccaugaacacuaagcacacacaugguucacauacauauaugcugacaaaauauacauaaaaauaaaauaaauacacuuaauauaaaaaauuuuaaguguggucuuauugugcagcauauguuuaauguucuaagaauuuuugagggaaugaguaaugcuaaugauuaaaauuuuuuugaaaauagcuagaauuuauacacucaugcauaaauuacaugcauauacacauguacauaccuauacauaauguacaucuauacacauagacacacacacacauacacauauacguacacacacacacacauauaaaaccuauacacaaacuuauacauauacaucuguauauacauaauuacucuccugaauauuuuuacucucauaucuuaccuccuacuguucuagauucuuuuaaaaagcaccuaaguaaucugugagccaccaaaguagugaugauuuaccagggaaccuaauauggguaaaacucauaaaaaccuuucuagcuuuuuaaauggauuuaguaguacugccuucuuagaaaacaacuaguaugauuaauaaguaguucuguuguauuuaaauauuaggcaacauauuaauaagauuaaaguuaaugaauauuagcaauaacuauuuccaucauuguaugucuguucgguccuuauacccaugaauauguauuuauauuauuaucauuacauuguggaaguuuuuaacauuauaucauaaacuuuuucauguugcuacuuaguuuuacuuuuaagauuauugucuucaagcuuuauuuuuauuauuuuaaaauuauguguauaugugcacaugaguguaggugcccuuggaggucagaagagggcauuggacccccuggagcuggaguuacugaugauugugagccucccaacaaggaugcugggaacugaacuuagguacucugaaagggcaguaugcacucuuuaguugcugagcaaucucuccauuccuuuguaguuuauuuguauuucauaugcuauuauccuaucaaucauucucuccacuccuauccauuuucuuguauguguaggacccugcguggcuuaacuucaugcuuuccacuucucaucuuuuuggucuugggcucagaaguaagaugaugggcuaaaaguugaauguguuuaugguuuuugcuccauuuugguguugcuucauaaaaaaaaaaaucauauuauacucucuacccuaugaaacuguucacacauucuaaauauuucuaauaauuuacauacucuauaauuucuucaguuuuaagauagcauacaugggugaaaguaccauuacauggucuaaaaauuccuuaguuuugagaaacuaaaaaauaucauuagauaugaguauuauacacaggaucagagguauaaaugccauaagauucauaaucacaaauagaucuaaaaguuguuuucaugauaacuuaacauuuuuaucaacucuguguuucuagcuauuuauuugaaguuaaauugagugagagacaggguugcagaugcaggcguaucucugugaguucgagaguuccaggacauccagagcugugacacaaagaaacccugucucagaaaaaaaaaaaaaaaaaacaaaacaaacaaaaagaaaacaagagagagugugugucuuagucggggucucuauucuuguacaaaacaucaugaccaagaagcaaguuggggaggaaaggguuuauucagcuuacacuuccauacugcuguucaucaccaaaggaaguuaggacuggaacucaagcaggucaggaagcaggagcaggucauggaaggauguuacuuacugacuugcuccccuggcuugcucaggucccuguuuguuuguuuguuuguuuguuuguuuuucuagacaggauuucucuguauagcccuggcuguccuggaacucacuuuguagaccaggcuguccuugaacucagaaauccgccugccucugccucccaagugcugggauuaaaggcaugcgccacuacgcccggcuucagcuuccuuucuaauagaaugcaggacuaccagcccagggaugacaccacccacagugggcccucccgccuugaucacuaacugagaaaaugccuuacagcucgaucucauggagguguuucuccaagggaggcucguuucucugugauaacucuagcuugugucaagaugacacucaaaaccagucaggagagggagagagggagggagagaaagagagagagagagagagagagagagagagagagagagagagagagcaagcgagcuguuauagcccaaggaauaauuucuauuacauauuauuaaaucaaucaauguauuuauuuauuaauaauauuaauaauuucucauuuauguguaugaauguuucaccugcauuuaugucuguguacuacgggcaugccuaguauaagccuugaagcuaggagaggaagucagauccccuguuacugggguuacagacaguugugagcuaccaagugaaugcaggggaucgagcccagguccuauugaagagcagacaucuacuuagccccaauaucaaccaguuuaagccuuaauaaauucuuaucagaucaauauuuucuaaagaauucuagcuaggaggauuacuauagaaauugauuacucacacacaccaagcauaguucccagaaauaccuacuuuauugacaacauauauuaauuuuguuaaugugaaauauuguuugagacauauuuauuuaguuuuauucauguuuuuaguauguuauugacuacuauaaaauuuucugacagcaauauauauuaauuauuuuuaagaagcagucccuuauuuuagaauuuuugauaaauuuuguaaaauaaauauuuaacauauuuuauuuuaauaaacauacggauauuuauuuuucuguuugggggagaauucuggccuugccuguggcucugguucauucuuuacugaguuauccccugaaaucuuuucuuuuuuuaaagauuuauuuauguauuauuauauguaaguacacuguagcugucuucagauacuccagaagagggagucagaucucauuacagaugguugugagccaccaugugguugcuaggauuugaacucaggcccuuuggaagagcagucagugcucuuaaccgcugagcuaucucaccagcccccuuuuuugguuuuucgggaugggguuucucuguguagcccuggcuuucauggaacucacucuguugauuagacuggccucaaacucagaaaucugccugucucugccucccaaaugcugggauuaaaggugugugccaccacugcccagcuauccccugaaauuuuauaacuucuaguaguggcaguugcuuuauguguuaauuucuuauauauacuggugggcuaauuuugguuaauaauuggauucuaagauaguagauauaauuaauauauaugccucauuaauaggacaucaauaugaaauaacugguaauacaaccugcugauuauaaacuccuuugucacaacagaauccauuucgauuagaucucaucaggggaugggcuagucggccaucacuggaaagagaugcccauuggacuugcaaacuuuauaugccccaguacaggggaacaccagggccaaaaagugggaguggguggguaggggagugggugggaggguaugggggacuuuugggauagcauuggaaauguaaaugaggaaaauaccuaauaaaaaguauaaaaaaagaaaaaaaagaucucaucaggguugagaaucauaucucagcuuagccgauaacagaauaagacacaucagagugugugccaggagauucauaaggucaagaacaagaaauuaaagagguggggagaaggauucagcaguucauaccaguuucugcucuuguagaaucugaauuccauucccagcaaccaucuggcagcucauaacagucuguaacuccuauuccagaacacucuauuguagccuccucagguacugcauacuuauggugcacuuguauauaugcaagcaaaacaccuaugcacauaaaaugauaauaaauauaaaaacuguaauauccaaaaugaauucaagaucacuuaguaccuucccccuucaaaaaggacuuuucaaacuguacuagcaggccaaguacagagccagauaagaaagcuggcugacuaaacaaauguagaaacaguuuuagcggucaaaaugauuaaguuugcaacuaccaaaacaauauuagcuguucucagagaaauaaccauaacaagauuagcaauuuccuuaccccaccccaccccacacugaauucugaaaaagaccauaaaacacccuuuaccuuguugcuagaaucccccugacguugagcugugauguuaauaguugacccauaaguucaaaauguacuauuacuuugcugaccaaaucauaauagcccaccauggggcaagcaaagugagggacuaggccaaaggguuacuuagucacuauacaagccaaccaaugccugaaagguuuacuugcuacacuaaugagaauccuguugcucaaaucugccccuuaaaaagguauaaaaaguguguucuuuuuuuguucugggucucuccucuggccugcaugcugagaggggaguccccaacauguuggaucaauaagaauccucaugugguugcagcaauggugauuucugugguccuugugaguaagggucuuuugacgaacuccaacaucacaaguaaaagauauuauuuuuguauuaaauaucugauuuuguaguacuuuugcaagaugaacaacaaauuucaaacuuaaaaauuaaauuuccacuuuggacuugaauugauauccuaagaaguuuuuuuuuucuuuuucuuuuuuuaaagauuuaucuauuuauuauaugugaguacauuguagcugucuucagucacuccggaagagggcguuagaucuuguuacagaugguugugagccaccaugugguugcuggaauuugaacucaggaccuuugaaagagcagucggugcucuuaaccacugagccaucucaccagccccagaaguuucuuuuuuauauuguguuuuccacauaagaauuuuucccuuaguugccuuuucuaucuaucuuuaauuuuuuuuauauucuagucguuaugcuccccccauucugcucucugacaguuucucagucuccaagaggauaucucacuccacacacccccacaucccuccaggccuccccauucucuggggccucaagucccugaaggguuaggugcagucuuuucucacugaggccugaccaugcagucaucugcuauguaugugucauaggucuugggccagcuaguguaugccaccugauugguggcucagugucugagagaucuuggggugcagguuuguugagacugcaggucuuccuaugggauuacccuccuccucaaauucuuccagccuuucccuaauucaaccacaggggccaugucuucaguucauugcuuggaccuaauaucugcuucuaucucagucaacugcuuguugggucucucagagggcagccauuccuuuuuacauuguuuugacugucuucauugcuuuucccucccucuccauccggucuuucucuugcuucuuuaugauguuucugagcuaaugugagagaaugcuauuguucugaaaucuuauuuuuguucuuuaauacuuugaacuuugcugauuugaaaaaucagcucaccaaaauacauugcccuuagacaugcagccacuguauuagaucuguagucaacacauacacaguuuugcacugaaaaauugccuuuuacauuucacuauguccaaacaacuaguccauuuuucuguuguguugcaaaccuuauaugauuaaauuuguuucaaaaccauauuucuuuuauuaacaaauugcucacucauucuucagaauuuaacaaaauuaucugguaugugucaagcacuuuuuuugaauagccauuaccauguucuucaugaaaaugaaaauauauuaagaaagauagacagucaaacaaaugaugauguuaacagauauucuuuuuuuuauuacguauuuuccucaauuacauuuccaaugcuaucccaaaagucccccauacccuccccccccacuccccuacccacccauucccauuuuuuggcccuggcguuccccuguacuggggcauauaaaguuugcguguccaaugggcaucucuuuccagugauggccuacuaggccaucuuuugauacauaugcagcuagagucaagagcuccgggguacuggguaguucauaauguuguugcaccuacaggguugcaguucucuuuagcuccuuggauacuuucucuagcuccuccauugggggcccugugcuccauccaauagcagacugugagcauccacuuauguguuugcuaagccccggccuagacucacaagagacagcuauaucaggguccuuucagcaaacacuuacuaguguaugcaauggugucaucguuuggaggcuaauuaugggauggaucccuggauauggcagucucuagaugguccauccuuuugucucagcuccaaacuuugucucuguagcuccuuccaugggugauuguuuccaauucuaagaaggggcaaaguguccacacuuuggucuucauucuucuucaguuucauguguuuuacaaauugucucuuauauaucagguauacuaaguuucugggcuaauauccacuuaucagugaguauauaucauuugaguucuuuugugauuguguuaccucacucaggaugaugcccuccagguccaaccauuugccuaggaauuucauaaauucauucuuuuuaauagcugaguaguacuccauuguguaaauguaccacauuuuuuuguauccauuccucuguugaggggcaucuggguucuuuccagcuucuggcuauuauaaauaaggcugcuaugaacauaguggagcauguguccuucuuaccgguugggacaucuucuggauauaugcccaggagagguguugcgggauccuccgguaguacuauguccaauuuucugaggaaccgccagacugauuuccagagugguuguacaagcuugcaaucccaccaacaauggaggaguguuccccuuucuccacauccucgccagcaucugcugucaccugaguuuuugaucuuagccauucugacuggagugaaguggaaucucaguguuguuuugauuugcauuucccugaugauuaaggauguugaacauuuuuucaggugcuucucugccauucgguauuccucaggugagaauucuuuguucagcucugagccccauuuuuuaaugggguuauuugauuuucuggaguccaccuucuugaguucuuuauauauauuggauauuaguccccuauccgauuugggauagguaaagauccuuucccaaucuguugguggccuuuuugucuuauugacggugucuuuugcuuugcagaagcuuugcaauuuuaugaggucccauuuaucgauucuugaucuuacagcacaagccauugcuguucuauucaggaauuuuuccccuguacccauaucuuugaggcuuuucccuacuuucuccucuauaaguuucagugucucugguuuuauguggaguuccuuaaucaacuuagauuugaccuuaguacaaggagauagaaauggaucaauucgcauucuucugcaugauaaccgccaguugugccagcaccauuuguugaaaaugcugucuuuuuuccacuggaugguuuuagcucccuugucaaagaucaagugaccauagguguguggauucaucucugggucuucaauucuguuccauuggucuacuugucugucacuauacuaguaccaugcaguuuugaucacaauugcucuguaguacaguuuuagguccggcauggugauuccaccagagguucuuuuauccuugagaagaguuuuugcuauccucgguuuuuuguuauuccagaugaaucugccaauuaccccuucuaauucguugaagaauugaguuggaauucugauggggauugcauugaaucuguagauugcuuuuggcaagauagccauuuuuacaauguugauccugccaauccaugagcaugggagaucuuuccaucuucugagaucuucuuugauuucuuucuucagaacuuugaaguucuuaucauacaggucuuucacuucauuaguuagagucacaccaagguauuuuauauuauuugugacuauugugaaggguguuguuucccuaauuucuuucucagccuguuuauucuuuguguagagaaaggccauugacuuguuugaguuaauuuuauauccagcuacuucauugaagcuguuuaucaggcuuaggaguucucugguggaauuuuuagggucacuuauauauacuaucauaucaucugcaaaaagugauauuuuuacuucaucuuuuccaauuuguauccccuugaucuccuuuuguuguugaauugcucuggcuaggacuucaaauacuauguugacgagguagggagaaagugggcagccuugucuagucccugauuuuagugggauugcuuccagcuucucaucauuuacuuugauguuggcuacugguuugcuguagauugcuuuuaucauguuuagguaugggccuugaauuccugaucuuuccaagacuuuuaucaugaauggguguuagaucuugucaaaugcuuucuccacaucuaacgagaugaucaugugguuuuugucuuugacuuuguuuauauaauggauuacguugauggguucccguauauuaaaccauccuugcaucccuggaauaaaaccuacuuggucaggauggaugauugcuugaauguguucuuggauucauuuagcaagaauuuuauugaguauuuuugcauugauauucauaagggaaauugaucugaaguucucuauauuuguuggaucuuucugugguuuagguaucagaguaauuguggcuucauagaaugaguuggguagaguaccuucuauuucuauuuuguggaauaguuugugcagaacuggaauuagaucuucuuugaaggucugauagaacucugcacuaaacccaucugguccugggcuuuuuuuggcugggagacuauuaaugacugcuucuauuucuuuaggggauaugggacuguuuagaucguuaacuugauccugauuuaacuuugguaccugguaucugucuagaaauuuguccauuuuguccagguuuuccaguuuuguugaguauagccuuuuguagaaggaucugaugguguuuuggauuucuucaggaucuguugcuaugucucccuuuucauuucuaauuuuguuaaguaggaugcugucccugugcccucuagugagucuagcuaaggguuuaucuaucuuguugauuuucucaaagaaccaacuccucguuugguuaauucuuugaauaguucuucuuguuuccacuugguugauuucuccccugagguuaacagauauucuuguuacaaaaaggaaaacuaggacuauuagggauauuuuaccacgagagacacaugaauugacuauaaaaggugcuuagacuuuauuaaggagagaagaggguuguaguagcaagaagcaaaggaugaagauguggguaaugacaauguaaagaugugggagugugcagugaacagaugaggugcagauaaagauaaaagaaguugugugggcugaugugggcagugagaauguaggcaguguguaggcaugagugcagaucagugaggaaggaaaggggcucaauuuguaccaaguauuugguuagaacuuggucaggaguugaaugauggaaaggaaaggaagagacuagagaacagaggucuuuauggagguaaacagacugacuauccgcccugaacuuagcuaguaagcuuauuuuuauuguuuagguuaucuuuuuaaaaaacauauauuguuauucuauauuauguuaugcggguguucugccugcccacauaucuguauaccaugugaaugacguucccacagagaccaaaaguuuuuuacuucccuaggacuggauauacagagaguuuugagccauuuuuuuuuuuuuuuuuuuuuuuuuuuuuuuuuuuuugguuauugguaaucaaaccuagguccucuggaggagcacccagugcucuuaaccauguagcccucucuccagcuccacagcuaacaguuuaaauacuacgaucauauguucauuaugcaaagcaaucaggaugccaucugggugaugaacaggugaaauauguguaacaccugacaagauacuagggauuaugaaagugaaauuuagugauuccuuuguguacacagcuuguuuuuauuaucucugccccuuuaucuuucuuaguuuguauguggaaagacuuuaguaaauguuacuuaaaucuauuuccucaacuaacagucucaguaauuuguuccucuucacacauuuuauuuuucuuucauuuuuuuuauauuuuuuauuacguauuuuccucaauuacauuuccaaugcuaucccaaauaucccauuuuauuuuucuauagaaccuuuucuauuuauguguguuccacuucaucauaucacuguccugcauuuuuuuaacuuaguagaaacaauguucuguuuaaauuuguggucuuuccaaaacuucucucugaaggagugaauuccugaccuagugcauguuaaaugcguauucucuuauuaaacuacacucucagcucaaacguacacuuuuuuuaggcuguguuuuucuuuagcuugcacagaauucuucuuacaggagauggcuuaggcauugcaugucugugguuuggcaugugccaaaacaaaagugaauucaaauacuaauucacucaugguauaguacaguuguggaacacuugucuagcauucucaaggcuucauugaucaccacaaaauuaccagccauauuuccuuccaucuugucccaacacagcacacauaaaaucaauucagauuucaaauuguagugaaucaugaauguuguacaccauauuuucuuccacauuaauggcuaaugaugagauuuuuuaaaaagauguauuuauuuuaugugugugaguacacugucacugucuucagacacaccagaagagagcaucagaucccauuauagacaguugugagccaucaugugguugcugggaguugaauucaggaccucuggaagagcagucaguucucuuaacugcugagauaucucuccacccccaugaugagaguauaauacuuuuaaauaucuuuuuucuuucuuuaaguauuucuuuggaaauuuuacuucuacaggauacccuucagcauagaaugaucuugaauugagauaugcugacagauucuguuucucauucuaauaacaagacaacuaauugaauacugaaaaauaccauaauuuuuucuagacacuuuuuuuccuuuuguuuuguuuuguuuuuguuuuuguuuugagacaggguuucucuguauagcccuggcuguccuggaacucacucuggagaccaggcuggccucaaauucagaaauacgccugccucugcaucccaagugcugggauuaaaggcaugcgccaccacacccggcccuuuauggucuuauaaaagcauauggucaguuuuaccaucauauacauaaguguaaacauuauguauauuauuauuauuaagucuuucuaauaucaucuccacuggggagaaacagcagcuuuguccuuugugcucacagcagacagaguuugaugcuugauuucucuuguaagcuccuuauagauccaaaccucuuuggucuuugaaucucaggaucacacaaguaccuggcacacaguaccagucacacagcagguacucacuguauugaauaauauggguauaaauuguguaguuucucaacuuuauuagcuacacaucuaguauauaauauaauguguugcagaugugacuuaagauagauaauacauuaaaaacuacuuggcaauuuuugaauuuuauuucuccuuauagaaaguagaccucugccauaacuguauccacucaacuuuuguaucuuucuaaaagcauuccauacauaugcaagcaauuacauauaaauaucuacauauaugaauaccugcuuacauauuuauuauuaauagcacugauauaaucauaaacauaguuaugaaugcuguuuuucuuauuauaucucccucuuuccuagcaacucaucuuuuuuguuuauuuuuagccaugggaaaccauccaacugaagaaaacucuugaugaaagcuugaaauacuucucuguaaaauuggaguauuucuucacagauaacaagaauuauagcugucagacuguguaauguuuauuuuuuuucuuuuuuuuccauuuuuuauuagguauuuagcucauuuacauuuccaaugcuauaccaaaagucccccauacccacccacccccacuccccuacccacucacucccccuuuuuggcccuggcguuacccuguacuggggcauauaaaguuugcgugucuaaugggccucucuuuccagugauggccgacuaggccaucuuuugauacauaugcagcuagagucaagagcuccgggauacugguuaguucauuauguuguucugccuauaggguugcagaucccuuuagcuccuuggguacuuucucuagcuccuccauugggagcccugugauccauccauuagcugacugugagcauccacuucuguguuugcuaggccccggcauagucucacaagagucagcuacaucuggguccuuucgauaaaaucuugcuaguguaugcaauggugucagcguuuggaugcugauuaugggguggaucccuggauauggcagucucuacauggaccauccuuucaucucagcuccaaacuuugucucuguaacuccuucccaggguguuuuguucccacuucuaaggaggggcauaguguccacacuucagucuucauuuuucuugaguuucauguguuuaggaaauuguaucuuauaucuuggguauccuagguuuugggcuaauauccacuuaucagugaguacauauugugugaguuccuuugugaauguguuaccucacucagggugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuucugaggaaccgccagacuguguaauguuuagacuagggcuacuaaaauuagcagcacauauacuuuaaaacucuguaguagggacauuagaaaaauaauacguuacucaucuuuaacaguauauuuuauuuacuauagucaguaggagguuccaguauuucuguuucuugauuuugagcuguaguaucuccuaugcaagcacauuuuuauuugaaccagucaugugccaauucaccaguagcaucgcauaccauucaagaccuuacuucuaguagcuuugauuaauagaauuucugaauguaaaacuuuuguuuuucaccauguuuuccuggcuggccuauaacugacuaaguauacuaggcugaacccauagaaauccaccugccugugcuuccagagugcuaggaaucuaagcccagcuaauuguaacuuuugauaacuaauuucuaauuuuuaaaguaagaauuaaaauugcauauaauuuuuaaaaauuuaaccacuagauuaauuauuugcuacuguauauugauucuuguuuuuccucugacuuacaguauugcucuucuaaacacauuaaauguuugcauugaaagaaaagacaauaacaauacuuuuggguauuacauagccuaggcuagccucaaaauuacuauaaagccaagagggauuaucuugaacuucugauccuccugccuccaccuccuuaauuaugaaauuacagguguaagccaccaugucugguuuaugcugugcuggggaucaaacccaagacuuugagcauauuagacaaacuuuauaccaauuaagcuguguuauguuucuaaaaacguguaaaauauuccaguacuuuauagcauaguucccaagaagagggauuauucucauugaaaaaggggaaacacucauuuccuaggauaugucuauaauugcagcauuuaggaaauaggcaggaauucaaguucaagaccagccuggcguacauaaugaguagaauucaaccuaaguuauauagcaagucucaaagguuucaaaaaacuaacaucaugaacugaauauacaaaaagaucaguguuucuggauucacuaugaauucuuacaguguguuagauuuuauuuuuuucucaggacauuuauuacuuaaauguaguuacauuuauaacuacauuuaaaauuguaugcaaaggcuuacaaucuaauucauuaauacuuuguagucuuuaucaauacagcaggcauccaaaguccucugaaucaucauaguagggaauggacuuuucuacauucuaauucuugauuuaaaguccuuucugaauuuauagugaguuguguagggccuacaggcaaagucugagcucuucuaugaccauggugcaaauuguguauagcugugauguuccuggaaggcuuguuauagcuacuuuuuauucuuugauuuuuaacaauauagugaaaagacaguuacauagcauuuuuagauagacaacuuaaggugaccugugauuucaaauuguauuucuaaucaacuaaaaaacauucauuguguaauguagucauuaaagggcuuuguagcacuccuucaacucugcagguuuccucuagcauaacuguauguuccucuuccacauacuuucucuuuaaucaucuauuaaccuuguuaagauuuuugugguuuauguuaugacuaaaagguaugagauaaagaagaaaagcacaauucaaaugguugauuuuauuccuuuauuugcuggcuuuaaaaauucuuaaguugggcuugggaaagugcucaguugacaaagucucugccaggcaagauugaggaucugauuuugguucacaaaucagggcaagguuauguaugccuuuaaucucagcuuugggaggggagaggaauagacacagguaaauaaaucccuaguacugauuggucacacagccuagccaaaucaauaagcuucaaauucagugagagaaacuauccccucuacccccacaaaaguauaaagucauaaagauauggaacagucauguuauucauugucucuugguaaucaccuuuuagcuaaaaauaaggucagugguacacacauagauuucuaauguaaggauuuuguaaaaagucccaaaaauucauuugucuugccuuuagucacuaccagagcccagacauuuucucauuuauuuuguaaauuuagauuauguauaucccuuuaguaauacaaucaaaaaacuaggaucaccugucugugggcugccucuagaauugcccucaugugaucaccucaguuaguaaauauucuuuuuaaaaugugcuagauucucuguuacucuuaaacaguuauuuaauuuuucauuuaaauauuuauauaaaauauguacauauauuuuguaggauaaugacuuagaaaaugacugucaucuuaacuggauuuauuuuuagugaauguaaaaauugaaggagcuuuguuagcuuuuuuuuuuuuuuagcugaaaggggcauacuuuccucaugcuaggaacuuguuuacuguucuauugcccacaucuuccaguuuuuaaauucuaaacugcuccccaguuuuuaaucacauuuaaaaauuaaaauuaugucuuacuacuaauacaaacacagucucugaccaguuuggucaugaggauuggaauuagaauaagagcauguaccauuuuugucugguccuuggugcauguauccuagugaguacacuguuuaguucaucuuaaauacuugguuuuggcagcccaagcagucuguucuuuacuucauuucauaagauacuuuggaaaacaguauaguccuuuaguuggaguagguacuuauggaauaagccauacauaaugacauuagaaucaguuaaacaugauuuuuuucucuuuuuaugcacuacuugacauccaaagcaaaaagagguaaguugguuauaaacaucuaggugaaccauauuuuccauaauagauuuauucuugacuagcuuugccugaacuaaauuuccauaaaucaaauacuuuuacaucaagaagcuuaucauuguaaauuccuuuaaaaauuuguaaauaccuucuguaaaauuguauuuuuuaaaauacuauuuaaacauauuguuuuuccuguaaauucugaucuaauuuaaaucuuaggacauuuggaaacacuucauuuaguuuggauuauuguuugucugauaauguguauugcacauuauaugaacuccuuucuuaauauaagaaaaagaaaaacacagaacaaaagaacaccacaacaaaccaaaccaagaaacaaccgauacugagaaagucuuuaauuuugagauacauugauuugcugaagaggacguccaaucuucucagaauauucuccagugugauuuuucugcaauaauuuaaaaaggaaaauuaugaaauaaaaucaaacacauuuuauugagugguaucucauagauuuuucuugacugauauauaucuuuauaacugaacuuuuuagugaaguccuauaauuuguuuaacuuauuucuccugugucuuuguugauuaauuaggacaugaaaagaugaucuggauuugaugcaugcuucuuaacuuugaacugccuuaguaucuugaguuaacuguaccaaguugcauuguucuugagaagguuauuucuaaacaaagggucauauuugaaaagguguuugauugguaugagaaucuggcaacacaguauacuuuuaccucuuggugccacuguaaauaauuagucucuaucccuuuaucauccauuucuucauguucauuauuuauuccuaaauuguccagaagcaaaaaggugcaguuuauauauuucccuuuguaagauuuguauaaaaugaauuuuucuacaaacauuguuuuguuuuauugacuagccauaggauaucaugauauccuauggcaaguuaaauaaguuuuuuuauaauuuguaaacagaaaaaaaguuuuucucugcuuagcaaauaguuuuaauacuuuucagagugcaauaaaccuauaugcuauugucaguuaggaaaggcacaaccaaaugccuuuuaaagguuuguuauuuuugucugaauuauauuaauauuuuuugauauuucaacaagucuguaguuuuguucccugaagaauuuuaaugcauaaagacuauuucaaacuaucaaggauagaaagauuuaauggaguuugcuguguugaacacugagugucuggugcuauaaauuagcagauuauaucccagagaaguuggaaaugaugcuaucauuuuaucagagguugcuuucaaagaaacuaaaguguuucuaggacauaugauacaauuggcaaaaagggaugagauagccaacucuauguguuugauuauaaaugaaaguugaauugugaccaaccaaauguuggucacagcuaccuauuuuuauuagugucaaugucuuguucacucauuacuggaauuuugaaaauaucuuacugaauacaauuaguauuuauguguuucuaucauguccuuuuauuuuucucucuauaguauuucuauuucaaguuuuucucauguuuuccuguuauuucaggugauguacuugggaguccuuaggucuacuuaagaaguguacuugacauuucuuucuguuaguucaugaauacacuauuaauaacuuguagauuuagugaggaauaauuuaguauuguuauugauauauuuuaaaugauaauuuaaauuuuauuuuucugauuuaaagccuccaauuaucaaaaaauaauauuacuauauuaacuuucauauuuguauuagacauuauuccccuuuucuuauucuuuuguuaggaacauuuugaucacagaaaugcuugauucacaaacuuucuuccucaagugaaucuguuaaacauuuacaaaauauacauagagaaaaaauucacaaauccauuaagggaaguggaaucaguacauuagcaaauauuuugcaccacauugaaaauucccuacacaaacuacugugaggaaauaaguagccuuaauuagacauucuucaagcaaaguugcuaacaaaggccgauggaggugaguuuugacaaaacuuaaagaaguuaggcauuuucuucugggaugauggguaauucugcuccagacuagauagcucugaaagagaaagaacauuucaaauaaacauacagauaggagcaaaggcuuuuggaaacaaauucuuuauauuguuuauuuugaccuuucuuacuucacuacagcuaguuccuuuacuucuugaaguaaaaaaaucagucguaaccagaccugccuuuccuuuguccuguugucuaaucaguggagugugggcugcauguuuucacaaaaauucucucaccugaucuucauggaaauccugcaagacuauugauuaauaucaacacuuauugaguaagugaggguuaaaauuacuucuuuugucagcugggcagugguggugcuugccuuuaaucccagcacuugggaggcaaaggcagguggauuucugaguuugaagccagccuggucuacagagugaguuccaggacagagaaacccugucucgaaaaacaaaaaacaaacaagcaauaaauuacuucuuuugucacuuaguuacuguuucacaaagcaggaagccaaacacaaagucuuuuuaaguguguggcuccaugguagaguccaggcauaacguuuuugaggaccaaacauaccagagauaaauccauaccguauuaguuacuuuuauguugcuaugauacaaucucaugacaaaaagaaauguauagaagaguuuauuuugguuuacaauuccaaagggagagucuaugaugauaagaaaggcauggcagcaggugguugggucaggaaguuugcugacaacauuucaguacaacacaugaagcagagaaagccaacaggaaguuucauuaagcuauaaagucucaaagccuucccacaacaauguaguuccuaaaacuuccuaaacagcacuaaaaauggaggaccaaggguuuaaauauauaagcuuauggagacuuugucccccaagccacaacaaaugcuuaguucuuucugguagacucugaauaccaggcugaaaaggagaguugagcagcauaagauagagaaggcaguagaaagaugucaggagccaucauaggacaagcugauaacuagcaggugaucuuccugaaaugacuucacuuuguuuuauaucuacgaugaagcucugacagucaaggcccaagagaaaaucauuuuaggaaagauccugcuauuaauaugccuuuccuguuacuauuaaacauauauaacaaucacuagguuccuuuugagcacaucucuacagaucuacaaaaauguuuugucuuguagugaugcuauguagauaaauagaugacaucuuaauucuuaaugaugauccuauaagaauuucuaaaguuaaauuagugauuaauaagcucuuuuauagugggacugcuauuagauccuucucugcuagucaaaacugcaaugagaacugucaagucucccaugugucaccaguuaauugccucuuagauacuaaccagacuuucuacuacucagagcacauuccaagagguuguaaaacaauuaaccaaaggucauaaaaaagggaauuaaugauuuauuacaggugcuaggacagaagauaaaauauugacuggguuuaucuauacaaaccuuuacuaguaucuuaguuaugguuaacuuucaaugaaccuguggagcugugacaggugauagauguuuagucagauaauuauuccuaauggauaugcauguaaacauucucuguuguaaacuucuauuucaauuuaugauuuuauuuuaugugugaacuugugauaaacuuuuuaacaugugaucauguauucugaaagauguauaagugcugagaacaaaagagaagagucagaacugagcugaggagaacuuuuuuguacagaacacuucuuagacaaagaggagaagcaagaaaagaacuuuuuccuugccccacuuagaaucuuuccacuuuucccuuuucuuagguaguuuucauaggaaaauuuuuacaacuuaguaaugaacucuauaaucauuuuucaaagugucuuuuuuuuuuucuuccugugacuucuacugaaagcuacagcuguguaguuccuggugaaauagaacaaagaccacauuacuuaauccccuguuguuaggcuaaaggagucaauugccuaaaccagcagguuuuuacccucagaaagagcaagaaaguuuuuagggccuuuuagaaguuaucaucagcauuucaguauaguuagagaguuagaaugucuggagacccucagacuuucaagccacacaagaguccuacucugugccccaccucuacccuuuccaggcuaggaagcuccuggcagaaagaaugccaggaaauggugacagaagcuuuacuggguagaggcaggaaauaccuuguggaaugcucaucaccuaucaugauaggucuacauuaucuuccccaaguaccugaaugugucucuacuauguggagaguguuuuuguguuauuauccacaaacagcaaacuccuguguuuguaagcagugguuguaaugauucauuuuuuuaucuucacacacaguguauagaaguuuuuacuuuuauaauaauguaauuacccagauuuuauauucugucaucaguuuaguugucccuaauaacacugauuugguagguuuuuuuuuuuuguuuuuuuguuuuuuuguuuuuuuuuuugguuuuuugagacaggguuucucuguguagcucugucuguccuggaacucacuuuguagaccaggcuggccuugaacucagaaauucaccugccucugccucccaagugcugggauuaaaggugugcaccaccacgccuagcagauuugguagauuuugcuucuaauaugcagacaugcauacauacaugcauacauguauauauaaaacauaacauauauaaaaauauauugcuaaaaaacaaguguggauuuucauuuauaauuuguuguguccccuuauauauauuguugggauuugaguuuucuuugagucuucuuaaaauguauuuauuucuauccuugaacaacuuuaaagguaaagaaaugugagaguacuuggcuguuauggauuauauuggacugaugaugguagaaaguugguguuaccauugcaucuacuuuagaacacauuuucauuuucuuggacugugguuacaaaauaccacagaccaagcaacuuaaacaacaaauuuuguuuauuuguuuguuuaucuauuuucccacauuaaaaucuuaaauucaaggucaaggugccuacaggaggacuccuuggcuuucagguagccacacucuuacugcauccuuguuugguccuuccucugaguuauauacauuuuugugucuuucugaugucuucucagcacaaggauaugcaucauauggaguaggaccaaacuccauaacaucauuuuaacuuaaucaccucucugaaggucucaucuccaauuacaauccuauucagagguccuggguugagaauuuaacuuugaaaggauacaauucaggagcuaucauacuccauaugggcauuauacuaaaagaacauaugaagacagucaguaacuugggcuuaagcucuuaacucuguuacuuacuugcacccugugcugacuagauuuauaucacagauuauaugauuugacacaaauuagagucauuuggaaagacaaaucauaauugagaaaaugcucccaacagauuggucugcaggcaagucuuugugacauuuucuuagugauuuaaaugggacagcccauuccaugguguaugauguauggguagguaguccuggggguguauaagaaagcagacugaauaagcaagccacuccugcaugacuucuacauuggcuccuguggauuacaaguuuuaugaagaaauaaacccuuuccuccccagguugcuuuuggucauggccauuuauuauagcaauagaaaugcuaacagauccugucuuaguuaggauuuccauugcugugaaaagacaccaugaccaaagcaacucuuauaaagaacaacuuuuuuuuuuuuuuuuuuuuuuuuuuuuugguuuuucaagacagguuuucucuguauaguccuggcugauccuggaacucacucuguagaccaggccggccucgaacucagaaauccaccugccucugccucccgagugcugggauuaaaggcgugugccaccacgcccggcuuuaaagaacaacuuuuaauugggacuggcuugcacauucugagguucaguaucaucauggcaggaagcacagcaacguccaggcagacauggugcuggagaagcuaagaguucuacauuuucauacaaaggaagucaggagcaaacuguuuccaggcagcuaggaggagggucuccaagcccacucccacagugacacacuuccucuagcaagaccauaccucuuaauagugccacuuccuggaccaagcauauucaauucaccacaagcccuaagaaaaucacuuaacucuuugauauucaguucucuaagcacuaaaacaaccuuuuuuucucaauaaaagucauguagaaaaugaucaggcauaggcuucucuuacuuuccaagccucauuucuguauucuaaauaaaauuaaaucuauccgagugugguggugcauagucguaaucauauuacuuggaagacaaaggcaagaagauaccagcuuaagaccaacaugggacccuguuucaaaaguuagaaagaaagaaagagagagagagagagagagagagagaaucuauuugauugauuuuuuuuuaauaaggaucagagauccuuguaugaaagguauuuaguuuaugucuauagagcacuuccuuaacauuacaauucaccauuauauuucaucuuucuuguuuuucucuuucauucuguuucuuucuuuucugucaaucaaaaucagguccagguuuucagaaagaagaaagaggaacacuuuagaacacauaucaaaggcucuguuuuccuuucuauaagaacauaaaagaaguugucuccaugcuuugauauugacuguggaauaucaaaauaauccauguaucuaucaacuuuuuauuaaauaucugucauagauaaauauucuuguuuuuauacuauaguuuagucaccuguuaucgaauauugaccauucucugaaaguucauauuuuugguccaaaguuauaucuacuugaaaguugcaacaaugucauucuaugauagaaauuguucagauguauuuauuagauuuuuuauuaaaaauaguauacuaacuuaaaagacaauaaccaugugucuuacuaaaagaucuuugaaucaugaacuuccauuucucuugccuauauuuucucaugccuguuuuugagaauaugaguugcuauuuucaaaacaugaaaagagaagccagauauagaaguaauaccuauaauccuagcacucagagcugacaccauuagaucaugaguuugaggccaauggggccacagaacaaguuacugucuugaaaggagugagaagagcagugaaggggaggguucuuaucuuuuucuuuuuaauuucauugcugaaggaaagauacuaaaaagucaugcaacauaaaugaagaggugccaggggaaaaagagaauaugaaagcaauaggauagacaccuaaaugugucagagaauguggaaauaaaauuuuuauacagaagaaagaaaaguuuuucuaaacuuaagccucaaauucaagccugaucuuugacaaauuucaggaaauggaugcauucaucugcuuaauauacaguggugacagcuaaaagccaguucauuaaaaaugccuucuguuagacuaaacuucuuuuucauacauaaagccaggguaagugcuaugucugaaucuugacaaacaaccagcuguuuaaaauuuuuuaaggcaaauagagaauuaguuauacaauuuuuuacauucauaacugguuaaaaaauugaaaaucauccauuaagauguaugaaauagccuuauuguuaccagucuaaaaugaagauaucaaaguaaaauugccauauuuuugaauugauacauaaaaauaggagagaggcuuacauauuaaaugaguagaauucaaaagauacauuaaguagaaaaaagcuuaaaaugcaucagggauaaauauauaauguuuaaaaaguaggaaucagaguugcaacucagugguagagugaaugcuuagcacgcacaaggcccuagguucaauucccaaagcacaaauuauauaaacuauuucauuagaauuauaaacauauauuaauaauggcuauauauguguaugauaaguaugcccauauuuuauuggcauuuaaacauauauccauaagcacaggguagaagaaacaugacuuguuaucaccaucuauaaacaaagaaagauuggcauaaaauagcagugaaaugugguuuccuuuaaaugucauaaugauuuuauuuucauagaauuuugaugauuuugaugaggcaggucuucuguguuucucuccuguagucaugccagacuacauaugauuuuauuuucacacaccucaggguuaaaaaggugucccuggacuauguucuccaggguaagggagcuacgugauaggagaaugagagaaguugccaccaugucucauauuuggcauuaaggaaacucagagguucagaugguuauuauggacauuugaguaguacuggauguagcuuauggugcuaagagaaggagauauguaugaaagauacauuuccacuaagagccauggcuggauuagaccuuccaccuugaaaauaggcuuuaauaagucaugcuuuaugaaacuugugugacacugcucuuuucacagaguaugugguaaucaaggaaaccucuccuagagccucauccuggcaggcuguauacuccacagcucagacuguacucauauccuaaaugauauccauaguaucuugugggaugauggaagagccaaaaccuaauguucaaacucauuccauucagguuacucucaccgaucucaagcagccauuacucgguuucuggacucccaaaggcauuggucuuuaggaaauuaaugaauuuucuaaauugcaucaaaaagguuagaaguaguagaaaccugaaagaaaucuuuaaagcaagaccucuucuuuucuuccagggaaaucuauuguuuccagcaacccaaaccaaccaaccaaacaaucaaaaaaacuaacuaaaccaaaaccaaaaccaacaaaaacacaaaacauuauuccuguucuuggaugcuauaucuuguucugugcuuuugauguauuuuauuuucuucaaaucagugucucaacuguguagugauguucccucacuauauaacccugauacuuuuggagguaacugauagaacuuuaaguagccagaauauacagugcccaacacaugguaagcaauaaaugaguuucagaugcagucacuucuuccucaucaucaccaucuccauggcauguuaguguuaagugcucacugaauauguuugucuuucucaaugaagcagauauguuaucuuuguauuuuuguccccacugucuccaacauaaaguuaguaauuugauuauugaauaauugaaacuaucuuaauuaguaaaucacaguaucaacuuccacauaauugugucuuucaugcuuuaaaaauaauaagauucugcuacaguugccuugagagucugucugaccuagaagaucauagucggagcugaaagaucaggaacugaagucugagaaagaucuuuucuaucucccagaacaccugcuuuaccuugcagaguguauguuaaaauauuguguuucaguuuagcauaaagugggcauaacuaaaguuguguggacccaagaggaaagauuuuagagacaauggagucagagcaauguagccuuuaaaguuuuauucacaucaauaaaugguguuuuguacauuuggauucugcuuuuuuucucuuaaggacagcacuuagaggccgggugugguggcgcauuccuuuaaucccagcauuugggaggcacaggcagguggauuucugaguucgaggccagucuggucuacaaagugaguuccaggacagccagaaacccugucuugaaaaacaaacaaacaaacaaaacagcacuuaguuaaauauuuauaaauguaaauuauuaacaauaacaacaggugguuucuauauuuuuuauuuacuuauuauuauuuuagacagucucauuauacaguuuuggcuggcuuggaacucacuaugcaaaacaggauggccuugaagccaaaagaucugucuuauuuugccucccaaguacugggauuagacauauaccaccaugcccagcaaagugauuucuuuucaaaagagaauauaugacuggagagauaucucagugauuucuuaauuuguugcuuuuagagaagaccuaaaucacuucuacuuacaugguucacaacugccuguaacuguaguuccagagggaucugacacccucuucugaccucuguggguaccaggcaugcacaugauacacauacuauauguacauguaggcaaauacccauauacauaaaauaaaaacaaauaaaucuuuaaaaagguaagagaacauaauguucacuauaaauguaaagagcuaccaaaucaggcagcuuauuaaggaagugcuuuguggucuugaucaucugcuuccuaauuauuaucagaagggguauuuucaauguaugauaagccaugacugcauuggcagagaaauuauuucuggcauacagaagauuugaaaaauaauaauuuugauacuccaauugauucuaaggauugcuauucaacaaagucuaacucugcuuuggaaauguuucauuuaucccuuacugacaagcauaacgauuacagaguacauguucaggccuuuuuccucccauuguacuuaaagaagggcagcauggaccugguuaacuuuaaaauugccuaucagguggcucaauuaaaauucacuagcuuucuaaaauugucaauagaauuuuaacccaagccuguagaucuagaauuugagaugacguggcuuuauauuugcacauaucuaaacuguucaccaaagaaaaugcuuuaagaguaauuuucaagucaacucucauuuuuacuuuuuuuaaaagauuuuuuuugcaaaaauauuauguaugcauuuccaaauagccucuugcauguuucuaauauuaugaacccagugccagagagcagacugauuucugauggguuauauaccuauuuucuuggaauuguugauuaacauaauaacaaguuauaaaauuuauuuaaucuaaugagaguuauaguaugugauuuuaaaguaauaaaaacaaaacaaagugagcaccauuaauaaggcugguuuccuucaucaguccuguuuauuaaaauuuuauuauauaaugaaucaucuaagauuucugcuagcaauucuuuucaacacauacaaucaauuuccagaaaacuguaaauauaauuuucuuguuuaauuucuuguuaauaaaauauuguuuggcuuucucaaaauaucuguguuuaacaauauuacuauaugcccugacaauaaaaucuauuuccugaauauauuucauuuuagaacagcauaucuguuugcuaauuaaauaaucagcauuauguucaaguucaggaguuagaauuuuuaauauuaauagauucugauuuuagaguaaucaaaacaccaaauaugaauggccauaggacauaauguacuauuaaaaucuugcuacuaauuuuaugucauuaguuuuuuucuaagacauuaauuaaaaauucagucuuuucuauuggcauuagucaaggaaaaaaacacacccacaaaagaaaaaaaaaaaaccacacuuaaucuagauguuucuaaguaaacguucccguuccucacuaaaucucaggcagcugauuuaguuacuguugcuaacaccauugugucaucucuuuguauacaugucuaauuuauuaguuucuuguagauugucagcagccugcugccuccguaccgccacagugcucacaacuagcugggaggcaagacuacccaacggucagguaaauucacagguccuuccuucucccaccagcugcaugucagcuccccuucccaagaccauaacuaccuaugcaucuuuauguuauugcauguuuuucaugaauuggcuacaugacuucacccuuguucauauuuccaaugagcaugcacaggaguuagugcuaugucaucaaccacuaguugauagaauagaggcugcuucauuuccccuuugugagaaaauacuugaauuauuccaguguuucauugccuccaaucuuaaacauguaauuguuaaguuauuugaccuacuuuucuuuuacuuuuuuguccuucaaauacaauucucagguaaacaaacagggaaaauauaugaaauuauauauaaaacuuaucugauguccauucuaggacaguuuuaaugguuuccauuuucuguuuacucagucccauuguuaaaacugaauugaaaagccauuugugguaguacauaccuguaaucugagcaguuuggaggcugugguaagagguggaguuugaaucagaaugagguauauagugaguucaaggccagcuuuugauacagaauagcugucuucaaaaucuauaaaagaaaaagaggaaaggaggaaaauggagagaaaaacucaaaucugaauucccaaaagaauauuugcagugauuauuuucccuuuaucugaaaugaaguguuuuaaaggcauguuuaaaacuuccuugagccaggcagugguggugcaugccauuaaucccagcacuugggaggcagaggcaagcagauuucugaguucaaagccagccuggucuacagagugaguuccaggacagccagagcuauacagagaaacccugacucaacaaaacaaaacaaaacaaaacaaaacaaaacaaaacaaacaggaaaaaaaacuuccuugaguuccuaggcacugagaggagaguuugcugacaguucauauuugauuuuuaagcuguccaaaacaguuucuaguucccuccauccuaagugacuacccacggccuagaaucaucccaucagaacuuucucaucuccacagugucuuucauccucauuuacuugguuucuguugguaccaagccucuggaaucuggauaugaucuuuagagucuacuuacuaauauacauaaauguaucuuuuguucuccuaccagaggaggguuuguaucaagcaaggaucagcucaaacaugauuccaugugugugucuaagaugaguagcuguuauuugcagacuauauguauucuugccuuugcuggauaaucaccaauacagaaacaauauauccaaagcuaguauguuauguggucuauugccuaaguaaguagaacacugcccccaguguuguagacugaaccugugcucucucauauguuaggucaaggggucuacuacugagcugcauucccagcccccaaaguacauugauaaauagucacuagacagugucuucugauuaaugucucuuagaaagcugaucaauaccacuucaaguaagaggauauuuaucucagaacuauuuuauuuaucucagaacuauuuucuuuuuuuuuuauuuauugacuuuauuuuuuauguguauucuguuuguauauauuuauguacaccacauguaugcaugguacuuggggaggucugaagagggcauuggaucuccuggaagcagaguuagaaugguugugaaguaccauguggguacugagaauugaaccuagguccucugcaagaauaacauauacucuuaauuacugaaccaucuccccagccccucagaaauguucuuuacuaauguauugauggcauuuauaguaguagccaguucuguauaauuucaauuauauaaguaacugaauauuaguaugaaugcucaaguugaucugagagggauuuuauaguauaguauaguguuuggagacccggacaccuguagucuagauuccacaaagcagccucccucaauuggggcacuaggguagugucaaugcaguacagaugcuccaugaaugcagacuacaugugugaguaaaugggcuuuggagucagacuucuaccuuguaauucuaccucuuacauaccuacauguguaaucuuggaaaauugcuucuguuggcaaugaugaugaugauuuauaaaguaaggaagaaaauggacauuggaggaauucaaugaugaagggccugacaugucugcccugucugcuguuagcacuaacacuuuguacauugccaucccugaccaaaauuuuguuuauuuugugacaaaucuaguuuucuuggacagaguuguaauacuacugcuuuaagaauuuccaugggcuggcgagauggcucagcggauaagagcacugacugcucuuucaaugguucugaguucaaaucccagcaaccacaugguggcucacaaccaucuguaaugagaucugacgcccucuucuggaaugucuaaagacagcuacaguguacuuacauauaauaaauaaauaaaucuuuaaaaaaaaaaaaaagaauuuccauaaggcaguagugcagauguauuccuucuguucugagauuacuaaauuuaggugcuuccugucuccauggggggugauuuguugaaagaaaaacaauuuagagaauuacagacacccuaguuucuauccaaguagacauagcauauccaaagcagacuuuucuuucuuuuuauaguucacucaaagaaauuauuaaugcguagagguuugaaaggaguccucuucaggguggcuuggguucugaaugguuucugcugugagaggaucagagucaguucugcacugcccucuuacuccuucugggcaagaagggcaauauacaaccaacauuagaacucuuacuggguaccaggcaaggguaaauucuucacauguguuagucauugcgauuccuguauaagcuaaacagcuauuauacuuuucuaaaggaagaagucuagguuuaggcagacaaaacaacugucaggugccacauauuuuuuuaauacaauugagccaagugaccuaacaccuauucccuguccauuguagagcauggcugcaccucagauaaggaaccagucauuguaccuacaguugguaaaagaaagccuguuuaaguuaugcugacucaguuucuuucaauugaaaaguggauucucagugaaacaugagaaaauuuucuaggaaugcugagugaguucagaucagcugaguuucucauuuugaaaaaaaaaguuuacuucccuccuguuuauauguauauauuuauguaauuuuuguaacuuuuuuuaguacuacagaucaaauucagggcuauacauauguaaucuacucacauaacuuuuaagguguauaauuucuuaauaaacaguguuuuuacacuaaaaauguagaacuuuuccacauaugguuuuguuuuuugaaacauagucuuccuaugugguuuaggcuuaucaugaauuccuugaacucuaggcuucaagugauccuccugccccaaccauccaaauagcuuuaacuguagguguaugccaccauaucaaacauuuauguacuuuguuuuuuagcauugauuagaguuuuuauuugaauuaucauucacaaucuauauaaguaauauacaaggcauggaaaacaccacaaaauaauaucgaaauauaagguaagagcacaguaugucauuucaauaaauauaauucaaaauuuuuguacuuuuugcaggcugauucuauucuaaguuauuuaaaucuuuauauauaaugauguaaugggaaaugauguaaccuuggacauaauauauuaaauauauaaauuaaauauauaaaaauguuuacuaucuaucacaucugcacaucugcuaaguuguguuuaccaggaagaagaccaaaaauaaauaaauaaauaaauaagcauuuugaagauuuaccaagcuuccugaagauauguccaacuuaauaccugaaaaccucaguaaugaaguauuaagcucggggcuggagagauggcucagcaauuaagagcacugacugcucuuccagagguccugaguucaaaucccaucaaccaaauaguggcucacaaccaucuguaaugggaucugaugcccucuucugguguggcugaagacagcaacaguguauuccuauaaauaaaauaaguaaaucuuaaaaaagaaagaacaugaaguguuaaacucacuguuccaucaucuuccagugaaaaguuaacuuauuugugguaaaagcugaauaauaaaucuucuaaagauauuuagcacucaaaauugaaacuaaauuuauaaaauuuucuaauaaauaauauaucaaauguuuauuuuaaaaauaauucauuuaccugucagucaagaauauguuucuuacaaguuaauauauagaccuaaaauauacaugacauuacugcacuuuaugcaaacuucaaaugcuaauacuaugguuuaaaauauucuuccacuuuauaagaaauuugaaauaaugaaaauaauuuuaugucaucaugaaugaccaucaagauguugggccagcugaacuauaacccgugcucaggcuauugccauauuccucagcuagccaugcaaaaacacucuaggaagaagaguacugaaucauacaagguccuucaugcauaccaugacuaccauaauacuuacugcuugcuauaacuugugcuguguuuuauguuuaauuccauagagagaacuuuuuucuaacuuacaacaauuuacagaaagaaacacaaggucugaggaaugucuuucuaaauuauuaacuuguuauucccuuuaucauugacuacuaggaaggucaaguuuaaccuaacgcaauauuguuuuucuuuuaucauuaauuagauaaaucauacacuaucuucuuguuccuuguucuaccauuucauauuugcuacauuuuaaccauauagguugggcuuagucacagagugcuugcccaaacuguaugaaaucuugguuucauugcaaguaucaccaaaaggaaaaaaauuaggaaagauaauucuuaucauugaucauccucaucaauauagaacagcaguuuccuuuuaaacuaaauuuacagugggucaaagaguaggaaaggauguaaugucuagcuaaauauuuacauaauuaugauuuuauacuaauguucaacagauauaucugauugacaauuucaauaccaaaucuucaaaaguauuuguuuaauacaaauuuuaguuaacacauccaaaacauuaccuugaaauauuuagaugaauaauauuauauuguauguauauacacacauauauauaauaaguuauauaaaauacucccuauagaaauuaauuauaugauacuaaaauucauaauauauggggaauugcaauuuaaaaaauauucuuacugugcccuuucccuuuugcuagucacauuuuaaaacauguaagcccagauaugucuuauaauuuuacccuaggaaaucuaauuuuacuacuuuauuugucaauuauucaucaauacauugaaugaccagguucauuacaauuugaggcucucagauguggccuauugguuagaaaacaacaucauucacuuaacaauugcaaaaugucauaaaaauuaucaguucauuuuuuuucacaccaucaagccaaaguggaggacuccuuagaguaaacuuggcuucacaagcaaaugaacuaucuucuugagucucuacuaguaaacucuagucucuucuaaacucugaugucuugguccauuggcuagcaccauuugaaccacagugagcacauuacaaaugcagacucuagaguccuuuccuggcccugcuaaaucaaagucuccuuuaccaagaucuuugugugacuuguacccacuauaaaguuugauaaggacugaucuaaugacacuuuacugccaacucagagaucuaggcguuggaaacugcaaaaucugaauacuugacuuggggacaaguucauguaucuguucucaacguuucuuuuuacuuucuuauccaugcccccaugcuuugcuuuuaaaaccuucauuuuuauuuuuauuuuuuuggcaugcuuugguuuuaaacuauuuucuucacaaaauuucuguucauguguuuaaaauguauaggacaauaauuugacugucaguggacuugguuguuuaccagcuuguuuuuacuaacugccuucucucucauuuucaguccggacauugcccucaguaaggaacagccacauuccagcucacagugugcaccucuucauugucucaccaagccuccuuaccccuagucuucaucucucauggaugaauaucuggacugaagguuuuuuagucacagugagggcacugcuuaagaucuagcggguguuuucuucuuggauguuagauguauauguggauuccaguccaucauuuuugaagaguaaagagaguucagaagaauaaaaugaugcauagaccuucgugugaucaauuucugguuucucugaaucacagaugaccugcaaucaaauggcaacaguucacuuaaaacugaaaugaaacauguauuucagauaguuggcuucaccuccauagcauaaaaaagauccaagacaauguaaaauagauaugcuguaaaaucaucuuucccuauacuccaaagucagcuauagauguugauucuaauaauuuucauugauacuuacuuuauauuuuauuuucuguaugguuuauguuuauaaagauuauuucuguaagcagaauucauuuauuuuuaaagagucauaguuuacuuaguuauuuaaaguuuuaauuuaguuuaaaaucugaaaccggacagauucugguccuuuuucuugcagaaaauuacaaaugaggugcaucagaauguuaacaauaacuguuuugcugcuacaugaauauucuuuaugcaguuauuuucuaaucaguaacucauuaauugucaguuauuuuuuuaacuagguuucuucacuaaacauuuauuaaguaaaucuaagaaagaggcaaagcuaugauucauugacuuaaucaaguuuugaggguaucuuuaauuuuuuaaaauugcaguugaguagauagauauauuggugcugcuccuguguguguguguguguguguguguguguguguguguggucguauuaaagaaggacaaauuacuugaaggaaagaaauggugugcuuauuuaaugaccacaaauuuuuuaaacuuuuccaaauuuagggucuuacuauggguuucccacuaaaagggaucacaauaaaugcaaaaauauauacauauauaacuguaagguagccuuggcuaguuauuuuaugcagaaaguguauguuuuguuguuuguuuucuuuuucacaaugaaucuuccuugccaaaaaaaaaaaaaauagauaguaaaccuuagcucauugucuacuuuuaacaaacacucaggugccuacagucauauuauauugagauaagacauguuccuacuuaauuuacagauucugcuagguaauuuuaugacuuuauuuaaggcaauagaauuucauagaaaaauuuaguuuuugcauuauugagaaaacaaggacaacagcuaguugagcuguaaggucuaacuuggauuccucaguucucaagugcugcccacauaacugcgccuaacccugacuccuugucuuugucagguagccuuaacuuacauaaaaccauaaagguuuuauuuuuucauguaacaguaucuuuaacuuuucuucaaaacagaacuaguccucacuguuagcaaaaagaugacuaguuuuguaggacaccaacaauggcgauuuuagagcuacccagcuuguggagggaaagaugugcauguuuauggaguggugaccuaaggucagcugucagccacaaagcacauuacagaaauauuuuuuguuuguuauguuccuguugaguaccagucauaguuaccaaagcaacccaaagauuuuguguucuuuaucggauuaauaauagacccuauggaacuucucaucagucagaaucccuacaaagucgucccuccuguauuacuugguuguuccuauacauuuuccucauuuauugguguuaagucuaccuggugccaaucuuagugagacaguacagauuuuugucagaguucaauuaaagacaacuuccucuguucuuucuauucuuuucccccuuugcuaagcaugauucgaaacccaagugucagaauuacuaaguuaauuuuguauuugaggaaauaaguaccucaaagcaaguugugucuuugggcugggaacucaacaguggaucucuucucuguguaaccacuguugacauagcugcauuguguuugugaauagaguugacuucuuccaguaugaaauuuaucacugucuguuauaaacgauuuuauuauaguuguuuauuugaauauaguggaaauuuuuguuuugaaauauuacuucuauaaaauauuaauuuuaacaacuuuaauaagaagauauagaaauuuugaaacaaauuucucauuuucagcacaaaaguagguaauaauugcuaagcaguaagagacuaucauguauuuauguaguaacaucauuuagugcaguuuaaacugagcuguauuuauuuuuauuuauuuacggacccuuucaaugaauaaauguagagugcugauaaaaacgaguaccuauaaagauaauaucagaauguaaaaagugaaaacuggugaaacaaaaaacccaugaaucucaauaagagaauugaaggugcauuugauauuaaaauauaaaguaaagaaauucuacaaaugcuaauuguuguagacauuuugaacaaaggugagaggugauguuuaagaucaguuaucaaaguaaccaacuacuguuauaaaauuucauuacauuguagugcgugcauguaugugugugugcucacccacaacuacuguuauacauuucauuacauuguagagugugugugu

SEQ ID NO: 3499 - RNA, 10164 nt, Mus musculus
ucuagcggguguuuucuucuuggauguuagauguauauguggauuccaguccaucauuuuugaagaguaaagagaguucagaagaauaaaaugaugcauagaccuucgugugaucaauuucugguuucucugaaucacagaugaccugcaaucaaauggcaacaguucacuuaaaacugaaaugaaacauguauuucagauaguuggcuucaccuccauagcauaaaaaagauccaagacaauguaaaauagauaugcuguaaaaucaucuuucccuauacuccaaagucagcuauagauguugauucuaauaauuuucauugauacuuacuuuauauuuuauuuucuguaugguuuauguuuauaaagauuauuucuguaagcagaauucauuuauuuuuaaagagucauaguuuacuuaguuauuuaaaguuuuaauuuaguuuaaaaucugaaaccggacagauucugguccuuuuucuugcagaaaauuacaaaugaggugcaucagaauguuaacaauaacuguuuugcugcuacaugaauauucuuuaugcaguuauuuucuaaucaguaacucauuaauugucaguuauuuuuuuaacuagguuucuucacuaaacauuuauuaaguaaaucuaagaaagaggcaaagcuaugauucauugacuuaaucaaguuuugaggguaucuuuaauuuuuuaaaauugcaguugaguagauagauauauuggugcugcuccuguguguguguguguguguguguguguguguguguguggucguauuaaagaaggacaaauuacuugaaggaaagaaauggugugcuuauuuaaugaccacaaauuuuuuaaacuuuuccaaauuuagggucuuacuauggguuucccacuaaaagggaucacaauaaaugcaaaaauauauacauauauaacuguaagguagccuuggcuaguuauuuuaugcagaaaguguauguuuuguuguuuguuuucuuuuucacaaugaaucuuccuugccaaaaaaaaaaaaaauagauaguaaaccuuagcucauugucuacuuuuaacaaacacucaggugccuacagucauauuauauugagauaagacauguuccuacuuaauuuacagauucugcuagguaauuuuaugacuuuauuuaaggcaauagaauuucauagaaaaauuuaguuuuugcauuauugagaaaacaaggacaacagcuaguugagcuguaaggucuaacuuggauuccucaguucucaagugcugcccacauaacugcgccuaacccugacuccuugucuuugucagguagccuuaacuuacauaaaaccauaaagguuuuauuuuuucauguaacaguaucuuuaacuuuucuucaaaacagaacuaguccucacuguuagcaaaaagaugacuaguuuuguaggacaccaacaauggcgauuuuagagcuacccagcuuguggagggaaagaugugcauguuuauggaguggugaccuaaggucagcugucagccacaaagcacauuacagaaauauuuuuuguuuguuauguuccuguugaguaccagucauaguuaccaaagcaacccaaagauuuuguguucuuuaucggauuaauaauagacccuauggaacuucucaucagucagaaucccuacaaagucgucccuccuguauuacuugguuguuccuauacauuuuccucauuuauugguguuaagucuaccuggugccaaucuuagugagacaguacagauuuuugucagaguucaauuaaagacaacuuccucuguucuuucuauucuuuucccccuuugcuaagcaugauucgaaacccaagugucagaauuacuaaguuaauuuuguauuugaggaaauaaguaccucaaagcaaguugugucuuugggcugggaacucaacaguggaucucuucucuguguaaccacuguugacauagcugcauuguguuugugaauagaguugacuucuuccaguaugaaauuuaucacugucuguuauaaacgauuuuauuauaguuguuuauuugaauauaguggaaauuuuuguuuugaaauauuacuucuauaaaauauuaauuuuaacaacuuuaauaagaagauauagaaauuuugaaacaaauuucucauuuucagcacaaaaguagguaauaauugcuaagcaguaagagacuaucauguauuuauguaguaacaucauuuagugcaguuuaaacugagcuguauuuauuuuuauuuauuuacggacccuuucaaugaauaaauguagagugcugauaaaaacgaguaccuauaaagauaauaucagaauguaaaaagugaaaacuggugaaacaaaaaacccaugaaucucaauaagagaauugaaggugcauuugauauuaaaauauaaaguaaagaaauucuacaaaugcuaauuguuguagacauuuugaacaaaggugagaggugauguuuaagaucaguuaucaaaguaaccaacuacuguuauaaaauuucauuacauuguagugcgugcauguaugugugugugcucacccacaacuacuguuauacauuucauuacauuguagaguguguguguguguguguguauacacgcgcacacacacacacacacacacuauccacaguaugugugggaaagucagaggaaaaccuacagaaguugcuucucucccacaacuguauggaucccagggauugaacuaagauuaucaggccuaguggaaaacaucuuuaccugcugagccaucuuauugguucccacgguuuuguuuuugguuuuuuaauguaagcacaauuacaaagcugaauagaugaauuaguaugcagaaaugcuuuuucacuaaggauuuucauuaaagcauaauaguaaaauaaaaagaagcaauaaauugcuuuuggccuaagugcuuaggagcaugaacaaaacuuuggauguauaaaccuuuugcauaucuaauucuggauuuaaaagaagagagaggaggaaaaaugaauuuugaaaacuucuagagaauauaaaucuauaaaggaaugaagaaaagacuuauuuggaaauuauaauuuauauuugccuaaaggagaagagguacaauaaugaaauccaacaaaaagaacuuaacaaaugacagagaguagcuacagagccuauaugacuaaaugagaaggguuaauauuaccuauaggaaagagauauuuuaaaguggaaacuuaaucauucgauagcuauaaagauuuguuuuuaaaaacuggaaugauacugguagucuuguaaguauagacaauuuacaauaauauauaauccuaggaguccacaauucuaugauucuuuuguuuuaaaauuuaaaauauauugaauuuuuacugauuggucauagaaaauguuuacuuuuaaacuaggauaacaaucuuaauuuucuaagauauuuauuauuuuuaaaaggauuucuuuaaagguaucugaaguauagcaacuccauuuaaagaagcuucagugucagagucuaaaaaacaaauauacccaagaaaacuucauaaauacaguguaugcaaucucauagaggagacaaauacuuuuuaaauuuuauucacacacaaagaucuucugucuuuaacauuugcuuuaucuaugcuguagaacauguucuuauacagauaagcccuucucuauuagguaagcaugaacaauuggucuacugaacuagcuaagaauguggauguucccucauauacuauauugaauaaaauccucuccaguaaccaaguacagguuacaaauaauuauaugaauaaaucaaauauauuuucuacucugauaaaugucaacuuuuauuguauaauucagacaaaagauuuaaucuuucuuacaaagaaaucagugggcaggaguagggaguaacucagccagggguguuugcugaaccugugugagaggauagcacccacugcacugcaaaacaaacaacaaaacaaacacugauauuucccugaauaaaauccugcucauucaauccaaggaugucacaaaugaauuaauauuguacauauaaugaaauuuguaaaacccacaauguuuaaaacuuuuguuuuuaauaaaucagagugauuuaaauaaccuugcauuaaggcugcaaaauuuaaauaaauuucaaauaaagcugaaagcuaucgaagucaugcuagucagcauggccagugccaagguugaaaaguacuuacuucaaaaucaguguccuagcuccugaguuaccauacccauuuucuguaauaauaacccaagaugaguuuuuugaaaauaaauuuaucuuuaaauguuauuuuaaccaccauagucccuaauaucuuguaaccuguuuuuauuuuaauacccaaaagauuucaaauaagauaucuuguuuauuacucaagauauaaauuaaugagauaauuaguguuaaaauuuaaaauguucuuaaauuugggauuuuucagaaaugacaaucuguuuauaaggagcaaaauuaaccuucauuaguguaaagcaagaguauaagacguuugcaugaaauauuucacaucauguaagcuuucccauauccauaacauugacucuauauagaaaucuuacuugcugugugaucucgccauuaggaaugaaggaggcuguuacaugcacuggaucuccuuuccauacugaagcgcauggcuuuguuccucaaauuuauuuuuacaucucucagauggaguuauuuaauaaucugccacaauugaacugaagcuuaaaugaccugcugauucggauaauuucuuugauugcucuacauuugcugagaacuuauuuuuauuuuaacuucugcacauaaucagucucugcucaguauaccucucuaaugagaccguugagaaguaaauuugaugcuucuuaguguggauguaugcuuauuuuuuuucaaaaaaauaauuuuuuuuuacauuuuauuuuauuuauuuauuguuauuuuuuuagacagaguuucucuguauacuccuggcuguccugaaacucacuuagaacaggcuggccucaaauuugcagagauccaucugccuuuccaaaaaagucuuuaucagagaacuaugaaguuaagggaaauaacacuguuguguugacaaaucuuuaucuuguaagggagaaacagaaggaaucauuggguucauagcuaugacuaugugucauaucagaggaaauacuuuuuaauuuucuugccacaaaacuuuuaagcucaaugguuugacuguuagagucaauuaacaauuuuugaaaauauuuuaugacuuuuuuguaauauauucagugucuuuauuugcauggcuaugcauauaugaagaugugacucugacguugugauucuuucccauguuaaaauuuguguuguguguggucaaaccuaauuuuuacacuguaugauuauccuuguaaugauucaguuauuccagccuuuguuauuaugccuucggggaguaaacaaugugaaguguuucuaucuaauaauaauaauaccaugaaaacaugacugaaaaacuaauuuaagaaaugccuuucuugcuaauuauuuuugaaauccaaacaucagcgacauuaucaaagacacgugcauuuaaguacaaaaaguucuuauaaauuuauugcuugcuguucuuuuuacuuuuuuguagauaaucccaagugaaccucucaagggagaauccuuaugucauauguuuguuucugugcacucaauauuugugaaaggcaccccacugcuaaggaaauaacuagauacuaauaauuauuaucuugguuaaucuuaccaauugaccauacuguauugcaaaacuuuuuccaguaaauaaacugauuaucuuuuguuuauuucaucaauguuaaauuuuuauuaguuuacaauuuuucuguuugccauuuuuauuuauaccuacaagaaauaaaaaguauaggaaucacuauaugauuauauauuuuuauccaauauaagaccuuauuugucuuaacauuucugcauauuuugugauguguaucaacuucauuuuccauuuuccaaacucauaauguuuccuuaaaggguauuuuggcaggaaaaugcacuuagcuaaauuaaacuagaaauguauuaauacaggaaacacuguuuuaaugaaaggaaaaugacacuuuauuauggagaugguucuuuuuuucuuuuacauaggaaagagcuaagccagcaaacucgagggaggucacuuuuacuggaccuacaauauaaaucaugguagaucagcugcucugaggaucaucuguuuugauucuguuuuauuuuacaguggugcaggguuaaggaggaaacaggcaaguauggguuuaugugaagugauaaugaacaaaaaugaaacccuuauaacugaccaaauuuaugggccugguuaaaguugccucuucuucuuuggcacagaaaacauuaaaaauaaagugucuuaaaaaucauucccuuuucuaaaaacuacuguuuuuguuguuuuugcuuuuguucuaggagguuugaccuacaaaucuauuugauacuuggccuuuucuuauacaguaauaccaauaguuuuuuacauuccuaaagcguaagaauugacuagccuucagaaacaucaaaaaagucucuuuuaauccaguuacauugacacuucucugucauaguuacuggaaauauggagacaggaggaugggaaagaucacuugagcucacaaguuaaggccaggaagauuuugccucaagaacaaaaaaagaggaaaagaaagucuuugcugguggcccagcccccuacagucaaguacugaggcaggaagaaggccaaaggcugaugaccucugaccuuuaacucucucuuacuguucuggaaggcagaagcuaauggcuucuggcaauuuaacccucucucucucucucucucucucucucuauauauauauauauauauauauauauauauauauauauauauauauauaauuuuggggguaugaagcuuuuuagugguuuucugcuauaucuuaggcuuuuagguuaauaucuaguaugcauaacuguucccuccaagauuaaaucauucaauccuucaggaaacuccuuaaaacaggaagguaaagaacucaaaauagaggucaucucccaucagaagaacugggcuccaagagauaacaaccaaacaugacaacauaaaacauaauaagacaaagcaacagccuucacaccaaaacagacaaggcaaccuaacaugagagaaagugugccaaaagcagacaaaauagucagagacacgccugcucccucagucugcucccaugacugaggcuucauggccagaaaccacauaguagcucaccauuugcugauucuccagucccaagaaucuccugccuuuuuuuggucucuguugguacugcauacagacacaugcaagcuauauguauguguguguguguguguauauauauauauauauauauauauauauauauauauauauauaucaaagcuuaaaaauacaauucuauauaaugauauuauagcccugagacagacagcagucagaucuaguuaaaaugaugucuuucugguccugcauggaagccagccuacucagaggcuaaagcagcccuauugugaaguuaaaauugcucagcaaagcuguuccucuaagaaagguguccacaguucugauaggugacuuugcuuaauguuuucugaauuuguggcauggauacauuuaucuguuagaucacacaucauaaucaacaggaagcauugucuccugagcaauuuacucucacauugucauuuacuggauuuucaucuuagaucuuauaauauaaggugaacauuccagaggcauuucuguauaucauuuuuauaguuuacauaucuuucuacugacuuugagcuaagaauaaccuuaaauagcucagccuugacauugugaccacauucaggagaggauuuugcuuaucauuuauaaaaguaggaaaaccuguaugugaacauguugaauuaacuaaaacugaaagaguuucaguacuaugugugauuuuucuuaauuauagcuuuugaagugggaaaccccuucuuuaaucuagauuuuaugaggugauaaaauccaccuuuaaucuaggccacagcuucugguggcagccuauaauauauaaaggacauugaagaugguagcuguuucucuuugucugcuugcccuaccucuggcuagcaaguuguuguuguuguagugguggcgguggaaguggugguggugguuugguuuuguuuuuuccugguacuaaagccuucuucucuggaauucuggaauauacuguagaccaacuagcauauccagccacauggucugaacacuacuggauucuucaacuuuccauugguugacagccauugucaaacuaguuggaccacagcuugugagccauucuaauaaauccacuuucugcauacauggagagaguccuucuaccaguucuguucaucuagagaaccuucacuaauacuccugucgguuuugugguggugguguuguuuugguuuuuuuguuuguuuguuuuugauuuugcuuuuaaccuucccacugaggacgaugugccagcuaacaauaguguucuacaguguuugucaucuguuuccugcuuuguuucauaccuaccaggugagaaguagcugcaguuuaccugaacccagcaugaagccacaaagcucuuguuuccuaaaauccuucuuuguuaauauucugggcacccuuccacuugugggacagauuaauaacuccacugcaaguugaguaacggguuaugcaugcuaucuaccuugauuccaggaggaagaaggggaaaugccuaccgagugcugugaggggagcucagucaaucucugaaguagguaccuggugagcacagggucacugcccacaaaggggaggagcacauggcugaguagcaggaacugaagugcuggguccuccccggagauggguggaagacagaugaguaggcuauuggaggauagacgcaaaaucuacugaaaugcaaauccuugcagaacuggaaaaagucugacucuggacuggaaguuuugggccaggaaccacggugcuguaucccuaaggguuagaguguaaucgugucacucaagacucacuggccaaucagagccuuaggcagaucugccaaucagaaggggaggaggguucuuucgggugcuaugcgacugguuccgcuuaccugcugagcauacuugaaugauuuggugugaugugcucugagcccuccuucugggugcugcgagguguucugaggcaagcuccgaaguugcgacauggugagcacaggguuacugccaacaaccgggagaagcagggggcugagcagcgggaacugguguggugggucuuuccccgggcugggugggaaccugcggccaccagugagguccugugagguccuagccauucgcugcacccgaggguagccucugcauaacuucacuauggcagcuguaucugcucagagcauuuggaacaguggguugugcguagaaacaucccuggcagaaugagaaacucggagaacccuaguuucuacaaguucugcccucggcauuuaacauuaagguguuugauccauuuggaauuaauuuuguggagguuggaaaagacaucucauguguucgguagcaaugcaauauuaagcugugguguaaaggaguagaauuggugaugugaaggauuuacuaaugcuuagugucggaggccagcuccggcgaucuaagguagccgauggggaagagcgucagcaggggcaagacuuggacuugggagauauuuaggguuacuuuuuaauaacacgacguuuaccuuucuuaaaucuaagugaauuuguaguaguagccugaguuccccugagaccagaaacuacagucucugacgucuagcacaucauaguaaaacagagauuaaguaggcuuuguccuuaucuccaccugcuaguuaaagacucaggaagaaaaagagacacuuugaaaaaugauuuuaaucuuuacuucuaaguucuuuuucuccaaaaaagaaaagaaaagaaaagaaauucca

SEQ ID NO: 3500 - RNA, 883 nt, Mus musculus
cgacugguuccgcuuaccugcugagcauacuugaaugauuuggugugaugugcucugagcccuccuucugggugcugcgagguguucugaggcaagcuccgaaguugcgacauggugagcacaggguuacugccaacaaccgggagaagcagggggcugagcagcgggaacugguguggugggucuuuccccgggcugggugggaaccugcggccaccagugagguccugugagguccuagccauucgcugcacccgaggguagccucugcauaacuucacuauggcagcuguaucugcucagagcauuuggaacaguggguugugcguagaaacaucccuggcagaaugagaaacucggagaacccuaguuucuacaaguucugcccucggcauuuaacauuaagguguuugauccauuuggaauuaauuuuguggagguuggaaaagacaucucauguguucgguagcaaugcaauauuaagcugugguguaaaggaguagaauuggugaugugaaggauuuacuaaugcuuagugucggaggccagcuccggcgaucuaagguagccgauggggaagagcgucagcaggggcaagacuuggacuugggagauauuuaggguuacuuuuuaauaacacgacguuuaccuuucuuaaaucuaagugaauuuguaguaguagccugaguuccccugagaccagaaacuacagucucugacgucuagcacaucauaguaaaacagagauuaaguaggcuuuguccuuaucuccaccugcuaguuaaagacucaggaagaaaaagagacacuuugaaaaaugauuuuaaucuuuacuucuaaguucuuuuucuccaaaaaagaaaagaaaagaaaagaaauucca

SEQ ID NO: 3501 - RNA, 883 nt, Mus musculus
uggaauuucuuuucuuuucuuuucuuuuuuggagaaaaagaacuuagaaguaaagauuaaaaucauuuuucaaagugucucuuuuucuuccugagucuuuaacuagcagguggagauaaggacaaagccuacuuaaucucuguuuuacuaugaugugcuagacgucagagacuguaguuucuggucucaggggaacucaggcuacuacuacaaauucacuuagauuuaagaaagguaaacgucguguuauuaaaaaguaacccuaaauaucucccaaguccaagucuugccccugcugacgcucuuccccaucggcuaccuuagaucgccggagcuggccuccgacacuaagcauuaguaaauccuucacaucaccaauucuacuccuuuacaccacagcuuaauauugcauugcuaccgaacacaugagaugucuuuuccaaccuccacaaaauuaauuccaaauggaucaaacaccuuaauguuaaaugccgagggcagaacuuguagaaacuaggguucuccgaguuucucauucugccagggauguuucuacgcacaacccacuguuccaaaugcucugagcagauacagcugccauagugaaguuaugcagaggcuacccucgggugcagcgaauggcuaggaccucacaggaccucacugguggccgcagguucccacccagcccggggaaagacccaccacaccaguucccgcugcucagcccccugcuucucccgguuguuggcaguaacccugugcucaccaugucgcaacuucggagcuugccucagaacaccucgcagcacccagaaggagggcucagagcacaucacaccaaaucauucaaguaugcucagcagguaagcggaaccagucg

SEQ ID NO: 3502 - RNA, 3460 nt, Mus musculus
guuuuuuuuuuuuuuuuuuuuuuuuuuugacacaggauaaaaccuuuauugcugaacauaaaauacccaccagagaggccuggccauuaaccucuucccugggcaggaguccuggguagggaggguugggggcaccaguccuacagcugccaaugccaccacaggagacaggcugggaugaaccucacauggcacccugauggauggggaaacagggacaaguccuaaagugaggcugggugccuuggaggggaggaggggcagaggggaggaggggagaaggggagggagaggaacagggaauggacagggccuuggcuugagggagaacaaggccugggcacacaaaggccuccagaggcuaggagccaagugggaggagcuaugacuccugguuagagccccagcugggcucaguggcaggcugcuucuccucaggagcaguuguggguagagccuucauccucuccaggggugagggucugagguaggugcgggcugguccucagggggccucacaggcgugguuugauguguagcggcuucccugaguccuuggugcgagggcuccugggggccuggggcccagucucagucuguccuccugggcuuggggaggagugcagggagaugaaggauggcagcuugcagaggccacuggagccuguuccugagccugucccagagacagcuucuuccugcuccaaggaaggggcuggggagcuaguagagggagagggggaaggagaggaggcagcgguggccuuugaagacaggguagagguggaggcuaauacccuuggggagggagguggggaggcuggggccucagcuccggaagccagaccacuggacaucugucugacagagcgcugaguaguaguaggcuuccugaguacguggccagcugaggccuugcuucugggggcuccaucacugggcccagggauaggaggugcagcuguccgccggccaugucgcuucugguuacgauggagcagcuggcacugggagccacggggacaaauaccccugcgggcaaagucaggacacagcagcgugugcuucuucuugcacuuugcacccaaugggcaguagccuuugaggaagucacugcagacuucagccuugcgggacacguacacauggcuguaggggcaguugcuguugcugcagauccccuucagaaaguaggagcacacaggcaucuuuuccuuggacacauggugagagaaagggcaggacccaucugucuucuugcaugugccucggacaaaucuggugcacacggccaccuucucagggucauggauguaggggcagcauucgccacgguuacaccugccaaagcgguuguaguacaugcaguacucucucuucuucucuuucuucugcuucgccugccggaugauagccaggcuccgcuggauggcccggcuggccaaggaacgacugcaggugguagcaggguccaggcguccugugcggaggaggguccuguugccaucacugggccugcuagaaguuuuggagagcuuguuggcagacaccuuguacagaaccccuccaaugcagcgguagccuuuguugcgccaucgagggguaccagguggggcuuucccucccccagugauugcuggacgaaggcgguuuagcacuagggacccacugggaugccaccccucacuguggcuggaaguaggacaccugcaccuggauaaugggaugcgccgggcccgccaggaggguagagaugaggggaaggauggagcaccaaaggaagagcuuggggucuucuuaacaaugcgguagcgggucuugaucaccuuauuggaggguggaauccccaugugcacacuggaagcuuccuugguggagagguggguccggcuggacggcaggcagcagagccggugccuguugaccugcaucagacccuuguggggagucuuccuuagaaccgggcuauucuucccccggagggccugucuccgucgcuggguaagaugguuuuugcuggugguggcaguuguagggcuguucuucuuguccccaggaaugcugguauugccccgccuccggauaaucuugguccggcucuucacuuuguaagcugagagcugugacucuccaaagaggggcuucaagcugcugggucccccugcuggucuguccccugacgugggccuagaugggacuggggagagcugagaaguaugguccuugcugccagccucagacugccaacggaaagaggaagaggaggaagcagacgggcuggaagccuuccacuuguacuugcugggagagaggccaggcuuggaugguguggccaguuucuccggccucaccucugggucaacuuuaggcuguggcuucucugucuuuccaacuguacccaaaguggccuuguucccccucuccagaguuguucugggacugagggcucuccgagcgacccgugggcucuuuucugaggcagcuacccauuuguaguuguuuuuccgaaacuugcugguucgacaggacacgagcagugaggccucccugaccugccuggcuguugcuggucugacugaagccaccacuggccccaaggaagcuggcuggucugaguggccaguguuugcucuuuggucuccaaugaacuguucagaauagcugguagaaugagggccuaccuuccugcccagagccacagcagugugauggggcaggacagaugggaaguguacccugagggccacuucauuuucacugacuguccgccgaugcucgggagagcugucacucacccugcccacagacuucacuacccgaggcuugccaggcuccuucuggcagaccaagagggggucguccacacuguaacccaccuugguucuuccuggccuugcaggcugcaguuguccaccagggaccucaaccucacuuccuuggggucuuuggccacuccaagaggggucaucacagccuuccaaggacccccgcuggaccccugaagcauugauggcaccugacuuugaugguggcuugaucuuaauaaccauauucugaucuggacugagcuggaccugucucuccaguacauacugcugggguucaggaugcuggcuauccucagaccugagggaugucugaaaagcaggaucgcuggcugggucagaagauuccacaggcugauucacaagggaguauuucuugcgccacgaagggccauggugugaggagaagccccuccgacuuggacgggaguagcgggcgccaaagguccugccacccgggaacacggguggcugccaccgaguagcugaugaguugcccagggcagggccauugccguggaguguuuuauagucaucaauuagaccugagaaggcagaaucacacgcucaguuacccugcaggaggcguaucugccgccgcagcugcuccuuuuccuccaucuccggaguccgcc

SEQ ID NO: 3503 - RNA, 14548 nt, Mus musculus
acagaugagcugucagcugucccucccuguugguccccacccuacccgccaggcacauuuccgguggcuacuugaaugcuguggguccuaccuccuccuaccuuaaagaauuuucagcuucugugcagcacagaucuggagcucugccccaggaacacauccagcacuccaggauuucauccagugucugguaagucacuuggaagacuguuucauaucgcuuuguuguagguggaagggcuuauaaaugugugugacaaggaguuuaaggauuguaugauaaaggaaagaaaacuuuaauuguguaugaguuuguauauacaugagcacauggauccuguaguguacaaccugcuuggcugaguuuugaacucauguugucugucugucaugauggcaacugccuuuguuacugauccauccuacaggcccaagauggugcuuuuuugaaacagggucucacuauguagcucugacuggccuggaagucuccauguggaccaggcugccuugccgucuuagaacucacuguagcuauguuccuguugggauaccaggaguguacuacuauuuccucuguuuuugguuuuguuguuauuauuggguuuuguuuuugacuuuuauuuucaguuucuggcucuacuuuauccccuggggccaugucuagagauauuaagaaauucucuuucucaaggugagucacagaaauccugcuccaaauuuggaaggaaggaauguugcauugagagugagaggccuaggaaucuaaacagacaagccuuucugguuacccucaaaagcauuacuccccaaggguggguuaaaagggcuuuuggaagcagucuuagagccaggcaggaagguaaacagacaaauucaggugccugggagaacagcaggcccaaauugggcccugagcucagggauccacccagacuugauucugcucucuaguuacccguuugcuauccuuuaaaaaaccgaguccauccacuuacuuacuuugauaucuuuugguuuuuacuaaguguauacauaccaggaggguggggaacugguucauaggccaccuugggaucauuucuuuuucuuuuuguuuuuucugccucagccucuugaaugcagggauuauaggcuagcgacaugauauuugucuaaaugucauuuauucauuuuaguuuauuuacuuuucuaaagacagggucucagucugcagggucccaggguaaccucagacucuuggcaacuguuuaugccaaucuccugaguuuugggauuucagcccaaaugucccuuauaacaaaccagaccagguuauggggauucagcucaguugacaggagugcuuggcuacuguggaaacccugauuugaucucuagcacuacuuaaacccacugaggcuguguacaccucuacauauccccaacauuugggaggugaaggaauccccauggaggaucacauggugaagucauuuuaaccuaguggguuugagcucaggcugagcaacaugagauucugucucaaauaaaauaaaauaaaauaaaauaaaauaaaaggaaaugaaauaaaauaaaauaagacuaggccggggccuagcaaacacauaaguggauguucacagucagcuauuggauggaucauagggcccccaauggaggagcuagagaaaguauccaaggagcuaaagagaucugcaacccuguaggugcaacaacauuauaaacuaaccaguaccccggagcucuugacucuagcuacauauguaucaaaagauggccuagucggccaucacuggaaagagaggcccauuggacacgcaaacuuuauaugccccaguacaggggaacgccagggccaaaaagugggaauggguggguaggggagugggggggaggguaugggggaccuuugggauagcauuggaaauguaauugaggaaaacacguaauaaaaaaaaaaaaaaaagaaacuaugccaucaugcagggcucuuuugaaaugccagacuaagauaucauuaaagagaucugcuagaaaaaaaaaaugaaauaaucaagcuggguauguauaguggugcaugccuuuaaacuugggaggcagaggcaggaggaucucaguuggaggccagcuugaucuacauagccauuuucaggaaagccaaagcuacuuagugagaucuugucucauaaacaaagaaacaaaauccaaccccccccccaaaaaaaaaaaccaaagaaacaaauaaaagaaacucugaaguaauuaauguaaggacaguguuucuuugaguucuacaagacacuuuagcucauuaauaaaauuugaggaguggacucuggggaccccaauuuguagcugaaaggcuugggguugaagguaagugaaaacuaggccaguuuugggguuguagccaucaauuuaugaauucaguguuaacuccagauagacugugucagaacuggacuugguucaugggccucuagcuggugucugccauucugggguguugggaugugcuaaauagguuuaugccaacuugauacaagcuaaagucaucugaaaggagggaaccucaguuaagaaaaugacuccauagaaucaggcaguaggcaggccuguagggaauuuucuuaauuagugauugauggggggaguguggggcuagggagccaugggaccaggggagcaggccuggaacacaaguccgguagagacauucccaaaaccagaaaauuuaugcuccggggccuguaugaccuugcucacauaacccuaaccuuugcuucucacuagaggaggucacauagccuguagccagguuacacuucuuuuccccuuauaaggucauguccggccgcaccuggaauuuccccuugugcaaaugaaguuuuuuuguuuuuguuuuuuguuuuuuuguuuuuuucugaaugacuauuuuauauuuuauugacuaaaaucauuaaacauuuucuuuuuuuuaauauuuuuuuuauuacguauuuuccucaauuacauuuccaaugcuaucccaaaaguccuccauacccucccacccacuccccuacccacccauucccacuuuuuggcccuggcguuccccuguacuggggcauauaaaguuugcguguccaaugggccucucuuuccagugauggcuuacuaggccaucuuuugauacauaugcagcuagagucaagagcuccgggguacugguuaguucauaauguugcaccuacaggguugcagaucucuuuagcuccuccuuugggggcccagugauccauccaauagcugacugugagcauccacuuauguguuuggcuagggucccccagccuagucucacaagagacagcuauaucaggguccuugcagcaaacucuugcuaguguaugcgauggugucaucguuuggaggcuaauuaugggauggaucccugugguuuuuguuuuuugcuuuuuuguuuguuuguuuuuuauucugagagaggguuucucuguauaacccuggcuauccuggaacucacuuuguagaccaggcuggccuugaacucagaaaucugccugccucugccuccugagugcugggauuaaaagcacguuccaccacacccagcuuuuuugagacaggguuucuuuucuguagcucuggcuguccuggaacucacuuuguagaccaggcuggccucgaacucagaaaucccagugccacuguggguugguuauccaggguucuguaagaaagcaggccgaguaagcacaaggagcaagccauaagcagcauccauccauggccucugcaucagcuuccuacucuguuugaauuucuguccugauuucaaucaaagaaguguuguggaagccaaauaaacccuugguguuucaucacagcaauaguaacccuaaugaggacauaguguuauguaauacauuucugggggucagagaagugauuugugcugugaauacagcaggaaaaaaaaaaaaagaccuugaacaugcacuuuaaguggacagagguggguggggccuggauguguuuggaggugugagauuccuuuccuggcuuucugugcugggaauggaaguuucaggaaagaaacugcaucuucaaacugaacauucuucauggaugacuacccaauuagaaccauaauugugugugugugugugugugggggggggguuggcauguugcaggacugugaaccccaacauuaugcuauugauuggaaaaacauguuuuuaguugugguguggcucaguguuuauuuuauuuuauuuuuuuuuaagauuuauuuauuauauguaaguacacuguagcugucuucagauacuccagaagagggcaugagauuucguuacggaugguugugagccaccaugugguugcugggauuugaacuugggaccuccggaagagcagugggcgcucuuagccacugagccaucucaccagcccccuggcucagucuuaauaccuuuaauccaagaguuuucugcuugaacauuuuaaacuggauuagagucagcccguugacaggaagugaacauaggauuuuaaagaaaaaaccauagaguuuacgagggagucagaagggcugauagagagacauaccggaaguagaagggagggaccugaguuugaaggagguguuuuggagaugggcuugagggaggggauucauucugggacgaggucugagaaggaaagugagcugggugcuuucucugccucucugagcuagcaggcuuucaccccagcaucuggcucuagagagucuucauugguaaaauacaacgguugagauuuuguuaaaaacaacgcccaagugcuugaauuaaaggcauaaaccaccacacccugucaggugauuauucaagauuucucaucuuguuuuccagcagaguuuggaucccuccaccaggcacuaaagauguuauggcagaaccuccaucaguuuggccagaaguugguucgccggcggccccuggcggcaaacgaacagucugagucuuccuugucucgaugucugaccacuuuggaccugguguccuugggugugggcaguacccugggugcaggcguguauguccuggccggggagguggccagagagaaagcuggaccguccaucaucaucugcuucuuaauugcugcccugucuucagugaugucaggacucuguuaugcggaguuuggggccaggguaccaugcucggguuccgcauaucucuacagcuaugucacagugggccagcuguuggcuuucaucacuggcuggaacuuaauacucaacuaugucauuggugaggagaugggggcaggguuuuauauaaguaggccagguuggucuugaacucucuauguuaacugagaaugaccugaauuuugccucuaccuccuaaaaaugggaucacgggacuccuuguuucauuuuuaugaauacagggucucauguagcucaggcuguccuugaccuugcuauauauauaacagaagaaggccucaaaucccugauauacaugcuucuacuucaccacacucagccugccaggaauucuuuuucuuuuuuccuuuccuuuccuuuccuuuccuuuccuuuccuuuccuuuccuuuccuuuccuuuccuuuccuuuccuuuccuuuccuuuccuuuccuuuccuuucuuuucuuucucucuuucuuuuuuccuuucucucucucucucucucucucucucucucucuuucuuucuuucuuucuuucuuucuuucugaaugucgaagacaaggguuucucuguguagcccuggcuguccuggaacucaugguauagacucccuuguuuguucuuccugcguccugggauuaaaggccugcaggcuggcuaguaauucauuguauauuucagggagauuaguuuuauagacucuucaucauuuggaguguuuguucacuugcuacauuuuugaaaaauuccuagacuaccauuuuguuuguaauugcagugccugggcucaaaccuagggccuugugugugugaggcaaguacucugccacagagcuaaaugccuaucucaagaaagucucaugagaucauauaucuuuuuauuuauucaauucaauucaauucaauuuuuuauuaaucauuuguuuauaucucaaaugauaucccccuucccgguuacuccuccacaagcccccaucccaucuccccucuuccccuccccuuugucucuaugagggugcuucuuuacccacucagccacuccugccucacugcucuagcaucccccuacucuggggcaccgagccuccacaggaccaagggccucccacugaugucagauaaggccauccucuguuacauauguaucuggagccauggaucccuccauguguacucuuugguuggugguuuaguucuugagagcucugagugguccacuuaguugauacuguucuuccuaugggauuguaauucccuucagcucccucaguccuuccccuagcucaggggucccugggcucagucugaugguuggauaugaauaucugcaucuguacuggucaggugcugguagaaccucucagggaacagccauaccagguuccuaacagcaagugcuucuuugcaucagcaauaguaucaugguuuggugucugcagaugggauggaucccuagguggagaggucucuggacggccuggaauagaaagauuauguaucuuguguacgauuuuucaccccuguuccucacagcagagauugagauuagauauguuucuuucucuuccugucuguauucuaaggguucacuuucugcuuguacaugaagguuccgcuuccucuugcaggugcagccaguguggcucgggccuggagugcagcuuuugauggccucauagggaaccauaucucccaagccaugcagacgacuuucccuauccaagugcccagcuuucuggccaaguauccagacuuuuuugcgcuuggucuggugauaguucucacuggugagacaggcuggagagggguggugagugugugggaggauuggaacugguagaagauauaaaauccaaggcacuggagggcagaaugugagacaggguuuuuuccuauacugggggcugugggucuguaguaaaauacugaguaacaacaugucuagcuuucaaccacugguuguuagagguacccucuuccccccuguuacaagccagguguuugugguacccugucccucuccagcuuucugcugagauccacuaauguagaauuagcuucuacuucuacuucuacaugcauacggaggucacaggacaaauuguggaaguugguccucucuaccauguaagggccuggagauagaacucagauugccaggcuuuuugguaagccuuuuuuuuuuuuccccugauaagccaucuugcaagccuuucuucuguaugaagaccaaauuaaaaaaaaauuaggucuuacuuuauguguauguguuuugccugccugcauguauuuauguauaccaaguaccugccuggugccauggugccugcaaaggagauaucaaagccacuauauguguucugggaacugaacccugguccucugcaagagcagccagugcucuuaauugaugaaccaucuguccagccugcguuuugacauugacucacagucucccuucuuguguaucuggguugauuuaacucuuaguuccaccacuuuuguccugguauugcagguaugugccaccacagccauguuaggguucuuacugccuucuuuccauucccuuucccgcaggaauccucgcccugggagcacgagagucugcccuggucaccaggguuuucacaggagugaaucuuuuggugcuguguuucgucucccucucuggccucauuaauggcaagcuacacaacuggcagcuuacagaggaugacuacaaacuggcucuguuagaauccaacaacacugacaggucaggagucccaaacaacacagcuagcucagggcaggaaggggugcagagaguaggggucugguuacugggccccaaacugugccacaacuguggaaguuguguauaauuauguaaaaauuauuuuuaaauuugagacuuguuucucuuuuuuuuuccuuuucuuuccccuuuuucuuucugucuuuguuucuuucuuuuuucuuuuaguuuuuuggagacaggguuucuuuguguauguagccuuccuuggcuguccuguagacuaggcugagaucugccugccucagccuccuaagugcuggcauuaaaggcuugugcccugccccacccccauaagcauuuuugguucuuucaagacaaggucuccauauauagcuuuaaaaguccuggaucuugcuguguagagcaggcuggccuugaacucaaagauccaccagccucugccucccaacuaccaggaguaaaggugugcaccacuaugccuggcagguuuguuuguuuuaaaaauuuauuuauuuauuuuauauaugugaguacaauguagcugucuucagacaccagaagugggcaucagaucucauuacagauggcugugagccaccaugugguuguugggauugaacucaggaccucuggaagagcagccagugcucuuuuuuuuuuuuuuuaaagauuuuauuuauuuauuuauuauauguaaguacacugucgcugucuucagacacuccagaagagggagucagauuucguuauggaugguugugagccaccaugugguugcugggauuugaacucuggaccuucggaagagcugucgggugcucuuacccacugagccaucucaccagcccgcagccagugcucuuaacugcugagccaucucucgagccucauuucuggcaguuguuaauauuuauuuuuguaugagugauuuugacuggauauauguacaugcaccaugugcaugccuggugcauauggaggccagaagaggccauuggauucucugaaauuaaugaguuaaacacgguugugaacuaccauuucuaaauugaaccuagauccucuggaagagcagccggugcucuuaacugcugagacaucugucacgucuccuuuauggugguuuuugaggcagggcaucauggaucucagccugguaucuaacuuacuauguagcgaaggauggccacagucuucugauucucuugcuucuauuucccaagugccagggcguguugggaucaaacccauaauauguaugcuaagcaagcacuauaccaacucagcuauuuccuagcaucccuuguccuguaucuucacuauuuuuguguuuugagauaaggucuugcuguguagcccaggcuggcucugagauauguaguuagaguuggcugugaaccuuuagccuugaguuccugagugcugggaauauaggcauaccccgucauacccuguaucccugcaaugauuuccuccuucauucauuuauuuauuuauuuauuuuuauuuauuugguuuuucgagacaggguuucucuguauagcccgggcuguccuggagcucacuuuguagaccaggcuggccucgaacucagaaauccgccugccucugccucccaagugcuggguuuaaagucgugugccaccacgccuggcuauuuccuccuccuuucucuugccacagcuugggaccaaugggcucuggaggguucaugccuuuuggcuugaaggggauucuccgugguacagcaacauguuucuuugccuucauuggguucgacuguauugcgaguacaggugagugagcaguagucccucugucuuaucaaacgcauauacacguacggcugguggagaguuagccugcuuuugggagcauaggaggggagaaggugugugugaagugaagccugugagugcuucugaaucaagguccguuccaucccugcaggggaagaggcccgcuguccccagcguuccauuccauugggcaucgugaccucacucuucauuugcuuucugauguauuuugguguuucgggggcacucacucucaugauacccuacuaccagauuaacaucaacagccccuugccccaggcauuuauccacguuggaugggggccugcucgcuaugcaguagcugugggaaccuuaugugcccuuucauccagguugguaucaaagguuuuucucauuugcugcuagauucucagcuguuccagccuuugaaauagaagagagggaggggaaaugucuuacauggcuaaaggagcagggccugcccauugauacucucuggucucuuaugucccuauucccuaauaacagccucauagguuccauuuucccugugccucgggugguguauuccauggcagaggaugggcuccuguuccggaaacuugccuauguucauccucgaacacacacuccgguccuagccacuguccuuuguggaaucaucgcagguaagacagccagccuuaccacuuucaucagcuuggcuaugcucacuagcuaaugccucacagguuuuauacccaccuuuuguucuuaucacuuuagcauuuauggcuuuccucguugagcucagugaucugguggaccucucguccauagggacccugcuggccuacaccuuagugaccuucucuguucugauccucaggugagacuccaucacgccuuggcugaguguuauggggucaugaagacagucaguugcuuauccucgcugucacuuguaugcauggggguagcagguaauguucccaugcuauaucguucguucagguaccagccggaccaggucuuaagcucuuguaagagggagaagucugagagugcagcuguggagcuggagccuggacuugaaccuucuucaugcauggagccuauuucuccagaagggaugccagggauugcaaggacacucuguauccccacgaacaccaccccaacucugagaucuggccggauugucuauggaugugcuucccugcucggugaucacugggacuuuacuccuugggcauuuggaagcugauagcaugggguggaugucaggggcagagcgggaggcacagaacagacaggcuugguuggauguagcccaguguucugacagacuucuccccgacuugacuuguagucuuucuucugaugcuccugugccugauccugacccagugguccacacagcuauucucuggggacccaguuuugauugccauggcugcuucacuauugcuucuuacugucggagugaucacugucaucuggagacagccucagagcaccacuccucuccacuucaagguaggugacugacuucuaauauaauccacccuagggaguuggucaugccugacuuaaagucuaagcacguuucaccuuuccauggaaggaaggggcagggacugauaaaacgaguggauaugcugggcaugguggucuuugucuuuagucccagaacucaggagacagaagcagguauagguaaucucucaaucugaggugcuugguuuacacagaguauuucagaccagcaaaggcuacauaguaagagccuguuucacaacccccucccaauacaccaaugggcagagcgccuggauacucagaaggcucgggcaggaggaucacauauuaaauggguuacagcuacuucuagacuagaaguuuagugaaauucugucucaaaauaaaacagguauguuguucuauaccuauacuucuaauacuagggagguaaagggaacucaggaauucaaggcuaugcucaguuugagcaaacaaacaaaaaucccaaaguguucccucacccaagucugggagauguaauucagugguagaauacuugcuuaauaugcaugaaacccugugugcaguccccaguacugaauagaagucagauggaggugggaauguagucgguugguggagcaauaguuuagaaugcaugaagucuuggguuugauacuagcaccacaaucccagcacaggugaagugcaggggcuggagaaccagaaguucggggacuucuuugagacucuauguccaaaaaauaaggcaucugcugcuggaugugguagugugugccuuuaaucccagcacucgggaggcagaggcaagcagaucucugaguuugaggccagccuggucuauagaguggguuccagcacagccaggauuacgcagagaaacucugucucaaaaaaaaaaaaagcaaaaccaaaaucaaucaaacaaaagacaucucagggcuggagagauggcucagugguuaagagcacuggcaagcacugcaagacuggcaagacuucuaaaguccugaguucaauucccagcagccacaugguggcucacaaucaucuguaaugggaucugaugcccucuucuggcaugcagguagaacacgaauauacauaaaagaaauaaauaaaucuuaauaaaaauauuuuaaaaaugaaaaaaaaagacaucugcugcugggcaugugguauaugccuuuaaugugccuuuaaucccagcaccugugacaaagaagcagacagaucucugaguucaaggccagccugguuuacaaagaguuucaggccagccaaaacuguuauauagaaaaaccuugucucgacugcaccccccccccccccccccgcaaaauugcacucgcuuccaagccccaugucaguguuuuagugcucaggauaugucucuucuggcacaucccauggugucuccagucugagcaggaacugauugcagagcccagggcugugccugucauucaugggaaagagcucaggugucuggugugcacugggauuuauaggccguguuuacagguuccagcccugccugugcuuccugcacugaguaucuuugugaauaucuaccugaugaugcaaaugacuucugggaccugguuucgcuuuggaaucuggauggugaucggugaguagcuugcuggggaagagauucuuugguaacugaguccagcagucuucuaauugcuugucuuugaaagguucugaggccauguggagaauuccccagugggaaccugggcaaaagggugaucaauugcaccucacugucuauucccuuuuaggauuugcuaucuacuuuggauaugggauacagcacagcuuggaagagaagaaugaccaacagccaacagccucaagcucccagacucuccaggaacuccaggaacauacucccaguguugacuuaccuuaacuggagaaacgggaugcuuccaggaccccaugggcaucaguuuccuucccuucccuucccuuucccuuuccucccucuuucccuucccccuuuuccuuuccucccucuuucccuuccuuuuauucucucucucucucucucucucucucucucucucucucucucucucucucuguguguguguguguguggggcggguugggaaggcaguacugggaauugaacuuagagucuugugcgucugaggcaaaugcuccaucacugaccuaaucucuuguagguaucuuuaggucaaggaaaaguuugaauauuugugggcuguagaugggacuucuuuucuuacuuucuuuuuuuuucuucuucucuuuuugggacuuauaucauuguaauuuugugagcaaauuccuuaaccuuuuuuuuuuuuuugguguguguauugaaauuggauccaugauuuugcauaugcuaggcaaguaguacucuaccacugagccacaucccuagucccuuuaguuauuuaacugacagcaaaauuuagguauuuacauauuauagaaugguuaaaaaaacugauuaauauauguuucuuuuuauguuugggcaguuagucuucuauggcuaaggucagacuugaacuugaucuucugaacauuauuauuuauggagagagagaaaacacaugugucacaguguuuguggaguucaaaggacaacuuuauagguuccuucucccuuuccacuuuucauggauugaacucagguauuuaggcuuuuguggcaacagcuuuacccacugaggcaucuuguuggccccuguauccccucccccacccauaaacaguaucauaacugagaacuaucaugaacucaugacccuucugucaccaguucuccaaguguugguauuauaaguguggacugugcuuguuguuguuuuuuguucuguuuuucaagacacaggguuucuugauguaguucuggcuaucccuguaacuuacuacaguaaguuagaucaagcuggccuugaacacagagaucucccccaugagugcuuagauuaaaggcaugugccaccucuggccuaucuucaugcucaguuacuguggugcuaaacauuaugccaggguuuuaagcacauuuggacaaccaauuuaccaacugagcuacaccccccaacccuauguuuauguuuugugaugaaaacauuaaauuuuuuuaaacauuuuacagaucuauagugcauuguucaucuguggcaacauguauaugaacuuggaggauguauauuauguuaagugaaauaaaugagguuugaacaaau

SEQ ID NO: 3504 - RNA, 912 nt, Mus musculus
cggaggcaguuccuguugcccuugcuaaacauggcacuggcuagcguguugcagcggccgaugccggugaaucagcacggguuuuuugggcucggagguggugcagaucugcuggacuuggguccggggaguccuagugaugggcugagccuagccgcgccgagcuggggcgucccggaggagccgcgaaucgaaaugcuucacggaaccaccacccuggccuucaaguuucuccauggagucauuguugcagcggauucccgggccacagcaggugcuuauauugcuucccaagacggugaagaaaguaauagagaucaacccguaucuucuggguaccauggcugggggugcagcggauugcagcuucugggagcgguuguuggcucggcagugucgaaucuaugagcuucgcaaaaaggaacgcaucucggucgcagcagccucuaaacugcucgcuaacaugguguaucaguacaaaggcauggggcuguccaugggcaccaugaucuguggcugggauaagagaggcccuggccucuacuacguagacagcgaggggaacaggaucucugggaccgccuucucagugggcucuggcuccguguaugcuuacggcguuauggaucgaggcuacuccuaugaccugaaaguggaggaggccuaugaucuggcccgccgagccaucuaacaagccaccuacagagaugccuacuccggaggggcagucaaccucuaccacgugcgggaggauggcuggauccggguguccagugacaauguagcugacuuacaugacaaguacaguaguguaucuguccccugagggaagguggaugcgguugucugcaucucuaggugggucuccauggcuauaauaaauaauaguaccucuuuaaaaaaaaaaaaaau

SEQ ID NO: 3505 - RNA, 912 nt, Mus musculus
auuuuuuuuuuuuuuaaagagguacuauuauuuauuauagccauggagacccaccuagagaugcagacaaccgcauccaccuucccucaggggacagauacacuacuguacuugucauguaagucagcuacauugucacuggacacccggauccagccauccucccgcacgugguagagguugacugccccuccggaguaggcaucucuguagguggcuuguuagauggcucggcgggccagaucauaggccuccuccacuuucaggucauaggaguagccucgauccauaacgccguaagcauacacggagccagagcccacugagaaggcggucccagagauccuguuccccucgcugucuacguaguagaggccagggccucucuuaucccagccacagaucauggugcccauggacagccccaugccuuuguacugauacaccauguuagcgagcaguuuagaggcugcugcgaccgagaugcguuccuuuuugcgaagcucauagauucgacacugccgagccaacaaccgcucccagaagcugcaauccgcugcacccccagccaugguacccagaagauacggguugaucucuauuacuuucuucaccgucuugggaagcaauauaagcaccugcuguggcccgggaauccgcugcaacaaugacuccauggagaaacuugaaggccaggguggugguuccgugaagcauuucgauucgcggcuccuccgggacgccccagcucggcgcggcuaggcucagcccaucacuaggacuccccggacccaaguccagcagaucugcaccaccuccgagcccaaaaaacccgugcugauucaccggcaucggccgcugcaacacgcuagccagugccauguuuagcaagggcaacaggaacugccuccg

SEQ ID NO: 3506 - RNA, 4604 nt, Mus musculus
ugauuguuuuggugacuucuuuguuuauccucuuuuuuguuuaguuuccuuuuuaaggaugcuuaaaagucucgaacuugugacaauccugcaggccucugccgcuccaaaugcuauaaucguaagcauguaccaauucaauuaucccuuguuuuauuuauuuauuuauuuuauuuuuuuauuucgguuuuuucgagacaguguuucucuguauagcccuggcuguccuggaacucacuuuguagaccaggcuggccucaaacucagaaauccgccugccucucucucccgagugaugggauuaaaggcgugcaccaccacgcccggcucccuugcuuuauuuuugacacaaggucuuacaacauagccugguucacgacagaguuacagcaaaggaccuccuugaacuccaaguucuguggcuuccaccuuccaaauacuuucaagauucuuccugcccccacccugccuccugccuaucuccccuccagccaagaaggaaugccgagccaaccaugugcuccacgaacuaggcuacaccuccagucuugugaagcuuuaaggaaagucaggauuauuucucaauaacaaaccacauuguuauagaagucuauuacauuuaacauaaggcuugaaaacaugagcaugagucuuuuuuuuuuuuuuuuuuuuuuuuuuggguuuucgagacaggguuucucuguguagcccuggcucuccuggaacucacuuuguagaccaggccccugccucccaagugcugggauuaaaggcgugcgccaccacgccuggcugaaaacaugaguccuacgaggaggacgguagugugggcuaggacaugagagccuuccagaguucaguuccaaacacacuacacacacaaguccugcuugcccagcaaccucacccccacccuccgcaccccaugcuggcuuccacaagaccaguauuccuuaaaggacuggcuacugaaugguuucuuaggucacaagguauccaucacaaagacuugguuccgggauucaaaaagaauagaaaagcagccuuagacaauagaaagagaaauggguguagcuguggugguguagcccuggcucccagcaacuucacagaaauugagcacuugagcaucaaaaacuucuuaaaauaaaacuuaaaaggaaaaagauguuguuacuuuuuuauuuuuugccuuuuuaagacugaggauuaaacccagggcuucaggcacgguaaacaagcacacuacaauccagcuguauccagcuuuugagacaaggucuccugccugcuagucuagaggggaguagaacuuacucugaaguucaggcuggcuuccagcucaaagcaggccucuugucuccuuuucccuagguguugggauuauaaagauuggaugcuacaccaggcuacuuaaaaaaaaaacaaacaaaaaccagguggccacgccuuuaaucccagcacucuggaggcagcgggcaggcggauuucugaguucgaggccagaucuggucuacaaaagugaguuacccaggaaacuacaucauccagucaacuaauuauauauauauuuaaaagauuuauuuauuguauuuauaugagugcacugcagcuguuuucaugcacagcagaagaagccucggaucccaucacagaugcugugagccaccaugugguugcugggacuugaacucaggaccucuggaagagcagucaguguucuaaccacugagccaucucuccagcccagccaauuaauuauuacugaaagugguuuucugcugaauguaaagcuaaauacaaaguuuucaaaggugaaaaauguauugugcgaauguagaugcuugcacagccuggacaagguucuggcuccccauugccaagccuggggacaggaggacaaauguauaaaugaccacaugacagauaucacauaucaggguguacaugucauggagauuaagauaacucauacuugucuuuccaacaccugggcagcugagacagaaaccauugcugugaguucaaggccagcuuguccuacaaagugaauugcagcccaaacuuggcugucuaauaggccucucaggccuccucgaugaaggacuugaacagguguuugugcuacagggcuugguucugaugcacacaguuuaaccugauaaugauuuuacauucugaugcugagccaagcaaccugggucagguaugccagcccccaaaagaaugguuuucuccacuuuucuuuauaguaccuuccacagaagaaaauaaggauaaccuggcaguuuaccaucuaaugccuuuauuaaaggcuauccuccagccuugucacugugaaugaagaugggauugaccagccccuccaauugcaucaauuaauuuugaaccuaaaaggauuucaagcccagaggggaauuuacagaagaaagcauucuuauuguaaugcucaauccuaguaaacaaagccaaggguuggguggcaaagggagggaggacugggucauuaccauaaaagccuugcugccgacaugcaaaugacuguccuucaccccagccaguggaguuuugaaagaaguaaaaugacucuccuuuuuccggguccuuacuucaccagcugucaaaucucaucccgcaguucugugaaauuuccaguaccuucucucauaauaacuuaaugcuacuaugaagaaagaaacagauggggugggagaagugacaccaggugagagggucaguagguaaguuccaucccccggaccacagaggagaaggagaaauuucuucaggccagcugcccugugauuucuaccagagcaccuuagcaugugcacagccucccaacccaauaaugucauuucaaagccccacacugaguaguagcugucugagagucccaggauagccagggcuguacagagagagguacccugucuguugguggacaccuuuaaucacagcacuuggaaggcagaggaaugcagauuucugaguuugaacccagacuggcuuaaauagagaaucugugugucaagauaaguaaauaaacugaccugcgacccccuaaucacauaggaacagaaaauaaauauaaucacuuuauauaauguaguguuaauaauaagaagaaaaagaaaagccagcaguguguguuaggaaagagacagcaggugauuuuucuguaguagacaaguuugaggccaagcagcucagccugggauuaugaggucauggcaugaguuugaagccaaugagcucagcccugugacuaugauucugccagccuccgugccauucagacuccagguaacgaaggaagucuaacuaguuugcagguuaacagucccuuuggcuggggagaaugaaauacaucucccuucggauuugagccugggaggacuugggagcagguaccucgccuggugccucacuuccuaggugcaguacaaaccucaagaucucugcuggggucccugaagcucagcaugagaggaaaggaaggaagcccaagguugaaggcagggcugauaaaagcaauguuuuugcuaauuuucauauauccccagcugucuuuuuuuuuuuuuuuucccgaaacaggguuucuccguguagcccuggcuguccuggaacucacucuguagaccaggcuggccucgaucugaaauccaccugucucugccuucuaagugcugggaucaaaggugugcgccaccacaccgggcuaaaacagcuguuucuuagugucaucauagaaagguuuuugucagaaccuuggaaggcagcugacaaugauaaagaggagaaggggagccagaguggcaccccaccuuugccccuccacuucugagcucccugcuaggccuaagggucaaagguaaacucuaaggaggccuuauggaggacuuaagagaugcuucuacauuuuuaacccuaggugcuuucaaaaguguucuuuauggagcccuugagcuguauuaauguauaaacagguauacugccaaacucaaagaccugaaggcaaucucuggaccccaagagguaagacagaacucagugcuacaagcuacugucuaacaccuauaugcuuccauuucaccucugccccucccugcaacauacaccaaaaauaaaacuuuuuuuuuuuuuuuuuuuuuuuuuaggcaggguuucucuguauagcccuggcuguccuggaacucaaauccgccugccucugccuccugagugcugggauuaaaggcgugugccaccauguccaacaaaacauaauuuuaaaacgcucacugugggccagcuugguacaagcccauacucgagaaagcagagagagaugcguggauuucugugacuuggaggccagccuggucuauauagugaguuccaggccucucuugccuagcaagauccugucacaagaaauaagcaaguaaggaagugagugagugaauaaauaaauaaauaaauaaauaaauaauaaauaaaauucuuaggguuaaguuaguggggcacuuugcuugguuauguucaacacaguaugaacagggaacagaguugccaaggccaucuugggaaaguugaagagaagcuaaaucaguagcucaucc

SEQ ID NO: 3507 - RNA, 1861 nt, Mus musculus
  misc_feature (1382)..(1481): n is a, c, g, or u
ccagaagcuuuauuaaugugaacagggcugaucagcgcaagaagaggugacugcaguccagcuucagagacagaaaccugauccagcauugggggaguggugugugggaagaagugggagacagaauccaagcagcuaucauuuugguaugaaaacgauacagaacugaguguaguggcccaugccuaaaaucccagaacuaaagaggcugaggcagggggaucaccagaguucaaggcaugcccgagcuucagaaagagacauuuucuuaaaacaaaaacuugaaagagggucagugagauagcacuugcugucaaguuugacaaccggaguucaauccgcccccugggacgcacaugguagaaggaaagaacugacccugccaguugcucugaccuccacauaugcaccacgacacacaugccccuagauccccacaccccacaaaacaaauacuuuuauuuucauuugaaaaugaaaagugaaagugacagagaaggaaaacguaucggcaagaagacagcaaaugcacacagaauuuccauagcuacuaaagcagaugggauugagaaauauggagagguccaggggccagaagaggggagaacagcucaauagcaaacagggaagagagccucgggaggacuuccacaaugaggcagcgcugcccaccuuccagagcccgcugaugacacuguguaucuugcuuugagagcccugagcaaauccagugacauuaucuucauucaguaacgacaacucagugcucaggaaugucuucugaggacuggcugaugccaguccccugccauuucagaacugauuccaaccaaaaaguccagaguggggccagcagagguggcacuuguguuccaggcaccuggucguagcagcugauguacuggaggagcuaccuggggaaggaaggaguuggugaaaggugggucccaccugggugguccacagaagggcugagagagggagugagggcuaagaaucagacccugcugucaugccacguggcuguccccugucugggucucugcuguaaaaaaggcccccagggacacacaggcuaauaaauccaauaaggacaguugcucuguuucaugugucccagcacccuaauucccuagagucugucuuuucuacuuucuuggggacugaggacuugaacacugaaacugaucuaaugacccugaggauucuggccauaggggccucuuccaggucuuggaguauagguucagacaacucuaggaauacaagcccuagcucuccuucuucagaccuggaggccccccaccccccaucccagcccuauucccacuccccuguccagacugaagagucagguuccaggccucucucaggcccacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaauaacccguccuccucccucaagaccaggagccuauacugaagcucuguucccacauacauaugaguucaacccuucucccugaaacccucaaacuacauacccugccucuccucccccagacuuuaagaauccagaccaagcccaccuccuccaaaccuucagacucaaagaguccaccccgcccccacccccaguacuucuuccaagccucuggaccucagaauccugcaagccaacuagggagcuuccagccuggacugcucaggacagaaacacaaguucucugacuucacuggcucuuugagauccagauuuuggacuuugcagccuggucccggacccuuggggaaacagaucucccuucguucgcucuguu

SEQ ID NO: 3508 - RNA, 10965 nt, Mus musculus
  misc_feature (5345)..(5444): n is a, c, g, or u
caugauguggucuaacuucuucaugcaagaggaagaccgacgccggacagcugugggccggcgucgugcccaagaacagcagaaucucggcuugacuccggagcgagagggcaagaucaagcugggguugcugguggcaaucgugggugcuacgcuggcugugcuggcugugggcaccgaguucuggguggaacucaauacauacaagaccaauggcagcgccgucugugaggccgcccauuuggggcuguggaaggugugcaucaagcgacuguggcaggcggaugugcccgcgggcagggagaccuguggcccagcugagcugccaggaggugagaggcuguguucugagcccagaucugugucccacagucagggagaaagaaacuuuugucugggggaaacuuuugucuuguucuuaucccccaagaauguuugugcccaaaucaaccugugcucacagaaacuggagagaaagggggcggggagagugagagauguucagggguagcacauaucccuaauuagcauaugcccuaaagaaacuuguuucuuaaaguuugccuucuagcuguggccuaugccccagaccagccuguaccccucagacagccugugcuuccaaacccagcugguccccucagaacaacagccuguauacacccccgccaacccguauccccuagaacugccugaauuccccaccagacagccaugcacccacagacagccugugcccuuaacuagaagccuggagacaucccacauucccauucugugugccucuguggagacagaccacccuacgcccacccggaaguaaaaaaaaaaaaaaguucuauguugauucucuguuuucagauacaaucaacugaaguucuuaccaggucuacucaccgcucugggugcacuuuguaccuccuuagaaauguuuauuuccaguuccucucgccuugacauggucgggacagacauuacagcccuccucccuuacucuacagacacuccacaccccucauggaacccggugguuccucugcucucagcugugccucuuacucucugacaaaacaugcuaugcccuuugcuuagugggauaaucuacauuccccuaggaacuggauauguguuuauuuuaccucuuuugacacccaucaaacccacuuugguuauauuagcuugaugagaucuuugccaugcugguccccagcauguacccaguauucucaggaccccucaagaacauccuucaccuucauccuucacucccucugggcucuggauggauuuuuuuuucauuccucaauuccuacuuuuucagaugugauauggaacccaaaauaggauguucuaagccuuugauagcuaaguggaaugccuucacugucuguggccugaacuaccugucuguccugaucagcuaucuuaaacaguuuccuuuugcuguuucuuacuguuuggcacuucaaucgagaugaucccaaaccuuugcaaaaugggaugacaaaaacaaauacgggaugccaguugggucuggugguacaggucuguaaccauagguacucaggaggcagaggcaggaaggaugugaguucaagggcacccugggauacagagggaguucagaguugccugugcaacucugugagauccucucucaaaaaaucaaagccagaggggcuggagagauggcucagagguuaagagcacugacugcucuucuggagguccugaguucaauucccagcaaccacaugguggcucacaaccaucuguaacaagaccugaugcccucuucuggugucugaagacagcuacaguguacuuacauauaacaaauaaaauaaaucuuaaaaaaaaaaaaaucaaacccagaacuggggggcguaucuaaguaguagagcagcugccuaaaaucccucagagaguggcugagguguaguccuguggcagagcaccugccuagagccccccacuaaggggcuggaaguguggcucagagcaccugucuagaguuucccagugagggacuggagcauagcuuagugauagauuacccccagaccuguucuacaggggaggaaaauaaggagcaacaacucuuagcuccuaaucuaagccucaggauagcuuuauagggucugacucuugggugucucuguuucuaagaacuaugccuuacugcaugucacuagcgcuuaaaaagaucucagaggcccucacucuuuggaagagacuguccucugccacuuuacugugugcuucccuuucucuucccucuacuugucaggauuucaccacugagcaugguggcacacaccaggacucaggaggcaggaggaagaccaagaguacaaaaucagcucggcuacauagugaguuguaggccagccuaggcuauauaauaccuuguaucagaaacaaaacaagaggacuuuaccuuucuuccaaggccauuaccagcuccccauaauucugcguuaucagaggaccuauccuggacuccacugucucaaggaaauaacuuccuuuaaaaauuuaaagaaagcuguuaugucccuuggcugucagagagggacucacccuguuguuuuccaaguggguuugcccuauucucuggggcacauggacauaaaauccuguuucuagcagccaaaugagauuccagacaccacacccaggcccagaagggacuuuuuagcucucucuguaguugauuaucagcugcaaagagcaucuuucuuccacgggaagugcccuuugccucuuggugcuguaggacagacugcucuguacaauucaccuguagcugcucuggccuagaaacugcaaaccccuuuugccugagcuuguacugggcaugccccauacuaucacuugacauagauuuagccauuuccacuucuccaaacugucuggcucccuuuccaauguucucuacccucugugguuccucacccccccuuuuuuuucuuguauuugaguuuccucaugcacaggucacuauagaauacacuuugggagucaggauguagguaauuggcagagugcuugcccugagucugaccccagcaccauauaaaacagacauggugguacacaccuguaauccuagcacuugggagguggaggcaggagggucaguaguucaaggcuauucuuagcuucauagcaaguucaaagucaguuuagaauacauaaaaccuugccuuaggaaguuagaacauccuguuaacuuuaagcuuucucaugucuacauuagcaaagguauuuagugaaucuuacauauguuuauaacaagacuauugucugcuucugcaagguccuucuuaugcucugucuuuaaaauuuuucauuuuaaaaaggucucauguagccccuacuggcacaacaucucccuauuuuaaaaauuauuaacccuggcagcaguggugcacgccuuuaaucccagcauucgggaggcagaggcagguggauuucugaguucgaggccagccuggucuacaaagugaguuccaggacagccagggcuauacagagaaacccugucucgaaacaaacaaacaaacaaacaaacaaccaaaaaacaaaaacaaacagacuaaauaaacccuucucucucaaaacaaaacaaaacuaaacaaacaaacaaaaaacccugucucaaaaaaacccaaaaaacccaauuuaugcaugguaguaaccccuuuaaucccagcacuggggaagcagaagcaggggaccucugugaauuugaagccaguuccaggauaacaaaggcugacauggggagacucugucucaaaacaaacaaacaaacaaacaaacaacaacaaacaacaacaaaacccucuccuaauucaauccucuaauguguuugacauuguauucaugcacaaauguuuugauuuggaaauauauagaguuugaguuuauauacauguguguuuugauuugaaaaaaaaaagguaccaugugauuuuauauuauuuucaauguaauuuuucuugcucaacauugugauuuccaaaacucuuucauuugcuuuaugcuuuuguaguuuaugggcuacuuuaugcuguaaagauguccauuagagugucuaucucaacuauauauugcccaagagauggacacaagauuaauuccuucugcagcucaguaaacaaugccauagagaacaaccauaucuauaguccuauauguguuuuauuuucuucuuggaauacccagaaguaaaaguauugugucacauagcauagacacauagacaugugucacuuagugguagagaugucuucugagagaugcauguuaaggacaacucaucuugagaaucaaagugugugcuuauguagauagauuaugauggcugcuguaugacaaagccuuggcuuguuugauuucuacuuuugaauuauguguauauguggggacggugaguacagguacccacagaguccagaaaagagcauuagauucucuaguauggaucugcuauuguaagccaccucauauggacaccagggcccuaacucagguccuuggcaggggugguaugugugcucuuaaccacugagccaucucuccagcugcaaggugacauauucuuacugugccucagucuuacacacagcccacugcugacuggacuguuauugccugcuguacaccuguauuucauuuucuaaguaugcuagaguccuucauacauagauagugacaguuaacacucccagcugcuuccucuuaucccuccacugcuugauacugcccuuucaauauuugcccaucuaauugaucugaaguggcaucucccugcugcuucaaguugcguuucucugacuccugcugcagcaaagucucucuucauguacuugugaacuauccagacuugcccuccugugaauaacuauuccuauccuuugccaguuucaauagguuuacuucucuccccccuugcuaaucugcaggagcccuuuguguauguagcauaggagaggaaucuuuccugagucucuuaggcuccugguaccugcaucuugguguccuuuguugaauaaaaugauaacucauuuucaauccacuugcuucucagacucacaugaaagagccaggagagaggaagaaucagagggccagagagguuaaugguucccuugugucaaagacuuagauagaagggcuugagguuaaaaccucagucuccggacaucagugauauggcaaguguauuuauacuucagugucauuucccaccuuuguacauuuaauuuauuccccucucacaaugugugugugugugugugugugugugugugugagagagagagagagagaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaggagaggaagagagagagagagagagagagagagagagaggagagagagagaggaaacccacuggagucuucuaccauguggauuccaaggcuugaacuccggacaucaggcuuagcaacaagcuaaaccaccuugccagccugauuuuucuccucuccucuuaugugucagccaugcuaauacuuuauuuuuaguucccuguagugucugggaaauauccagccuugagcuuauacaaaacuucaugucaucaccucccccuuuuuuucucccugcaccccacagaagcaaacugcaccuacuucaaauucuucaccacgggggaaaaugcgcgcaucuuccagcgaaccaccaagaaaggugaggacaucucggauggugacaagggagggcugggaguaggaugacugcucugaaggagugacagacagcauugugcucaggaugggcucagccucuguggaugucuccaauuuggaaggugacgguagguuaagaauguggacaucgaucauuagagcuugugucuagcccacuggccauuuacucugccugugcuguauggcuugggcaaaucauaccugcucucuguagcaagcacuauaaggacauuuuauaugcuaaguccagcacccaguuuguuagcacaguucuaguccuugcuacaagccagcaaggcuuggacuucagcuucaucauucaggggagaaaucaagucaaaaaugguugagagaauuacuuuucuuuuuccacaaaagggcagagacaagaucccaacccaaauaagucuaaaucuacaaaauuguauaugacaaugcuacauguauacacugguccauaugauggcuuccagcuacguguggcagccuaguacacagaagauggcagguguaaugggaggaaaugcauuuuuaauuuuaacuuaagugaacuuaaaaugaugucugguagauacuacgguacucaguacugcaacucugagaacuuuguccuuucuaccuaaguccagcuucucgaauaucacuccagugccccagugccuccacaaaggaacuggggucauuccaugucucucauucuuuguuuuguuuuuaaauaaggauuuaaugagaccaagcagguaagcauaugagugcagguguauacucguaccccuuaccuuuuacauucuuuucuugugugagcuggcucaggucacuguguaccuuugguaaaaucauauggaccaccuacuaugugcugagcaccacacugggcacuucuaauccugauuuuacagggauuuuccagagccuacgauugacagggccuuaccaggauuuuccagcugaggaguaguuagggagaauuacaaccuagaugguuacaagauaaugaaucaccuuuaccucuguucccucaacuucaucaucuguaacccagugaugaccaaaggauaacuagcagcugguuaucccaguaucccugaccuggccaugugccccuugugcucuaacuugagccaaguagcuaacugacccaucugggucuccaucccuucaacaauguaacacacucucaggaggucuuugaaguuuuccaucuuucuggugcugguucuuacagaggagugcugucuauucuccuauucccacauucucuaccccuuccuuggccccucuugcagagguaaaccuggcagcugccgugauagcugugcugggccugacggccauggccuugggcugccucugugucaucauggugcucaguaaaggugcagagucccugcuccgauugggagcugucugcuuuggccucucaggugagggccaaagacauugcaugcugggaggugagaucucuacacauugcugcaugcugggaggugggauuccacacgcaguuacuugcuuagaggugggaagacccuauugcaugcugggagguguuucuccgaacacuguugcaggagucccuaccaacuguugcaugcuggaaguuaggauccccacacauauuggaguguugagcagugggaacuccacauaauguugcaugcugggaaguagacucuccaagcauguugggaaugaggagaaacccaaguauauuauucaaagguggaagaauuccagagacuuuucuggcaagguuuauuuagacuuaaugcuauuuuagauuuggagcugugagugccaagaaucuuuacacacugagaaugggaucucuccacuaugcugggaggagaggagagggcaguucaaggucuguuguaggcucaaagauggaauuccaaauccuuuuauuggcagaagaguagacugucuccaaauacuauuuagguuugggcaugggaucgccaaggauugcuucaugucaaggggagggggugaucuccagguacuguugcaugccaggaguuggagcgaauucguguaaaaucuaaaaucuaggaacauucuaagccuguuguugcaugacauuugcauuuuuccacauguuuuuuuagauuuggcccggagucuccaacacuguuguauaguaggagcuucaggcaggacuuugagcacuauugcaugcuggaggucaaagaagcucaugagcugaguagaucugaagaugagagucucaagccauucagaagguguuuuaggguuuuauugcugugaaaaguccccauacccaaggcaacucauacagaaaacauuuaauucaaaggcucaauccauuaucaccauggcaggaagcauggcggccuccagugcuggagggaccaagaguucuacauccugauccgaaggcaaccaggagacuuuuccacaccgggcggagccugagcauaggagacuucaaagccuacccccacagugacacacuuccucuaauaaggccacauuuccuaaaaaugcaacucccuauggccaagcauucaaacucaugaaccuaggggggccagaccuauucaaaccaucacagaagguuucuagucuuugaguguuggacuuggaguuugcagguaguguaggugaggauccagaaaaaaaugucauaucuugugaaauguagaccucaguaaauaacaaagacuucagucuaguuuacaucuaacucaaagcauuacagugagugaacuagcuaaagguugacauuuguuuuauuauuauuuucaauuuuuauuuuguguguauugguguuuugccuguauauguguuugugugagggugucagaucuuggaauauugauaaugggauuugaacccagguacucuggaagaacagccaguacauuuaauggcugagcuaucuuuuuagacuccucucucucucucucucucucccucucucucucucucucucucucucuuucuuuuucucuuucuauaaaugcuuuuuuugcauuauguccauuccugaggaguuuagaaaagggcacuggauucccaggagauggaguuacggaugguaaugagcugucaugugagugcauccugaguucucugcacuagcaacaagugcucuuacccaccaagccccaaagauuacgaguuaucauuuugucaauaagaguacugagacucagaaaagucaagugacaucucauagccaugcaaacacuaauggcagcagaaggacuuuuaaaaaaauuguucaugguggugacucuagagaugaugguggauguuaacaucuaugugguagcugugauggugauggugucauuacaucauuagcgaugacguaaugauagauguuauugucuuagggguucuauugcugugauggacaccacauccauagggagaaaagguuucuuugaucucaugcuucuaaguaacaguccauuacuaaggaaagucaaagcaggaacugaugcagggccagaacuaggagacaggagcuggugucaaggccauggaagaacacuguucacuggcuugcuccccuuggcuugcucaaccuacuuuuaaaaagaaucucaugcaggaaugcugauucccaagcagcuaccagauuuuacacucacaccaacgcugagcaugguucuccuuuccccacauuuguugucauuuguuuuuuuuuuuuuuauauucauaacugacuuagaauuuauuagcucccaggcuggccuuauuaaggcaauccuccugccuuaguacugggauuauaggcauacacaaucauuccugauucucccuacuuaaauuuuuugggggugcuagagagauuguucaaugguuaaauguguuugcucauaacugccugguacuccaauacagaagaacuguugcccuuuucugaccacuguggggauuacacucauauagugcacacacacacacacacacacacacacacacacacacacacacacacggggguggggucugcaugcuaaguacagacauaauauuuucagccccguuccauuugugcaguuaaggugacuguugaauggcugaggacaagccugagagaauccucaguuccuugguugauaaagggauggcgggugacagucucaaaccuggacuggagcuaagagccucacucucuucuuccugcacaggccugcugcucuuugucagccuggagguguuccggcauuccguaggagcccugcugcagggagucaacccugagaccccuccagcuccacgccuggccuaugaguauuccugguccuuaggcuguggugugggcgcuggucuaauccugcugcuggggggagucuguuuccuccugcucaccuugccuuccuggcccuggaggucacugugccccaagugggguggcccaaccgccuagagccugcuuucugaagacaucugccaacccugucucaguuuccagcuuucuccucaagaguuuucaucucucuucuagagaaauuguuuuucccacucuggggggcccauuucacaaaaugucuuggucccucccucaucuucucccuguaaauaaugcuuuugggggugaggggaauggcuuagugaguaaagugcuugcugagcaagcuugagggcauggaguuugaauccccagaacccacuuuaaaagccaguacagcagcacaugucuguaauuccaauguugugaaggcagagauuagaggaacccuggaacucacugauaggcuaauuagucuagccaauuaaugagaucagguuuagugagagaccccuuaagaacuaaggcagaagcaacaaaggaagaugcuaaacucugaaccccccuccccccccuacacucuuuuuuuucuugguagaugauuuuggguugcuugagguaggaugggaagagguuauaugcaaauggggauccguggggaaacuucugggacugagggaguguuagcuggugagagggcuagguccugagguccuggaaggacuggggagcuuucuuuguccaagucuauacugacucacucaagggagagauguccuacgacugccuggugggacagggaagagcccugguccgacuucacugucaucugacuugggauuaaagguuugaagaugugacuguag

SEQ ID NO: 3509 - RNA, 12776 nt, Mus musculus
gucaaguuuaaaggcagcuguaauugguugcgagguguauucuacccugaacucauugguuagcuaugaauguggguagaggaaaacgacaaaaagcauagcgugugaguguuaaaggaagcuuaucuagugggagacggagaggugccagaggguuggggauaguaaacccaagucaucuaccaaucaaaagagccgccagcccuaaggggaggagcuagacaaacaccccgccccuucccucgguuagccaauaggguagcuauuaaccugccgacaggugugguugucggagcauccuuccuuugccugucuaggcuguuaucugauccucguaguuauuccccaagcgcguuugcuugguauaucucuaaaacucagugcuuucuaaaggaugaaagaaagaaagaaggaaucaggaacauugcagaagcgacugagaaacacaaggcgugggacugacguuucucugguuaaguuagcagacugggaccuucccuggaguugcaaggacuccagcuguagaggaaacugcgcuuugcccuaccucgguuacaucuguaaugacuacucacuagaguucugcuaugcuucuuaaggaguaaacuucuccgaccacccuugccgagugcuuaggugagccucugguuuaauuuuguuugauuccugccguuuuuacacauacuugagucucacucucuggauuucucguuguuuaguacccaugaagcacuccauagcccuuugcugacuagguugcaaacgugagcaccacguuuucaugaauuggggaaacucgaucuaucucugccuacuauguggaggaaaagaagauaaauccacacuugaagagaacgugcacgugcauuucaccgcaucagaauggcaugaagcaagagagaaaaaauggcuuauaaaaaggcauauucuucggcuggaaagauggcucagcaguuaagaacauuuuccugcagaggaccaguucccacaggguggcuugcaugcuuguaacuucaguuccagaucugacucuuucagcuggcaucugcuggugcacuuaagcucacacauuuauguaauuuuuagaugcauauucuuagggucacauagacuuaagaaggugaaaccuagggaccaguguuuguccagauuuuuuaaacagcuucuacacucucucgaguuuguuauucauucaguuuugcuauuucaugcgggcccaagaauggggaacugcuucuagcucuaucaggaaucccugccaaauuauuaagaugcagcuuccuucuuaucuaggcgguccccaauucugcuuuuucuaacaagcucccaggauauacuaauggccuuaaaaacaguuaugauucucgggcugagcugcacuuuagaaucaccgggggaguugguggagguagaauccagauacuuaagacuuaugcuagaacaauuacaucaacagcuagaguuggaaacuaguuauucuuucccugaaaugauccauggaaauuccuguuuuucuuuccaguagagagauuugaaaccaaggcuuaacaugcuagggaggaagacuacuauugagcuauuuccagucgauucuugccucuccuuuuugacagauuucacauaggacaggcuggauuggaccuagagcuuugcagcagagaaugaccuugaacuucaagucuuccugcuuccauuucucaaguacuggauuucagguaugugcuuaccaccauguggcugcuucuucgaccuuuuaaggaacuggaagucacuguguagacuagguucgccagagaacucacagaaaucuggucucugccugguaacgcugggagugagugagugccaccacaccgcaaagcccuuuuaaaauguuugagacauggccuugacacugcuaggcaggcaccccgguuugaacuguauugcuggcccuuuaaaaacuuugauuguguacguauagguguuuagcuuaugcgugucuacaccacaugugcaccuggugcccaaggagauaagaaaaggaugucauucucuggggcuagagcuauagaccauuguaggcugacgugggugcugggaaucaaacccagguccucuugaggagcagccaucucuuuagucaacucccccuaacauuuuguguguguauaugcauaugaaugugugcauaugcauaugaauguacugugugcaggugcacaugcaugugcuuaugaaggccaagucaaucucagcagcucauuuuuuguuguugcuguuuuugagguuguuuugcuuuguuuuagauaggccacucaucaggaccauacauaccuguguccaccuugucagcauuggaauggcaaauacaugcuaccaacuccuugccuuuauaugggugccaaguauugaacucaugguuuuaugcuguuguuuuggcuuuauuuugguuuugggguuuuucaagacaggguuucucuguguagcccucaauguccuggaacuuacucuguacaccaggcugucuuuagacucagagaucugccugcuucugccuuccaagguucccauguuuuuaugaaauacacuuuaccaacagugcuaucuugccagaucucccuagcuugcuugcuugcuuucuuccuuccuuucuuuuuuggacacuggcuuuuuccuacagccuaggcugaccuugaacucaacuguguagccuaaguacuuccaacccuucugccucaaaagucuccugaguaaguaggauuacaggcuuaaauacacauuuuuugagcucuaucuuagcaaaagugaaaucaaacuuuacgaccagcaaccauaucuuagugaguccucaagacauucugcagcaucuugaauuccgagacucacaucuucauacuucacuccacucaacacuggcaaagucagaaugaagucaggccagggacagaguagggguucuaagggaagugacagacaaagggcuuuccccaacagacccacgggggacuacgauuaagauacaguauguagagaggaauagagaccaggaagcccaagauagaaagcccuaaccucaccagcuacaucuacauuuagaccaacagagcuaaccuuaagcagagaaaauggagcccagcagcuacucucccucagagaacgacagacucauaacaaaccagacacaguucgcacuguucaacguucucccuugaagccccggcucgcaagucagacuggguggugugcacuucuuuugcuugccuggcauuggucccucccacaggacacccgccugccucacccuugcugaggaccuaggcuuggaccccucaucaaacaugaauuaaaacaauaggcuccaccaugaaugcagaacugggugggugcuuucuguacacacuuuccaaggcuuuuacgugcuucauuuuguguggauguuucuuggaccaaggugucuagccugagggacaacaacccugugggucuuguuggguccuggaguuuugugguggccaugaugcugauguucucauggggcaggugaugguguuagagauagacaggguuuuucuuagauuccaggauaagagcagaagagagcuggguccaugcugcucacacuggaagccccacagcucugaguccuuugguucuuucauaaucacucacacccucuguucagagcccgacacuacacauuuaauuguacucguucuauaaaagcacugccuuucccccuguaaguaaaaaagcugagugugaggaagaccuuucugcccguuuagggaagcagcagcauggaugcugggggaggcaggcuaagguucuucauccuuuuucuuggaugcuauggccuugggccaaaggcaaagcauggaaggcugccuccaccacaccacaacuuccuggcuggauaucugucacuucagaagcuccaguccuuuauguccuuucaguggauggucaccuggagugcgggcuccuucagguagacauggugccacuuuucucacccuugaccuugaggaacucggccaugcuagagaaauacuucugguuggccucugccaccuucuucucggcugcuuguggguucacaaucucuagacccuggguuggaaaggaagagggugacaggugaaguugggaagcucaggccucccucuagaugagaaccagacaugucagagucucccagacacucuuguggacauggaaccauuuacagucccugaagucucccucaguuugggagauuuuugacacaguggguguugggguaggucuuagaugucaggacuguuaaucuccucaggugauguuaaaaucaccacuccugccugguucuggauaaggaaacugaaucccagagggauauggccagccaguuuccugcaaaucccacccaugacagugaugacaaugcuggcacuauauugaauauuuccaauccucuugcugggcuuccccuaaucccaucaccguccacgccugcuucuuccuggcaccugugucuucuaauacauuguguacuagacucaaucaucugugcuccccaaccuucuccccacaaaagcaaagcuugucucuuuugucucuaugcccaaagccuggaacauggugggcaggugcucaguaggcacuuguggcaagcuagggagcucuuugguuccuugagacauuauggggcguacuugccuaucucugugguaaguaaccugaggccauucugcuccacacugcucagugccgcugggcugcugugauacucaagcccacccugauggcauccugacuacgggacuauuuuuaaacaaagacuaggaaguucagagaguaucuggaucacgugggcagcauccuaguccugguuccaaaguuggucugaguuugucacaacugucauggccaacuguuaggcacuuacugugugguuguggaugccuaagcucaugugcuauaucucaacagaucuccacagcagccuuaucauaugccugguagaaaaggguaugguaccuggaguggagugaaggccacacuggaggcagucccugaggagcggucacgaauuguugacuucccaccauacaccacgcucuguuucuguaagguccgcuguagggaaaggggaggcugggauccaggcucacugaccuccauaucccaccugccucccauucucaugggcccaauccauaccugcagugucuuggagauccuggccuugguggccucauucaccugggucugccgcacacgcccacugccugacuugcccaaguggcccaggcuaaagcccaggucuuccugauaggcauccuccucaaucuggugagacgagagcaaccugcgguuaagaagcuggguacauccagccaguccccugaggcagucaccugagaacccaaucagccagucucauggacaccaccucaucagccaggggacuggcagcauuaagugaccuaauaagagccuacccuauuggccagaguccaucauccuuagcaguauguaauuaaagcucgcuucacauuugucucagaaaagaaaaaacaaaaacaaaaacaagagccuauccuaccucuguuuggguauagcuaggaacccugggaagaacugguuccugaccugaguagaguagccauuuuuucucuacauccacauuaaguugccaagaauugggaugagccgcgcuacugagguggcaccuaagcggauucuuucaggaccaccuagaugacagucagauauagaagcagccuggagagcugcgugggaagccagccagcugagagcugcaaagaucaccauggagaaggugguuuaagaggagaggcuagacaagagggaggaggguuggguagccccagaucugcucucagauuacaggguggggaggagggauggcagcaggaugugcagagagaagacccuaauauggucccacugguacuguggaucaagccugaccucuccaaagcucaugcgguuggccugcuuccggaucuccgucaguccuagccguuccuucaucuugcgguaccuagggcaaguggguguuaacaggauauagggagcuggcugggaagaaguuguuucccuuccccacuuccaaacgucuagccccaucagaacuccuuaccuucggcccccucgcuucuuccgcugcccaucaaggggugcaggcaggggcuucaccugcuucacgggugguggcuccugccacuuaucaaauuugcgcucaaucucauccuuuaguucguagcccaccuaggggggaguugagaagcgguggccagccauguaaacuguccccucagccaacaucuauauaucaucaacccaucuauuguguaucugaccaccugacagugugcccuccccaagacauguucuucacguuuguccaggaauggugcucuguggguuccagugccuagugcuccuugaacuuguagcucagguucaguccucauaucuaagcucugcacccucuggauaauugucucugucugaguccugggccaggcagaaucccuguauucucuagucaacagacagcgugucaucuccacugccuuacuuccacaccacagaucccccuggccucuuagaacagaccccagcuagccugcuucucagugccucuacagcagccagaggcccucaaagguuguacacauuaucugcuccuggaagcagaaggcuccucucccugcugggguucacucaacucuggccucaagaucuuuguacucacuauucacucugucuggagcacucuuccaaguggauagcacaaguagccacacgacugacuauaacuucacucaagcccaaauuaaaacguccucagaaguuuuucuucacauucucugucaucagagucuaagcuuccuaaccccacagccccccugauugccccuggcauucacaaagcaccacugaacccacuacagacuuuucagaacuacugccuaguuguuuuggucccagcuagaacauaaaugcugugugacacagcaaccuccaauccuagcuagcagcuggagcaggaggaucaaaacucguucaaggcuuuccuggacuagagauaagacaugucucacaaaagggugagggugagcugaggauguauagaucuuauagauguauguucagugguacagaucaguugucuagaacacguagaguccuagguucaaucccaguauacccaccacacacacacaaaagccacugaggcagaccuuugacaucuauauaacccccugcuguacugccuuguuuagaaaguggcaaaaggcaaaaccaaagacugaaccucugaccugggcuaugauguaauuucuagcagggaaaugcacacaguauuguuucuuaagcccacacagaaaaauagaugguaucacuggaaucaugucccugcuaguacaggacagguccuacuaugguaggcaaaauacugucccuuccaacacagggcuacaccuuggugucagguguccuggucucuaggaucugugacuacauuuuacauggcagaggaucuuugcacaaaaagccaaagaucugguaucauggcuucuacaccaacaccucaccuaucuccugagacagggucucucacuggaacuuacugauuugguugccaggcccacaagcuccaaaugcccuccugccuucaccuucccagagcugggguuaguuacugaugugaaguacucugccugcuuucuuuuuucccuuaaccugaguuaggaauugaacucaaguucucaugcuugcaugcaggaacugaagugauggagccgcaucuccagcccugggcuuuuuuucuuuucaaacacaggauuucacuaugcagcccagucuggccugaaacuuauauaacccagacugccucaaacuaaugaucuucccaccucugucucucaaguauugauguuaaagaggccuagccaacuuuuauaugaagcuacuccaucuauagugaguugucauaacugauacagagcugagaaugugauggccucaguagggguugcagacagacacaucugucugcuagucagaagaggucucugaaguagcaucuucccaugaaaagaccccaagcaccagggacagaugccuguccucuccucaccuucccuucugugcucucauggaagcuguccacacgagcugccaguguacacuuggcagccacuaggcgggccgccuuccgccggagauccuggagcaauggcaaggagaaaggaaacugaaccucuagagaagguaacagccacuacaauagucacuccucaucuagggcagccauaccccagacucugggagguaagccucauacccgugggcucuucuaauaacagccucuugagggguacacucuggcugccccccaguuuccagccacccaacuauuauugccaagugguggccccagaaugguauccuccaggagccugaggaauauugccagccaagccagauaaggccugguggcugggggaaggggacaaggugaaggacucacugggggcagagacugcacaaugucacugugguagauauaaccaguaugaggcaacacugagguagaagagaagccagacagggucuugcgcugggcucccagcagcaugauguugcaggcaggcaucuuagagagguuggugagcccuccagccacaccugcaacaagaggugaggucagagcccaggacuuccauccaggagcucauguauaccuuugugcuuugaguaagagugacucccauaggcgcauaaagucaccaugaggugaaacucauggauagacuagacugaucaggaggcguggccuuguuggaagacauguaucacugggggugaauucugagguuucaaaagcccaugccaggucccacaugugugugugugugugugugucugcuuguggaucaucuacaucuccagcacuauaccugccugccgcuguguuuccucccaugaugauaauggcuuaagccucuaaaaguaagccccaguugucucuucacagcaauagaacagugacuacgacgucuuugcuccuucauuuguuggcugguuugauaacaaguauuucacucuguagccaaggcuggucucaaacucaaaguaauccuccugccucagccuucuagauacuggcguuacuaguaugagcuacugcaucuaggaggauauggaucuuuugggggguauuuuauuuuuauuauuuuauguguauaaguagggugugugaauggagaccagaagacacuuuugggacuuagcucuucccacuuggauguggguuugggggaaucaccacacucaggcugccaacccugggcagcaaguucuuuuacuagcugagccaucuuucuagcacaggacacagaaucuuuaagaagauggcugagguaaaauaaggucauauggauccugacucuauccgacuggaaugcuuguaaggaaaggagauaaggacacagauacaagugguguaacuccaugaagacacagaagacacgucugagccaggcagaggccucuggagaggucucacagcaccuuggucucagccuuugccagcucugaaacagccuggccagagggccucaagacugaagcuaaguaagcaaagauggugauuuuccccauauucccuuuucaagcaccucucugcaaugagggaagggacucugcuacaggagcuuccaggagaagagcauagcauaugggaggauuugcugccccaaguaguaggaaagccugagcugacuucgguacucggugguugcuccagagucuaaaaugggccuauugucaggaagaggccaucugugcggucuaauuaagccagccagcucaaccuagaaggggguugcugugcuucuauuguguggaugugccaaacuggcugaccucugacuucaggggacaacacaauaggccaaaccccacuuuccaaggcaaccuaaccuaucagcagacucugccaaagggaccccgcugggaccucacccaugaucuuggcagcuguggaugcuccaaugaugauggacaaguugggugcaaugaaggacauccgggacuccacauacucauagaugcgguguuuggaggcauucagcuccagugccaugucacaggccuccucuagccgcucuagcuccucauccgacagcugcugccuacauuguggagcacgugaggguugugggcagacuccagcuuugcuagguacauuucuuucuuuuuuuuaaaagauguauuuauuuauuauauguaaauacacuguagcugucuucagacacuccagaagagggcaucagaucuccuuacagaugguugugagccaccaugugguugcugggauuugaacucaggaccuuuagaagagcagucggugcuccuacccacugagccaucccuccagccccacuagguacauuucuaacugguggucagccccaucuacugucucagcuguguauguauguguguuuguuuaguucugggacuaucauaaaaauuccaucugucuaggggccauaauucucagucagcaccacucugaccaugcccuccauucugucucuccuguuaauuguccuaugguaggcuugcggcacauuaccguuuggcauacauaccccuggguaguagaggcagugacacuaacaaccaugauaguagcauuggucaggaucugcuggagguucucauuguucuugcacuuauccaggcuguugcccagcuccugggguaggaaggggagggagaauuuguaguaagcccaaaagacccucuuuugcuacaacaccaacagaggucuccccuugaggaagcugggaaagcuaagguccauacacuggaggccucucuuuccuuuuacacuuuuacaaccucccugccuaaagcaucagugugccugcucugcucuacggaugcagaaguacaagcuggcaaagcagccuccaaggaagacaugcugcacuaaagaggccgucaaaagcgcacuuuauuccacagacacaauuccugugccaccauccugaucuccuggacagaggcaggaccccugcucuuucacuuccacucgcuccaaucccuuguagagaagccaacaccuuccacaucuaauguucucugcccuuucugaccucuccaagcuucccucccugccccuucugacuucauccuugcuuguucccacgcagggucuuagcucuuauucagcgguggccucugccagcucaaaggacaccugcuccaacugcagccagagguaagggccaggucagugguuauccucccaugaaaccaaggggaggaaggaagcaagagaugugcaugacacauccauuccaguaucugucccucaccacugagccccauucaugacucuccauuauuucuagacuugagguuucauggucuaguggccccaguucuucccaagccagacuucucuccacucaccuugacugugcggauguaauccagagcauugggcaccaaggauucuagcucagggaaucucuuugaguauuuaucccggaugaacuuguggauaaugucuaaaugggacaucaaggacaggugucuacugagggggaggcagacucugcugcuauccccaauaccuacuuccaccucucuaguaaccaaccccaaaucauucuaauuuccuagcugucuccaaugcuaugugcaggugggaguuuguucuacaaaagucuacaaaauaugaacugaaagugacaauuuucaacuuccagaucguggccuuaaggaaacaacuauggccuaucuucccuccacauuugcugguagggaugcagaggugggcaucauccuggagcacguacgagguggcaaagccuggcugcucaagggggucaaaggaugacucgagaccugcccugcuuauucagacuuuuaugauggaggagaguacaauuuauguuaguuacucuguuauagaagaugaaccuaaucagggcaauauuuuugcccaagaaaggcaaacaaaagagguccagguucaugccuguucuucccuuugggucauaacgaaagagugaagagcacaggauacuggugucuccauagcccuucccaucacucacucagcucauuuucuaucuccacagucagguuguuggcauccacaaugacucgguacucaggagcugccuccacuggucccaucacuacaaagaagaagggauauggaugggggaggaacgaagcuggggacugagguggaggcuggauggaaucagaaaggaggggcugagggggcuacauaagggcugaagaauucacugaggcuuauauuccucuccaggagccuuacuccugcuucucaucuuucuccugcagucuauccucugggucaaucuggucuugaccucaucuugcuccaaaauuaaaccuuccuauagcuucccaaagccuugaggcuagcgagcaagauccucagacuggcacucaaggucucccauacagauggagguccacguuccccacaccugcaaccuuggugcacacagcacaggagucccuucagugagauccggugacucguuggcucuacagcauuauccuuucugcuuuucugcuccauccucccagccgccaccgggcacucaaggcuauuucacuccuccugccuucacagguacugcuccaucucccugggacauuccuuaagucuguuucuagaaaccacacuuuaugcauagacaauuaaauugguauugagu

SEQ ID NO: 3510 - RNA, 3521 nt, Mus musculus
gggggggggggggggaggccgggacaggcuggugagauggcucaaugguuaagagcacccauaugguggcucacaaccacccuuaaggagaucugacacccucuucuggucaacuacaguguacuaauuuaugauaaaucuuaaaaagcugacuugauuucucaaggacugaaauguagaaguagcaagcagcuguccuucaguugcucuugcucucauuucucaguucaaaccgcguaucugcaaaucuuccugucugacucaagcuucucggcaagggaaauagagaaugaggaagccagcuucgcuccugcccaggacaacacaaagcuuuagauagggaaguucucaagcagcccuaggcaaacaucucacuagcuuaucuccugcucagcaaaaccacaucuugaggcagaugacuuacaagagccacccuagaaguauucaaagcaaucucacuagagacuggcuccaaauggcuugcuuuccacuguaucacagugcagauaacaugucucccuucuugggaacauuuaccaaaauagguuaguuggacaguagcacagccuauguguaguggagcaguugcacucacuacagaggcacaccaauaaaccaaguaucaauucuuuuuuauuuuucagcuggaaaacuagacaauccuccaguucagccaaguauuaauuaauccucuuccucaucaucaccagcuccagccccgcccuggccuuucuuggcauucuuccucuucacucggccuggacggccgccgccauaaggagaacggagggagaagucgaugugcuucugagaguccaggcgaacaaugaaggaugggauguucaccaccugcuugcggacccuggacaggaagaacagaauaaggggacaaagugaggcugaaccauuugguccugcccuuugacucaagcaggcucacaggcacuccugaccucagacucaguaacuuggaaggaaaacaagagugcccauacuaaugcuuugauuugcuuccuguccacauuguaaugccauguggucucaaaccaccucagacaagaguacaucucugcccauaaacgaaagcuggugagaaagaaaucugagacuucacucuguauagcugucaugauuggugcucauuuacagaaggguuaacgagcaugcaauuucauuuaccccagucacuucagacaggugcauucucaacuggcaaauuaacaaguagaaauauagcaaugaaggccuagauuguaccuccacagacagcuuugucaccucaacauugacuccaaucucccuccaggggggguggcaccaagagcuguuaccuguccagcugcuugagugccuggcagacaccuucacaagguguacggcuugagccgcagugacccuugcgcugggcuauggggaaacaaggcuguccccagucccccauaagcuguuugcagggcacgauucugaacccucaaggguaagcucacaucugucagcuccaaaggcugcacaggagauagaauggcaacuuagcuaacgaaaccaacggcacaaguagggaaauaaagauuuacaggcccagcugcaacucaccuaaugugacguuggcggaugagcacacgggcauggugaauagauuuggccaggcccagcuuaaagaccugggucugcagccgccucuccaagaaauccucaaucuucaggcccaggauguaauccagcuucaucuugcccucguccagcaccccaaugcgaacaagccgccgcaggagagcauugccugugacagggggagcagcagccaaugaggcccgaccucagacuuccccagucucugaguagaggacuacagcuuucacucauuuuuguagggagcucuggugccugauaacuuuucuucccagagcccuaggcuugagacccugacauggccacugugccacccuuucaccaacaggcaucacgcaggcuuacaguuuuucauccagccuuuaagccuaagauuaagagcucuaaugcucaacuuuaaaaacaauuuucauuuucacaacaugaaaagcuagggcuaacaguucaaaggcaaucugagcuacacaguaccaucaggccaacaauauauacacaaacagcacacauuuauuccucagacuacucucccaggaguuaaaugaacuguguauguaggcccagucaccuauaagaaacccuaaguauggaauauaaauauguuaaaauauaggcucaaccuggauuaacauuguauaaacgcuacccagaugcaaaugcaaaaauacgucccccggauggaaaaauaaucauuacuccucuuacaccacaugaaacuaaauaaaacauccaguauuaagacagaaaaagcauuagugcaacucccauugucuuuggccuccauuuguccaaugcagacagaacuagauucuagaaacucaaaaagaauccuuguggugugauuggggggcgggugggggggugucgcagagaggaaacugggaagagaaauaacauuugaaauguaaauaaaauaaccaauaagaauccuugugacacauacccagcacuucugaauuucuggcaguuuauggcaagacugacuuacauuugaguuccaggccaaucuacaccaagacccugucucaauccccacuagcccaacuuguucagucacaucucccacgcccuaaaacacucagcaaccaccacuccuucgaaaauaggcucauacacaccuucaaacagacgccggggauccuucucgucuagcgucaacagcucccgggccgccuuacggaucuuggccaggguaaacuugacccuccaaaccucacguuuguuccggaguccauacucuccugcacgugguugggaggagaccgcggggcaagagccauggguuacuacaugugcauggcgacuagagaacacaaaacuaaacugcaauccucuggcgccacacaggaugcuccagaacgagcacgugggagacagacaucauggcuaccuaacucuucccggauccgcaauucgaaauucuacuuuggccacucaccaaucaacuuuagcuccuggucgagacgcgacuucucgaagggucuccguggggucacauagguuuugcgacaaacccagcuucuggcgaccggcauguugaccucgcuaggccggcugcgccugcgcaguaaagugucguuuuaaaaaauaaucuuguggcgcaugugcagcaaaaccccgcuagggacacggcgacaccaacucggcucucagagaaauccgccuuagaaaacuugaaaaugggauuguuccacaaccguguuguaacuuccagccaccuucgccccacccucuuacucagcauguucaugaagauucgaauggcuccguuaccuuacaccaucaaccccuaaaaggcgaacucaacaaucagaacacucaccuacgaacucaggcccgagacaaagagagacaaggcgguuggaccgaggucuuauaguaacgucgccuuguag

SEQ ID NO: 3511 - RNA, 17403 nt, Mus musculus
ccccaaucuccacccccggcccuccgggcuccugcucccgggagccccgcaaaccccgcuccgcccgcgccccgcacagcaccgaggcucccggcccgguccgccccgcugccccuccccggggccaugggggcacccccgggcuaccgacccucugccugggugcaucuccuccaccagcugccccgcgccgacuuccagcuccgcccggugcccagcggcuuugcuccccgcgaccaagaguaccagcaggugggauggcaaaccugggccagguccccugggaacaggaggcugggucagaguuccggcgucuuaggggcuggggacccggccugcauuugugaguacaaguccaagaucagagguauagcgcucauaccuugagguuccccuaggacgugcgcugggggugcagaccccucucuucccagauaaggagagcugggauccuagacuuccaagaauccugaaugggaggagaugggggcccagcauuuggguuucugagaccugccuggaaagccagucuuuagggucaucuaaggaaagguccgcucuugaggucccaggcgagaaggaccccgcccccacagaaucccgacuaguaaauaugucccagauuaaauuaaaaaaaaauuuuuuuuuggcggggggguggggguagagaaaggacugagagagggaaggcaggggaggcagccgaggucugggaaggauugauauccucaaauagggaacagagaucaggacuggggaaaccagcugagguaagaugaggauucaaggugccuucagccugucccaggagggaagggguuguuagggugccagagaggguugggauagaaaugugguuagguuccaggcuaaggaagacaacaggccugggucccaggagggugaggcuggugguggacccucacagacucuggggucccuagggaaagaggcccagcugcgguucgugggggggggggggcggaggugcuguccccugacccaguuuaauucaaguccuugacuuugagauuaaugaggagaaaagcuuggcugagcugggggccugguggggggcugggaguuggccuugcccuccccucaagucugaaccucuguggcagcccucugggaaaggggcacaggguugggagagcuucgagggagggggauguucccagaaaagcagcgagggggaucgugugcuggugugcuugcuauuugggucauggcuggcacagccugagcggcuccucccugccuacuccacccgcccccucuccccuccaaaugagcaccgccauccccucgcccacagccacuuacacaaucgcagccuccagccggucggcccacccacucccagcccaacucuuggggcuuauggcucuggagagucccucagccacgaggaauccccuccugggguccccaguaccaccacagccgcucagagcaguucacucaacccucaacccgauacucaucagucagucacagcugaggcacacacaguugcauuccugggacauuauucuucauagaaauggccauugugagcacagaaagaccaacuaagagagccucugagauaggaccugaacaaccauaugaccagucacauauacacaacacacucgugugugcaccaucacacacgggcacacucauacauuaugcacagcuacccuaucucacaugagcauaagcucacacacacacacacucacucagucuacuuaacacaacucacugacugaagcagcuguguucagaaaacauuaaugcccgcaaguauucugcugcauacagacacgcagcauggucuacacaaauaccucauccucucuccauaugcccucaucugauggaaggcaaacucacggccacaucaacguugcacugcacacacuugucgggcacacagaugauguggagggcaggcagcugugccaccguuuaaggacaguggccccugggacugcaggguugugauucuagaucucacacuuccauuacucugcuguguaacucuaggacaacuguguccagcccugggccuaugagaagacaugagacacaggucuucugaaagacccuaccauaugcagaguccacuauaguauaguuuaucugaagcauggccucacucucuagucggggcuggcuggaguuuguguauugauuggucuagccugaaaguguggccguuuucucaccucagcugccagaaugcugggguuacaggcaugcacuaucacaccuagaucagagccgcccuguuccacaagguguuucgagcuguaaacaucccuucugccuaccuuuccuuuccucuacccugugggucucgcuacacauuccgcccugucugcuuuuucuauaguucuguauaugccccucuuugucucuucaucucugucugucucucuccucgaucucugauuuaauccuucugauguuuugugugucuuaucuccauaucucucucuuguuuccuuggcugccucuuucugucugcaucgucaucucuuuugcucaucagucucccuucccuaucuccaucccugggccuugacucucucucucucucucucucucucucucucucucucacacacacacacacacacacacacacacacacacacacacacacacgcugucacagcaucccuguuuccauccccagcccuggggugacaaacucaguugcagugggugugugagcucaguagcaggagggagagagggguaaaggaggcugccucuccuguucucccgaaauacagacacgggggccuuccugccccuuauucccauacaguucagagagcagcagcaaguccuuggggcauguuucauuucaauugccaugcagcugagaaggaacuucuugucugggacauggaagugcccucugaggcuucucaacaccucuuccucaggcccugcugcugguggcagccuuggcugggcuugguuuaggccugagccucaucuucaucgcugucuaccucauccgcuucugcugcugcaggccuccagaaccccauggggccaagagucccccacccggaggagguugcgucaccuggagcugcauugcugcccuucucgugggcugguaauggggccccagggugggugggggcggggacagagauuccuauacucgcugucuuuuucuagagaccuuggggguaugagcccagaguuaggagggagaaccgcuaggcacuaagagugccugccugcccugugagugggggauagagagguuugaggggugugaagcagccugccugggaggagaaaagaaagccuacuaggcuuggagaucucagugguucucucauuggcccgcgguucuaucuagaggcgugagauacucucuagacuucaguuucuccaucuauagcgcgugguuugcggcacuacgcauacccuaguuacagugagaauagacuagagagugcacagugccuggauguccccuaugaguguuaacacugaucaaacucauucauucgcucacucaucaacucaucaguucaacaacugaacauaacuacucugugccaggcacugaacacgccacagaaagcacucugugauuucagccagagugccaaucagggaaacagaccguagagggucaccaccaguagcacccacucagcccacacuaaagcugggucuggguccuucucgugaugagagcugggcucaagauugccacaccugguccugaaugaggaucgucaggaagggagaaacaugacuuugcaagccuauaugguuuaagaggcaagcggagagucagacucaugguauaagaaccauccagggcucccaaugugcuugcucccuaggaguuaccccgaacuugacacugagauuucuggcucugaguccagccccuaccgggucauaguuaguuaaggggcugagaccuaguggggaccucauacauggccagcaggacuacuuuagaaaucugguguccccuccagccagcuggggguuauguccuggagcacucucaccccagucugggcugugggccacucuuccucauuguaggaagaagaggguguguguuugggaguauauggggguugggcgcccuauagccaagauuuuuuuucucaucaggcucuccagaauggggguggaugggggugggauguugaaaaaggcccagugggggugaggcacagccccagcccccucagagccuaggaacaagaggagcuuuguaggguccugaacaauggggcaagggcaguaggcucccauccaagggaugagguggggccuguguagcccaaggcugggaacugugagggcaucaggcucucgcccccuccaguguggaguacagacuaauggaggaaaguggguccccauauucaagcuccacaauggagucuguguguuggcugggcagagacagggcccagcucuuggccuggccucuccagcccucccucccacauucucucagucucuuccagcuggcuggaugccuggaucccugggcaucauaggggaaggcuuagagcucugggcacaaugucuuuuacaaaagaauagggucuagggcauuuaggaggaagggguaaggaacaccugggcuagaagagacagcacuuggccuaaugauuccuaagacaaggcuguaaaugcugaaugucuuugcaaaggaugugggaguuguuugugagcugaucacuauuaggacugauugauaaccuuuaauccagggcuagcuaggcaaaaaccaggguuccacucuggggaggugugaguuaaaucugggggcucugucuuuuccaccacuccacccaccauuagcaucacaaugacgucucuccagcagggggagugaggucuucagguuaccuuggcaacugguggaggcaaaccucgugcuguucuuuuucccacggaggaugaaccaauaggguggaugcagagaucagauaggcaaaugaagaagcugggaggauggguauguguguagaggcauggugacacccuccagggucugagacugguugguauuucuucuuccuuucccuucagugccggcauuggcauugguuucuaugguaacagcgagaccagcgauggggugucccagcucagcucagcacugcugcacgccaaccacacgcucagcaccaucgaugacguggugagagagccagccacugaccagacugcagacucaugccccaguuggucuucauaugggaauguggucccccacuggagaccaaaagcagccaaaucaaagcagauuucagaccaaaaacuuaauccccgaaugcagagcugcagacucagaccugcagacauugggccauauguucaaccccaacccugcaaaccggagcuggauccgcauucagacugaagacucacauccagccccaggccugcacugcggguuacaguccaagcauuaaggaaaccagcuccugcccucaggccagauccaaagcuacagacccuguccuuggcucagaugcaaguucaggaacuccccgccccccaccccacugugagcuuuuauguacccaggauuccagagcucagggcuaaggugcagcccacuuccaaccuugaacuucaguaccuacuagucagacuucagaccccaaccucaaaaaggcagaugcagauuucagaccuuaggucccccaaccccuuccauuuugaccuaauuucaacucugggauuagaaucuuuaccuuaggcucaagcccccugaccaacuagagcuccugacaagaucugggaaccucccaccuucacucacggucuccucagucuccagaagccccagacuccagaucucaggcaccuggcgcuccuuaauccugcuucaccacccccugccccaccccagacuuuaucccucguccacaacccuaggcuuccgguaaccaccaccccagaggugagacaaugucaucuccccaggugcuggaaacgguggagaggcugggugaggcagugaagacggagcugaccacccuggaggaagugcugucaguccgcauggagcugguggcugccaccaggggagcccgaaggcaggcugaagcugcugcucaguaccugcaaggacuggccuucuggcaaggagugucccugagccccguacagguggcugaagaugugacuuucguggaggaguacaggugggagaaggauuucccuauuuauuuuuuaagcacugcggucucuagauccugagggauguggguuaguaucugaacaguuuaauuugucccacugguugaaugagaagcuacuggcuggcuccugguggguggagacaggaugcugcccaucauccuauaggccagccccucugugauuguaaagcaaggcugauauacucagcaaugaccaaguaguugagggcccacccucauaguuacauacccugucacgaccacucuuucauucauuuacucacucagccauuccuuaaaugauucauucagcagguacaucaccauuccacacaguugcuccuggacuaacccuaguaguaauccuaccugcuagaugauucugggggcaccuguguucaucgugcaacucgucuggugagagacggugugcacgggauuggggaccuccgcuucaggaggccacucuguauuuguagguccuuaaacgaguuucuuuccaucccugcguuucaguguucccacuuuagaguccugucaugcauagcucaaaauggauuguggagaguuaguuaauaacaaugacagaugagacaaugccaggaaaauacagauauaucaagcaguguggauaacacaggaaaucccgcguaggagugggucuucucagcugggagagcaauauaaaauaggcccacaaagccaggccugggaauauaggccuguaaucucaacugcuccagagacucaguaaaaggauugaaaacucaagcccuguuugggcuacagaucucaaggccaggaugaauaacuuagugagacauugucuccaaauaaaauguaaaaaggcugaggaugugauaauggaagaacacuugccucgaaucugcugauaaaggauugagaaugugacuuagugguaaaacaucugccuagaauccccccagugaaggguugggguguggcucacuuaccuagaauccacuacugaagagcugggaauaugauucgaggauagaguugccuaccuagccugugugaggcucuauguucauaguagcaucaaaagggagaggggaggccuggagagaugguuccgugguuaagagcacuugcugugcuaugcauggagaggaccuagguucaguucccagcacucauauggcggcucacaacuaucuguaaguccaguuccgugggauccaagacuuucuucuccccucugcagacaccaggcaugcauuuggcagacauacacacauguaagcaaaacacuuguacauauaaaaauaaaaauauuuuuuaaaagcaaacacauuuccuauaagguggauaaugagugcuuuggagcaaauuaaauaggaaggggcuugucugaggacaggcaggcagcuugugucaggguguuuagaagggccauacuaaagggugguacuugaggggaccggacaagcuaugcagcccucuggggcagccauccaucucagcagccagucuucaccuacuuagaguuauuucaucccugcuugcuuggagcugauacuccugaaucuccuauucccaagcaggaggccaugcuccuugguacaagcacccuggggcugaaacaaucccugcugcggaugcgugguggggcaccaagucagugggaggcaggaagguucacugucaugguuccuaggagcccgggagcccgggagcuuggacagggagguaguggcggcugugaacgugauccuaagaagaugcucuggaaaagugucugacauuagagaggccacggaggugagccuggcaguguggucagggacagggacucagggugcaaaccacagcuccaugggaacugcugagaaugacacuacugcugagcauuugcggugugccaagcacugaauuugggaccuuccaagcauccuucccuguaguccuggugcguuacuuacuuaaguaaauauuauguagcauucaaagcccccuggauagugauuuauaacauuaacuauauccacaagcccauucauuuaccucgcaacagauuuugagguugauccuauuaugccuucauguuacugguagggaaacugaggcaaacagguuacauggcuaacugaguaguugagaccuaugcaccauaccucugaaauauucaauuaggucacaggugacugacacccuaacaguuggggaauccgauucagaggcugacaacugugcccauaagcacagaacuuguaugugaaguggucaggguaguuaccaggugcuucaguuccacacccaugcugcagagcgcuccagggucuugugaaaccauguaccaugucaccgggcagcagggaggucacaggaccagauuggguuggggugacuugggggugcugauagccuccugaggcucacugucuucuugguccuucuuccugcagguggcuggccuauguccuccugcugcucuuggugcuucugguuugucucuucacccuccugggccuggcaaagcagagcaaauggcuggugguugugugaguggagcgaauuggucaggggagggaaacaggcggguuuccagcaagcaacaugcuaaagucaggagaaaaauagagauugcauuugcuauaaagggcucgggagggugugcuuuugucucugacaugccacacgugcguucuucuuuggucgccacaacaaacccauggaggaagugccaccagguccccuguauggcaggugggggauccgaaauaauguacaggcacauaggaccuaugcucuuagugcacaguucugugugccagacgcagcccuuaggacuuggacccagugugacuagguuacuuguucaggaccacacagucagggaguacugugauaggucuuaaguucagcugcccaucuuuggaagaacccaugccccuucugccuuggugcccacuguguuuggaaucccccugagaaagauguccagcuacugcaucaaggccuggacacugauaaaaacacacugugcugaucaaguauaugaauuggucuuccaguuuauaagagcugucaaccucuccuaucacuccaugacucagaauuauuccaccugucacagcccuggauauaagccaagccaagcucugaauuucagauaucaacuccguagcaauccccacacuuuacagcuuggagguggagagaguggagagagacuagcuaaauaaaaugggcuguggaugggccuggcagcugccucagaaccuacuagacccugugcacuuaauuuccaggaaauucagcccaggcguggacagcugcuuccuagucuccaggaacaguuaggauagaggcuagugaccuggcagccgcgaccuuuuccuuuuccaacugaacagauguugucuuugacgucagucagucaugggccauaccccgcccuuuacuccugugccucugacucuaauccuuuagacuacagagguugguggguauuggggagggcugugauuggauauaggguguagaaaaaggcaaagcugaucaaguccugaguucagccgccuccccccuucuaggaugacugccaugagucuccuggugcuuguccugagcugggguucuaugggccuagaggcugccacagcuguggugaguauggggcucuggauucaggaguucugauucuggggugagugugaucugauuaaugccauacacacuaagguggagggggucaugaccacaguucugaggucuuagccuuaauugcuggauccugagagcagaggcuggugccuagacucgcagucugaggaaagcugaagucuggaccccugggucugagggaggaggguuagggccuggacuucugaguucuguggaaauaugaaauuggacauucugaucugaccccucccugcuuccuucaucagggccucagugacuucugcuccaacccagacaccuaugugcugaaccugacccaggaggagacagggcucagcucaggugaccccacaaaucccugaugccuucagcacucccuccuaucccccaaggcccaguguguuguaggguagagagcagcagcaucuuccaauccaggcaggaugggaaaggggcaaaaugccugugggugugauagacacagggaagugggcccugggccuccguggucacaggguuggacuggaggacaacaaggaagcauaauuaggucagcuggaccugcuuccagauauggcugaagcagaagggaugaacgucuagggugugauauugcccaccuauaaucccagcaauuaggagguugaagugugaguucaugggcacucuggguuaucuagaccuggucacaccuuguucugaagcaaaaccaaacaaaaaacaaaaaacaaaacgaauggaauuaagggugucccuccauugguaaagugcuugucaaagcuguaaguuugaucccuagcaacacauaaaguuugccuugugcccagcacucaggaaguaagaucagaagccuucaaggucauccauagcuacauagagaauucaaggcaaaucugggauacaugagacugucucaaaacauccuccuccucaaggagaggaggagggauggaaaggaaaagggagagggaagaggaggacgggagagaggaggggagaaagggagggagggaggagaggaaggaaggggaacagaaggagggagagagaaaggaacgagggggaagagagggaggaaaagaaauggaugggagaguggaaugucccccgggcuuuggcccuccagauuugcccagggagagccuggguccaggguuauagccugcuccuuucucucccuccacuucagacauccucagcuauuauuuccugugcaaccaggcggucuccaaccccuuccaacagguuaggaaugugggcaaaagacauggguguugaggagauggcuaauguggacucucaagggcguaugcugggcuaccaggggcuccaggguuccaugggggguggagggugccaaggccacaccuugacccgaguccuccuuucucuuaucuuccugcagaggcugacgcugucccagcgugcucuagccagcauccacucucagcugcagggccuggagcgggaagcuaucccucaauuuucugcugcacagguuaggucaaugaacugcaccagccugagaggaaaaagggccgaaccugaugaaccugugggaugccgccuccacucauguaaaggggcagauugacugagucagauagccuuguggagcuggcccuucuccaaguaggcgggauuucacguugugugcaaaucuauggaaaggggugaggcaauagagccgagcuggucucugggagagagccuacaggaagggguugcagcaagaaaaauccacauuucucuuggugcugggccaacaguggaggugagaggcucuagggugugacuaagggcuggucccuuugggaagugggguccuuggguugaggggggggggcuauuuuacugggucgcauaaagacugguuaacuguguccucucccacuacagaagcccuuguuauccuuggaggagacacugaaugugacagaaagaagcuuccaccaguugguggcgcugcugcacugccgcagucugcacaagguaagcucuggguguuugccaacccugucucuuucucccccuccccuuugcuuucucuucucuucccccuccucucuuucucauacucucucuccccccucccgccuuugucccccccccucccaccccaccccguguucuucaucuuccacccucuccucucguagaaagcugcucagccucucaagcccuggaaugagaacccaggcagcccccaguucccuagauugaaaacuaguccagauaucucuugcuaugaaaggggcaggaaaaggcgagggcggcggcagggcagccugugagccuaccgugggcucagcuguggucuguauggccccgggagcaagccagcaucucugacuguuguaaagacucucacccuuacaacaccgggacuccaccugaccacuuucccugguuacauaccgucucccaccaugauacucuccaugcacacaggcuuugcuaugauccuggcucuacaggauucacuggacacugaccccuccauaacaagaucagucaguagagcaugagacucuuaaucucagggucguggguucgugccccuauguugugggaaauauuaaaaaaaugaacccaccacccuuccagcccugcugaacugcccuucuaucucccuauccucacuucccacugcaucgacugcucauacagccaacacugcaucgggcccuagcccuucucaccucucacaugcaugcccaucuugcucauuccaucuguccaauaacagcuggugauccuuucugcacacaaucggaucagagucuucauuuaaaacccuuccaugagucccucuccacauggauuaaagccgggcucguggcacugaccuaguaggaaccuguguagacagccucggccuugguguuucuacuccacaucaggccaacuacgugccucugacuagagcugaccaucugccugucuccuaguguucuucucgcaaggucucugcuggacaguagccuaacauuuccuguccuacaagcucucaccucuccaaaguggcugccugggucccaugcauugaagguugccagugcugguggcaugcccggagcaaaggcagauuaguccauccugguagaauauuggcugugacacuuggcauucagguuacagagguucugcuggccuccagaaugguggucacaauagccgguccuuucugcaugucucuccuauggaugcccaaaccuaaguguuauguaagccagcaaucugugggacccagggggcaucugacaauguguggggaugugacugucacaagugcagaaacagaugcugcuggcauccccaccagucaauagcacguggguagaacaaggauaggcaggguuguugccagugggaaugacagcguagaggcuugcccacugaagaugcugggagagcagcucucuagaugcugaguggagaugcuaggccacuuugcauaugggaguggggaacugagauaaaauaggaguggguuggaaggcugcagcucagcaaaggcacaagcugaacacauagaugacuuuccauguucagaacagcucccugacaagagacuacacuugcgcacagagagucugggugacagccagguaaauggaugguuggaccuguguaugaaguguacaugugcauacccugagccuccucacccucugccucaggacuauggcucagcacuccgaggccugugugaagaugcccuagagggccuacuguuccugaugcucuuuucucuccugucugcgggggcccuagccaccacucugugcagccugccccgcgccugggcccucuucccacccaggucagcaggggagagagggcaggcuccccagggaggggacaggaggcaguacccagggccacugguggggauggggcagccuccugacucguuuccauccugcuucucugccacuccccacauccccaucacacuucagugaugacuacgaugacacagaugacgaugacccuuucaacccucagguauccuggugugaagggaggaggccuggggccugagcuccugggucucuuggaaggggaaaugaguauugcauucucgggucugagaagaagagaaaugagacuggaccucugggucugagguccuaggggaacagggaugagucuuggccaugagggaggaggcuggggucuggaagccugggcccgagggaggagagaagggcccccacguacacaacagauucugagugucuuuccugcccugguuauccugccaggaauccaaacgcuuugugcaguggcagucuuccaucugagccuccccuccagucuggagccugccucuccucuaugguaaccuucaauguguacaguugggucuuggcucuccccuacaguaguuguagcucucuuauguuggguggauguccaugggagggucuccagugaauaucagcucuucauuucucccucucucuagcuccuuuccuggcugcuggagaaggccccacuaaccugaccuugacugggcucugaccacuaacacugcuggcuauggacaucucacuuaggauggcaaccugcucuggcccuaacacccacccccccauccccauuucuccuuagcacaggggauugcugagguggcacaacagggaccagggguggcugggaagggggcugaccuauacagccugguguuccucaccucuggcugccaguccuguccuuggagggaugaagcuggaggcagguacaggcacgucccuguuuccugccauaccccagcgaucucaaccuauggcacuaacuuggaagagggcugauuugaaauaaaagggaaggcuuuauuuuacaagcagcuagguccuucuuauccaccccaacuacugagagaaggaaguccugacugggcuagggacacuccuccucuggugguugaaaggcaacucuccucuuguccaggcucagcacugcauugcuucuauaaguaacaugugaauccugacaagggggaagaagcagauaccggaagagaauaagccuagcacuaaaucuaaacaggcgugcagccacaggaacagucaagcuuccagucccguggaauguacaaagccugcuggguuuaggaaaggcguggaaucaacuugcuuccuagcagcucacacccagcacaagacuccagaaaaccaacgcuuguaucagaauagggacagaagucuucgaagagaaaguagaauauuugcuuguagugccaccagggugauaugaagggggaagguuuaaggaagauauuauaaauccaggcaggaaaagaugaggcacucaauaaguuaucaaguaaaaacaaacauggcagagucaaaagggaaauuuauugucuggggaacaauauguauguaguucucauuuguuuaaaaaacaaauagcauacauggcaaagaaaaacgugguuaauacauaaacauaauucaaaaagcuucuauuaucuaacaaaaaagaccucaauuuaauaauaaguaacugagaaaaacaaaaaccccaaaacaaauggauaaaauugucuuuuuugucuuuguuguuguuguuuuggagacaggguuucucugugaaacagcccugggcuguccuggaacucucuuuguagaccaggcuggccuugaacucacagagaagagccugccucagccucugccucccuagugaggagauuaacggcgugugacggcguguaucaccacacccaacuaaaguguucaaauucuaaugauuagcaaacacaaugugcuacuuuccccuuucgaguaccuauuuguugugggauuuagaguggagugugggcuggugcuggucuggaggcccagggaacagguucucuaaauaugcugcccagagacugugaaucaccagcuaugugaaaauaauaauaaacaaaacaaauaaacaaacauaaauaugcuuacaugugagaggauaaaaacugcaucucuuauccugguaauccuuugagggaccagcuuccagaaagaaauaaacaagcaaccccuggcucaguuaaacgcuggagacaaaacuaaucugccacagugggacucuucccaaagaccagcagcucuguaggggagauggcagagcaggguccucaagugacuacagaagcaccagggguaucccugguucuugcacaaugcugguuuggauuccuauggguccuaguccuggcaccucaguguuaauguaagcaaguuauuugacucacugaaccucuuuuuuugguuuuucaagacaggguuucucuguguagcccuggcuguccuggaacucacucuguagacaaggcuggccucgaacucagaaacccaccugccucuuccucccaagugcugggauuaaaggcgugggccaccacugcccaguuuuuuuuuuuuuuuuuuuguuguuguuguuguuguuuugguuugguuuaguuugguuuggcuuuuuguuuuguuuuuuugaaccucaguugugugguaaagcaaaugggcaucauaaacccaauaaacagcucuugacaggauggguaaaaaagcaagacaaaugcaacaugaugcucuggguuacgcuauggcgcaccggaaacauuagugagaaaaagcgcccacaucugcggcuuaguucagaauauuagagcaaugucaauuucuuacuuuuaacaaaugaauuugagguguggaaucuagcaauaggggaaacugggcauagugugcccaauuccuguauuacuuuuguaauuucuguaaacuuaaaauuuauucuaaaauaaaaguucauuauaaaaaagagaugggaagaaaccuaccaagcuaacacuagcaaaugauacagaguuauccaaguguuguuuaauuaccaaaaguugcuuguacaaugugagacuggaaacuggucaauugaugaacaauaauugauaagaagguagucuuaucaauuauuuuaacgggagaucccaaguugggcugcauaauucaaucacuccuacuguaaacagugagcuuuaaguggcggcccacaccuuaaucccauuaagagggaggcggguuucugaguuccagggccauccugauccuaaaagauacaguucugcuagcugccacuccgagcagaucucaccaucccaacacccuacaagguaccuuuccagcgucacaguccaguggcuacucccauuccucaagcgacgcguuucccgcuuccuuugguucgcacucgcuguucccuacgccaggugcgccuuuccaauuuuacucacuaaauaaaccuuccaagggaggauucaccuuaucccauuucccuccacccgcuuauauauucauuuauuuuaaaucguccuagcgcagugcgcagccucacaacuccugucccuaugcguuacaucugagagacuauugacugcugagucaaaacuaagcuguugugagcgcgcacgagaggcugggagguacuuguccccacggggccaccgucuagggccagcuuccggcuugcugacaaacgccaacacgcg

SEQ ID NO: 3512 - RNA, 10589 nt, Mus musculus
gccaggaaaauacagauauaucaagcaguguggauaacacaggaaaucccgcguaggagugggucuucucagcugggagagcaauauaaaauaggcccacaaagccaggccugggaauauaggccuguaaucucaacugcuccagagacucaguaaaaggauugaaaacucaagcccuguuugggcuacagaucucaaggccaggaugaauaacuuagugagacauugucuccaaauaaaauguaaaaaggcugaggaugugauaauggaagaacacuugccucgaaucugcugauaaaggauugagaaugugacuuagugguaaaacaucugccuagaauccccccagugaaggguugggguguggcucacuuaccuagaauccacuacugaagagcugggaauaugauucgaggauagaguugccuaccuagccugugugaggcucuauguucauaguagcaucaaaagggagaggggaggccuggagagaugguuccgugguuaagagcacuugcugugcuaugcauggagaggaccuagguucaguucccagcacucauauggcggcucacaacuaucuguaaguccaguuccgugggauccaagacuuucuucuccccucugcagacaccaggcaugcauuuggcagacauacacacauguaagcaaaacacuuguacauauaaaaauaaaaauauuuuuuaaaagcaaacacauuuccuauaagguggauaaugagugcuuuggagcaaauuaaauaggaaggggcuugucugaggacaggcaggcagcuugugucaggguguuuagaagggccauacuaaagggugguacuugaggggaccggacaagcuaugcagcccucuggggcagccauccaucucagcagccagucuucaccuacuuagaguuauuucaucccugcuugcuuggagcugauacuccugaaucuccuauucccaagcaggaggccaugcuccuugguacaagcacccuggggcugaaacaaucccugcugcggaugcgugguggggcaccaagucagugggaggcaggaagguucacugucaugguuccuaggagcccgggagcccgggagcuuggacagggagguaguggcggcugugaacgugauccuaagaagaugcucuggaaaagugucugacauuagagaggccacggaggugagccuggcaguguggucagggacagggacucagggugcaaaccacagcuccaugggaacugcugagaaugacacuacugcugagcauuugcggugugccaagcacugaauuugggaccuuccaagcauccuucccuguaguccuggugcguuacuuacuuaaguaaauauuauguagcauucaaagcccccuggauagugauuuauaacauuaacuauauccacaagcccauucauuuaccucgcaacagauuuugagguugauccuauuaugccuucauguuacugguagggaaacugaggcaaacagguuacauggcuaacugaguaguugagaccuaugcaccauaccucugaaauauucaauuaggucacaggugacugacacccuaacaguuggggaauccgauucagaggcugacaacugugcccauaagcacagaacuuguaugugaaguggucaggguaguuaccaggugcuucaguuccacacccaugcugcagagcgcuccagggucuugugaaaccauguaccaugucaccgggcagcagggaggucacaggaccagauuggguuggggugacuugggggugcugauagccuccugaggcucacugucuucuugguccuucuuccugcagguggcuggccuauguccuccugcugcucuuggugcuucugguuugucucuucacccuccugggccuggcaaagcagagcaaauggcuggugguugugugaguggagcgaauuggucaggggagggaaacaggcggguuuccagcaagcaacaugcuaaagucaggagaaaaauagagauugcauuugcuauaaagggcucgggagggugugcuuuugucucugacaugccacacgugcguucuucuuuggucgccacaacaaacccauggaggaagugccaccagguccccuguauggcaggugggggauccgaaauaauguacaggcacauaggaccuaugcucuuagugcacaguucugugugccagacgcagcccuuaggacuuggacccagugugacuagguuacuuguucaggaccacacagucagggaguacugugauaggucuuaaguucagcugcccaucuuuggaagaacccaugccccuucugccuuggugcccacuguguuuggaaucccccugagaaagauguccagcuacugcaucaaggccuggacacugauaaaaacacacugugcugaucaaguauaugaauuggucuuccaguuuauaagagcugucaaccucuccuaucacuccaugacucagaauuauuccaccugucacagcccuggauauaagccaagccaagcucugaauuucagauaucaacuccguagcaauccccacacuuuacagcuuggagguggagagaguggagagagacuagcuaaauaaaaugggcuguggaugggccuggcagcugccucagaaccuacuagacccugugcacuuaauuuccaggaaauucagcccaggcguggacagcugcuuccuagucuccaggaacaguuaggauagaggcuagugaccuggcagccgcgaccuuuuccuuuuccaacugaacagauguugucuuugacgucagucagucaugggccauaccccgcccuuuacuccugugccucugacucuaauccuuuagacuacagagguugguggguauuggggagggcugugauuggauauaggguguagaaaaaggcaaagcugaucaaguccugaguucagccgccuccccccuucuaggaugacugccaugagucuccuggugcuuguccugagcugggguucuaugggccuagaggcugccacagcuguggugaguauggggcucuggauucaggaguucugauucuggggugagugugaucugauuaaugccauacacacuaagguggagggggucaugaccacaguucugaggucuuagccuuaauugcuggauccugagagcagaggcuggugccuagacucgcagucugaggaaagcugaagucuggaccccugggucugagggaggaggguuagggccuggacuucugaguucuguggaaauaugaaauuggacauucugaucugaccccucccugcuuccuucaucagggccucagugacuucugcuccaacccagacaccuaugugcugaaccugacccaggaggagacagggcucagcucaggugaccccacaaaucccugaugccuucagcacucccuccuaucccccaaggcccaguguguuguaggguagagagcagcagcaucuuccaauccaggcaggaugggaaaggggcaaaaugccugugggugugauagacacagggaagugggcccugggccuccguggucacaggguuggacuggaggacaacaaggaagcauaauuaggucagcuggaccugcuuccagauauggcugaagcagaagggaugaacgucuagggugugauauugcccaccuauaaucccagcaauuaggagguugaagugugaguucaugggcacucuggguuaucuagaccuggucacaccuuguucugaagcaaaaccaaacaaaaaacaaaaaacaaaacgaauggaauuaagggugucccuccauugguaaagugcuugucaaagcuguaaguuugaucccuagcaacacauaaaguuugccuugugcccagcacucaggaaguaagaucagaagccuucaaggucauccauagcuacauagagaauucaaggcaaaucugggauacaugagacugucucaaaacauccuccuccucaaggagaggaggagggauggaaaggaaaagggagagggaagaggaggacgggagagaggaggggagaaagggagggagggaggagaggaaggaaggggaacagaaggagggagagagaaaggaacgagggggaagagagggaggaaaagaaauggaugggagaguggaaugucccccgggcuuuggcccuccagauuugcccagggagagccuggguccaggguuauagccugcuccuuucucucccuccacuucagacauccucagcuauuauuuccugugcaaccaggcggucuccaaccccuuccaacagguuaggaaugugggcaaaagacauggguguugaggagauggcuaauguggacucucaagggcguaugcugggcuaccaggggcuccaggguuccaugggggguggagggugccaaggccacaccuugacccgaguccuccuuucucuuaucuuccugcagaggcugacgcugucccagcgugcucuagccagcauccacucucagcugcagggccuggagcgggaagcuaucccucaauuuucugcugcacagguuaggucaaugaacugcaccagccugagaggaaaaagggccgaaccugaugaaccugugggaugccgccuccacucauguaaaggggcagauugacugagucagauagccuuguggagcuggcccuucuccaaguaggcgggauuucacguugugugcaaaucuauggaaaggggugaggcaauagagccgagcuggucucugggagagagccuacaggaagggguugcagcaagaaaaauccacauuucucuuggugcugggccaacaguggaggugagaggcucuagggugugacuaagggcuggucccuuugggaagugggguccuuggguugaggggggggggcuauuuuacugggucgcauaaagacugguuaacuguguccucucccacuacagaagcccuuguuauccuuggaggagacacugaaugugacagaaagaagcuuccaccaguugguggcgcugcugcacugccgcagucugcacaagguaagcucuggguguuugccaacccugucucuuucucccccuccccuuugcuuucucuucucuucccccuccucucuuucucauacucucucuccccccucccgccuuugucccccccccucccaccccaccccguguucuucaucuuccacccucuccucucguagaaagcugcucagccucucaagcccuggaaugagaacccaggcagcccccaguucccuagauugaaaacuaguccagauaucucuugcuaugaaaggggcaggaaaaggcgagggcggcggcagggcagccugugagccuaccgugggcucagcuguggucuguauggccccgggagcaagccagcaucucugacuguuguaaagacucucacccuuacaacaccgggacuccaccugaccacuuucccugguuacauaccgucucccaccaugauacucuccaugcacacaggcuuugcuaugauccuggcucuacaggauucacuggacacugaccccuccauaacaagaucagucaguagagcaugagacucuuaaucucagggucguggguucgugccccuauguugugggaaauauuaaaaaaaugaacccaccacccuuccagcccugcugaacugcccuucuaucucccuauccucacuucccacugcaucgacugcucauacagccaacacugcaucgggcccuagcccuucucaccucucacaugcaugcccaucuugcucauuccaucuguccaauaacagcuggugauccuuucugcacacaaucggaucagagucuucauuuaaaacccuuccaugagucccucuccacauggauuaaagccgggcucguggcacugaccuaguaggaaccuguguagacagccucggccuugguguuucuacuccacaucaggccaacuacgugccucugacuagagcugaccaucugccugucuccuaguguucuucucgcaaggucucugcuggacaguagccuaacauuuccuguccuacaagcucucaccucuccaaaguggcugccugggucccaugcauugaagguugccagugcugguggcaugcccggagcaaaggcagauuaguccauccugguagaauauuggcugugacacuuggcauucagguuacagagguucugcuggccuccagaaugguggucacaauagccgguccuuucugcaugucucuccuauggaugcccaaaccuaaguguuauguaagccagcaaucugugggacccagggggcaucugacaauguguggggaugugacugucacaagugcagaaacagaugcugcuggcauccccaccagucaauagcacguggguagaacaaggauaggcaggguuguugccagugggaaugacagcguagaggcuugcccacugaagaugcugggagagcagcucucuagaugcugaguggagaugcuaggccacuuugcauaugggaguggggaacugagauaaaauaggaguggguuggaaggcugcagcucagcaaaggcacaagcugaacacauagaugacuuuccauguucagaacagcucccugacaagagacuacacuugcgcacagagagucugggugacagccagguaaauggaugguuggaccuguguaugaaguguacaugugcauacccugagccuccucacccucugccucaggacuauggcucagcacuccgaggccugugugaagaugcccuagagggccuacuguuccugaugcucuuuucucuccugucugcgggggcccuagccaccacucugugcagccugccccgcgccugggcccucuucccacccaggucagcaggggagagagggcaggcuccccagggaggggacaggaggcaguacccagggccacugguggggauggggcagccuccugacucguuuccauccugcuucucugccacuccccacauccccaucacacuucagugaugacuacgaugacacagaugacgaugacccuuucaacccucagguauccuggugugaagggaggaggccuggggccugagcuccugggucucuuggaaggggaaaugaguauugcauucucgggucugagaagaagagaaaugagacuggaccucugggucugagguccuaggggaacagggaugagucuuggccaugagggaggaggcuggggucuggaagccugggcccgagggaggagagaagggcccccacguacacaacagauucugagugucuuuccugcccugguuauccugccaggaauccaaacgcuuugugcaguggcagucuuccaucugagccuccccuccagucuggagccugccucuccucuaugguaaccuucaauguguacaguugggucuuggcucuccccuacaguaguuguagcucucuuauguuggguggauguccaugggagggucuccagugaauaucagcucuucauuucucccucucucuagcuccuuuccuggcugcuggagaaggccccacuaaccugaccuugacugggcucugaccacuaacacugcuggcuauggacaucucacuuaggauggcaaccugcucuggcccuaacacccacccccccauccccauuucuccuuagcacaggggauugcugagguggcacaacagggaccagggguggcugggaagggggcugaccuauacagccugguguuccucaccucuggcugccaguccuguccuuggagggaugaagcuggaggcagguacaggcacgucccuguuuccugccauaccccagcgaucucaaccuauggcacuaacuuggaagagggcugauuugaaauaaaagggaaggcuuuauuuuacaagcagcuagguccuucuuauccaccccaacuacugagagaaggaaguccugacugggcuagggacacuccuccucuggugguugaaaggcaacucuccucuuguccaggcucagcacugcauugcuucuauaaguaacaugugaauccugacaagggggaagaagcagauaccggaagagaauaagccuagcacuaaaucuaaacaggcgugcagccacaggaacagucaagcuuccagucccguggaauguacaaagccugcuggguuuaggaaaggcguggaaucaacuugcuuccuagcagcucacacccagcacaagacuccagaaaaccaacgcuuguaucagaauagggacagaagucuucgaagagaaaguagaauauuugcuuguagugccaccagggugauaugaagggggaagguuuaaggaagauauuauaaauccaggcaggaaaagaugaggcacucaauaaguuaucaaguaaaaacaaacauggcagagucaaaagggaaauuuauugucuggggaacaauauguauguaguucucauuuguuuaaaaaacaaauagcauacauggcaaagaaaaacgugguuaauacauaaacauaauucaaaaagcuucuauuaucuaacaaaaaagaccucaauuuaauaauaaguaacugagaaaaacaaaaaccccaaaacaaauggauaaaauugucuuuuuugucuuuguuguuguuguuuuggagacaggguuucucugugaaacagcccugggcuguccuggaacucucuuuguagaccaggcuggccuugaacucacagagaagagccugccucagccucugccucccuagugaggagauuaacggcgugugacggcguguaucaccacacccaacuaaaguguucaaauucuaaugauuagcaaacacaaugugcuacuuuccccuuucgaguaccuauuuguugugggauuuagaguggagugugggcuggugcuggucuggaggcccagggaacagguucucuaaauaugcugcccagagacugugaaucaccagcuaugugaaaauaauaauaaacaaaacaaauaaacaaacauaaauaugcuuacaugugagaggauaaaaacugcaucucuuauccugguaauccuuugagggaccagcuuccagaaagaaauaaacaagcaaccccuggcucaguuaaacgcuggagacaaaacuaaucugccacagugggacucuucccaaagaccagcagcucuguaggggagauggcagagcaggguccucaagugacuacagaagcaccagggguaucccugguucuugcacaaugcugguuuggauuccuauggguccuaguccuggcaccucaguguuaauguaagcaaguuauuugacucacugaaccucuuuuuuugguuuuucaagacaggguuucucuguguagcccuggcuguccuggaacucacucuguagacaaggcuggccucgaacucagaaacccaccugccucuuccucccaagugcugggauuaaaggcgugggccaccacugcccaguuuuuuuuuuuuuuuuuuuguuguuguuguuguuguuuugguuugguuuaguuugguuuggcuuuuuguuuuguuuuuuugaaccucaguugugugguaaagcaaaugggcaucauaaacccaauaaacagcucuugacaggauggguaaaaaagcaagacaaaugcaacaugaugcucuggguuacgcuauggcgcaccggaaacauuagugagaaaaagcgcccacaucugcggcuuaguucagaauauuagagcaaugucaauuucuuacuuuuaacaaaugaauuugagguguggaaucuagcaauaggggaaacugggcauagugugcccaauuccuguauuacuuuuguaauuucuguaaacuuaaaauuuauucuaaaauaaaaguucauuauaaaaaagagaugggaagaaaccuaccaagcuaacacuagcaaaugauacagaguuauccaaguguuguuuaauuaccaaaaguugcuuguacaaugugagacuggaaacuggucaauugaugaacaauaauugauaagaagguagucuuaucaauuauuuuaacgggagaucccaaguugggcugcauaauucaaucacuccuacuguaaacagugagcuuuaaguggcggcccacaccuuaaucccauuaagagggaggcggguuucugaguuccagggccauccugauccuaaaagauacaguucugcuagcugccacuccgagcagaucucaccaucccaacacccuacaagguaccuuuccagcgucacaguccaguggcuacucccauuccucaagcgacgcguuucccgcuuccuuugguucgcacucgcuguucccuacgccaggugcgccuuuccaauuuuacucacuaaauaaaccuuccaagggaggauucaccuuaucccauuucccuccacccgcuuauauauucauuuauuuuaaaucguccuagcgcagugcgcagccucacaacuccugucccuaugcguuacaucugagagacuauugacugcugagucaaaacuaagcuguugugagcgcgcacgagaggcugggagguacuuguccccacggggccaccgucuagggccagcuuccggcuugcugacaaacgccaaca

SEQ ID NO: 3513 - RNA, 10589 nt, Mus musculus
uguuggcguuugucagcaagccggaagcuggcccuagacgguggccccguggggacaaguaccucccagccucucgugcgcgcucacaacagcuuaguuuugacucagcagucaauagucucucagauguaacgcauagggacaggaguugugaggcugcgcacugcgcuaggacgauuuaaaauaaaugaauauauaagcggguggagggaaaugggauaaggugaauccucccuuggaagguuuauuuagugaguaaaauuggaaaggcgcaccuggcguagggaacagcgagugcgaaccaaaggaagcgggaaacgcgucgcuugaggaaugggaguagccacuggacugugacgcuggaaagguaccuuguaggguguugggauggugagaucugcucggaguggcagcuagcagaacuguaucuuuuaggaucaggauggcccuggaacucagaaacccgccucccucuuaaugggauuaaggugugggccgccacuuaaagcucacuguuuacaguaggagugauugaauuaugcagcccaacuugggaucucccguuaaaauaauugauaagacuaccuucuuaucaauuauuguucaucaauugaccaguuuccagucucacauuguacaagcaacuuuugguaauuaaacaacacuuggauaacucuguaucauuugcuaguguuagcuugguagguuucuucccaucucuuuuuuauaaugaacuuuuauuuuagaauaaauuuuaaguuuacagaaauuacaaaaguaauacaggaauugggcacacuaugcccaguuuccccuauugcuagauuccacaccucaaauucauuuguuaaaaguaagaaauugacauugcucuaauauucugaacuaagccgcagaugugggcgcuuuuucucacuaauguuuccggugcgccauagcguaacccagagcaucauguugcauuugucuugcuuuuuuacccauccugucaagagcuguuuauuggguuuaugaugcccauuugcuuuaccacacaacugagguucaaaaaaacaaaacaaaaagccaaaccaaacuaaaccaaaccaaaacaacaacaacaacaacaaaaaaaaaaaaaaaaaaacugggcagugguggcccacgccuuuaaucccagcacuugggaggaagaggcagguggguuucugaguucgaggccagccuugucuacagagugaguuccaggacagccagggcuacacagagaaacccugucuugaaaaaccaaaaaaagagguucagugagucaaauaacuugcuuacauuaacacugaggugccaggacuaggacccauaggaauccaaaccagcauugugcaagaaccagggauaccccuggugcuucuguagucacuugaggacccugcucugccaucuccccuacagagcugcuggucuuugggaagagucccacuguggcagauuaguuuugucuccagcguuuaacugagccagggguugcuuguuuauuucuuucuggaagcuggucccucaaaggauuaccaggauaagagaugcaguuuuuauccucucacauguaagcauauuuauguuuguuuauuuguuuuguuuauuauuauuuucacauagcuggugauucacagucucugggcagcauauuuagagaaccuguucccugggccuccagaccagcaccagcccacacuccacucuaaaucccacaacaaauagguacucgaaaggggaaaguagcacauuguguuugcuaaucauuagaauuugaacacuuuaguuggguguggugauacacgccgucacacgccguuaaucuccucacuagggaggcagaggcugaggcaggcucuucucugugaguucaaggccagccuggucuacaaagagaguuccaggacagcccagggcuguuucacagagaaacccugucuccaaaacaacaacaacaaagacaaaaaagacaauuuuauccauuuguuuugggguuuuuguuuuucucaguuacuuauuauuaaauugaggucuuuuuuguuagauaauagaagcuuuuugaauuauguuuauguauuaaccacguuuuucuuugccauguaugcuauuuguuuuuuaaacaaaugagaacuacauacauauuguuccccagacaauaaauuucccuuuugacucugccauguuuguuuuuacuugauaacuuauugagugccucaucuuuuccugccuggauuuauaauaucuuccuuaaaccuucccccuucauaucacccugguggcacuacaagcaaauauucuacuuucucuucgaagacuucugucccuauucugauacaagcguugguuuucuggagucuugugcugggugugagcugcuaggaagcaaguugauuccacgccuuuccuaaacccagcaggcuuuguacauuccacgggacuggaagcuugacuguuccuguggcugcacgccuguuuagauuuagugcuaggcuuauucucuuccgguaucugcuucuucccccuugucaggauucacauguuacuuauagaagcaaugcagugcugagccuggacaagaggagaguugccuuucaaccaccagaggaggagugucccuagcccagucaggacuuccuucucucaguaguugggguggauaagaaggaccuagcugcuuguaaaauaaagccuucccuuuuauuucaaaucagcccucuuccaaguuagugccauagguugagaucgcugggguauggcaggaaacagggacgugccuguaccugccuccagcuucaucccuccaaggacaggacuggcagccagaggugaggaacaccaggcuguauaggucagcccccuucccagccaccccuggucccuguugugccaccucagcaauccccugugcuaaggagaaauggggauggggggguggguguuagggccagagcagguugccauccuaagugagauguccauagccagcaguguuaguggucagagcccagucaaggucagguuaguggggccuucuccagcagccaggaaaggagcuagagagagggagaaaugaagagcugauauucacuggagacccucccauggacauccacccaacauaagagagcuacaacuacuguaggggagagccaagacccaacuguacacauugaagguuaccauagaggagaggcaggcuccagacuggaggggaggcucagauggaagacugccacugcacaaagcguuuggauuccuggcaggauaaccagggcaggaaagacacucagaaucuguuguguacgugggggcccuucucuccucccucgggcccaggcuuccagaccccagccuccucccucauggccaagacucaucccuguuccccuaggaccucagacccagagguccagucucauuucucuucuucucagacccgagaaugcaauacucauuuccccuuccaagagacccaggagcucaggccccaggccuccucccuucacaccaggauaccugaggguugaaagggucaucgucaucugugucaucguagucaucacugaagugugauggggauguggggaguggcagagaagcaggauggaaacgagucaggaggcugccccauccccaccaguggcccuggguacugccuccuguccccucccuggggagccugcccucucuccccugcugaccugggugggaagagggcccaggcgcggggcaggcugcacagagugguggcuagggcccccgcagacaggagagaaaagagcaucaggaacaguaggcccucuagggcaucuucacacaggccucggagugcugagccauaguccugaggcagagggugaggaggcucaggguaugcacauguacacuucauacacagguccaaccauccauuuaccuggcugucacccagacucucugugcgcaaguguagucucuugucagggagcuguucugaacauggaaagucaucuauguguucagcuugugccuuugcugagcugcagccuuccaacccacuccuauuuuaucucaguuccccacucccauaugcaaaguggccuagcaucuccacucagcaucuagagagcugcucucccagcaucuucagugggcaagccucuacgcugucauucccacuggcaacaacccugccuauccuuguucuacccacgugcuauugacugguggggaugccagcagcaucuguuucugcacuugugacagucacauccccacacauugucagaugcccccugggucccacagauugcuggcuuacauaacacuuagguuugggcauccauaggagagacaugcagaaaggaccggcuauugugaccaccauucuggaggccagcagaaccucuguaaccugaaugccaagugucacagccaauauucuaccaggauggacuaaucugccuuugcuccgggcaugccaccagcacuggcaaccuucaaugcaugggacccaggcagccacuuuggagaggugagagcuuguaggacaggaaauguuaggcuacuguccagcagagaccuugcgagaagaacacuaggagacaggcagauggucagcucuagucagaggcacguaguuggccugauguggaguagaaacaccaaggccgaggcugucuacacagguuccuacuaggucagugccacgagcccggcuuuaauccauguggagagggacucauggaaggguuuuaaaugaagacucugauccgauugugugcagaaaggaucaccagcuguuauuggacagauggaaugagcaagaugggcaugcaugugagaggugagaagggcuagggcccgaugcaguguuggcuguaugagcagucgaugcagugggaagugaggauagggagauagaagggcaguucagcagggcuggaagggugguggguucauuuuuuuaauauuucccacaacauaggggcacgaacccacgacccugagauuaagagucucaugcucuacugacugaucuuguuauggaggggucaguguccagugaauccuguagagccaggaucauagcaaagccugugugcauggagaguaucauggugggagacgguauguaaccagggaaaguggucagguggagucccgguguuguaagggugagagucuuuacaacagucagagaugcuggcuugcucccggggccauacagaccacagcugagcccacgguaggcucacaggcugcccugccgccgcccucgccuuuuccugccccuuucauagcaagagauaucuggacuaguuuucaaucuagggaacugggggcugccuggguucucauuccagggcuugagaggcugagcagcuuucuacgagaggagaggguggaagaugaagaacacgggguggggugggagggggggggacaaaggcgggaggggggagagagaguaugagaaagagaggagggggaagagaagagaaagcaaaggggagggggagaaagagacaggguuggcaaacacccagagcuuaccuugugcagacugcggcagugcagcagcgccaccaacugguggaagcuucuuucugucacauucagugucuccuccaaggauaacaagggcuucuguagugggagaggacacaguuaaccagucuuuaugcgacccaguaaaauagccccccccccucaacccaaggaccccacuucccaaagggaccagcccuuagucacacccuagagccucucaccuccacuguuggcccagcaccaagagaaauguggauuuuucuugcugcaaccccuuccuguaggcucucucccagagaccagcucggcucuauugccucaccccuuuccauagauuugcacacaacgugaaaucccgccuacuuggagaagggccagcuccacaaggcuaucugacucagucaaucugccccuuuacaugaguggaggcggcaucccacagguucaucagguucggcccuuuuuccucucaggcuggugcaguucauugaccuaaccugugcagcagaaaauugagggauagcuucccgcuccaggcccugcagcugagaguggaugcuggcuagagcacgcugggacagcgucagccucugcaggaagauaagagaaaggaggacucgggucaagguguggccuuggcacccuccaccccccauggaacccuggagccccugguagcccagcauacgcccuugagaguccacauuagccaucuccucaacacccaugucuuuugcccacauuccuaaccuguuggaagggguuggagaccgccugguugcacaggaaauaauagcugaggaugucugaaguggagggagagaaaggagcaggcuauaacccuggacccaggcucucccugggcaaaucuggagggccaaagcccgggggacauuccacucucccauccauuucuuuuccucccucucuucccccucguuccuuucucucucccuccuucuguuccccuuccuuccucuccucccucccucccuuucuccccuccucucucccguccuccucuucccucucccuuuuccuuuccaucccuccuccucuccuugaggaggaggauguuuugagacagucucauguaucccagauuugccuugaauucucuauguagcuauggaugaccuugaaggcuucugaucuuacuuccugagugcugggcacaaggcaaacuuuauguguugcuagggaucaaacuuacagcuuugacaagcacuuuaccaauggagggacacccuuaauuccauucguuuuguuuuuuguuuuuuguuugguuuugcuucagaacaaggugugaccaggucuagauaacccagagugcccaugaacucacacuucaaccuccuaauugcugggauuauaggugggcaauaucacacccuagacguucaucccuucugcuucagccauaucuggaagcagguccagcugaccuaauuaugcuuccuuguuguccuccaguccaacccugugaccacggaggcccagggcccacuucccugugucuaucacacccacaggcauuuugccccuuucccauccugccuggauuggaagaugcugcugcucucuacccuacaacacacugggccuugggggauaggagggagugcugaaggcaucagggauuuguggggucaccugagcugagcccugucuccuccugggucagguucagcacauaggugucuggguuggagcagaagucacugaggcccugaugaaggaagcagggaggggucagaucagaauguccaauuucauauuuccacagaacucagaaguccaggcccuaacccuccucccucagacccagggguccagacuucagcuuuccucagacugcgagucuaggcaccagccucugcucucaggauccagcaauuaaggcuaagaccucagaacuguggucaugacccccuccaccuuaguguguauggcauuaaucagaucacacucaccccagaaucagaacuccugaauccagagccccauacucaccacagcuguggcagccucuaggcccauagaaccccagcucaggacaagcaccaggagacucauggcagucauccuagaaggggggaggcggcugaacucaggacuugaucagcuuugccuuuuucuacacccuauauccaaucacagcccuccccaauacccaccaaccucuguagucuaaaggauuagagucagaggcacaggaguaaagggcgggguauggcccaugacugacugacgucaaagacaacaucuguucaguuggaaaaggaaaaggucgcggcugccaggucacuagccucuauccuaacuguuccuggagacuaggaagcagcuguccacgccugggcugaauuuccuggaaauuaagugcacagggucuaguagguucugaggcagcugccaggcccauccacagcccauuuuauuuagcuagucucucuccacucucuccaccuccaagcuguaaaguguggggauugcuacggaguugauaucugaaauucagagcuuggcuuggcuuauauccagggcugugacagguggaauaauucugagucauggagugauaggagagguugacagcucuuauaaacuggaagaccaauucauauacuugaucagcacaguguguuuuuaucaguguccaggccuugaugcaguagcuggacaucuuucucagggggauuccaaacacagugggcaccaaggcagaaggggcauggguucuuccaaagaugggcagcugaacuuaagaccuaucacaguacucccugacugugugguccugaacaaguaaccuagucacacuggguccaaguccuaagggcugcgucuggcacacagaacugugcacuaagagcauagguccuaugugccuguacauuauuucggaucccccaccugccauacaggggaccugguggcacuuccuccauggguuuguuguggcgaccaaagaagaacgcacguguggcaugucagagacaaaagcacacccucccgagcccuuuauagcaaaugcaaucucuauuuuucuccugacuuuagcauguugcuugcuggaaacccgccuguuucccuccccugaccaauucgcuccacucacacaaccaccagccauuugcucugcuuugccaggcccaggagggugaagagacaaaccagaagcaccaagagcagcaggaggacauaggccagccaccugcaggaagaaggaccaagaagacagugagccucaggaggcuaucagcacccccaagucaccccaacccaaucugguccugugaccucccugcugcccggugacaugguacaugguuucacaagacccuggagcgcucugcagcauggguguggaacugaagcaccugguaacuacccugaccacuucacauacaaguucugugcuuaugggcacaguugucagccucugaaucggauuccccaacuguuagggugucagucaccugugaccuaauugaauauuucagagguauggugcauaggucucaacuacucaguuagccauguaaccuguuugccucaguuucccuaccaguaacaugaaggcauaauaggaucaaccucaaaaucuguugcgagguaaaugaaugggcuuguggauauaguuaauguuauaaaucacuauccagggggcuuugaaugcuacauaauauuuacuuaaguaaguaacgcaccaggacuacagggaaggaugcuuggaaggucccaaauucagugcuuggcacaccgcaaaugcucagcaguagugucauucucagcaguucccauggagcugugguuugcacccugagucccugucccugaccacacugccaggcucaccuccguggccucucuaaugucagacacuuuuccagagcaucuucuuaggaucacguucacagccgccacuaccucccuguccaagcucccgggcucccgggcuccuaggaaccaugacagugaaccuuccugccucccacugacuuggugccccaccacgcauccgcagcagggauuguuucagccccagggugcuuguaccaaggagcauggccuccugcuugggaauaggagauucaggaguaucagcuccaagcaagcagggaugaaauaacucuaaguaggugaagacuggcugcugagauggauggcugccccagagggcugcauagcuuguccgguccccucaaguaccacccuuuaguauggcccuucuaaacacccugacacaagcugccugccuguccucagacaagccccuuccuauuuaauuugcuccaaagcacucauuauccaccuuauaggaaauguguuugcuuuuaaaaaauauuuuuauuuuuauauguacaaguguuuugcuuacauguguguaugucugccaaaugcaugccuggugucugcagaggggagaagaaagucuuggaucccacggaacuggacuuacagauaguugugagccgccauaugagugcugggaacugaaccuagguccucuccaugcauagcacagcaagugcucuuaaccacggaaccaucucuccaggccuccccucucccuuuugaugcuacuaugaacauagagccucacacaggcuagguaggcaacucuauccucgaaucauauucccagcucuucaguaguggauucuagguaagugagccacaccccaacccuucacuggggggauucuaggcagauguuuuaccacuaagucacauucucaauccuuuaucagcagauucgaggcaaguguucuuccauuaucacauccucagccuuuuuacauuuuauuuggagacaaugucucacuaaguuauucauccuggccuugagaucuguagcccaaacagggcuugaguuuucaauccuuuuacugagucucuggagcaguugagauuacaggccuauauucccaggccuggcuuugugggccuauuuuauauugcucucccagcugagaagacccacuccuacgcgggauuuccuguguuauccacacugcuugauauaucuguauuuuccuggc

SEQ ID NO: 3514 - RNA, 15086 nt, Mus musculus
aauugaauugcaaauaaagaaaauaucuaauuaaaaaauaaagaaauuaguguuaggggaugaaguggauugggagagggugauaaagagugaaaaaacaaccacaaaguagcaaagaucagguacaguuaugggcguguuaaacuaaguaugucacugaguucagcaggagggaccuugagaaccucccagucugcuuccucauuuguuaacugggaauaauaguucuuccauagcccuguuuuaugagagcauucuguggcugacuauguaggauagggauacagaguuggggcucccggaugaggcagcucugauaugccuauguccccacagaugccgguaaugaagcagcugggcccugcacaacccaagaagcggcuggaucgcggagcacucucgaucucagcaccccucggagacuucaggcacacauugcacgugggacgcgguggcgacgccuucggggacaccucauuccugagucgccacgggggcgguccgccucccgagccuggagccccaccgguuguggccccacauucugucgcuccaccugcagccccacagcccccuguggcugugccuucaccugcggacccgcugcugucuuuccaccuggaccugggccccucuaugcuggacgcgguguuaggcgucauggacgcggagcgcagcgagacaacagccaccaagcccgauggggaugcccacccuagagugcagcaccccaagacccgcugcugcucaaaugcugaccuccagcuggacgacgucaucggucuguagugucauaauucccucaaccccucccucccagcacuccacuuuuguacacauaaauggcugagguuugugccauggacugucuauucacuuuacgcgggaaaggguacagaagcaguaggguggugccacuucuaguuggggugccaccaacuagaagucaaguugucagugaugcuccuuuaagaguuugaauacguauucauguaaugccccuccccaaaggcggagucucuaccacaguccuauucaucccucaaaccuugaccgauccucacuaccaccuggauaaaguccaacacccgugacagcugcuaucuggcauaaagagucacagucgccuggccauccacuucccuccaggugcacucugacugggcggcgcuucccugcaaagggaagcgguuggcgagccuuuggagccacgagggugugguucccgugggaagggcuucaggucccaccaacugugugucgcccugcgggaggcuguugcguuacaaaucugggcacaaaguucagccugagacguccagauauuuuaacaucuagaggugcaggacugcccgaaccuauaucgggaggggggugaagcaaaauucucaaagguuuucagaggggaggaacaauuagaauuagucucuggguuuguuuugggacggggcuaucuuaggucccuagagggauaagaccaauuuaaauuaaccgaaccagagguagaguaaggguuuuuauaguuuccaaaagggugggucguauauuucaaacguuaggcuggugacaggaguaaaacccgaccucuacaaggaggcacaggagaaaccauuucaccaugguugaguccaggauaagaccaaugaggggcggagcauguguaaaacaaucagguggagugaggccaagguaaaggggugaggcucccaggaaagacauuuauaaauaacuugacagaggcagaaccaggagucacuuuauucguuaugagguguggcauguaagauaaucaauugcaugggagcuggcuacaaacuuuaaagacgguugggggcggggccaagaccgcugagucccacuccucuccucccaacgaagcugcgguguucagguaaaucaguugcugcccugccaggcucccuagaggucucgagaggcugagcagaugcaaaguaucuggaggcggccggagggguugucuaagcccuacccccacccaggcugcggaguauauguaaaucggaugcggagaagccuuucuuggggcccugacagcgguggggcacuugucaaguauuugcuaaacugucucgcuaaaguccccaaagggagaaguuguauggaauaagacgugacucccuggauguccagagagaagcuugacgcacacauaaauuggcugguugggcggggccaggcucuuuaagacucccugaggggcuggacauauguaaaucauuucaggcggggcaagaggggguucccaguggcuuacaaacccgguacgcguaaauaaacuggacuugaaauuagagcuccagagcccguguuacauucugacgcccugccugguccuuuggccuccuuccaccugaggcgggagggguuccuggcgucacaguuggagaucaacgcugcagacagagaccgcuuagugcgugaaggcccauggaggccucggccgauuccucugaggcccccgcggucugccgcuucuuccuagagggccgcugucgcuucggugcgcgcugccgucagccacaucccggggccccggcgccguccccggugguuacgcaaccggaggcuggguccaagaagccggcucugcguacugcugcugacgucauccgacgcauccgcugggacccgcgccuggacccugcugacuuuucggugggcuacaccgaccgcuuccugggagugcaggaagagccauucugcgccuucugcugggacgagccgcuggcagcgcucggaccuggcguguuggcagugccgcagcaccgcauacgcuacuuccgcuuccgcggccgccugguaugggaccgugccucccguacugaccucauuuuuggaucgggcucuguggcuggucggggacccacuauccuugaugcgcuggacggcggggacgagcauuggacagaggucacggcagaaauucccgacacagagaaaacagggguggguuuagagggucuggauacccaggaugcccuugcagaggcggguggaaacccgaccggaacaggucuugauucgggccuggagacacacgaagaggguggggcaaucaaagagaccagaacugggcuugauuccagccuggagacaccugaaguggaugggccaaccaaagagaccgggcugaaugggaccacugaguuagaaaugccagacccaagcaugaacuucucaggagugaagaucagcucaguagaggagcccagagcuacauugcuuccacaguggcaggcgcagggcauggaaacgaaagggcuuucugcugaagagaugggaaaugugugggauccagguguuuggccugacgacagaagggccccucgccagccccggcccacacauuuuguggcacugauggugacagagucugggcuuagggcugagguggucaaggcccaagagcaucugguccggauugccccuucuugugcugaguuccugguaccagcacaggcccugcacuugacaguggucuugcuaaggcugacaggcccuggggaggaggcugcagcagcuagagcucuucggagagccaucuugaaaccagggcuucaggcacccucccagcuacaguucagggacuugguucuucugggccaucaugugcucugugccacacccucccccacacugacagguauggcccaaacacugaaucagaggcuagaggccgaagggcuuagaguggugcugcugccagaacuacaaccgcaccucacccuggcuaagguaccacauggaacccaggucugccucccuaagccugaguacacccugaaccaggagcuaggaaggcagccccuaaguaaacucuggcuuugccgcauggguagagcagggcauagcuaucuucccuugguagaaauuucccugaaaugaccgagguuucauauuucggauaaaacaggccaagcagaaacagguucucgcucucucucuuuaauuuugguuucaagcuuccaaaauguacuguacucaaugcucaaggagaaugaaggaagggaggggagagggagggagggaggcagggaggcaucugggaaaaagcagccugacaguccagcuguuugcaaccucauagcacauccuccaguuacauggcagaagggggagggguaaaaagaaaaggggagaaggaagaaaaguaacuuaaauaaacacacacacagagaaaagagaaggaaacaugacgugaguuggugauccaugaaggcagaggggaggaaagaagggaggguaaccauuuuaccuguguugaaccagggagugggaagggaagaggcaggagggaaagaaaaaaaaaaaaucagaagaaacauuggggcagagggaggaagggacacggagacaacuuaauacaacuugaguaagacgaggcagcccggccggcauggucccgcgaaggccuuggaguccucagugcgguguggcgcuggucugguugugucgguggugcuggcuggaguuucuggggugaggagcugaagguggggcauagucuuuaaguggcuucccucaccccaaacacugaggccccaacggcugggcagcaagagucuaugaagaggcagccgaggcaauggguguggccggcuggugccccacugcagcgggugcggccuggacagccugucuucuuucugcuggccccagcgugggaugggccgacgcagagucaggcgcuggacuacgagcucgagagagagagagaaaacacugagacagcguuaguggaggugacaggugcacacagaaccuguagccccgccccacccugcuccacuauacacucccaauuauccccucugagacaaaaaauaaaaauguagaaaaaaaucucuguacagguccccggugggaaacgggggcagggaugcuggcucuuccuggagccuacuccccacaaauuuuuacaacccauguccauggcucaaaaaaugugaaaaggcggcgcugggccacagcccugcucccgcccgugcucgaugggugcuuagaaggcuggcagcugcgccaggcugaggcggcaguccacgcuggaguuguccgggcccguguaggacaggcccaagggcucuaggaaggcccggcaggcggccucgcccucgaaggccaacucggccugcagguaggagacgggcagcgcagggcggaagcuauggagacaagaggagaaaaugaugaggcaaacagacaagggagggcccaagaacaaggagcaaugcuccccaucugggcuuguauuuuccucagcaaggaaccugcuggcuucugcagccccucccgaccuccccauuuucaggggcuugggggggcaagggaugggguugguagccccagugcccagcugugcccccccucgcccacacuuaccuguucaggaaggagggggcaggagggaaagggcccagcuuggcuccucugcugacugaggagcuggagccagacagaguaagugguacaugggcucagaggguagggacaauggcgccccccuacccccccuucccccccggauguuugcacagaguguuacacucagcagugccuucugguuguuacucagaugcccuaauaguguacauguaccgcuaauuuugaggacccucuccugaagaccacuuuaagccuuaccaaguaucuggaacccaggcacccuauggcccugggacagaacagccugccucugauaucugagggaucugucugcugugcucagcucacagcaaaggugcuguuagagugaggccaacacaggccagagcuugaaagcugcccacagaguggcuuucuggauuacaaaaggcugaguagccucauguccauucauuuuagcuagucaaucuggagucacagccccaccucccuuggguuggacugacuuagaaaauucucaaacagguuucuugaccccuaaguugcagaucccacuauaauggaaccacuaaugacaaaacacugcugcgcagccugacagucaaggcuccucaagacuaucgacagagcucuugaccagcauuuuuuaaccuuggcaagacuggcacacacugcuguggggccuuuugcugcacagcguuccuggucucuaccacuaccacuagauggcagcagcauccaggagcaaaaucugaggacaagguuguggugguguugggaauccuccucauaugggcaagccucgugcagucugaugcccaagggccuugguaccacagguucccaacccaaaacuucugauagucaaaaauggaaugggcacaaggucucaucucaagagacugcuagcaauaugaaucaagucacccuuucuaguaugucaggaagaagagcagcacguagcugcaagcaaaggcccugagaagggggaagauaaagcagguuccaaacugaugugaacagaaaggaggcagggagggaaaggacaugaugccaggaguggugaggccagaacagugggaggaaaccugcaacugcagguggccgaugaggaaagcaaugagggcuagggcuaugaacaggggacugggaggggacuccagcagaggagcugaaggcugaccaggaugcggaggggacguggcagagccacggcacagaaggcagcagagugcagugccacauacguuuugaucauggccuugagggcggccuugcgcucccggucugcaaacuuguccacaagguagccagacaugcaaggugcauggcaauagagccugaagaagcggugguaguugcccagggcccaggcugcccucagugccaacgcgugggccacgcaggggucugccuucaucucccuugugagguaugccaguuccguagugaugucugcacaggagauaacuggaggucagguggcaggguggcaccuugggcauggccccuccaucuuggggaugggccucucaccuccagaguucuuggugaagauguaguagaggauucgguaugcaguaaauucacccacauugccugcuaaguuuuccgcguacagugacuuaagcuguguuuggcacugguugaauucuucauggucacccugaggguaaggcauggaaggagggugugaggcacaggcaaguacaagugauuucaagaaaggagugggaggaaaccaccaagcuuccuaccuucuccaaggcaaugcgggcaugggucucauacaccuccacagugaacuccguccggaugccuugcaccugggcaguagaaaagagcagagucagggagaggagagcaggaagaggccugacaucagcacccucucagcgcugccuuacugucagguccugccgaauggacuucaucugcucacaggcaaaggcauaguccugcuucuccuuccagugggacuugaccaugcacagagacuucuucaaaaccuucagggaagagaaucaaagcugaguggccagacagcugacaggccaaagccacugugccccacucaaccagagcagcaccaaagccaguaucagugacucaccacuaugaacaaacaaaaucaaaccaacacacagcaggugugagugcuccaagucucccuggcucuagggccccacacauaagucucccuuaacuuugcuggucauaagggagauugugaccaggcuaugccccagaugugaagggccugcaugcuaggauuuuucucagccagagcuaccacuuccuucacccaacauguuccaugugcccgaucuuauguuaugcccaacacauucugggggcagacacacaaugccugggacuuacagccacaggucgcacaguugacgggucuggggcgcaggugagccgcagauagugcuuuguaaugucaggacaggugcccacaaucugcagcuccugccagucagggucagcuccacugcucuccagguuacucaucuguagcaccaaagguucaaggcgcaggcgacgugagugcccauguuggaagcgggcugcccucuuuugcuucuuaagcucacgcucuggguccucgcacuccagugcugccaucuucuugcggcuacguuuggugggagcuaggucaugucuggggagaaaggguaaaaaagaaagucaaugucuuuagccacucugaaggccaucucccccaccugugagacccaauaccacccacccaugccuaggaagaaaucacacccuaagcaccucaccucuuuccacgcugcgcccugccccgaccucgauccaugugggccccucgaccaccccgacccuugggggguggguuccugcggccuacaggguggcacucauucccugaguaggagcugucagagucugaaugggagucacugcacaggaaagagaagucaggccugaagcacaagggucaggcuccacgcaguucccccccagcgcccuuccagcccaagccugcacaccuucuccgaaagugucucgugggagaccuggaugaggagcgggagcgugaauccgugcuggaggaagagcuguuauccuucaugaagacguugcgguugccgaacuuggugaagcugcuaccccgagcucggccagcacccccagccccaggugucccucgcugggauugggcacccccgccccuggucaccgagccugccccccuggaagggugaaggcugcuaggggccucccaccgcuucuucuuggggcucucagccacaggcucccuggucagccugaggauauaguagggcagggcauuaccaaccagccaccaaccugcaguucugcagaccccaccccauggcccagggccaccaaaccugagaaagcagaggcacuuaccccggcaacucagccacuguggugcaggaaagggaccaagcccaagauugucuguguccaggggaugcucuuagccaucaagccacccauaccucccuaguaaucccuucccacuucccaaaacccauccuuggucacuccuggccuccugcccaccccauggggaccugagauacaggugucagcuuuugggaccacuugucucugaaccugcuaguuuugagauccauguccccagcccauaucuguuucacagugucacccagacugacccaggcagaggcucucggcuccagucgaugguguaggcagagccauccuggagccgggccuguagcaccuccuugagcaguuucucuguccgguccuuguccucuucugacucgcaggcggugaaacaccguuccacauauuccuucauauccugaggccaaucaucuggcuucccagacagguuuccccggccagaagguccacuguggggugggggauagacgaaggcacucaggugggaggacccacacgugucagcagaacucccucugugaucugagaaggcagccuuguucuguacauuuccccacucccuucaccccacgaagcacuaagaguggugucuaaagaggcccuggagcacagagcacgggcgugcgggucaggguaacagucaccugcgguucugaguguucuccgaguugggcuggggcccaaagcugcuguguuggcccucugaauuggagcugaagcucuggcuggugacagcaaagggccgcuucuggauguuaaauuuuagacccccagucccaggggcugcugugggaggauagcagagacaggaguuaggcccuuccccagacaguuaaauaggcuaagcucuggaacaaguuccuaacaugagcauaccuguucuagaacaaucuuccccuagacuagggcacauaacacccggacaaaggacuagcaacccuguguggcucacagccaagcuccaacccucugacuuccccacagauacacuaacuuacguuucaugcggguccauaacugcugacccuucuuagguuuggcaggcucgcuguagcuguguggcccauaugccugcccuguaggagccccggccugacugugcugagugcuuggggcugucccaggcugagggccguugcuuagacuaugugucccauguugugaguuugagggcugagggggcugagcugcagguagcugcugaggggaagccugguaggccauacucucauccaugccagggacuggaggcugcaagaagaagcagaggaugaaagaagcaggcagcauccuggugcugagucacaugguauucagucuuuauagucaucuucuuuagcacucagugcuacaacauuuuguggguugccauaaugugugcucagugacucccugggguauguauuuucacuagcagcucauuucacaacugagaagauuaagccucaagggacugaacaacuuuccacagcccagcugucaaggagcagcuaccagcaaugccaacacuggguugugacucuaccacacugaugacacaucuacuaagguucccucucuugagcacaucaacacacaggacaacacaucugcccaaucccuaugagaagauugcauccucucgauucuuaagagccaccaagguaugguagucaugugacucaagagguccacagaagaggcaaagcacggauucaaaccuaggucaauguacuucccacgaucugggcucuuccacuccucuaggcugugccagaugcaaaggcagcacguuggguagguacaggugugcaugcaccaucugcuguguauguguaugugggggggggggagggggaggaagcaggggaggacuuccuccugaauacaggcugagugcacaugcuggaggaaaagggagaagacagaccgccaaacuacaaacuauccccacuaucuucccaguacuacagcccccuggccuugcccagccucaagcccauucauccuacuuuuaaaagcuaagcuuuuaaauuaggagccucuuggcaagaaagaacaaagaggaagggagggggcagcuuugaaaucaugcagacuaaugguucuaaguccucucgagacccaggcucucucccagcugaccaggagcagcgaggcacagcauuaccugguucagagucccuuggugcuggggagccgauggcugcugggcuguagcugagccguaggagcuggccaucccauacugggagggggagccauagcucugguacaugcucugccaaggcacagggggagccagaguuaguggaggcugcucaucaugccuuuggccucccuuggaacuguguacaacuccagaggcuuugggccccaggcccuuuuuuccaccacacaaugaaguaaucauguauucucauaaaugaaugaaugaaugaaagaaaaaguaguaaucacaaacaaaaaucucuucauuccacuuauaucauacccagaguucuucuuaauagguagugagaaacacuaagugccaacacuuuuaaaugcuaugauaaagugauaggggcaacagcucaucccuuuaaucacaggacuugggcauggggcagaggcagguagauuucuguggaauuuugaauaagccugaucuauacagugaguuccaagccaaccagaacuacauagugaaacauugucuuaaaaaaucaacaacaccucccaaacaacaacaacacaaacaaacaaacaaaaaagacaagcuaguuguggugguguacauucaggcaacugaggcagaagagaagccuaaagucaacuugggcuauauagagaaccgugacucaaaaagaaaagcaaaaacccagauuuuaauaaagucuacacacagcuaugggguaaguagguaauguacuccaguaaguaccaugaacgaauacaaggaagagaaaaggaaaagcaggaugacgacuuaaaaggcaaugggaggcucucuugaagguguucgcugggcagcaaggaaccuugaagugagcugcagagagcaaagcauaggggacuaggacaugcuaauguccuggggucuggaggcaguggaaaugucagcaucaacaguggaaaggaccagaauggauaugccagaucuuaugagaccuaagcaggaaucuggcaguuuugucaggggcugcugucugucuucaccccaaccaaccauuugcccacccugacagaaggcucccacccugcagccagguccucaccaugggguaguaguagcuauacggauaggcauaguuguacugcugguaccacugguaguauuguugcugcugcugcugcaaagcagaggcuucugccugagagacguacugcagaaaaaggaguguccaucaguaccagccacaggagcccaugggcacuacacuaccaagaggguaggccuucacugcagagcaacugcagaagggugcagacucuguacaguaagacuagacaucuuaaaagauggggacgaucauccuuaagaucacucaggcccagguugacccaaaggaguuaacuuucccccuucauuacauuuaguuaacaggaaaacaugcuuacagccccccuauggcacuccccucuauggaagccagcauccuucccacccuucucucggcaacggccccagcccagcacuguaguucccaaauccuccaugccauucucacuugugcacuggccacaggaccacugcugcuggcuuuggaacugcugguagccccugcuuugcugaugcuggccagggccuggcgggccuucucccacucuggguucucgugcauaggagucuccaugccauuuucucugcuguucccagucaccaugcuguacugagaagaccugcaacaacgaagcacaguuauggucuccccuaucuauacacagguagacaaaguuggggaaaaguaaacccaaggcuugcauucuagagcuaaacucccuacucaccacagcccaagcugaagguggcacauagcaugugccaagcaaacagaaagcuaaccaguauguacauaauucuauacaugaccuacgacuuuaggagaacucagguuuuuuacaagccagugaauucugacauggccaacaaugaaaaaaaaauuuaaaaaaagaaaagggaaggaucagaaagauauuaagagggggcuggagagguggcucagugcuuaagaacauuuagcagucuugcagauaucacuaagcucuguucccagcacccaugucggauggcucagagccaccucuaacuccagcuccaagggaucugaggcuucuucugaccuugacgaacaugggugacacacacucacucacacccacauaagcucacauacauuaaaggaaagcucaaaggggaagcuugccccuccauccuagcccccacaaugagcauuuuucccccaagcugugcaaggacccguugugucuuguuccucuugcaaugggcuguguucccuuagcccuacuaaccagucugcagcacgcugaucacccacguuggccgccaucuggaccuugggguguagggaauagaccucgggagccaggcugcuuuuuaaaugucuauaagaaaagagaucaauuagccccaagagaagauaggcuagaaagagaggguaucucauagaagggaacacuggcaaagaauggaaaggaaagcaagugugguggcucaugaccauaaugccagcaaucuuuugggaguuccaauacccaucugggcuacaaguuacaguccugucucaaaaacaaacagcuuaaagaaucagaaucaguuccuaguguggagugaagagaccugagcaugaaaggaaacaccucccuuggaggccgagacuagccuguaggauaugaaaaugaaagacaaagaagcugagacuugcauuacgaguguggcugugagggagaccugacucaagugguggaugcagaaaccucaguccuggauaggaaaucuaaagauacuucuacuacagcaagaggaaggcucuccagugacugaaguacuagcuacaaagaaguuuggggagagggaagccuuuggggauacucugaggaggaaggaauugagacugggagaacacuggagaauagagcaaaguuuucaaagaaaaagguaaaguauggauaucccgcugagcagccaggugaaggugcaggagacuccuuccugugaagucacugccuggcagcaccuaccagacucagaucaauuacagucuccagacuuguaugggauguuccuaggagugggaguugguuugggagcaaacaaguggcaauuacucaaguaaggugucugcagauaacagaggcccacaacauucuuaaacuauuaggggugggguggauaguaccauaagaaauaggauggguugagcaccgugccaacagggcuggagcgguccaaacaacaggauuuacagaaaagaagccuauuggagaaacugaaacccuuauaggaagccuaaggggcacugacaggucucaaaggccuuuaaaaaacccaauccguugggugguaucaagggguccuaacuagggaugcacaaaagagagccucguguucguaacugguauuaggaguaaggggucugauuuacagacgagaacaacacggacuguaagcucagaagcaccuggcugucccgcaggcauggaguccacgacgcuagguggagguugaggccgcccugaacacaagcgaccucccuugucccccgcgaccagccaccggccgggccgcgcuugcgcaccacgcugcgaggguggccucucuggguugcccuaggcaacaggaaggccagcguaacagcgggucaauggagcccgcaaggggugcgucuagggcacuagggaccgcaggguucccagggccaguagcagagcggacgcggacgcgcacgcgcacguaggggagccgcccccucccccccccagcguacacccggcgcgcaugcgcagaggcgcuccggcggccacacccuucaaagacgcagggcgcggcgucgguuggccuuaccaaacaggccagggcucgcggagcgcggagcccgaaggcgucccugugcucgcccgccaggccucccacuacuacccacacucacuaggaccgcucgcucccgggacucguuaccggcgguccaaggcagcuucaagacaaccaagacagcgcucagucaccggcuggcucuagucuggggcucgaacguccugaccgu

SEQ ID NO: 3515 - RNA, 13605 nt, Mus musculus
augccacuccccuaacagcugcagucuggaagaaauuacucuucuaaacagccagacuucacugguuucaggacauuccaggcugggccggggagggguugggcugggggcgugcccguccaucccccuagcucuacccccgcuuccacuacgcucaguccugguuuccuccugucccuacaaucccuucaaagggccuuuagcuuuucuaccaucaaggcuuucuaguccuuuaaauccuagaggcaaacuuuuagggacuaaggaaggcugggaggggccuauggcuuaacccucucaacccgggacaagagaccagcuuggcugacugggcguugacucggugcuugguugguaggcugccauggcccccgagaggggcugaagcuuauuccuggugcagguaagaaggaacuuccggggguugccagauucugggggcuagucucuugggucugagggaggagggcaaacgaaagagaauuccuggaccccuggaaugugagagaggaaagcaggggaacucccagcccgugaaaccagagagcuaggagguggggcugcugagacccaagggugcaggacccagccugaggcgguggcacucagaccgccgcaugccuagguccuggagccccuaccagguaggacgugacacuuacuuuauuugccaggugagaucucuccugcagaaagaaggaaaaaggcgccagagaggccaggagggaccccagcuuaagucggaucucaauuaagucuggaccacgaggugagaagguuguagugggcaggggucuucaaccgggggcgugggaggaagacagacuaguuagcaaacagaccagggacuucgacguacccgaugcagcccgguggcuuuaggaaaagaauugccaaugcugagaucccaggggucuccagguggggucccuugccaggucugggcuccacccuccuccagccugagaaccaguccagccagcucuggagcggguuauuauuuucuugcuggcagggcuggggcugagagaggacagaggugagccagcugugccccacccccacccccacccccaucccugcagcuggagccacgcgguacuuaggcaggaaaaagaggguggaagaggccagagaggaugugcuuaucugagcaugugucugucagggcgggcuggguugccugcuuucuuccagucuacuuugcauugaucccuaacaacagccccucuguaagagccuaggcugaugacgaacuuuucccaagaaugaccacauugccuuguguuuaacaggccugcagcacgcauauuugagcuuagagcugagugugcaaaaggacaccuagguugcagggggaugugacucgcugaaggucucagagcaagccaaggcuacaggggcauuaaaaucuccauguugcauguguuagagcaggcauguaguguguugcauucgaguauguuaggguaacccccuagauuauucuccacuuuauucuugaaaugagagaggucucuuauucaaaggaauaagccccagcugucuucuugccccugcccucuuccgugcugggcuuagaggguuuuugaaugggugcuggggauuugaacucagguucuugugauugugcagcgaguacccucgucccccucuaaacaguuaaccaucauuccagucccaagagcuuuuuccccccaagagaccgaauuucacuauguaguccuggcuggccugaaacucucuauguagaccaggcuggccuuagacuuauaaagauccacuuaccucugccuucuguacacugagauuaaaggcaugugcaucacauccaccucccaaagcucguugugguugugagccuacccuuuagcagcugagcguucucucuagccccacaaaagcucuuuuaauucacuuccuccccccauauacaauggaagagaaaacaaagucaggaaagguaccacaugagagcucuggcuuuuauaucaaauuaaagcuuuuuuguuccucuccaugugguccaccuccugugggugacugucaacugcaauagcuucuuuacauuucagucuuuaccagccuggucuaaauccugucuccagaauauauucccgugugacccagggccaguuauugaaucuuucugcuuuucaucauugaaaaaaaaaguuaucaccuucugcuccaaggauuguuuugaggaucaaaugaguuaccaaggccggugcucaucugugagaaugugccugggaaauaaagagggcccuguguguguucaacauccuuuaauauacagggaucuggcucuuguuuuucagaggauaaauucagcaaaagauuaagggaacucccauaagaaaaaaagggcaaauuucuagcaccaguauaugugauguuacaaauugugaucuuagcugaauuuauggguauaggccuauaaucccaguuacuagggaguagaggcugaggcaggaggaucacaaguuuaaagaucagguuauggaguaaauauaaauauaaaauacaacaucaauuuggaccggggcagugguggcgcaugccuuuaaucccagcacuugggaggcagaggcagguggauuucugaguucaagaccagccuggucuacagagugaguuccaggauagccagggcuacacagagaaacccugucuuggaaaaaaaaaaaaaaaggaaaaauccauguaccugcuaaguuguuaagggccagucccacagcccaucaaaacuuuuguuuacauuaugguggaagaagggagaggugauugugugucaaguuacaauaaaaauaugucugcuuaucuacuuuuuuaaaguuuuauuuaguuuuuuuagcugcuuuuuaaaaaagauuuauuuauuuauuauaucuaaguacacuguagcugucuucagacauuccagaagagggcaccagaucucauuacggaugguugugagccaugugguugcugggauuugaacucagggccuacagaagagcagucagugcucuuaaccgcugagccaucucuccagcccccaugucugcuuaucuagguuaaggguagaguaggacugguauagcaagagcaguuugagagauggacaagauggcgcaguuuuguaagcucagcacuugggaaggcugaggcaagaggacugccaugagcugccugaaagaugcuaucuccaaaauaaaauuaacaacgauaaacaccaaugcuggugguaggccugaaaucucagcuacucaggaugcugaggaaggagaauaacgaaguuuaaggccuaggcuacaaagugaguucaaggacagccuggacaacuuaguaagaucuuguccaguaaugaaaaucaaaaagguuugagagagggccauggaaguauuggagcuaugacucaagacauuagaagcacuggcugcucuuccagacaaccuggguuugauucccacaucugucauauauaauguaguaaagggucuccuagugggcccaugccaauauguccuccuguguaauuaagcuaguauacagggaguuuauuugggggagggaggggagggagggucugggaaaauggucaaggcagaugauagacauguagacaggcagacaguugggaacaaagccaugagggcagaguguagcuguccagaggccauggauaacuggauuaugccugaagggcauaugaauaugcacucugcauuucuucauggggaugaauaacugccauggugaauaaacugagcuuugcugaaggugaucuuguguguaggcaacuaaucugcuuaacauacaaugucaaaaguuaaaaacaauaggauuaagguucucuguggggaugucucagguauucaauaauaaauaaauucagcugcaaauuagcaaugaucagacccaaggucuggccacugggugagcaggagguggcuuugagaauuaacagaaaacuguuacuucucugguaagaguggaaacuacaauccaaguucuaagucaguuuccacagucuccauggucucugucccacaaggucuaaaagccuaaagcaaggcagcuuguccaaucugggguauagacaaggaaaggugggucaagaacauauguccaauacagcauuccugucaccguugucagggcacucagcaagcucacgguucagcaucauccuuugucccaguaucagcacgucacaccaaucacucuggcagcuagcaugcuccugcagcauucugcggaaaaaaacacaaacauguccucuuccccauauuaaauacuugaucaggaucaugccaugugccaauaaguagauccuuccauuucaccagacauaaguaugccugguuguagagugccauagacacucagcagagaguuccuuggcauccaaauuuuaaaauuuuaaaaauaaaaacaugauuuaaauaauguguacagggauauaauucccuccuuuuauuuaaaaaaggagaagauauuguuuaaagucacaauagcuugucccugaggaugauaaggaaucccaguaauguggguaacauuaaauuguugacaaaaugucucaaaggcuucauaguaauagccaguuccauuaucuguuuuaaucugauuuggaacaccaagcagagaaaaauaaugcaggcaaugaccaauuacauuuuuaguuauuucuccuauugaagaaguugcaacuagaaagccugaaaagguaucaaugcauauuuuauuuuucugaaaucagaaauaugaguauccacuugcaauaauugauuaaaguccucgagaauuaauaccauuaugugguacagguugaaauugaggauacugagaacaagucuuuacaauuugacaugcacauucucuaaaaauaucaaauuauugucucaagccauuacuauuuugaugaugugaagaaugagaucaugcugggcagugauggcacacgccuuuaaucucagcacuugggaggcagagguagguggauuucugaguucaaggccagccuggucuacagagcgaguuccaggacagccagugcuaaacagagaaacucugucucaaaaacaaaaaaaaaaaaaacaaaaaaaagaaaagaaaagagagaaagagagaaggagggagagagagagagagagagagagagagagauugauuauuuggccaauuguuccuguguaagaucuauaaucugucugggauacaaaucugcuguggcauugccuuaaggggucuuguccaggcaguccaggaugaguucuuaaauguccaaagacaguccuuuaaaggaacaguacuuucucuuaacuugaguuguauaugccuaaacaauugcaagauuugauauauauauauauauauauauauauauauauauauacauauaugcuaucaguauacaaauuaaagcuugauuuuaacacuuuaaaaacaguggcuacagcauguaguucaauuauuuaugcugaaguagagggaaacucaugagaauaaacaugugauccaauauacuucucucccauagcggggauguuuauaaauauaguagauguauucuuuauaaauauaguagaugauguauucucuaggggaugcaugcauaaauuuucaggaaauacaaaaguaugcauagaagcaaauuuuaacaacuugucuuuuggaugaugauuaucaauuuugccuaaaaaguuugccaugcaauaggccaacuaucaguauucuuauuuuauuuuauuuuaaauuauuuuauuuuauuuugagacaggguuucucugcauagcccuggcuguccuggaacucacucuguagaccaggcuggccuugaacucagaaauccgccugccucugccucccgagugcugggauuaaaggugugcgccaccucugcccagcuucaguauucuuuaauaaccaauucaauugcuuuuugaaacaaggaauggaugucucauuagguuuuuaagacauucuuuccaaaauacuuucaugauucuauccuacaauucuuuauuaacaccacaacagcuuuauaauaggauguuaaaacuuuauuuggagaugaagaaggaugaauucacauuaaugguccuuuugccaaagaauugcugugggcacauugaguaagaauaacuaaaauuugaucacacugauaacaauugauuacugcagcuuucucuacuuuuugcaaagcuauucauaccucaccaguuauuuugcaucccccuugagaacauccaacaaagguuuaaguccuccugugaugagcuuaaggugaggucuuauccaauuaacaucuccuggaagcuuugaaaauaauuugaaguaagcaaaucaucuuuucuuucuugaauuuucugugccauacuuuuucuaggauauaacugagacccgaaauauugaaaaagauauggccucugaaucuuuucuggagcaacaacuacuccaauuuuuuuuuucuuuucuuuuuuaaugguuuuagagcuuuauuguagaaaggcagggggaaggagagaagguagacagagaccggccaucgccauguggcgagagggggguggggggagggagagagagaaggagggcuagagaguaguuguauaagagcaaagaucuguagugaaaugccaucagagggaucagcuaauaagauacucuccaucuaauaaacaauauacacugaaagauucaaaguccuaacuucucguauugaagcagagacauuuuuaaaaacuuaauauaaggcuauuagucauuccuagaggcaaaacuuuccaaugaucacaagcucaggagaaucaaacccuuuacaauuaucaggauguaaaggaaaaaacaaccuuccaaauccacaauaauucuauauggaguaggcaggccagauuguaaugccucuacaaguuccacagccucauugaccuuucauaaaucuuaaguuugaaccuuauuuugaacaacaccuggauuaaucuguaauaauacuguuuuggcuuaaaaauaauuucccagaggugagggcccaaaaacuuccaaaggcaggguuuuguaagacaaaugcagugccacgaaagucucacugaggcagcucugagcuuugcaugaacucaaauguaaagauuucuuaaucugagcauacugccugaguccugacccaaugauuacccaccccccccacacacacaccccccgcagugaggacagauuccaggggagagauucuacugucugucuaucccuuuaauuuuuggacagucuuuccuaaaaugauuuauacuuaaaacauuccuuaugaccucggcacugugaaagcauuguuuguacuguaguccccuugcaaggcagcagccauagguagacacggauuguaugagagcccaauuuuuauauauggaaccccugcuugagggucucugaauauucgacuaccuguuuuuaguagccuauccacaaacuccuugaagcagcucaucaggagccuguuugauaccaaauaaauuuccacugauaucuccuuuccgaucuuggggguuaaauuuugcuucuaccacuguauccaauaaagcuuguguaaaaggggcaggggcccauacuggccacagcuguucuuaacuuuuauuacucuugcaaucauccuaauuacaaaauaugggcaaguuaagaaucaaaacuacaaacugcagccaauggaacacuggcaauuuaacuauaauuuuaaaguuucuuuugcaauauuagagcauaaucauaacuuuggaaagcaaaauccaacuuuaaacaauccauucucuuuaaaaucaauaccauaagcaucaccuucaccuuaugaaguuuggcuaccaguucuuauauaugaaugcaugacagugcagcuuuuuuuuuuuaaagauuuauuuauucacuauuauuuauuuauucacaccagaggagggcaucggaucucaucauagaugguugugagccaccaugugguugcugggauuugaacucaggaccuucggaagagcagucggugcucauacccacugagccaucucuccagcccgacagugcagcuuuuaaugcuucauuaaagagauauuauuuuauaucuuaucccuuauaagucuaguuucuaggauaagaauuacaugaaauauuaucccaauuuagaaguaucuuuagaggccugguuuccugcgcuuguucaugccauguguuguuguuuaaaaugacuccaacccugaguuaccaguuuuaagcuaacuuucuuauuaccacuguuuuacuuuuuaaaucauacccaauaacuuauaagccaauacucuaugaucaagacaugcagaacauauuuauaccuuuaagaccagucagaaacaaaaugaaguggcuacacgaaucuuauaaauuuagaccaaacaaaauuuuuauuuuucuagcuguaauuucaagagaaaaagcacguugucauuugcugaacccaaugaucacaauugcagagauuuuucuaggaaaaaaacaacuaucagcuuauuugccuuagaacuaagaagcugcuggccccucuuuuuguuuuguuuuucgagacaggguuucucuguagcccuggcuauccuggaacucacuuuguagaccaggcuggccuugaauuuagaaauccgccugcuucugccucccgaguguugggugugcgccaccacacccggcugcugcuggccccucuuaaaagcauccuuucagcagggccucuccugcuguccuugacuccuggcuaagggugcagggcaacuuuaaucagccuccgcugugcaaacugagacugaaucaagagauggaccgacagcagauaaaauuuaaacaguuuuuucuuuucaacaugaaacagaacagcagucauucagacagugaaacaaaaaacaaacacaaauugacacauagacagauuggugcaccaaagacauacaacagacagggacgagaacuugauguaaccagaacuaaggauuucucuuguaggggucaaagaggaagcaggacgucuccugauuuacuucugucccugggagagcuccaaaaucuacuuuccuucucucucucucucucucucucucucucucucucaugucauuuguguaucuagcaucuccauuuuuuguuguuauuguuuuguuauauacuuccccaccccaaugcugucacccuuagcugauaucagugucaggcugaugcugacucagucuagccuguauucuuuuugcacccuuucaaucaacagccuucaaaagauaaaauuuauagcgcuaacauuaaugcuguauguugcuuaccacugugagggauacauaacuucuaccgguuucuggggagcucuaccaaaggcaugucccucauugggucucucugugucuuggucccucauuugggcaccaccuguagcuguccaggagccauggauaaccagguuuaccuggaaggaaagcugggcuuggaauagaauggguggacaagagaaauaacgagccaagacaaagugucucugaugguggcucaaauuuuaauuuuucagcucugcuuuuauauaagcaaaacccaaaaacccaucccuuuguuucagcuggauugaguugcaaaguaaagucuucagcagcucagcaugugggcaguucucaguucucuggucucagucaggaagauguaaacguagagaggccggaggccuggcuccagugucuuuguuuagccaacucaaggcugggggaagggcacagcagagaaggagguggggggacagagaaggacaaaaaaggagaaagagauuauccaagaacacaugggaacagagagagaacugggguguccagcaguccuuauacaugcugccugcaccuggcggccauagguaauggcggcugacgaugccauaaggcauccagggaguagccuagaggaaucaccuguaaacaacacccacaggguaacccuuggucagcuguuauucuaagagauuugacacccuguuuuggccucuaugggcagcaaccaugcacguggcacacagacacacauuugggcaaaacauccauacacuuauauauauauauauauauauauauauauauauauauauauauauauauauauauaugggaauguagcucacucaguguuagagugcuuuucugggaugugugagauccuaaguucaggcagaguagagaggaacacauguaaauuguacgugcauacauacaugcaguuagacuacgcccaucuaaauuauuucaagcaguuuuggcuugacacuucuccccugggugcugaaugcugaaagaauaguguuggcugcuuugccuuucucaugcaguuuuaccaagucuaaucuuuguuccgcaguuauuguuugggugacacagccuuucuucucccaacacuaacuagcacuaccaguuggcaauacuuaaauuaaaaguaggcuuuucuuuaagucgcuguuuccaugugcucugcaaggaaucagaagcgucauuuuaucuguuguacagacaggaaaaugaaaagauuaauuuauggagagucacuuuacuggaaaagggugggucuuugauugaaagagaaacaagggauuucauuauaauagcagugaguguuaaaggugcaggguuguaaaagucccacucaaaauuuccauggaaaaaagaccaagcuucaggauauuggccaaggcuugcuguguuucuauuuuccacccagccagguguggugcaguaaucuagcaacugcacaucugguuuacaauucacuagcuggcagcugcaaauauaugauauucuugcugauauuuauuuggucaucucucucugccucuguguguaugugugugcacgugugcacgugugcggguacaccacaugcaagcuuggugcccauggucgucagaaggaggcaccagauccccuggaauugaugguaaugggaguugugaaccaccauggggguagugggaauguguauauuuguacaugucuguguguguguacaguaguaccuacagacgcaagcagagggcaucaguuuucuuggagguguaguucuaggaaauucuaaacugugggacauggguacugagaucagagcuucccuggaaauacguuaacauauaagguauuugcuuuauuauuaguguuuuuacaaagcaugagauguuauacugcuugcuaggucauagucccaccccaaagcagaccaguuuaguuauuaaauucuaugcaaauaugcuucccucccgucgaagaguagcaaacgggaaaccucugagcccucucuucagcccguuacuuuuacuauuacuauucuuucuaacauauaacauuuauuauuuauuauuaguguuuuacagaauaugagauauuauacugcuuggucaucaucucccccaaagcagacuuuagcuauagaauuguguaaauauacagcuccccugaaccacucugaaccucccaaauaagaaucuucauguggccuauucagugaauuuugcacaugcccuguagagcuuucuuaguccacuucuucaauguguacagagcgcagggugcuugaauguguaguugguccuagaccugcacccuggguauuaaguggacagucucccugucuucgaggaugggcauuggcaaucacguguuguuccucuauaacuaaugcuaacugaaguuauuuuuuauuagccuagauggguagcacuccaaaaguaauuuuuuuugguaccuacccccuagaaaugcucaaauauuuuuuguugggaugacccacacaguauaauggucauguguagugagaauucuggaauuuuuguuaaaaaaaaaaaccagaaauauuauaagaauguccuuccaucuuaaucccaggcauagagaugugaggaugcuucagauuuucuucagcagcugacuaugauuuaccuugagcucuagcagaagugugcuuuugccagcugcgacuuuguaaauuugggauucuggaaacuuuucagagguuacauaaacaugagcccugagagaaguggucugcaauuguuggucacuuaggaaggucggucgcagugugcuaguagccauggucaaagaaaaaaagaagaguggggcagugguggcccaugccuuuaaucccagcacuugggaggcagaggcaggcagauuuuugaguucgaggccagccugcccuauagagcaaguuccaggacagccagggcuacacagagaaacccugucuccaaaaaccaaaagaagaaggaggaggaggaggaggaggaggaggaggaggaggaggaggaggaggaggaggaggaggaggagaaggagaagaaacauuugccugacaaauucagaagaggaugcucacagccauccaguggacugagcacaggguccccaauggaggagcuagagaaaggacccaaggagcugaagggauuugcagccccauaggaagaauaaaaauaugaacuaaccaguacccccagagcucccagggacuaaaccaccaaccaaauaguacacaaggagggacucaaggcuucagcuguauaugagcagaggauggccuugucugucaucagugagaggagaggcccuuggccuugugaaggcugcaugcaugccccaguguagggaagcaggaguuggguggguuagugagcaggaggagggggaaugggauagggaauuuuuugguggggaaaugaggaaaggggauaaaaauugaauugcaaauaaagaaaauaucuaauuaaaaaauaaagaaauuaguguuaggggaugaaguggauugggagagggugauaaagagugaaaaaacaaccacaaaguagcaaagaucagguacaguuaugggcguguuaaacuaaguaugucacugaguucagcaggagggaccuugagaaccucccagucugcuuccucauuuguuaacugggaauaauaguucuuccauagcccuguuuuaugagagcauucuguggcugacuauguaggauagggauacagaguuggggcucccggaugaggcagcucugauaugccuauguccccacagaugccgguaaugaagcagcugggcccugcacaacccaagaagcggcuggaucgcggagcacucucgaucucagcaccccucggagacuucaggcacacauugcacgugggacgcgguggcgacgccuucggggacaccucauuccugagucgccacgggggcgguccgccucccgagccuggagccccaccgguuguggccccacauucugucgcuccaccugcagccccacagcccccuguggcugugccuucaccugcggacccgcugcugucuuuccaccuggaccugggccccucuaugcuggacgcgguguuaggcgucauggacgcggagcgcagcgagacaacagccaccaagcccgauggggaugcccacccuagagugcagcaccccaagacccgcugcugcucaaaugcugaccuccagcuggacgacgucaucggucuguagugucauaauucccucaaccccucccucccagcacuccacuuuuguacacauaaauggcugagguuugugccauggacu

SEQ ID NO: 3516 - RNA, 1220 nt, Mus musculus
caugacucucacccucacauuccuguucagucuuggugagauguggaaaauggaaagagucaccuaagucugcgaaugaccccauagacaagcucugacccaugaggagacuucaagggcucaggaaucucuggguagaaaaggacaaacuuucaggacaaacuucccacagaacaaccucaggacugaguaugggcuacaagaaagcaguacuggcaaguggguguauucccagcuguuccaggugucuccaccuuacuugggacaaugugucacauucaggcaguggggaugugaaacaguaaaugugggcugauguuagggauggcuggaggauccugggucugguaacaagaaccagggagaugaauguccugggaauuggccucugguuucuuuucagggacccuuucugugcccaucaucuggguugagccagauucuguggucaccugggguacaauuaugagcaucuggugucagggaaucuuugagacccucgaguaccaucuuguuaaagaaggaagccggucaccuuuguacauaagacuucauuggagcacaaaaacaaggucaaauuuaccaucucauucccauaggaucauuguuacuaucugaacccugauggcuggucagcgcauaguaacccaguggagcugguggugacagguaaggagacccucagggauaucaguccuugauugaccccuccccccccccacacucucugcuugaagacacuguggguuguguaagccaguuuauaaauuacagcccccuccuccccccuccucuucuucuucauuuggucuuuuugaggcaaguucucuaauacaauucuggcuguccaggaauucacucugcauauuaggugagcugugaacaaacagauccaccugccucugcugggauuaaaggugugcaccaccacccauagcuacauucuucucuuguagaauucuacagaaagcccacccucucagucuugccuaguucugaagaagccucaggagggaaaauggcuguucaaugugcuucuucacugagauaugauagguucauuuucacuaaggaaggaaaacauaagcuauccaggacacuacauacacaacuuguaccuaaugggcaguuccaggccacauuccauguggguccugugucacuuagccagaaaacaugcagaugcuauggaaauuacaagaucaauccauuugucuagu

SEQ ID NO: 3517 - RNA, 20890 nt, Mus musculus
caucuggucacuccccauagccggguucugguggcugugugauuccacguucacgcuacucgagcgcacguggguuccugggcagcgcguucguccgcggaguggccuggagugcagacccacggacacccuuuuccccagccugggaugagccgcuuucugcugccgguguccguagugggcacggugaucggcggcaccgugcugcucaagugagucugcgcgucuucucugcgcgcuuggugguagguuugcgacaggggaaugccaaacaaggccagagaaguaucccuuguccuaaguccucggacgaauucuucccgcucacuaguauggcuuuuccgggagaggagggcgggucaccucuucaaggucaccuagggagaagggguggagcauggaucuugugcucauuuuaucucuggaccacuccuucucuacccuuuccucuuugcccagccuguuugccuccccuuccuuccuuucuucccuuuccucuccucccccguccuucuuuccuuccuugcguuuuucagacugggucucaccaugaagccuuggcuggccuggaacucguuauauugaccaggcugauuuugaauucacgagagaucugccucugccuccugagugcugggaccaaggacaugcgugucugucaccgcuaacagcuuacaugagguguuucccuccccgccccccccccccccgcauguaugcauaugcuaugcuuucggagguuaaaagaagauguuagaucccguggaacuggaguuauugugagucaccguguggggugcugggagcugauccuggguccucuguaagagcagcagugcucuuacugcugagacaucucuccagcuucuugauguauacacacccgcuucccaaucauuguucuccaacuuccauggaccccuucugacacaugcuccuuccaacgucaugcauucugucugucugucugucuauccauccauccaucuauagacaaggcagcauguagccuaggcuggccuugagcuugcucuguagucgaggaugaugaccuuaaauuccugguauuccugccauugccuccugaguacugggcuugcaaguguguaccaccacuucuggcuauugucuuuuguuuuuauaaaaguaugaauaaaugauuguuaccucuuggagauguuccaacguauaauccuuuucugaggccaugacgaggacucccguguguuugggugcuuuggugauggaugugagcuuacgagugcuuugccccagcucauaaaucuugaggcaggcacgaggcagacagaacucacugugcuguuucucaccuucagggacuaugucgcugguggggcuugucccagcaaggccaccauaccugggaagacuguuaucgugacaggagccaacacaggcaucgggaaacaaacugcuuuggagcuggcuaaaagagguaagagcagccccugcucugggguuugaagaguuaugugcacacuguugugugcacaauguuguguauggcagccuuguuuauaauaccucgaaggcagaagcauuccaggugucaauuugcagacaaauaaacagaauacggcucauccauacaguggaauauuacuaugcuuucaaaaggaaaggaauucagacaugcuucugugugaugauucuacaggauguugugcuaagugaauaaaggcagacaccacacacacacacacacacacacacacaccccaacagcuacauaauucacauucucaaaacuauccaaaaccaaaccuguuuuuauuauguaguguguguauguugggcuggagugggucugaguuugccaucuguguagacaaccauggaagcugguuuucuccuucugcucuguagguccugacauugaacccugguccucagacuuagcaguaagugcuguggccuguugagccaauugccagccucaguauuugcauaucuugauauguuugcuuuguguguauaggggggagguggguacacaugugcauaugcgugcacauccuuguggaggacagaggauagccucugguggcauuucucagaacaacaguagcauauuuccauacguccuucgaauguuuucgucuucccacacgccuuuagaauauuuucauaacagcuccucuucccccaaaucuccuagcuccaggaaaccugcauccuuucucuuuguggauuuaccuauucuggacauugcauauaaaugaaugcauguaugaaugucugacucacugaguguagaguuuccagguccauucaccuugucauaugucaguacauuacuacaguuauggcugaagaguaugcuauggccuggauagacugcaguugguuuauguauugauuaguggguggacauuugcuauuuuguguguguguguuuugaggauugaacccacggugucuuguuugcuaggcaggugguuuacuacugagccacaccccagccccucacugggggauucuaggcagguggucuaccacugagccaugccccagcuucucauguggggauuguggacucuaccacugagccacacccucaguucuucacugggggauucgaggcaggugcucugcugcugaaguaccuccucagcccuguuuugacuuuuuugagacagguucuuaccaaguugcccaggcaggucuugaacauacuuuguaaccuaggcaggccuugaacuugcaauccucuugccucagccuccagagucacugccauucgaggucuacaucaccaagccugggaguaauugaguucccaucuuuuggcuauugacuauguuacugagaacacugugugcagguuuaaggugaguguaugcuuugauuucuguuggacagauguguguucucuuuuccuguuccaggaggcaacgucauucuggccugucgugacauggagaagugcgagguggcugcaaaggacauucgaggagagaccuugaauccccgcguacgugcugaacgccuagacuuggcuucccucaaguccauccgagaguuugcaaggaaggucauuaaagguaggcaagaggacauugacuuuuccagccaagguuuguagcuucagguuagccucugagguaccuaaagccuguaagcucuggagcagaggcuggccaacggcguccgcuggcuaaauguagcugcuaccuggcuuucgguucucuucauaagaucagcuagcugugccugcuugugagaguccaucaugaucuggcuuguggacuguugacguucucucagaguuggagggagcagugcuuugagugagaauaaccuacacaggcccgugugucugaaugcugguguccaguucuuaggacuguuugagaaggauuuggagguguggccuugcuggagugucauugagcgugaacuuugagguuuuagaagccuacagcauucucaguuagcuuucucuugccucguguguauggaucagauagaagcucucagcuauugacccagccccauaccugucugucugcugccaugcuccucacuuugguggccaugaacacugaugcugugaaacuguaaaccuccaauaaauuguaaguugccaugguuauggugauauuuuaucuuaaagauauguauguauguauguauguaugugaauguguauauauuuaugaaugaauaugucuauacacacacacacacacacacacacacacacacacacacacacacucuacaaggaauuggcucaccuaguuguagagcugacaagacccagagcucgcagcuuagagacccaggaccugcagguccuaugcagagguuugagguuccagacuggauugaguuuaaagucagaagagaguugauguucgagcuugaaggccuuuggggggaagaagucucccugcucugcagagggucacuuuuguuguggucggggcuucugaagauuggaugagucaaggcauggcauauacaccuccccuuaccacuuuaaaaagaaaaugaaaagaugaacauuuuuauuaauuuacuuuuuugagacugggucuuacuguguagcucuggcaggccugggacugucuauguagauggguuggccuggaacucacagagauccaccugccccugucucuugagugccaggauuaaaggcaugcaccaccguaccugucccuguccccaucuuaacucauuauguuacacacgauaucucaguagucaggaguucaacaugcuucuugaaaaggcuuuuuuuuucuuuugagacagggucuuauguauuaucuaaacugcucuuaaacucaaaauccuccugccacagaguccugagagcugagcuuacaagugugcacuacugugccauagcacuuaggaccuugugaaugcuagguuaaagacugcugcugagccacacccucagcccguuacuaguuaacucuaggcaggcacucuaccauuaagccacacccccagccccccaguaggggauuuuaggcaaugcccugcugcuuucucaccuggagacucuaggcaaaugcuuuaccccugagcuccauucucacuuagccccaugacaucuuuuugggaguucaucgcagaguagauccugacugugcaggaugaaggauggaccaagugguggggauguguuacagugauuagaaacacagcaucuacagugugauugggagacaggagucaaauggagaaccaagagucggaucuggggagugggacaccgugcugccguguagcaauucgcaaggcuagcagcuggaugagguugcgcuuauuucagaacugggucugaaguugaaggguaauggagaaggcaggacaccgacucauccuugcucccagccuuucuggugaugugagggcagugacgaugagucagaagcgcucuaugcauuaggucacaugaugaugugugugcugcucgagggcagugccuggggcuuucuugugagugcccuuggauaaucccagggcucaucuggcaaauucuguauuucugucacaaugaggggugacaaccuuuuaggugaugucaaacugucacguaucaguauuuugaauagggccauagcuccaucuuuuuaaaaaagauuuauuuauuauauguaaguacacuguagcugucuucagacacuccaucucauuacagaugguugugagccaccaugugguugcugguauuugaacucaggaccucugguagagcagucagugcucuuaacugcugagccaucucuccagccccauagcuccaucuugaagcaacugccaggaaguacaaaguguguuccuuauuuuaauugauuuauuaaaaauuauuuauguguugugggcagugguggagugugccuuuaaucaccccugcaccuaggaggcagaggcaggagaaucucuuuaaguuuggggacagccuggucuacagugugaguucuaggacacccaaggcuacacagagaaacccugucuugaaaaaaacaaacaaaagaaaaaagaaaaaaaauuauuuauguguauagguacacacauguaugugcagcacucauguacagugcuugcagaggccagaagaggccucugggacuguacggaugacugugagccagcaugugggagcugagaaucaaacccagguccucuggaagagcugccagugcucucaaccucugagccaccucuccagccauguguuaacuuuuuaaguuauauuuacuguaauuaucuaucuaucuaucuaucuaucuauccaucuauccaucuccauccacccauguauccaucugucagugguuguauguauguauguauguauguauguaucuaucuaucuaucuaucuaucuaucuaucuaucauguauauauuuaucaucuguguaucuguguauauguguaucauguauguauauauguauguauguaucuaucaucuauguaucuguagaucuauguauuuauccaucauguauguauguauugucuaucaucuauguauuuaucuauguaucugucuaucuaucuaucuaucuaccuaccuaucuaucauguaucuaucuaccuaccuaucauguauguauauuuuuaucaucuaucaucuguguuucuguaucuaucuaccaugcaucuaucuaucuaucuaucuaucuaucauccaucuagcauuuguggguguagauguuucacagcacacauauggagaucagagacaauuugcaggagcagucagugcaugcgugcaugugugcacaugugugcauacauuuaccacaguguauguguggaggucagagggguugguucuuugcuuccaucauguggcuuuggggcuugaacucaggaagucagucuuggcagcaagugccuuucccuccuuagccaucugucuccauugcccuuuuuaaaacuuuugagacuggcucggagcugugcuguauagucaguguccugaauagcuacgauuaccacccuucagcaaucacuucuggcuuuuuucuugauauauauguuuuacauuauuuaucgugugugugugugugugugugugugugugugugugugugucuguccgcuugugccauggugucggcaagcgccuuugcucucugaaccauucuccagcccauuuuuucccagaacagcuaccucuggugaguucuuuguaaaaaacguuucauuacuuuuaauucuguguaucucuaugggucugugaacauggguguuuuggaucccucuccuguguagcggggguugcaggagguuguaaacugccugaugugggugcuuggaaccucugcaagagcaguguguacucucagcuaccaagccaucucuaguccaagagaguuuauuuuuauuuuuuaaaaaugaaagcacuuauuagccugagaaaccaucuauggucagaauuuauuuauugaugaaguaggauaguucucuuuugaguguguuugguuuucagucuugcuggaauauccauuucaggaaggcgguaaccucaacucuccuguccacccuguauuuccaguguccaauaauaggugcuuagaaaauacuuguugauuaacuaguaauuacaugguucuaccaggcagguacuaauauccauuuuuauuuuuuuuuauuuuuuuagauuuuguuuauuuaguuauucugccuggauauaugccugcaggccagaagaggcucguuacaggugaucacgagccaccaugugguugguaggaauugaacucaaguccucuggaagaacagacagugcucuuaaccucugagccaugucuccagccccccuuuauaaagguuuuauuuauuuuauuuguaugagaacacugaagcuguguuuagacacacaggaagagggcaucagaucccagaugguugagagacaccaugugguugcugggaauugaacucaggaccucuggaagagcagucagugcuguuaaucaccgagccaucucuucagcucuguuauccuuuuuaauaaaggaagaaacugagucucagagaagcaaugugaacuggccagugucaaaaauccagucagguuuuuuuuuuuuuuuuuccagacagagucucacucuguagccuaggcuggccaggauuauaggcugagccaccauaucaggcuucagagcuaagauuugaacucuugucugccugguugcagauaggaugugccuccaucccuccccacauccccacgccaacugggaaucaaaccugggacuuuguccaugggugguaguugguucuagaaucuccugggagauaaacuccugggcucgucugucagggaguuuccaaaugcaguuaauugggaugagaagacugaagaccuacucugacugggcagggucaucaucccauaggcugggucccaggcugaauuaaaaggagaagcagucucucugugccaggauuaaagaccugugccacuaggcucagcagugacuuauuuauuuauuuauuuauuuauuuauuuauuuauuuauuuuuuagacagugguucuuuuuuuuuuuuuuaaagacuuuauucauuauuuuauuuauuauuauauguaaguacacuguagcugucuucagacacaccaaaggagggcaucagaucucauuacggaugguugugagccaucaugugguugcugggauuugaacucaggacauucggaagagcagucagugcucuuaaccacugagccaucucuccagccccuacuuauuuauuuuugguuauauuagugugugucuguacgugugucuguacgggugccugcagagaccaggacagggcaauggguacucuggagcuggaguugcaggaagcugggacuccugaugggugugacuguugggaacugaaguccgcuccucugcaagagccagccguaugugcuuuaaacucugagccaucucuccagcccugagacaagguuuugcuuuaugacccuggcuggccuugaacuuguaauccugccccagcuucccugguagccugcacugccaccugcggcuuggagcuuguguucgucauuggugccuuauauuccacucacccacugggugacaaauaagauccugguccacaucucuucgguggagacacccaauuccuuauguccgcugacauucucuuggaaguguuauggcuucagucugucgccaugggggaggcucugacucuuaggaucucagaaggugaccuuguuuggagauuggcucuuguagaggcuaucaaguugaagugaggucaucaggaugggcccuaggucaguaucccugguguccucauuaugggaaacugggacacagagggcugugcacagagggaagaugauggguggaguuggccaucuacuagccaaggccuggggcagauucucuucgucagccccagcuggucuagcucuuucuaagguccugauccuggcuucucagcaucuuggccauccauuucugguucuuuuaaagauuuuuuuuuuuuuuuuuuuuuuggcagggguagguuuuuuuaagacagcaucucucugucuauccuggaacacacucuguagaucaugcuggccucaaacucacugagaucuuccugccucugccuccaagaguguugggauuaaaggugugcgccaccacugccuuucuaagauuuauuuauuuuuauuuguaugaguguuuugcuugcguguauuuauguauaccacguuugugccugguacacaaggagacuagaagaaggcauuggaucccuuagaacuggcguuauggacaauugugagcuacuguuuuagugaggguuucuguugcugaaaugaaacacgaugaccuagagcaauuuggggaggaaaggguuuauuuggcuuauauuucaacauugaaggaagucaggacaguagcucaaacagggcagggaccuggagguaggaggaacugauguagaggucauagagggguggugcuuacuggcuugcuccucauggcuugcuuggccugcuuucuuauagaacccaggaccaccaaccaacccaaggauggcaccaaccacagugggcugggccuucuaucaaucaccaauuaagaagccauaucuuauagaagcauuuucucaacugagguuuccaccuuuuagaugauucuagcuugagucaaguugacauaaaaccaccuagggcagcuaccauaucagugcgaggaacugaacccagguacucuucaaaaucagcaaguggcuuagccgcugagccaucucuccagucccaauuucuguuguucagguugcuuggcuuguagcauuuugugaugucagccagaccaaguguccaggauccucuuuaagaacaauaugcaugcacuacuaacuccagucccuuuuauguucguuugaaacaaggugucuagcccagguuguccuugaacucccugucuauauaggauggccccagccuuuuaauccucuuagccucuucccguauggauuauugguauuucacaagaguuguuucauaugguacuggggaagggagccagagccuggugcaugcuacacaagcaguaaacuugagcuguaucccuagccccgaggaccucacucgaucuagaucaucucugugacagucaagguuauguguugaacuccuagggaucugacucaguacauggcugugggaagaugagguagagguugcucacaucauggcugacuaagugagcaagcagagaguggggcuagaacucaggacacuuugguaguuuccaagaccuucccccaguaacuucuaucacucucaccuuuggccucuugucacagagcauccucccucugucucuagccuggcccuucucccuuaggaggagagcaaccaacucuguugcaucacaacacauuccaugaucuuaccuaaguggcacccgaucaucucuacaaagauccaccuucacaggcgccagguagacaggaacgugugugggacacuguccuaccuucaggcagggguggagugcaucuugauguaucugaccucacccaugucuucuagaggaggagcgaguagacauucuggucaacaacgcagccgugaugcggugcccacacuggaccacugaggauggcuuugagaugcaguuuggugucaacuacuugggugaggccugggcugguuuuacaugggaugagaauugguucuugauguggagucacccacucugugguguguguggaaucuugcuccauucuuuuaaaauuuauuaaccuauaugucuguaccauagacugggugaauccucauuucuuuuuccuucuacuuuuuaaaaauuacuuugaggucauauaaaugauggcauuuucaugcgugugugcccucauaccuuggucucgguuguucuucucccccacuuagcuuccccucuacccuucucuuucuucccccaguuaguccccuuucauaguuuuauuuuuguggcuguauaaaacacucuggcagaaaagcagcuaugggagaaaggguuugucugguucacaguuccagguuacaguccgucacuugaggaagucaaggcagccaagaccugcaguggcuagucacugcacaucugcagucaagugcagagagaugcaugugugcaugcuaguguucagcuagcuuuccucacucuuaguacagggcucaaaaggagcaaacagcaaacucccgcuuucagagaagaccuucccacaacagcgaucauaaucaagauacuccuacagacaggggcacagccaacaggcccuaugcggcuccacuuugaggcucuguuuucaggcuacauuguacaagguugacaaugaaagugacuacuuucucuuguguucuuucuuuuucugucugucugucugccugccugccugccugccugccugccuuuucucucucuccucuccccucccccuccccccaccucuuucuugauucguugcauuuggguguugccugcauguaugucuguguaccacgugcaugccuggugcccugugaggcuggaauuggguaucagaucccguaggauagguuugugagcagagcaaccaugugggugcugggaauugagccugagucacuugggagagcagccaguguucuuaacugcugagccaucucuccagcccugauuacaauuuuuuauggccucuuauuucuccauugcauguaucugucacaaauguuuaauuuuuuuauucuucagccagguggugguguaugucuuuaauccuagcaccagggagacagaggcagguggauuauuauuaauuccuaggucagcauggucuacauagcaaguuccagacuguucaaggcuguguauagugagucccagucucucucuuuuucuaaagacuuacuuacuauauaugcagcauucugucugcauauaugucugcaggccagaagaggacaccagaucucauuauagaugguuaugagccaccaugugguuauugagaauugaacucaggaccucuggaagagcagcuagugcacuuaaccuccgagccaacucucuagcccaggucccagucucaaagaacuaaaaagauaaaauuaauuuaacuuugagaauuucauaauacauaaaauaaaaugacuuuaucuauccaguauuucucucugacucuacccauaucuacugcaucaugcucuugucccaauugcaucucauuugagaccuaugcuggccuugaacuuguaaagaugacuguaaacaccugugaacacuuucuaggugcugggguuguauguauaugccauuuagccugguuuuuguuuguuuguuuguuucucagaauacagggucuugguaucacauuuucuuuaucuguucauccguugauggucaucuaggcuggcuccauuuucuggccauuggacuuauugcggugauaagcacccaugaguaggugucucuguggucccuugaguuuuuguccaggagagguagagcugggccauaugguagcccuguguagaaaagucuccaaacugacuuacauagugguuucaccaguguacuguccacaagcagugaguaagggcuccucuuuccacacguccuugccagcacuugucaguuauuuucuuagugauggccuggguugagaugaaaucucagaguaguuucccugauagcuaaagagacagaaaacauuuuaaaauauuugcuggccauuuguauuucuuuaguugagaacugucuguucaguucaugagccuauuuauuaauuggaugauuuuuuuccuuaaacuuuugaauucuucccaaauccucauucuugcugauagaaggcaagaagaaaggaaggaaggcuaugaaagggaagcuaucauuucaccaccagaaguagcuaugauuaaaacaaaacaaaacaaaccaaaccaaccuggguguggugguuuuaaugagcauggcccccauagacuuauauguuugaaugcuuggucuccaguuaguggaacuguuugggaaggauuaagagguguggccuuguuggaggagaugugucauugaggugugugugugaaaaacuuucagaucuuucuuugacaccgugccugacuaccugccaccaugauuaccacaaaguaacucucuaaaacuagucaagccccccauuagaugcuuucucucgugaguugauuuggucaggguguacuuucacagcagcagaacagucgcuaagacacugggcuugguguccugcgccucucugagagcuugcuuggcggcuuuaguggaggagcacagacacucauccacucuugauggaagguagaagggaaucuccuucaaccaagugugcagcuucuggaugugugugaaacacugggggaggguagggaugccugccgccccagauggaucagcugagaucagaugucagagccagcuugcccucauauccucacuuccugcgaggccucacgacccgagguugaucccugagaccuacaugauagaaggcgaaaaccaacuccugaaggguggccuuaccuccacaugcaugcugugacacgugcugugacacaugugcccaccccuacccuaauaaauuacacuuggaaaaaaagaaaaaccaacugaaccuaaauauaaagauuuuuuuuccuccucugaaaacaaaacaacuccaaacaaaacaacaaagugugugguaucuagaggaagaggaggauuacacuacugcugcguaugaaaaaauaaaauaguggggcuggagagauagcucagugguuaggggcacuggcugcucuugaaaaggacuugggcuugguguuccuaacacuuacuugucauggucucuuacaaacauauguaacucuacuuccaggggauccacugcccucuuguggucuccacgggcacugcaugcauguuuugcaggcacacauacagacaaaaacacucauacacauuaaguagagaaagaauaauugccaugaggaaaaauauuuucuuguucuucauguagggcauuuucuauugacaaauuugcuguuggacaagcugaaggccucggccccaucacgcaucaucaaucucucgucccuggcucacguugcugggcacauagacuucgaggacuugaacuggcagaugaaaaaguaugacaccaaggcagccuacugccagagcaaguuggcuguuguccucuucaccaaggagcugagccaccggcugcaagguguguagauggugaucuuuucugaucuucuuccuucuucacugugucuaggauaguucuauagcccugagcuggugaugaagaggcaaguaguagcuuuaaacaauguagucaaacggauggcaccuguaccaccauguccccuuccagugcuagagacagacaucacuaauaaaucgugguucuaaugauugcucuuuaguuucaaucagccugccuucaucagacaugcugaucuugcuuuucuuggauagacuucuaagccucuggugcugaaaaucugugguuggggacggggagugguuuugguccauaagggacaugugugagugcuugcagacaugugugucacaacugggucagugugagguugcucccagcauuaguggguugaauucaggcauccuccuagaugguuccccccgccccccccaauucuuuccagucucagggauuaaaaaaguuucccccugacuucuugcuucucaagaguugucugugaccagcaaacagugccaggcacccuugggggauagucacaauuauaauauuuuaaacuccaguccucugcuggaguccagaaaugugggucuauuaggccuucaggggaagccacacgacagagccaccuugucaggggaagccacuggaaacugagguuucaaagcauggaggauaauaugggcuccagcgugggaggcagcacaggcuggggaagaccccggguggaguggggccaccuagucuuuuuucacuagucuuugugagugccuguuugcaagugugugugagcaugugcacaugugugugggguguguggguguaagucaggggacaguguugggugucauccacuuggcuuuucauuugaaaaacaacugaacuauccccccagcgcucaccaccgauguuucuauuuuucucaggcucuggugugacggucaaugcacugcacccugguguggccaggacagagcuggggcgacauacgggcaugcacaacucugccuucucuggcuucaugcuuggugagucccuuccagcuuggugucccucacagagcccucucccugugcccucucuccugggggauccgagacuuuugcucagagccugucacuuuauuuuuuuugauuauuuuucugacuggguuucacuauauauaucugacuggcuuagaacuuguuauguaggucaggcuggccuugaacucacagagaucuguuuuccucugucuccugaguguugggauuaaauaaauugccaucauguuuggcaguuuuguuuuucucaacauggucucaucgagacuagacuggucuugaacuucugaucuucccaccuccugagugcuaggguuacaggugugugccaccacaccuggcugcuggcuuuaccucucucaugucuuccuuggguagcagaugggucauuguucuaugugguucuggcuucagaucagccaaaaaaugagcuagagccccauugaugaauaagaaaacuaucuuggaggauauaucuugacuccuggagucaggcuguguacugaguaacccuggcuucacucaaaacuaagugacucaggaaaauguaccuuccagucuuuuuuuaaaaaagauuuauuuauuuauuuauuuaauguauauauaugaguacacuauagcuguacugaugguugugagccaucaugugguugcugggaauuugaacucaggaccucugcucgcuccggccuaaagauuuauuuauuauuauaucuaaguacacuguagcuaucuucagacgcacuagaaaagggcgucagaucucauuacggaugguugugagccaccguguggugacugggauuugaacucaggaccuucggaagagcaucagugcucuuaaccacugagccaucucuucagcccacaccuccuaguuuuaauagccucuuacuguauagaccagauuuugauccuccugccucuacuuccugagugcuaggaucacggacaugccucgccaugcuuguugcauugaguauuagugucagguccaugaugggucuacccucacagucacugggaaaaucagccgaguaugcccauaaauugcucugcacagugucuggccaagacucuagucugacccacagccaaacauuagguggagagagcuucaguugaaaagcgucaugggaucacuucucuugaagcuugggaaucccagagaagagggggagaaagaguuguaggagccagcaggauugagaguaccaggagaacacggcccacagaaucaacuaaguagggcucauucacagagacugaagcagcuaucaccaagccugcacaggucugugcuagguccucuguguaugcuaugguugugcagcucauguggaauugugccuagucuuagugugucuuguuaugcuguguucgguugauauuccugggaggcccgcucuuuccugaagggaaauagaggaggaguggaucugagggagagggaaagcaggaaggcaaacugggagagugaagggaggagaggcugcgguugggaucaacggugugagagaagaaguacaagaauguagucugagucaacagagcacuguggcaggcauucauaaugcccgagucacuuagugggcauguauuaagaauuuuagcgugagaagaccacagaaucgagggcuggagaugucgcucaguuggcgaacugcuuggcuaucuuucuggagcccugggguugaucuccagcaccacauaaaaucaaacacugggauuugccucccagcacucugcacauagaggcagagggaaggaauuuaaguucaucuuuggcuguauagggaguugaggucagggccaaccuggacuacacaugcccugccugagacacaugcccugccugagacacaugcccugccugagacacaugcccugccugagacacaugcccugccugagacacaugccccugccugagacacaugcccugccugagacacaugcccugccugagacacaugcccugccugagacacaugcccugccugagacacaugcccugccugagacacaugcccugccugagacacaugcccugccugagacacaugcccugccugagacacaugcucugccugagacacaugcccugccugagacacaugcucugccugagacacaugcccugccugagacacaugcccugccugagacacaugcccugccugagacacaugcccugccugagacacaugcccugccugagacacaugcccugccugagacacaugcucugccugagacacaugcccugccugagaggaaaagauuauuucuaggaacaauacauagaauagaggaaaaugugcuuucauuuuucugggaacacucagggaggcuuccuauaggaggccgcuuuuggauucaucucuccuuuuggaggaauuugugggguguugccugggacgggccauuuagguagagagaacugcagacacaaaggccuggagguagguucccugggacuucagggcagcuuccagccuccaaggcuggguuuuggguucccugaggguggagcaggggauuuuuauuuuugacuguucugugguugauuguagggcccuucuucuggcugcuguucaagaguccccagcuggcggcccagcccagcacauaucuggccguggcagaagaacuggagaauguuucggggaaguacuuugauggacucagagagaaggcuccaucuccugaggcugaagaugaggaaguagcccgcagacuuuggacggaaagugcccguuuggugggcuuggccauggcucauggauccccugggagaggacaugccauucccagauaaccuucagagacccagauggagcuguguuaccaagacugcugcuggccaugcucucaucauccucuaggggcaguauugguacuauuagaaucucaagacuguggauguuggcugccauguccucaucauccuuuagggacaguguugcacuguuagaacucaagucuguggaugcuggcugcuaugcccucaucauccucuagguggcaauguuaguucuagcauuuaucguuagcuggcuacauugaguuggaccacagguaggcacuggcucaggggauggcagguccauguacucuguugguuacuggggagaugguccaucaggugccuccuuuaggaaucuaaaaggggaggcugauaggggagacagucacucugguuaugggcaguguccaaagacaguggacaccaaagcugcugugguggacugauuggucuacuguuaaagagcaggcauagcuauagauuuuugugggcccuuauauacuccugccuccucucugacuuggcuguuguucuaguuugcuuucuguugcugugauaaacaccaugaccaaaaucaaccuggggagaaaaagggcuuauuuaacucacagguuauaguuuaucauggaagaggcaagccagggcaggaacucaggacaguaacuugaagcagauaccaauggaggugugcucacaggcauaugucagguaccuugcuuuuauuuuuauuauuauuauuauuaucuuuuuuuuuuuuuuuuuuuuuuuuacagagagggucucacuuuguaacccuggccuuccuggaacuugcuauguagacuaggcuggccuugaacucacagagaucugccaugccuggaauuaaaggcauguauuacuaugccugucccagguaccugugcaggccuaccuguccaaggauggcaccauccacagugggcgucuaccuccuacaucagcuagcaaucaagaaaaugcuccacagacaaucccucaggacagucuggucuaagcagcucuucacaugagggucucucucugucuuuuacgaaugucagguugacaaccaaaugaaccagacagcucuugauugcaaacugcaaagggucacugcucccuuaaggauggugugggucugaagcucucgccagacucagaaagggcagccguggacaccuugugugcuggacaguggcugugauccaguggaaacccuggcagacccugucuugguuagccccgaagugcucaggacagagugggaugaaaagcugcuagcugcugccacagaaaaccagcgugaccuaggaucaggaucucuccaauuccuguguaauuuuaacuguagacucuuaagcuuguuguuugauuacaguaacauguuagggguaguggcacauaucgguaacuccagcacuuaagagggagaggcaggaggaucaagaguucaaggccauccucugccagcuugggcuauacaagauccuguuaaagcaaagcaaaacagugaaaucucuaaacagcugauucauagauuuaaaauaaaaauguuuauuuagagugugaguguauauguacauguaugugcacaugcccuuguaugugcauucaugauggaggucagaggacaaccugugggaaucuggucccuccuugugaguuccugaggauccaacucaguuaggcuugguagcgagggccuucaccucugacccauaguggcagcucugagucauagguuuuaguuuauccuucuauauggacuaugugguucaggcuaaacuugaacucccagucuccuugucuugagccucugggguccagagauuacaggucggccacacccuguguuuacaaucaauguuaacauucaaauaaauggaaauaagcauuucugucacuaauuugucauuguccuuuuguuugagguuugucuugcugggacagcauuucugacagaagcaacuuaaggcagggaaguuuuagucuggcuggccguuccaggguucagcgcaucauggcuguguguggauggaacuugcauggaaccaguucucuucugccaccgugacauggguucuggggauuggacucagguuguccggcuuuuguggcaaccucagaagccucugcuuuuuauucagucuuggucuccagcccauggugguggcucuccuuaugcucacugugugaaucuucacauugcaaugaacucaaccccgaaacuuucucugucacgaccagacuuuuaucccuuaggugacacuagauacugucaaguugacaauauuaaccagcacagggugucuucucugggagaugaaggucaucuaaaggguuaaaagucuaaauccauguggagcccaggcuuccaggggggcuggucauggagcuaacacuggugcugggggauuucuuucuugcagauggauguggcugcuucugaccacagacccucaugaacacuaucuacuuccuuuucaaaaccaagagacaucgaggaccauaaucucaaggucccagauggcuugaagucagcaguacccuaagaaauaggaaaguugacaagauguauuugaaaaaccaguacaggggguuagaaagauggcuaauuugaugucucagaugauuaaaccaggcccagugucucauucuuucuguuuccugucagucucaauauagaacucucagcuccuccagcaccaaaucugccuguguguugccaugcuucccacugugacaauaguagacuaaacuucucaacuguaagccagcuccaguuaaauguuuccuuauga

SEQ ID NO: 3518 - RNA, 7865 nt, Mus musculus
cucuaagcuauugaguauuuuauuuggccccaagagcagcauaggagucaagcugugugggaagagguaagagacugggaaaaaggaaaucagaggcuucacagcugauugucaaagcagaggguaggacccuggggcaggggauaccagacuuucccggcucucccaccuccccgcaggcucacugugguuucuggguauaggagugguauuggauggaacuuggaaacauuuccaauguggaaguaggaaugaaugcaauguuuggggagcagggagagggauaagggucuaggagcaagggaucuggggucaggugcuugcuugauggaaaucagggugcugguauuggccuggcucugucagggggccgcagagagugccacugggcaauggggcgccugggguuggccaacaugucagcccagugccgcaggccagccccaccgacugcugcgcccaccgccacucucccgauggccucauucuuccccaguuugucauaauccagaacagucagcuccaccuggacuuucuguagggucagagagaaagggggacuaggaaggaggcaugaagaggggcgcgggggucauugucuccccgugaccaggcuauguagagacacugcugcaggaguuuggggcagagaggcauggcagugggaaaggacaaaaagguacccaggagcuuuuauuccuuugaaaggaaagacuuccuuccuuuccuuuuguuuuagaaagagucucacuaugcuaugcaguggucuggcgugguacuuguuguauagaacagucuggcuuuaaacucauaaaguucccaugccucuaccuaaagagugcugggauuaaaggugugcaccacaacaccuuguuuaaaacaaaccucuagagugguaaauucacaggauucguuguccagagguuaagagaucagggcucggaagaggggcaaacauucaagucuuugccauaggugccacggccaagccauaaccuggccagcucugucucuaacgaucacauaaaggcuuuuuuucuauuggaaauggaaugucugggccuguuggggacaaggcuugcuggggacaggcauucuguccacacuuacaagucuugcuuaaggggagaucaugcccacagccaggcugggccuccuggucuccaauggaggaaauggagauggacaaucagaccucagaccuuaggaucuggcuucuucaauguaaccaggcuucuuucccuuugccacuguuacccuugggggcuccugugguggaaccauucugguagaaacgggggcauggcugcacucaccugcaccuggucacagggcaccucaaagcugaaggccucguuguaauagggguucaggguguucuucuuaauggugguuuucuucuugcgaaccuuuuuaccucccuggagcaggugcaccuucacauagggaucuggggaaagaaggccuccuugaacaccccacugccgggcucaugggggucagguggugugaaagcaaugaggccucuccuuuggaccuccugagaauaacccccauucaccucucagaucccuccuuuccggaugaaaccaggucuguaucagguucugcuauccccuaagagaccccccaggucaagaaccuuaggcaaaaaagcacacucccuguucugaauagcguuuguuuuuguucuuguuuguuuaaagauagaucuauugguuacguauacagcauucugcuugcauguaugccuacaggccagaagagggcacccgaucucauuauagaugguuauuagccacuaugugguuugcugggaauugaacucagaaccucuagaacagccagugcucuuaaccucugagccaucucuccaucccuagggcauuuucuuaacuagggauuaauguuggagaaccagaucaccguggguggugucauuccuggauaaaugguccuugcugguauaagcaggcugagaaagccauggacacacacacacacacacacacacacacacacacacacacaaacacccuuacauaauuuuuuuucucacacaccugagaguccuccuacauccauuuucuucagguuuuuagcuuccaagacaaugacggugagcuucccggccguggggacauaacggagagagaagcagaugucccccaguuucucuugcuaaaaggagaaauagaacuuaucacuuaagucgggcugcugccccuagcccacaggcuuugaaaugggaugcuccagagucaagcuccagggacgcccucuggcaucugugcaaaaacaaaacaaaacaaaaacaaaaacaaacaaacaaaacccccaacggguugggggcggggcuugcagacguugguaaagucugugaucugauugguccagaguagggaugggcggggccgcaauacucaccuccucuuugggagccaccugcagcucucuccaggccugcaccggccgccccagguucacugaacucauaggcacccgcaccuccccgauggcaucguugcgggagaaccgaucaaagucauacaccgccaugaccagcacucugcccccuaguuccacguaugggaccuggugaaagggaauacgaaggggcggguaggaaaucagagaggaaguggagggcagcauauucagguggaaguagaguggggcagugagguuccagugaccucaguaaaguacagggauccacagaaggaaaccaacgugugaacagaacacaaauaguaauauacaacgaccaaggcaauugacugacagugcucucagggauaacucuaggucccaaugaacagcuucccaaacccucuacaagcuggcaucugcgaccugagccgugucuucuuccaggaaaagcugaagaggucaguccuuggcaauccagggcuagauguaggccaaggaccacagggccaagacaacagaaacuuaccuugaaggcaaaugucucuccaaaguguggauucagggucugccgaugcaccuuggucucaugucgccuccgcuugucuggcagcagauagacacuaacauagggaucugaggaaccuccuagguccaacgcagccagucccugagcuugcaagaugcccaccaggagcugcagguguccaggaacagcaugaggacacuagucucagccuuccucccagggguccacucagaagggaggacuggaguaccugagacugucucccuccaaagcauucacccuccuucacacccaccuggccagucuggaagucauaguccagugaauacugcagucggccuagcugguguuugucugauaccugcuguccaggcauggauggugaccgguccagcuccucuauuucaggcugaaccuagaaaaccagggacaagccaguggaauuguccccugaaacgaguacccuccaggcucagaagccucaggaggcucacagaucccucccucaagccaucaaugauuguuugucuaaacacuuguuugauuaguaaugucuggaauaagacaugguagcauaaagucaacauauaugucagcauuugauuagugaugucugcuauggacagggaauagacauagugagacacaguucugggacuguuuauuccuccacauccuaaugaauguauugggauaacaguacaaauuaccaccauugauacugucacaggaaaaugugcaggagaaaugguauauuuaccaugugcuuggcacuuagcacauaaguguuauuuugaaccuaggccaucaauucuaaagucuaguguaaaucuaauccaccagagaugaggggcaaaauaccaaggucaccucauuaggcguucugauucacuaggucugugugacaucacauccagaauuuacauuucgacaaagauggaguuaauucugacacaggauggcuuaaauaauaggaauggaagcuggguuccgggaccccaaagggaauccuuauagguaauaauaugcuccuuguugagcaaggaggggaagcauguguuaauuaccaggagcuugaggcucagagaacaaagguguagguaguuccaaaagaugaaaaaaugguccuuaggguuggaaaccccaaacugccuggccugcauucuacucugcacucagaggccuaauauucuaccaaagccuuuuauuaucaaucauuaucauugcuauuguuauuauuguuguuggugguggugguuuuucaugacaggguuucuuugugcagcucugguuguccuggaacucucucucuguagaccaggcuagcuucaaacucagagauccaccgccucugccucacuagugcugggauuaaaggugugugccuccaccgccuagcugucuuuuuuuuuuaaaaaaaaaaaaaagcguuuuuuuaagauuuguuuuaucuuauuuauuuuugcucguuuuauuuauuuauuuuacgugaguacucugcugcauguacaccugcaugccagaagagggcaucagaucccuuuauagaugguugugagccaucaggugguugcagggaacugaacucaggaccucaggaagagcagccagugcucucuacgagccaucucacagccuugucuuuuauuauuuuacuacuuauuuuuauaucuuaaauuauguguaagugugugucuucauauggucaugugcaugggguccagaggcacugggugcccugaagcuggaguuacagguggcucugagucaccccuaccuggguucuggggacagaacucaguccuacagaagaggaacaaguguaacaagugcgcucaagcacugguagaucucccuagucuuugauuuuugaagaguccaucuaaguccuugcccauucucucucucucucucucucucucucucucucucucucucucucucucucucucucucuccccccccccccguguguauguguguguguccauucauccacauauaugacauuuaugcuggaauaaauucuccuaaauauuuaggguaguguagcuguaguaggacucuguguguguguguguguguguguguguguguguguguugagauguaauguauaccuaugcauguugguauacacaaucuauuccuguguauguggaagcuugaggucgacauugggugucuuucucuaucacucuccaccuuauuuuuugagacaagaucugaauguagaauuuaccacuucugcuuacagagauaugccugucucuacccccaccccagcacuaacuguaggagcuauagacauguacagagccagguucucagcccugaucuuugguuugguuugguuuuaauugaggcaaagucucacuuuguagcccagcuuggcuaugcaggcacuauauagcucuggcugaccuugaacucagagcaaucccacagucuaggcugggauuauacauauacaucaucaaauccagcucaggcaagagaguucuuguggauaguugcuagcucugaucccgaguccaguggauaaagugggauuaagaagugaaggggcaaaaagaaaaaaaaaaaaacaacaacaacaacaaaaacccgggcggugguggcgcaugccuuuaauccuagcacgugggaggcagaggccugaguucaaggccagcuuggucuacagaguaagcuccaggacagccagaauuauacagagaaacccuuucuggaaaaaaccaaaaaaaaaaaaaaaaaaaaaaaagugaaggggccaaggacagaagauaguagcuaggacauucaaaggugcagggguguacaaagggaaggauugagaggcucagcugugucacaccuuaucuauguaacuccggcccagcuccuucacuuccugaagauggacuugggcuugggccugacucuuuuugcccauccgucuccgacagcgcuuccgguagagacagaaacaacugcugaagaccaggaggcccgagcccagcacgaugguagccaggacccaggcaggcacugcagaaggacgaacaugacaugauucgaagcacugggaagguggcuggcuaacucacgcuugauuccauccagcaguuugauucuagccugguuuucccuacacccaacuccauuauauuuuaaucccaauuuuccuucuaaccaaucucaccuauaaagcucaauuuaugcccuaacccaagccgacauuuguuuucuuauaauucugaugucucuacacccauuuuaauuucugcucgcucccuacugcuuuuagcuuucacuccugggccuguucacauucauccacuucugauuccauuccaugccacacccgugaucugguuugccucacuauuucagagucuacucgucugggauaccgacccacgauuccugcgggauuuuccagccuacccacccgagucuuugcuacugagacccuucucuggggaucuugagaggcuguccacuagggcuagcccagggucuucucaccugcgcccugccugaugcggcuggagucuggaggugucuuaggcgcuggagaccccagggucggggguuccgggaacauggcgucgggguccugcggugcuuccugcagagguacccaaauacucuauccccaccccaccccacuccuacccaaagcauccagugaguuuucucacgcaucaaagaaccuuaaauuccauugauuuuuggugcacacuaggaguuaaucucagccucuucacgccaguggcaggcuuugggggacccaauuccaucacaaagggauacuuccucuguaugccaccccaucccauucucuucccaauccauucucuucuaccccuuccuugcucuucccaagggcuugaaccggaagugggcgcaggcaggcgugggaaccagcagaccacuguugcccugagcgaccgccaggcuccaggcagggugauagcagugcugguugcugggcaacgagccuguugccaaggcaacgggagggacugacgcacagaaacgaaguccgggcggugccgguccaugggacccagguccgggaucccguggcacagcgagagcggccugugaucugugcaucuacaguggcuccucccaucgcaugggaccccuugcaccaccacucuuucugguaaaguggagaaccugccccggcaccucugcugggccuucacauccucuugcucaugagucucuugagcgcaccccgacucugucuucacaccuguucucgugaccggcucggcccccacuucuuucucgaccccagauaggcaucuucccucuucugucccccacaaccuucucucgucagcgccucuacugcccucuguugucuagccucucucucucagucucucuuugcuuuuuuuugacuaccaaccugcucccuuuguuuccacaccugucucuccucuccacauagcaauuuccuugguuagggcuucaaccugccgcucaaaguugaaccuugucgacgacccuccuccaccccucucacacgccagaccccccacgaaugggaccgaggauguggcuuggacagagggucccaacagcuccuaccugcuaggugucucgacaggacccuucuggagguguugugggcugcugggaccccgcccccagcacguggguggauggcgcuuucccuugugugcugaucacacaguuuggcagggugggggcgcggcugagccuagccaggcuaaugucugcgccccugugugagaucgcgcgcgcgcgcgcgcguguauuugugcauaugugugcgugcguguucugccccggagaagagagaacgcccugcuccgccccucggcccgccacacccgagaaccaccauggcgcccacguacguugaucuuaguacccuagaaug

SEQ ID NO: 3519 - RNA, 857 nt, Mus musculus
caugcccaaaaggaggaaggccaaggggaagaagguggccccggcccccgccgucguuaagaagcaggaggccaagaagguggucaacccucuguuugagaagaggcccaagaacucagcauuggacaggacauccagcccaaaagagaucgaacacgcuucgucaaauggccccacuacaucagguuguagcggcaaagagccauccucuauaaguggcucaaagucccuccugccauuaaccaggucacccaggcgcuggacaggcagacagcuacucagcugcuuaagcuugcccacaagcacaggccagagaagaagcaaaggcuacuggccugugcugagaagaaagcugcuggcaaaggcgacgucccaacuaagagaccgccuguccuccgagcaggagucaauacagucaccaccuugguggagaacaagaaggcucagcugguggugacugcccaugacauagaccccauugagcuggugguuuuccugccugcccugugucgaaagauggggguguaugcccuacugcaucaucaagggaaaggccaggcuggggcaccugguccacaggaagacaugcaccacuguugccuucacacagguuaacucggaagacaaaggugcucuggcgaagcuggugggagcuauuaggaccaauuauaaugacagauaugacgagauccgucgccacaggggaggcaacguccuggguccuaagucuguggcucgcauugccaagcuggaaaaggcaaaggcuaaagaacucgccacuacacuggguuaaaugcacacuaaguuuucuguacauaaauauaacuacaaaauuuaaaaaaaaaaagaaagaaaag

SEQ ID NO: 3520 - RNA, 25072 nt, Mus musculus
gggggccagcccagcccccuggggacccccggagaaguggggagcaaccgggggggccgggacggaggugucgccggcccccaccggaggaacggggcgacgggccgcagggggggcggccgggggaccggucgggccgggaccaagggcaccaugucguccggguccaaggaagguggcgggggcucccccgccuaccaccucccacacccacacccacacccaccccagcacgcccaauaugugggccccuaucgccuggagaagacgcugggcaaaggacagacaggugagaaccuaagcggacaccuggggcgggggcggggugcuggaaggggcagagggcgggaccauggauauuuaaagggcagaccccugggucccucguagaaaaggggcuuggguccugaguuccaagugcccacgguguacggaguagagucugacguuggggccuugagauggcaggggucugagacuuguggguuccagggagaaguaggggucuggacuacuguggcucaaauaacccuauuggggcagauauuggaggggcuucaggaagcuguggggaaguaggcccauuacgggugugggaccugggcugauucugcaagcugaggcaggcgggugcugcaguacagccgcaggcaggguggaggugcaggcuggguggaggugcauccaucccgagagaggcugcuauccugucccucuuaugcucaaaagcggucacuugcgcuccgugcagcaagcuggagcccuagggugugaggucgacuacauucucuccauucugcaguguggaaauagaauggagagguggacuguagaaagcuaagcucccagccagaaguggcccuggaaagcagaguuaucuuugauugaugcuaaaggcugaguguggccacaaccaucuucuucuaggcaggggaucgaggugaacugagggaugaccuccaguguucugggcuguggguucugggucccuaugaaguugaguuccaggccugagauaggaaagggaggucagaccuuuauauccugguaguaagagugugacgugcuguugaccucaauucuugaacuuuggaaggagaaggggccauguaccugcacugcugggccugagggacgagggcuggggccaagacuacugggucuaaggacggagggguaagaucuggguuccugggacugagaagaggcaccuuccauagcugagcucuggaucugaggaguggucagggaauacgcaugcuuucugaccaugacagcuuuuuuuuuuuuuuuuuuuuuuuugguuuuucgagacaggguuucucuguguagccuuggcugucuuggaacucacuuuguauggggaggcuugggaaagaagaaaaauugagaguguguuuuguaagauuauagggcuucugaaaucugaaaagaaagaugaaguugggcagacauaccagaaggccagagagucagaauaaaaggccaggagaggcugguggaggggaucggcaaagggcagacagucagaaggacuaaaagugggcaacgugcauaggaaagaguuguguuuuguaggcauggcagcuguuggcuaccaguucaaaugcagaaauucgggauagaagaaauggguaaccaagcugggagugaggauggggguguguugacaacuugagagcuagggugaacuccagaacaccccauauuuuaaauccgaucuccaggucuaguuaaacuuggaguccacugcaucacgggucagaaggucgcugucaagaucgugaacagggagaagcugucggaaucggugcugaugaagguggguguuuguguguguguguguguguguguguguguguguguguguguguguagcgagaguguccuuuggcgcagaaggaaaggcgggaggugaugcugacccuuucucuuguaucccuggccccucagguggagagggaaaucgccauccugaagcucauugaacacccgcacgugcucaagcuccacgacgucuacgagaacaagaaauauuuguagguauuuauagacacccggccccuccguccucccucuccaugguguagacaccgcuccagaaacaggacacaagcuuccgggcuagcgauguaacucgguugcuagagugcuccuguggaaugcaggaggcccugaguccagcccccagcacugcauaagccuguggcagcccucaaggaucaucccagcucuguuaagcugaggccgcacuguccaaaggucaaggucauccucaagaggucaaggucauccucagcuacacuguuuuuaacuuuuagguuggaucacugaaugcuuaguccuucccuuggguauaggaacauccccccagucuacacucugccugauacuacaacagaguagagugguccugagugcagagcagaagcugugccucuugcugcuaucucucuaccucagccucccgaguaacugagguuaccagccuguaccaccaaauucaacuuccugccucuuucuuccuaaagcaauuaagguuacauuagcuuagaagccuaaaggauccuuccaaauucucacucuaggacaccugaggucucuccuaucccaacaucacuucccaugccaaggcuggccaccccaacaguaggccuccuggaguccugugucaguaucacgaaguccauuaccauccaguuaagaugggggugggaucagcugucugggcuucagagaaugacucuuugugcagacucugguggcccaaagaacagcuggaguggacaacggaagaggggacuggccucacaguuccccuccccaccccccaaccuucccaggguguaagauaaagccacuacuccaauauucaucagacugggggaauagguuuccccaagcuggaagcaaugugcagccccggguccucaugggaguuguaguccuuaggcuucccagguguggaggcaaggagaagccacugucuucacaauugaugguuaccauuccuacuccaccaucaaagcugacagagcucaugagaguuugugcuucacaugggaaucuagcuguccaacagcucaaaaaucgacuuuuucuuuccugggaauugauuggaacuggagguuuaaucuuucagagccugaugggauuugguggucucuagaauccagguggcugaugggaauugggaccaucugugucccagaggcuuaugggaguugggagggguuugguuuuguuuuguuuuguuuuaaacuucuuuacauugaugggaguuuucauuuaucuuugguguauacuguaauugucacugcccaaaagugaaugcgaacuuggauuuguucacaggcuacugaacagauuagaggcuugggcuaugggugggggaaugugcuaauggaaguagggucuuuauuucccagaguucacuggggauuaugguuucugaccucaggugccaaugggguugcauuaucuccaaaaacaaccaagaguuuccuugggaaucaaugccacaugggacuagugggaauugagucgugguuuccuagagacguguggauauuggaaucacuucucuuggaggcuuguggcaacuggaaucucuuucucagggacugcaguugaaauuucuaccuugcagagacuggaauuggggcuucacugucuucagaaaagggguaccaggccucgguccuucacaugucccuuccagcccuccgccccgucugugucuuucagauacuugguucuugagcacguuucugguggugagcuguucgacuaccugguaaaaaaagggagacugacacccaaggaggcccggaaguucuuccgccagaucgugucagcacuggacuucugccauagcuacuccaucuggugaggggacagcugcagcggggugacgacugagggugguggaccaggaggcugguugcugccgccacaugaagggcugagcagaaaccagugugguuagcccucaacccuaaccuuuugaaaauuccugguauuguaacucagaccauacaauuuacccuuuuggaaaaguguacaguuuaguaguuuuaaauacauuuucagccuugugcaugguugcuauguaauuuuggaacuuucuuuuaaguguguguguguguguguguuugugugugugugugugugugugugugugugugugugugugguuuugggcuuuggcgugugcuaggcaagcaaaaccauuugcaauacauccccaacuuuuuuuuucacuuuuucuuuaugugugugagagagaaacuggguuucguaaagcuccucacuauguaagcuaggccgcccgcaaacucauugcuguccuccugccucagccuccuguuuaaucauauuacagcugugcaccacacacgguuuuggcucuguauuuggugguuuguacauuugauuucuuauugaugugugugagagagaguuugcacacgugugcaacagugugcauguagaggucacaugacaacuuuuaggagccuguucugaccacuuaugggcccuagggaucagacugagguccucaggccuggaggcaaguggcuccucccugccacccccacccccagccaucuugccagcacuucugugcugcccaaaccuaagucaaggugacuacauuucuauccaaugguuucuucuagaagcuauacaguuuuuugguuuuugguuuuuuuguuuuguuuuguuuuguugguuuuucgagacaggguuucucuguguagcccuggcuguccuggaacucacuuuguaaccaggcuguccuugaacucagaaauccgcuaccucugccucccaagugcugggauuaaaggugugcaccaccaugcccggcugaagccauacaguuuuaucucuugcauuuaaauuuggggucccuuugaaguuaauaauuguguuugauaugcgguaagaaucacaguucauguuuaugauguuaauaucccaacagauugguacuucuuuuccucagugacccgccuuuaacccagacaagaugugaugcagguagcauuuagggugagggguacaugccugugacccuaguaccuaggagacaggcaggagcuccauugagaguuugacaccagcaagcucuauauaaggaauucuagcccagccagggcuacauagaaagacccucucuuaaaagcaaaaggagauguggcuaaagagauuucucaguggcuagaacauguaaugcagaggauccaaguucaagccccaccacccauaucugaagccucccagcugcuguaaguccagcuccaggauccaagaagaugaaauaccucuggcuucacucacucacacacacgcacgcgcgcgcgcgcgcacacacacacacacacucacacacacauacacacacucaaacacauacacacacucacacacacacacacucacacacucacacacacacacucacacacauacacacacacauacacucucacacacacacucacacacauacacacacucacacucacacacacucacacacauacacacacucacacacacacauacacacacucacacacacaaacacauacacacacucacacacacucacacacacacauacacacucacacacacacacacucacacacauacacacucacacacucauacacacacucacacacacacacacacacacacacgguaaaucuuuuaaaaaagcaacucaacucagauuauuuaaauuaaauucaacacuuuuuuugagcagccagggugucaagcucugagguugaagacuacauugaauaugaccuacucaccgaccacuccgaauagaaucuacagaucuugaggaguuuggucgaggauuagaaagguccugaaccaguugucugcuuuggguggcaagguuuguuuguuuguuuguuuauuuguuccaaaaaaaaaaaaguuucuugaagccuauuguggcuuacaccuguaaucccaccacucaagagggagaaacagguagaucuuuaaaaaguuuuuaaaauuacuugauaugcacuccuaauaauaacaauaaugacaauaguaauaacagcugggcaugguggugcacaugggaggcagaggcagucagaucucucugaguucaaggucauugugguuuacagagugagucccagagacagccgggcuacacagagaaacucuguuuggggcaggggcggggacgggggcggggacuggggagauacuugauauggaauuacuuuuguuuuucuuggagguaguaauaaucucacgguguagcccagguuggccuggaacucauaucaauccuccugccucuauaccucuauacaugagccacuauaccuugccauauuuuuauauuucucuuuuaaaaacaagccauuuauuuauuuacuagggaaggggugcagauuccauaacucacauguugaagucagaagacaacuuuuggguucucccuuuguguggcuucuagagaucaaacucaggccaucauucucaauggcccagcuuuuauauuucuuuuguuuguuuguuuguuuuguuuuguuuuuuguuuuucgagacaggguuucucuguguagcccuggcuguccuggaacucacauuguagaccaggcuggccucgaacucagaaauccgccugccucugccucccaagugcugggauuaaaggcgugugccaccacacccggcagagcuuuuauauuucugauaacugguucaggguggaugugauggcacauaccucuagagacagaugcagguagaucucuaugaguucagggacagccaggucuuauacauugaguucuaggacagcccaaggcaccauaaaaagacccucucuuaauaaauaaauaaguaaauuuuaagcugaggcuguagagauggcucagagguugugagcacuagcugcucuuuaagaagaccuggauccaguuuccugcaccuauaugguagcucacaaucacaacuccauuuccaggguauccaacauccuucuccgaccucuucaggcaccaggcauccagcauucucuuuuggccuccaaagucaccacacuuacauaguacauagacauauauucagguaaacacucagacgcagaaaauaaaauuucaaaaugaauuaaaaaauaaaauucccugccaggcagugguggcauacgcauuuaauuccagcacccuggaggcagaggacagcgagggcaggcagagaaaaccugccaugaaaugcaagcaaacaaaaaagcacaguagagaggaagacucuagcugucaacguuuugccuccccaggcuucccauacaugugcacaugcacauacacaaaaaggcaugagaaucaggcccggugguauaugccuguaaucucacugccugcaggaguaaggcagaaggacugauucaaauuagaaaucaauuugagccaagaccuaccuuguagcaugacucuguuacacacacacucacacacacacacacacacacacacacaagaaagucaggcuuaaugggacauauuuguacucccacaacauaggagggagguagaggcaaaaagaccaggauuucaaggcuauccucgacuacauaauugcugugaggcuagccugcgcuacaugaugccucuguccuuaaaaaauauuagaaguaucucacuuuaagagagacugaaugagugaggaugggccucccuacagcauccaaagcugagccccgccugucugucuuagucacagagacuugaagccagagaaccugcuguuggaugagaaaaacaacauccgcaucgcagacuuugguauggcgucccugcaagugggggacagccuccuggagaccagcugcgggugaguggggaucccuccacggguuccugggaagggaaagaagccggccggccggggcucauagccucugaucgccgucucucuaucuuucucuuucuccagguccccccauuacgcauguccagaggugaucaaggugagcugaagagcaaggggagguuaggggaguggacagagucgggacagaaaugccauugaagugacaccuuuugccucuucagggggaaaaguaugauggccgccgggcagacauguggagcuguggagucauccuauuugcccugcuugugguaaggugccuuuugcugcuaccacuguguuucuagaacagugucccccuguggaggauagaacuuuacacgcguucucacuccuggcuguguguguguguuucucuugaauauuuguaugugugugugacugcguggagugaaugugauuucuugaauauauguagguguuuaugagagaaaggaaucuugaauauauauguguguguaugauugaaugacugucucacaucacacggguguauauucgugugucugguauaugugugugauaucucauuuauguguaugugugaucccauaaauguaaacguguauguguggcuaugugugugugaucucccacauguguguguggguuuuuuauagagagcagugguucacaaccuucuuaaugaugcaaccuuuuauuuaacacagcuccucauguccuggugaccccuaaccauaaaauuauuuucauugcuacuucuuaacugucauuuugcugcuguuaugaauuguaaugucaauguguguguuuucugauggucuuaggcagcgccuacggauaggccaagggugucgugcacagguugagaagcacugacuccgagaggcacaggcaguguagcaugucucccagccuagccuuagauaggcaaaggcggcuugaacuccugaggcuccugccuuuaccucccaagcguuuagaucacagguguuggucgcacuugguuugggcaguguuagcgccugaaccccagagcuuugugugcgaggccuagaacgugccuccauccuugcucguucugugguucaccuagugaauaucaacacccacguaaacccucagcccauggucauuucucccacacacuucccagagucucccucuggccucccuugccccuuccccagguuggaucuugccauaaguguccuucuuccugcccauggucuggguucucaguaugcauuuuguugcauaauucuaaaagccucauuuuccccccaugucuaucauaagccccuugaggcuggggcucaugacaguggcuuucaucuuuguucauuuaguugacucaucucugaagacgcaggguuggucugucuuaaacucccuaaugcagagugaacuaauaacucacuuaaagcaagcuuucuucuuucuuucuuucuuuuucuuuuucuuuucuuuuuuuuuuuuuuuuuuuagcuuuuuaagacaggguuucucuguguagcccuggcuguccuggacucccuuuauagaccaggcuggccucgaacucccagagauccaccugucucugcuuucugagugcugagauuaaagguaugcaccaccauguccagcagcaagcuuucuucucagcauuucuuuuucuuucuuuuuucuuuuuuuuuuuuuuuucauuuuucgagacagguuucucuguguagcccuggcuguccuggaacucacucuguagaccaggcuggccucaaauucagaaauccacuugccccugccucccgagugcugggauuaaaggcuugugccaccacgcccggcucucagcauuucuuuuuaagguuuuuuuauuugugugugugugugugugugugugagagagagagagagagagagagagagagagagagagagaacaugagugucuguggaagcuaaaagagggugucagauccccugaagcuggaguuagagggaguuauaagccuccuuguguaggugcuggaaacugaacuuggguccccuggaaaagcacucaguguucuuaaccacugagccaucucuccagcccccugagcauguuuguuucuuuuuaagauuuuuuuccuguguaugaguguuuugccugcauguaucugugaacugugugcuugccuggugccugcgggugcaagaaaaggugucugaaugcccugcauccggaaucgugggcaguuaugaggacagcauguggauucugcggagcaagcccagaucccugcgagagagagcagcaaggacugagagcacuuagagcugaugaguaaccauuucuccagacccaauuugguuuugggggguuuggguuuuuuuuuuuuuuuuugugguuuuuggguuuuuuugcuugaugaucgguugguuugucuuugguuuugagccaggguuucucuguauagcccuggguauccuggaacucauucuguagaccuggcuggucuugaccucagauuuccccugccucugucucccgaaugcugggauuaaagauaccaugcuggaaguugaacccagggcuucguguaugcuaggcaagcucucuacccacuggguuagaucuccagagccaacgcucagcuuucugucaucaguagggaaaggauagaguucaaaucucugcuuccucaugcuggacaaguaaaucgcucccuuuguguaggccucaauccuccuaaucaaguaauuauaugugaaccgaauaauuacauguggauaauuacaguaccaacaauugugaagguuuaaauuaaauacaagaucccagguuccccuccaguacugcaaacagauaagcaacaaaaaacacaguacagccgggcagugguggugcacaccuuuaaucccagcacuuggaaggcaggggcaggcagauuucuggguucgaggccagccuggucuacaaagugaguuccaggacagccaggguuauacagagaaacccugucucaaaaaacaaaacaaacaaaaaaaaaaaaaaccaucacauuacaaacaacuuagaguaagaacugaccuugaugugucaguuuuuguuguguggcuuuuguuguggccagaggguagaaggaaccuagcugguuucuaacagaagcaagaccucccuauuccaggacucacuaacucacugaucacagugauuauauaaaauuggacuuccgagaguaaugaggaccagcugugcuguggcugauauuuuuaaucugucccauagccuuucccaauagaauccucacaucccuuacacagaggcgauaagcugaggcucacugccagugccaucaggcaccagagccaaaggcaggcugucugacuccaagaccagucagaaggugcccuccccaucuaccuucacccugcauucuguccaugccccuuagauaccagggucaaccguuuaaaacauuugggaaagcccucagacucaucucucccaagagcccuccucuaauuccuuaugucagaccagacccccuucuuacucugucccaauccugaacauuacaucagcccauuccaccuguauuccccacccgacccccguuucuccuuuuauucucuuauucccuuuguuauguuuauuuacguauucauggagggggugugcuggcaagcguauucaaggcaugcuugaggucagaggacagcuagcaggcggcaauccuucccuucaccacaccacgugggucccagggaucagcucugguacagaggcuuggcggcacaugccuggguuacaugucaugucacgggccuauuugagacagguucucauaugucccaggcuggccuugaccucauuauguaacuggagaugagcaucugaucuccuugcuucuccugccucccucccagggcuaggguuccaggacucagguccacgucccguaucugcagugcugagaauucugcacagcuugcugcaugugcuuaguagaaaagcgcucuacugccaacugaaccacagccccagccaguuucucucuuucuuuccuucuuuccuuuuuucgcucucugucucucugucucugucucugucucucucucuuucuuccuuuguuuguuuuuguuugguguuuguuucagacagggccuuuguuuguagaccaggcuggccuccagccaacagagguugccugccaugucuaaccaaguucuaggauuaaaggcgugcacugcugcaccaggcccucuuuauaguuuguuuguuugagacagggucucacugguaaccuuggcuguccuagaacuugcucuguagaccaggcuggccucaaacucauaaaggucaaccugccucugccucccgagugcugagauugaaggugugcacgaagaguuuagagagaggcuuauuuuaguuuugauguauuuuuguuuuguuuuaauguaguuuuguuuguggcagugugucgcaucacccaggcuggccucaaagcucaauauguaaccgaaaaugaccuugaacuucugagccuccggccuccaccucccgagugugggguguaggccugugacaccaguggugcugggggugggacccugggcuuccuggaaguuaggcaagcgccccacuggcugagcuacaucuccagcccuauauagguguggacaguaaguauccaacccaacucucaaucuuuuuuuuuuaaagauuuauuauauguauaugaguacacgguaguuaucuucagacacuccagaagagggcguugggucccauuacagauggaccaugugguugcugggaauugaacucaggaccucucuaaagagcagucucuuaaccacugagccaucucuccagcccaucaccuggacaguguuaagcuccaccuaaggaaggcucgaaaccuuccugacacuguggcccuuuauuccguuccucauguuguggugacucccgaccauaaaguuguuuugguugcuacuucauaacugugauuucacuacucuuacgaaccgugguguaaaugucuguguuuucugaugguguuagacgaccccugugugagggucauuuaaccugucaaaggggccaugacccacagcuugagaaccacugccguaaggaaagagacaacgauguagcucacuugguagauugcuuguccaggacacaugaagccucugguuccaucccccaaacuacaugaacugggccugguggugcaugucuauaacaccaccacccccacccccacccccgccaagagcugccacgccagguugagaaucacugaccugaggcucuugaugaugucuugcacagggggcacugcccuucgaugacgacaaccugcgccagcuacuggagaaggugaaacguggggucuuccacaugccucacuucaucccuccagacugccagagccuccugagagggaugauugaaguggagcccgagaaaaggcucaguguaagcagcgaggggcuggcagaggugaagugguuccagagaguuccuggagggcugccuguaaagccugccauuggaugaguuugcugguuaagccacaagcccaagguccagcaaaaccuaaaacuuagaaucauucccaaguuggaccaaggacccuugagggcggcgcauugagggauuggcggggguugaaaggcuggcacuuggcgugcaguaaacugcuaccuggguuuaaaaauggucaaucugcaggugcuugaccgccaccaggggaagacaugaugucacccugcuucgggaugggucagugaccucccggagccaaugcuaaucaauuuuauguuacugcuugcuagcuauuguaugugaccuaauuucugcuucucugugacccaccccuucacagcuggagcaaauucagaaacauccuugguaucugugaguaggagggaauugaacaguuggguaccugcgggaggagguagggcacccgggucagaauagaaagguggaggguggggugccauauuccugaugggugggaugggauggagggaccuaccgucucaaacuucagaguaugggcagaggaggacaaagcuaaagaaagggaggguguggagucuagagggaggagggcuccggacucuuugagucagaguuugaagaacuagggucuggacacccucagucugaggaagauggggacccagacucuccagauccugggaugaggagucugggcauaggacguaacacuaggaagauaagcguuucucuacuauuccaggggcgggaaacacgaaccagacccuugccuggagccagccccaggccgcagaguagccaugcguagccugccuuccaauggcgagcuggacccugacguucuggaaagcauggcgucucugggcugcuucagagaccgcgagcggcugcacagagaacugcgaagcgaggaguaagagcucccaaaauccuuuucaccggcgccccacuucauugaauggguuguggcaguucccuagaaagccugaagggggcgugccgcauccaguuuuauggaucugacaaacuuuagugcuggugcacgggaauaaucuggaaaugcucagagaaagaaagcauuaaagcugagaugggcgugaauggugucuucauuacguagaacuuaauaagugcuuaaguugugacgaacacugaacauaggaagccaacuauguuggcuugugggaaaaaauggcauuuuggguccaaaaaagagaaauaagaccugaacaccugugucugagggaggaaggcuaggggcuuucacuugggggacuguggugggaggggugaggucugaacucgaaaguuuaaaggagaagggcuggggucuggauuccuugguccaaggaagaaggucuggacuuguaccguuggauaugggggcagaucuguuagguggccugagcucaaagauccacagcagcgaagggagggagggaggucucauugagacacaaacuuccuuaccuuacauggguuuuuguuuguuuuucauuauguaugagaggaggguguauagaccagaggauaacuuggcaggagauugguccucucuuuccaccaugugggucccagggguacaacucagguuaucaaccuugaguagcaagcaccuuuauccaucucuccagcccugggcacugaucgcugaccucaauccucccuuaaccaccuccuucuucccgucucagggaaaaccaagaaaagaugaucuauuauuugcuuuuggaucggaaagagcgguauccuagcugugaagaccaggaccugccuccucggaaugauguugguaagaaggcagauugggcgguuuagaucccaggauuccugagggaggaggaugcugucggcccugggagucuguguguggacagcugggcauuuaugagagccucgcucugcuaugcuccuugguuuccccauccguuuacaaggcagucacguauaugcuguguauaccugggcaaacuaaucuacugggugggucaauaacucucucccuucagacccaccucguaagcguguggauucccccaugcugagcagacacgggaaacggaggccagagcggaaguccauggaaguccucaguaucacagaugcugggagugguggcuccccagugccuaccagacgggccuuggagauggcccagcacagucagaggugagggagaggcuguacccucugggagaaucuucagucccagagcguagagggagcagaucguucuagacccugcucaaccucccgugccugggaggacauggaaauggagaaacaccugaaccuucugaaacucucucagaucauuuuuuuaacccuguaaacagaucccgcagcgucaguggagccuccacuggucuguccuccagcccucugagcagcccaaggguaagaguagacccucaaagaauuaagagaaaucaacagaaaauacaauuucaugaggcauucuugccugagaagugucaaagacauccauuuuugucuacucaagauuggguuuguaguauguuuuggggguuuuaauuauuuaucagaaguucuuugaguacuuucagcgugccaauuucugcuuaggcuaggguugcagccuuaguguguaaauuggagacaguacuugugccuaaauccagagugguggguggggcugauugaacuacaauucccagcaugucuugcaguccucccuagcgauucugagcaaguaacaauuaaucccaaauaacaauucccuccgggaaguuguaguccaaauugucacuaggcccugcuuuucuacagaguccggucuuuuccuucucaccggagccaggcgcuggagaugaggcuagaggcggaggcuccccaacuuccaaaacacagacgcugccuucucggggccccagaggugggggcgcuggagagcagccaccaccccccagugcccguuccacgcccuugccuggaccaccaggcuccccgcgcuccuccggcggaacccccuugcacucaccucugcacacgccucgagccagcccuacggggaccccaggaacgacgccaccucccagcccaggcgguggcgucgggggagccgccuggagaagucggcucaacuccauccgcaacagcuuccugggcuccccucgcuuccaccggcgcaagaugcaggguaagggucucagcagaugcugggcuagguuugccaaaugcuggauucuaaugugggaaggaggggcuaaacgucauauggaaaauuucauggcgggucuucagguaggaaagagagccugauucccaaaucccgagacucuaaaggugaugaugacguucggagagaggcaggucugggggcugaagggugaugggaacagguccugccacgguguacucucgccuacucauuggucuguaggagcuugugccuacccggggaauguggucuagccacacugucuauccagaagggccaggacugacuacucgaguuaggguuagccauuugggagaugacugaauccacagggugcuggaugauaaauuauaaguaaguguugacuacucccucuucucucucuaacuagucccuaccgccgaggagauguccaguuugacaccagaauccucuccugagugaguucaacaagggaagaaacuaagugggcagcaaggggacuugucuuuuaaccccuuccugacccucccuccucuuccuaucuaucccauuccacccaggcuggcaaaacgcuccugguucgggaauuucaucuccuuggacaaagaagaacaaauauuccucgugcuaaaggacaaaccucucagcagcaucaaagcggacauuguccaugccuuucugucggugagaguccuggcaucccuaucggaccacaaagcuaugccucccugccacuccauccauggccagacuuacuuccgagacucaugggaucuguaguuuuccagcaagaggugaccuugaucacuacggaacagggaggcaggcacagacucuugggccuaaagccuaaaaguggugaaguaagacccuaaaaacagguuccugaguaccagcagaagaugaguggguugccuugccaugccaaaagaucugagggggugguccaaggagagaccuuucuccacggaccuuaaugcuuccuacuuaauaccauucccgcagcccuuugcuguaggacugugaugggauuuucaguuacuaagacaugugacuuguagaggaaagaaagguguauuccauaaauggugcaggagccuggaacugucuuguaaauaucagaggccacaugaguuuaggauccauucuucagaacauagggcaggggaccuacagaagacgagccagugggcaguggggccucccaagccuaauuuguuauccucuuacccauugcugaugggacuuguuccuuguccagagccagguguaggacgguuaucuguucccucaguucaccucauccuuauuuauauucguaccuucuagauccccagccugagucacaguguacugucacagaccagcuucagggccgaauacaaggccagcggcggccccuccgucuuccagaagccuguccgcuuucagguggacaucagcuccucugaggguccagaacccucaccccgaagagauggcagcaguggagguggcaucuacucagucaccuuuacucucaucuccggugagucucucuugaccagcuuugggguauuggggaucucugaaauaggauaucggcacaggagggcaucaagaucagaaaucaguacagaaugcucugguucugcagugcccccgcccccagcacacacacacuuuccuuucccagucuuuccaucacauguauugugaaaaauaguucacagguaucaguaaucaaucauuuuauaaggugcuucaugguaccuucucaucuccaucuucuaauagaagaguaagcaugcucgccucaaacaucagugccuuucccaaagcagauaucaucaguccauccauggagcucuuccugugcucagcugagcugcagccucagaauuuuaacucuaggcagccaugaccaaucaagacuuagcccgagagaggaaaacacucggggauaaguuucuuccaauucuuaguuccuugucaauuuuaauauguuauggucaggaggugaguuugcucuaagaguuucuaaaucaggcugcagagugugugugugugugugugugugugugugugagugugugugaguaugcgugugugcacgugugugagugugugugcgugugugugugugugugugugugugagugugugugaguaugcgugugugcacgugugugagugugugugcguguguguguguguguuagacagagagaacgagagcgagacagagagacagagagagaaagacaauuuccggggauaaguucucuccuaccaugugagccccagggguugaaaucggguuguaaggcuuggcagcaaguaccuuuacccugaaccauucugccagcccaagauuuguguuguuuuagguuuguuugguuuuuuuauggguuuuuuguuuguuuguuuguuugacuuguuuguuuguuucucucacuuauuuuucuauguuaaaagauguuuauuuuauauauguggguuuuugucagcaugaaugucugugcagcacaugugugucuuaagguaucagauccccuggggccaucaugugggugcuaagaaucaagcucaagcccucuggaagagagcgaccagccagugcgcuugcauccugagcaucucugcagccccuugcuuauuuuucuuauguauuuccgccccuccucccauccuuaaggaaagucaaaugagcaccaacaccuauuuuaaauagagagcaacacuuaguguuagaaugaaauggagaugucugggcguaacagugauccuuaagugcaggauagagagcccucuggggaaccaguuauuggugcagguccuaacagagucaggaaaauuaacccugaaaggacgacagucuugcuuguggagggauccugcaugccccagcucucucucagucacuggguuccuguuugcccaucuucccucaggucccagccgucgguucaaacgugugguagagaccauccaggcacaguugcugaguacucacgaccagcccuccgugcaggccuuggcagguaggugacagauguguggugggcacacauccagggugaccagugcaaucucaggugucucucugcuucucuuaagcugacucacuucuuggacuuuuggccagugucuugcugaggucuccccugcacuguugggaauagauuucccccaagaggcuggaguccaagaaaggaguuucucagcuaccugaaagcccuaaaacaacaguggcccccacguuggaagcaauggugccacagagcucuggagccagaucugcccugugggagagugaucagucaucccagugugccuggaacuaggggcuaaagccaggggagauaggacagauugguggcccucucugcaggacccaaaugcuacuggcauugaaaagcacaguucucaaauggcauccagggagcagagcagaggccaggccucagggaacuguuuauaauucauucagguuuccauaagagaauaacauaaacuaaccagagguuaguucagauagagguagacuguuugccuagcaaugagaaaggucuggauucagucccuaggagaaaaaaagaaaugcaauaaacuugaacgggguggguguuuggauuugguuugguuuguuuaagacagguuuuuuugugugaaaccuuggcuguccuggaacuuucucuguagaccagacacuggcuuugaacucacagagaucugcuugccucucccucccaagugcugggauuacagaggugugucaccaccuuacaagugaacuggguggcuuuuuaagcaauaggagagugaguauggaaaugcguacaugcuguaguccaagcauucaggaagcugaggcagggagguugcuauccugagggacuaguuccaggucauuuuggccacuuuauuuuuuuuuuuaaagauucauuuauuuauuauauguaaguacacuguagcugucuucagaccaauccagaagagggagucagaucuuguuaaggaugguugugagccaccaugugguugcugggauuugaacucugaaccuucggaagagcagucgggugcucuuacccacugagccaucucaccagccccuuuggccacuuuauaaaacuaucuaacaccuauaaauccuaacaccacauaaacuagcaguggcauuauacagcugcuguaaauggcagccagcacuuaggagguggagucaggaggauccggaauucaaagucaucccuagcuauauguaucaaauucaaggccagacagauauucaugggacuuuaucucaaaaauaaaaaauaaauaaacuuuuaaauugcaauugggcaaugcuggcacaugccuuaaauccuagcacuuaggacacagaggcaggugcaucucugaguuuggagccagccuggucuacagagugaguuccaggacagccaaggcuacauggaggaucccugucucaaaaacacaagcaaauacauacauacauacauacauacauacauacauacauacgauaguauuaucuauuuuauguauaugcacuuuugccugcauguaugucugugcacuguguacaugcuugguguauguggaggccagaagaaggcaucauaucucgaguuacaggggguugugaucugagaauggaauacuguccucuggaagagcagccagggcuccuagccauggaacccaggaaauuguguucagagacuggaaggccaaggucaaggcagcaagagagauuuugugucugccaacagaucauuuccucauucuuagagggccucggugucucuaacaugguggaacagcaagggaguaauuuguauuuugguuuuuuucccagacuuggucucauauaucucagucuggccuuaagcuuggaauguaguuaacagaugacuuugaacuccuaguccgccuaccucugucccagcugcuaggauuacaggcguguacuaccagucuggcuuucacugaggucuuuuauaauuucagggcacuaaucccagaggcccuauggauuuaggugugaugguuucagccugugaauuaugggggacacaacauuuaaccuguaguagaagugucugccauagcagucagagcuacaaagaugacaauucuaugugacuaaaagguuggcuuaggcaagcaggcuccauuguaggaugcaagagaggaacaugccaggugcacaaggcuggugagaucagccuagcauuccucucugucucugucccuuguagaagggaucaggcaaagagaaucuagcaaugaauauagcagccaccggaggacacuaguggcuugacucuggacagagcuagucuugacuuuggguucaucacguaugauugccauuaguaagugaccucagagauggucccugaaacaauacagauuuuucagccugcuguccgggaggugaggcacccagggugacuucaggaugucuuccugagagcuguccucucuugcucugcaguuccuaccuuuaucuguggccacuuccuccagaacacuacugacauuacugguucauuuaaggacuugggucugcccagauaauccaagguagucuucccacccacagggauuauccugaaucgcaacacauggucucagcgucuucacagauucccagcuuuaugugaacauauguggggugccauuauucagccugucccagccucccugagggacauuugcaguguguggagacugauuugauugucucacuugcagggcagggacuuguuauugacaucauguggauggggaccagggaugcugaaaacaacccugugacucucaccacagaguuacucaggccucagcaucagugcccaggacgauuaguuagcccgcggguugcugcagcagaacaccuuacaaaagcaacuucaggaaguggggacuggcaagaaggauuagcacuuaacgguggugcuugccacugaacccgacaaccugaguuaaguucccaugacccacagauuaggggaaaacaaauuccugcaagauguucucugagcuccacacugaagcccuaauacauacaccacacaugcaugcaugcacacacacacacacacacacacacacacacacacagaggaagaagagggaaugauggcuggcaggagucugaggcagcuggucacauugucugcauuuaggauacagagaguaaugaaugcugguacccagcucucucucuccuuuuuauucaguucaggaccccagccccuggagugguucugcucacaguagggcagguugucuuugcaucugcauuauccuaauccagaccauccuuuacaaacaucucagagccuugcuuccacaaugacucuagauccuguuaaccuaaccugugagccagucacuugggaggcugaggcaggaggaucagguauucaaggucauccacugcuacagagggaguucaaggccagccugggcuauuguaugagauccugucucaaaaaaaaauaguaaaauaaaauaaaaaauauaguaggugauggcgggcuagagagaugguccagugguuacgaacacuuacugcucuuccagacgaucccagcacccacacaauugcucauaaauauccagaacuccaguuccaggagcucugcugaacuccguggaccccaggcauguacauggugaacaugccugcaggaaaccacucauaaaauaaauaacaccuaaaaacaaacaaaccaaccaaccucagggguggugaaauggcuuagucaguaccgugcacgacaaccugagaagcucauccgcagagcugugugaaaaagccgagaggccggggccuuagcucagugguagaguacuuaccuagcaaggcaaggcucuacucucagcuccaggaaaaagagaagccagccacugcaguguagccccagaaccccagcucugggcaaauggagacagaagaaccccuaacccggcuaaccaacucugguaaguuccagguuccaugaacgaaccaacucccccaaaccguccucugacccccacuugcgugccauggcacuuauguguccccacacaaaauaaauacauuaaaaagaaagaaaggaagaaagaaagaaagaaagaaagaaagaaagaaagaaagaaagaaagaaagaaagaaagaaagaaauguaaucuaagaaauaagaugagccggcccugauggccuuuaaugccaguauugugaaagcagaguuugaagacagcuuggucuauauagagagugcuaccacaugcauauguaguguggccuucaggucagcagauccagaaauauccgagacauacacagaacaauuugcaauacuuugagccucaaucccauagaauuaccuaguuguacauaaaggguauuacagccuuauaguugccccagagagccgagaauuucuuguggugagcuggccugggccucagacaaacugggcagguuuuucaaagccaaaauguaggcuuuuucuauagcagcugucucugggauuugaaguuccaaaaauggcggacauaauaaccucuauucugguuguuauuaugacuaauuuacauuuauuuguguauuuggggugagcacagugguguacauguggaggucagagaacaacuugugggcgucaguucucucucucuccaucugugugggucccagggauuggacugaggucaucagacuuggugacaagcucugcugaaccacgucaccagcccaaguuugguuucuuggugccacugugaccaauaaacaggagccucaaccuggguucaacaacuugccugcccauggaaaauuacuuccuccuuugcagaugagaagaacggagcccagacccggccugcugggaccccaccccgaagccugcagcccccaccaggccgcucugacccugaucugaguagcucuccccgccgaggacccccuaaggacaagaagcuccuggccaccaauggaaccccucuacccugaccccagggggccagggaaggaggggagcccccuccaccccccuucccugccccccuacugugaaucuguauauaaggcccaaggaguauguugggaggggggacacaaaacuaggccuugcccugcagggauagggcuccaggggccauacccaauggggggggagguucuagggcaaaaagggggugggagcuguuuuuauuuauuuauuaauuaauuuauuauuuuauuuauugaucaaucucugcgggugggguaggggagggauggggguggcuuagcagauccggacagggcccucugucucugugucauccccaacccccagccccuuccuggcccccugcucccccccagguccugcccccuccccugugaccuucuguacggauuugcccucccggaaggaauucugguuucgcgugauccugccugcgucugugucugauuccgccggcggcagcaacaacaacaacaacaacaaaaauaaauagccuugaucagggac

SEQ ID NO: 3521 - RNA, 9808 nt, Mus musculus
uuuuuuuuugguuuuucgagacaggguuucucuguguagcccuggcuguccuggaacucacgaacucacucuuagaccaggcuggccucgaacucagaaaucugccugccucugccucccgagugcugggauuaaaggcaugcgccaccacgcccggcuucccuccuuccuccucuuaauauaaaaaguaaucguuuaauaaauaauguaggaagugaggaagacacugugaacagauuucauagagaccccagaacccaggaucucaguucccugcucuucagggucucagaugcacccacccaccccccaauuguuuaaauaaauaaguauaaauaagccacaggugaucccccucacccaggucuacuggaaagacugucuagcuggguguggggcgguuguuugggguguggcaugccccugaucaucaugccccccuccaaguaccaaaauaaauaaauaaauaagaucugguuuuaaagggcgguaucgauggugguuuucagucccgagucacagucgagucuuuaacaacagcaggccccgcacggcccaguccaaggucaggugcagcccuccuaggauggcaugagcugcccggaugcuuccccaggcugaggcaggagggcccagggggaucacagguuggucuggggcugccuggggcaaggccaggcgagacaucuguugaagagagaaagaagguuagcuaaaggcaagggucugggguuuagaaaacugaagccguauuggguguucucgccuguaaucccagcacggaaggaucaggauucaaggauacauaggaaaggcaguuuggggggcuggagagauggcucagugguuaagagcacugacugcucuuucagagguccugaguucaauucccagcaaccacauuguggcucacaaccaucuguaauggaucugaugcccucuucggguacaucugaagacagcuauaguauuauacacaaaauaaauuuuuuuguguuuuguuuuuuucaagacaagauuucucuguguagcccuggcuauccuggaacucacucuguaaaccagaaacucaggucuugaacucagaaaucugccugccucugccucccaagugcuggaauuaaaauaaauaauaaaauaaauaauuauuaacaaaccccgaggcuuggaagaaugcacaauuaauaaaguaguaaagugcuugcugcacaaucaagaggacaugaguucaaaccucugggucuaauguaaaaaagcugggcacaccagcacgugccuguaaucuaagugcugaguaaauuagacagguaggaggauucucggggauuugccagucauccagucuagcugaauuggugaguuccaaguucaaugagaaaccucuucucaaaaaagcaaagcagagccucugaguuugagaccagccuggucuacagagugaguuccauccaggauagccaaaguuacacagagaaacccugucccaaaauucucaaagauaaaaacaaaaaagaccucaggaacauaaucgagguggaaauugggcaucaauacagaaauaugcccaauguugaccucuggacucuaggcucucauuucuguguguucaugucuuaaugaacacacgcacacacgcaugcacacgcacaugcacacacacaugcacacacacaggucacuguccuaaggaccagguuaagggacuaaggaaugaggguuagggaaugaauggcgcuugccaugucuucucagaaggucagagcuagugucuuagaacuuggagucuagggaccaugucuagggacugggguuaggagcaagaauuugagaccuagggucuuuacaggcagggaccaaauacugaagucuauuggacaaccgggcugagguucuggaauuuacgguaucgauauuaaaaacuuauaauauugaaaaugagacauagggcuggugguggggggugggggguugaaacaagaucuuauaaacccagauuggccucaaucucacuacacaacugagauggccuugaucucuucguuugccaccucccaaacacugggaguacaaucaggugcuaccauaccuggcuuugcuuuguuugagacagguuucugcuacgguuuucguuauagcaaggcuggaaaucacugugccuccuaagugcugagacuuacaggcaacugccacugcacucagcuagggacgacacuugagaucuggcauuguagagugucaaggcugguucagucaugaucuugucucuuagggacuagggcugggucuuugagacgugaggaucuggggucggggcagggcugggaucugggguggggcgggcuggcuuggauuuggugcuuuggguauuagagguuuuuuaggcaucuuaagaccuaggccucuaauucucacgagaagauuuggauccuguuaacucagagaaggggucuuaggucuaaggaucuugggauucagggucuagacuuuuagacaaguggucaggguugggguuucauacuaucaugggcugcgauuugggggacacaaaacaauggucuaugguggcuuguagccuuggggauugguuaagaguugcucugaagcccagcagugguggcgcacgccuuuaaucccagcacuugggaggcagaagcaggcggauuucugaauuugaggccagccuggucuacagagggaguuccaggaccgccagggcuacgcagagaaacccugucuggguggauggaggaaucaaaaccucaggcuguuguuucuuagggucaaagggaucagaauggaagucaaaggucuuggagucagagcauaccaagagcuguaaacggcggaguagccguuccagucgggcuugcagggcacccagcucuggcuccagagucuuuagggaaggaccaccugcacggcgcagccauuguacaugccggagguaggacaucaagucuacucgaagccuugucagcacaccaggaagcuagggacaaagaauggaaaccagggaaccguuaacacaugcaucccucagccaucagucuuucagcccucccuaucagccagcgcucaccugcaaagaucccaaugucccagcgcucauggccaaggugggcagggaguccagacugugaucuccgucagcugggaauuugucucucuggugagaaagaagcugugaggggaaccccaagcucuccccuucgucaagugcccaagagagagaagugacugucauucuauauucccugucccuccaaucuccuaccaucugugcagcuaguugccgugugucugccaggagggaucggguuaggagaacagcgcuguccagaucugcucgagggucugaagagacucgaggggagccagcugguggcccaggggcaacgacucuaucuggccagaggcucagcaccaccaggaccaggcgacaaacaccuguggacagaagggagaaaucaggccaaacucugggucugagggaguaggacuggggucuagauucuucugccucugaggaagaagggcuagagucuagaaccugggucugagugagguaagcuaggguucggaauuuuggucuugaaggacuguggucuggacuuuacggucuggaggaggagggauggauggagccuggauucugggucugagggagggcaggcugggccucgggacccuggaucugcagaauaagggcuagacucuggacuccagguucuagggagaagagcugagguuugggcuccugggucugagggaggagggcuggagucugaacgccuggaucugagggaggaggaccuggaggucuugagucucaggguggggcgccccggggcaggucgcaaagcccgagcccgggcgggcuucccucucccucccuggcucuggcugccccgcccgucggagcagacgcggcccggggcggguagacgggccgggcgucucccguccgcccccggacgccggaaucugggccccggggcggggcaugacgggggggggggagguacaggccagaaccugccccccuccccugccccgggagcccuagccggccugggaacagugguaggagucagagacuggagcugacacccgaacacacggauuccucuccaggaaggugccuggacccauucccauaugcccucaaagguggcugcagagggcugggccguugggucggggaggaccugggcgcaccuggucugagaggcgcucagggacgcacgcagcugaagacccgucgggccgcguucggggcucaggggcuagggacagcuccuuugccggcugcccaucccccagcugccccgcccaccucugagacagccagccaaucagagccccccgggccaccaagcucaaguaucacacccccagcccgcccccugguccccucuagcuaugccuaguccuucgcaagccccuccugggccgucugucggugcacccguccccuagccggugcgcaucugucuggcucuuuaagcucucuguccgcaccucucuuucgucugccuccccugccuguuucucguccucuggggcuugcugucaucugggauucucugccucaguuucccacccugagacgcgcuguuggaguucgugguugucucuguuccuagauucccacugacucccugggauacccgaucccuuaaggaucaccucccucccagcaucugucccucuguccuugucuggcugucccuugccuuguucugucucuuucucuguccaucucuucucuuaaacucccacuuuucucacuauucuuucucaaucugacuccccgugacuccucuuuucuaucccucugucccuacucugcuucgcauccuccccacucccucaauccuuccccccccccaacccuguccccucacccaugaacuggaaccaacuuacaguucauguccccacaggccagggguuccccagggcagggggcagggagccgggggggggggcuuuaacccuucccuguccgcugccgggggacccagggggucagcugggccucggccuggggaggggagguuugugagugugagcagcaagggccaggcagugagggaguguguacgccugggggguuauauagggggccggggcgggcgggcggggggcaggcagcaggggagggcggccugacacauccugacucacccucccuccugccuuuuccauucagacgagccggcugccuagcagggcucacaccgccuugcuuggaggagggcacggaaggaaaaguuggaaaaguugaaaagugaaggggggguggucugagaggggccggugaggucauuggcguccccucccuccaccuccacgggcugggacagacacacaaggcucaagagcucuauggagccuggcugugggugguggucugcauggaccaggacuaguacugagagauggugaggcaguagaagaggcaaguccagggccugaggagguggaggugaggggggagaaucuggacgacagagagaacacuggggcagagauggagccucuaaacccagaauggcugacaaaugcacagagauggggacagcaggauauagagauaccuagccucugagauggagagacacugggaacugaggagcugaggauguggcucaauuggcagagugaugguacauacacaccugcacucucagcacugggaaggcgaaagcaggagguucagaaguaaguucaaggucauccuuagcuacacagugagacugaagcuaaccugggcuacuugaaaccccauuuuaaaaaagaagcagcgauccccaagcggaaaggggccacagacaugggaagagaagacucaggcugcagaagaauaccaaagaugaggucaccugggagacagguuagaugagguagcugaggaccaaaagaaaaaggaauaaaggcuuucuacagaggugucucuggcuguguugcugcccuuccccccaacuugccaguucuguaaauggggcugagacuaucuucuauggcuaaggagaugacccaggggguaagagugcuugcugcacaaacaugaggagcugaguugaauccacagcacguauauaaaaagcugagcauguguaacugcagcccuguggguggagagguggagauggcggggucacuagggcuugucuuccagccuagcuccagguucagugagagacccuuucucaagagcguaagguugagagugcuagaacuucccagugucccccucuggccucuguacacuugcauguaaguacagauaaucuacccacauauacauacacucccagacacacauacaucccuuccuaccccuaaaugccacagugaggagucuuguacaaacuacuacuagagaaauguuuuugaucucaugguuacaguuuaucagcuauacugaggcacagguagucacugcgagagauggcaaaaugaguggugaguggauggguacuagaaacuuagacaaagccgcauucagagaagggggugucuauccaggaaagagccaaacacaccaguucagugacugcagcaauacccacauaccguguucaacaggugacuaccauugguucagaauucacaggcccuuaagggauggcgacaccaaaaucagcucacauauauucccagaagccuccucaagagggaaaugggauagcucugaacacaggacaguuacaugaacugcaaaaaaucucuuuguagaccacccaugcccaucuuuugggcccauugcauuggcuggagaugggggaguagggugagggcuggcucuggacugacuggcagccagaggcuuccccuccccaucuuucaccacuaggggggaagaacugcucagaucccccagggggugaggucagagcccccacucccaccccaauggugggguaugaccucaucaccucagguaagagcucuuucucucccuuucuugguuugucacaccaccccuuugagaggccccccaggggcccuccucagccccugcuucugcugggacccaggcuucugaccacugggucuccgccccucagggggccuguuuccggcugagucaucguggggggcccaaggcugcgucagugaggggagagcugacguagcacccccccagacuaugggggcuagccaaggugacucaggccaccagccuggggaauggacuggccugaggggacaggggacugggcuuguagccagaccuggccaauaccagggacugcaaaugccagccccuucccccaacugagauugaagaacucauaccauucccccaccuccucaucuccccauauuccuuaaacccaggguacagaucccagcccucuucccucaggcccagguucucagguauuuaacccuccugagaggguuaaacucaaacccuggguacaaacccuagcccuccucccucugauccaggcucucagguacuuggccaaccaacccucuucugucauacccaguguacagacccuugcucuuuucagaaccaggguucuagaucccagcccucuucccucagacccagggaacagaccccagccagccagcccuccuccaucagacccaggccagggaacagaccccugccagcccuucuuccucagauccaggguacuaaacccucauuuuuauauagguggaaaaaauaugugauguccuacaauugggagagcuuuguguuugaggaaguuugugagucuggguggugggcuccuugcucguucucaguccugcuccacuuuccaaccuggggauuguggggaaagacucaucuuccccagagugaccacagaaggacugaagaguggacuugggaguccugccugggucuucccugggugaggguugggauaccaguucuauggaaaugagacagagagacagaugagguaggaggcuuuugggaauccccccaaaaugacggaagacagcagaaauaaacaaauacaaacaggaucucacagcccaaugacgagaagacagaagcaaaagagugcuagggaggccaacuugaguacucaaacacagaggcagaggguagaaggucucugaagcauaucacgaggugucccuaggauguggggaucuagccagggggggccuuccuugauggugugcuggccccuggggugagcuggugcuggcugggcaugaugucagcacaucccaggcuguguguguccgucugucugucccugggggguccugucuggccucuggggggugacgaggcaggucagccacagaggcagcccaaaccugucauuagcggugagggccuugacggcgcaccccccccccccaaucccaauccgcagcgguccagggccaggcagcuccaccuccacccccuccuugaucccugaggaauccagggaauugggaaguggguccagaugguguugacacaggaaauggucagcagcugcccagucucagcccagcaaccccucugacccccacccccaggcccccugccgagcccccucggaccugugucaucucugacggagacagcccagggcccacucagcacccucuaggauguuuacaguaggaccuagggaugaaagagagucacccuccuaagcuucuugggaaacaggggucugaguucagaccccucccucccacggaagggacaauccaggccccagacccucccuccaccccccagaucugaaauaggcccgggcuuccucagaaucaagggucuagaccccaacacgccucccucagaccacgagagccuuccuucuucagaucccagagucuugggucuucuuccccuaaaagccucaguucaggacccagcucuuccugcucagacucacguucccaaaaccugccucccucagccucuaggcucacaguuuucagucucaaggauucccuucuccagacaucuucacccccucugacccaagccaugggugccccagccaucccaugagcccagggccaauccaggaccuccaucaggaaccaaggaacacuucucacuaugccaggggaauacugcgcucaggugaaugaggaaccagagugacauagcuccaaucuggcuggcuggaagcuaggagggcaaucuuggguaaaacaaacacaagacaacucgaguugcucuagcuuguguucccucauuaacaaaagggaagcugagucucuuuggggaccugaaacuuuuggcaggagucaccaucacagccucuaacagggaccacaccucagucucagcagggccacgcagucagucccaccccuggucuguguucccuaaagcagaugccugcugaagccugugaugugaaacccaaggccaacgcaccagcccucacugucccuuccuccucucaucugguugcugaggaaacccuucucuaacaauggggcucagugagaccccacuauucuaggguccuuuuuucccccuuuuuuccugguugcuaaaaggaaaaauacccuagcaaugaggauuucugaacuugggucucuugaggcugccucuuuggacauuggguuaggaaagaaauggagucugcaacucaaagauuuccccagucccauauccuuauccugucaggucccggaugaacauggagagaccucuccagcccugugcguuguccugcuuucucuuguccucuucccuugcugagaaggcacuaaauuugaaaucucccaaugcccacccaccucuucuccuaaguaaggagcuacuuccuagauagaauugaugggaccaggucaccccuucuug

SEQ ID NO: 3522 - RNA, 9808 nt, Mus musculus
caagaaggggugaccuggucccaucaauucuaucuaggaaguagcuccuuacuuaggagaagaggugggugggcauugggagauuucaaauuuagugccuucucagcaagggaagaggacaagagaaagcaggacaacgcacagggcuggagaggucucuccauguucauccgggaccugacaggauaaggauaugggacuggggaaaucuuugaguugcagacuccauuucuuuccuaacccaauguccaaagaggcagccucaagagacccaaguucagaaauccucauugcuaggguauuuuuccuuuuagcaaccaggaaaaaagggggaaaaaaggacccuagaauaguggggucucacugagccccauuguuagagaaggguuuccucagcaaccagaugagaggaggaagggacagugagggcuggugcguuggccuuggguuucacaucacaggcuucagcaggcaucugcuuuagggaacacagaccaggggugggacugacugcguggcccugcugagacugagguguggucccuguuagaggcugugauggugacuccugccaaaaguuucagguccccaaagagacucagcuucccuuuuguuaaugagggaacacaagcuagagcaacucgaguugucuuguguuuguuuuacccaagauugcccuccuagcuuccagccagccagauuggagcuaugucacucugguuccucauucaccugagcgcaguauuccccuggcauagugagaaguguuccuugguuccugauggagguccuggauuggcccugggcucaugggauggcuggggcacccauggcuugggucagagggggugaagaugucuggagaagggaauccuugagacugaaaacugugagccuagaggcugagggaggcagguuuugggaacgugagucugagcaggaagagcuggguccugaacugaggcuuuuaggggaagaagacccaagacucugggaucugaagaaggaaggcucucguggucugagggaggcguguuggggucuagacccuugauucugaggaagcccgggccuauuucagaucugggggguggagggagggucuggggccuggauugucccuuccgugggagggaggggucugaacucagaccccuguuucccaagaagcuuaggagggugacucucuuucaucccuagguccuacuguaaacauccuagagggugcugagugggcccugggcugucuccgucagagaugacacagguccgagggggcucggcagggggccugggggugggggucagagggguugcugggcugagacugggcagcugcugaccauuuccugugucaacaccaucuggacccacuucccaauucccuggauuccucagggaucaaggaggggguggagguggagcugccuggcccuggaccgcugcggauugggauuggggggggggggugcgccgucaaggcccucaccgcuaaugacagguuugggcugccucuguggcugaccugccucgucaccccccagaggccagacaggaccccccagggacagacagacggacacacacagccugggaugugcugacaucaugcccagccagcaccagcucaccccaggggccagcacaccaucaaggaaggcccccccuggcuagauccccacauccuagggacaccucgugauaugcuucagagaccuucuacccucugccucuguguuugaguacucaaguuggccucccuagcacucuuuugcuucugucuucucgucauugggcugugagauccuguuuguauuuguuuauuucugcugucuuccgucauuuuggggggauucccaaaagccuccuaccucaucugucucucugucucauuuccauagaacugguaucccaacccucacccagggaagacccaggcaggacucccaaguccacucuucaguccuucuguggucacucuggggaagaugagucuuuccccacaauccccagguuggaaaguggagcaggacugagaacgagcaaggagcccaccacccagacucacaaacuuccucaaacacaaagcucucccaauuguaggacaucacauauuuuuuccaccuauauaaaaaugaggguuuaguacccuggaucugaggaagaagggcuggcaggggucuguucccuggccugggucugauggaggagggcuggcuggcuggggucuguucccugggucugagggaagagggcugggaucuagaacccugguucugaaaagagcaagggucuguacacuggguaugacagaagaggguugguuggccaaguaccugagagccuggaucagagggaggagggcuaggguuuguacccaggguuugaguuuaacccucucaggaggguuaaauaccugagaaccugggccugagggaagagggcugggaucuguacccuggguuuaaggaauauggggagaugaggaggugggggaaugguaugaguucuucaaucucaguugggggaaggggcuggcauuugcagucccugguauuggccaggucuggcuacaagcccaguccccuguccccucaggccaguccauuccccaggcugguggccugagucaccuuggcuagcccccauagucugggggggugcuacgucagcucuccccucacugacgcagccuugggccccccacgaugacucagccggaaacaggcccccugaggggcggagacccaguggucagaagccugggucccagcagaagcaggggcugaggagggccccuggggggccucucaaagggguggugugacaaaccaagaaagggagagaaagagcucuuaccugaggugaugaggucauaccccaccauuggggugggagugggggcucugaccucacccccugggggaucugagcaguucuuccccccuaguggugaaagauggggaggggaagccucuggcugccagucaguccagagccagcccucacccuacucccccaucuccagccaaugcaaugggcccaaaagaugggcauggguggucuacaaagagauuuuuugcaguucauguaacuguccuguguucagagcuaucccauuucccucuugaggaggcuucugggaauauaugugagcugauuuuggugucgccaucccuuaagggccugugaauucugaaccaaugguagucaccuguugaacacgguauguggguauugcugcagucacugaacugguguguuuggcucuuuccuggauagacacccccuucucugaaugcggcuuugucuaaguuucuaguacccauccacucaccacucauuuugccaucucucgcagugacuaccugugccucaguauagcugauaaacuguaaccaugagaucaaaaacauuucucuaguaguaguuuguacaagacuccucacuguggcauuuagggguaggaagggauguaugugugucugggaguguauguauauguggguagauuaucuguacuuacaugcaaguguacagaggccagagggggacacugggaaguucuagcacucucaaccuuacgcucuugagaaagggucucucacugaaccuggagcuaggcuggaagacaagcccuagugaccccgccaucuccaccucuccacccacagggcugcaguuacacaugcucagcuuuuuauauacgugcuguggauucaacucagcuccucauguuugugcagcaagcacucuuacccccugggucaucuccuuagccauagaagauagucucagccccauuuacagaacuggcaaguuggggggaagggcagcaacacagccagagacaccucuguagaaagccuuuauuccuuuuucuuuugguccucagcuaccucaucuaaccugucucccaggugaccucaucuuugguauucuucugcagccugagucuucucuucccaugucuguggccccuuuccgcuuggggaucgcugcuucuuuuuuaaaaugggguuucaaguagcccagguuagcuucagucucacuguguagcuaaggaugaccuugaacuuacuucugaaccuccugcuuucgccuucccagugcugagagugcagguguguauguaccaucacucugccaauugagccacauccucagcuccucaguucccagugucucuccaucucagaggcuagguaucucuauauccugcuguccccaucucugugcauuugucagccauucuggguuuagaggcuccaucucugccccaguguucucucugucguccagauucuccccccucaccuccaccuccucaggcccuggacuugccucuucuacugccucaccaucucucaguacuaguccugguccaugcagaccaccacccacagccaggcuccauagagcucuugagccuugugugucugucccagcccguggagguggagggaggggacgccaaugaccucaccggccccucucagaccacccccccuucacuuuucaacuuuuccaacuuuuccuuccgugcccuccuccaagcaaggcggugugagcccugcuaggcagccggcucgucugaauggaaaaggcaggagggagggugagucaggaugugucaggccgcccuccccugcugccugccccccgcccgcccgccccggcccccuauauaaccccccaggcguacacacucccucacugccuggcccuugcugcucacacucacaaaccuccccuccccaggccgaggcccagcugacccccugggucccccggcagcggacagggaaggguuaaagcccccccccccggcucccugcccccugcccuggggaaccccuggccuguggggacaugaacuguaaguugguuccaguucaugggugaggggacaggguuggggggggggaaggauugagggaguggggaggaugcgaagcagaguagggacagagggauagaaaagaggagucacggggagucagauugagaaagaauagugagaaaagugggaguuuaagagaagagauggacagagaaagagacagaacaaggcaagggacagccagacaaggacagagggacagaugcugggagggaggugauccuuaagggaucggguaucccagggagucagugggaaucuaggaacagagacaaccacgaacuccaacagcgcgucucagggugggaaacugaggcagagaaucccagaugacagcaagccccagaggacgagaaacaggcaggggaggcagacgaaagagaggugcggacagagagcuuaaagagccagacagaugcgcaccggcuaggggacgggugcaccgacagacggcccaggaggggcuugcgaaggacuaggcauagcuagaggggaccagggggcgggcugggggugugauacuugagcuugguggcccggggggcucugauuggcuggcugucucagaggugggcggggcagcugggggaugggcagccggcaaaggagcugucccuagccccugagccccgaacgcggcccgacgggucuucagcugcgugcgucccugagcgccucucagaccaggugcgcccagguccuccccgacccaacggcccagcccucugcagccaccuuugagggcauaugggaauggguccaggcaccuuccuggagaggaauccguguguucgggugucagcuccagucucugacuccuaccacuguucccaggccggcuagggcucccggggcaggggaggggggcagguucuggccuguaccucccccccccccgucaugccccgccccggggcccagauuccggcguccgggggcggacgggagacgcccggcccgucuacccgccccgggccgcgucugcuccgacgggcggggcagccagagccagggagggagagggaagcccgcccgggcucgggcuuugcgaccugccccggggcgccccacccugagacucaagaccuccagguccuccucccucagauccaggcguucagacuccagcccuccucccucagacccaggagcccaaaccucagcucuucucccuagaaccuggaguccagagucuagcccuuauucugcagauccagggucccgaggcccagccugcccucccucagacccagaauccaggcuccauccaucccuccuccuccagaccguaaaguccagaccacaguccuucaagaccaaaauuccgaacccuagcuuaccucacucagacccagguucuagacucuagcccuucuuccucagaggcagaagaaucuagaccccaguccuacucccucagacccagaguuuggccugauuucucccuucuguccacagguguuugucgccugguccugguggugcugagccucuggccagauagagucguugccccugggccaccagcuggcuccccucgagucucuucagacccucgagcagaucuggacagcgcuguucuccuaacccgaucccuccuggcagacacacggcaacuagcugcacagaugguaggagauuggagggacagggaauauagaaugacagucacuucucucucuugggcacuugacgaaggggagagcuugggguuccccucacagcuucuuucucaccagagagacaaauucccagcugacggagaucacagucuggacucccugcccaccuuggccaugagcgcugggacauugggaucuuugcaggugagcgcuggcugauagggagggcugaaagacugauggcugagggaugcauguguuaacgguucccugguuuccauucuuugucccuagcuuccuggugugcugacaaggcuucgaguagacuugauguccuaccuccggcauguacaauggcugcgccgugcaggugguccuucccuaaagacucuggagccagagcugggugcccugcaagcccgacuggaacggcuacuccgccguuuacagcucuugguaugcucugacuccaagaccuuugacuuccauucugaucccuuugacccuaagaaacaacagccugagguuuugauuccuccauccacccagacaggguuucucugcguagcccuggcgguccuggaacucccucuguagaccaggcuggccucaaauucagaaauccgccugcuucugccucccaagugcugggauuaaaggcgugcgccaccacugcugggcuucagagcaacucuuaaccaauccccaaggcuacaagccaccauagaccauuguuuugugucccccaaaucgcagcccaugauaguaugaaaccccaacccugaccacuugucuaaaagucuagacccugaaucccaagauccuuagaccuaagaccccuucucugaguuaacaggauccaaaucuucucgugagaauuagaggccuaggucuuaagaugccuaaaaaaccucuaauacccaaagcaccaaauccaagccagcccgccccaccccagaucccagcccugccccgaccccagauccucacgucucaaagacccagcccuagucccuaagagacaagaucaugacugaaccagccuugacacucuacaaugccagaucucaagugucgucccuagcugagugcaguggcaguugccuguaagucucagcacuuaggaggcacagugauuuccagccuugcuauaacgaaaaccguagcagaaaccugucucaaacaaagcaaagccagguaugguagcaccugauuguacucccaguguuugggagguggcaaacgaagagaucaaggccaucucaguuguguagugagauugaggccaaucuggguuuauaagaucuuguuucaaccccccaccccccaccaccagcccuaugucucauuuucaauauuauaaguuuuuaauaucgauaccguaaauuccagaaccucagcccgguuguccaauagacuucaguauuuggucccugccuguaaagacccuaggucucaaauucuugcuccuaaccccagucccuagacauggucccuagacuccaaguucuaagacacuagcucugaccuucugagaagacauggcaagcgccauucauucccuaacccucauuccuuagucccuuaaccugguccuuaggacagugaccugugugugugcaugugugugugcaugugcgugugcaugcgugugugcguguguucauuaagacaugaacacacagaaaugagagccuagaguccagaggucaacauugggcauauuucuguauugaugcccaauuuccaccucgauuauguuccugaggucuuuuuuguuuuuaucuuugagaauuuugggacaggguuucucuguguaacuuuggcuauccuggauggaacucacucuguagaccaggcuggucucaaacucagaggcucugcuuugcuuuuuugagaagagguuucucauugaacuuggaacucaccaauucagcuagacuggaugacuggcaaauccccgagaauccuccuaccugucuaauuuacucagcacuuagauuacaggcacgugcuggugugcccagcuuuuuuacauuagacccagagguuugaacucauguccucuugauugugcagcaagcacuuuacuacuuuauuaauugugcauucuuccaagccucgggguuuguuaauaauuauuuauuuuauuauuuauuuuaauuccagcacuugggaggcagaggcaggcagauuucugaguucaagaccugaguuucugguuuacagagugaguuccaggauagccagggcuacacagagaaaucuugucuugaaaaaaacaaaacacaaaaaaauuuauuuuguguauaauacuauagcugucuucagauguacccgaagagggcaucagauccauuacagaugguugugagccacaaugugguugcugggaauugaacucaggaccucugaaagagcagucagugcucuuaaccacugagccaucucuccagccccccaaacugccuuuccuauguauccuugaauccugauccuuccgugcugggauuacaggcgagaacacccaauacggcuucaguuuucuaaaccccagacccuugccuuuagcuaaccuucuuucucucuucaacagaugucucgccuggccuugccccaggcagccccagaccaaccugugaucccccugggcccuccugccucagccuggggaagcauccgggcagcucaugccauccuaggagggcugcaccugaccuuggacugggccgugcggggccugcuguuguuaaagacucgacugugacucgggacugaaaaccaccaucgauaccgcccuuuaaaaccagaucuuauuuauuuauuuauuuugguacuuggaggggggcaugaugaucaggggcaugccacaccccaaacaaccgccccacacccagcuagacagucuuuccaguagaccugggugagggggaucaccuguggcuuauuuauacuuauuuauuuaaacaauuggggggugggugggugcaucugagacccugaagagcagggaacugagauccuggguucuggggucucuaugaaaucuguucacagugucuuccucacuuccuacauuauuuauuaaacgauuacuuuuuauauuaagaggaggaaggagggaagccgggcgugguggcgcaugccuuuaaucccagcacucgggaggcagaggcaggcagauuucugaguucgaggccagccuggucuaagagugaguucgugaguuccaggacagccagggcuacacagagaaacccugucucgaaaaaccaaaaaaaaa

SEQ ID NO: 3523 - RNA, 2118 nt, Mus musculus
auuuauaugcuauaucuguauuaagggauccuccaggguugcccuauucuucaccuccuguguccuccccggaaacugcagcugcaguuucuacuucgccuccuggggauuggagaacgguaguugacuuguuggccgaucgucgguccuuagacagugaggagacugucuuugacaguuuacuacauuuccgauguagaaaccuugguaggugcagcaugucuuggcgccuggcccaccugguggggagagcauauguucagccugaaccacccacaccuucuguggagaaccaugccuccuggccuccccagccacacucaccagaagagacagauacuggugaucaggaagaguaggcugccacagguccagcccagugcccacauaugcuuccuccgcauauuuucuagaaaaggggaggaggaagcuccagggauccacccucuggaggaacccucacccucugaaacauccaggcugcagucaggucacucaccaucuggccgcugaugauagcacacaccgucccgguagcagcaccgcaggcguaggcagagguugggguucucaauugcugccugacccccacagcucucucggucccacacaucucccucacaaccuaagggccaccacaguaggugcuaaguaacaaaagaacugucccuggaagcuacaggcacaagagugccaaggccaggcuguggggcugcgguacugugcauuuggcaguauuuagaggacccaagaguccagacccagcccuccucccucagacuuaggggguucagcuuccagcccuccucccacaaaccuagacauuccaaccccagcccucuuccuucagagagucgauuacacaaaccuucucccucaagcucaggagucaaaguugcaggcaucucuccagaccccagacccaaggaccaagguccagcucuucucccucagaccgaguccaggcuucagcccuccuugagucccagagguugaguuccuagcccuccuuccucagacccaagggucuacccuccagcucuuuuccuuuggacccgggggucaaucccccagccucucucacacauccuacaaucuuaauuugggauccccccacccccagggccccaggauuuuggcucuuacuuacuccauggguagaaaaaucccuggauuccauucgcaucugugggaaagaaagggugauguugggagauuguguggcagccaacguggugguccuguccacagcccccaguggcccuguccauggcccccugauguccuccucaguacccucaccuacugagcccugcaucagcaggagaaggcccaaagcugagaucccagaccccaccauguuaccuccccagaccucuggggccucugcaaagaaaccuagcaacagcugggcuccgccccaaaagcuucagccccaaaauucuuaguucuguugcuaagggauccccucagcaagggguucacaagaaggggugaccuggucccaucaauucuaucuaggaaguagcuccuuacuuaggagaagaggugggugggcauugggagauuucaaauuuagugccuucucagcaagggaagaggacaagagaaagcaggacaacgcacagggcuggagaggucucuccauguucauccgggaccugacaggauaaggauaugggacuggggaaaucuuugaguugcagacuccauuucuuuccuaacccaauguccaaagaggcagccucaagagacccaaguucagaaauccucauugcuaggguauuuuuccuuuuagcaaccaggaaaaaagggggaaaaaaggacccuagaauaguggggucucacugagccccauuguuagagaaggguuuccucagcaaccagaugagaggaggaagggacagugagggcuggugcguuggccuuggguuucacaucacaggcuucagcaggcaucugcuuuagggaacacagaccaggggugggacugacugcguggcccugcugagacugagguguggucccuguuagaggcugugauggugacuccugccaaaaguuucagguccccaaagagacucagcuucccuuuuguuaaugagggaacacaagcua

SEQ ID NO: 3524 - RNA, 10706 nt, Mus musculus
aucaggaaaacagcuguuuauuccaaaacaaaaaccaacaccccacccccagccaagugccugcuccuuuugcuguccucaccaggaagaugaaggugaguccagcacuggaaggaaguguggggaggggaguaagaaugggguucagaggccugaggaaccucugguguggcacuuugaucuugucucugacacccccucugcagcccccagccagaagggagcuuuccugcaugggcacacccugccuauguguauuuguguuuauuggggagcagggguggggguggggaggggaagacucagaaggccaggucccaauucuggaagcaucguggugauggugggggaugagcagaacagggccugcuggcccacccucaagaccucuccccacuauggcuuuauugaaauaagaggucaagacuucagggucaggcagguggaggguggaggcuggggugagggcagaucccaggaaggaaggaauucagguuuggggagggaugaagggaaagagagagugggcaaacaaaagcugaaagccccugaaccucuccagggcuuggagaaagcuguguguuccaugggaguguuaagcacacuugaagggaggcccuagaauggaugcggagcccauggagcaucuauuaguugggaggccgaaaaccuggugcuggcauuuaggaagauuggugguaacucccuacuuuccucagcauggugagagccuguuaccaucuaucccauccaggcucugggcaagaagggauggccacaggggccaauauuugguggggggagggagacauaagagggagagggcggcccagaggagggagaagagccccucuccuugccauaggggcugggaggggggcauguagcccuuuaagaguggggaauggccgccccccugaaacauggcuauauguacagagaacuggguguggcaggaaaagauugugcacugggugucagggacuuccugaagccccuggguacucacucccugguauauuagggaaagaggcaaaggagcacccuuggccuuuucaggugaagguagcaggggccauugcucucagauauacauacuccaggaauaggccagcgggugguuuaucagcuguggcaucuccuacauccucucuagacagagcauggcccaagccagcaaguucugauccugguugggaccaaguaccagaaauggaguggguuagggcagugaugccaucuaagggcugggaagcucccccucugcugcugcuguggagaggucaccaagaugacccugucaccgaucagauggcugggcaagggacagugguaauccaagaagaguuaagaugcacucaccagugaguggaaggaggcuugccaaggccaagucuguaggugaagcugauccagguaucuauucggaucaggaaugaggcagugacacauuaagaagggacagaguggggugacauuaucagaggaggcagcuggcuccacccuaguccauuggagggaaugggaaauggccuguugugcugguuccccuaaagggaggaacuguaaaugccaugagaccccagaggacaacugaaauauagccugucacaacauuuggacccuaagaugauggguccugguagauggcacacaauugccacggguccuagaagaugaggacacacgguuuuacauggauucugggagaggaugauggcaccaucgcugaaguacacucuggaaaugauaacauuauuguugccauggguccagggaggugaugacaacugugauuaugguagacccuaagccauggagacacugggguugaaguagguccuggagaaugaagacacuguuggcuauuauggcugcuuggaggugauggcaccacaguuacaguaaauccugaugagucgugauaggacaugacugaugugucuagggaggugacagaaugaugguccucauagaugcucauuguauaugauacuugugacacuauuagauggauacugggaugugaugauacauggucacaagaauccagggacaccacaguuggaguggauuuuaugaaguggugacaucauagcuaugauggcuacugagacaugaagacauggcuaaaguggguccugggaggugacacugcaauuauauggagucacgagagacucuggcucuaucaguccuaacaaguccugagagaugaggacagugugguucugauggaucucaccaucugggagauggugaggacuguaugguugugauugcugggagaugaagacccccuggcugugauggaugcugggaggugaugaggugagcauguugugaaggauucugggaagcaaugaggacauaguggauccugggacaucaugaugauguguuguuuggacccugggaaaugaugacaccaugguugggagggaucuugggaggcaaugaugaugccauuaauggugauaaugccuggaaguugauaugguaauugaggugagucauggaauucugggaaaugacacaguuaacauuggaccccaacugcuaugccaucaugaaaggaggacacuggguggcauugaugaugucauuggcaaggucaacagcacauauacccuaacccuuccccuccaauagagauggggacuguguugagagcugaugucuuuagauauggcagaaagaagugaugccauccuuuggcucacccuugagucccaggacuuuagcagcccuguggaucagagcggcuguggagcugaagcucauccaugggugccguccccagggcucacugcauccccagggcucacugcacaggcccagucugccuuuacuggggcuaguagacauccuguuggcuaugccccuggggucacgcaaagaaagaagcacagagcucagcuauagggacuuaaggacucugaugacacaaucauuaugcagucacuacuguuggucaucuagaguggggaacaccucugagaaggaagcacucuaugaugauguccaagcaauagagggcaucacccccagcauccuauagaaagacccuaguaucccuagugcugacgcccucaugacaucucaggacagguuacuuucucuggccucuucccagguggccuugggcuacacaugcccaacuuucucacgacauggcacagcgauagaggugucuccuggugucauuuccaagugggugguaacugguggucacaccacagaagggccucacucuggagaagucccaagaacagguggucauuucugguaaugacaucacaugaagaggcacagucccugugauggcgccauugggcaaggcaccuauucuggugauggcaucacaggagggaggcaaaguccugugauaguauuguggaaaggaggccuaauuguuagugaggacauaacuggcagggcguaguccacugcgaugugucccaggaaaauggcuuugucuguagugguggcaucauggaauggagcuaucuucuccauggcagagaaacauuuuuccugugaugauaauugcaagaggccuuggugcucagucaggaugaugucaacaagugucaagaagugugagacuugucucuguagugacacgcaggaagaaauuuuuguuuguagggaugaugggaugggacaaggcauugucguagugacaucacaggaaaggaguuucuguggugaugucaugcaaaauggacauagccucuagugaugaccucaggcagggcucuuccucuguggugaccucauaggaaggagguuuagucccugcaaacaacaucauaaaacacagacauauuugcuagcaaugaccucauauacaggccuccuuccucugggaugacaucaugggagggaggccuugguucaaacagugacaaaguaaaaggagagaucucaucuacuguaacaucccaaaaggaggcguggucuccgguccaagggcccaucuggucucagagccuugguguguaugauaagccuuguaauggagaucugggcugggagaagggggccucggaagccacagcccccagcacuccaccgggccucagacagucacuucguucuugcuggcagugcgcaggugcuggggcagguggugcccaggaaugaacugcagcugcuccagggugcccuggcgcuggaaggguggccugcgggccagugugcccccacccccgcccgcaucagacauccaggcuggcugaggagagccaugaagggcauggugauggugggcaugcaggccugacggaggcaacccaugcaggggugugggggggcccccaggcccuagcagcagguuggagugugaggcagccaggcuggcccggguggugggaucugggggcagugcaggacuucgugggggugacagcaggugcucgcgacucuggcgaagcgccucaggugaggacagcagcagguguuccugagacaccaggcgcgcucgaggcaacgugaacucauagcgggaagcucggcuaccaucacccagaaggugcuccugggacauaacacgccguggguugggugcuggugccaggcccagcuccucagggccaccccagccauccauacgguagccaccuccagugccaggccgccggagugcaugcaagggcagcguuccgcgcggcaucuccaguugucugcgcuucagguaggcuucauccagaucuuucucagcugggggagaaaagacagaaagauccccugacaacccagagccuuccuccucuagccuccuuaccgaaaccccaggcagcacccaggagaccugaaaguuugaccaacaagagucaccaagcuaagcagggcauggugugucacaccugcaaucccaauacuggggaagccgaaacaggagggucaccauggguuugaggucagucugggcuacauaguuaguuccaggacaauguggguuacaaagcaagucuuuggcucagaaaagcaaaauuaaacacaaauaaaaccaaaaaccucgauccaauccaaaauaucucagguaauauggaaccaacuaggaaaaaagcugguaagaagacggaaaccuuuggcgccucccaucgccgccacccgcuguccaugguacugaacgauggcgacccuccccccgccccccaaucccaaggccauugacugaguccccucaccaggcuuacuuacccagucucuugagggaagaguaucgauucaguucugauuucacagcagccucauaggacgggggaagaugagagagguuguggaaggaucgggagcaggauaguguggaguagugcagggaggggcugggcggcggcauagcacgccagucuguggccgaggaagagccagucagugcagcccuccuccuucagacccauggacccgagcccagcccucccccucagacgcaggguuccauacccuuucauucucaagccggaagauccagauuccaucccucccucagauucaggaacccagauguuaaucuuugcccuuuuccgucagacccaggagucugggccucagcuuucuucccucggacuccagucuaagcucccacccuccucccuuagaccuaggauuucagaccccaacccuccucccacagccacaggggugaagaucccagcccuccuuuuucaaacucagggguccaugcucuaaccauccuuccauggaucuaagauuucagguuccagaccuccuuccgaggccuaggguuugggagguggggaucuggaguucuagcccgugaaagcugcaaccuuugggagccccuccuuccccaucucauuggacaggaucgugguugaggaugaaaucacauuccaggucggggaccgcuggcauuugucagcacccacugaauccuggccucagcuggggaugcauuccgcgcaucuucccaaaacuugacagcaaggagauccaccacuuccgguguccucucgaggacacugcagcugccuugguggggccagccccacaugagcaccagcucacgggggucugacuggggcuccacccagcaccaggcuggggcuccccacaguggggcucgaggacccccgacucccagggcgccguacccaguguggcggcguggugcuuggggcuguugacguuguagugcagguuaucugagggaccgagaagggaggugacgucacugucaucgccaucccagcagacacuccagccuggaagugugccacuucuggcucucaguucaguacaaccccuacccccucauuagaaguuauucuauuggcccuuuggggaaacagaggauaggugcucaugaucaugguugggggugagaugucccuuuuccacauucaccccaauacccaagucagaagucugguggucuccaugccaccucuuuccuucuuuccacucaagccugguggccccuccugaccucacaucuuugccuugccuggcacucucccucuaaaucaccaaauacgcccuguuuugucaucuucccaguccacauuaaggugagaagccaaucacaguggcugcucccccgacccucgacccucggcacucagaugaugccuuccgugguucacuaucccgacaggaaagguagaauaugggggugguaucugaggcuugccacagggccuuugcacaugcugcaaugcuggucucaaugccuuggaucucuuccuuucccuauuugaaugaaaucucucucaggaucuagcuugaggcuucacacagugggucaugccugcaacccuagcauauggaaggcugaggcaggcggauuucuaaguuugaggucagucuggucuacaaggugaguuccaggacagccagggcuacacagagaaacucugucuuggaaagaaagaaagaaagaaagaaagagagagagagagagagagagagagagagagagagagagagaggaagggaggaagauuaaagccugaaacuguggcacaagccuggaaucucuaguacuugagaaggagguucaguaguucaaguuugacuacauaguuugaagcccagugugaugagaccugaucugaaaacaaacaaacaaaaacaagccaaaucccacaaagaccuacuuugaauguccccucauuauuaccauugaaaaucaucuccccccccccacccugauccgguuuagacccaguucuucuguuguugcacaggcccccugagccucucaucucuucuucuaacauagcuugcguauuccagaacauggguuuuuguuguuguuguuguuguguugguggucuuuuuaaauuuaauuuauuuauuauauguaaguacucuguagcugucuucagacaacccagaagagagcaucagaucucauuacagaugguugugagccaucacgugguugcugggauuugaacucaggaccucuggaagagcagucagugcucuuaaccgcugagccauuucuccagccuaguuuuuuuuguuuucuguuuuuguuucuggacaggguaccagugugaacuggcuggccuggaauucacugagaucugccuuucucugccucccaagugcuggggguuagaggcacaagccacuaagccuggcuuccuuccaaucuuuugccaggcuggagauagagcccagggucuuaugcaugccagguaagcacccuaacacuaacuccaucccaagguucuuccuguuggauucuaggcaagggacccaugagguccaccuccagcuccucacugaugaauucuacccaagcugcaucccuaccccuugguuuucuucuuuguuugucucuuccuuccuuccuuccuuccuuccuuccuuccuuccuuccuuccuuccuuccuuccuuccucccucccucccucccucccucccucccucccucccucucucucucucucucucuuucuuucuuucuuucuuucuuccuuuucuuccuccuucuuuuugguuuuuugagacaggguuucucuguguagcccuagcuguccuggaacucuguagaccacacuggucuugaagucacacaucugccuuccucugccuccugacugcugggauuaaacucaugagcuccuaccgcucugguuuccugagacaggaucuugcuauuuaacccaggcuggccuccaacucuugaucuuccuaccucagccuucauucagaauuuugggauuauagcugugugcaucaucaucuaccuaucucccacucauguccugucugcucccugcucaaagcaccucaaugguuucccauugacuucagaacgaagaaccugagcuuagccugaagaagccucuagaacucuaagcugucuguggucucaggucugagagccucauaagcucuucuccagccacccaggguuccugcagcugaaguugcuccucucacugggaaaagcacccucacgccacucccccauuuccuggcucaaauaagaccagaacuuuuccugccuacugugaccucggggaguucucuuaggaagagcaggaugcguguuggaagaagaaauguccacagcugauggauggagacuggaauggggucagggcaucaggauugagagugucacaugaggaggacagagccacagggaugagggcauggccagagaugaggcaccaugucacuugcacucaccgagguuggagggcuucaugguguuguaaagguucuuggguguccuuggggccaugcugucugggccucccagcccuggggucagagaacugcuucuggcccgguccgggcggguugcagguccugcuugaugccugagaauauccacgagagcucuaaaaauggcagauggauggguggguagucaaggacugggaugggagggagauggguaaggguccaggacuuuuccucccuauccucuucuuuagggcauccacagugcagagaugugguccaguuuuggcuaugcaccuuuuaaugucaaccuuuccaggccacauuucuugcuugaugaauucuuuuuggaacccccucugaggucucuccacagucaccuguguggccuugccccaccaugagcuaagaccuuauaacuguuccuugggcagccuuccugguugcaauaaaagauguccuacuuguucacuugggcagaccuuucugaacguuucccuccuuguaaucuuucacaacagaccuccucaauacauugcugaucaggucacugcucagcaaguuucccaucuggaaaucacagccgcucucucuuggugugcagcuguaguccuugccuuuugucugcccucauacauagccucaaagguguuucacuugguuauaucuaucuccaguggcucuucauaacacacagaagaaaugcaaccccugccugcuccuccucagacacacaguaggaacaggaugccuccccaguguuguaguuucccucugccugaaaugacccucacacagauaccugaauggcucugccucuuauuuccuccagggucaugcucagacagacucuuucugaucuucaacuaaauuccuccccaaaccaacacuccuccuguuaacuuuuuacauugcuuuguuuucugcacagcacuugucaauaucuagaguuacguugcauauaggcuugcuggauccaccaaaaguauuugaacucaggaagagaagucaugcucuuaacggcugagccaccucaccagcccccaccacaaguauuuaaugagcacucacucagcuaggacucuacaugaaucagcucaguuaaucuccuuuacacuccaaauaagcggggucaauucuuagcccuacugucuaugcggggaagagugccuagcaucgcacagaucacaggcagaauucuuggacuuaggaaaacaggcuuauccagaaaggcuggacuuuuguucuauuuuguaucccuagccccuggcccacagaaagugcuuaagaaauacugguugagcugggcagugguggcgcacgccuuuaaucccagcacuugggaggcagaggcaggcagauuccuaaauucaaggccagccuggucuacagaaugaguuccaggacaguaagagcuacacagagaaacucugucucaaaaaaccaaaaaaauugaaaaaaagaaauacugguugaaugaaugaacucucuauaccaauucuuuucuacagccagguccuuuugucgcuucugucacugggcuuuaguuacuucccacaacuaacuuggaccucagccauccguguggccacgccccaacagguucguauucugaggcgcaggcccugucccccaccaagccacccuuauugcccagaccacauccccaagccgguugaccucucacagaguaagcccugccacuuaaucaguugcuccacuucccaguaccaagaaaccgccuccaucggauugucuguuccccagugccagguuccaggcucccuccugucccuccaaucccaauucacacuuaccugggcacguugaucucccggugcgcccugggugcacgugacgccuugcugaaggccacuuuggcaccgacgcccaccgccagggcgaaacugaugacuccgcacaccacguaggcugugcugcccccugggcccucucccccacgucccccagcgcccccggcccggcccccuuccagccacccugccuggcccggcccuggucccccaccc

SEQ ID NO: 3525 - RNA, 10706 nt, Mus musculus
gggugggggaccagggccgggccaggcaggguggcuggaagggggccgggccgggggcgcugggggacgugggggagagggcccagggggcagcacagccuacguggugugcggagucaucaguuucgcccuggcggugggcgucggugccaaaguggccuucagcaaggcgucacgugcacccagggcgcaccgggagaucaacgugcccagguaagugugaauugggauuggagggacaggagggagccuggaaccuggcacuggggaacagacaauccgauggaggcgguuucuugguacugggaaguggagcaacugauuaaguggcagggcuuacucugugagaggucaaccggcuuggggauguggucugggcaauaaggguggcuuggugggggacagggccugcgccucagaauacgaaccuguuggggcguggccacacggauggcugagguccaaguuaguugugggaaguaacuaaagcccagugacagaagcgacaaaaggaccuggcuguagaaaagaauugguauagagaguucauucauucaaccaguauuucuuuuuuucaauuuuuuugguuuuuugagacagaguuucucuguguagcucuuacuguccuggaacucauucuguagaccaggcuggccuugaauuuaggaaucugccugccucugccucccaagugcugggauuaaaggcgugcgccaccacugcccagcucaaccaguauuucuuaagcacuuucugugggccaggggcuagggauacaaaauagaacaaaaguccagccuuucuggauaagccuguuuuccuaaguccaagaauucugccugugaucugugcgaugcuaggcacucuuccccgcauagacaguagggcuaagaauugaccccgcuuauuuggaguguaaaggagauuaacugagcugauucauguagaguccuagcugagugagugcucauuaaauacuuguggugggggcuggugagguggcucagccguuaagagcaugacuucucuuccugaguucaaauacuuuugguggauccagcaagccuauaugcaacguaacucuagauauugacaagugcugugcagaaaacaaagcaauguaaaaaguuaacaggaggaguguugguuuggggaggaauuuaguugaagaucagaaagagucugucugagcaugacccuggaggaaauaagaggcagagccauucagguaucugugugagggucauuucaggcagagggaaacuacaacacuggggaggcauccuguuccuacugugugucugaggaggagcaggcagggguugcauuucuucuguguguuaugaagagccacuggagauagauauaaccaagugaaacaccuuugaggcuauguaugagggcagacaaaaggcaaggacuacagcugcacaccaagagagagcggcugugauuuccagaugggaaacuugcugagcagugaccugaucagcaauguauugaggaggucuguugugaaagauuacaaggagggaaacguucagaaaggucugcccaagugaacaaguaggacaucuuuuauugcaaccaggaaggcugcccaaggaacaguuauaaggucuuagcucaugguggggcaaggccacacaggugacuguggagagaccucagaggggguuccaaaaagaauucaucaagcaagaaauguggccuggaaagguugacauuaaaaggugcauagccaaaacuggaccacaucucugcacuguggaugcccuaaagaagaggauagggaggaaaaguccuggacccuuacccaucucccucccaucccaguccuugacuacccacccauccaucugccauuuuuagagcucucguggauauucucaggcaucaagcaggaccugcaacccgcccggaccgggccagaagcaguucucugaccccagggcugggaggcccagacagcauggccccaaggacacccaagaaccuuuacaacaccaugaagcccuccaaccucggugagugcaagugacauggugccucaucucuggccaugcccucaucccuguggcucuguccuccucaugugacacucucaauccugaugcccugaccccauuccagucuccauccaucagcuguggacauuucuucuuccaacacgcauccugcucuuccuaagagaacuccccgaggucacaguaggcaggaaaaguucuggucuuauuugagccaggaaaugggggaguggcgugagggugcuuuucccagugagaggagcaacuucagcugcaggaacccuggguggcuggagaagagcuuaugaggcucucagaccugagaccacagacagcuuagaguucuagaggcuucuucaggcuaagcucagguucuucguucugaagucaaugggaaaccauugaggugcuuugagcagggagcagacaggacaugagugggagauagguagaugaugaugcacacagcuauaaucccaaaauucugaaugaaggcugagguaggaagaucaagaguuggaggccagccuggguuaaauagcaagauccugucucaggaaaccagagcgguaggagcucaugaguuuaaucccagcagucaggaggcagaggaaggcagaugugugacuucaagaccaguguggucuacagaguuccaggacagcuagggcuacacagagaaacccugucucaaaaaaccaaaaagaaggaggaagaaaaggaagaaagaaagaaagaaagaaagagagagagagagagagagggagggagggagggagggagggagggagggagggaggaaggaaggaaggaaggaaggaaggaaggaaggaaggaaggaaggaaggaaggaaggaagagacaaacaaagaagaaaaccaagggguagggaugcagcuuggguagaauucaucagugaggagcuggagguggaccucaugggucccuugccuagaauccaacaggaagaaccuugggauggaguuaguguuagggugcuuaccuggcaugcauaagacccugggcucuaucuccagccuggcaaaagauuggaaggaagccaggcuuaguggcuugugccucuaacccccagcacuugggaggcagagaaaggcagaucucagugaauuccaggccagccaguucacacugguacccuguccagaaacaaaaacagaaaacaaaaaaaacuaggcuggagaaauggcucagcgguuaagagcacugacugcucuuccagagguccugaguucaaaucccagcaaccacgugauggcucacaaccaucuguaaugagaucugaugcucucuucuggguugucugaagacagcuacagaguacuuacauauaauaaauaaauuaaauuuaaaaagaccaccaacacaacaacaacaacaacaaaaacccauguucuggaauacgcaagcuauguuagaagaagagaugagaggcucagggggccugugcaacaacagaagaacugggucuaaaccggaucaggguggggggggggagaugauuuucaaugguaauaaugaggggacauucaaaguaggucuuugugggauuuggcuuguuuuuguuuguuuguuuucagaucaggucucaucacacugggcuucaaacuauguagucaaacuugaacuacugaaccuccuucucaaguacuagagauuccaggcuugugccacaguuucaggcuuuaaucuuccucccuuccucucucucucucucucucucucucucucucucucucucucucuuucuuucuuucuuucuuucuuuccaagacagaguuucucuguguagcccuggcuguccuggaacucaccuuguagaccagacugaccucaaacuuagaaauccgccugccucagccuuccauaugcuaggguugcaggcaugacccacugugugaagccucaagcuagauccugagagagauuucauucaaauagggaaaggaagagauccaaggcauugagaccagcauugcagcaugugcaaaggcccuguggcaagccucagauaccacccccauauucuaccuuuccugucgggauagugaaccacggaaggcaucaucugagugccgagggucgagggucgggggagcagccacugugauuggcuucucaccuuaauguggacugggaagaugacaaaacagggcguauuuggugauuuagagggagagugccaggcaaggcaaagaugugaggucaggaggggccaccaggcuugaguggaaagaaggaaagagguggcauggagaccaccagacuucugacuuggguauuggggugaauguggaaaagggacaucucacccccaaccaugaucaugagcaccuauccucuguuuccccaaagggccaauagaauaacuucuaaugaggggguagggguuguacugaacugagagccagaaguggcacacuuccaggcuggagugucugcugggauggcgaugacagugacgucaccucccuucucggucccucagauaaccugcacuacaacgucaacagccccaagcaccacgccgccacacuggguacggcgcccugggagucggggguccucgagccccacuguggggagccccagccuggugcuggguggagccccagucagacccccgugagcuggugcucauguggggcuggccccaccaaggcagcugcaguguccucgagaggacaccggaagugguggaucuccuugcugucaaguuuugggaagaugcgcggaaugcauccccagcugaggccaggauucagugggugcugacaaaugccagcgguccccgaccuggaaugugauuucauccucaaccacgauccuguccaaugagauggggaaggaggggcucccaaagguugcagcuuucacgggcuagaacuccagauccccaccucccaaacccuaggccucggaaggaggucuggaaccugaaaucuuagauccauggaaggaugguuagagcauggaccccugaguuugaaaaaggagggcugggaucuucaccccuguggcugugggaggaggguuggggucugaaauccuaggucuaagggaggagggugggagcuuagacuggaguccgagggaagaaagcugaggcccagacuccugggucugacggaaaagggcaaagauuaacaucuggguuccugaaucugagggagggauggaaucuggaucuuccggcuugagaaugaaaggguauggaacccugcgucugagggggagggcugggcucggguccaugggucugaaggaggagggcugcacugacuggcucuuccucggccacagacuggcgugcuaugccgccgcccagccccucccugcacuacuccacacuauccugcucccgauccuuccacaaccucucucaucuucccccguccuaugaggcugcugugaaaucagaacugaaucgauacucuucccucaagagacuggguaaguaagccuggugaggggacucagucaauggccuugggauuggggggcggggggagggucgccaucguucaguaccauggacagcggguggcggcgaugggaggcgccaaagguuuccgucuucuuaccagcuuuuuuccuaguugguuccauauuaccugagauauuuuggauuggaucgagguuuuugguuuuauuuguguuuaauuuugcuuuucugagccaaagacuugcuuuguaacccacauuguccuggaacuaacuauguagcccagacugaccucaaacccauggugacccuccuguuucggcuuccccaguauugggauugcaggugugacacaccaugcccugcuuagcuuggugacucuuguuggucaaacuuucaggucuccugggugcugccugggguuucgguaaggaggcuagaggaggaaggcucuggguugucaggggaucuuucugucuuuucucccccagcugagaaagaucuggaugaagccuaccugaagcgcagacaacuggagaugccgcgcggaacgcugcccuugcaugcacuccggcggccuggcacuggagguggcuaccguauggauggcugggguggcccugaggagcugggccuggcaccagcacccaacccacggcguguuaugucccaggagcaccuucugggugaugguagccgagcuucccgcuaugaguucacguugccucgagcgcgccuggugucucaggaacaccugcugcuguccucaccugaggcgcuucgccagagucgcgagcaccugcugucacccccacgaaguccugcacugcccccagaucccaccacccgggccagccuggcugccucacacuccaaccugcugcuagggccugggggcccccccacaccccugcauggguugccuccgucaggccugcaugcccaccaucaccaugcccuucauggcucuccucagccagccuggaugucugaugcgggcgggggugggggcacacuggcccgcaggccacccuuccagcgccagggcacccuggagcagcugcaguucauuccugggcaccaccugccccagcaccugcgcacugccagcaagaacgaagugacugucugaggcccgguggagugcugggggcuguggcuuccgaggcccccuucucccagcccagaucuccauuacaaggcuuaucauacacaccaaggcucugagaccagaugggcccuuggaccggagaccacgccuccuuuugggauguuacaguagaugagaucucuccuuuuacuuugucacuguuugaaccaaggccucccucccaugaugucaucccagaggaaggaggccuguauaugaggucauugcuagcaaauaugucuguguuuuaugauguuguuugcagggacuaaaccuccuuccuaugaggucaccacagaggaagagcccugccugaggucaucacuagaggcuauguccauuuugcaugacaucaccacagaaacuccuuuccugugaugucacuacgacaaugccuugucccaucccaucaucccuacaaacaaaaauuucuuccugcgugucacuacagagacaagucucacacuucuugacacuuguugacaucauccugacugagcaccaaggccucuugcaauuaucaucacaggaaaaauguuucucugccauggagaagauagcuccauuccaugaugccaccacuacagacaaagccauuuuccugggacacaucgcaguggacuacgcccugccaguuauguccucacuaacaauuaggccuccuuuccacaauacuaucacaggacuuugccucccuccugugaugccaucaccagaauaggugccuugcccaauggcgccaucacagggacugugccucuucaugugaugucauuaccagaaaugaccaccuguucuugggacuucuccagagugaggcccuucuguggugugaccaccaguuaccacccacuuggaaaugacaccaggagacaccucuaucgcugugccaugucgugagaaaguugggcauguguagcccaaggccaccugggaagaggccagagaaaguaaccuguccugagaugucaugagggcgucagcacuagggauacuagggucuuucuauaggaugcugggggugaugcccucuauugcuuggacaucaucauagagugcuuccuucucagagguguuccccacucuagaugaccaacaguagugacugcauaaugauugugucaucagaguccuuaagucccuauagcugagcucugugcuucuuucuuugcgugaccccaggggcauagccaacaggaugucuacuagccccaguaaaggcagacugggccugugcagugagcccuggggaugcagugagcccuggggacggcacccauggaugagcuucagcuccacagccgcucugauccacagggcugcuaaaguccugggacucaagggugagccaaaggauggcaucacuucuuucugccauaucuaaagacaucagcucucaacacaguccccaucucuauuggaggggaaggguuaggguauaugugcuguugaccuugccaaugacaucaucaaugccacccaguguccuccuuucaugauggcauagcaguugggguccaauguuaacugugucauuucccagaauuccaugacucaccucaauuaccauaucaacuuccaggcauuaucaccauuaauggcaucaucauugccucccaagaucccucccaaccauggugucaucauuucccaggguccaaacaacacaucaucaugaugucccaggauccacuauguccucauugcuucccagaauccuucacaacaugcucaccucaucaccucccagcauccaucacagccagggggucuucaucucccagcaaucacaaccauacaguccucaccaucucccagauggugagauccaucagaaccacacuguccucaucucucaggacuuguuaggacugauagagccagagucucucgugacuccauauaauugcagugucaccucccaggacccacuuuagccaugucuucaugucucaguagccaucauagcuaugaugucaccacuucauaaaauccacuccaacuguggugucccuggauucuugugaccauguaucaucacaucccaguauccaucuaauagugucacaaguaucauauacaaugagcaucuaugaggaccaucauucugucaccucccuagacacaucagucauguccuaucacgacucaucaggauuuacuguaacuguggugccaucaccuccaagcagccauaauagccaacagugucuucauucuccaggaccuacuucaaccccagugucuccauggcuuagggucuaccauaaucacaguugucaucaccucccuggacccauggcaacaauaauguuaucauuuccagaguguacuucagcgauggugccaucauccucucccagaauccauguaaaaccguguguccucaucuucuaggacccguggcaauugugugccaucuaccaggacccaucaucuuaggguccaaauguugugacaggcuauauuucaguuguccucuggggucucauggcauuuacaguuccucccuuuaggggaaccagcacaacaggccauuucccauucccuccaauggacuaggguggagccagcugccuccucugauaaugucaccccacucugucccuucuuaaugugucacugccucauuccugauccgaauagauaccuggaucagcuucaccuacagacuuggccuuggcaagccuccuuccacucacuggugagugcaucuuaacucuucuuggauuaccacugucccuugcccagccaucugaucggugacagggucaucuuggugaccucuccacagcagcagcagagggggagcuucccagcccuuagauggcaucacugcccuaacccacuccauuucugguacuuggucccaaccaggaucagaacuugcuggcuugggccaugcucugucuagagaggauguaggagaugccacagcugauaaaccacccgcuggccuauuccuggaguauguauaucugagagcaauggccccugcuaccuucaccugaaaaggccaagggugcuccuuugccucuuucccuaauauaccagggagugaguacccaggggcuucaggaagucccugacacccagugcacaaucuuuuccugccacacccaguucucuguacauauagccauguuucaggggggcggccauuccccacucuuaaagggcuacaugccccccucccagccccuauggcaaggagaggggcucuucucccuccucugggccgcccucucccucuuaugucucccuccccccaccaaauauuggccccuguggccaucccuucuugcccagagccuggaugggauagaugguaacaggcucucaccaugcugaggaaaguagggaguuaccaccaaucuuccuaaaugccagcaccagguuuucggccucccaacuaauagaugcuccaugggcuccgcauccauucuagggccucccuucaagugugcuuaacacucccauggaacacacagcuuucuccaagcccuggagagguucaggggcuuucagcuuuuguuugcccacucucucuuucccuucaucccuccccaaaccugaauuccuuccuuccugggaucugcccucaccccagccuccacccuccaccugccugacccugaagucuugaccucuuauuucaauaaagccauaguggggagaggucuugagggugggccagcaggcccuguucugcucaucccccaccaucaccacgaugcuuccagaauugggaccuggccuucugagucuuccccuccccacccccaccccugcuccccaauaaacacaaauacacauaggcagggugugcccaugcaggaaagcucccuucuggcugggggcugcagagggggugucagagacaagaucaaagugccacaccagagguuccucaggccucugaaccccauucuuacuccccuccccacacuuccuuccagugcuggacucaccuucaucuuccuggugaggacagcaaaaggagcaggcacuuggcugggggugggguguugguuuuuguuuuggaauaaacagcuguuuuccugau

SEQ ID NO: 3526 - RNA, 3474 nt, Mus musculus
gucugcgugcuaccauguuuccuaagaugauaauggacuaaaccucugaaccuguaagccagccccaauuaaauguucuccuuuguaaggguugccgggaucgugguaucuguucacagcaauagaaacuccacccuuagcagguaaaauuccaaguuuccuggaauacaagcacuccgguacuggguaacugagauggugccuuaagugauuaccgaggcggggauggggguggggguguagcauauacagcguggauacacuagacacaggauuuguuuucuaacugcaguggauggcauacuguuccauacuguucagaacagaaugcaaauuaagaugacgaaugcuuuaauucuggaauuuuccgugugguauuugaagaccaagauugauugucuaaacuaaaacuagagagaccucagauuacacggggcugugggggguggggugacggggguuccgggaaugcucacacaaauggaacaggagaaaagggggccugggaccuugagcuggaccacccaacaucaguauagauauuucgcgcccccuggcggaucauccccaaguugcaagcugugugcucaggcuggacauggcuuggaaacagaggagcucguggauguuucucuuggcugcuaggagcaaggaauccaggucaacuucuggaacugagcuagcaaaaaugcuauuagcuacagcaguggugaccccuggcuggcccugggagugugagccuuucauucgacucuggagagacccgagaguacacuuccagcaacucuggaccaaggaauuccagccuucccccaccuaccaagauuuguaaaaaauagacuuuaucuggacguggagacaagccucccuaaggaaccacccauaggaccuagguguaaguguuaacagcucugaggggaaagguuuccuugacccaaguguugcaguuccgcuauucuguaaguuaggcgccaagaaauaccacaaaguugcacuacacaucaaaucuuacucacauaagagauuuacugggaaagacacaagaggguggcugccucugcucaggugaaaagcagcaaagaacuggacaggaagcgggcuucauauagaauuuccugggugggacggucagaacuuucuaagguggucugggcuuguugggauucucuggucucuucuugggcucccccuccccuuuccuuuccucuguaggacagagcuuggcugcuugcaucucuaugggcuggaaauggccuuuaugguuguuugaguagucugggggcagggccuggccacuggcucuccuccagggacuuacacucaaaagggugguucacuuuaagauaauauacuuuuucuucccagaauucucucccacugaugcagucucagguucagcugggucugugugcuuccuuagaaaggaguaaauaacuguuuuuccuuucuucuuuuuccaucagacucuagccagagccugagugugcucuuaaacguccucaccauggcuuugggcuuccuugcucugcuguguggcuuggcuaccugcugucuuguggcugacuucccaguucaucuucucccucccuucuccuccucuuccuccuccugacaacugugagcuuuacagcuugccugcucugggacuuucuucuuuucuuuucuuuuuuugaguuagagucuuuacuagauauuaguucaggcagaugccuugguucuggauccccucucccuuuaggucacagugagcggguuucuucagaagagccuguggggcugagacuucugagccccaugggcagaagcagaacuggaaagccucaaauacaugcugcuuccaugcuuccaggcugggcagcagggaggagagcccagggcucuccgucagacaccuuggagguuugguaggacagcagcuguacacccgccucugccgggaggccgaucacaggguuggagggcugagcugggaacgugagcagggguuggccccugcauaguggcaccucuagucugaaaacaguuccguugagcaccugcagcauugguguggugcccugguagggaguaccagucagggccacagucaggaggcauuccccgcugcccugcuccccugggaccccaggguuguggaagauggugacauugaggccagccucuuucaccaguagcuuagcguucagcaaguucaugucugccugcuuagaugcuucucucagaaggccgacaaugacuacagggcucaggcaggucccagcauucuucagagauguuccuuguguaaccaccuggauggucccuuuaggggagccagcccaggcgugcaucugccagaccaauccaaggcuuaguguguggagagaaggcacuggugagggccugggcguucacgacgccuguuagagauuuccccuucaccauguccacaaacuggacugcgauuuccuccccacagcagcucugggccuucuuggugcuggcacccagguggagacagcugaugauguucucgugguccacuaaggcccggugguggcucuucuguaaauauauccagugcagccccagcacauugaccagaccgcaggccaccuucauccacaaugccuccucgagcacaguucaccacucgcacgccuuucuugcacugagcaaaggugcugucaugcagcaagccugugguggagggcaggagagggguauagauaguuaugaaaucacagagaggccagaucuccuccagcggcagcugcugaacaccaaaggaggccgcgacuucaggagagaugacggggucauagccuacagucuucauuccaaaggacugcauucagguggccaccucucuuccgauucugccuaggccaagaauucccaguaucuucccguucaauucugucccgugaacuucuuccggucccauuugccaucuuucaucgaagccgucgccuggagaaucugccuggccagacacaugaucaucccacaggugaacuccgcagcacugaugcuguuugcauuggggguguucaugacuaagauguccuuccucauggcagccuccagagccacauuguccacgccuguacuagcccugcccaccgccuggagcuucucugcugcauugaugacaacagcagugaccuuaguagcugaccggacaauaaugccuucacaguccugcagcucggcugucagcuccuucuugcucaaguucugcuucuccaccaccugcagcccuccaucuugcaggaucuuccggcagcagggcuccaggcugucacugaugaguacuuugcucagauuugcaaaggccauugcuagagucaagccuuagaaucaguugcucugggugggcagaagcacuuaguucaaaaacugcaggcaagggcuggcucuggugacugggcaggaauuuucuuuuguuuuuuaagacagauuuauuuauuauuauauguaaguacacuguag

SEQ ID NO: 3527 - RNA, 6789 nt, Mus musculus
aagagauucugggucuuuauuagcaaguccagccagcagccccccugacucuggggcugaccccagcccagcugaggagaacaguuaauugcggggagggggucucuucaaaacguguguaccaguuggacugcaggaagagucugcacaaucuggauggagggcaaguucuggggagccaugaccccugguccagccacugcggggaccacuuguaccaucugggacgggggagcuacgggcacccccacaggggcagagaccgggccaggugcugacggggccaggaguugcaguguuguggugccuccugcaacgcugcuauuuucuagcagaucaguagcuggggcgcuacgaaugauaaggaguuucuguccugaugggccaguggccgcuggcuccgccagaccgggggaaagcguuuccaccuccugcacgcagagccuagucugcucaccauccgccccacucagcaccagcacacucugcagccccucaucugucugcagugucucaaacaggacguccuggaccacaccagcaccggccucacugucucccacuuccccgggcccagggccggucagcaacucuucaguugccccacucugaaccagcagcagguuuggagcuucuguagugccagcuccuccauuagaauuggagacuuggccugucaggggcuggagcuggaccguagucaccuccugugcugguuguagcuggacuguagucacuuccugugcaggcuguaguuguaccguggccacuuccugugcuggcugaagcuggaccccacucacuuccugugguccugucuccccacucccuacauucugcagaacaaugaggcucugcccucccccgcuagccccugcauuggccccuccuugcagccccagaccaccugggccuggaaaccacaccaccccuguccccuguccagcuuucccaacagaccgagggccuggccuugcagcaccacugcccggaccuccagcacuggcaggaggcagcagaaugacuuuaggggguggaggcggggguggaggaguaggggauuggacacugcuuggaaucagcuggaggcccugggcagucuguaccaggagaaauguuugagaacugggagcagccgggccugggggcguaggcugggcuguucccccagcuacuucaagugaaaguguggccuguagguuagggaguacgugaacaucuugagcagccaguggaguuggagcugcagccaauggggcagggggcugcgaugcuacagcagagccgguggugcccgaaguugugguggcuggggugugcguccucagaugccgcugcagguaggcagccauaacaaagccacggccacaaauggggcaggcaaaagggcgcucggcagaaugagugcgcuggugcagcagcagguuggaggagugugugaaggucuuggggcagagcgggcaacggaaggggcgcucgcccgugugcacccgcuggugcugccgcaaguuggacgucugugcgaagcucuugccacacacacuacaugaguggggccgcucaccggugugcacaugccgguggcgccgcaggcacgaaguguuacggaaggcuuugccacacucagugcaggcauagggccgcucacccgagugaagucgcagaugguacugauagugggacgaccacuugaaggugaggccacacuggccgcaggugaaggcucgcaggccugugugcacacgcugguggauggccagcagggaggagcguuugaaggcuuugccgcacuccccacacugguagggccgcucaccuguguggucccgaaggugguagcgcagcccggaagaacccuugaaggccuucccacacucggcacauuuguagggccgcucugcagaaaccaccggggcagguggaggaggaggggguggggcaggaguggcuggggcuacagguuccuggggacaggugaccuccgcaaccucagccuggggaggugggcguccggcugccgccuccuccacgugacacugcuggugagccaagaggcuggccaguugugggaaggcaccaucacagcugccacagcgaaaggccuguccacuggccgcaccauggcugugcuggugacgggacaggccagccaccguccggaaggacuucccacaaggaagacaagcaaaguuaggagggccuggaguggcaggugggggcugugguagggcggagucagccuggggcagcucggcaggcacauccugggacuggguggcuacagggggccccgggcauggcuggugcuccaggaggagcuccucgcugcugaagcccugcucgcagccaucgcagcgguacacuagcuccacuguagucucagcagcagccaaaaaaagcucgggcaccacgggugggggcuggggugguggggcuggaggcucaggcgggcuacggggcugcaaguaggcaucagagaccagaaccuuggugucagcucugcuggucuccccugggggggcgggggcaggggcggggccgggggcagggccgugggugcgguggugcagcagcagguuggaggagugugugaaggucuuggggcagagugggcaacggaaggggcgcucgcccgugugcacccgcuggugcugccgcagauuggugcucugaguaaagcucuucccacaaaugccacagguguaagggcguucuccugugugcacaugccgguggcgccgcaagcuggaggaguucuugaaggccuuggggcagucagggcacggguagggccgcucaccgguaugcugucucaagugguauugguaaugggaugaccacuugaaggccagaccacacuggccgcaggugaaggcccgcaggccugugugcacacugcgguggaucugcagcaaggaagagcgcuugaaggcuuuggggcagucugggcacugauagggccgcucgccuguauggccccgcuggugguagaggagggcugaggaacccuugaaggcuuuggggcaguccgggcauuuauagggccguucaccugugugagugcgcugauggugcaggagccgagaugaccaccugaaggacuugccgcauuccccacacucauacugagcagcuggggugggugcuggcgcagugggcccuggcuuuuccccaguucccucggugguggaagcuggcgccauguccacgugggagccggccaucacaccuggugaaaggauucugaucagaaugagcaagcacuggaccuccucaccacucacagcggcucuucaaggaacaggggcagccucccugugucgcccaugcugugggggcucuuccuuagggggguuugcaacagcguggguuuaacacacauuaucgaagacucaagggaggaguaauggggcaccugggaugugaaacuucucagcaaaagagcuccucuaggaagcaaacaguuccaaaaaggggugcucucuaaacaauguccugccuucaggacacuggcuccuucugucaucagucccuuggaagaagccucuggcuuggcuucuugccuauuuugaagaguuacguccucagcacucaucucccuacuucacccuaaacaauuucacucuaaggaaagccacugaguagggaucaaggcucaggcauccacuccagcacccacuaccugccucauucccucucagaucccccaaaucccuagugaggaugcccuguucccacaggaucugcaaccucuuuccaucacgcaguguuaccagccuuguacacacucucccuggcacacccugccugugcauauauugaugcccgcaacucaacauagcccaugccucucagcucccagcacuuucucugaucuccaugcccccccccaccaccaccaccagggauaacccuuagcauguuucuucucccacugaaauccucuugcuucgcuguccuuagccacuggccgugcugaugacuggaaagagaagagcgaucugaauaauaaauauucucauccuccaauccaggcaccaacaggucccaaacgagccaaaugucuuuccacccaggaggcaucuugugaugucuggagacacuggcuguugcuugucugucaagggcagggacagaggugcuucucagcacccuacagcacacaggaugaaucccuacaaagaugcaguccaaaagaguagcagcugacaacugcaaggguccccgcccccaaauacucuaugccauggccucugaccucccauggcauccucuagcaguuugcuucucuccuggcccaaucccagcagcauauguaaggaaacaagaccccuuguuccacuucccccagcccuuuauaugucagggggacuaaccugccccucccucuggaaccacgucaggugccugcaguccccacauaccccagcuccuuguaccugcaguccccacauaccccagcuccuuguaccugcaguccccacauaccccagcuccuugcugcugagucuuuccuuuaagcauaucuccuagcugcagauggcugacucucccuucugugaccaccuuagccuucgggcuggauccuucuaaaccuggagguggagaaucagagcucagucaagaacugcugucuuccucucugcccccacugccccucucugaaagcccuuacccuccccuaggauuccacaaucuauagaaaacucuaaaagugugacucuacccaggccucuccuuugcuccaaaugcuugggacacaagauaccucacacuuaaccacaaucuaacuccaggucuuucucccucuaugcucuccuguuacaaaacuuaaggguugggcaggagauguagcucaguugauggagugccuauccaacacacacaaaguccuaggugugagccccagcacugcuaaaccaggugugguaagaggaggcuaagacaggaggaugagucugaggcaaaccuggauaguagucacaccuauaaggggacagaagacaaacucccuuacaggagccugcugacugcgcauaacuacguccgucuucuccccucuugcaggccuccugucccucuagccguucaacuaagcagggaaagcuaccaccaccuuaugccuagugcccuuccccuccaccauccacaacucacacugucaccuccaagucuucaagaacucaccccagagagccuuccucagaccacccuugagcacucccugaucuccucccaugccuuauuugcucccuucuucacggggcccaucaccuucuaaauacuauagggcaagcauuucucuuugucuuuuugagacacaguuucucugcacagcccuggcuguccuggaacucacuaccuagaccaggcuggccucgaacucagaugucugcaucugccuccugagugcugggcucaaaggcgugcaucaccaccacccuagccaggacuucucaaccucaccagcacagagauuuggagacaggucauucuuugucagaggggcugucuaauaaauggauggguguucaucaggauuccugacucaauaggauggaugccacugguaacaaaacacagugccagcuugacccuucccuaguaaauccugaagucaguacugcagugacaguaccccaggacagucccaucaacauauaagucucuuacugcuuguucuacucugucaauguucacaucauccaaacagagaaccucugcuucguucgaucgaucguucucugaugcauccaucacccaccaaaacaucaggagagagcaugcucaguaaagacagucugagugaagagagggaggcacccccuuuugacagguuauaaaggauuucuuuuucaaagggcaauaggcuaugaaggauuguuuuuuuaaagggcuguuguuccuuuuggcguguaggugacaaaugagguucagaaacugucugugccucugaggccauaucuuuuaacacaagaggcccaacggaacagggacccaucuuagcagugagagugcccuuuaagcgucugggcuuuacgaggaagcucuugggguuugggauguagcucgguuauuaaggguuaaugacuggcaugcacaaagcucuggguucuugucacaguacaccauagaacugggcgugguggcacaggcaggccuguaaucccagcgcgcagaugaaggcagcaggaucguaaauuuaaggucauugucagcuauacagugagucugacggcauccuaagcuacaugagguuuuaucugggagggaaaaaagaucucuuuguucagauagucuagggaccagcagaauuaugaaacuuuuccuucaauguuugggaaacuaucacccgcuuuuaaggaaauaacccccuuuuaggagaaaggggagaagggaaagggcaggaagcuuugcaaaaaugcagcuaaacacacuguccuuaccccuuuaagagggcggagccggccuaacagauuaaauaucggaggcgaaauagcgaccuucccuuuaagguaccccuuccgguuucccgcucgccguucuccaaacgacuccgcccuccggcccuucccccaccgcgcccuccggucucucaccuguggccccggucggggagggggaucaaggagaaccccagggccuucccgcgggggcugacgggaagcggggcccggcacagcgcugcgggacccgcggcccgggagggggcgggggcgcgcucccuccccacggcccccggcgcgaggcacucaaccuuuaucggcggccucucgcgcacacaaaccc

SEQ ID NO: 3528 - RNA, 2983 nt, Mus musculus
agguauagucaugggcauagccccugcuucagaccuggaagucuucauucuugcuucccggaucugaggugacuugcuuuguacuuggagggcuaaaugcuucuccggggugggguccagcucccccauccuuuaaacuguuaaggcuuuuacugugcugggggugggagggcggguacacuugcagaggacagagagacagugggagucagucauguggguuuccuuuuggcaagcucucuuacucccugagcuauuucucugguccuuucccaaccuuuguauguauucgucuguaguuguacuuauagcagggaggguuagggaucaauuucuggauuuuccacuucuuuccuauaaaccacccuuaccucaccugaaagguagguagaggaauauuauuaauucaaacgauaccccaggugccuccggguugagaauaaggucucagcugauggggaugcuugaugcuaccccucaucccuucccucaaagacccaagcgccaaugagauuagguucacaagcaacgccuccucuuccugaugcucaggucgcuuagcaacgaaggaccagcaagaaaggagcugugcuaauccucccaggcaggccggguaagaaacccucucugucccccacucccauccccccuucuccaagguucucccacuggccuccagcaggucacagcucuucccucguccucgcaguuuccuccauuacucccaaccccugccccauagugggggaagcuuggcaacaguugcuaaggugccggucuugccuccagucgggagcguggacgucacuuccgguggugacccucuccugccccugccccccuucucccuuacugucaagggauucgagcaaccccguggaggugccuuucagggcccuguuucugcuauguggggugggaccacuucaggagaccggcugcuggaguuuggauaggggaugaguuuacaggcagaucaaugaaugucuucuccggagugggggacgauucgggacgauuuucagagccccacuggguauggaggcaccuggccugccacugugacagucuucuuuggcaaugcucuaggguccuuggcgaucugggaaacacugcggcccaucccucccagggcucuuagaacucaggugcccaccuaacaccaaccuacuuguuuucagcagguguacaacgucagcucccuuggggaggggccugccugggggcuaccauggccccuaaccaccugucagugcgggaaaugagggaagaugagaagccccuggugcuggagaugcugaaggugagaggccggcaggggcaccagugagcaugcgcagcuucuuagggccauucaaaguggguuccaucagccccgcccaccugccugagcuccggggguccugggggaggggauuuucgccucagcuguuuuuaauuggucucuuuucucuacugccuucucccuacuuaaaccucagcugccauuuuuaaaaaagcaauugaaaggguguaggggcuggguguucaggucucuugaccuccauucagccccacuuaccagucccaaaaugagggcuacugagacacacacacaccccagaccuuccagcgaagagcccaugucuucacuuugccuauccuguucagucuccuuuggugcguuaccuuagcaugccauccggacucaugggccucagguccuaaaucaguucauuucauucgggcaaaccgcauucauucgcucagcccuuaacacccaaugggccagacugggaccaccccauccgcuggcuucucuucucacuugagaagagaaauccuuccucggaaguucuuaugugaugaauggcugagccucuacucccacccacaggcugguguaaaagacacggaaaaccguguggcccuccacgcucugacacgaccuccagcccuucuccuccuggcugcagccagcagcggacugcgcuucauccuggccuccuucgcccuggcccuccugcugcccguguuucuggcuguagccgcugugaagcuggguuugcgagcccgauggggcucucugccuccaccaggcggccugggagggcccuggguggcuguccguggcuccggcgauguguguggaguccuggcucuggccccuggugccaacgugggggauggagcccgagucacccgccucucugucucucgauggcaccgucgcaggggcgugggcagaaggcugcuggccuuugccgaggcucgagcccgagcaugggcuggaaguaugggggagccucgggcccggcucguggucccaguggcuguagccgcuugggggguggcaggguuauuggaggccuguggcuaccaggcagagggaggcuggggcugcaugggcuauaugcugguuagggaauucagcaaagaccugugauuagagaccaugcccacuggauagaugggcagagaaccagcaccuaaagaacaccuacugugugccaggcacuuuacaucccccccucagugucuaccuagucugcugggcugauagugaagcaccgagguugauggacuuacauucccagugugccugccagcugcaaugaggacucuaaacucaaguagaacaaaucccuucuuggucuucugggaccacuagaggucaccguguccaguccuuugccucacccccacugccccagucuguaugcacugaaaaacgucggguucugggucuacaaagccccugcugccuguguuugaggucuggaagggagauuugaggaaagagagagagagagagagagagagagagagagagagagagagagagagagagagagagagagagagacuaaaaguuagagucugugacagggaacucccaaaggggacagaucuucugggaguggguggggccaggagcacagugucuccaagcccaucugguuuuuuacacuguuuguuaauaaacccugaaacuucugugugc

SEQ ID NO: 3529 - RNA, 19046 nt, Mus musculus
ccccugcugcaucccugcagccucucucccuccuggcagagccuucagcccagccugcuccuagcuguccagggcuccucagcagcugcuucccucccuggcugccuccuccuccccucuccugcccuccuuccccuuucaccccauccccugccccuggacucugcgaacaugaggggcuuggccugccuccuuggugagugauccauuuccuuggggggggggguaagcaccuuaggggccuggacccuuaccucugacccaguuagcuucuccaguuuaggggcucauacuugagggagccuguucuggucccuggugcagugugauauccugacaucuggcuggccccucuaaucccugagggacccagccuucugcacguccugccuagcagcucaagugaccugcccuuuguugcccugucauguacucuguagcgcuaucacucccaccauucaaucugguccccaguccuguuuucaagggucaggcaucuggggccccacccaccccagggaccuguaacuuaucccagccuccucccaaaguccauuccagcagugggguuucugacucagaggugugaggaaucugacugugaaugggugcuucccacuguacugaggcugggagccugcacuggggaaaggaccccuccccucugauuuauccuucacucuguccccuccaaccuccuuugcagcaaugcugguggggauccaggcuauagguaaguguccugauucuacacuuggccucaccccgcuccaacucccccccucuccuucuggucucugcuaccccaauuccacuccccagacauugcugccauccaacagggacaaugagucuucucuagaguuagcugcacgcugaccuaugggagaggaccaaaguuaugaggccagugauggggagaggaguggaaagguuauuugacccccuuguggggcagaaggaccggggaugccugaauucccugguucacaguguccuuccacacagcccccagcaucucugagacauuccucucauugcaccugggagucugggaccaggguccagccuccaggguagcuggcuuccuggugguagcuuguaagguagucccccugccuugguguuaccguagacccccagccaacaguacuccuguguggggucacagcuuuuccuucaucccucagagcgacuccgccuggcugaugguccucauggcugcgcaggacgccuggaggucuggcacagcgggcgcuggggcaccgugugugaugacggaugggaccuucgggaugcugaaguggccugccguguguuaggcugcggaggggcgcuggcagccccugggggugccuucuucggggagggcacugggccuguauggcucagugaacugaacugucggggcaaugagggucagcuggguaucuguccccaccggggcuggaaggcccauaucugcucucaugaggaggacgcaggcgucgucuguguagguaaaaagauucaaauuccucuuaugguuauggccccaggaacccugcccuuaguuccugcagaucugaguugucuagaagcuaagcgguaaccaacuccagauccccauaagaccaggugcuccccucccaaggacucccagcuuaugagcacuuauuucugagccacaggaaauucaggcaucccagcuccuccugucccaggggucaaaugaccuuucuacuccuccccccaucacuggucucauaacuuugguccucucccauaggucagcgugcagcuaacucuagagaagauucaaugucccugcuggauggggauccauggcuggcacugucuggggagcuaagccccagcucagaggagcccccuauaacucacggugagcacaaaggacaggccucccaucccgcacccuggucagacucagcuaugggggaagguuauccugcaaacguuuuucuccggcaagcuagucuccuucauuauccagaaauccucuguccagaaaucuuucaaacccucagaaaagaaucccgagacagaugccaaggaguagggaagagugaccagcugagcuccugacuuccuggucacgugucacuuuccuagcuccccaaccagcagcaagcucccagaauggcccccggaagaagaacccccggccacccaagcagaccaaguccacccgagccccuguacugacaaauggagcuccccaccaagguaaggcucuacauuucccugucuuccugaucugugugcuacgagacccuagacccugccaaacugaggacccuagaccuccauucagccugugacucucuaaggagaccggcguucacagugccccuucagauccagucagggcuggccaccuccucuucuuuauccucccucuaugagacccagggggguggccggucucuuuucugaauuagguacuuggcagacaaaucucagucuucugcucuuccugggccucaguuuccccaguuguaaacaaacaggaagcugcccccuccaagcugacauuagacuaagccuuuuacagucucucaucuucccugguuguauuccucuccccccaccccuccccagagcggcugcgacuggucucagguccccacggaugugccggccgccuggaagucuggcacgguggacguuggggcacugucugugaugauggaugggaccuccgagaugcagcgguggccugcagggagcugggaugugggggagcgcuggccgccccugggggugccagauuuggaccuggugagggaccuguguggauggaugacgugggguguggaggaggagaggaggcccuccgagacuguccccgaagccccuggggccggagcaacugugaccacaccgaggaugcagggcuggucugcaccgguauguauguauguauguauguauguauguauguauguauguauguguguguguguguguguguguauauauauauauauauauauauauauauauauauauauauacauacauacauacauacauauauguaugggcagcuacccgcucuucagaucucagcuccucccucccccaggaagcaguaaaaggccuagccucgggucugucucucuacacauucucugggagaggcuuagccugcugggccucagcuuucuugagggagcaacuagaaacugggaccaagaguaaggggccauggaagggcacuuggguauuuccuccuccauugcuccucuccuucuucucccucacucccugucccucuugccuuccuccagccuucuauucccugucagcgcccauccugcuucuucaguggucuaacccagugucuaaugugacccuugcaagccuacucuaguuuuccuucuugguauaaguguaggcacucauccauucuaaccacuuaucacccugaccucuguccuccuguuucagguccugcacccaggauacgccuugcugaugguccccacggcugugcuggccgccuggagguguggcaugguggacgaugggggucggugugugacgaugccugggaucuucgcgaugcugcuguggccugcaaggagcugggcugugggggugcccuggccgccccagggggcgccuucuuuggagaggggacuggacccaucauccuggaugaucucagaugucgaggaaaugagacagccuugcgauucuguccugcgaggcccuggggucagcacgacugucaccaccgggaggaugcuggggccgugugugaugguaaggguguaugggugaugucaguggggaaagaugggacacuguguguguguggucacuggaguggaugggaaagaaguguugucccaguucagccuuuacuuccugugugauuucccucuuucccuaucucauauucuuaugugaaaccuuaugccaaauuaacuagggguaacuaggucucccuaaggggcacuggauauuauuugguauuugguggucauaaugagggggugagcccuacuuccuugcuccuaguggaagccaaucaaucuugccuugcuaggugccuccucuguuuucucacuuccaaacucccuccauuuccugcucucucuacccucuucuuucuauccacuucuuguugcggcucagaguuguggaagccuugggccuguguaggaggcaguccuggagguggugcuaaugucgucuuuccugccccaggcaugccucucggugcugugcagccuacaguuccugcaguggacagcaacagcacagcacacaggcuucugucuaccuccgugggucagaugccaggcccagcaggcccuuggccuccuucugcuucuccuacugccccuccagagccugggcccgaagcuggugagucccucucugcccuagcucuaagacugucuccaugaaaccugcuuacaaaaaaaaaagguagaaaagaagagcccaaaccccugcucagaucaguacuugauuaaugcucugcugauagccuaaaauccaggguugcuuguaagaguucucccuucuguagcuggcccugaccuggagaggagggugggcacgagagcccacugccuaacgucuggguucuguggugggacuguuacaguguccucuggcuagccacugacugcucuuccagaggaccugaguucaauccccagcacccacaugguggcucacaaccauccguaauggaaucugauaguguacucauauuagaaaaaaaaaaggaauuguucugagucaggcggugguggcacacaccuuuaauaccagcacucuggaggcaaagcagaggcagcuugggcuacagagugaguuccaggacagcccggccuacacagagaaacccugucucaacaaacaaacaaacaaacaaacaaacaaacaaacaaacaaucagggcucaauuggguaagugcuuaacuugcaagcacaaggaugugaauucagauccccaguagccaaauuaaaaaaaaccuagguacagcaguggauaugucuaacuccagcacagggugggagagauccuuggggccugcuagccagucagucuggccaaaucagugagccucaagcucagcgagagacccugucucaaaacaacaacaacaacaacaacaacaacaacaacaaaccaagcuagagaaugaugucaaccucuggcuuccacaugaaugcacacacacguacauucacacaaacacaaguugucucucaggaccagaggaugguccaguagguaaaggccaccgagccugauggccugaguugaucccuaggacucacacugugcaaggagaucccugacucuuaaauuuuuccucugaccuucacauacaugugguggcauacacacacccuugugcauacauacauacacacauaaauaaguaaauaaauaaauguaauauuuaaaaacuccaaaaaauaagauaaaauaacccccuuggugcagugggcacgguacuccugcaauuccagcagaugagaggcugaggcaggaggauuaugaauuugagcccagccugggcugcacugugcauuucaaagugcauugcagaggucacuaccauguccuguuuaccugucgcuacacuaaggagcgccuuugaauuauugugacuagcacagcgcaguguauguauacagcaagugacuagcauagcacaaguguauguauacagcaagugcauguauacagcaagugcauguauacagcaaguguauguauacagcaaguguauguauguauacagcaaguguauguauguauacagcaagugcauguauacagcaagugcauguauacagcaaguguauguauacagcaaguguaugcuaacagacacuuucaaguuuuuagaaucaugucuaucaugguacauaucgguuagaguguagugguacccguucugugcuccugauuggucucacaaucgcaccacuggcuguugacaucuuuauuuaccaguuggaugcaacugggggccggguccuucauugccuuaugugcagauacuuguguaagcaguuugagggaccaaaauuaauauuauaacacaagcagcauuaagccaaacucacuucauuuccccccuuucaucuaauuaacagggcucuuuuaucucagacauaaauugaguacaacuauaaaaauuauguaaauuacaaaguaugauguacaagugacaucugauucaucauauuugucaguuagauaaaguauuccaccaucuagcuaaacucaaagaguuuauacuuuuauaucugaauuauguucugauauuagcuugcauuaccaucugaaaaccauccuuucaaauauauaucaucucucucaaugcuaaacaacuuguguuugauuaugagacuauaacuagucucauaauccaagaaagaaaauccaagaaagaaagaaauauaaccugaauauacaggaagcacaaaaacauagcuuccaaaaacuuaaacaaauuguggagacagcugccugccuggacagccccuaacuucuuauaacagaugucagagcaucugucuuccgcuuucuggcccagaaccaucugacagaccuugaaauaaagcaggaauaugaggggcuagcuuacccugccuuggcagagcuuagcaguugacuagcccacaucuguuuguccucuuuggacaguauuuugucugcagaugaauagggcaguuuuugcuuagugguuaccuugccauuacuggagcaacuccauguggagguguugaugcucaauuucuucuuugaaccaugaagaggguacugucaggagcaggcaugucucuagucagaauuucuaauaauaaugaaaugauuaaauguuaacagauacauucaaguucuuaaaaucacguuucucuccgugcaugcaugugugcacacaugccacaguacacauagugggagaacucuuuuucugccauguagaugucccacaggucagacuucuggugucaggcuugagggcaggcgccuucacccacugagccaucucgccagcccccuuucaauguauuuuggguguaucccuaggagugggauuucuauaucauaugguaauucuacauuagcuuucugaggagccagccagcucugcuuggcucuguguccagugcaggagagaucucgaucagugccugcuaccugagcugaaggguuaugaggagaagcagagcugagggagcugaugggcauuuagaaaggaaggcagaaggcagguagaugaaggcucagagugcuagcugggcucuuugacccugacucuugcuucuucuucuucuucuucuuuuuuuuuuuuuccuauuccaggguccccccaguugcgccugguggcuggacccagcaggugcucuggccggcuggagguauggcaugacggacgcugggggacaguaugugaugacagcugggacaugagagacucagcuguggucugccgggagcugggcugugggaggccucggcaaccagaccccgcagcaggccgcuuuggcuggggugcaggccccaucuggcuggaugacguagguuguauggggacggaggcuucacugucagaaugcccugcugcuuccugggggaaacacaauugcgcccacaaugaggaugucgggguuaccugcacuggugaggaugcacuagccacccacuggcucuaggagggcuucuaaguggaagcaguggaggcuaaaggugguguuaacuugacugaguacugcaagcuccagcucuguaguggguauuuagcucauauaaccucauucaaauugccuauguguagccaaagugagggcuaauucacaugaacucuggcagugcauccccccauuuauagggguugcuuuccagcuccacagcuagauacugagcuaggagcuggcugcucagaacagaaugaacauaguacaggucuuugaggagcucacgccucauggagagcaaggggaacacagacaagcucuugcaaaccagcaguguuugggaggucucugaaaccgcacugacauuccuucuguugcuaaaggacucccagaaaugagagagguggggggugguggggggugggggggguuguauuucaauauacugaagaugcagauuaaguucagccaagggaaagcaaacacauguggaauggaguuuaggugugaaguccuggugugugugggagggguauaaacggugcuggauuagcccagcaacaugugugugacaacaugagagaagagccagaugugcuagucuugaugucuauggggauugauuguuuguuuguuugcuuauugguaggggcuugauugaccacguucagggcuguucagaaaucacauugucaguguggacuuaacauggugcaaacugccuccccuaaacauauaaagaguuucuuaccaggcaagaacauuccaagggcuuagaggucaucuuccuagagccagggcaaagcccccaagcuugucuugggcaugauucguccuugacugccuagguggccuaaccagagagacagaguguggauauuggugacucaaaggauagagugagucaucaggauagugccucugucuccucugggagccaccggaggacggggagcaggggacuggcuuguaggcuucaugccacucuugaggguacugaauaugaaagaaaaggcaguggugauagagcaagccugugguaccagcacuuggaaggcugaggcaggaggauucuuacgaauuuaaggcuauccugagcuauagaguccuugucaugggaaaacaaucaggggcuaagugguuuaaagugcuggcugauuuugaagaggacccagguuugagucccagcacccacauggcagcucucuaacucuacuugguggguagggaaucugaugcccucuucuggccacugcaggcacugaacccacauagagcacagacauucaugaaggggaaauacaucaaauagaaguaaaucuuuaguguguguguguguguguguguguguguguguguguguguguguguguguguaggcaugguggggcagaccuauaauccuaguuacuugagaugguguaagaggaucacaaguucaaggccugccuggacagcuuugcucccgucucagaguaaaaacauaagcagcugauacauugcuaagagaugaagcccuuaaggcagcaguuuucagcucauggguugugaccccuuuagggguugaaggagccuuucacagaggucacuuaaguccuggaauaaucagcuaguuauauaaugauucauaacaguaguaauauuacaguuaugaaguaacaacaaaaaauacuuuuaugguugggguuuaccaaaacuagaggagcugcauuaaaagguggaaguguuaggaagguugagaaccacugucuuagggugugugccuaggaguggaguagcuauccugcauuucccuauuccuugacuuuaaaaaaaauugacuuuauuauuuuuaaccauguacaugcauuuguguguauggcacucuucccugcugggcugucccuccagccccuagccccagcuuuuuguggaaucugcacgcuaguuucccagaguggcuacaccacuagacacucccacuaagcgugaaggaggacucuguuuccuauuggcugucauuuguuuccuugaugauaguuuuucugacugggaugagaugggaucucaaaguagcuuuaacuguuguaccaggcucuuaaugacaguuuuaauccaccgguaacgcagaugaccucugauggaucgcaugacaaaaacccaagguuaugaagaggggagagaggcagguaggggugagagagauaauuagggaacaaugcacuguagacaugcucgcaaugcucagggggcaagcacacuuaguauagauugccuuuauuuaguuuuuauuuuauuuuauuuuauuuuauuuuuuguuuuuuuagauuuauuuauuauauguaaguacacuguagcugucuucagacacuccagaagagggcgucagaucuuguuacagaugguugugagccaccaugugguugcugggauuugaacuucagaccuucggaagagcagucgggugcucuuacccacugagccaucucaccagcccuauuuaguuuuuaagugugcagguauuuugccugcaaguggaucugugcgccaugugcuugucuggaguccuuggaggccaggagaggccaccagacucucugagauuagaguuacagacaguugugagccacuauguuugugcuaagaaucaaacccagguccuauggaagagcagcaaguacucuuagccacagacccaucucuucaguccaacagacuucuauuuucuuaagugaaacgagggcggaggguauggguuagcaggacaggacgagaccuuccccaugaucuuaucucuccucccucccggucuccuagggacccccggccuggauaccaucucagacccuuucaguuggagcuggcucccugggcuggguagagaucaggaugccuggcucccaggagagcuaaccaccaaaccuucugccagucucaccuccagugugccacagaaacccacaaagguuccagggaaagcucccaagaguaccaagaagugggugacuaaaaaugcaaggagaccaaccacucagcccccugggaugccaaccaccaaacauuccagggccccaggcaccccaaccucccuacauccaacagcacguaccucugaguuaccaaagagacugaccacugaggcuccccacaggcagaccucacauaccacuguaaggcugaccccuaggguccccugggaguggaccucagagccuguggugucacaguccacucaagguccccaagaagugaccucugaggccaccacaacggaaaacccucagaccucuuuggagccaucgggugagaacaccgaaggcucucuggaaucaucccaagauccagcuaccaccccaacugcuggagucccugugccaucaggugaguaguagagaguuaaaaggguggggacagggagguggcccuguaccuccuaaccugagagccucccaccucccccaggucccuuccggguucgucuggcugaugggcccaacaggugugcuggccggcuagagguguggcaugcuggacucuggggaacagucugugaugacagcugggacauccgggaugccacaguggccugcugggagcuggguugcggaaagguccggccccgaguaggcaaaacucacuauggcccuggcacugggcccaucugguuggaugacaugggcuguaaaggaagugagaugucacugagugacugccccucgggggcaugggggaagcacaacugugaccacgaagaagacguggugcucaccugcacugguaccagggaacagugagggaggccgaggugguggaguuagagugggacagaauggugucucgugggcuagaggggacucagcguuggugucuaaaggucuaaggagcgggcuggagggggcucagcaugagagcaggaaaggguuacuucaggagacucuggcagggaagggaagcccgggggcgggggggggggaccucagcuagcaggaagaggcacaagcuaccugucucucccccaggcuacacgggugaugacgauuauccuuccuggaccugggacccuacuuccggagaggaccugaccaaagggaccacaguggcugcgcggccuggacauacacuuuccugggcuaccacuacaaacacugaaguccccucuccagcaacacagaaccuuccagacacgggugaggggcucaaccugggugcauaugccaaggcaugugugaugaggucagagucaaaaugguggagcucuauccacaagcuccuuuaccuaccgggcgauggcauccgcccacuuuuguuuuguuuguuuuguuuuugaggugcuauaucuuguaucccagacuggccuugaacuugcuauguggcugagguuugccuugaacuuccugucucccccucccaaguauuggcagugcaaacauaugugcuacuguggucagccauaaagaucucucuaacagcuagccuaggccuccauguccuggcaggcuugccuaaauguguuccacucuugggcuugacaguauucaccuucuccagagugcaaugggacagcauguggcucagagcgaucagagggcaucagcuaguacugagccuaccaaaucgaccaugccccucaauccagagcaugugcaggaaugacccagagcccucagcucaggguuguccugugagcacaugguuccaccgucagcagacucauacccagucuggcaguccauguguuguccuggucaggcucuaggucagacacagacaggacccuccuggagcacagguucuaacuccugcccuucccagccccacccaugaaagucagugccuuacaugacaucugucaguccuucugcuucuccauggcuucuguuuugcuauggucuguguccuuccaccccugaugcuaacccagggaucuccauccacccuggccccuacaucuuagaacuccauuuugcuuuucuccuggugucuuucucccauuggauucguucccacucucuuuuccucuuuaguacucuguuuuucccagugcaguaucucuugguuuuuuucaucaguuuuucuuuaaaguucuauacuccuuccacaccuuuuacauuguuuaaaguuauuauuuuauggguaugguuguaggcauaucuaugccaugugcauacaguucccacacaggccagaagagggcaccagaguccuggccagaagagggcacuagugcuccugaaacuggaguuauagacaggcgugagcagccacaugggugcagggaauugaaccuggcuucucugggagaacagccugaacucucuguccagccccuguaucuuccuuucaagucaccaucucaccccauuucucaguaguuugcuuuuucuuuuuucuuucguugucccagcuggccuagaacuccuguucucccccugccuccaccuccccagcccucgggucacugggcauguaccaccuugcccgucacucacuguauuucacgugacuuccucucuucuuuccuuccuggguucccccuccacugucuuuuucagacccucugcuuuuaucuccucccuucuguagcguucccccuuuccuuccuuuuucuuuguuagauugauugauuguauaugugugugcaugcacaccugugcucagggccauaugccacaguaugugcucgcacacgcacucauauguaaguguguauaugcaugaguauacgagcucauaugugugugugcacacuugcaugcguggauucgugcuugugugugugucuauguacaaccugcaggagucagucuucuccuuuuaccauguugguuccagguauacaacuagaauuuucagcuaggugccgauccaucucaucugcccugucucuaauuuauuacuccagcuaccugucauucaugucccucuuuccucccguccccuucuugagacaggcuuuucuuuuucuuuuuaagauuuauuuauuuuauguauaugaguacacuguagcugucuucagacacccagcagagggcaucagaucccauuacagaugguugugagccauuacagaucaugugguugcugggaauugaacucagcaccucuggaagagcagucagugcucuuaaccgcugagccaucucuccagccucuucccuuccccuuucuuuuucuuucuuuccuuccuuuuccucucuuacuuuucucugccccucuacacuuuugagcuguucuuuuauagcucuagcugggcuucucuauguacccgaggcuggccuugauccccugacugcacccaccaaugcuaggauuacaggcacgcauacuccaacuucuuuucagucagcuacugccauguucugagucgcacuaucuguuuuuuaauucugcuagcuucaguccuuucuccuucucccucucccucucucuuuccuucuuucucuguuugugucucuugacccucauuucagugagagaggacacuauuugugcccuacccgcugcauuucgcaccccuguuucucugucacccucauuucucucugcauacaccguugaaugcucccugccucuuugugugugucccucugccugccacugauuggagggucugcuugcauccuuucuggaacccagcaugcacaaucaggccugccuagguagguaccugcucuucugccuagcaccuccuuacgucacggagugcugcacauuuugauuggccaccaggaucccuguucuccaccuguagaguugaacuagggagccaacuucaggaauguauaacguggauccaggaguaccucuugcugguaucgagguugaucguuagaaugcuggaaccagaagugaguucuuagagaccccguuccuuguucaagugcagcugcauuugcagaacuuacauucuacacaauuagggcaguuucucuguccugcagcgcccccucgugguagaauugagcgcauggugaggcacugcccacugcagagacagcugaggcagggggauccuuguagggggagcagggcaaauaaauuagaaguacaaacuguacaagcaaacucuugggacaauuuuauguaucaaggguuagaagaagguguaguaguaggaugagacuguuucaaacaauuuauaugugucuuauguauauaugugugugguauguguguaaguauaacuauauguaaaugcuugugugugucucugcaauguguggacaguguguguggaggcgagaggacaacaucuggugcuauuccccaggcacuaucuaaaccuuguuuuuaugagacaauggccuugaagcucaacauugaggccaggcuagugaugcauaaaccugggagauagcucugucucugucucccuaccaccgggauggcauacccagcuuuauauuuucuuuaaaugugugcucuggggcucacacuccguuccuuguguuugcaaaacaaguaauuuacaaacugagcuaucucccagcucuuguuugcugccgagagcuucuuuuuuaccauagccuaagcuggcuuggaagucacuguguaguucaggcaagccuugaacucugagugguaggauuauaggcaugcaucaugaugccagccuaaugccauucacucguuguacugggaugaugugugcugccacucaaagcacaagccugggcucugacucacuuagcugacuccaauccagacagcacagggacaaguugugugacugugcguuccaauccaacguacagaaggcccgcgucgucaccuauaacagaaaacucugcuuaccgaaacaauucauaggcucaggaucccaaggugguaaugauuauuuauagaagagaaaccaagaaaauccuuccagaaaugugauauuauccuucagcagacgagagcaagaagagaaguguuguuuaauuaauucaugcgugugccauggcuuauguguggggucagaggacagcuuccacgaguuguauuuucuacuccaccauguggguuuuggcaggguuuaacugaggucaucaggauguacagcgagcaacuuuacccacuguucccaggaagggaauucucaagcgaccaaaggccugugggagaaaacucgcauagucacaugguuaagauucuuuuuaaggacuuauuuugugguucaggcaugguggugcauacccuucaucccagaacucuggaggcaaaggagguggaucuaugugaguuugaaacuaaccuggucuauauagcaaguuccagaacagccaagcuacacacacacacacacacacacacacacacacacacacacacacacacagcucagugagaccagaagaggacauccaaucuaaaccuggcauuacaggcagguguaagcugccugaaguguggguuggaaacccaaaagaugcucuuaaccacuaagcuauuucucccaccucagcaaggguaggcuuuaagcucuaagaagggccuccauggaucucucuggcugcuagaacaucaccacagaucuaguggcucauguucuugaucuucuguaggucagacuucaugggucugacugaucuaagaucaggcagggcugaucccuaggggagaagcugcccucuugacuuuuccagcuccagccccuuccuucgucaaagcccggaguguguugccuuucucugggcuuaaucgugucuuuagucuuuccccugagauucacccuggaaagguuuguguauucuaaguauuuaugagacucaggaacguuuuuucuuuuuguuaauuauuuauugucacccauuuauuuaucuauuuauuuuaacuguauuauguuugugcauguguguaugugugugcuauggcuuaaaaaaggcugcuugggacagcaugauaguucaguagauaggauacuuggugacaaaccugacaaguauuguuggagcacacaugguggaaggcacacaugcacuaauaaauacaugucauuuuaaaauguaaagggagauuggaauuccaggccagcaucagcuacaugaguucaaguucagugugagcuaccugagacugugucaaaaacaauauugcuuugaacggaaucaaugcacgcauuugcuuuaugggauaaccucuucagguucugcguuuacuagccaagagcauccugaccggugacaaggugacauaggcugaggggcugaaugacgggugagcugugguaaugagcagcaggaaaaaguggaaggaggacucaacucucuuccucacacaucugcagaugaccagggagguuaugagucuuccuggacgugggauacaccuucaggaaggggucuguucaaggggacccccaccacaaccaagccuggauccacaguuaccacuagcaccagcaagagucccggccaccccuuuccagcuccaagggcccgugcaggugaggcaugggcaaagaggccuggggaguauguguccugggguacagagaugggcuccaagcuccuagggguaacuacuucuuacuucaaagaucaagcagagagacagccucgaacucacacacuuccuccugccucugacucuaaaaggcugggguugaaagcaugggccaccacgccugacuaacucacuucuuuucauucaguuuagaaccccagcccaagcgauagauaugguuguuucucccuccucaauaaaaucucucuguaaacucccauauagacauguucagaccuguguccccugggugauuccaaaucuugucaaguugacagugaacguuaauuaucacauagagucucacuguggguguuuccuaggagucuucucguaucccaaagcguguucaucuuucugguccccugggcucuuucuccacucuguacuuguaggcaucuguguuccccgcauaggccaccagguggcggcagggaccucgcaagaguugaggaggaggggcacuagggccuggugaaaucugccggugacccaugaugucacgaagaucuuugccuucccauuggucuucuccucaagggacuuugcggaauacguagauagggcaauagggcagacugaccucugaccgaucugccccucuuuucuccaacuccagguucaccaaggaagccaacaccugagcgccggccgcugcccaccucagccaccaccucaucuccugcuuccuccucuucaccagagccuucuggcucacggcagaccucuggcuccuggccacaacucaucccagacucaaagcaggaggggaccucuagcucccccaaaccaucucuacucaccccaggacuucccuccccagcaaccuuugccuuguccacuccuaauaccaguuugcuuccaacacguuccccagagcuuucaggcagcccaacacccaccuccccugaagggcuaaccucugccuccucuaugcuaucagaagugagcaggcuuucuccuaccucagagcugacuccaggaccugauacaacaccagcaccugaaauaaucccagaaaguucugacuccucagaccuccccaugaacaccaggacccccacacagccguuuacagccucucaccccaccagcaucccucaacucaacacaacuucuuaccccaccauugccccucaaccuaccacaaacccucagcaacccaggagcccucaccccgccacaaguccucaaccucccaccaauacucacccuuccucaaccccugccaccccuacagagucccuuccauccucccgaaagacagaacuuuccucucccacuaagccuagacuaaacucagaguugaccuuugaggaagccccauccacagacgcaucccagacgcagaaccuagagcucuuucuagccucggaguccggccccuccagucccucuccagccucaaacuuggacccacuacccacagaugccuucaaaccacccagaagccagaccuuacacucagcuucagaccaccucacucaagggccaaccccuaaucacaacccagauccuuuugggccauguguguccccauuaccaccaguaagggucauggcuugugagccaccugccuugguggagcugguaggugcugugagggaggugggugaccagcugcagagacugaccuggguccuggagcaggaccggcaggagcgccaaguccuggcacugggccuagcccaguugguagaggcugcucagggguuggggcagcugagugagacuguaaagaggcuagcagagguggccuggccccccagcacuccugugcccaugaccaccaccacagaggaggaggagaggccucugaggggagaugugugacccacucugaaauucacggugcuuaagauacucuuaaacaaaagccaacguauguacaaucgaag

SEQ ID NO: 3530 - RNA, 5914 nt, Mus musculus
gauggagcgcaggguccucgagaccaccgaggauggggacacagaggugagaggcgggauaaaagggaggcagagagacugagaaagcaggagaaagagggaguggggagggagagggagagaaggcagggagggaaggagggagggagagagagacuaaaggcccagauucaaggagggacaauagugcagacccaaagagucccccagugaacaaagaccagaucacaugggagagggugaggggguccaguggacuaaucacugaagccauaguaacauggguugagaauaucuggcugccucccucaaguggggagcagacaaagaccccuaauucugcuaggacacacacacaaaaaaaacagguguccccaggcacggugacucacugugacucauacuucucucuagagacagugaccccugucccuugcauccuaagcuugguucugggcuuggccucugaucucucccauuguuccaagaggccccaaacucaccccucaaccacccaacuccuucuccccacaggaggacacggccauggcccugcagcggcuaguggagcuaacagccagccgagugacaucaguaagaagccuguguguacaguaccgucucauccgaaagcuagguuccggcuccuauggccgcgugcuccuagcccagccacgccaaggaggugaguucagccaccaagggguggacuucaaauucucucagcaugagacaucucagagauaagccagaccuggugggaacucugaaaauguagaacucugugaucuucugagagauauaggucccccagagagguuauggcagacuccaagucucacaucacacagcaaggcaagagaacaauuugaacuggaauucaugucacuaucaugucccuuuaucuuauaggaaauggaagaccagagaggguaagucaguuauacaaggcagcacagcaggcuaauauagaauagcagagcaaauaaggaaagaucuguuucaauccacacuucacagauggagaaacuugacuuucaugaaaauucucaggcucagagaggucaaguggcuucccuaaggucccauagcaggaccaugaugucccagguucuuaucugacaccaucuucccgacaggucaaacuguggcccuuaagcuccuccgaagggacucaguccugagaacaacguuccugagagaauucugugugggccgcugcgucucuucacauccaggccuacuacagacccugggaaggccccuacagacaccucgauauuuugccuuugcucaggaguuugcacccuguggggaucucaguggaaugcuccaggagaaggcaaggcuggaaaagacugcucagacccaccucaucccugcccccaauucacugccccaucuagauccacccugagacuccaaaugaccuccccauuccuaaucaucaacacaguucccugccuaaccccagaacugauccauaugaugguccaaacgcaagcuaggagggggagggcuggguugccauuaggguugggaguggauuagagcuauugagggguuggaguguauacagcuucgaggcuccaguugaugcugggauuaggagguagggauagcuggagugagaugagaggguuuaugguugcuccuacauaggugggcugugguuguacaagggcagguuagcacaggcagugucugcuggacauuuggguagagcugaaauggagcuuucucuagaaaggguucuaggucagaacuggacacaggagagucuuagccucucuuguucugagauccggugcauggagagauuauaggggggugcuuggguuugagauggaauuagggguagaaauaggguaagugaaagcaaggaagagagggagggagggaagauaaguagauggaugcuuggaugaaaggauacugaguggaggacagaugcauggguggauggaugcgagcaugaaugcauggguggguggaugaauacaaacauguauggauagcugguguacagauugaucaacucauggguggguggacagauguguggaugcauggaugaauaaauagaugacugcauggauggcuaccuugauagcuguauggaugcguaaugcacgguuagguggguauggauggacaaauggaugcaugcuugaauaguugcacaguuggcugguugaaugacuaauugaguagauaguugauggagggaugauagauggagggaugauggguggguagaugauggaugaauggguggauggauggauggauggauggauggauggauggaugauggauggaugggugauggauggaugauggauggauggauagauggaugggugggugauggaugaauggaugacugaaugcauggacagaugaauggguggguaagaggauaaaaagaacaagaaagaaaccaagaaggaugagagguggguguuagauaugaaaauaggagaguugcauuucugccuggauacaaaguggauguggaguggaugcauuuuuuaauauuguuggauagaggccuggcuggacaguaggacagacugauaugaggacagucugaguuagacaaguucuacaucaauauguggcuaagaucaggguuaacuagaagguuuagauucuaagacauuuaauaccagcgcuugggaggcgaagcagguggaccucuaugaguucaaggccaaccuguacuacauagugagacccuaucucaaaaaaaaaaccaaaaaacaaaaaacaaaaaaaacaaaaacaaaaacaaaaaaaacccaagcccccauaaaaacagagaggagggggagggaaggagagacugagagggacagagacagagagacaccgaaagugauagacacagggaggcacacagaaagacacagacagagaaauaaguucugauuuaaaggagguucuguugggacucacuggguguagagacagaguggcuaaucugaagaacuuugaguguuuguggauauaucaguugucuuucugggggcucugaguucuagacacucagaccuugagugucagagucuuucagaauuaagagcuguguccaagaugaggaagagagcuugacuuguugccuuucuccccaacuuuagggccucccagagcugauggugaagcggauaguggcccagcuggcuggagcccuggacuuccuccauggccgggggcuagugcaugcagaugucaagccagacaaugugcuagucuucgacccugacuguaacagaguagcccugggugaccuggguuugacucgaccugaaggcagcccaaccccugcucccccagugccucugcccacugcaccaccugaacucugccuccugcugccaccaaacacacugccccugaggccagcuguggacuccugggcacugggugugcuucucuucugugcugccacggccugcuucccuugggauguagcauuggcuccugauccugaguuugaggccuuugcugguuggaugaccacuaagccccagcccccucggccaccagcacccugggaccaguuugcacccccagcucugaccuugcuccagggacuucuggaccuggauccugagacuaggaguccuccacuagcugucuuugauguuuuaggggacaacugggggcuccaggguaguggagagggauccggaagcuuggggguuauacccuacaaagauggggaggaagaagagggaggaucaaguuuggaggaguggaccgacgaggaggaagaugaaaucaaagacaguggggggauggaggcagauaacagagcuucaugaccaggugacugagacaguggucagaaccggagcucuugaggccaccugggaaaggcagcagcuguucugggagaagggggaacacacuggauguggaugugcacacaucucccuucccugaagugcacacacacacaacugaggacuaaggggucccaauugugugcugcugcagccucauccccuucucaccuuuccauuuuccuuuugucuucuuucuuuuuccuccucuucuuccucuuccuugcccucuucuucuuccucucccuucuccauuuccuccucuuucuccucuucuuccucuuccuccaucuucuccuccaucuccacuucuccucuucuuccuuuuccccuucuuccuccucuucuuccucuuccccucuucuucuuuuucuuccuccuccaucuccucuuccaucuccuccaucuccuccucucccucuuccccuccucuucuuaucaucuuuccuucuccucccucuucuuucucaccuugauuuuucuuuacugcccucaacugacuacguagcugaccuagagcuuuggauccuccaccuccacuuccccagugcuggccuguacuuccccagugcuggccuguacuuccccacuauuuugaggugcugggcauuguugaggaaccuggggcuucccugugcuaggaaggcccucuaucaacuuaaccucuuccccaaccccugagcaucuucacagcccaaguuuccguuucuccuacagauauauuucugugcucugaaauguugaaugcuuaucaugaauucugaugggaccacucuucuguaagagcagugguucucagccugugggucguggccccccuuugggggaguugaacaaccuuuucacagggguugcguaucagaucuccuccuuauuagacauuuacauuaugauucauagcaguaacaacauuacaguuacaaaguagcaaugaaacaguuuuaucauuggggaauuauauugaagagucacagcauuaggaggguugagaaccacugucuaagaccauggugagggggagcucccaccauuugaggcacaaaauccaaacuuacaggauccgauauuauguugaucugacaguuucugggcucuguguuggugacauugugggaauugucacacacacagagcaaaagaaacauguguguacacauaccacuaccaccaccaccaccaccacccacacaccaccacaccacugccgacagacacccacacaccuuauaugcuccaccuagcaccuuugacuuccaucuuguccuacagaaacguucccaucccuggagcccucccagauaccuaugucuacucuuccuguccuugucacaaacaucuggucuagacccuuccaucuucuauuuccacaagaugccccaaguucucugguuaugaauaacccagcuccaucuauauucagggacccaucaauccugagagccaggacuaguuucauggcucuuccuugucccaaacagcacacagacuccaguucugugugucuggaguccccagcucccagcagaaacuagaaacaucacaggaauuuauacuuaaaaaauuuuucaaguuuuucuguaucccaggauguucccucacuagguggcagaggguaaccucgaacuucugaucauccuucguccaccucucaaugcugggauuacaggccuguguuaugauggagauuuacacagugguggauaugagcuuccagagguucaugcagggaaaacaaagacugcagccagaacuauaaucccaaccaggaaccuacacuuucuagauuuaacagugaguucaccaaaugaaccauggugccccggacuggacuugggaacaggaaaaggaccuugaggacaaagaugguggguaggauggaugacuauuguugaaagcuuugcuaauuuagugaugaaucuuggguaagaugcugaccuuggggcaagcugugugaaggguccaagggaccuuggcaacugugugucuuuuacaacugugugaccuuugugauuguuuuuguaaaacuaaaaauaucuacaaaauaaaaaguguauuuuggacaa

SEQ ID NO: 3531 - RNA, 1067 nt, Mus musculus
cggcugcugcauggcacagagcggcccuuccccugccacaucuguggcaagggcuucaucacgcuuagcaaccucuccaggcaucugaagcuacacaggggcauggacugaauaaccaggacaccccugcccacugaguccagagccagaccguaagacaagccaggccccugccuggaaaaauggugccacccagaacccacagugaaacauccuucagcaaaggggguccaagaacauaauuguuggggaauuucucucugaaaccuacagagacuauucacuuugagaccccuggaauguggcauguucaaaucaacuggccuccaagacuggguacauaguaaugaaaaacgggucuccacuaacaucucucugaagauaacauguaggcacccccaugauuuuaaccacccugugagccagcauuccagauccuucaucuagagaauggggguggggcaauaucuuagacuccuccaggaaccccucaaaugacaccugccagccacuggugaccccagaaaaugaguauaaccgaaaucugccuuccgccaauuuugcuuccuguacugaaagaagaucaggguagaugccccccaccuucaguuaacccacucucagauuaggucucccuuacugcagaauggucugacccuacugaucuucccccauccugaacacuagauuagacuggcccuuuagguuggacuaacccagaugcacauacuccuauccacuuggaaugggcuggugucuggaaugguuguggccuaaucccacucuccuuagaguaauagggcagacauucccuuaugcuguagagcacaguccuuugaccacgauuucccaauccugugaccugguggaggugguagacauugaggcuuucccuaccccuugacuuguaguacuuuggucuuuccaucacuacaacuugacucuuuguuccaaugucccaaggggauaugggaacuuggccagggguuucucuccugugagccucaaccugaccccugaccccucuccccaaugucucugggacuccaauaaaccucauucaguca

SEQ ID NO: 3532 - RNA, 45643 nt, Mus musculus
guuuauugaaaauuuucaugucucuuuaauuuaaacucucagaauaauacucugucuuugcaugggaugcagaugggcuacuccuggcuaaggaggccuagcuggcagccccugcggggugaaauggagacggggugccuagcgugugcggccgagaagcagggcccagugcucaggaagggcagcuucuagcccuggcggugccccgggaaggccgaccuagccagcaaucugcugggggggaggcgugcggggcggcggcaucaccgcuugaagcgguaggugaugggcaggagcagcuugcucuucuugagagccugcaccuucuugagagucucgucguccagugccaggaagcagcggcgggaauacucuagcaggcgcuccuuggauggaucgaacucucccaccucagccagcuuuucgggagccacaaugaguagcucugcgaugggcguggucagcgccacgguguuccuguccacacgguggugcucgaaggcucuggacaugcucuucagcuucuggaaggugcccaggaucuucuuguagcggcagaggaccccaucagcauccuucacugcaggaccaagaggacagaaagaggaggacuggaaaagacacucaugagggaaggagacaugggggaacccagguagaaacaggaaggcaggcauaaagaggaaaaggggugaaaggcacacagauuugaaaacaagcaagcaagaaaucauggaaguggggacacaugaggagccccauacaggaagagaaaggauaacaagauggaaaacaguuaagaccugagcaagaaguagaccagggaaauugaaggcaggccuggacaccagaagaaaggagaugggcccagagaccuccuuucugaugacacaggacuaaaucugcugguugguguaaaacgaaauuuaaaauuaacucaggaccgaaaagggcugugagaugaaguugagucugauuguuuuguauauggagaguuagggcaucacuguagagcucacacugcgauucuggguacacaaccccucaacacacccaucacauguacccacuccccacucaccccgcugccucucucgagccuuggucuucccaaaucgcuuccggcuaguacuucccuucugcuucugccucuuccuuucacuggcacuuccgucuucggaaaccccgcugaaggaggaggcugccgacucggggucugaggcuucuccaaccccagcccugcuguccccaucaacccuccgagguccaggcuucauccggcaguaguccucuaaagagagacaaaagugaacugugacacaauguccuauaauugcccugaggggggaaagauggacauggaggccaaguccucggaaugagggcagggugaaguccccaaguagagacauuagcuacacugaaugccauagagccagcugggauucggggaauagugugagcauuuuucuaggcucugaacuugacugaaacagguccagggaauucaugagaaucugugacuaugcagaguuucugugggggaaauguauccuggggagcuccagagugaagagucaaaauccgagaggcagacagugccucuggguaggaggauuggauaucagacuccuacagaagucaggguucaguuuggguacugggaaaugcuaacuaccuuccccuagauagggagccaacucagacucagcaucuucugaaggaugaacuccugagaacugaaaccaagacucugcccagucauaccagggaaagauaggagucacccuggauagagcucucaguauaggaagagaggguaugcauguccccaucccagugcuaggucccuuuacuagagcuuuugccaugguuagcaaugagaaagccugccagcagcucagcuggauacagagguuaggguuauggccugaauaaaggcuaaguacuccaagaaaccagggcuaaagcucugggaaagggcagccuugaguggggaaugugcugggaauggcagucaacacagguuaaugagauagggcccugccugucagaagaggugacaccaccaugcuguuacuaguuguagauuagagcaagacaagggagugggauccgcucaggacccuaaggugaagcuuaggagacagagguacugggacccccacagccuuugaagaauaagaaacaugaggcaugauaauguagagcaggguagagggaagacagaacccugauugguauuucaggguaccucuaauggaugaugacugcaucauucagaaauccuggggugcuggcagggccccucugaggaauccaguagacugcaaugggucuacugacaaagggacauuuccccuaagaugaggaaccugggcuggaaauauagacucugggagacaguuaugccaagugcuugaggcugaugaguuacagggcagucucaucacaagauaggaaaugagagaagucuuugaaaucaagaaggaaauggcuggggaaggcccuaaaauaggcaugggccuuaguggaaggauaagaugccaaguccccaucagguccaaccaacauuggguguugaauucugcggguccugggggacugugugcccccaccugcauccauccgggcagaggaaaugaauuuguccagcugacaccgcaagaagucccucuccuccuccagguccucaaugcgcuucugcaaccacgaguuccucuccagugccaugugcagcugggccuuaacacugcucaucagggccaggguuggggaggcgcccucuggaggcucuaagaacagcagggacggaggucaugccccagggugaggcaguaccccaccugacuccagucccuccaaugcccuuucucagcucacccucaacauuucuccgagacggacucagacgguauaagauuugugagucuaaguggggugccucuucaaagggaauggagaucucaaaggucucuucguccuucacugcagagaggucagcagaggucaccccagaaguggccugaaccuuauagaccacccccaaccauugcugucccauggacagagggaaccagaaugucagaccaaggaugggaaaagaaaggguccccaggugccucacuuguccgccaacgguuguuucugucauucauaucgaggaggcuuccugcagacccagcaacugagcccuugggggcacuggacagaagcaggucaccaaaagucggcagucccuggagagguggaauaccugucccuccggaguaaggaaggaucaccagucugagggaggaaaggacccauacuucuggacagagucagaggcuuccaaaguauguacccagagcgagggggcucagcgagaggaaucuugguugugaaggggcucggcccuuaaauucuuugguuccucguggggucaacaccacagggagaccuggccugaaugagaaagcccuucaucauggcccaucuccgaacccaaugccauaaauggagaaacaaccaccccuaacuuccauucuugggguaggggguccauccugcaagcguuccccugucccagccgcccauuccucccgcacucgcgugggcgaguaaagccccuccccgaagugggagcugggcgcgugcgcagugcgugggaggucacgcguggggaugcgcccccacccuuugucccacaagugggagggggcgaccguggcgaagggucccagaaugggcaaccggcaugggggugucgaccgugggcaccguuccccgccuuugggugcucaggguacaaggggccgaggccccgcucucacccacccgcgcacggacuccagccccgggaccgacggcaguggcggcgcccaugcccagcgcaggggagcgucugcaaagugucgcggagagaagcgcccacccaccaguaagcgggcguagcggcagaggagggggagaacuggauggcggagcgcggagacgugggcacuaaccgaaucaggccugccgagccuggggcgccucuuccuggagcccaggugaggcccgccguuugcgcggaggucgggaccgcacuugcgcgauagccccuugcaacaccccuccaacccccaccccacacacaacccccccccccuccuuucccaaagccuaggcagggauccucaugaaauucucauccugcacagcugaugcgguuccggggguccuccgggugaguggcuaugugaccagugggccgagaaaagucagaagguaugaggcaguaaggaaaauugaagugaaauuugagucuccuuuaaugaucccuaaguagcugauuaauacaugcauaccuuuagucuuagccgcuccaaccuaccauaaccuccacccacccccauccacgaaaaggauuaaaggaauaagaggaccaggaugugagaauggguuguguggugguuacuucuccgcaaagugugggucaggaauagcccacacuggagccaccuguggaacagcuacacuccaguccuugcuccucauuccuccauggccucaguuuacucaccuguucagugggaaguuacucuuaaaagccuuugagaggauguaguugugugacauaccaaaggcucagcccagaaccggaccacucuuggagcuuaagauccaagcgcuguugauauuauuugaagucagucgguguagaugcacagccuuuaagacacucccccucucccuuccgccccaaaagaagucguguaaagaggcuaucugcauagggcacauacacacacacaaucagaggaaaggagcagcgaagacauguuuauuagaccuacacugccucuccgguucacaagcagcauccucuuugggguucugaagcccuaagaggcaugacuuaaaccauccuugcagaggaagacugaaugugucaaccaagacuaagcaguucauuuuuacaaauaaacugcauccugggucagcaaguccagggggaaccaccugcccuagaucaguauuucaaaccacagagaauuguauaaagccaggugaacuguauaaagcugugcuuaugcucuaagaugcuauuuuuuuaaguauauuaauguggauuguaguuuggguggggaagggguaguguucagaaccuuuuucccaaagaugcuaggaauguugcgcaguguguaaggugccuagcaugcacaaagcccagaguuucaguauucuggaaguggaggcaagaucauaaauccaaugucacccugaacuacauuacaaccuuaucuaaauaaauaaauaaauaaauggcagguuuggggaaacugaaguaggccuaacucccagaggaaaacggcagacuuucccauuacccagucaaggucuuuguuccagauagcauaaacuaaaaugucucccaaaauguaaguaaggauugagaaugggguguggugugcauugaguguucaauauaaggucccuacuuccagugucaaaauagagaccucugacuacccacuaaaacuucccaggcaagaguuuccccaaacagcaugguccucccuuccuccuaucaggaauccguaauaauaaauaucccaacuguucaaggggcagggcuguucucuaugagggcucguuuccauauaccuccaaagcacuaugaugcccugacagcucagagacucuucgaggcaaggcuggguuugugucuagggcucugaaagccaggcuggcacucaggccauugucugagaacuucaggaggagacccaugauccccgcgguccccagaggcagugcagggaugcuuccucugaauaugcuucuggaauggcuccugcucgguaaagcagcacgggcaggguaggaaggcacuggaacagcuauccccugagugcacacagcuguucugagccaacucgccccaaucccgaaaggagcaagggcagagcaaacagcugugggcuguccaccaccuguauagcagguuugacauuugaagggcuuuaccuccaaguggaugacgcuggaggcaagacacgcacucgaagacccuaacgcacaccggacaguuguagcucuuuuugugaaccaaagucccaucggcccuauccucccugacuccucaucccaccagcacuguguagaggacacccugggugucugugagaagauacugguuggguccugaaaaggacgaagucuggggaaacccuauagaagaagaaaguccaggguuuguggacccaccuguccaacagugaggggucuccauggccucaauagagagaagcacccagaucugagggcaggaagguagcagcaucagcauccguaaauguaaaugaggcugaaugggugggaaggaggaaccugcacucuauuuaggguauguguuuugcccaagguccacuguguuauccguauaagaccccuggggucccucuauugucuucugcguuccacuacccacuguauucacgcagucgcuuuccuacuauacgcaaucaagaccucagucaguccccuucccccaugugcugucuucaggucaccuagcagccauccuucaggacaucucguagcccuucaggacugucccgcgcucgggucuaguaauggguccaucugcuaugucuagguucucccguuacacgccccacccgaagcucuuucuaaauuuggagauuaaccaggcuaguucuccaaaagcugccuauugggaccccgcccccuccgcggccguuaguuucuccaucccuccuaccccgucugguauccaguacagccucucggauccaggcggccccggacagccccggguugcgcccacaguuguaggcggcagagggaccggggaaccuugguuucccccguaccuagcaguaccggguuugggaaauaggaaucuagggaaagaugaggguccaagggagaacggagagggcggguugccugagcaucagaaaacagcuccgauuggaaacgcucuccgagcacaagguuccuaugugcuaaugguccaaacucaaucucccuaucccaacacucaacccacaugcaaguaagaacccaagaaugaagugcggaauguuuauugggcaaggaauaagggaucgugggcauuagaaguacagaggcgauccagaccgugccgguguuuuugucuuccacgaagaccuuauacuugggaagaguagaccaccaagacucaggagaggucguaacguuugcaaaggcuuacacagcacagccggacugaagcccaguuccaacugacacccaggcccagaggggcaacaacuuuggucuacaucacacagcuagacgggagaaaauauaaaaugauauuucuccuuggggauggguggggaaacugaggccuaggguaaggcaguaaccucaggagaacugggguaugugugggagugacgcuguguggugauccggagagggcagggcugagcucagugcaggcgcacgugcugcgccagcuccgcggcguccuggaagcggcguggacagagcgggcaggugugagguggaccagcgcgcgcacgguggguggcgcggugccgcgacagguggcuggaucgcuugaaagcuuugccacaagcaccacaaguaaagggcuugagguccgagugcgacacacgguggcucugcagccgcagagggcucgcaaagacacgagcgcacucugggcagcuauagcccuugcgaggaccuggcucucccggggucgccucgcgcugcggcgggccccgagguuccuccuccagcugcaccguguacguguaggggaccccguuggcgucgaugagcagauggcggcccagccgcgguggccgcggccccgccaccgaggaagaaguggaggaggggccuuccgccuugggaaaagggggagucuuggggggcgguggguccaugaccuccggagaggaggaccgagggugggguggccgcggcggcagcagcagcaucuggagcggcagcugggagcggcggagggaagagaaguuaagauccucucuuccuuucaggaaaaaaaaaaaauccuaaaaaggaagaugauaccacucccugccagacugugcuacugaccuaccucccuacaaaguaagaagugacuccaguccccaucuccgggacuccuacaccagggcuuagcaacaccccgcuccaccgacucaggucauaaccucagacauccuucggauucccuucccucaccuccacccaccgaaaucaaucuccaaguccauuucuuuccuucucaguuuagguccuuucuaaucucacauucuagagacuaguggccuccgagauuuuucucccaucuacccauuccuuuuucucagagcucuacucaaucucugauuuaguccuuucccucaggucccucaauacccucagagccuccccaaucuccacaguugucgucgccucaaguuuccucccuagauacuuauccagagucccacuaacccaauuccccacuuuccauucaaggcucuuuuaugucauccccacacucugcacuuaaagguuuugccauucucuuuccacucgaggaaagccaucgucuguacuucauucucaacugacugccuccaauaugcgcccccaucuuguuauauuuuauucaccaccgucuccacccacaaaguauccugacaucuucgguuucucucuccaucgccgccaccaccuuggagcaucuuccaacucgcagucauagaccuucugguuucuuguucccgcacagcuaccccuaaccuuggccccuccucucuagauacagcuggcaucucuggucccucuucaccucccggguuauuugaugcauagccccucgucuggggaccucuagcagcccugguccucuaaaccacccugucccguuauauccccuacggccuuccuacuccccuggcuuccauaaggagcuuuggccucccgacgccccucucucaggcucugagugucgcuuucgucgccucaccgcuccgacccacacccagagaccugccggccucgcgcccugcccaagccaggcuccucccuccaucccggcccccguacccggugcagcagccucucggguccgggggagaacggggccgaggucccggacggacccgggcuugcccugacgagcgccgcgguaggagcgagcuuccgggcagcuccgggccggcggcgccggggacgcgggucggggggcgcaggggcgcgaggggcgacggcgucccugagaaagagcaccguucagaaacgcccgcuacacacacgaagguuccgaggcuggagucugcagcuguaaagggagagcgcaagggguggggguggcgcuuggccaacgagaaggaccugcaaaaggacaguuuccagcugcgugccauucacaagagccauuccuuugcuuugagugacccguaaaaagcuagauacugugaagucuaguaagcgccccauaaagaauugaaauuuacagcuugucgucuuuccacccugccuccccuuuccgcuuaggcaaaaccagcggguuagagaagggguguuucuguuggaugagcaaauggagagacagagguccagaagcccgaucucuguucugauuuagcagggucacaauccucacgucucauaaaugggggaaucaauguccaaagaagacguugccagaucccguaaaguauauaugcuccacugaacauacggggaaacagagacuggggacgaccagauguugacccagaaaggaaaauguacuauuuccccgcagagcauauggggaaucugaaaacuggagcaugcuugcuagguauaaaaauggggacaggguuuaccuaacaugcacucuugguuugauccccagcacugcauaaaacugguugaaacagaagaaucagaaguucaagguuaucuucuccaauauauugaguuggaggccggccugggcuacaugaaaucgcaucugaaaacaaggauggagagcagcugugauucuugccagugacccagcaggggaaaguaaggucuccagaggagaccagccauuccuagguacgggcauggggaaguuuagacuuacuauggaauacauggggaagcugaggcucagagaaagccaggcauugucguauacacaggcaaggaagcugguucuuuggaauggaaaagagugcugcugaagucaccagcacccacugccuaugguagcuggcgcgcagggcucuucaaggagggucugagcauccaguuuugaugcaguagccugggccagugaagacacuuuguauuuguaaaaugcacucugguaugagaugcaauuacaggagguuaggacccaucuaaggcuaaguccuagauccacguacugggaguugggagggggcaacagcuggacauagccaagggagaggaggguuaggcgcccagugcaaggaccccacccacccacccacccaaagaguggacuaccccuugaagaauuauccaacaucuuuccaucgguaacaaaugcuauaauuucuaugaggcgugacaguggauacaugaagcuauugagcacuagugcuucugaggcccugaaguauggaacguauucauuccuuaauuuagauuugccccaggagacagcuauauaaacuguauuuuuauuucuugagacaugaucucaagaagccuagccugacuaugcagccuaagauaaccuugaauucucucucuccuuuaaaaaaaaauguauguaaguguuuugguggccuguaggcauauacacauguguacuugguguccuuggaggucagaagacagcaaucggauucccuagaacuggaguuagaguguuugugaaccaccuugugggugcuauaagucaaacccagguccucuacaagggcaaaggaguucaaacccagaugaccacgugguggaagaaaagaaccaacucuagaaaguugccuucugacugccacaugcauguacacgaucacacauaaauaaaugaauuucaaaaccuaagccaagaagagggcagagacacaaaacaaaauaucaguuagugaaugaguaaauuugaucagauaguaaaucccaccucucccugaaaagauacuucuggauggagcuggagccaugcuucagcaguuaagagcacuggcugcucuaguaaaagccccagguuccauucccagcacccagcuuaacaaccauuuauaaauccaauuccaggggagcccacaccaucuucugucuccuguaacaggcauacaugucuacaaacauccgaguaggcagaaacaccaauauacauaaaauaacuuuuaaaaaagcuacugccggguggcuuagcauccccaaagcucuggaucugauuccccacaacacagaggagacacccugccaccuagcugggacauggucaugauaaagucuaccagacaucagucuaaccccucuaauguccucacuugucccaaccaccaccucucucccucucaaagucagacauaucauguccugauauguuucucuguuaaaggagguguggccuuguuaaaguggguguaucacugugggugugggcuuuaagaccuuguccuagcugccuggaaacaaguauucuccuagcugucuuuggaacaagauguagaauucuuagcuccuccugcacugugccugccuggaugcugccauguucccgaguugaugauaguggacuaaaccucugaacuuguaagccagccccaauuaaauguaguucuuuauaagaguugcuuuggucauggugucuguucacagcaggaaacccuaacuaagacaucugccaaucagccugagucuacagaagcggcaagaagccacuggaaucugacgucacgagaaguuccuuggugaguuaaucucuaugaagucaugacaagagaacacuugccacgugguucauggccaacaguaaccagagcaucuucagugaagacuaucaaggugaaacaaugcccaagccaugucccaccaucugcagucauauuuauauucuuccuaagcaucacacauccuuucaccugugucuacuuuagcagaacacucuuucauguaucugcaccagcaaaacaucauaugacauaacugaguucccaaagaaaccugagaguuccacuucaaacaugccugucggcugugguggggaguuccuuuaaucucuuuuuguuuguuuguucuguuguuuguugaggguuuuuuuuuuuuuuuuguuugucaacuugacacaaccuagagagaauauucugggaaggggaaccacaauagaaaaugaaggggaaaaaaugccuuuuaguagauuggccaguagacaaguuugugggacuuuuuuucuuuuuuugauugauugaugacuaaaauggaaggguucagcaugcugugaguggugucaccccagagcaaagaguccuaggguggauaagaaaacaaauugaagaaauaauggugaucaagccaggaagcagcucuccucuguggccucugcuucaguuccugccuugaguccuguccugacucccuccaugauggcugugccuugaguccugucuugacucccuccaugauggcugugccuugaguccuguccugacuccccuccaugauggcugugccuugaguccuguccugacucccuccaugauggcugugccuugaguccuguccugacuccccuccaugauggcugugccuugaguccugucuugacucccuccaugauggcugugccuugaguccugucuugacuccccuccaugauggcugugccuugaguccugucuugacuccccuccaugauggcugugccuugaguccugucuugacucccuccaugauggcugugccuugaguccuguccugacuccccuccaugauggcugugccuugaguccugucuugacucccuccaugauggcugugccuugaguccuguccugacuccccuccaugauggcugugccuugaguccuguccugacucccuccaugauggcugugccuugaguccuguccugacuccccuccaugauggcugugccuugaguccuguccugacucccuccaugauggcugugaugugaaauaaaccuuuuccucccuacguugcuuuuggccagggccuuuaucacugaaauagaaaacaaaccaggacaaacccaagcugauugauuguugucacagagcuucuccauacacugucacaagaaacucucuccuaggccuuaugggggcgacaaaguucaaaguauuaaaauguucccuccauuuuaacagauggugaaauucaaauacaaagaccuauguccaagacuggugagguggcccaggagggucaacugucuugcuaccaagcucaacaaccuucuucugacucccuaaccugaguuuaaccccugagacccacaugauggauaaagagaacuugcuccugcaaguuguccccugaccuccaggaacauggcaugccugaacacacaaaugcaugcacacauacacauacacacacgcaaaaauaaauguuuugggguuguuuuguuuugagacaagguuucuguguagcccuggcuguccuggaauuggcucuguagaccaggcuaaccuuaaauucagagauccaccugccucugccccucaagugcuaagaucaaaggcgugcgucaccaccggugacugguggggguggggaguuguuuguuuuaagacaggaucucacuaugcagcacugacuggccuggaacucagagaguaugccuuucuacuugcuucucccucccuaaagugauuggauuaaaggcaugcaccaccaagcuguguuucuccuuuuaauucgguauguguugcugugugcacagagccuguggcaauuguagugggcauggaauucccuucccuggauuggaguugcagaugauugucagccacccaguaugggugcugggagcugagcuuggaucuucugcagcaacgggaaacacucccaaacacugagccaucucuccauccccauaacuacuuuaacaaaugauuuuaaauuacauuuauggggaagggggagugaaugccgugacacuuguguggaagucagaagacaacuugggagucaguucucgccuucuaccauguagguucugggaaucauacgcaagccaucaagcacagcagcaacccuuacccacuaagccgucucucuggcucuagaauaacuacuucuaauaguggcuauaugguucagcuugaccucacuguagccaucuugauaaccaccacaaccacugcaaagcaaaccauguuuuuuccuggaaaccacagacaugucccuagaguaacauguaggguuucagaacuguuucaaugucagggaugcaccugccugccccuuuccuauuagcugaagaucacaaacacauucuaaguuagaugagaucacagugcccccuagccuuucauucuuauacagguuuuagcacuuguucugccugccgccuaggaucacacuucuaucagcacacccccucaauaaauucagaucaugaacccuugaaucuuaucuuccucuuuucugcagucauucugcaucauagcccuugcaccuggcucucacacacuggaaccugacugucauuacgcugucuuagaaaucuaguguguauuuucacacuugugaugucucacuucguucuaacauugugucaugugccccaacuccaagucagucgcaucuguguuggacagacaaauacagagaugacagacaaacagguaacuacaaugcaaaauguugaaucacaucacuagggagguagaagugggugaacuccgaguuccaagccagccuggucuacacagugaauuccugaccauccaggacuacaucgggagauauccucuaagugggccugggagauggcucaacaggaaacagugcuuaccaucaaaccugaagaccugaguuugagcccugggaccaacacggugcaaggagagagccgacuucugaccaucacacacacacaccaccuuugacacaagugcacuuacacaaaugcacacaaagcaacugaaaaaaaccacuaucaaaugcuuacaguagacuuuaauguuuaauguguauggauguuuuccucucauuuaugccuguguuccacuugcaugucuggcgcucaaaaagccuagaacuccuggaacuggaguuaaaagaugguugugagccaccaugugagugcuggcaaucagaaccagguccucuggaaaagcagcagccaaugcucuuaacugcuaagccauccagugcccaagacauucguuuuauauaaaaauguguucaguuugauuuuguaguuugagaaagggucucauaguccaggcuagccuugaacucacuguguagcuguuauggaguucaagacuucccaggggaaaaaauaaagaagauaacagacucaaucuagauuauaaguaguuaaauuucuuguagcugguagcaggacagcuaucucugagccaggcgagugacugccacucaaagcagaugaggaaaggaaggacuuuuaaagacaaaaaccacagggagaccuugacuaucugcacaaguaagccacaagcugcuuugcucugccaagacuagguagucaaggcacauccaaauaguccuugaaugucugcagguuuacagaagccaaaaggcagucaaugauaacaaagcagcuggucgugguuguacauuucuggacugacugagucaggguuacuaggaauuuaucuuccaggggcuagaaccagaggcaaauggccaguggguaccaagggcuagaaccagaggcaaauggccaguggguaccaagggcuagaaccagagacaaauggccaguggguaccaagauggaugccuaccagaggcaaauggccaguggguaccaagauggaugccuaccagaggcaaauggccaguggguaccaagggcuagaaccagaggcaaauggccaguggguaccaagggcuagaaccagagacaaauggccaguggguaccaagauggaugccuagcagaggcaaauggccaguggguaccaagauggaugccuagcagaggcaaauggccaguggguaccaagauggaugccucgcauagaguggaguauuauuugcuucauuuuuugguuagguuugguuuuuuugaggcaggguuucuuauguuguggugauuccccaaacacaaauuucuuuuuauuguuacuucauaacuaaauuuucaauguuaugggccauaauauaauuaucugugguucccaauagucuuaggugaccccugugaaaggaucagucaaccuccacagaccacuccucucuccaauaugaggagcuguauguaugaaagaguccuaguauuaggaaaguugagaaccacuggcucagagguuaagagcacuaaugguuuucaguagaaauaguacaucagguuaggagugcaguuguaugguagaauacuugccuaguauguggaaggccguagguucugucucuaaccgcccuccccccuccauacagacacauacacggggagagacagagacagagacagagacagagacagagacagagaaacagagacaaagaaagaaugagcugggauaaauaguugauaagaaaauguaagccaaaaaaaguaguuuaccacuaccuucaauaguaaaucuuuuauuuuugaggcauggucucacuacauaguccuccuaguuguccuaaaacuuacuauguagaccaggcugaccucaaacuaagagaucuacaucccugugacugcugaaugcugggauuaaauaucugcacuacugugcccagcuuuuuaauuauccucuuauuuuagaugucugggugguuugccugcaugaaugccuauacguauguccaauuuuuaaaucugucuacagguucccugacaccagugauuuauuaaaaacaaucaaacuaagggggcuugggagauggcccagccauuuaagaccccgugcuugucauucagaugaccuggguccaguucccagcauccagguggcagcucauagggcugagguucuagggcaucugacaaacucuucuuuuucccuccuugugggggcuggggauggcguucaggguuuuguuuuguuuccagacaggguuccucuguguagcccuggucaugcuggaauucacucuguagagcaggcuggccccaaacagauccaagugcuaggauuaaaggcaugcaucaccaccagacuagacauccucuucugaccuccucggacaccaggcaugcacaugguacauaggcaugcaggcaaaacacuccuacacacacaauaaagugaauaaauacugcuaaaaauggaaaauaauggcccaacagaaaaguuaugacuuguauagugaguauccauauauguauuuaucuuuuuucuuuucuuucuuucuuuuuuuuuuguuuuguuuuuuuuuuuguuuuuguuuuuguuuuuguuuuugagaugguuucacuguguagcccuggauguucuggaacuaacucuguagaccaggcuggccucgaacucagaaauccgccugucucugccucccaagugcugggauuaaaggugugcgccaccaucauuuuuaaguagcaucuacagcuuaauuuauguauuugcuuacuuauuuagugcauggggcacccauguaccaagagacagaaccacccuuacugccagcacuucccagguuuguuuuguuuuuuaaucuuguucucuuugugugugugugaaugcaaaugcccacagagaccagaagaagguauuauauuucuuggagcugaaguuucuuuggaaagucaguuaugucaaaugguguuuugcuggggcacauaggugaaaggaugucuugcuaaagcagaaaugggaaagcaguuuuccugaagcagacacaggugaaaggauguuuugauauagcaaacaugugaaagaacccaugaugaaggaguauaaauaugaccccacuguccaagccagcucagucagucaacagguucuccagcgcaggagugaggauuaaaagaaaaaagacagacaacauuguagugugacuccagccaguucugagguagagacagguuuauuuuuuucccagucugcuuuuauaccauuuuaaguacauggaaguaauaaggucaguucuagguugaggaacaagcaagacaauaaacacaaauagucaaggaacaaacaagguaauaaacagaguccuguggucacuccccaggacgucuguuucuaaggcuugucaggaugaccaagauaucugagccuacuucccucccuauccuggcccaaaaucagauucuugccugaagccuacuucuuuuuuuuuuuucaaacaaaccuuuugaaauuauuuuaaaauauuuucaaaaaaacauuucuaagacauuaguaucugaaacaguaacuaaaaucgagaugauuaaaacaggagcaaaagacuuaaacguuucuucagagaagaauacaaauaucaauaagcaugaaaggcuaaggagaagggaauugggaugccacaguuuaguggguauggaguuugggguuauauugcuuguucauguaugagggggggaggggauuggucucacuguuuuuggccaggauggucuccugaacuuaaaugacccucccauucaagcuccugcgaacugagaaccucagacagacacaugucaucauguccagcuuaagaguuccaauuuuauaauauaaagagaauaugaagaugaaagaugaugccuugguugucacaguuacaacaaaauacuucagaagacaacuuagaaggagaaaggaguucauuuugguucacaaucucagagauggcaaccucugacugacuggugccauugguucugggccaguggugaagcagaacuuuauggcaaaagggugugacagaguccccuaguucuuuguuccagccugaaauuagauuccugccucaacuuacuuccaugucaugggcccaaugucagauuccugccugaagcccauuuccuuguccuuggccaauguagauuccuuccaaacugccccaaaagcucuccacaccccacagacagaaggagcuagagcacugguuugauuuguucugccuugguauucuuugcuaaagacacccacauaagggucaccuuacauaguguuguugaguucaaguugcugucaugcugucacugaaggaaacucacccaggaacugccugggagguuccugagguucucaccucaggccagcuggcgagccuggcaguuuccucaggacugaacuacagcugccuggugucuggccgaacgggcuggacugcagcuguggguucaugcccggugucuucccgccuagaagacuggucugcagcugcugaguccuauuuggucuuugcuacaggauggaacugcugccaaagaagaucuagcucucccccaaagaacuguuacugaacagguccacuucccccacauccuaauaacuuuucuccuccacucccucuccuggguagggggcuagaggagaaguugaacucuuauuaaaaguauguugcaaaaaaauguaugccagccgggcaugguggugcacaccuuuaaucccagcacucgggaggcaaaggcaggcggauuucugaguucgaggccagccuagucuacaaagugaguuccaggacagccagggcuauacagagaaacccugucucgaaaaaccaaaauaaauaaauaaauaaaaaauguaugccuacaaauaugaacugcuguguaggugcuggggaucaaacggguugucuggaagaacagccagugcucuuacaccaugagccaucuauuccuccagcccccaagcucagcuugacaauguuuucugagcaggcagucauggcgcacgccuuuaaucccagcacucuagaggcacaggcaggccgaucucuugaguucaagaccagcacagucuacagagugagcuccuggacggccaggacugcacagagaaacccuguuuguaaugcaaaaaaacaaacagaacaagauaauggcugaguggcuaauaguauuuugugcucuuccauaagauucaaguuuaagucaggcucagugguguaugcuuuuaaucccaggauucaggaggcagaggcagguggaucucugaacucaaagccagccuggucuaaagagggaguuccaacacagccagggccacacagagaaauccugucuugaaaaaaauuuuaaaaaagacccgacuuugguuuuaaacacccagguuagaugguucuucuggccuccacagguaucuacacucauacacauaaauaaaaauaaaauaaaaauuuaagcauagcuuuuaaaaauuauauaaguguguguguguguguguguguguguguguguguguguguguaggacagaaccuagggucuugcacauacuagguaaguacucaauauaacugcauucccaaccuaauaaacuauuucuacagaaaacugcuagugcucucuagugcucuuaaccccugcgcagugguucacaaccuuccuagcuaaaggaagucacauggucacauguaacuucaagcagaaaugcuaucauaagcccccccucccaaagaagggaaaucuuagccaugaugauaaguguuccggucuggucuccuggucuauccaaauaaacagaguuucaaagcauucccacgucucuuuuuugacuguuuccacacacuucuaaaggucuguacagaagagagaggaauggagauggacccggggguggugggggggggguggugguacaugccuguaaccacaggaccagaaauaucaagaguucaaggccagggcuggggagauaacucagaaguuaaggcauuuguugauuuuucagaggaccuggguuugguuccagcacccagaugacagcuaacaacccucuguaacuuccccaucucagauguccaugaguacugcaaacaagugguggacagacagagcacccauacgaggaggagggagggggagggggaaggaaggaagaagaagaagaaagaaggaagaggagggaggaagggagggaggaaggaaagagggacagagggaaggaaggaggaggagaccuuuaaaaaucaaaauagaguucaaggccagcauagacuacauaaguuugaggucaccuuacuguauggggcguagucagaagguaggaaacaaggaaugagugaaaauaggaagagaagccaggcagugguggcccaugccuuuaaucccugcacuggggggggcagaggcagguggauuucugaguucgaggccagccuggucuacagagugaguuccaggacagccaaggcuacacagaaaaacccugucucgaaaacaaaaacaaaaaaagaaagaaagaaaaucccauaaggaaacccugucucaaaaaaaaaaaaaaaaaaaaaaaaaaaaaaaaaaaaaaggaggaggaggagaugaucacagaaguguccugacuuaucaagucacaaagucaggcccuagagugaguuuaacucucaaaagagcccuguccuuagugcugccgaaaacccucuuugagcucuuuucucccaaacaucacagcaacugagagggguuagcuuccgucuggaaucuuaccugagcucaugagucuccuccuccuucuuuuuuuaaaauugguuauuuucuuuauuuacauuucaaauguuauccccuuuccggguuccccgaccccccacucccgaaugagucucauucuugacacagacuuagaaaaccucccauucauaaacugaaccgcuaccuuuugcaccaugaauugaaaguaaccucagaaacguuagaaucucccaugccuuuaaguucacauaagcaaacuucgggcucaccugcaguuaguuuuaaaaggggauuuggaaggccgaucauuauggcucagaggccagcagauuucugugaguucgaggccaucuuggucugcaaagagaguucuaggccagacaggaauacauagugaaaacaugccuaaacaauaaaaaguggggagacauuggaaugcgucgcuaggguguggccgaccuuccagcugcaaguucagucagcccaugcggaggaccgacagguuuugaagaccuuuugccggauuccgccuauccuaccccgccagggccccgcucaucuaccgguuaugaucccgccccucgucgaccugccccgcgcuugcgcagcgccgccagcccggccccgcccuucgcggagcaaucuuugcccucagggaccgggcuuagguacaagauggccgccgcgcgcccggaucccccgauuccgagcucaccgacccgggagucgccauccccggagccgccggaccuggugcgggcgacgaaggggucugggccggggguucacagcgaagaagaucgcagggcaaggggcggggucaaggcggggccuagaacaauugggcggggguaugguaacccucuggggcgggguuuagggaggagccuauggggaaugaggagcgaggccugguugaggcgggucuugaagacagcuugugucuugggcuugguuggguccagggagaggacaagggagcuugcauaaagaaguguggcaucuuaagaggggcggggcaccagggaaauuauagggcuaguggaugguugggaaggugaccccaaaggagagcuauaauucggucaccguguugggauggcaugugaugauacaaggacugacugccuuacaaaugcccaagggaggagaaaugggugcuucggaugacuuuagaacuuauaacuaguaacuggaaaguaacugaaaauauugguucauucagcaaacauuuaaagcuccaggggaccaaaauggacaacgauugcguccucuugcaacuugcagucuuaugaggagaaaaagugacgauaaagaguauuguaauauguccuauaagagaaauaaaaggugcacuuaagaguggggguggagcaagcuaaauuuaaauggcagaagucagcugggugccggcuuaugguugcaauguagucagugagauaagcaggauccagaucguguuggauauuauaggaaggacacgagguuuuaagugcaaucggaggacuuggaguggcgaaaugucaugaccucauuugcauuuuccaaaguccauuuagggugcucuagaagagguggauaaugaggggcagaagcaggaacagggguuaccucugagugguguuuuucauucuaaggggggaauuaugagacuuuuaacuaguacagaggagagguaccaccgugucugugguauauuugggucaagaaggggaaaugccagaacaaggauccaucaaaaauucgguaucauggauaacaggguuaagaaaucaagggauacggcuggagagauggcucagcauuuaagagcccuggcugcacuuuuagagguucaguuccgggcauccgcauggaggcucacaaccaccugugacuccauuccuagaggaucugacccucacuccugaccuccauggacagugacacacacagugaacacacaugcaggcucucacacagaacagaacaugaaauacuugggcuugauggcaagcgcacgccuuuaaucccagcacuugggaggcagaggcaggcagaccuuugugaguucuaggccaaacuaaucuacacagcaaguaccaaaccagccagggcuacauagugaaaccuucuaaguaaauaaauaacaaaucauuaaauauauauaugccaggcggugguggcacacgccuuuaaucccagcacucgggaggcaaaggcaggcggauuucugaguucaaggccagccuggucuacaaagugaguuccaggacagccagggcuauacagagaaacccugucuuggaaaaaaaaauacaguggacuucagaggagcaaacauuuuauuuaaauuuuuauuuuucauuuauuaugugaggagagggugugagugugugccauggcacaggaauuuggaggucagagggcaucucaggaagucagucagucugucuuuccacccugugggucccagggaucauacucaggucgucagauuugguaagugucuuuacccacugagacaucuucacugccaaagcaaguguuugaauaaguggaggcauuauugaaugaagacucucuccaagcagguccacagccuccuguuuuuucuucugcucuccagguccuggugccugauggucgcccugucacacccccaggugaccucaucgagauccaggugguaaaagucacagauaccacaucggucccugagcccccagagccaggaucuuuucauugugcccuguguccugcugccuuccgucuagucucagagcugcuguuucaugagcauggccaccuggcaagcauggaggggcuugggcaggauggggauccuagccguugucauguguguggccacagcuguccagguccugcuagccugcgugcccauuacagcuugcacacaggagaacggccuuaccgcuguucccucugcccacgggcuuuuaaggccuuggcaccucugcuccggcaccaacaccgacaugggguagagcccggcaccucugaaaggcuucuacccacaacaacaaccggacagccaaacucaaggguggcccaggagaggucggagguggugauggcugcagcagcugcgggugcugugguaggcaagccuuucgccugcagguuuugugccaagcccuuccgacgcuccucagauaugcgagaccacgagcgggugcauacaggggagcggcccuaccacuguaguaucuguggcaaaggcuucacgcaguccucugugcugaguggucaugcccgcauccacacaggcgagcgccccuuccgaugcaugcucugugaccgcacuuucaauaacuccuccaacuuccgcaaacaccagcgcacccacuuccauggaccagggucuggagugggagagucuagaggccaacugagaucaucuucagugucccaagaaucaugaaguaaaugugggacagagaacacuauggaagaaggguguagagagacugugaaagugaauguggagguugaccaguaggcuggaagcuaggacauaucguaggagaggugggugggcaaauagaggcagaggccaaggagaaaucaugagcaguuggaguuagaugaaaaagggaaccugguucuggucucccagaaacccaugcuacacuugagacucaggaaagagguacuuggggucuguggguacccagauauaucuaaaaauacauagacagcugggcaugguaaaggccuguaaucccaguacacuagaggcugaggcaggaggaucaugagguccagaccagaccaggcuggaaagcaagacuuucuguaccaccaccucugguccaaugaaauguuuugccuacuucaacuggauugcacugguccugggaugccuacccuccagugcagaagaugcccaccaagucaucucuaaagggaugcugggauaccuuccccucaaaaccgagaguaccuaaaccacaucucucagaugugaaccugcucauaaagauucacucuaagcccugcucacuucuccauccuaccccauagugggcucucuuuaacccacuaaacuuaguugcaagcaacugagagcacacacuauaagcaggcaaucacuugguaucccuuuaagccuuaggcucagaaccugucuauaaagaaauuucccaucucucuauucugcacucugaaguaggcaucuuccugcauagcccugggcaauucugaggcaggguuagcuagugaccaccuuggugggccaguacaggguguaaagaaagaaaugacacugugguaaggggcuaaaaggacuugggaguuagcguacaggguaagaguggggacuuccagucuguuccuauuaaaagacuuucuguaagucuucucugucagucuuguauuccaauucucuggguaguuauccauuaucuggaauggugagugaccaggcuugggcuguuuggagaugucuauuugguuguguuguaagaaguuuugugcaaugaggugauguaggagguugguguacuuacucagaagggucccuaauuuucucauggagauguguugcuaguucaguccuugucauccagcauccccaagagacgauccucggaugaugcauaauaaaaacucaccagcuccuccaaagagccugcuucccaagacaacggagugucuugguuuuuucacaugaauccuugccacuaaacagaaacuccuugcugcuuucagaggggacuacccccccccaaaaaaaaaccaaccaaacaaacaaaaaagccaggcggugguggcacacaccuuuaaucccagcacuugggaggcagaggcagguggaucucugagcucgaggccagccugaucuacaaagugaguuccaggacagccagggcuacacagagaaacccugucucgaagaaaacaaaacagaacaaacaaacaaacaaacaaacaaaaaacaggggacuaccaacacaguggcagugcagauaaguggucagauucaaggagaagugaaauauaguaacugacacucugacucaguguucaaaucauugagaaguggggggacugaaagcuaaaggaguuuguacacucuuuuagaagagggcagugcgguuaggggugcaguuuagcugcuagagugcuuuucuaguacacaugguguccuggguucaaucuccagcaccacagaagccagucauaaugcccauuuucccuuuguauauggaaacaggagggucgaaagucuguagucucagggaagaggcucauaaugucccaccugucucuuaggagcuauaggcauuuaaugguugccuggagagggggaaccauaguccucagugguagagcuacugguuagcugccccugcucagguaaauaagccuuccaacgcauguuuauacaugcaacccucacuaaacuuaaugggucaccaagaaaauaaaagacaggaaaguaagacuggcuuguuggcaagaaagggcucagcaggauugggagagggauaagagcauaguggagguuguguguacaaccaaaguuugugugugugugugugugugugugugugugugugugcgcgcgcgcauacagauacagauaugugucaaacugagaggacagauaaaaucuggggcugaaguaauagcucagcaguuacuuccagaugauuguugugugauucccaacacccaccuguagcucacacccaccuguggcucuagauugaggaugcaaugaccucuucuggcuuccaugggcaccaggcaccaagcggugcacaaacauacacgcaggcaaaacacccauauaccgaaucucuuuacauguuuuaaaaaaucuagauuuuaaaaaaaguucaagauuagccagcuaugguggugcacaccuuuaaucucagcaccagagaggcagagaggcagguggauuucuguaaauucaaaaccagccuaguccacagagaauuccaggagagccaaggguuacauagagagaccaugucucaaaaaugggggaaaaucaagccuaucuguaccuacaaagcaaguccauagcuagccuagacuacaugagaccgucuccaguaagucugcagacuguguuaaguuccucagguaugcucucccagccuacuggagugugaaugucauguccgaucaauucaucagucucccuagcgcccaggucagggcuuggcagacagaaggcuuccgguguuuccaugguggcugagagcaucauggaagggagucucggggucucaaaucaguuccugagagggcgacuucccuguuucacucaggcuaaugccugggacauggcaaauccucacucaaccuaggugaaaagagagugaugugaggugauguguccagccagucaguggaacccccuaggaacagcaaggacagaccccagcggcccuguugauaccauuuauuguucucugcucuguacaagccgcgucuguccccugcccaccccaccccccauccaagagcacccagacccccaccugugcccucccaacccuucauaguccacuguccagccagaucccagaggauguggagagggcgaguaguucaaacccaucuccaccacagaguucacuggagccagaauugcugcuggguggcagaugagguuuacaaaagaggauccuacuggacagaggaucaaguccagugucugacagaugaagaaggaagggccagaauggccugggauuggagcaauuuaaucuucaguuuguagggcauggggcuggaaggaagcuagaccaccugggagucuuuagaaugagugacaguaagaagggguggggagagucugaccagcagccccagaaaggaagaguccagaagggaguaucugauuggaguggcauacugaaacacccuggucagggauccuuuccggccaaggcgcuucccccuguuccgggcaucccaagacccucagccuugugcaucaggcgguguuucuucagaccauagguguuggcgaagcccucaccgcaggaggagcagcggaagggccugccgcccugaugggcagccagaugcuuccggaaguagccaggauccuugaaggcuuugagacaggcaggacagcgcagcucgggccgcgggggcucgugggcucgcugauggcguaacacggagcucagguagaagaagcccuugccgcagugcucacagcgguaggcgcgcucgcccaggugcagccgcugaugcuccagcagguuggagcgguagcggaaggucuugccgcaggcgccgcagcgcugaggccgagccacagcgugcagccgccggugcuccgcuaggcuagaagacugcgcgaagugcuuggcgcacacgccgcacuugaaggcgcgcucgcccgugugcaccacgcggugcugccgcagguaccaggagcgcaggaagccucuaccgcacacgccgcaccgguagggccgcugcucugugugacagcgcugguggcgcaucaguagggccgccucccagaagcgcuucccacacacugggcagcggaaaccccguuucugccgguggcuucggcggugcaggagcagaucguacgcgcccgcaaagcucugaccgcagaggccgcaaccaaggguccggcgcaccaggugcacauacuuaugagucaccaggccuaggaaaugcuugaagcuuuggccgcauguggcacagcugaagcgcucagcgccugaacuggucccgccacccgauccggccaccgucgccccacccgcauccucgcugcccccagacaccccagccagcgcugccacagccguccccaccucuccggccaguccguuguccagcacgcuggaugcaucggugccgccgccgcugcugccgccaucagaagacugggggccacuggguguuggcgcuagaaggcgcuccggggcagccuggugaaccagcuugugccacaugagguucucgaugaaaccgaacgucuugccgcaggcgucacagccauacggcuucucugacaugugagcuuccuugugacucaugacguggaagagauccgggaagugcuccccgcagucugagcaggcauagcucaggucggccggcccaccugaagugccugcagcuccggguccacaggccccagugguccccuggccgguggcgaggccuguggcuccggccagggcgcagggcaauuggagccgaugcaccuggcgguggcgugugaggcucugcggguagccgaagaccuugccgcacaacucgcacuuguagggccgcucucgggugugcaccacguggugcuugcucagauggaaggacucccggaaacgcuucccgcacaccgggcacugguggggcuucucgccgguguggaugcgcucguggcgcuucagggucucgcggcgcccaaacgcgcgcccacagaugccacagcagaacgucuugcuggggccgccugcgcccgggccuccagcaccaccauuccccgcaccgccgagcagcagcggaugcgcgcugagaagugggacaggcaccgcaccauacaccacagccgcugcggccgcuguggcuuucucgucgguaguggauggguccgcgggcaggagguaaggaccuggggggaagggaggugguggcugugggaccgaggcagccccguccuuugccggcuccguggccacagguggugcgugggcagccuugugucgcagcaggcucugcggugcggaguauguuuucccgcacaggucgcagggguacaccggccgcggagucccggccgcugcgugggcugccuggugcuugaggagguaggaagcaucgcggaagaccuugccacagaugccacagggcaggcgcagcaagucggccgagugcguuuucacgugacguuugaggcucucccuccgguugaagcuuuugcugcacacggagcaggagaaggguuucucacccguguggaugaucuggugcugguggagguggcuaggcuucuugaagaccuuccagcagagggagcaggcaaaugggccaucaccgccaguaguggcagagggaggcauggccaccccggguggggcagcaggggugguguucccaucaguggagguggcaggcguugcagggguggcugaggggccagaggacacugcggcggggucagagcuggcuguggcacuggcuguggauaccgggaggcccagugaagggagugcgggcccaggcuguggcguaccuccaguugguguugguggcacauccuuguggcagcgucgguggcggaugagacuggagacaugguuguaggugcggccacagaugccgcauucguauggucguuccccggagugcacuaacaugugcuggaccagaugugaggacuguuugaaggacuucuggcaaacaccacacgggaagcgucgcuccaucagguacuucagccuucggaaauagcccuugucguccuugguugggucgcaggcugccccuacugcgggcccaggcggggucugcgagggugugguaaguggcccuggggucccagugggagugcccaguccugaugcuacuccaggcccaggggugggcccaccacguuucagguucccgaacaggugcugguguccagagaggucgacuauuccccauugcggagcagggaaggcagcaucaaagaguggagggggaggugccccgaagguggguggcaaaggcggauccaucuucuuggcuugggaagaggaugaggaagacgaagaugaggaagaugaugaugaagaugaugaugaagaugaggaaggagccuccgccuuggguuugaaacuggacugggguggguagucauauugggguggaggaggcuggggugggggcuggggcgggggccccgggguacagggcagggcugccacugccuuggcguguuccccguauagcuccaugggcucaaagcgcuggugguugaggaauuccaggaagucaaauggguaacucuggaaguggaccccguccucgcccccgaugccgcugcucccgccacccccggcaccgcugccugccugguuugccuccaucucuggucgguggaaagaagggagacccugugaagaagaggauggggacugagcaaagagagcccgugaguagcaagcaaagggaacuagauccaugccucugcaccaacagcauucucuuagcagcucgccuaucauuccacccauacaucugcuuuccucuagccuguaauaacucagggucauugcuagccuccucccaaccuuaccuccaucuuuucuggaucuucacacaccucccuauucauccucagacugucuuuaugcaccugcuuucucuuccaggacuaauuccccaaggaccugggaggugggguagcgcucaaacucuccucuaaauugauucccucuacuccauuccccauaccuuccucuggucucaguccucugguuuugccacugcaaaaugaagauaagaauagaucccaucugagugguuuagacagcagcuucaggaaccaaaacgccagcuucaaaccuaagccuccacccccaaccccccuuuuuuucuucuuuguuuuuagacaguguuucucuguguagcccuggcuauccuagaauucacucuguagaccaagcuggccuugaacucacagagauccacuugccucugccuccugaguaacugggauucaaggugugcgccaccaucaaccugugugugugugugugucugcgcucacagucauuuucuagcugugugaccauggguaaaugacugaaccucugugccacacgaccauuguaagugagggcaauccaagcacucaggaggcugagauugcuccaaguuugaggcaaccuuaugguaguuggggcagaaggaacaagggcuaagacaaucaggaucuaucaagcauagggcuguugugaagauucagcgcuuuaacauuaacagguggaaggcucccuggcacccuguaaacacccaugguaauauaugguaauaccuucuauuaauuguuaguaucauuuccaguaucagaaacaggaaagccaauacuguggggagagggaauauuccuugaaugcaaaguuggaagggaaaucuacuugccuaagacaagcugguaacagcaagagugccugcauuccuagaagauagcucaaagccaugacauacacaaauaggccuggguucugaacugaucucugcaugggcaucugagggagaaaugcagcauucaucaacagugugcaucccaucccaugcugcgugugcuauuagugauuacaucacauaccugggcuuccuugaacacccccggcaggcaggcaggcacuuucuuguaccaucuuuauggugcauuuuccaucccugcugugugucuguccuucccucugcacuagaagcuaacuccuggaguccauccuguguucucagacccagucaucccaaugagucuuugaagagucaaugugagaaaguccacuuuuuugcccaucauuccgaggacugccccugcaguccugucucuauguauagcccucaucuuccuuacauacuacacuaaaaagcuaagaagcuuugggggagaggaugucucccccucacgccucaaagcccaggaccuuuuauuuuauucagucuuucuggauggcucuaugcacccacgggugagagguguuuccacccuacccuuacucagaauuagauauuuucuuucucuuucucucucucucucucucucucucucucucucucucucucucucucuuucuuucuuucuuuucuuuuuuagacaggguuucucuguguagcccuggcuguccuggaacucacuuuguagaccaggcuggccucgaacucagaaauucgccugccucugccucccaagugcugggauuaaaggaaugugccaccacacccggcuagaaugagauauuuucaguauccaguucugaguguucugggaccagauucaacaucccaugcccuucacacucccucuagucuaaucuccagaagaacaaagguguagcaaccaggagacugcauacagaaccuaacugagggacucagcugccaaggaggaaaagauguaguauaaggaugcagggagugccauggaaggggcagggacaaagguaccgauuuugcuugcuuccauuagcaccuuuccaauguguuuccacuucucaucagguccccauuacaacucuuaaagacauuuauucucuccacuggacagaugagaacacugaagcucagagagaucugguaaauuccucaaaguccccauagccugcaguagagcaauuggcuugauagccaggagagaaccccaaccuguaaggaagcuauacccucacccccaaacggagggaguacagguuagaauuacagaaaaauuaggggugcucucugggaucuagugggaggugugagaguuacuagucaacagauucugccagacauggugaugcacaucuauaacccuaccauuugggaacccgaggcaggauucaaggcuagcuucaucuacauagugaguuugaggcuagguugggauacaugagacucuaccucauaaaacaacaaacucuguggauucccugucugcccugggacaucauuccccagaagucaacgauaccucccugagucccauuuagguuucuguccucuugccuauauccauguagccuauaauccaguuacuuuuaccacaguuagugccaccaacaugcuuuugccacguguuuacuaaggcggccaggacuaaaguagccuguucuguuugccauuaugccccagcaccuaccacagugcauauguggaaaagguguggguacuugacaaauauuuguugacauguugagcuuaagcaacaucuagcuugcucccucuccuccaggagaucuaugaagagaccaugagggaaacuagagaauguuuugcaugaaugaaaaugaaaacacagcagggugugguggcacaggcuuguaaucccagcacuuacgagagaagcaguaggaagaccaggaguucaagaguagccucagcuacacagagaaguucaaggccagccugagcuauagaggacucagucucauaaauaaguaaaaaauaaauaagaaaaugaaaacacaacauaccaacacagaagagacacagcuaaagcagugcucaaagggaaauuuauugcuguagaugucuauauugauaaguacuugcugacuaauaaaugaggagcuaggaagacagcccagaggguaagcauuuguucaauaagccuagcagguugaguucaagccccugaaugugcauuuaaaguggggaagaauauaguggugcacauuuaaaguggggaagaauauaguggugcacauuauauaguggugcacauuuaaaguggggaagaauauacuggugcacacaugcaauccuaacaccuccaccgcaagauggcaggcagcgacagaagaaaugcuuaggaccaauuagcccaguguaccccucagcaagcaggaaggcgagagcugacuaccaaaaguuguccucagauguccaauacacauacuggcaagcacacauccaugcuaacacgcaaagucaaacagaugagaccaaacugucuagagccucccuagagagggggaauauuuaacacaauggaguuccuaugucucccagagaaggaauucucuggucagcaguauuccacagcuguaggguugccacaaggaaagugcacacuaaugaacagaauuuauuagguucaggauaaucccaaguggguaacaagacauuuucuccuuuaguggacuuuaaaaaaaaauguauguaugagugcacuguagcuguuuucagacacaccagaagaaggcauugugucccauuacagaugguugugagccaccaugugauugcugggacuugaacucaggaccucuggaagagcacuaagugcucuuaaccacugagccgucucucaaaucugacugaagucuucuaaaccauuuacuacggauguaacuugugagugagggcgcaugcgaaguuagaggaugugaugugugugagggagggugcaugcgaagucagaggaugugacgugugagugagggcacaugcgaagucagaggaugugaugugacgugugagugagggcgcaugcgaagucagaggaccgcccugaagcugcuucucuccuucuaacauuaauuggguuccagggauugaacuugggucaccagucuugcauggcaaacacuuuaccuacugaaccaucuugacaguccaguacccaaaucuuaaauugcuccuuuuagaaauauuuacuuugugugugugcucccugcaugccugucuacgcacugccugcaagccugggcggaagccagaagaggcuguuggauccccagaaucugaguuacaggugguugugagccagcauguggauggauucuggaguccucugcaagagccacaagugcuuaauaucagaccagucucucuucagcuccaaauggcuauuuucugagguggcaugugucagggaaggguuuaugaaauuauaauggaugagacucccuuaccacauacaccaaaccaaaguuccacauaaacacagcaaguuuuaauaggacugaggaaaugguccagcagauagagcauaugccauccaagccagaagaccagaguuuggcucccuagaacccauguaaauguuaggcaggcauagcugcucucugcaauccaucacuuaaggcaaaggcccagcuaguuagcuacauuagcccaaccugugcgcuucagagucagugagagcccuugcuucaauaaaguggagaggaaucagggaagacacucauggucaaccucuggcccuacacaaguauacacacaugcgcaugccaugcacagggggaaaaagaguuuuaacaggucauaucuauuuuuuuuugacucuucuaaaucccccucccaacaacgagaaaggauggguagaauuacugacucagaaacaccaacuucagccaggcagagguggcacaugccuuuaaucccugcacuugggaggcagaggcaggcagagaucugucaaugcaaggccagccuagucuauaaagcaaguuccaggacagccggggauacacagaaaacugccucaaaauaaguaaauaacaacaaaagccacugaggaagagacuggaggucacugagcuaaauggaggugaagggagaugguugaauuccagaugcuguacucuuuucuugugauguguugccuuucaguauuucacuuuccaaaguagaaggaagcaggauccucaaagcacuguguggcggagacaagaccugucucauccucuccugccuccucaucacaucugaguuuggcccaaguccagcaccagccacaggcauucacugaauucuaaagaguauggugcuuggugcauuauauauagugugucccauuccaaacuuccaacgcugucaauaguguaucuaucacgcuuaccuguaccggacccugaugcuccuguugaaagccuagugaccccaucucacucaguaaaacccaaaguccuuccaaugaccuacacaggcccccacaagcuugcagcuguuccuccaauaugcuggcuccauuucuguuccguggccuguguuucaggauuauagcuucugcuggcaaacuuaacacccccauacucuccuccucuuaucuccuuccugucacugauuguugccuucucaauggggcucugagcaaccgcugccaccugucacccagaccuauaaucccuagcuaguuucccacuagaucccuugcugucauagaauguaccuguauguauccugccuuucugaucauauuuuuacuggccucccucucugaugccacgauauuuuuuccccuuuuucauuucucacauguauacgcacaugugugcauguugcagacucaaggcugacgcuaggaaugauccucacucucucuuccgcaguauucauugagcagggucucucaaucaaacucagagcucacagauauggcuagucucguuagccagauuguuguggggauccuguuucugcccucagagacuagagugacagguggaccuccuaacuggcuggcauucagaugggcucgggaaucugaacucugauccccauguuuccauagcagaugcuuagucacuaagccaucuccacagccccggccggcguuguucugaacuguccucaggaccuaggacaguaccuagcuugcuaaucccuaucuucucuuuuucccaaauaaaaaaggcacuuauuucugguguccaucuguauugugugugcacauauguagaggugagaggaaaccugcacgagugagugcucuccucccaccacauggguucugcagacuggacucaggcuaucaggcuucaguguuggccugcgcagccaucuugcuggcugcuugcuaaguauuccugaauaagugaagcaaugaggcggggcaagcgggcugaaagaaggcgugaggcuaguaaaguucacagcuccuacucuucuucauuccacccgcaaggcgaggaagcugucagagcagccuccguggugggccacagcagucuaggaccaaacucucugcucugggcuuuaccugaggaacaagauggcgugagacaguccacacguaguauuuuugauauccuagccccuauaacuguccucggguguucucauuuugugugugguguaugauugcaugugaggguguggaggccagaggccagugucauguggccucaacuguguucuccuccuuuccuccuuucuuugagacagucuuucauugaaucuggagcuaggcagugagcuccaggaauccuccugucucugucuucccagugcuggcauuacaggcuuacaggcaugugccagcaugcccagguuuuguuuguuuguuuguuuguuuauguaagugcugagaaucugaauucaggacaacacuuucuugacugaacuaugucccccacccccacauagcuucauuucuaaugucugccucuucaacauagcacucgaugugaauuuuugcccauuuuauucucuguaugaaguagaugcuuauuaaucagguguugaaagugugaacaaggaacaagugaaugcgggaagaaucuuaugaguucgguagcgcugaccaaaagccaggcaauuuaugccaaggcuuuuuuggaucaagccuucucugauucugguccaaacucacugcuacucucccacaccacaucgccaugaccucuggaccucuggaucagcuguuccccagaucugugaauggcaagauuaaaucuuguguuuaagcauucacaucguagcucaccagacucucagaaaacccacagagcagcacuguuucugaucugccucucaacuaggcuguaagcacccuguaaaaugagggcucguugcaucucucuccucucugaaacugcaaggccuggguauagaauggcgguguucauucagcgaagaauaaaaccuaugggaaaagauguaagcagagccaggucuuuccuaggaaguuuggggacaaugucaagagacuuggccaaagauggggucaagagcugcugauacuccgggaaggaacauucucugcuaacuugcauuguccugggauugcagaagccaggaugaggggaggggggggaagugggccaggaguguuucaugagaaucugaugcuaaccaggcagauguuucucccuaaacggguaaaaggccaugguauuaaaaaacucuggagggagcugucccccugggggggggcgggggaguugaauuugaagaggucuuuuugggucaguugcaggaaaagguccuuaaaacgcacuuuuagcaugggccagaauagaaaauauuuuuugcacccacaaagagggcauggggaguggguuguguguggucagacauaguagggggcaacccuagucacaaaguacuaaugcuacacccccuggaagcaauccuacaguagauaggaacagaggguucaggagcagcuacccuguaagcacagccaagccgguggcaagcagaggaucucguggaggaagcugaugaggcggcagggaaaggauucguggggggcccuggcacuugagagguucuuuacuaaugaaaucgagcuguuagccaucccacgguauuagggggcaucuacggguaagauaucuggagugaucuuguaggggacuagugguuggggauccccugccucgggcccggcagugaagcacugacauucuuggggggggggugcguucuggggacugcggcagggcagggcgaggccccccgcccccgaggaacccggguccccgggccgcacacccagucacucaccggcgcuggggucuccgccgggaggaggcugaggaggcggaggaggugccgccgcuccggggagacccgagggcccaaccggaagugccgccccuucccccucaacuccccaccagccccgcgccuccugcccggaagcggaagucgcgcccguucccccaagcgccggcguggaggaugguggcggaggaacggguaagggaaauuacgccggcacuagacacgggaggggaacagccaaggcugcuuccggugggcgaacggggccuagugcgcaugcgcccauugcgcccgcuucuucuuagggcaccacccacaggcuccaggcuuccgguuaggacgcacccuagacucgggucucaagccaaagccucgcuuccuaggcuggaccacgcccaucucugaacgucccguuauaggccggucggauuccuuuuucugcaccuccgauuaguuuguucuauucuuucuucgcuccaaaucucuacuuuuggaacuccagccucucagacgggucacaccuacaagccacgcccccuucuaaauccugccccuuacacaaaaaagcuuuguacagccuguugcauauaagggacaucgguuuucuuuuguguuguuguuguuuuaaaccuuuugauuuauuucuucuuuugagacagagccuccucacacuguggucaggguggccuugaacuccuuuuuuuuuuuuuuuuuuuuuuuuuuugguuuuucgagacaggguuucucuguauagcccuggcuguccuggaacucacuuuguagaccagacuggucucgaacucagaaauccgccugccauuggauaccaagugcugggauuaaaggcgugcgccaccacgccgggcuucaggguggccuugaacucuuguauaggcuauaauggcuucaaacuugcagcaauacuaccagagccuucaggaauucugggauuauagugaugacucuuuaaugacuuguauguaguccugccucgcaccuugaaagcauuccuuuaaaguuaguuguuagcaaccauuggcaucaauuagcucaaugcucuuuaacucuuaacccagacuuacugaauauaaagcguugggauggaucuuaggaauccauuugaauugaaacacuucugaugcacucuuagaugagaaccacagcuuuggcacacuuuacacuuagccacucagagcucuauaaaucuuucuuaauucagccccauuacacuacagacagcuaagccuaauucuaugcauccaagcucucccuuguuguuuuucuucccucuccauggccugaauggcagucacgucuaacaguuaagccuuggccucuuuuuuuucuuuuuguuuuguuuuuguuuguuuguuuguuuuuucgagacaggguuucucuguguagcccuggcuguccuggaacucacucuguagaucaggcuggccuggaacucaaaaauccgccuaucucugccucccaagugcugggauugaaggcucagcuucgcaagccucuauuaaaagaucucuuaacaacaacaaucuugaacucugcuucauuuugaaaguauuuccuuuaagccccacccuucauuuaaauaccauucauucccucuaaauugcuuucugccagccaagccuaaacuucuuugacccucagacaaauuuucagccuccucuuggguugggcagcuccaaccuaaguuuuuacugcacaaguuuugaacaucaucucagcccugccuucucaagcucacacccuucucucuaaaugcuauugagauggucgaugcuguucacacuccucaaaucacacccuccagcuggccauuggcccauacaucaagcccucaacuuaguuuuucuuuccaaauaagaaguucucuggaaaagaaaugggagcaaaaagugucuauggagaauuuggaagaauuuaacuaggauggagccuugacucacguuugcauaguaggucaaaauuuuuguaguacuugucugguggaggucagauugggcaaaggcuuguuccaagucauugguucuuuggcaccaagcuagggagaugugugagaugggguugucuccaaucacgcacacacaccacugucaggcaagguaauggaggagcacugaaagggacaggcaccaugacugaacacacaguggaagucaguaggcagggauuuauuuccacagcccaugccucccagagcuucucaguccacaggagggugcccaauggcaccaggacccagagguuuaggucccugcuuuugauccccuuccauggugggaauaccaccagaaacaagggugucuuggccuucuugcccgcgcccagcaccagcugaacccccugcuguaaacccagacaggggagaagugguggaggauaugggccaaguaggcuccuuuccuucaggacucuccuccuguaccccuucuugaacagggaugcccucgucgucgucccacagcgguuggguucuuggguuuggggggcacaggcgcacaggcauccccacaagcucuggguguuugcguuuguaauggcgccggagaguauuggccucggugaagcgcacccuacaugagggacauugguaaggucgcucaccagaguggaugcgguggugaugugcgagcuccccugccucucggaaacggcgagggcagagcacacaacggaagggccuaaggccagcauggauguuacaauggcgccgcaaguggcuggaccguuugaaggucuugccgcaaucuuugcacacguguggcuucaauucugagugugagaugcuguggcgcuccaggucagagagguaggggaaggcucucaggcacacgggacagaagugcggagcccucuuggaaccagagcccuggggcccaucugcugcugacccuucaggaacuguauaaggaacacccugaucaucgaucaacagaagaucgcugcugccaccgcuguccacuggugcugucaacgggguuuccugcucugaucuggggggacggccccucuuucgagggagggaggacuugagaguccgauuggaggugguggcucccccuggaggucggccucggcgcccccggggaacaggaggcaguaaggccagagguuuuucuuccuccccagacaaaguugaaggcaacgggucugagcugggguuguccauugagaaguggggagcucgagucuggguacuggagccggcuaagagaagagagggggcggugucaguguggugagggucuaagcccccguguaccccaguaucucaccuauuccuucuaaagacuuuugagauccauauaagacauucuguauaaguuaguaagacaugcugacugcccuccaccaaagggugucccauaacuucuuaaccuuuggaucuaguuuuucuuucauggagguuaaauaagaaucccccucucccaccaggguucuauguuugaguguuuggauccauuaguggaacuguuugggaaggauuaggagguguggccuugaugugguagguguggccuuauggaguaguguuucacuaggugugaacuuugagguuucgaaaucccacaccaagccagucuccuccucccucaaaccuauggaucagaugucagcucuuagcuacuguuccagcaccaugucagccuguuggucaccauucucccaaccaagauagaugaucacggacuaacccucugaaaaauauaagcaugccuccaauuaaaacgcuuucuuuauacguugcuauggucauaguuuuucauuacaucaacauaacuacaaaaagccuuuaaagucaaaacaagccaaaaauaaauaaauuuuugaaaaaauccagcuaagaauguaggccuugaaacagcccaucaaauucugggucacaaaggucucaaaaggcuccugcuccccacagagaugggggggcaugaagagagacaaguccuagccaaaagcuauugauuugugaaagauauauaugaaaguugcuaagagucugggcuuugaagucauauacccagaaaucaaaugcugagucugucccuuccuuugugugaccuuagccaagauccuuacuucucugagcuuauuugugucuuuuguaagauggaaaucggggauuuuuguuuauugguuuguuugauugguuuuaccuacuaacccagacaugcugugaacauaagagccagcacuacagcacuggucguugagccucacagcaauccucugagggaacauuuucaaaggguuucauuuggauccaguuuggccaacaaucaccaugugauucuacaaguggcuuugccugagucuguuuccuucucuauaaagucaauauaccaagguuguugggagaaucgacaggaaugaggaagcuucaaaaauguccuuagugcacagucuagaaaauagaaagcuccaggacuuuccccagugcccacaagaucccaggauaguaggaauugaguguacuuggggucaaaggucaaaggugcagcuagcagcagauucugucgggggacccugcaccccucuuuuuauuauuuuauuguuugguugguuuaaaguuuugugugugguguuggcuauccuaaucagggccucacacauacugggccugagcuacacccccaaaacuugcacccccuuuuaauaugcacauagcaugagguccacacagaagcaacuuguccaggaucauaugguucgcacgaugaggaagccuggacaagaagcugaguuucugaaacauaccuaugaagugacagaguggcucuucgacccucucccacccacaaguccgguacgacgcgugccugucaggcgcgaguggcccagcccgcaagcggggcgggcccucaggguacgguggccaaugagcggcgcggggacauugguggcaggggcugccagaagggggucugcgcgcgcgagcccagaccgcucggcggggcgcgaggucgacgugcgcaggagagagcaaagaagcugggaacaggugccgggugcgcgcuuaugcgcgcgcgccgggaccacccucuuucccccaucccccccacccgggccccccgccucuggguaccucauuugcaugcugccugggcucgcguguguacgcgcgcgcgcgccgggggcgacgggccgaagcgugggaaggggcgggagagagggggcccagccccuaggcggcggcggggcgggggugugggagguagcagagcgugagcuggaccccgccccucggcacggaagccgggggccccucccucccuucccugcugccagcgcccgcggggaacaaagaggaugcccugggucccaaggccccgacacgcuagcaacaaaugcgccugcguaucaggcgccuucgugugcccagugacaacgcacaaaaauccccaaccaccugcaaaaaugccuuuccucccacgaagccuucccaacccggugacccaaucaaauacagguaccggauagaugagaagcgggaaauggcugc

SEQ ID NO: 3533 - RNA, 4371 nt, Mus musculus
aaucuuugcccucagggaccgggcuuagguacaagauggccgccgcgcgcccggaucccccgauuccgagcucaccgacccgggagucgccauccccggagccgccggaccuggugcgggcgacgaaggggucugggccggggguucacagcgaagaagaucgcagggcaaggggcggggucaaggcggggccuagaacaauugggcggggguaugguaacccucuggggcgggguuuagggaggagccuauggggaaugaggagcgaggccugguugaggcgggucuugaagacagcuugugucuugggcuugguuggguccagggagaggacaagggagcuugcauaaagaaguguggcaucuuaagaggggcggggcaccagggaaauuauagggcuaguggaugguugggaaggugaccccaaaggagagcuauaauucggucaccguguugggauggcaugugaugauacaaggacugacugccuuacaaaugcccaagggaggagaaaugggugcuucggaugacuuuagaacuuauaacuaguaacuggaaaguaacugaaaauauugguucauucagcaaacauuuaaagcuccaggggaccaaaauggacaacgauugcguccucuugcaacuugcagucuuaugaggagaaaaagugacgauaaagaguauuguaauauguccuauaagagaaauaaaaggugcacuuaagaguggggguggagcaagcuaaauuuaaauggcagaagucagcugggugccggcuuaugguugcaauguagucagugagauaagcaggauccagaucguguuggauauuauaggaaggacacgagguuuuaagugcaaucggaggacuuggaguggcgaaaugucaugaccucauuugcauuuuccaaaguccauuuagggugcucuagaagagguggauaaugaggggcagaagcaggaacagggguuaccucugagugguguuuuucauucuaaggggggaauuaugagacuuuuaacuaguacagaggagagguaccaccgugucugugguauauuugggucaagaaggggaaaugccagaacaaggauccaucaaaaauucgguaucauggauaacaggguuaagaaaucaagggauacggcuggagagauggcucagcauuuaagagcccuggcugcacuuuuagagguucaguuccgggcauccgcauggaggcucacaaccaccugugacuccauuccuagaggaucugacccucacuccugaccuccauggacagugacacacacagugaacacacaugcaggcucucacacagaacagaacaugaaauacuugggcuugauggcaagcgcacgccuuuaaucccagcacuugggaggcagaggcaggcagaccuuugugaguucuaggccaaacuaaucuacacagcaaguaccaaaccagccagggcuacauagugaaaccuucuaaguaaauaaauaacaaaucauuaaauauauauaugccaggcggugguggcacacgccuuuaaucccagcacucgggaggcaaaggcaggcggauuucugaguucaaggccagccuggucuacaaagugaguuccaggacagccagggcuauacagagaaacccugucuuggaaaaaaaaauacaguggacuucagaggagcaaacauuuuauuuaaauuuuuauuuuucauuuauuaugugaggagagggugugagugugugccauggcacaggaauuuggaggucagagggcaucucaggaagucagucagucugucuuuccacccugugggucccagggaucauacucaggucgucagauuugguaagugucuuuacccacugagacaucuucacugccaaagcaaguguuugaauaaguggaggcauuauugaaugaagacucucuccaagcagguccacagccuccuguuuuuucuucugcucuccagguccuggugccugauggucgcccugucacacccccaggugaccucaucgagauccaggugguaaaagucacagauaccacaucggucccugagcccccagagccaggaucuuuucauugugcccuguguccugcugccuuccgucuagucucagagcugcuguuucaugagcauggccaccuggcaagcauggaggggcuugggcaggauggggauccuagccguugucauguguguggccacagcuguccagguccugcuagccugcgugcccauuacagcuugcacacaggagaacggccuuaccgcuguucccucugcccacgggcuuuuaaggccuuggcaccucugcuccggcaccaacaccgacaugggguagagcccggcaccucugaaaggcuucuacccacaacaacaaccggacagccaaacucaaggguggcccaggagaggucggagguggugauggcugcagcagcugcgggugcugugguaggcaagccuuucgccugcagguuuugugccaagcccuuccgacgcuccucagauaugcgagaccacgagcgggugcauacaggggagcggcccuaccacuguaguaucuguggcaaaggcuucacgcaguccucugugcugaguggucaugcccgcauccacacaggcgagcgccccuuccgaugcaugcucugugaccgcacuuucaauaacuccuccaacuuccgcaaacaccagcgcacccacuuccauggaccagggucuggagugggagagucuagaggccaacugagaucaucuucagugucccaagaaucaugaaguaaaugugggacagagaacacuauggaagaaggguguagagagacugugaaagugaauguggagguugaccaguaggcuggaagcuaggacauaucguaggagaggugggugggcaaauagaggcagaggccaaggagaaaucaugagcaguuggaguuagaugaaaaagggaaccugguucuggucucccagaaacccaugcuacacuugagacucaggaaagagguacuuggggucuguggguacccagauauaucuaaaaauacauagacagcugggcaugguaaaggccuguaaucccaguacacuagaggcugaggcaggaggaucaugagguccagaccagaccaggcuggaaagcaagacuuucuguaccaccaccucugguccaaugaaauguuuugccuacuucaacuggauugcacugguccugggaugccuacccuccagugcagaagaugcccaccaagucaucucuaaagggaugcugggauaccuuccccucaaaaccgagaguaccuaaaccacaucucucagaugugaaccugcucauaaagauucacucuaagcccugcucacuucuccauccuaccccauagugggcucucuuuaacccacuaaacuuaguugcaagcaacugagagcacacacuauaagcaggcaaucacuugguaucccuuuaagccuuaggcucagaaccugucuauaaagaaauuucccaucucucuauucugcacucugaaguaggcaucuuccugcauagcccugggcaauucugaggcaggguuagcuagugaccaccuuggugggccaguacaggguguaaagaaagaaaugacacugugguaaggggcuaaaaggacuugggaguuagcguacaggguaagaguggggacuuccagucuguuccuauuaaaagacuuucuguaagucuucucugucagucuuguauuccaauucucuggguaguuauccauuaucuggaauggugagugaccaggcuugggcuguuuggagaugucuauuugguuguguuguaagaaguuuugugcaaugaggugauguaggagguugguguacuuacucagaagggucccuaauuuucucauggagauguguugcuaguucaguccuugucauccagcauccccaagagacgauccucggaugaugcauaauaaaaacucaccagcuccuccaaagagccugcuucccaagacaacggagugucuugguuuuuucacaugaauccuugccacuaaacagaaacuccuugcugcuuucagaggggacuacccccccccaaaaaaaaaccaaccaaacaaacaaaaaagccaggcggugguggcacacaccuuuaaucccagcacuugggaggcagaggcagguggaucucugagcucgaggccagccugaucuacaaagugaguuccaggacagccagggcuacacagagaaacccugucucgaagaaaacaaaacagaacaaacaaacaaacaaacaaacaaaaaacaggggacuaccaacacaguggcagugcagauaaguggucagauucaaggagaagugaaauauaguaacug

SEQ ID NO: 3534 - RNA, 2775 nt, Mus musculus
agcagucggaaggcggcggucgccgucaaaaucacccgaagcgaggauuaugccggcugcccgaguuucgguaacuuuucggaaacuagcguuucaacguucggaggauuccgcgagucuucgcguuccccgacaccagcccccucuaaagacacggauuuuccuacaacucaaaccgucugucucuggccuccucuggaaauccgucccaccccucgccgacccuguccaagcggucagucacuuccaacaauccuaaccguccgggccuucggcucuuuccgaagguuuccagcgcucgcucaccgccccucuagagauuaagcccgauucuagucuucggcucuuuccggaggcgccacagggucacuccgccccuuccggagaauaucggucccuuccgccacugcuucgggaaggucucacgcccaggagggaaguucggcucuuuccgcucuugcuucggcuccuuucggcuuaaagacccgaaaagggagggaggacugaugggaggugggccagauagcuacgggggagggggcggggucucagcuuucggucccuagcucucuaggagaaaacugaaaaaacugaccucgcggaaggccagagaaagugugugggacaguagcagccagugcgacaaaggguguucgaggccgcugcggagguuguuagcucagcuugggacgccugcgcacggugauuggagagggguuucugcgccugcguagcggucuagggcacguuuuucucagcgcuccggaggauccgccauucuaaauccacauugcgcgugcgcccgaucuccucccacacaccccuucccccaccgccaaccucagcccccaaggcacuaacuucaagacgguuaaaccugacugcucucucccgguugccaaggcaaucgcguuaaauuguccgccccugcuccugcugcgcaagcgccgaaugugacaccuccgagagaucuccugaccccuggcgggcaggcggaaaagagucuacccagcgccccgguaccuccuccgggcuggcucagcuaaacguucauugaaucaaugccccaggcgcugccuucuuaaagucgucuuaccucaguuucuccuacugcuccgcuucccaccucugccuccuggggcuaauuacacccuacccuccccaaccucucuagaggcuucuggcugagcgcuccugucccagucuccguggcgacggccaccccuucccagcauauucccuuccuaguaagaccuggggcccaguuuauugaaaauuuucaugucucuuuaauuuaaacucucagaauaauacucugucuuugcaugggaugcagaugggcuacuccuggcuaaggaggccuagcuggcagccccugcggggugaaauggagacggggugccuagcgugugcggccgagaagcagggcccagugcucaggaagggcagcuucuagcccuggcggugccccgggaaggccgaccuagccagcaaucugcugggggggaggcgugcggggcggcggcaucaccgcuugaagcgguaggugaugggcaggagcagcuugcucuucuugagagccugcaccuucuugagagucucgucguccagugccaggaagcagcggcgggaauacucuagcaggcgcuccuuggauggaucgaacucucccaccucagccagcuuuucgggagccacaaugaguagcucugcgaugggcguggucagcgccacgguguuccuguccacacgguggugcucgaaggcucuggacaugcucuucagcuucuggaaggugcccaggaucuucuuguagcggcagaggaccccaucagcauccuucacugcaggaccaagaggacagaaagaggaggacuggaaaagacacucaugagggaaggagacaugggggaacccagguagaaacaggaaggcaggcauaaagaggaaaaggggugaaaggcacacagauuugaaaacaagcaagcaagaaaucauggaaguggggacacaugaggagccccauacaggaagagaaaggauaacaagauggaaaacaguuaagaccugagcaagaaguagaccagggaaauugaaggcaggccuggacaccagaagaaaggagaugggcccagagaccuccuuucugaugacacaggacuaaaucugcugguugguguaaaacgaaauuuaaaauuaacucaggaccgaaaagggcugugagaugaaguugagucugauuguuuuguauauggagaguuagggcaucacuguagagcucacacugcgauucuggguacacaaccccucaacacacccaucacauguacccacuccccacucaccccgcugccucucucgagccuuggucuucccaaaucgcuuccggcuaguacuucccuucugcuucugccucuuccuuucacuggcacuuccgucuucggaaaccccgcugaaggaggaggcugccgacucggggucugaggcuucuccaaccccagcccugcuguccccaucaacccuccgagguccaggcuucauccggcaguaguccucuaaagagagacaaaagugaacugugacacaauguccuauaauugcccugaggggggaaagauggacauggaggccaaguccucggaaugagggcagggugaaguccccaaguagagacauuagcuacacugaaugccauagagccagcugggauucggggaauagugugagcauuuuucuaggcucugaacuugacugaaacagguccagggaauucau

SEQ ID NO: 3535 - RNA, 1024 nt, Mus musculus
auuucaaauaugaaauacaacuuuauucugauucuaaaugaaagagugggaaugacaguuacaaacaagauuucaccacugacuauugugaugcuacgguagcagucuuaucuuugaaauccagaacaacucuguuccagggggcuaaauacgcaaguccaaaaaaaugaagguguauuuuaacugccacauucacuccgaagcccauucaucuccuucagcaucccaaugaauugcacgaucuccuuuagcuaaauaagguggcacacacacugcaccgcuggcuggcaucacaggacaguugccuaaaauagacuucugacgcagggcuccagcuucacuuucucacaggucaucuuccucaucugggagagcagucgucugagcaaccucuaaaucaugcucguacugugcugccaaagcuggguccaugacuaccucagguggggcaagagcaggcauggcaacgaacuccaaguuaggaucuccaaugagcuuucuggcaagccagaagaaaggcuuuucaaaguuguaguuacuucuggcagaaaugucauaguacugaagauucuucuuucgguggaagagaauagguuuugccuucacuuucaugucuuuaacauccacuuuguugccacacaauacaauggggauguuuucacacacacgcacuagaucuuuaugccagcuaggcacauucuuguaaguaacucuugauguuacgucaaacauuauaauggcacacugggcuuggauguaguagccaucgcgcagccccccgaacuucuccugaccggcugugucccacacauugaacuugauagguccucuguugguauggaagacuaaugugugcaccuccacgcccaggguggcuacauacuccuucucaaacucuccggucaaguggcgcuucaugaaugucgucuuuccggugccgccgucgcccaccaggacgaccuugaacuggaccugcggcucucccugggcggccaucgcggcgauccugccggagagagcggcu

SEQ ID NO: 3536 - RNA, 1016 nt, Mus musculus
aaauaugaaauacaacuuuauucugauucuaaaugaaagagugggaaugacaguuacaaacaagauuucaccacugacuauugugaugcuacgguagcagucuuaucuuugaaauccagaacaacucuguuccagggggcuaaauacgcaaguccaaaaaaaugaagguguauuuuaacugccacauucacuccgaagcccauucaucuccuucagcaucccaaugaauugcacgaucuccuuuagcuaaauaagguggcacacacacugcaccgcuggcuggcaucacaggacaguugccuaaaauagacuucugacgcagggcuccagcuucacuuucucacaggucaucuuccucaucugggagagcagucgucugagcaaccucuaaaucaugcucguacugugcugccaaagcuggguccaugacuaccucagguggggcaagagcaggcauggcaacgaacuccaaguuaggaucuccaaugagcuuucuggcaagccagaagaaaggcuuuucaaaguuguaguuacuucuggcagaaaugucauaguacugaagauucuucuuucgguggaagagaauagguuuugccuucacuuucaugucuuuaacauccacuuuguugccacacaauacaauggggauguuuucacacacacgcacuagaucuuuaugccagcuaggcacauucuuguaaguaacucuugauguuacgucaaacauuauaauggcacacugggcuuggauguaguagccaucgcgcagccccccgaacuucuccugaccggcugugucccacacauugaacuugauagguccucuguugguauggaagacuaaugugugcaccuccacgcccaggguggcuacauacuccuucucaaacucuccggucaaguggcgcuucaugaaugucgucuuuccggugccgccgucgcccaccaggacgaccuugaacuggaccugcggcucucccugggcggccaucgcggcgauccugccggagagagcg

SEQ ID NO: 3537 - RNA, 528 nt, Mus musculus
cuuccacagaaggccuacaugccgccgucugugccgccgccaugucucuagugaucccugagaaguuccagcacauuuugcgaguacucaacaccaacaucgauggguggcagaaaauagccuucgccaucacugccauuaagggcguagggcggagcuaugcucaugugguguugaggaaagcagauauugaucucaccaagagggcuggagaacucacugagugugugaucaccaucaugcagaacccacaacaguacaagauuccagacugguuccugaacagacagaaggaugugaaggaugggaaguacagacagguucuggccaacggucuagacaacaagcugcgugaggaccuggaguggcugaagaaaauucgagcccauagagggcugcaccacuuuuggggccaucgugucuguugucagcacaccaagacuacuggccgcaggggcuguacuauggguguaucgaagaagaaaugagucucugggccuuugcuguuaauaaauagcuuauauacca

SEQ ID NO: 3538 - RNA, 528 nt, Mus musculus
ugguauauaagcuauuuauuaacagcaaaggcccagagacucauuucuucuucgauacacccauaguacagccccugcggccaguagucuuggugugcugacaacagacacgauggccccaaaaguggugcagcccucuaugggcucgaauuuucuucagccacuccagguccucacgcagcuuguugucuagaccguuggccagaaccugucuguacuucccauccuucacauccuucugucuguucaggaaccagucuggaaucuuguacuguuguggguucugcaugauggugaucacacacucagugaguucuccagcccucuuggugagaucaauaucugcuuuccucaacaccacaugagcauagcuccgcccuacgcccuuaauggcagugauggcgaaggcuauuuucugccacccaucgauguugguguugaguacucgcaaaaugugcuggaacuucucagggaucacuagagacauggcggcggcacagacggcggcauguaggccuucuguggaag

SEQ ID NO: 3539 - RNA, 1104 nt, Mus musculus
gucacauuaccuuacuaagugacauagcaagaaugaccucgaaccuucagaguagggcuccaaauuaaguguuuaugacuuauuacucuccuagaagaaagguccaucacaguuuggaggaugcugaugaugaagaaaaggaaugaaaggacccucuacagauaucugcuuccaaggcacaauuugaaacuugaaagucaaugucagcuucucugagacaaaugguaucaucaucacguaacuaccuuuacaaaagcaggcgucaggugcugcugacacuuggacuaaguaagggauggacuuuuuaaacaaacuccuccugcaccagagaaaauccugggcagccuaaagaagcaaagcccacaggcaaaacgauacaugacaccugaggacaagcuaagaaaauggaaagcauagccaucuccuuagcaaggugcuccagaagucuuugcucagcagacuguuaaggauguguagagaguuagaaaauucaagaggaggccuaugcugagcccuguaauggaaaauguccaaacugccuguaauucauguucaagcgcuggacuuccgugguuagauuaaagauaaaccagccaggaccuuucaacgggugauaaagaucacaggcugcuuguaacugaucaaaaggcuaaaggcgaacccacagcagggguauuaaaauggccccaaagguaaagaguaaacggaggacaguaaaaaaaaaaaaaaaaaaaaaaauuaacuaucccuuccuggcucaaagcuaacaaaacuaaaaggcaaacuggcagcaucagacacagccacgguaguuacuguuccaucccgaguccugggccacacagaggaauucuuagaaugcuaaaccaaguaaucugaagauacauauuuucuccauggugagccucaaaggcucagggguacacacucaccuaguacccacgaaacccuaacgggaacagcuuugugccacuuucagugacaacuacaaggaaccaaggcucugggcaccccaggcuuucucuugucucuccaaacuuuaucuuuuuuuguuuuuguuuuuguuuaaacucuaguaaaugugcaauucuguuuugccccucc

SEQ ID NO: 3540 - RNA, 29359 nt, Mus musculus
agcccagcacgucaggaagcuuuaaagcacacuuagguuucacucaacaucugaaagcagagagagacagggcuuucugucugcucuuggauuuuguuugagggucagcacgacagcuuagugguuaaagauacucacugcugagccaaugcccucaauacacacagaaucacacagaacucacugaauacgcacugaaucaaaaaucaaucaaaaaucaaggguuuuuuuauuugaaaauuauaaaugauucuuagcgccccuccacccugugucauuugcuguucugugaauguaagaaacaagcauuuagcaauuaauuagugcacaauaaagaaagguugaaaauggcccagaagagaagguguuggggaaagccuuacaaaggcucacucggcugcucuacuggcuauugucacagggcacgguccccagacggcuuccugcugagccucuggacacacucauacucugcuaguugauaagccagaguucgaagagcuuccuugggaagugaaaugcucuggagacggagggcuugugaggguugagcaaaacagagcagagcggcuucacuggaaggaacagcaggggucgucucuacggaagaggagaaaguagggcagucacaguuggacacuuauuuaggucuucauauguucucagaccccauaggacuuuacucgagaccccugagccugccugcgcuucucaccuacguccggggccuggcuccucccacuuuguucgcccccccccccccaacaaacuguuccaccugcugauaccacuucacucagaccucugugcaaccaggggaucaagucuggagcaaaaaugagaucgagguguguccaaacccgagaaaucucgucuugagacuggcaggaguagcgccugcucguccuagcucacgcagccuguacagccccuaccucugccacccuugaaauggucaugcagccugacagccauguuacagguuaaacuuucuccauccuuaagguaaguccagcaagcauaauuuugcauaauuccgccgggcagugguggcgcacagagaucugccuaugucugccucccaagugcugggacuaaaggcauguaccaucagcacccgaauuuuuaaaaauauuuuuaaagauuuacuuuuauuuuacguguguauuuguccacauguauguauguaugugcaccacauacaugcagugucuguggaagccagaagggagugucagaucuccugguacugaugguggugagccacucugugagugcuggcgaccaaaccugaacccucugcaagagcagcaagugcuugugccuacugaucuaucucuccagccccuaauuuauuuuuaauuaugcauguguguguacguguguguguguguguguguguguguguguguguguguguguguauguguguagguguguccaugugaaugcaggugcccuugcaggucagaacagggcaccuggucuccuguggcuagaguuacagguuguacaaguccuauaaugugggugcugauaauuuaauuuggguccuuugcaaaaguaguacauguuuuuaaccucugaacuaucucccaagcugucuuauuuaauaauaauaauaaucccacuuagaauaaaaaauauguacauauuauuuauuuauuuauuuuugagacaggguuucucuguauagcccuggcuguccuguaacucacuuuguagaccaggcuggccucaaacucagaaaucugccugccucugccucccgagugcugggauuaaaggcgugugccaccaugcccagcuuagaauuauauucuauuuuauuuuauauauugugcuggggaggggaacacacauggcucccacaggaagggagaaugaacuugggacuugccgugcaauucugugacucugacuuugagccuacaaacccuacuuuggacauuagguuuuagagagaauaucguguguguuguauggaugcaccacccauuaguuuaaaagccuauggccuauggcuuaggcaggaaauagaaggugggacacccgguagagagaaaggauucugggauagaaccaagcaagagauuugccaggcagaugugaggagauuaguacagguagacagccacauggcagaauguaggcuacaagaaaugggauguuuugaguuuuaucuagucagagaagagccuagcuacauggcaauuugagucugagucuuauuccugggagcguggagcugggagggagaaccagggccuaacuucaaaaucaguuauuuaaaaccaagcuccugaauccaguggcacuuugcugccaagacugaagacuaaggacgaaguucucuccuuggaacauguaaggaagaaggaaagaacugacuccaguaagcugccccuuaccguuugugugccauggcaaaaguauacaugacacacacacccaaauaauaauaacaucacaguguaauuaaauaaguuuaaagguucccggagagccagggauacacagagaaacccuguaaaaaaaaaaaaaaccaagagguuuaaagccaaccucccugacccauaggcaaaagguggcaugcccuucccugccaugccauaccucagauccagguccggguuacaguagcggcaguaacacuggagaagacaacaaugaugaaggcauggaugugaaacagagaaaaauaaaauaaaaaauaaaaaucaaacaauaucggggauuuaccuccuggguuccccugucucccucagcccucaaccccaauccaugagccacauuccugcuaagagucuaggccagcaguucuccaccugugggucuuucacaggggucaccuaagaccaucagaaaacacagauguuuauauuauaauucauaauaguagcaaaauuaguuaugaaguagcaacgaaaauaauuuugugguugaggguguuacaacaacaugaggaccuguaucaaagggucacagcauuaggaagggugagaaccacuggucuagccaaucuagcaggauuuuccuugggucacuacuaccuacagcuccuggccugaccauccuugucucucuucuugcucuuguauccugcuccaaauucacucuacacccgguacccaggggcuugauuucacaacucagaugggcugggcauguggcucaguugguauggugcuugcucagcaugcaugaaacccuggguuggucccaagcacacccuaaacuagauguggaaguucacgccccuaacaccagcacuuaggagauggaagcugaaggagcuucauccuggacauccaagggcauccuagccuacauuagagaccacugcucagcgggcagagaugugaagacuuguuccuuaagacucuccggaauauggagggcgggggcuggggagugaggauacaaagugucguucacagggaaacaacucuuaguagagaacugccugccucucaucccaucugugguucaguaacagaggccucuuguggccaaguccagucagaauucagucucugagauugaaugaggcagcaacucagguaaauuggaguaguaacacuaacgcuauaugggaugugcucacaggcuugcuuaggaaauaguaaguuacacaaagaguuuaguugaaggagugcugcugcugugagguaagcagugugcuucucaccaggcuggugcagaauuuucacuccauaccguaauuaaaguuuaggguuguugaaaaaguuucugcuuauguuuaguccccaggacugucugucaauuaggcuccauucucauaacaaaaggaggcaaccccacgucaaagaauaugcuucuaagaggcggcuccagaggguagcacagggucacaaccauuauugaaucuuggucugccuuaaggccucugugcucuuaucaguaaaaccauaauucugccagauggguaggaucacccuggguaacaaccguuugaagaaaucaacacuaguauacauaaaagauaauuuuagcaaguguguauaucucccaucugccccagaggccagacuugaagccuccagucuccauugaaauugcucaaaguguacccugaggcuaguacaauguaaaaugcauaugaccaggguauauuuaaguuaguaaaaucucugauccauggccagcuccucuuuggguauuagcuagagcaguacaugugcaauuauucuaauuuuccauuugaaucuccaagugugcagggugguuuaucacugggaaggcauaucaauucuagaauaguaggagagaccuggcuucggaaagcuguccgaugacaucuacuugauugugcacagacacacacacaugaguauacucucgggugagaccacuucguaggacagucuccccuccgaccucaaccguucugacagcucugugcagacucccuucucccaugauaccuccuccaucucucccuacccugccccucccucucgucaaccuuccucccuccauagacagaaaggcucccuccucacccagucuccuuuauuguaggacacgaagaagaacguaaucaccauguaggcacaccucagaaaguuccauccacugguccucacaaguccccugacuguggugguggcuggaggaggcuucacuaaaggcaaaugcugcugaugauuaauaauacccagaagcccccuuccccuuugguacuccaaacuugcgccccuagaugucuccugaguuggaaguuucauuuauauucgagguuguggccauuuucucccaucuuaguaaucucucaacuuccaggcaaacuauuugcucaguaacagaggccacuuguggccaaguccagucagaauucagucucugagauugaaugaggcagcaacucagguaaauuggaguaguaacacuagcgcuauaugggauguacucacaggcuugcuuaggaaauaguaaguuacacaaagaguuuaguugaaggagugcugcugcugugagguaagcagugugcuucucaccaggcuggugcagaauuuucacuccauaccguaguuaaaguuuaaauuaaagcucuuuugcacagagucuaaccuguacucuguaaacaaacaaacaaacaacaacaaaaacccuguccgcaaaccaccuggagcucugagggaaccucacuaauucuccucuuuuuguccuuuugacuguuugauuugcuucgauuuuuuggaaaaggaucccauguaucucaggcuggcuucaaacuuacuccguagcuaagggugaccccuugacccuccugccuccccucccaaggacuggaucacagguacgcaccuucaaguccaucuuacuaauuguucuggcgcucucugugugcauugugcauauguauguguucagugugugcaugcacacacacgugcaugucaguuccuucaucagccccucuccaucuuauuuuuauuacauuucacuuauucuaucgguuuguuccccuuugguuuuuuccucccaaaccaaagggucagggucucucacggaaccuggagcucacggauuuggccuggcuugcuaacugaguuccacaggacacuuugcaggaguccccccuuccaucauauggaucuugaggauugaacucaggucaucgagguuagcaguaagcacuuuuaccugcuaagacaucuugccugcaccaccaguuuuuaaaagacauauguggugguuugaaugagaauggcccccguaggcgcauacauuugaauacuuggcuuucacaguuccuagaguguuuuggaagggugggagauguggccuuguuggaggagguaugucacuggagggugggcuuuaagauuaaaaaagcccacaccauucccagugagcucuccugugcgcuuuauauccaguguaaauucucaacuacugccccagugucaugccugccugccuacaccugucaugccugucugucacugugcucccuaccguaacggucauggacucauccucugaaacuguaaggaauccaaccaacuacaugcuuucuuuuauaaguggccuuggucacggugucucaucacagcaauaggaaauugacagagacgauaccuuuuaucacuaugugggugugcauguugucuguacaggcaugugcaugccacacaugugguggucacagggcagcuuuguggagucaggguuguccccccaccuuuaaguggguacugcuugaacguuccaaaaaugcuuuugaccaugggaccaucuugugggccccaguuuccuuuauaucgaguggcuguaggguucuccuaaccuccuaaaacauguuacuuggugguucuuuuaaacaacauacaaaugccaggaaaugguucucuuccuccacuggggaucaaaucaggcccuccagcuuggaggcaagcaccuccaccuucucagcccccucgccaacccaggaacucaacucuuaauugcgggugcauauucuuacugcuaggauugcuauguuuguuauaaauuacagcucccggggacauuacuaaggguuuguuuguuuguuuguuuguuuguuuuuguuuuugagacaaggucuuuuggagcucaauggccuccaacugccuauguagccuaggcuaaccuugaucuuuccucuacauucuaaaucagcagcuuucaaucuaugggucaggaccccaggguuguacggcccuuuuacaaggggucaccagagauccucagaaaaagcagauauuuacacucuaauucauaacaguagcaaaauuacaguuaugaaguaguauugaaaacaguuuuaugguugggggucuccacaacacgaggaacuguauuaaagggucucagaguugggaaggcugagaaccacuauucuaaguacuccgugcccggugguuuguuguuaucguuguugcuguucacuuuuguuuuguuuggucuuguuuuugagauggagucucaccauccuaagcuggccucgacuuagcugcucauccagccuguaaccugagauuccccuguccaugcuggccucugauaaugacaucugccagccuugccuaccuuuucugauguuauuucucuguuuuauguuuugaaagggggggggggagguccucacgaaaucaaaacaggccuugaaccuuucuaagcugcccauguugccuucaaacuucugaucuugccaaaugccaggguuacaggugugaggcaccacugccguugcgcauggcccuagggaccagauccuggucuuugugcuuacuagauaugcacucugcccgagucgcacugggcaucuuaauccaagaucacuuaacaggagcgauccaccagcaggaggcuugugucuguggccuuccauucucuuaguuuccagucacauucgccugccacucagcuuacccaggcauuuccaggggagaggagggggucuggaggucggcagaagcagaaugccccuucuucuuaccucagugugucaggugcauugacucagaggagccaggugggagggagaggguggcuggggccuuggaugcucccagaagccucaggcgcugaggcugacgcagcuaucugaccuuuccuccaguacuacaguguaccucacucagagggaaggugcuaaccgccuguccaccccgcacgaggucucgagcauacagcccacccaccuucuucuuugcaguuacuuguuucuucuaagaaagaaaaacguggagagaauagaggaggggagggaggggagaaagaaggagagaaggggaaagggaagaaaaauaaaggaaaauuagagauuggguggaaacccagcggcaaaugauguuucugggacccucugaugaaagggagacuuucaccugcuuaaugucacuugaaucagggucuccacugcuacuuggcuauuccucuuugugacaugcccuccccauagauacacacacaugcacgcacaugcacacaguaugcacguguguguugaucuccuucguuccuucaagccuuugcugagaugucacuuccuguggaccgugauggcccaauucccucuaaaccacaucagccucuuucuccacacugugcucucaugucuucugcucuccucgcuccguaggacuaugguguucuucagacucugugccugcuucuggaccacuucauuccccacucaucaaaauaccagcugcauuuguuugucugauucuguuuuaaaauuacauuugcuuauuugguguaugugugugguaugcguguguggaggggugguauguguguguaguguggggucuggguaggguguggguuguguuugugcauguguaguggugguguuaggggguauuuguauguaugugugguguucacauauguguaugugugauaugaggaauguguguguguguguguguguguguuguguaugguguguggugaugguguguguguguauguauauggugguggugguggugguguguguguaugguauguguguauugugguggugguggugugcacguuuguguguguaugugugugugugguaugaauuugugugccagaguauacauauggaggucagagcacaacugacgacaguccauccuguccugccacuacuugcagcccagggauugaacucagaucaucagccuuggcaagaagugcauucucucacugagccauuucuccagcuguuuguuuguuugugacagggucucaaguaguucaggcuggccuugaacuucugguccucuuguguccaccuccagagugcuggcacuacaggucuguaccaccccacucagcuugcuagcugcaccugguaugcguuugauauaucuuauucccucuucuaucucaaugccuagaagacgacagugaauggagcaugagguuugucuguggcuuggaugcgugucaugggguugugcugcuaaugauuguggaguugagguacguaggguucgguaacaucucuuccagcuggaaaagcuaauaccucuguuuaaccaaaaccagaaaugaugacgucaccaacucaccauucaguacuuggaggcucagcagaccuaaaacaauaaagaaauacaauagaaucucaaagguagccauacagaacccaggucaauagagcccacaugcucaccccagacccauuuccuaaagagcccuguggaauucgggcccacuugccugccugccugccugccugucugccugcaugcaugccuugcuugcuacccacccuuccuuccuuccuucuuuucuuuugauauaggaaaaacugagaauaauaaauucauguuacagaggcucuacuaaaucugcuuaugagauauuaaacacacaaagcagaaauuacuuaauggagcucucugagucucuuacucagaggagggcgauuuugccaggcugaaacaggaugaccucaggcaacagauacauguuaaagcagcccuaguccauucugguaaaaaugacaaaauuuuauccuguaacuccugcauccaucuaaacaaucaaagcuuggcuuuucugucuccguaaaacauguuucagcgcccaaaaugcaaccuggacugugaaacuauagaagacaagauguucuguucagagcugguucccuucugugcauuaggcagaaguacucaggcucauuaaagaguuuuuccuuagccgggcgugguggcgcacaccuuuaaucccagcacucgggaggcagaggcaggcggauuucugaguuugaggucagccuggucuacaaagugaguuccaggacagccaaggcuauacagagaaacccugucuccaaaaaaacaaaaacaaacaaacaaacaaacaaacaaaaagagugguauagcaauuucucacugggaaggcuuuaacacauucuguuugggucucacugaaguucuggcugaccuggaacuugcuauguagcccaggcugaccucaaacucacagaguuuucccuuccuuugucucugggauuaaagguauguauuacuaugcccaguacugcccaucucauaucaccaccucuaccaucaccaccaccaccacuaucaucaucaucguguguguauguauauguguuuacccaugugacucugggcacaagcauauuauagaacacauguagaggucagaggacaacuugcaggagucaguuuucuccuuccaccauguaggaccuggagaucaaacuuaggccaccaggcuuagcaacaagauccuuuacccaauggagcauccugcuagugugugugugugugugugugugugugugugugugugugugugugugugcaugguguguuucugccauguguacagacauggaggugggcaggcagaucagaggucaacccaauugucauuuuucaggagcuauccgucuuauuuuuagaaacagggucucccauuggccaugagcucaccaaguaggcuuuguuggcaggccagugagcccccagacccaccacuuggugcuucucuagcacuagaauucuaggugucacucccagugcauguucuggugacuugugucagggcccgaauuuccagggaguccugagcccauuggugacacaugucagguuacacacguccagggcccacauagaaugaaggacuuaccaaggaucccugugguccauccaggaggcaggagguguugaugaguccaggguccaugagagaggagaccacaggagggagaaauaaucacaacuuuagauggugggagaugggaguucagagcccaggacagcgggccuuagagcagagcugaagaaggcuagccugagagacauggaggucagaagacucugacgguggugaaggaccaaugggagagguggggcauuuuaaaguuaucaguauuuuuacgugcuuauuuauguauuugauuucaugugugugaguguuuugccugcguaugucugugcaccacauguauaccuggugcacagguaagaagaggagguuaggggcuggagagauggcucagugauuaagagcacugacugcucuuccagagguccugaguucaagucccagcaaucacaugguaucucauaaucaucuguaaugggaucugaugcccucuucuggugugucugaagacagcaacaguguacucauauacauaaaauaaauuaaucuuuaaaaauaaagagagagagaggcugagcgugguggcacaugccuuuaaucccagcacuugggaggcagaggcagaggcagacaaauuucugaguuugaggccagccuggucuacagagugaguuccaggacagccagggcuacacagagaaacccuggcuggaaaaaccaaaaaaaaauuuaaaaaugagguuggauccccuagaacuaaagucacagauagcugugagcuggcaugugagcaccaggaagggagcccagguccucuggaagaccugacaacugagcuaccucuccagcccccaauuuuugaaaauauuuguuuguuuuuauuuuugcuuuuuguuuuccuuuucaagacaggguuucucuguguagcccuggcuguccuggaacucacucaguagaccaggcuggccuugaacucagaaaucuaccugccucugccucccgagugcugggauuaaaggcaugugccaccacugccuggcuuguuuuuauuuauuuguguguguguguguguaggccagaagaggcaucagauucagauccuugaagauggcguuaagagcagaugugagcuaccugguguggguaggauuugaacucaagauccucuggaagagcagcaagugcucuuaaucaccaacccaucucuuuaagcuucucuuauacuuuuaaaaaauuauaugguauuuauuuguuggugugaaucuguguguguguguguauguauagaggucagaggacaacugauaggagccaauucucuccuuccaccacguggguacuggagaucaaacuuaggcuuagcugcaagcucuuuuuacccucugagccuuguugcuguuccuugaucugcccuuuggaagcugagaguacugcauucccugcucugcccccauuccugacagucccugcacugaugugagccucuuggcaggaauaagaaggugaggcaggugaaagaagaaacauacacuuacguuucaauacuguugaaacaggagcaccaaggagagggaaauccaggugggauuguuggguaagggcagaagugaagaagaaaaggguguuaacaauggccgacccccccuccuuccaccuggagcauccucagcagaggccaccccacaagggacguggaaguaucauccaguccaaacggcaccggcgaggcuguacacagagaugcugggucaucugugaccugucugcuuuuggacacacucaucccuaugccucgagucgccuggcccguuucccccugggaauucaccugccagcaaucuagaggacaucagaaaagcaucuccacucuucugucaucucccgacccuccccacaucucacuucccacccuacccccacccccagucagggaggaaggcuuggauccuguuuuuuauuuugguuuuguuuucuaccuauaaacacguguaacuccugcuguccugugcucuaggacaaugggggcaguuucagcaucugcucaaauacugggacuccaguaauacauacaguuucagaccccaguuuacagucccuggaagugggcggagccugaaagccaccuggggucuccuccacuagugggguaaauuccucuaaaaacaguuuccucuccccuccccuucucucccacucccuuuuuguuuugcuacagaaccuuauguagcccaggcuaaccucaaauuugauauauaacugaggcuagucucaaacugcuaauccuccugccuuacuccgcuuucauagugcugggaucauagacaaauaccaccgugccuagcucccuucuuucuuguuucuccuuccaaguaucuagaaacauucaguuacccauaagaaaggaagaaaaaaaaaacccuacagaaacaauuuucuuugcuaggcaugguggcauaccccugucgucccugcacucaggaggcugagguaggagggucaaggguuucaggucaucuuugguuauauacggaguuuaaggcuagccugggcuacuugagacuuucccaccaaacaacaaacaccaaaaggacaucaacaauaaaaggagaaauaacuuacuuuucacuggaaggcagauuggaaacagaaucaaggaguucaugugggaaagaaugggccagagaauaaaaugaauauuagucccuucucucucuggugccuuccauuuucuuucuuaaaauacuuuuaaaaguguuugacaauuguucuugugcucuguugaacuaccuuagagaggaaaccaguuuugcaguaucacugagcggauacagccaaccgucuccuaaugucucacccuugccuuaucugugagugugaguggacucuagcuugagcucacccuugccuuaucugugaguaugaguggacucuagcuugaguucacccuugccuaccugcacagguugaacaucccuaauccaaaauggcuccauuacaagauuuuucgagugccaaggugaugcuugaauaguuucccuuagccuuguuuucauuguuuuuuaguuuauuucacuuuauuuacguguauaugccuguguaagcauguguguaugcccuugaaagccacacgaagccacaggcaaucguaaacugucuuaaguggguggcaccuaacucaggucuucuaggaaagcagaaaguguuuguaaccacugaaucaccucuccagccuccauuugguuuuacuucuugagacagggcccucucacuccacagaccaaggcuauccugcaacucuuucuguagguucaaauccagccaaacuaccaccaccaccaccaccaccaccuccaucuaucucccaagugcugggauuaccagccugagacagcacauccaggucuggauuuggauauuguccagaucagauugggugcgggguaagagucaacugacaagagucagcaauguucgaaauccugaaaaugucugaaauuuuaaacacacucagcuuagggcauuucuuuuuugggggugguggugguggggguuguuuguuuguuuguuuguuugagacaggguuucucuguauagccuuggcuguccuggaacucacuuuguagaccaggcuggccucgaacucagaaauccgccugccucugccucccgagugcuaggauuaaaggcgugcaccaccaugcccggcuagggcauuucaauuaaggaaaauucaagccgcacuagacuagagaaaagcagaauuuggcucagccgaucagaaacauccaauauauucauacuguacaaucagggacuuugcaauggacugaaccaaguaaaucaauagaauuguugugacccguuugggauucugucugcauuauugucccuucauccccuauccuccaguguacaacccuaucugaacagaguucccccaaacuacuucuaguuuuccucuguguaacuugcaaauuacuugcucuaacaaaguuucuugugguacuggggauucaauaaaggaucuuauacagcacucuauugcugauuuacccccauccccucacugggggauucuaggcagagggucuaucauugagccacgcccccagccccucacuggggaaucccaggcaguuacuuuuuauuuugagacaguugaguucaugcguuugaaaauagaaagugaaaagacaggugaucaugacacaugccucuuuauuacgccuuuaaucccagcacucaggaggcaagaggcaggugaaccucugugaguucaaagccagccuggucuacagaacugcuuccaggacagccaaggauacacagagaaacccugucucgaaaaacaaggacaaaaacaccaacccccccccaaaaaaaagaauaaagaaaaagaaaggaaagaaaauaggagguuaaaaaguguaucaguacagcauguguuggaauaccccaaggaggaccugggggugugacucagugguagagccccugccuagcacacagguucugaguucaaucccuggcaaaauggggguacggagaguugggagucauaagauuucacgguacuuacuuucuucuucugacuugucuggaaggaagaaucaaugcagccauguucaacaugggugcagagagagggagagagaagugugggagugaaaguggaggugggagaguaagcgagagagcaggagacaaggggguggggggagagagagauugauuaauaguuuugccaccagauaagcaucccugaccagacagagacaagagaugaggaugcuauugaaagcaggcaacccaagucucucucgauuugcaggacaggacagggacuugagucugcauccacucucucuaaaauaaauauuuaugaagcacuacuguauccugggcauaagcaagguuugggugagacaauaucuacccccaguaaacaacauccaugguuuuccaggagcuugcaggggagggggaccaaaagccucaugaagugcgucagaggugggaguagugugcuggucgaccugcagggugugguaggaacuuuuaaagggaugcugguugcugaccuggagugguuaccaggggaggcgucuuggaggaggauaugauguuuugucugaaaccugaaagaugagcagggauuagcugaguggaaagaucuuggaaggggaaaagaaaaauuaucccagacauggggaagagugcggguaugguccuacggggaaagaacucagcuguaaaaggcugagagacacgauuauggcuggaugaggcaaagacguguggguaccauucuaagagcaaguaagguguugcuaaacaaacaggaucuguauccaaaucuuggcucauucaccuccuggugcgugagccucuuccgacauuuauucauaaaaacaaaaccaggaagguucggagagguggcgcagcaaacgagagcacucauuggcugcuuuugccagacugaaguucugagucccaguacccacagggaggcucacaacuuccuguuccgggggaucugaugcccucuucuggacacuauggguacugcaugcacaugguucacaggcauucaagcagggaaaacacccauacacauaaaauaaaaauaaauacauuuaaaagaaacgaaaaggaaacagugagcuccagguucacgaagagagccugucucaagaagaaauaauguggagagugauugaaaaacauauccagcauugaccucuggccuccaugggugcacacacugaugugcgcauacacacaauggagucaaauuaaggugguguacaucugugcuuucaugacucaggagcagaggcagguggacugggaguucaagacuugccucugguucccaagugcuggaacuaaaggcauguuccaucauuuaaggagaucuugugccccuccacccucccccaccugcgcccaaaggaaucaacgcagaacaacccacccacucccacccguguaaacuaaauagacccuuccauuccuagggucaggguagucugucacaccaugagaaaagcaacagauauagccugguacucacuauguagcccaggcuggccucaaacuuaagagccucccgcuucggccuccuaaguggcagacuuacagaugugaaguguuaggcuuaacucucuuucuaccuuguagguccugaggacugaaaucaggccaucacgcuuggcagcaagugaaguuugcccagugagccauguugcugccugguugcuaaacuuuugucaguugcuacuuuguuccugaugacucugaccuuacaggcucucaacuccaaguuaauuguacagacauuaaaggacuacuaucauaaugguuuauaccagugggguuugagggucauguaucagauauccugcauuucagauauuuacauuacaauuugaaacaguagcaaaauuacagcuaugaaguagcaacaaaaucauuuuuugguugggggucacagcaacaugaggaccuaccugucuuccaggguugaaguaguaggaaaguugagaaccucugguuuauauauacaauuuuauguauguauguauguauguauguauuauacauuacauacauacauuacagcuauuagugccccagaagguugauauuagagguggagggcuugggagguggcuucguggggaaggguucucgcugugcaagugugggaaucuuaguucugauccuuguggcacauauauaaaaagcuggcuacagccacuuacaccuguggucccaauacuauucagugacagaggaaucccaggcacuugcugaccagagccaaccaaaaaaacagugagcucuagguuuagugagagaugcugccucguggaaguaagacuaaaagaaauaaagcuggacagcaauguccuccacuggucuuugcaugugcgcgugcacgcacacacacacacacacacacacacacacacacacacacacucaugcacacaccagcacacacacacgcgcacacacucacacauacucacacacucauauacacacucacacacguacacacacacacucacacacaccugggccagcaauaugggucagcaugugaaggugccuucuagcaagucugaagaucugaguucuauuccuaagaccuacacaguggagagagggaaccagcuugugcaagguaucaucugacuuccacaugcaugccuuggcgcaugugccugcucacuauaacuuucuuuuuggaaacaggguuucucuguguagcccuggcuguucuggaacucucucuguagaccaggcuggccucgaacucagaaauccgccugccucugccuccugagugcugggguuaaaggggcuugccaccacccagcauaauuuuuuuuuauuuuaaauuuagaaccaaauaaacaaagcauaaggcauucuguagcugugucacuccuugugagcugagaacagagauucacacuuaccaucuggggacagucugcccaucaacccugagggaagagacaaacaaacaaaacaaagcaaaaacaaaugaugucaacacacaacagucaaaacagaaaaaaaaaaaaaagaaaaaagaaauaaaucugcagugaauggaaguucccagccaagugugggggacgugaggcuauggcgccuucacuauugaggccaaggccauuuaggaugucgggagggagggggccauaaugagcccaguuugguuggguuuuuuaaauggauuuuuauucccaacaauauagaauacauuucaauuucuuuguggcuuuuuguccccagcaguuugccuuucucugccguguauucccauuuccccuugcacgagguggcucauucugcacuucuuacacuugaaaggagaucaggauauaugcucugaccccagccagucaaccaaucagguaucucugcacuuuguggacauagacagaaacccagucccugcuauagaaggaacagauagguaacuucauagcaauaaaaaaacaggauagaagacucaccaaaugggacaaucuaaacccaaauaaaaacccaaccccccugagagcuggugggcuccucagagucccuucuuuaagcaauaaaucuguaacaucuacuauuaaacauccacugugugucaagcuguucuucugucuuuccauccgcccaccugauaguaucaacaucacuuagaguaggugugucaaccuacugugugucgaccuacugugugucaaccuacugugugucaaccugcugugggucgugacccuucaagggucagauaucaaauacuguacauaucagauauuucauuacgguugauaacaguagaagauuacaguuaugaagucaccuuauggcuggggucaccagaacaugaggaacuguacuaaaggguugcuucauaggaagacugagaaccacugauuuuagaguuucuuuaagagucuccacccuuugacccagcucagucauauagggcaacauucacuuccagcguggucugaacaccaagucaguaggaaauuucaucauuguaugaacaucagagaauggacauccacaaacugagaugguuauguugucaguguaggauaguauggucugcuggaguauaugcaauuucguacugaaggagaauaugacccaacaacaggguugccaugcagacucacacgaucccacuagauucugaguuaguuccaucuuuggacuucuauuaccacgcuaaaaacuuaccaagauguaagauguauaugugugcauauugaggccaaaggucaaccuccaauguuguuugaggagccaucuaucuuguaguucccaccccacaagauuuuuuuguuuuguuuuucgagacaggguuucucuguguagcccuggcugucuuggaacucacucuguagaccaggcuggccucaaacucagaaauccgccugccucugccucccaagugcugggauuaaaggugugcgccaccaugccccacuuaauuuuuuauuuuuuguuuuuaauuauguguaucuguguggguauguucauguaagugugaugccugaagacaccagaagagggcaguggaucccuuggagugguguucuaagcaguugugggcagcugagcaugacuguugggaauugauccucuaaaagcagcagcuaacuacugagccagcucucuagccccugccuucuucucuguuuucagaugugcggagcagcaaagucaggucaucaagcagcaaacaccugcuaccuccugagccauuuaaaaugcauaugaugggcuggagagauggcucaguggguaagagcagugacugcucuuccagagguccugaguucaaaucccagcaaccacaugguggcucacaaccaucuguaaugggaucaaauacccucuucuguugugucugaaggcagcuauaguguacuuacauauaauaaauaaauaaaucuuaauaaaaaaaaaaacaaaguggcugaguaauaucccauugugacauuaugaaauuugcaggcaaauggauagaaguaggaaagaucacucugagugagguaacccagacccagaaaggcaaacaugguguguacugacguauaaguggacauuagcugucaaguaaaggacaaccacgcuacaguugacagacccagagaagcuaaguaacaaggagggcucaagggggucacauggaucuuucuaagaaggggaaauagaauagaauuuuggaggguggacuggaggcaauuagggacagggacuggagggauugggugggaguaggaugcagaaauggaaggagagagggcaaugggggucgguguagugcagcggaaacccucugaagucuaucagugaccuuaugccugacacugcaucgauggccaggaaccuaaagcaagacagcccaaggacccaggauagagccacacaugacuggaaaaagucaaugagaugauuucugauauucugcuacacucacagacuggugcuugguccaauaaucaucagaaagaugucguucagcaacugaugggagcagaugcagagaugcacaggcuaccauuaggcagagccaagguaaccccagagaagaagcagcggaaggauugugggagccagagggcuugaggacaccacagaauacagcccacagaaucaacucagaggagcucagaggggcucagagagacugaacagacaaacauggacucuguacggaccugagcuagguccacugcauaguaugguugcguagcuuggcauuccugugggacucccaacagugggaugggggugucucugacacuugccugcaccccuuuccuccucccuguuggguugccauacucagcugugauaugaggguugugcccagacuuacuguauguuguuaggccauauuagauggauauccugcucuuuaauuuuuuaaaagggaagcagagaaggaguugaucugggguagaggggaggugggagagggacugggaaaaguggauggauaggaaacucagauaggaggcaauguaugagagaaaaauaagaauuagaaacuacacauuuauucgagaguguguguguguguguguacauggacugugguacauguauggaggucaaaagacaaccuugagugcaacccauaauucuaauuuuuaagagggucuuucuagccugucauccugguacucuauuagaacaggcugaccuaaacucagagauccugccucugccucuugagugcugggauuaaagguaugcaucacuacgacugacuuucagcauuacaaacucucgcuccaagcuuuccauugaacuacucagugcacaacaaugugacucacacacuuacccaagauuccugauggcaugaggaccaggugaggugacauggauagccaagauuacagaugaagcacgggacguugaaucagauggaucauggagacaaugccauaauuagaaagccaaaagcaagaucaggcucuggggggcugggaacuuauugggaaauggaaucuauaaugggucgugaugccugguugggaaugaagacugagguuccaugagauucccaagagucccagcggauuggggguagggagggguggggugggaggggaguucagaccuggggacaagggacugaggugcauauuuuacauaucaaaacagaccuggccuccagguucucccagcaucccucagccccuaccuuguaaacccugcucucaacucugaccuuuccaguccugggcugcucucucuccucuccucuccucuccucuccucuccucuccucuccucuccucuccucuccucuccucuccucuccucuccucuccucuccucuccccuccccuccccuccccuccccuccccuccccucuccucuccucuccucuccucuccucuccucuccucucccuugccugugagcucuuucucuuucccccucccuuccuucucucuccucauggcaacuucccuggacucgggccuuggagccagugaauucaccagugggugcagggucccaauaacccuguauuuaauauaaucuaaucugguuugcauuggcucauuucaccagcagacaaauaaccuauccguauuuagugaacugagaauggcagucaaacagcuugucugcagcuaugcuggaaggagaagaaaggcugccugcugucucgagaacaguccuccuuuggaggagggcgccacucuggaaaucacuacugucuuuccuugccugcugcggguaauaauucuuugcuucucagcugaauuugccuugaaccuacucucaccaagaugcaaaacaguuacauauggauuaaggagaaaaaacacugaauuuggugggaagagggggaaaaugguguuugaauucuaucaaaggagguauccuggcuacucagauucucuuuagucccuagauuagaagcuaggcuuuggacccaggacaggaaaugcugguugaaagucagguuauuguuucugagggacaaaaucggcuagaucagauggggaaggaaauacacucuuaccuuucagcacugugugcacgagaggaucaggaaagacagggugagccgggaccaaugggacauuuguccaaccaaagaaggaauauggaauggaaucaauuaggucaucuuuuaugcaucgucccuuaguguacuucaaagauccccaaauagggcacggaaacuagaauggggagcuuugacuuagccucugguucugccaucucuuugaagaugcauccauucuggaaaugagagcuccagggaaucuaacccucccuguuccaggagcuuagcagaaucggucuacauaacaacggauugucaaccuucuauucucagcuggaggccagguuguuuacuucucagaaaagaagaaagccuucugaccuguuacucaccgggaaauaccgcgcgguccacucuggcuauauagagaacuggggcucccacucucuuugaucagcucuuugauccuacugacauuaauaucaaacuauagucauggaaaccaacaaagguucuuucuuucucucuugcaagcaccaauccuaugagaucuggccccacccaaugaccuuuagagcuaggucaaguggccagguucaaguugaguauucucugagucugcuccugcacaaugugaugguuaguguuugcccccucacuuuugucucucugaguuggauccccccccaccccaacccuuguuuauauagagagggauugugacuuacuuuugacuggaggcggagugggaaccagagucauugagucagccagaaaaaaaaaaaaaaucgaagcaaacaagagggugggucaguacauaugcaaauuaccucagucucaccuuguaagucuuuguuccuucaaggaacaguuacacaccgacuguuaauagggaggggcuuuuacguaauacaaaggccgacugcccaguguccagaacuuccugugaugguuugaauaagaaugguccuggggcugaauucaggcugaauucgaaucgcccgugcuggguccugaacugagcauauaaaccuccucucaaaagagucagagaaagaauggcucagugugggaauuuagagcuuuugccacuuggauuugauaauguaauugcgugacaaguuugaagugcucaaggcuugcuagguacugaauuuccauugcuucccucucucugcuuucaaaaugauagcauuaucuuacauuugcgcagaaaagcucuuuccauuuauucaauccagcugaguacugaacuucccuaggccauaggaauaaagacaagagguccaugcuuucuagccacucacaaucucagggccuuuuccucugccaugugccauuguggggggggggggggggggauucucaaaagaucagccaagaaccauugaguugucccugggacuuuucaaaagaaugaugguugagugaauuaagggacacucgaguagcugggaaagcauaauuuaaucucugucuuagaguuuuauugcugugaagaaacaccaugaucuuaugaaagaaaacauuuaauugagacuggcuuacaguucagggguuuaguccauuaucaucacagugggacacauggcagcauacaggcagaaauggugcuagaggagccaagaguucuacaucuugauuugcaggcagcaguagacugugugccacacugggcauagcuugagcauaggagaccucaaagccugcucccacagcgacacacuuccucugacaaggccacaccuucuaauaguacuacucccuaugagcuaagcguucacacacaugagucuaugaaggccaagccuuuucaaaccaccagaaucucaucguugcauugaugggucuuggugugucagcagcaccgagucucccucuucuucugaaacagaagcuucagugauuuagcauuugcuuugaaugguuguauggcccagggagugucugcagguauguaugacauucagcaggccaacagaggaagagaaaauccuugcuccccugugucuguaacaucccaaccuuggauaucaaaacuccagaauucccaggcugacaucaguggcuccccgggcccuugauggacugugugaugguuuguauaugcuugggccagggguuggcauuaagauguguccuuguuggaguaggugugucacuguguguuuaggcuuuaauacccuaguccuagcugccuggaagugaaucuucugcuagcugccuuugaaacaagauguagaacucccagcuccuccugcaucaugccugccugaaugcuuccauguuccugccuugaugauuauggacugaacuucugaaccuguaaaccagccccaauuaaauguuguccuucauaagacuugccaaccucccugauucuccagcuugggacgauauguuaagggucuccuuagccuccacaauaaauccccccacaccugucuauucuauaucuuaucauaggcaguccuagucaguucuguucuucuucuauuucuauucuuuuuuuauauacuccauuuucuauuauaaccuauauuuauccuauucugauauauuuauuuacuuugaguuuaugucuggaacccauguaaaaguggaaucucacucuguagaccagaauggccucaaacucacagagacucaauugcgucuaccuccuacgugcugggauuaaagugcuacccaguacuaacucacguuuguuauaucugcaucauaguuuauuccuauuuucauucuagucugcuuccauuucauuaaguucuguuuauucucucuccucuauucuuuccaguucccuggagaauucuggcuaaaacagugaugauacaacauuccaacuccuuccauuugagauuacauuuacuucagucaaauuaacacaucaugacagacuggaugcagguacagaugugagaauccagccauuuucuauuuaaacuagccuuuuuuuuuuuuuuuuuugaaacagggucucauguagcacaggcuagccuuguacucacuguguagcugaggaugauucauguagcacaggcuagccuuguacucacuguguagcugaggaugauucauguagcacaggcuagccuuguacucacuguguagcuguacucacuguguagcugaggaugauucauguagcacaggcuagccuuguacucacuguguagcugaggaugguuuugaacuuucaauuucccugccucuaccuaauauuacaggcauauuucaucaugccuggcauuggcuugcuuuuaaauaguuuuuuuuuuccugauccucaagccaggauuuuauagcagauugaagcucuacccuuccccagaauucucagaugguucuucagacccaacagagucugagaagagccaucugagagcacaaacauaggguguugagaguucuuacuuuucucuuccauugcgacuggagguaaaagcaucauucaaguggauuccgucaggaccaggaagcaggugcagagagggaaugagacaagagacucaaagcacuacaaugaucaagaucacccacagcugucgugucuuuggaggcuagcuaacacacacaguuucuaucagaguuccucggggucuuucaucugcucacccaccugucuacccaacccucuucaugugucuaucaccuaucugcuuaucuauccauccacagaacuguuaucuaccaaucaauuccccaccuacucuucuacccacccauacuguacaccuauccaucaugcaucgacccauccuuccauacaccuacuuacccaucugccuacucaucuauaccuccacacacccauaaaucuacccaggaucccucuccauccaucaucuguccacccauccauccaucuauccaucuccugcccaucuaucacacuugucuaucacauaccuauuccucccuccaucuaccaacccagccagccaacauucacuugguucgacuuggccuauguuuagggcguaggagacacaugggaacuggacucagcucuauucuaaagacaucugcuuaguucacuggggaaaagucccugguagagggguaaacagagcauuccuugugguguuccucugggccucuguggcugccuuggucauuuacaggcacuucaguuuuagcaugucuagaagagaagcuggugauugucagccucccauccaucaaagaugaucaaucaauacaaguuaccagaagagaaaugguaacaagcuguagagaaaccugguagauacaaccuuagcuaagagaucaaagacagugucugucuuagucagggucauguugcugcaaugaagcaccgugaccaaaaaguuagugggggaggaaacaguugauuuggcuuacaccuccauacggaagccaggacaggaaguuaaacaggguaggacgcuggaggcaguagcugaugcagaagcauggagggguccugcuuacuggcuuguuucccauggcuugcucagccugcuuucuuauagaaacuaggacuuucuuauagaaacacucuagggguggcaccacccacuacgaucacaaauugggaaaaugccuuacagcuggaucucauggaggcgucuccucgacggaggcuccuuccuuuccaauuauucuagcuugugucaaguugacacacaaaccagccaaauacagagucauagguaagagacaaaccauuaucgaucacuuggcuaaaacucauccaugagggcacagugugacuucaguauauucuugcauaaccucaaucuaaucaugggaagagcucagagaaaaucaaucuaggagacauucugagacuaacugaccaggcucaucuaaauguuggaaguucaugagagacaagaaaagacugaugauuggaagaaggagaagaaaaagaaggaggagaggagaggagaggagaggagaggagaggagaggagaggagagggggaggggaggggaggggaggaggggaggggaggggaggagacgagaggagaggggaggggaggggaggggaggggaggggaggggaggagagaggaggaggggaggggaggagagaggaggaggggaggggaggagagaggaggagggggaggagaggagaggggaggggaggggaggaggaggagaaggaggaagaggaggaggaggaggaggaggaggagagaugccucaggggguaaagcuacuguccccagcacagccugaugauuugaguucagauugcugagauucacauggugaaaggagagaaccaacuccuaacaguugucuucugaucugcacacacacauaaacaaacaacaaacaaacaaaaauacaacuuuuaaaauagaagaaaaaaguaaaauagaagaagaggaaggaaggaaaugaagaaggaggaggaagaugagaaggaagccauauguuucaugugaccccaaaacccuggcuaucguggcucccacacacucuccagucuuacugugucuuagcucgcccaccaugcccucaaucuaucugccaucuuucugccacacugacuguucucagagccuugaagggacuccaugucuucuagcccaccauguuuucacacauacaguucugucugcacaaaacagccucuaacccucuagcugccuagcuucugcuucuucucgaggucuucucucaaaacucacuuuuccagaacagcguugccuaaagacaugcugggguaugaucaucugucaauuauaaaaaggacaucaaaauagagcuaugcccaccuuucccugacucuauuuucagcacugaguacaaauuaaaacuuggaaucauugucaaccuaguaggagaaagacaguuucaugacaaggcucaagucuuuccgguguagucuuuggcaucuuuacacuguaaaggaugggaaucuacgucacugacacacugacaaucgggcaagugagccccugcacuacacaaauuccaucucuucauggacacaaagcaguccagcagacucaaugacgacugaggacuagaugaagacaggacaagagacuguccaacauacguggugucucucucuaacauggcaaaaaggucacugcugagaacuaauacauccaucuccauggaagagccacgggcaagggacugacuaugaagccaccagugucucuaagaauaggcccaccaacacaagauucacuaagccaccaguaccucugagggcaaauccuccaaccugggauuaauguagucccaguaccuccaagggaauggccaccaacuagaaacucacaaagccaccaguaugucuaagagcaggaccaacaacccaggacucaugcagccaucucuacaagggagaagagagugggaugucuacacccaaagcaagaaagccuaugguagaccucagacuugcuuaucaaauccagccucaaugaccuccccacccuaagcuaccauggaguggaagccuuaccuucacgaggaacgcaggccucugccaggcccaggaaaaggaggaccaccagggaccucuucagaaauggcucuagucugcacauggugggggggggccuggauagggcgacugauguucuccuuccagggucaacgggacucuggucacucacuguucuccuguacucucaagacaaaaguua

SEQ ID NO: 3541 - RNA, 21307 nt, Mus musculus
cgagugcgcaggcgcgggagcucuguugcuagcaguucuguggcagcugugagacggaggacgcagcagggagacaggugagggggucuggugacugcgagccuuccuucagugggaaugauugauagcgugugugugugugugugugugugugugugugugugugugugugugugugugugacagagagacagagagagacagagaccuguuugcgugggucgcucuggugaucugaguugauucgggugcacgccugaagcuucguguaugcuuggcguauauuguuuguuguggggugaacacaguaugagaauccuucaggagacuccacguguguauaugugugugcgcgagagaagagaaguggaaggggggcgcgggagaagggaagugggaggggggaagggagagggagagaccgacuaggccugugagccccaagaaacaggugcgaauaccaccaacugcgugaugugaccagugugcccuguguaaaggaagacacuacaaggggccgcuaguggauguaggaacagaguucugagcaucucgguuguacuugugugugagugugauagacugauggagcuguuuaucauagucugagggcacucggccuguggggcccagggacaggugacuguacagguccuagugggaaaggaggccaccgcaggcuagaggggcccaagggugugggcacacaguucugaguaucucuaugucacuagcugugcuggugugagaguguuggcggguguguuugugugugugugagagagagaggcugaugaaguuauuuaucaaagucuagagauacagugagccaucagaugacaauggcuuugugagugugugccagugugugauugaucgugccucaucucauuuguuaccguggcaacgggcuccucuagaggaggagaugugauggccuagucugggaaacugaaccuguuaaggaugagacuuuuccuucuguacaaagggauaaauggcgcucaucagaguguugauggaaaggcuaaacggacugugaaauaauacaggugaaaugccuuguacaaugccugggacauacugagugcgguguagagucuggccuuuguuguagugcugacgguggagguuugcuguuguguuguuggccuguguacagguaggguuguaguggugaauuccaaaggaguuuuagugucuacauuuggaauuuggccgucuuucaccucuagcagagguucuggauugagcaguggugcacacacccuccagacuccuuuuaucccuaggcaagcaaccuggcuucuuggugucugcccaagaaugguccugcgggaaaguugcauccuacccugaccuguggaaccuguugggugucuuccuuaucaagguagcuugaaggcuucaguagaggagugguggggagugggaagggccucaggccagacaccuuuaaugcuagcacacaguagcccaugggagacagaggaaggugagucucugugaagucaagucuagccugguuuacaaauagauuuccacgacagggcuacacaggcacugcucuuaaauucagaauggagacuccuguggacacauggguaaagagguuuccuuagucccuacuggcugcacuuuguccacauuuuuuuggagauagcugccuaaugacugacucuaguacaccauuugcuuucuccacagucaccaaagccauuuuuaugccguguagccaccuccaaauuuuguuaaguagaaagucugauuagucucucuccugcucaguuccucucaccuuucccccaguuauaucuuaucacagaaacugcucacugucaccuuccugaucugguuccacaagccuuccucaccucacucugucuuagcacacagccauuuuuuuucuuuugccagagggugggggugggagggggagaugggggguagugggguaggauguccaagugugagggagguuucucuguauaguccuagcugggauuaagggcacguuccacccccaucccaaccccucccacuucuggcuacacacagccuucuuauaucucucuacacaucaaguccgggcuucauuagcacagggccuuggcuguaccuggaaaagugucuucccuguacccuguggcucacauucagaugucagcuuauggcuaccuucuuagagagguaaccguaacuccugcaccccucucugguccgcuauacggcccuuguuuuaccucuuaggguaugcaugugccccccaugcccaguuuauguuauguuggauguggaaaccuggggcuuagugcaugccaggccaucucacucugucaacugagcuacaugcccggcucagcacgugcuucuugucacucagcuucucuggguuuguagcucugggaggagugaaggaaauaguaaggauuccugcucuugaccccaaaucacuacgugcccuguggauugguucaggugccuuguccccaccggaacaaacagugccugggaacagcaacuuuccugcuuugacucucauuacgguaccugucaccugcagucaccugccauaagauggguggccagguaggugucuguacucucuuccuuaguguccuggccaggagcucauaggaacagacaauguugugugauucucuucuugccccuuccugacucuaaugauggggggggggggcuuauuucaggcaccuuggccuggcacaggugacuggggacaucagggccacugagcuuccucaucucuuuucugcuagcacucugccucagucugaauguggaccaucagcagcgggaggaaaggaugccugcaguccgcgggaaaucaaaauccaagguaaguggugacuguaacccuggcucauucuggucccgcacagucacccccucccccccccgcccccccccugccccccccgccccccccccccgcaaccauuuucaugggaguaauaccaauagccaacccagagcgaggccuagguacucuauauaaguuuuccuggagcuaaggaagauggcaguggcucaucagauaaaggcaccaccaccaagccuggccacuugagguugguucucaagacuuacauugugguaggagagaaugucaaacugucuccugacauccaucucgcaccauggcacaucccucuccacgcacacacacaaauaaguagauaaauguaaaacaaaaagucagaaaaaaagaaauaaaggccagguucaauaauauccaccuguaauaauauccaccuguaauaaaucccacugccccuggagcuccagacugagcgagagacccuggcucagaaaacaagguggagaacagcugaccgaccccggcucuccaucugccugguaugugugcacccuuacacaugcacacgcccaaaugaacguguacaucugucuauccuccaccccguacacaucaucuuccuguguugugaugaaccacugguaaccggauuaaagaacagauuucaauuuggaaggagccggacgguacgauugaaugccagcuccauuauuuaguagcuaugugaaacuggaauaauuuaccucaccucucuagguccuaguuuccucauuuguaguauuacuaugauccucuuggcaaugccuuacuacuacuaagggugauuacugagugaagcaguauaguuagguacuuagagaaaaaaaugccuugacuauaaaaaccaguaaguccaaauugcuguuuuuuuuaaagcagcauaaucuuuaauaacaguuucauuauuuuauuacguuauuauguuauaugcuauuaaauuuauuuaauaccucugcucuuuuggucuguuaaccccugucaugauaugucgccuguagucaccauuuuucuccagcccugcagaaagcacuuuugaagcuccugguugaauagacucguaauuuucuuucauuucaggcaccagugacuuuuggggacuuagccaucuacuucucccaggaggaaugggaauggcugagucccaugcagaaagauuuguacgaggaugucauguuggagaacuaucacaaucuagucucaguugguaaggugucgcggcccacacuucccugucucaguugguaagguuucauggcccacacuucccaccccagccccacccagccccagucaguaauccagaaccaaucugugaagggcaugaguuguuagggucuuuucaggaaaauggaaguugugugcauucuuuuaaaagugugugugucugugucugugucugugucugugucuguuucugaaucacacaguugguugguuuuuuacuguagucacagaguuagacaucaguuaccacggaaccuuuuucauuacucuccaaugaaaccugguagucaagagcaauucauuucccaugucuguauauccugugagagugggcaaucccuagcugucauucugucucuuuggauuugcuaaucugagccuuguauacaaauggagucauaacuguauggccuuuucucauuuaguauaauguuuugaggcucacaacugauguugcacauaucaguacuuuauucugauguauuauugaaucauuacauuguauggcuagaguucaucucguuuaucuuucauuaaccaauggguguuuauguugcucuacuuuuaaugaauuacugcugugagcuuucaugaauagguuuuggggcauauguuuuuauuucccuugguuauaaauggaaugggugagucauauggaaacugcacuuuuuuuuuuuuuuuuuuuuuuuuuuuugguuuuucgagacaggguuucucuguguagcccuagcuguccuggaacucacuuuguagaccaggcuggccucgaacucagaaaucugccugccccugccucccgagugcugggauuaaaggcaugcgccaccacacccagcgaaacugcacauuuuuuaugauuuauauauuuuauguauaugagcguuuugccuggauguauguaugaacaccguguacacaccugguaccuauggaggccagaagaaagcaucagauccccuggaaccauagucaccggcaguuguaggucaccauguaugugcuagggagcaaacccagguccucugcauaacagccauuguucuuaaccucugagccaucucuccagccccccuugccauggaauuuuuaucauuuguugcuuugaaagaauuuacuauaaggaguugacaguauuaaaaggugaacuugaacauugauuuauuauagagguguaacagggaugcagcuaccaccucgaaggcuguggggagaaaaggaagaguugauagcauuuuagggcugaaaggaagagccuugcaaagcuagaauucggauuucugaaagagaagggggggugcugucugguuugcuuauaugaguucugaauaagggauucaaagaaaacuggaaacugaaauagaaccccaacuggcaaaacuggcaaaacuggcaaaacuggcaaaacuggcaaagggcacauuugauugcagagcuugaggccaugcaaagucuaauucucugacuucguaaauccucaauggauccaauugcuauuuucuuccucuguguguguguguguguguguguguguguguguguauguguaacaguuauagauauuuuaacauauagcaaugcauauacuacuugcuuuuucauacaugugcuuuuuuggccucagaaccuugaguggaggucuaacaucccaguggaucauagaaugaggaugauuuagagcugaaaggugauagcauaagaccucgugccagaagcaccuggcccuauguucagaaaaauaauuuauuuuguagaguuaaacaacucuacuguauauaauuuagcuuucaucaucucuauaugaaaaauuaaaaccaacucucacacuuaaccauucaagcccagaauagucugauaucagagcagaagguuaccccaauacacaaaaagcucuuacuugaauaucaggcugacauugcaauucugacuaucugccugggucaguaucagauccacagauuaggggcucagugucacaagacuauccuuaccucaaauucugacuucguuaggguuuuccugcugugaacagacacugugaccaagguaacucugauaaagaacaacauuucauuggagcuggcuuacaagcucagagguucaguccacuaucaucaaggcaggagcaggagcaugacagcauccacacaggcauggcacaggaggagcugagaguucuacaucuucaucugaaggccucugggagaagaguguccucaggcagcuaggaagagggucucaaagcucacauccacagugauccacuuccuccaacaaggucacaccuccuaauagugccacucccuaagugccaaccaccacagauaccauucacaaguccaggccucuggaguucccaccuaacuguagguuggagguuccuacaaauugcccucucccagguuugauagaacucagguaugggcuuuaaguuuucugguucagcauaaaagaugcuguagaaacugcagaugaagagaugagucaggagaaauugcaaggaagagugcagagucuccaugcccacucuaucaugcuuucugaacucuuccuuuggguuuauaaaggcuucauuguauggguuugguugaucagucaggaauugauuugauuccccagcccucuugugaaguuaggggacaggauagaggccaaaguuauaaucacuguugauuucucuagcugauucugaggagcucaugugcacgcacuaucucauuagcauauaggaaagacaccacuuuggagggucaaaguuuuuagaagcugagugccuggugucaugaaucuacauuucuuagaaauaacuauguucucagggcagugguggcacaugccuuugaucccaguacucagaaggcagaggcaggcagaucucugaguuugaggcuagccuggucuacaaagcgaguuccaggacaguaagggcuacacagugaaacccugucuugaaacuucacacuccuucaaaaaauagaaaaaaaaaaucaccaugucuacacuuauuccuaccauccucccguucugcagcugccccucacauuguauccccacguucacaguguauucucacugugaugacaaacccacauuuuauuaacacaggacuuggcucugauuucaguggugcccacuuaaugauugguuccuguauuugucccauguguaggucuugccugccggaggccaaauaucaucgccuuguuggagaaagggaaagcaccaugggugauagagccaucaagaaggcgcugggguccuggugagugacugagaaccaaggucuacgucuugucauucaagcugcgaaugacagccaaaguaccgcauacacugggcuauuggucacagcagaaauuugucauacacaacccuaagagcuggaaacucuaagaggaggacucuagcagauauaguaucuaaugaugagccaggcuuauagauguugcguugccuuuuuccuguguugucauaggauaggaggguaagggaacacuucaaccccccccccccaaaccugauugagucccgagggcccucaccaugcagccuaguacuccuugaaauaguuauaauagucagauaucuccugugguugauggaguucuuuacuggcuguucuggggacuuccuggaagagguuccuauggucuucucccagcagccaauaaguucaugauucauaggcaguugccaugggagugcucccucucccuccuccucccccuccaaucgucucuucuuaucucuuacucucauuuuaaaagaaacuucucugcagguuuguuuguuuguuuguuuuuaaaaccccuucuucccguuaauuucccaaaucacucuuggauaccuugaaccauuuccuaucuaacacucuucuucgugccucaaggccugauccuguucucucaacccuuccucccauuaaacauaaguucacaguggcugauuaagugccagagcuucuuuuccugaaacaaccguaccugcccuguguuuguuuugcacaaucaggaggggguguccucuuugaaguguugcuugagggcuccccacuacacauggaaaagcuucaggccugugcaaagaggucaggucacagugugaguccuuagggugagaauaacaaauguccauuuagucucuacuuggugguguuguggggggucugcuuaaauccaacaugaacucaaacacuagucaauguggaugacaaaaauguauuguaaucaagcugccacugauccaucagggccacagaacaggcucaggcgcugaacuacuacucugaagagaaauugcacagcauauuuaaaggacaaaaccauaaagagagggggaacuggcugggcuguagcauugucuaaucauacuuugacagaagggguuuguagaaagaaucucuuauaagcacucaccccaugucaauaaaaaagcugaggcaggaaauaggugggacacuggcaggaaggcagaggauucugggaaauaguaagaguauaagauaaguggggggagcucugcgauaugagacgggagacagaacaaggagauagagguaaacuagcagguaucggaacuuggagagacacugagggagaugcugaggagaugagaaggaagaagcuggccaggacugaaggagagguaacuaaccaaguggcacacauagaauagauuaaauaguuaaauaaguuaagagcuagucagggaaugagccaaagcuuauagccuaggcauuuaauaaugacuaauuagucuuagaguugucauuccaggagacagggccgggaaagggaaacuuggaauuuaaaaaugauuucuauagggguugagcaagggaguuuucaccgaacagguuaggaguagcuuugugguccugggaacaugaacuuagcuugacccugccagcaaaaaggaaacauuguccuugagaugucuggacccagacaacuguuuccucauaaaaaaaaaagcuguucagcugggaaaucuccagcuccucuagggccugggaccuugacuuugguuuuuccuauuaaauggagucugaaaacgaaaugguaguacuuagaguagauuuauuuugcuuguucccaacagugucaggaaugcuuugagauacagguuccuccuggcaaugcuauagugggagaauugggucgcauuaggugaauggggcacugccauccugagaggcucagugacuugguggacccaaaguugaaacucagccugccuuuguaucuuuguauccccucuagcaccccaugacuuuguuuucucacuuccgaucagaagagguaucagcugaucgauggcgcucacacuugcaugacuuugucauuccuuaagagguguucauagcuucucuaacuccuccuccuccuccuccuccuccuccuccuccuccuccuccuccuccuccuucuucuucuucuucuucuucuuccuucuucuucuuccuucuuccuucuucuuccuucuuccuucuuccuucuuccuucuucuuccuuuuuuucgagacaggguuucucuguagcccuggcuguccuggaacucacucuguagaccaggcuagccucaaacucagaaauccgccuuccucugccucccaagugcugggauuaaaggcaugcgccaccauacccggcuucucuaacuguucuuuuuggcucccuuucaguuacucguucccuauguggauaaauugucccaguuaaacauuguuuagcuuuuuuaaacauuguguagcuuuuagugacugugagcuucuaagaguauguguuugucacugacaaauacugcguaaaagagagaggguuauuuugguuuuuggcuucagaggguucauuucaggguugacuggauccauugugcuuaggcccaagguggugaaaauugcuuugcgacaggauggcucaacuguauaguagccaggaagcagagaugacaggagagggcuggagacaagguguuaucuuuuuaaggccuaucuccagugaccugcuucugccaucuaggcccaacuucuugcuuugcaccaccucucaauacugccagccuguuaggaauccaucaagauacuaaucuaccaaugaaagcagauuaacucucauuguuuaauccccugauagugauucaacuuacaagccaagggccaaguccucaauacaugaacuguucuggggacauuuucauguucaaaucccagauaguuaaguauacaaagaagccaaagcaguaccaaccugccaggcaagguaugcccacuaguguaauguuaccgugaagguuuaugaaguaaccaaccacucugauuggaucugaguccugcuccacaaggggaaauucaugccucauauuacacucuugcucaaaaucccaugacucaaaagucacaggcccuggggaagggggacagcuacuacuacuauuuauuuuguuuuaaaaagaaaagauguugcucgggguggugcacgccuuuaguccuggcacuuaggagacagaggcagguggaucucugugagugcaagaccagccuggugaguucagaccaaccagaguuacgugugaaacucugucucaagaaaaccagaaaacaaacaaacaacaacaauaaaaauagaacaaaacuaaaagcaaaaaaauguuuuucucauucuauccugaagcauauuuuauuuauuucuuguuuucuguuugguuauaggaaaguuggucuuuuuaaaaacuucuuuuuuuuccauucucuccucuguguguguguguguguguguguguguguguguaugugugugucacacacacaugugcaugcauugagcauguguaugugugcauguuugcaugugggcacaguguguaggugcauuuggugaucugagguuggugucaggaaccauccuccaucagucuuccaucuuucucacugaggcagagucugucagucaaaccuagagcuccacaguuagucuugcuagccagccugcccuggguauccugucuacaaaccugaggcuggaauuaggccaccaagacaacuuuauauauaugcauauaguauauuauaucugaagggacucuagccagccugagcauggcaaacaugaauccaacaggcuuugcccuucucccccauucccucugccuugcuaaaaaccagcuuacaagauccauuuccuuauuuggccacuucauccuccugagucugacuaccaaaguccagcuaucagaacuccucuauggcucaccuaaugcacauagcaauuaaauuugaacaccucacccuaacacaggauuuucccuuuuaccuuaauaaacugucauuugccuauagaccacaucuguuuccucucuauccagauacaguccuuugucccucugggacaaauaccuguucccuuccccuucgcccuaguccuccugucugucucuuauuuccugcuuuuugucccucuggcaaauaagucuccuuugugcugagaacuugcucgggagguguuuuguaccuucaacaguuccugcaguuuagccuucccaaucccccacccccacgcccuuguauguccccuuuugcuuuuuguuuguuuuguuuguuguaaaccacugaggguuuuuuuuuuuagugucgcccgcuagaauacugacugaucuuguuggcuugaacuugggcaggagacgguuaguaguguccggcuuaaagugagccuuagcuacugggaccccccucagcugagacucuagagaggagaugaugcaaggggcuuauuuccuagugggcugggguuauccugcacccagaacagaggcgaccccuucucuuucuuucauacgcuuuuuauacaauuuuugagggcagauuauagcaacagcaacuaggcacauaaugauuggugguucuggugaccuugacauuaauuggcugggcagggaaggggacucagggaccuucccuaaggccccgugggaaguucaagugagggcucucucaguugcagugaauucaugaguguagggaacacacuccucucuguccugacucuuaacauucaacccccuucuccaccguguuucagucuucucucuuaauuaccuuucugucaauugugguaaaauacgcugauaaaagcaacuuaagggagagaggugucuuagucacuguucuguuacugcgaagagacacuauaaucaaggcagcuuuauaaaagaaagcauuuaauuggagguuuguuuacaguuuuagaggguuaguucaugaucaucaugguagaaagcaaacaggcaugguacuggagcaguagcugagagcuuuaccauccugaucuguagacaccaggggagggguagagggagagagacagacagacagacagacacacacacacaugaagagagagagagagagagagagagagagagagagagagagagagagagacugagagacugagauuaggcgccugguguaugcuuuggaaauuucaaagcuggcuccuccuccaacaaagccacaccuaccccaacaaggccaugccuccuauucccauuucauuaacuguuguuuaagcauuaaacacaaaagggcagcugugacugucaaguuauauuguguucacccaacauucuuuuuacauaguccaggaccucugccuauguaauagagucacccccuguaauccaacacuguucuggggagagguguguaagagauugguauuggcucaggccccccaagaccaaguucucagcacaaagauuuauuugcccagagggacaaaggggagggaauaaggaacaaagacagggaguuagaggauaagggagaaggggaagggaacaaggaauagggguguguguguguggggggggguauuugaaaccagagggacaaaggacugccucuggauagagaggagacagccauugcacauagggaaaugaugguuuauaaagguaaaauggaaacccuguguuaggaugagguguuuaauuagauagguuaauuaggugaggcaaagggggcuuuugauugcuagacuucaauaguugauagcuagacccugauagucucaggaagaggauguggccaaauaagagacuagaccuugcggcccagauuuaggaauguagucuaaggguuuuuagcaaggcagauggaaugggggacaagggcaaggccuaucagagccauuguuugcaagcuagcuagagucucuucaagguagacaaacaucugcucaccccagacagggaaccaaucacagaccaacucaagggugucaccagaguccaacuugaugaaccaauggguuuuaugggaguuacuuaacaggagugugggugagggguuacuuacaggagcagaaaugacugaaagacagcugcaucacccaggccuaccccagcaugagugacagccugcagaaacugggaaccuggaacauaccauguauccugccggcagcucaccagguuggaguguguucuuuccaagugacucugaucuaagccuccuccaggcugcucagcuggugucuguuucuuccaggcagcugguuugguuucaguguucuuugccgcucagcuuccuuugucugagaggaccuuucgacuuuuauuauuuacucucgcagggagggggccuggugaaucugaucugauucagggacuuccugaugguaucuugagguauuuaucuuuuuacccaaagagguuccaaacagaguggaauguuucaaucuuggaggacacugcuacacaacagcacaagaaacagcucacaaaggcuguauaaccggagcauucuguacaacuugccucgucugucuaacaggcuggggaguaacucugcaggcagcucagagagucugagccucuuuuguuugagaaugucuuucaggaaccauuacugacugcuugcauauguucagggagagagaagccuaacguauuuguucaguuucagggacuuccaaaaaccuuugauguuuacuuuccgaucuuagcaagcuucucugcaggauaauaugauuuuuaucucuucuuagaauauccugugccuuaaugaguuuccuugaaugguggacugucauccuacgucuuaaucaucuccgccuuuacaacauaacuauuuuauccaccugcuuuccuacacccugcgucuaaaugagcuucauuccaagauggaugguuuuaauccuagaggagagcgcuaugcaacacccaacaaugggagggucuucccucauucauccuaaucagaauaaagcuucacaaacccaggggcgugucucucagguauccagcuggcaagcccagggacgugucucucggguauccagcuggcaagcccaggggcgugucucucagguauccagcuggcaagcccaggggcgugucucucaaguacccagcuggcaagcccaggggcgugucucucagguauccagcuggcaagcccaggggcgugucucucagguauccagcuggcaagcccaggggcgugucucucggguauccagcuggcaaucgagauaauugaagacacuuugaauagucuuguucuuuuuauucauaaugacccaacaucaauaauaaaccaaaaaagcuucaguucucagguguuugaacaucagaauuaacagauggaggagauaguauggaccagaaauuuuguauuuauuauuuauaguucucagaaaauuccugucagguagcaauuguauccauuucauucaaaauuuuaaaaaauuacauggugggacuggagagauggcugggcuggagagauggcugggcuguuaagagcacuagcuguuuuuucagagguucugaguucaauucccaauaaucacuuggugucucauaaccaucuguaaagggaucuaaugcccucuucugugugucugaagacagcuacaguguacucacauacauaaaauaaaucuuuuuuaaaacauuacauugugcacacacauacacguacaccacagugcagauuuggagaugaaaggacaacuugaagguuguccuguaccuugauccaguagaucaaauccaggucaagcuugguggcaaaugcuuuagcccacugagcugucuggucagcccaaucccauccaauuuaaagaccaugacggggcauggaaagacagucagcaaucaagacucuugcagagcgcucgugguguuaccaucgcccaugcagggccuugcuuuaauauucuuuaauaauuugguaugacccaaaugcuacaguaugugcucacuauuucuacagugagauggucugcuugccuuuuuaauggaacauauucacuggaagguuugcuguuggcacaggacacaccaagaccaagcucucagcacaaaggagauugauuugccccagagggacagagggcagggaaucagagacaacaagcaggagacaggauaagggagaagaggaagggaacaaggaaucgggagaaagaguauuugucccaaagggacaaaggacugccucuggauagagaggagacagauguggcccacaggcaaauggcaguuuauaaagguaaaggggggaacccccauuuuaggaugagauguuuaauuuguuuaaaaagauuuauuuauuauuauaucuaaguacacuauagcuguuuucagacacaccagaagaagacaucagaucucauuacggaugguuguaagccaccaugugguugcugggauuugaacucaggaccuucggaagagcagcccgugcucuuaaccacugagccaucucuccagccccagauguuuaauuuuaauugugcauguuaauuaggugagccaaaggcggcuuuugauugcugcacuucaauacuuugauaccuggacugugguagucagucucaggaggagggauuggccaaauaagggaauaauccuugguggguagcuuuaggaauauaaucuaaggguuuacaggggagagggaacgagagaagggcuucuauuagagccauguuugccauacucaggcuggcuauagcccuucuucacacuuagcuauauaccuauuuuauacucacauaacauaccccuuaucauaccagccacauuuuagguacccagucaguacaugugacuaguugcuacuguauugaauagcacaguucucuguuuauugugccucaauaaauuaaggucuauaaucaauaugcuauauaaguacuuuauuauuugaaaaaagaauucucuuaaagguacuuuuuuuccuuuaauuuugagacaauuucuuauuauauuggcuugcauauaugcauaugugcugagcugucuuugaauucaggaucucccugacuuagccuccugauugccuggaauucagacaugacaucacuguuaucagcacaaguaauuauuuucagccauuucagacuaauauguccuacuccaauuugaucacuaaauaauagauucauucuuuuuagcuuaauguauuacucugcuuucuuggaggguucccccccccucucucucuuugguuuuucgagacaggguuucucuguauagcccuggcuguccuggaacucacuuuguagaccaggcuggccucgaacucagaaauccgccugccucugccucccgagugcugggauuaaaggcaugcacuaccacacccggcuguuucucuuaaauuuaaaguuuuuauaguuuuacauguccacucaauccuaauuguuaguauauuugugguuuucaguauuugguauucaagaauaugcuuuuaguauuuauagcuuuauagagacacucacuuacuuugaaaguauuguucagccaggcgaugguggugcacgccuuuaguccucgugcuugugaggcagaggccaguggaucucugugagucugaggccagccuggucuacagagcaaguucuaggacagccaaggcugugcagagaaacccugucucgaaaaacaaaaacagaacaaacaaauaaaaacaaaagaagagaaagaaauauagugaacucauucuuuaaaaagaaaagaguauaauccauuuuccuauuaauuuacaaaguuugaugucucaauaauccaguuuuagaugauuuuuauaacacagguauauuucuuuuacccauuuacaguuaauuuccuuuuuuuuuucuuuccuuuuuuguuuuuucgagacagguuacaguucauuucuauuuccacuauuagucccaguaaccauguaacauuucuguguaaauauucccuuuugggaacguuucauaugguaaauuacauuuaacugaugaacagucuggagcuaaauguggcauaugagauaaacuauaucacauauauaaaaacuugguuuauucacuuucaaacuucagacauuccugaauuccuguugcugugauuaaacucccaggaaaaaggcaacuuaagggagaaaggauguucauaaucccaggcugcuccaucacugagggaguuaaagcagcaggaacgugcagcagucgggcacuuuauccacagucaagaguagggagaggaacucaugcaugcauugcucagcuagcuuccugcucaagccuagagaauggcaccacccacaauaguaauaauuaauaauucauucuucuucuuauuauuauucacucuggaaccccaagcucagggauuagugcugcccaauugagguaguuaagauauccucagaggcccucccuucuucuaggugauucuguauuuugucacaccaaugauuaaaaauaaucaucagaagaccuuaauauagcaaugggaacuaugguaagacacauuguucucguuaacauuggguuguuauaaucacuaauuauaaugacuccuuuuuuuauuauccgagcuucauuucuucacuacuaauccuaacuucuugguguuuuucagaaucagggucuaaguaugagaccaagaaguuaccaccaaauucaugucacaaaucugggccaagcaucugugagaaaccaacuucuucacaacaaaagguucccacagagaaggcaaaacauaacaagaguucagucccaagcaaauccaagaaggaacauucaggcaagaaaucuuuaaaguguaaucuuugugggaaaaccuuuuuucgaagcuuaucucuuaaacuucaucaagacuuucacacuggagagaggucuuaugaaugcaguacuuguagacacguuuucaggcagaucuuaucccucauucuucaucagcggguucacaauuggaauaaaagcuaugaaugugauaaguguggggacauuuuuaauaaaaaguuaacucuuaugauacauagaagaauucauaauggaaaggaaaguuuucaccaugagaaggccucagauucaugccccucccucagucuacaccguaauaaucacacuacugacagcguucaccagugcaggaagugugggaaagucuucagucggaugucaucccuuuuacuucauaagaggagucacaacagaaagaaaauacaaaaauacaauaaauacaaaagaggcuucaaaaagcagccaguccuuguacauaaaagaguuuguauuggaaagaaaacucaugaaaguaagaaggccuuaauucagagugccaggcagaaaacuugccagucggaaaacccuuuuaugugugggaaaugcgggaaguccuuuaguaggaucucagccuuaaugcuccaucagagaauucacacuucagggaaucccuacaaaugugauaaaugucagaaagacuuuggacggcucuccacccuuauucugcaccuaagaauucauaguggggagaagcaguuuaagugcagcaagugugagaagguguguagucgccuuucauccuuuauucagcaccagaaaauucauaaaaggaaaaagaaacucauugcaugcaaggaauguggaaagauguuuggugggaugaaaaaucuuaaagugcaucucaacauccauucggaagagaaaccuuucaagugcaauaaauguaguaaaguguuuggccgccagucauuucuuagugaacaucagagaauucauaccggagagaagcccuaucagugugaagaaugugggaaagcauucagccaccgaauaucucuuacgcggcauaagagaauucacagugaggacagaccuuaugaaugugaucugugugggaaagccuucagccagagugcucaucuugcgcagcaugaaagaauucacacuggagagaagccuuacgcaugcaaaaucuguaagaaguccuucgcucagcgcauuucccucauucuccaugagagaagccauacuggggagagacccuaugaguguaaugaaugugggaaggcuuucaguagugguuccgaccuuauccgacaucagagaagucacucuucagagaaaccauaugaauguagcaaaugugguaaggcuuauagucggagcucaucgcugauucgacaucagaguauacauucggaggaaacacccuaaagcugucgcuauaucugcaaaaucuaaaaaggauuucagagacaugggaagugagcguaaguguucuugaccuuaugaugauguaugucccagaaacucaucguaaguuguaacguuugagacaaaauauauauuuacuauaccugaccuaccaaaugugaccauuuagcagcacagcgcaauguggagucccaguuguucauucuccugacccuguggcuuccuggaagcuguggccugauccugcugcccagcaucgugagaguuaucauccugcuuaucaucagccuagggaaagaucacacuuagacccaauucaauuccuaguugaauagauauugccucuguaccauuauaaugcugaaaaaucacaaauccgcaaucauucguuggagggagugcacuaucugccaacaaaauguuuugugucugcggggccauguuaugauacucucccuuugaaagccaaaaaaccaaagcagucgguagauucugaagugaaggucugaaagcagcugagguaugcucagaauuuuggaucaggguuugugagugaagggguuuuucgguuggcauuucauuucuaguacagcauucaggacauauuauuggaugcauacaaugagauggaacuggagcuagaguccacuuuucugguggagcuuugagccugaguugaggucccaggagaacagaguguuaagucuaacaggcagaccagaccaagcagggugccucuuucuccuucagagcuuuguuggggugaggacgaagagugagucuuuagggugcuagaaauaguaguuacaguggucacacugccuccaugguugugaagauacacugcgaacauuuaguaagacaggcugggggcuugggcaggagauacugaagaaugagaaacuugagagcagggagaagcuauuuuuuacuuuuuuuacuuggaaauaaauccucuauauuuauauaaguaaacaguguuuucaugcaguacggcuauuugcucugaaaguuacucuugagauauguguuuggguuuuuauggucuggauauuugugccaucgcaaaccucacauguugaagcccuaauccuucaaugugaugauauuuucaaaugagauuaauggaguuguggugcagaugggccuuuuugauauguuuauugaucagagaccuugucuccugucccaugugaggacacaggcgggccaucugcaaaccaagaaaagauccuaccagaaccugaccaguuugcuacgcucaccuuggacuuccagcuuauggaggaacugugagaaccuaauuucucuuaagucagcucgucugugaugcuguguuauagcagcucaagcugauugguucauggaagaccuccuagguuaagguacuggcugcuuuccuuugauccauccaauacguucaauguaucuuuuuuuuuuugguccccuuuuccagcaucuguaagcuguauaaaaaauaaagucuguguucuuuugugugauuagauuauauacaaagagguucuuuuacauguucucuucugcacgugccguuuaagagaacaucuguuucuuguuaagaaaagcuuauaguauuuguuuacauuguuaagaaaaguuuauagggguucuaauuuugagcacaaacauugggauuugaauaggaaauguccaccaccacaggcucaccauucccagcugguaggaggcuccaggugag

SEQ ID NO: 3542 - RNA, 3625 nt, Mus musculus
cgcuggucuugaggugggaauccugcugugggcagcaggcagcccggccaaagaggaaacagcugaaggaucuggagcuaucccgaagcuccaugguaaguauggaagcaggcgccgcggaccgagucucagccuucagacuaauugcgaugcuuggccguaccguuuuucauaggcuucccuaucuuggacuacauuucccguugucccucgcgggcuugagcucuguugguaccccaauccagugcucaguuuucucagccaaccuugugcauuuggggcaccuugggaaggguucuccaccuuagggaaauuagggauguuuugcauccaguacuauguuugccuuuauuuuucugagacgaagucuuguuuuauuauacguaguacauauuaaagcggagcuggaguuaagauacauuuaaaacaguaaaauaaaauuuaaaaauauuuauucguauguguauguuuugcacgcaugcaucguacauagaggccaggagaggguguuggaucuucuggaacugguguuacaaagagaaguuuuguagucgccauguguguucugagacgccaaacuggguccuccgcaaggacagcaaguucucuuagccaaugagccaucucucuggccccuacauuuauaacaguuuuaaguacuggggcuaauaggcguuuagaaaagaauaauauacccaagugugagcauagucuucuaaaggcagaucuugguuuauauuauacauauugcaggggccucacaacauuuagacccauagcaccacugucuuagaugcaacacuuggugacaucgaaguuaucuugguuuagguucacuguccaacuguugagugaaucacaggcuauuuaugcaaucggauguuguaccuuauaauaagggagagcuuccaauucaucauacuuaguacuuuuuuuauauaauuauuucacuuacaaauuggaaauauuuguaacgugacagguauuccuuucuuuaaugaacucaagaaguaguuaaaugacaagacuacaaaaaccuugggcauuuuuauuuuuguuguguuauucauuugggaauagggcuugugugccaugaacaccagaguggaggucagaggacaacuugcaggaguggguucucuguuucaaccauguggguccugcgaaccaagcucagcuugucacuuuacagcaagugccuuuucccuuuccugagccauuucauuugccaccugggauguuguucuguccuguuacuuuggacccauguaucaguagcuugguaguuugguuucuuaugcuagauguucuuauaguugugcaaaggaucuaguugugccagucaugaaucacuuuccuugauaacugcuguuuguuuguuuguugguugguugguuuguuugagacaggguuucucuaucuguuugagauaggaucucuguauagcccuggcuguccuggaacucacucuguaagccaggcuggucuugaacucagaguuccgccugccucugccuuccaagugcuguaauuaaaugcgugagcuaccacugccugacuuuauuuacuuuuugagagggaaagucucuguguaguccugauuggccuggaacucacagauccaccugccucuuccucccgagugcugggauuaaaggugugugccuaguucuucauauuguauuuuuuaaauuuguuuuuuaaaauugugugucuguguuguguguugggacaugugaguguaguugcuugaagagucuagaagaggguaugguauuuucuggaacugaaguuacaggcaguugugaacugccaauugugggugcugggaacugaauucaaguccucugcaagaguagccaguacucuuaacuacugagcaaguacucuuaaccacuugucccuugaaaucauguuugauuauuggcugucauauucuauuauuguuauggcuaugccaaaaaaugauucuauauguaacuacuugagaaaucaguguuuuugugggguuuuuuuccuucagcagauaugauuguguguauggcuuugcacacuacugugucuguuccaucuaauugugcgauugucuccugcaacuucacccuauuucuccacucaaaguaagucgaguuuggccuguggaguucuuugugaguuuggaaguuggagaaacaguuggcuugacuugagagugguuccauuugaugccugggagaugaaauggcugaguccugugaaugcugggauuccuuucgagucugcgguuaugcacauuaugcaagcucuccuuacucuccgagugaggagagcuuuccuugucuuuagaguaccguguaugucuccaucgcuggaacaggucugaggaccucugucugagcuuugcaccaccugcaguauuucagggaagugggagagaaagggccucucauucuauaccauuucugcagcagcuaaauuggccugcuggugauggguuugaccuagcucucuguaaugggcaguuagagaaauacaggcggggacaucacccuggcauucagggagcuuagaaccuccauguuugcuuuuccuccucagcucugauaccuaagaacucuguccuuccccaagagagaaaccuggaggaagauccaucagccuugaacuccugaaagucaugcugcucgugaguuuuaaaauuauguaaaaauuuguuauccugaaacuucccaccuggauuccaugaguuaaucugguccccugagaucuguuuaugguguaaaagacauuuucucugacaaaugugauuuguuaauucuguagagagguuuuccuagcagaccuucaugucccuucgugaagugggaacaucuuuguaggaacuaaaauuugaaaggagagagugaccacacaggaaaacagggaggugguguugguuaccauuucagcccuugggaagacuauuucauggcccugccuuggaagagauggauguuugggugcaauggagaucuagcugggaauuaagaucuaaucugagguuacgccaauugucuuaguuaggguuuuauugcugugaagagacaccaugaccauggcaaugcuuguaaaagacaaccccuuaauuggggcuggcugacaguuucauaguaguucuuuaucaucauggcaggaagcauaguguguucagacaaacauggugcuggagaaggaccugagaggucuacaucuugauccucaggaagagaacuggcuugagcgucugagaccuaaaagccuaccuccuacucacacaucuucuucaacaaagccacgccuacuucaagaccacaccuccuaauagugccacucccuaugggcauaugggggccauuuucuuucaaaccaccacuaagcauuugggucuuucuccacuagcuccuucacuuuuagcacaagagaaacacagagcuggggguuauaggaauugcaagugagacucucagccugacagguuggugggugaauucuugaagcuuggaagggcuuuggagauuggauuucuacuuugguccaaaauaugaggauguuuagucauucuuuucacuuaggagauuguuuaguccagaaaaacauaauggagagaaacccagucucaaaaaaccaa

SEQ ID NO: 3543 - RNA, 19331 nt, Mus musculus
cagaggcugcgcuugcgcacacauagcuuguaggaaaccucccagcguuccucgguugacagcgucuggguaaggcagcuagcgggcgcuuguuagggagugggagcccgagcgcugcgggcaggggagauccucguggucccuguguuuucugucuggagguaggcaggcgguugcguggaaucuagggggcacgaaagcucagacgacugggcguccggaucuaagucugugcuugggugugccaggcccgugcgugugugaaaggaacugggcuguaaguuuucggugugagagagggagacagagucugagagaaauaagugcugugauugugagagaacugugaaauguaugaugauaagugugucuuccagugaucugcauuacagcacuuaaaugcuuggaaucuccaaaguaauaaauaccuuguugacugcucuugauugauggcugacaagacucaagguaguuucagagucggugcugaucaucgcagacgcuaaacgggauuagaggaucagucccaaaccccauccaggagaggacaggagcugagguugaucaccagaugccaguccuuuuguugauguuucgagacagaaugucauguaauccagcaguccucaaacucuuuauguaaguagaggaugaguuuggaacucugaucuuccuaacucagccuuccaagugcuguaauuacaggcgugugcaacccacacucagauaaaugauuuacacagccaugcuuacgugaugaaguguccauagcgacucaaaaggaaaggauucaaagagcuuucugacaggaguauuguaucccugcauagaaauccugagaggccguugagggaaguggguaaagugaagauaggauuguguuggagacuucaagauguuggagauacuagagucgugggguagcugcagccugaguguggaaccagcccaagacagagaaguacguggcagucagcaaagcugaaaggauucggagaucugaaugacacagagaugcagaauuuagaguuugcccugcuuguuuuccgucuuuguucuuugguccaguauugauuuucuuauugugcuccuuucucucccuuuuggaauguguuuuuauuuuuaaagauuuauuuauuuuugcuuguauggauauuuugccugcaugcacaaauauguacaccaaaugcauggcuggaggcauggaucuccuggaacuagaguuacaggcaguuguaagcugccaugugggugcugggaauugaaccccaguccucuagaggaacauccaguguuccuaacugcugagucauuucuccagccccacuuuuggaaauaauguguaugcuuuggcauuguauguugcgagcaugugaucugcuuuuuaauuuugacuuuacagggcuacaguuaugagauugcaugagucucagaagagauuuugacuuuggacuuuaguguugagacugugauagacuaugaaggccuuugaaguugaacugagugcauuuuugcauuaugauauggcuacaagccuaagggggccagggagugaaaugugcugguuugaauaagaauggcccucauaggcucauauacuugaaugcuuagucaucaggcuacuacuugagaagaauuagaagguguggccuuguuggaguggguguagucuuguugggguagguguggccuuacuggaggaaguaugucacuggagguaggcuuuggggauucaaacgcccaagccaggcccaguggcucuuucuuccugaugccugugguucuggguguagaacuuucaguuacuuccccagaacuuugucugucugucugucugucugccugugugccacuaugucccuacccugaugauaaugaacuaaaccucugaaauuaagcaggccucaguggaauacuuucucuuacaggagugccauagucacagugucuccugguagauguuagaggauauaggaagugaggguuaacugaaaggacaacuccaaugcagaauucaugaagaugucaucuaugauagggugagacuuuggggugauacagaaguuuugggguuacccaugcuccuauaaauaauucuuuacccgugcucuguaaaaaagcccaauaaaccuguuguuccaccaaguuggauuuuugugggauuauuacguaggucuguccccuaucugagguaaacagaguuuguucuaaaacucagaaaaagcucaugcaaugagaaccagauauacuaauauaucaaauaucagcaaaugcaugaagcucuuuggagaaguugaaugaaaagggucacggcacacacuuguguauguguguauauguguguguaagaaagaaacugggcugugaaaaacuaugucggugugcacaguaagauuggaguaugccugugucuggccugugugugcgcacauuugacugacagggaugaaaaauaucaguggguggguuuuuuguguaagaaaguaacuggaauguaaguuccuaggauguguguguguguguguguguguguguguguguguauguguguguauguguguguguguguguauguguauguguguguguauguguguguguguguguguguauguguguauguauguguuugugugagaguguguguguauguguaugugugugaguguaugugugugaguguguguguaugugugugugugcaugugugugugugaaacaagcuguaauuuauaagcaaccaguguuaucucugaaagaguuugugaaaggccacugugguuuuccuuucuuuuauuauggauuuuggauuaaaauuuuuguuguuuuuaaauuagcuuaugaaguaauagauucuauuauggcacuuccauuuauauuuuauucauauugguccucuucccucauucuuucucaaauucucccaacucuuucuuguugguccuuuucccuuuuuuuuuuuuuuucuuuuuugguuuuuugagacaggguuucucuguauagcccuggcuguccuggagcucacuuuguagaccaggcuggccuggaacucagaaauccgccugccucugccucccgagugcugggauuaaaggcgugcaccaccacgcccggcuccuuuucccuuuucugauggugcuucuuuacagucccugccccaaauuccauuguauguacagaccauauuuucuuucuucauucauuguugaugggcaucuagauggauaccauguuccaacuguuauguuuauguaucucugaauguguauaugugccagggauagguuauacagccccuugggagaaugccuuggagugguaaagguccauuuuucuuuuuuugagaaauuuuauucugauauccauagugaaagcauuagcuuauacucccauauauaaaguuucucuggguaggccaggcuggaauggggcucugcuguaucccagcuuauccuccuucaaacucaucaucuccugucugugguauuugaaugcuuggcuauagggaguggccuuguuaaaauagguguggccuuauuggaagaaguguguuacuguggagguggccuuugaggucuccuaugcucaaacuacugccagugugacacacagucuuauucugcugccuguagauaaagagguagaacucucagcuccagcaccaugucuuccagaaugccaccaugcuucucgaugugauaauaauggacgaaaccucugacacuguaagcuagccccaacaaaaugaguuacuagcgucucaguguagugucucuucacagaauaaaacccuaagauacugcugcuguccuccgaaugucaggguuauaguagcauaccucugugcccagaaaacaucacauucaugaggguggaaaugggagagaaagaugagcaguugugcucaagaccaaauuggaugaaauggauacucugaugccuaguguaguauuuggaaggcuuuagaaauguaggguuguuaaaguuguagagucuucugugcaugugagagaaacagauaagaggcugugagcuuggugugggugugagagagagaaugagauuggggcaccugugaagaagauguguguuuucgaagaucacggcguguguaucugugaugugucuucuuucuggugcuugugauugugugcugcaugagauaggcagcaugugagaccaugucguguuuacauuuucgcuuccuaggcuauaaucauagccuugugugcauggaaugacuacuuugaagguuaauagaauuagauuuuuuaaaacauaaaaauaccauuauauuuugaauuaaauuuuugucuguuaguuuuguuguggggcacauguaugucacaggaugggguguguguggugguguguguguguguguauguauguaugugugugcgcgcacgcgcaugugcguguaaguuagagggggacuuuuaggaugguucucucuuucuaccaugugaguccuauggaucaaacucagauccucaaauaccuuuacaaaacccuuaagcuaucuuuuuaggcucugggagauuuucuuuuuccucucucucucucucugucucucucucucucacccccccucccccuuucuucaggguuucacuggcuagucuugcccuucugggaaguacccugccucagacuaguaauauuugggauugcagauauucacuacaauaguguguuagcguuauauauuuuuaaaaguuuuauuuaccuuucuguguaugaguguuuugucugaauguuuaucuauguaccacguguauuccuuggagaccagaauaagacauugguucccugccgggcggugguggcacacgccuugaaucccagcacuugggaggcagagacaggaagauuucugaguucaaggccagccuggucuacaaagugaguuccaggacaaccagggcuacacagagaaacccugucucgaaaaacaaaacaaacaaacaaaaaaacccaaaaacaaacagacauugguucccugucacaggacuuucccuguccaauuauauuacugcagaggaggucugugauuggaaagggaaaaagggggcggagcgaagagugggggagagggagcgucccagggaguagaaagaagaaccaagguggcuucagacguguaccuacauggcauuuaccagccacaaguagcuauauuucacaagguuagaaauauugggauaaagcuuuuaucauuaucaauuggcucugaaaugauugcauuugcaucuuuuaaauugugauaguauugauucauaacccugauugguuaauuaagcuuuaauagucaugauucuacugggguacuggguauugugagcugcagccgcgaggcuggcggucccauuuaguuacuacauggguuuaugcauuaagaagaacuaguggcgcagggacaagcguagugggggcuagcugggagagagaggcuuggcaucaagaaccugcugagcaggaccccgcugggacauaauguuguggccugucagugucaauacuagagugggaacgugccuggcggggcaggagaguuggcagaaucuuuuucaacaguugcccugaaacuggaauuacagaugguggugaccugcccugugguaguugggaauugaacuagauccucaagagcagugggugcuuuuaacugcugagccaucucucuggcccccagcauuagauucucucuguuuggcuguuugcaacuguguguugcuuggguuaagaauccuagaucuaagcauucaagaagcugcaguagcugagcugagccaucuauaggucagaaaggaagacagaugugacacgguaguggaacugguucccaaaguucuguuguuccagagugagaaagaagugaaggcccugggguucaggguagagaaagauagugucuuuuuuuuuuuuuuuuuaaagauuuauuuauuauaucuaagcacaccauagcugucuucagacacaccagaagagggcgucagaucucauuagggaugguugugagccaccaugugguugaugggauuugaacucaggaccuucagaagagcaguugguacucuuaaccacugagccaucucuccagcccccgaaagauagugucuuaguuaggguuucuguugcugugaagagacaccauggccaaggcaacucuuacaaaggauagcauuuaauuggggcuggcuuacagguucagcgguucaguucauugucaucauggugggaagcauggcagcaugcaggcacacauggugcuggaggaggagcugagaguucugcaucuugaucugaaggcaaccaggagagacaggcauccucaggcaguuaggaggaggcucucuucugcaauggguggagccagagcauaggaggagaccuccaaagcucacucccacagugauacacuuuuucaauaaggccacaccuccuaacgguaccauucccuauuggccaaucauauuaaaacuaccacagauagaaacccuuaggucugguggcauuaagagugggauuucaaacugaccguccuaaccauagaucagaaaccuccacagaaaacaauuccaccuuugccuauaaaauggaaggaagaaauaacuauuuuguaggacuuuuuauguacagucagacaagauaacaggacggggccuuagggauaacaauguaggacuuccaucggauggaagggagugauuaaguaauuugcuuuacucccguagugacugcauggccagcuuaucaguuacucuucucauugcugugacaaaaaucccugaccccuucccccacuccccccaaaaaagacucaggacuugaauacaaucugucauggcacaaaagucacagugacagagugugaggagacuggucacauugccucugaaggcuagaaacagagagccaugaacugauagccgacuugccucuuuugucaguuuuguuguuguuguuguuguuuuuguuuuaaauuaaugugagaucucagcccaugggauggucaguggaaacaccuucacggacaugccaagcauuaugucuccugugagauuuugugguuuauuuguuuauuugaaauauuuuuuucauaaauauauuuugaucaugguuccuccucacucauccagcuucauggcuucccuuucucucuuuagaaaacaaaacaagcaggugaauaauaaaacagauaaaccaaaauaaaacaaaauaaaacaaaacagaaaaaaagcaaagaaagggaaugagaaacacacagacucacauacaaacaaaccccggaaaaacacaaaaucagaaaccauagugauauguaggcaacugaucaguaagguauagaaaaugcccagacaaagcaaaacauuaugagacuuaaaaaaccuuuccauugaguucauuuuguguuggccaucugcugccuugaagccugccauugagcauuguuuguauccucagugagacuccgauugguagagguugaugauuguugauagcuucugcacuucuacuucugcucucagcacugggaccccuuuuggcuuggauucgugcagguucugugcgugcucccacagugucugugaguuuauugugucuagaacacacucucuccuugguguccuucauccucacuggaucuuuccaucuucuaccuccucuaccauauaguucccuaaucccugagaggauggguuggaggaagacaucccauuuaggacugcguguuccaagaucucucgcucuguguacacuguccaggagcuugucuuugugucaguucucaucuccugccagaggacgcuucuuugauaaugggugagcaucacacagaucugauucccagcuuggugucguaggugauuuuagauccagucacauugacagugagggugaagcaucaugcuugcucacagccagcuaaaccugggaggaaagaaagacaaggagccauuuacacugguaauguugggggaaggaugaagaccuuggcuuucaacuaaacucucuuguccuagguuggacuucccaggauacaguuguucuccaagagagaagccaggaggaggauaagacaugacaguugaacuaaugaaagccaugcuacaggugaguuuaugucugcuaucuuccaugagaagguuuuuuuuaauuagguauuuuccucauuuacauuuccaaugcuaucccaaaaaucccccauacccucccccccacuccccuacccacccacucccacuuuuuggcccuggcguuccccuguacuggggcauauaaaguuugcaaguccaaugggccucucuuuccagugauggccgacuaggccaucuuuugauacauaugcagcuagagucaagagcuacgggguacugguuaguucauaauguugauccaccuauagggcugcagaucccuuuugcuccuugggugcuuucucuagcuccuccauugggggcccugugauccauccauuagcugacugugagcauccacuucuguguuugcuaggccccagcauagucucacaaaagacagcuauaucuggguccuuucagcaaaaucuugcuaguguaugcaauggugucagcguuuggaagcugauuaugggauggauccccggauguggcagucucuagaugguccauccuuucaucacagcuccaaacuuugucucuguaacuccuuccauggguguuuuguucccaauucuaagaaggggcaaaguguccacacuuuggucuucgagaaggggucuugauucgcacuaaguaaugcuacuugggaaauucugaucaauagucuguuccagggcuuagccaucccuucauccauaagacacuguccuuaaccuuaacugccuacuaggugacuaauaacuaugauaagguguagagcccacucagaaccccauuguuuucaugcuucguauacacccuuuuaugauguaaaaucuaacuaguucauggucaaaccaccuuggaugugcgucauuggauccugaaaguuaaagaggguugggccugacuaguucuuagaugagagacagagacugacuauggagcccagcuggcuucagaccuguagcaaccacccugccucgcgcuccaguguagaaggauucaagguguguaccacuaugccuugucagaagacuggcuuccuuuuuacaucagacagagguaucucaguacugguaugaguuggguuccgguuagacggacaugcaaagccccucccaugaauguuaguccaagucucuuauaacauggagcuuguaauuggcaucugaauuugaggcagucuugugauaccugacacuguuugaggaaugugugugacgauuggauuagauuagagaucuuccaccugcuccccacaguagagcuggcuaguugcagguaggcagauccuacauauuuuaaucaucagagaucauggauguuuugagagugugggaggagaaaaggaguguuuuguugguugguugguuuguuuuuugauauucucucacucaucaugagucauuuuacucuuuuucuuuuuguuuugaaaugguaggagguggugcaacauguuggccaagcuggcuuuaagcuccuggacagaaacaccuucucauuuacauuuaaucccugucccacucccagucaacuauaguuuguuuucuaucuacauauuugugcuuuccagacauuucuaauaagugcaguggugcaagauguaguccccugugucuucucuccuuuagcaacugacucccaaggggagcucuucccucucccccaaacaaaagaauaaaaacauaacaaaaauuugcaaauguacuuguaucaucucaggaagcagugacauucaacgauguugcaauagacuuuucuccggaggagugggacuggcugaauccugcucagaggaguuuguacaggacuguggugcuggagaacuaccggaacuuggucucuguggguaagcaauccuucuuccuguggauaguccagaaucugcucuuagucaccuuucauauuuuuauuacuaaaacuguguuuauugugcugggguuagaugaaaaauucagaugcagucugugaauuugacauauaucagauacuggcagucauaucuuuaggcaauuggaccugcaaacauggugggaacuguggcagcucucugcucucuauuaccuuuauguuacaguucugcuauucucgucaguguaacuguuacaccucugaggggaaaggcuuucccaguguguugcagcucagaggggaaagguuccccaaaguuuuaacagcucuggggaugggguggggaugcagggagauuucuccaaguaucuuggcagucaggacgaaaggaauuccaaaaaguuucauagcauaaccaaucucacacaagagauauacugggagagacacaagaggguggcugccuuugcuugggugagaagcagcagggaacugaggggaggcagacauuguguagaguuucuuggaggaacggggugggggugggggugggggaguuguagcagagaucuccaggguggagauuggugggauuucaaguucagaguuuggggcuuuuuacucgugugugagugugagugugaguguguguguguguguguguguguguguguguguguguguguguguguguguuggagugguccugcuguuagggcaguuagagcguucucuauguggaaccuagagguuugugguccuaaggcaaggcgccuggccacuggaaagccucaaggucucaaaaccgguaggaaguaacagggcuagggacgaauauggccugguuacuaaaaauauggaaaaucacuuuucaaauauguauccuguuuuuuuuuuauugcguugauuuguguguguguguguguguguguguauguguguguguguguauguguguguguguguguguagggcauauauguauucacauacaaauuggauuaugacuuacagaacuuagaucagcugaugucaucaggcuugguagcaaaucgcuuuacuuucugagucaucucacugacccccaaauauguaucuuuuuauuaauuuaugauaaauaaguaaaacccaaugucuuaaaauaucugcagaugcuugcucuuauagauacuaauauagacccuucugagccugggaaauacauugaaaguaaaagcuacagaggcucuggauccugucauuguccuccgaagaguguuguuuguuuugauacaggguuucaagugcuaggauuacaaucacaagcuacuaugcuuuguucuguuuuagacauguaguucguuugacucagacuccaaacugucucuaauauccuuucacaauucauuuauuuuaauuuuauaaagagauuucauuuguaauuuuaaaaaauacauuuaaaaaaauaugugggcuggagaaauggcucagcaguuaagagcacuggcugcucuuccagagguccugaguucaaucucuagcaaccacaugguggcucacaaccaucugucaugggaucugaugcccucuucugguguguguguagacagggacaguguacucauauaaauaaauaaaauaaaucuuuuaaaaaaauaaauauguaccugcugccgggcgugguggcacacaccuuuaauuccagcacuugggaggcagaggcaggcggaucucuugaguuagaggcuagucuagucuacagagugaguuucaggacagccagggcuaaacagagaaacccugauucaaaaaaugaaacaaaaauguauaugugacuauauggagguauguucauugaguguaguugcaugcacaacagggucuuaaaucuccuggggcugcaguuacagguguugcugagcugccaggggcuguaaauugaaccuaggucuucaagaacagcauguucucccaagcacugagacaucucuuuacacugaucuccuagcaggcuauuuucucauuuauuacugugauggcccuuuaaaaacaccaagccaaguucuugcccuuccuccacuccauaagaaacaguauaauugcugaggguugacuguugacagcuggccaccagacuauuccagaguuuuaugcagucuaucauaagauagauaucaaauguguuugauuuuuuauuuuguaguugcaucaaauuuaaggagcggacuuaggaauccaaacaaccaaaacauggccuauuuuugugucuuuuuuuuuuuuaaugcaggagcuugcauuuccaaaccaucucuaaucuccuuauuggaacaugggaaggagccuugggaggugaagggucaggugacaggaagcagaguacaaggugagaagucaagaagcagauugaaaaccguuucuagggaauggcucugccaucuaucuucagagguccuuaccugggcugaggcugcccagaaacucuuccuaagccuugcaucccgggugugagcugacguuuccuugcuuggcauggauuccucccuucuacguccugcuugugucuucugcuuuccucuugucucuguaguaagucauuguauacagaggaggauguccugcuucugcuuccauugcugggaugaggugcccugaccagaguggccuuaagggggacaauguuuauuucagcugcaguugcacaugguaguccaucauuguugggaauucauauuggcaggacauugaaacagcuagccacagagcagagagaguggaagcaugcuugccugcuaugaagcuagcuuucucuacucauauacaauccuguuguuuuaaagacaaacauucaauuuuaccaaugaagacuccagcuggaugcuggggugacagacaguuugcuagcccagagaggcagagaaaacacccagcugaccuuccuauucauugaugccccagaaugaaaaagccucuuucuccuucuccauguugucuuaaaaaauaccauucucgggcuggagagguggcucagugguuaagagcacuggcugcuuuuucagagguccugaguucaauucccagcaaccacaugguggcucacaccaucuggaaugggaucuaaugcccucuucugguguagcuggugaagacagcuacagugugcucacauacauaaaaugaauaaauaaaucauuaaaaaaaauaccguucuccucauuguccccuccuuucuguuuacuuaugcucacucccuguuggcugguuacuugcuccgccuccugacuuaggguugacuuuauuuagcucuugguucaaaggugugugcuagagcugagucacauuacaacaaguuuucccaauucacaaucuuggaguucccaaugugaucagauauucugcaacacuauccagggccccaaagcugagaauucuguggccuguauuuaggcuggaucuucccacaucaauucagacagucaaggugauccucugcagacaugcucaggagccaaucucagcuccauaguccuuuacugagacaccuguuccuaaccaucagauaacagcaaaaccccauaauuuuuuuaaagcaaucuuuucuuaagauccauucauuuauuuuauguguacgagugcuuguuaggucugcaugcauaccugguugugagccacuaugugguugcugggaacucagaaccucuggaagagcagacaauugagccaucccuccagcuucuaaacccccauauuaaaaggcccgaaaagugaugcucuuccuauguuguugaaagugagagaaugaagaaaaaccccuuacuaugaaaccugaguugugugagaaagaguuugguguacugagacacaaacacauaaagguuuacuuaggagcacuguuuucugaugaugaaauucuauucgcgcacuugccuuuaaaucccaagggaagucaugaagcaucguguggugugugugcuugcugggacucucuagagaguuccaagaagcaguaguaaugaaauauauugguaguuaaacuaagugagcuuaacuauauauacuaauuaaucaaaaguaggaaacaggaggcuggaaagcuaccucaguggguaagacuuggguuccauucccagcacccacauggcagcucccaacugucugccacuccaguuccaggagaaucuucuggccucuguaggcaccaggcaugugcauggugcauagacauacaugcagacaaaucauccacacauauugaaugaguaaauaaauaaauaaauaaauaaauauuuuuaaagguaggagacauuacagaagugaauuuaauuuguauucuggucaaaucagcauuaucauuacaaaugacuucuaggaccucaucuuauucuucauuuacuuugucauuuccccauguuguucuagaucucuucccugaugccauauuuguuuccaucgcauuuuaaaagaggaaggguuuuuguuucuggcccaugguuucagagguuuacaucuaugguccacugucucuguugcuuuuggacugguggccaugaagaaacauggaggaagggcaugguggaagaaaucuauuuagucauggcagccagaaagcaaauagaagccugcccuugcuacugaauuuccucuuucuuuuucuuuuauuucaaucucccaguucauuggauagugacacuuccagggaaagugucaccucccuaguuaauggcuuuggaaacaaccucacgucuacacccauaggugugcuuugcaccucuaugcagugaaguuaucuaguuuuucauccaauagggucuagauuaucacaaagcucuuauucucagggacauccuugcacauuucccaguugaaauacuuguaugcaauuauauggaguuuaucaaaucguugaggauuacuccacuugaagugcugcuuuuguuagauggcagaugauaaagaagacuuuguguuuuacauuuucaggugguaaaucuguacagaagacacacgaauuaucucucaggcaguugguguuugaggauguggcaguggagaacacuacaagucuugguugugagucucucacuucuggaaggaagcagaaaugcaaagaccuucuggauagacagaugagucaagaaauauuuaaccugaaagaaacagucacucacaaaggaacccacacuaaagaaauaggcuacaaacacaccgaauccuuaaaaucugcccaucuggauaguguagaagagaauauuuauacucacaagucaaauaagaaaagcuucuccaaaaaucccaagguauggaaauacaagaaaaucugggcagggaagaccauuuuuaaauguaaugaaugugagaaaaccuucacccacagcucagcuguuacaguucaccagagaauucacacgggggagaaaccauaucaaugcaccgucugcggaaaggccuucaagcagagccaccaccuggcucagcaccacacaacacacacccacgagaaacucuuccagugugaggaauguaagaaagccuucagccagaauucauaccucacuguacaccggagaauucacaccggagaaaaaccguauaaauguaaggagugcgcaaaguccuucaggcagccugcccaccuggcucagcaccacaggauucacacgggugagaaaccuuacaagugugaaaucugugggaaagccuuuaaccacagcaugucacucacuggccaccaaagaguacauucuggagagaaaccauauaaaugcaaggacugugggaaagcuuuucggcagaguauacaccuuguuguucacucaagaauucauacuggagaagagcccuaugaauguaacgaaugugggaagaccuuuagggagaguucccagcugacuauucaucagagaaaccacacgggagaaaaaccuuuugaauguaagcagugugguaaauuuuucaauagaagugccuaucuugccagacaucagaaaauccauacaggagagaaaccuuaugaguguaaugaaugcggcaaaaccuucacacaugcugccuaucuuauaagacacaagaggguccauacuggagagaagccuuacaaaugugcggaauguggaaaggcauuuggugauggcuccucccgugcucagcaucagagacuucacacuggucagaggcccuauguaugugagaaauguggaagggccuucagaagaaagucaucccuuaauugccaccaaagguaucacacuggaaagaaacuguaaaaaugugucccccauggcaaacccuuuagccgccuacgaaccuguagcguucaucagagaauuuagcuuucaaccagauuguucacuguacucuacauggaagaucucacacaggucaaagagcucuuaggaauguaagggauggggagaaaucuucaguaaauguuccuaaaccacccaucauuggugaguucuugaugcagucaucucaggcaucccucccuguccucagguccugugcauauaccugcuaaguauuuccauuuagguuuggccccuuagccuccugauccaaaacacaauuguuuugcuuggacuuuuucaaaugucuguaauccaucuuguuuccuucaaguuuauuacucauuuauuuuacagucagaaaauuucuuuuuaaaaauauacauguuauuuauguaacucuucuaauacucauuguaaaauguuuauuuaaugcacauaaaauguuuagccacaugauugacuguauuaaguuuggauggagaacaucccuucaaugauuaggagacacaucagcacagaacacagagaggccacacacagaggcaaaggaacaugaggggguaucccugagccaaugcuuuauugggcccaggguuacagauuuccuuuguugagucgcaacaagcaggcaugaguucugggaggucaucucagguguagaaagugaucauugcgacauaugugcccaguccaucuucagcagugcauuuaaagggagcagugaaggcaggcagcccccuuugacggguucuuguucuuggcaccagcuugagccacuuguggauggugugauacuaggaagugucaaaggugacugaccuacaccuccagccugggaaaguuaaaacuucaaugaaauagauaccaagagaacauaaaaugaaaggacuucaauacacugacccauaggggugcuuagaaaauguguuagaccagaaaaauuauuucuaaaccauggccucucaaauuuggaacuuaggugaugacaacaauuuagaaacugaaagugucuucagguggaacaauuaguauguguaguguauuuaagauggaagcuuucuaaugauccuaaagguuauguuuucuuauugguaaagaaauuaaaucuggucugguacguagaaucuguuuuaggaagugccuagaaguuaaagacuggaacaaagaauuagaauuuauuugggaaaaaauacacauguguauauauagucuaggucacaaaagaaacauucuuauauuuacuaacaagcccccagcaggccagucuagccgaaacagggagccccaggcuuaccaugagauccuaucucaaaauguaagguggagggcgacagacucccaacaccgacuaauggucuccacacacacgcacaugggcaaucaagccuacaaaugcauauauacaaauaaauaaauaaaaguaaaauuugaaagggugauuguggcuguguuuggaggcacacacaucucauuucagcacucuggagguagagacagaugggucucugaguuagagaucagccagguuuacagaguucuagggcagucagggcuacauagcgaggccuuggauaaaaacaaacugaaagaucacaugcaagaugaguacacacugcagaaauaggaaaacaggggacacaaacuuccauucucguuguuccagaggacucugggugguuuuuguaaaguccaucucaugguagguucuguuggacuguaugccugccuuuccuuguuuauccuaaguucauucucuuccucuaccccccacccaauuuguuaucaaauugccagggcuggcgagauggcucagugguuaagagcgcuugcugguuuugcagaggacuuggauuugggucccagcacccauauagcagcucacaacugucuguaacccaacuuccaggggaugcucuuuucugggcuccacaagaacuguaggcacgcaaugcacacaauacaugaagacaaaacacucauccacauaaaauaaaagcaagucuuucaggggcuggagagauggcucagauguuaagagcagucugcucuucccaaaauccugaguucaauucccagcaaccauaugguggcucacaaccauuuauccugggaucugaugcccucuucuggaaagcggauguacauacagauagagcaucauuuacauaaaauaauaaaccaaccuuucaaaaaaucuuuguggugacaaugcugcaauauuguuuuugcuuaagaauuuuuuaguauaaaauuuccuucugguuauaugagguguuugugaagcauaaaugguuuuauauuuagauguugguuucuuuucuaaaauauuucauuacgguaugcacauauuuaccacucagaaaaaaaaauaacacuuuuguucucaaacauuuuauauaaagaauauucugcuugcucagcgguagugacacacacuuuuaaaaccagcccuuccagaggcagaggcaggcagaucuccgaguucgaggccagccuggucuacagagugaguuccagaacauccagagccacacaacacucucucagaugauaacugaaugacaaaaauaggcagcucacaguccuaaaugggacauucuuguauaccuucucaagggucugggaacaucguauuagacgaaggagaaagaauguaagagucugagaauggcaaggagugcuguggaaugguuuugggcauguugugcucaugaacucauagaaacugauuaccagcacaagauugcugguaauuaccagcgccgaucaauauuauagccauugauagaggaagggcguaccccuccacaccuagcugaggagcuauaagcaaaugauggcagcugagagagugggagucauuuuucuuuggggauguggccucugguagauuguucaugucacacuccacugguauacugguaggcggcacuaacagggcuauauuuaaaaaaaaaguguggugggguggcaaaaggaauguggaaguauuggggaugguugggagaggagauguguuggauaugaucaagauacaguauauauacauguaugaaaccgacaaagaauaaacugcgcuccccucaccuca

SEQ ID NO: 3544 - RNA, 947 nt, Mus musculus
gauggagaagucacuugaguugggcaaugugaccagaguccaggaguuuguccuauugggcuuguccacaaggcugggaauaagggacgcccuguuugucaucuuccugacucuuuaccugcugacccuccuggagaacacacucaucaucuaccucaucugcagucacagcgagcuccacaagcccauguacuucuuccugggcaaccucagcugccuggagaugugcuaugugucagucaccaugcccacacuacucauggggcuauggacggggcccugucauguuccauucacaggcugcaugacccagcuuuucuucuucaucucucucaucugcacagaaugcacucuccuggccuccauggcuuaugaccgcuauguggccaucugccguccacugcacuacccacugcucaugaggccacaggucugccugggcuuagccuugucuucauggcuaggugggcugcuggucucagugaucaaaacagcaugcauugcaagccuguccuauuguggccccaauguccucaaccacuucuucugugaugucucuccucuucuuaacuuguccugcacccauguggcccucacagagcugguggacuucaucucagcuauugucauccucugggguucacuccuuguggccauggccuccuauguggccauugguaggacaguucuaggcaugccaucagcugcugcucgccacaaagccuucucuaccugugccucccacuugguaguggugggcaucuucuacucagccacuaucuucaucuaugcccgacccagccgcauagaagccauggaccuuaacaaggugcugucugucaucuacacgguggucacucccauguguaacccaguuaucuacugccucaggaacagggaggugcaaucagcuuuccacagaaccaugcgcuggucuucaguuugac

SEQ ID NO: 3545 - RNA, 1208 nt, Mus musculus
agcggcucaccaggacgaaccauggacagccagggcaggaaggugguggugugcgacaauggcacuggauuugugaaguguggauaugcaggcucuaacuuuccagaacacaucuucccagcuuugguuguaagaccuauuaucagaucaaccaccaaagggggaaacauugaaaucaaggaccuuaugguuggugaugaggcaaguaagcuguguuccauguuggaagugaacuacccuauggagaauggcaucgugcagaauugggaugacaugaagccccuguaggacuacacauuuggaccagagaaacucaauauagacaccagaaacugcaagauuuuacuuacaggaccaucuaugaauccaaccaaaaacagagagaagauuguaaagguaauguuugaaacuuaccagauuucugguguguauguagccauccaggcaguucugacuuuguaugcucaauguuuacugacugguguaguagugaacucuggagauggugucacuuacauuugcccaguauaugaaggcuuuucucucccucaccuuacaaggaggcuggauaugacugggagggauauuaccagguaucuuaucaagcugcugcuguugcaaggauaugccuucaaccauucugcugauuuugagacaguuuucaugauuaaagaaaacuuuguuauguggguuacaauauugagcaagagcagaagcuagccguagagaccacaguguuaguugagucauauacacuuccagauggacauauuauuaagguuggaggagaaagauuugaacaccagaaacuuuauuucagccuuauuugaucaauguugaggggguugguauugcuuaauugcuuuuuaacacaauccaagcagccgacauugauaccagaucugaauuuuacaagcccauugugcuuucuggagguucuaccauguauucuggccugccaugaucgagguugaacaagaacuuaaacagcuuuacuuagaacgaguucugaaagaagguguggaaaaacuuucaaaauuuaagauccaaauugaagacccaccccgcaggaagcacgugguguucuugaguggcacauauccuagcagaccucaugacauacaaaaacaacuuuuggaugaccagacaagaguaccaagaaaacggugucugcgugcuggagaaagucgauguaacuguuggauaaa

SEQ ID NO: 3546 - RNA, 12235 nt, Mus musculus
cgacagacauugggcgguacuuccugcauuuuguccugucuuugguuuaacuguccauggguugguauuuggaggauucugagcuuuaaaaucagcaaguuagacuaaagguacgagagcgaacaggcacugggugucggccaagcagaccaucaucagccgcggcggccgugcaccggccccugcguacucuacagagccggauggcggcgcugaagcaccuggcucagguaagugccacauacuaggcgcucccucucccuagauacuuugaguccuagagccccuugaggacucccgcucagcucacauccuuaugaaaaacuuaaucccuguguccagaacagugccaagcucguggaugggauccgcauuucucguaacuagucugaugaggcauggaagagugggaccaagagaagagugauugacugauuugugugggcaguaucacguuuggccacuuuaaccgggagcauuccagccuaaaaaaacggcaaggugaggugcauuaacuaugcccucacuacggaggagccagcgggacugaauggaagauaaauguagcuagagguuauucaaaauauuccaaaagcugcacagaguuagagcgggcuggaagagaauaauauggagcccucaggagaauaaagcuuugugcaacaucccgcagcugcuaugacucagcacuaugcauaguuuagagauaauuuagauauaaaagguuaugaagauucaggacuggacagggguccagguccaugaaaacuuaccauggucuuugauucuuacaacuuucuucccacagguucccagaucuacagaaaaggguauggucuguauacaggugagugugggguguucuaguaaguucaccaguguggccacacuucuugccucacguugguaguggaauucauuuuuguggggguucuuaagaauggaauguaacauuuagcauggaggcauaucccuggagucugaacacuagagaggaccaaggcacguucaaagccagccugggauacauggugagacccuaagaaagaaugagugauugauaagauagcucaguugguaaaggcacuugcuaccaagccugaguacuuaagucaguccccagaaccuacaugauaaagggagagaacugauuccugaaaauugugcccugcuuuucuacuuguacacucacauacauaugcauacugggagaaaauaaauaaauaaauaaauaaauaaauaaauaaauaaauaaauacaaaaagagggagacugagauuucaaaacccaguaguauagugggaaugucagccgcuggcuagucacacagaucuacaacucuggggaaaauuaagcauggagacauccugauugcugaaggcugcuguuuauccuugaauacggguggauuaggaaacagaaucagcuuuauuuuauuauuuuaauacuuuuaaaauguuaucccccuucccaguuuccccuccacaaacccccuauccuaucccccuccucucugcuucugugagggagcucucccaccucacugccuuagcauucaccugcucugggacaucaagccuccauagaaccaaggaugccauugaugccaaauaaggccauccucugcuacauauccagcuggagucaugggucccuccauauguacucuuugauuggugguuuagucccugggagcucuaggguguuagggaguguccugaaggcuuuuucuuaacuccuuugaucaggugauacuccuuccugccucagccuccuaagugcuuauacaaugagagucugccaucauggccaaaaggaagcuggucuuguuaguaauaccauaagcauaacaccauacacacacacacacacacacacacacacacacacacacacaucgcaccaacauuuaggaaggauucuugaagugucugaaaagugaagaguuucauucuaggaauugagagcgcaaaguguucaucugggagaaucaguguaucugcagaggaggccccuguagcuagacuuuuugguagagcuuuguuagaggaaaccugugacuguugaaguggcauuaaaugccacauguaugaugguggcuaacacuggagcaaggaacagagucagccagcaaggcauuaagagaggauggcagcugccucugacacuaggaagccucaaaauuuggguagugauggaucuugccuccauauaugaagcuuucucuagauaccuccugcuaaguaaugcaggagcccaaggagaugccugugguauaugcuguggaguuugagguggcugugggaaugagcuguuauaagagagguguggacuaagugaaacacauagagauggaaaauguuagcaggcccugcgacuuggauaacagacacuuucuugguuuuauggaggaacccuaggaaaauugcagaacaaaguugauugauaagcuuuccaaagucuuuaaguacauggagagggacauuugaguaguguuaucuuuaaauguguuuggaauugucuuggguucagggugucccacccagacacacccagacacacccagacacacacacacacacacacacacacacacacacacacacacagagacacuuucuuugguuaacaggcauuuuguaccccuccuaccauugcaguaggacuccgugacuugauuugugagcaaagaaucagcuguaauagggcccuugcuuuagugcuuuagugcaugaaugacuguggacuggcugggauaagaguggguaccacagcuucugcucuugguaguauaacagguacagaaagaccuaccacaugcaaagggaaauggcuauauuucaaaaaaaaauaaaaaauuaccaccuguugcuuaaagcaaaaagucauuuaaaaaacaaacaaacaaacaaacaaaaaaaccaacaaaaaaacccccaaaaagccucacugugguuuuuauguuccaucuucucauuccauggccucaaaagaagucuugauggcccuuuauugucagguccaaaaugcauagcuacuccucauccuucugugggugcagagggaggauguagugaucugggaauagaguaacagguguuagccuucguguguuaagcuuuuuaucauuucaagaggagaguuaguaaaggauggacgugugggugcauaaacugggaauccgaaaggaaguugaucauugagugacuugucuucaucauaacagggcuguguaaccuuugaggacguggcaguuuacuucucccaggaagagugggagcuccuggaugaaucucagaggcuccuguaucuugaugugaugcuggagaauuuuacccuuauaaccucacuggguaagucccuuguacucacucucaugucuugguucccaucugucucuuucagccagauccagcucugcccuuuucagagccaagcuaaaggcccuauuggcuuuccuacuuucuuggcaggugugcaguuuuagaugguaagcccuccuguucuagcuaccaugccuccacucugccaucauggacucuuaucccucugguugagcugugugcacugcccuaagcauuccuaacacaugucaccccaucaaaaugucuagguggcagaaauucugcaguccagguaauaggucugucuuaguuugauaaaguacccugacaaaagcaaugugaaggacaaacaguuuauuuagacucaacaguuccagguuauagucuauuaagacagagaagucauagcagcaagaguuagagaaaacuggucacauuacauccacagucaaaagcagagaacaaugauuuaauacaugucauugcucagcuuacuuucucaucuguagucagcccaagacucuaagcccaaggaauggugccacccauugugggcaggucucaauauaauuaagacauucucccacaccuaugccaggaggcccaucucccaggucauucaaaauugugucagguugacaguuaacaauaagcacagcuucuagaaugaaauugccccuuccuuggccugaugacuauguucauauccauaauucccuuuucuccaaguucugcaccuuaucuagcuuugucugauagcugucucuuucaggaauuucauauguugugaugguugguguuuauauugacugugaacuguuuguauaagacccucuaucuaggcuucuuuaaaauacucauuguuuuguaccaguuacucaucugucuugucuuucuuuaaugcuuacauuauguauuucuuaugucaucgaacaacuagaagugugaggaaagcccugauuuauuucacaaaguggacaugcugccugcuucucccuaguaacagcugauacaggguaugccauuagggaugucagaucaaaccaagaaucugcagugugucuagcaguauuaugauguaagugugcugugugaaacauuuccugcuuacaguuugagaagugagcccuccugcuccagccaccaugucucugcucugucaucauggacuccuaucccucuggaacuguaauaaauccuuccuucucuaaguuuccuugguuuuauuacagaaauggaaaauaacuuauacacuaaccaaaaagaaagcaguugugagaucuagguuuuuauaaugucuuugucuucccaaguaggaacuggucuccaguaauuuaguuuauccagcaggaguucaaauagaucacacaaguuaauagacugcucccacuuaaguacugguuuuuaaguauucuuuggugucuaguaauauuucucuauucauuucugauuuuguuaauuuggguccucucuuucuuuugauuaguuggaucaagggcugugagucuauuuaguauugucuuuauuucuguuucaucaguuucuuucuuauaauuuuuugccaucuauuauaucuuaguuugcaguauucuugcuuuuccaaauucuugaguugccugcauuaagucauuuauucaugcucuuuuuaaauuuuuuuuuuuaaauguagacacuuagagcuauacacuuuuuucauaggacaguuuuuaaugugucccagaggauuuguuguauuguguuuuuauuuucauuuaguucugggauuucuuucuuucuuuuuuucuuuuuuuauuucuucuuugucuugcccaucauuuaauagugcauuuaaucucauugaauuugugcacuuaauggagauuuguuuacugucgguuuuagguuuuguuuauggccacauagaacauguggaguuauuucuuucuauuuuucagaaacugugaagacgaucucuuagacuguaggauauagucuauguuagagaagcuuucacggguugcugaguagaauauguauauucuuuuguguuuggaaaaauauucuauagauaucuauuaaguucauuugauguuugaugucacuuaaugcugauauuucucuguuuaauuuuuuauccauauaacuugucuauggaaaaagugggcuauugaaacugccuacuauuaguggcugggugcuuauuugugucuuuaauucuaauaauucacuuugcaugaaauggcauaaaccagaauuugcuacauauauguuuagcauaguaacgucuuccugguuaauuguuccauagauuagaaugaaggguccuucuuuaucacuuuugguuaguuuuaguuuggaaucugucagauauuucuauaccgacaccuacuugcuucuuggucccauucaauuggaguacaguuuuccaaccuuucucuugaagguaucuaucuuuaaaaacugaggugaguucauuguagacaacagaaagaugaguuguuuuugucguuguuguuguuuuugcucuguucagccagccugugucuuuugauuggagaauugaagccaucaauauuuaaaguuauugguagcugugcauugauugaagucauugcaucgcuauuugcugucugugucucuugacaaugguuauuccacuugccauucuaaaguauugcgucuugcauucuguuuaggggugaucugcuggauaugaauucuuugaaccuguuugucguauggaaaauuuuucuuuauacuucaaucauggaagauaguuuugcuagacacaauaaucuaaaucaugggcuuuuagaauuuggaguacauugcucugagcucuucuggcuuucacaauuuccacugagaaaucagcuguucugauggcuuuuccuuuauaugacuugguguguugucucauagcuuucacuagucuuucuuuguacuacauauuaaauguuuuaacuacuaaauguaaugggaagguucuuuucaggguguguccauuugauguucuguguguuuucuaucuacaugacugugucuuuccugaguuuaggaaaguuucucuaugguauuguugaaggucuuauuuaugccauugacugggaauuccucucuuucaucuaugucuaaaauucaaagacuggaucuucucauaguaucccagagauucugcacaucccuuccucaugcuuuuaauuuuuuuccauaaucuuuuuuuguuuguuuguuuguuuguuuuguuuuuguuuucaaaucaggguuuuucuguguagcccuugcuguccuggaacuuacucuguaguccaggcuggccucaaacucagaaauccaccuaccucugccucccaagugcugggauuaauggugugcgccaccacgcccggcaccauaaucuuuauuaguggucuaacuauucuacuucaagacuugauauucuagcuccuacuucauccauucucuuuauaagacuuuccauugagcugucuaguugaguuaucuuuaagacuuaauauucugucuucucuuugaucugcucucugcauaagguuuucaauagucuucuaguugguugcugggcuuuucaauccucauuuuuucuguccucauuucagcuugaguguucugucucuuugccgaauucagauuucaaaucugaagaugggguaucacuauguagcucuaacuguccuggaauucaguauauuaggucaggguggccuuaaacucuaagugaugugccaccacaccugauaugauuauccucuucaagucuguauccugggauuuaucuaguuaguucucauuaggaaacauugcugucagugguuuugcuucauacacacacacacacacacacacacacacacacacacacacauauaauuuuugugugggggugugugggugucccgggcauauggacuuauuucuuugcaaugugucugaugugagauucuauucugccuuagauugggccaguagaguaucugugugauuuucuuuacuaggccagggaaaacuagugcaugagcugcuuggaccuagaccaacaugaggagagccuuggucuggaucuaagccuguggagaugaaucuucuuuuaaggcauacauuuauauacaugcgugcgugcauguguguacgcgcauacucauaguauuuuuacuaccauuuuuuucguuuuaauauucuccuuuuccaaguaucucuguuaauaguucuguuuguuaaauuugagcuuuuaacuuccugaaacuuuggcuucuuuaauuuccauuuuuuugugugugcacaucagauaugcgugggagguagggaagggcuggagucuaccuuuuggguugaugcuugcuuggucaguuccucgugguaggaauagucuguucuuucuaagauguucuguuuacccauguuguucuuggacucuacaucuggcagaauagugagaacauuaguuuuauuuucugaauucuuuguuuugugauuaacuuaguaggcaugucaacuaggggccuauuacccacguuaucaccaucuauagaaguagagaaaguguuaugcagucaguggagaaugccaugccauuggggcucaguauccaaccuucaguauuccguguuauccucuacugccugccuguucagugucaaccucggucauuuuaaauuauacugagggacaccucacucuauuucuucuggagcuuucuucuccuaucagcuagccaauagcccugaggauuccugcagcuauaccaccccacccuacucuuacuauaugguccucaggacuaaacagguccagagacaugcaaguugccuucaguccuuaggcccaaagauauauuaagauacauaccacuuaccauacacuaugaccuauuguaguuuuaagucaaauggugcagaaacaagugccuaccaaagacagccaugcuggcauuaaaaggccagcuagggaacacuguugaucaguacuccaggcagcaacuacagcguaauacagggaacagccuuugcucuuccaucugaguggcccugcuuguuguugcacuuuccuuuauaugcaccaugggucuuaauuucuagagaugacugaauggcagcauggagaguugaaugccauugaaaauagggcuuauuucugaaauuugugagagaaggauauuuaugcaucauucaggguggcauggguaaacagcaggugcugaggaugaggguguaagaaagagaugagucagaggaaggaaacauguacaugaguacauccccuagaaccagaguuauagauggcugugggugcugggaaccaaacuugggucuucuggaagaggugugcucacucuuaaccacugagacaucucuccauucccaggauauggccuucucaucuagaauaugaccaggauagauaaggcagaggagucuauucuuggagacaugguuugcagugugggaucuggacuauucuaacagcaacuaaacagcauguucucaguuaaguuuuaugccaucuauuaagaguuagccucccuucccaugcuaugaaggaauaaaaagguuaggagggaggcagaagggggagaaagacaggaaggagcuagagaaaugacccucugguucagagcacuugcuacucuugcagagaaccaauuugauucccagcaccuacaucaggcagcccacaguucauaaaccagcuccaggagguuugacacccucucuagcaucugugcacaugugcaaauguacacagacucacuugugugcacaauauauagaaaugcaaacauaaggagcgggggaaguggugcagcaguuaagagcaguggcucuucuuccagaggaccugaauucaauucccagcacccauauggcaacucccaacuaucuguaacuccaguucuagggguuaugcccuugcacaggcacacauacagacagaacaccagugcacauaaaguaaaucuuuauuauuauuuuuaaaaauaaauacaaaaacaauuuuuaaagaaauaacagagggagcuaagauauagacaucggagaaauguguccacuuuacaucuagauggugccuguaaggaaggccuggcuauuugacccauaggcuuuauucucgucuucuauagaaacauuuaaaugauauuccuguuuuguuuguuuguuuguuuguguuuuuguuuucuccaaccauagaaaugaaacccauaguuggauacaagcaaaugacuggacacaagcuagaaaucugagacagaaaucugucagacaaguagauuugcucugagugauucaauugguuuaugccauuuuuuucccacucuccaguugauacaacuuguauuuuuucaaucaaagcagcuaaagucuuagacaaauauuuuucucuugcauccuacaaaucauaagaugauccaaaaguaaaacuaagcauauaauauuaaacaaacaaacaaacaaacaaacaaacaacuagccucuucucaugcugcucaaaaaggggaaccacguucaaacauccuugguaauuccagccaguugaugugcuucauaccaggcuuucuguccuuucagcucauuggucugaagcagaggcugaagacaaaaccugugcaccacagaucaggacugcaaaggaaggucuacccacgaagaagccccaucccucugacaucuguagcaccguccuuaaagauaucuugcaucuaagugaccuacccgggcagaaaccacauuugacugagguguguacagaccuccuggaccagaagcaucacagagccaagaauugguuaaagaaagauguggacucccuugugaagaacuguauauuccauguagcagggaacccuucugucuguaguaagauuggcgagaaauucccagcuguauggaaucuucuccaacccaaggccauucccaaaggugagaaacaaaaucaaauuaaguguagaaaggcuuuucacucagagaaaaauaacucuaagucagauaaauauaacaaaucuuccagcccccaacacaggcuucaugaauauccaagacuuugcaguggaaaggagggguuugagucuaacaguugugagcaagacuuaaacaaguacucgauugcaccaucccagacagaucagacugaaaaccgaccauaugggugucaugacuguggaaaaugguuuggccagaaagccacacuuagaauacaccagagacgccauaccggagaaaaaccguauagauguggugaauguggaaagucuuuuugucaaagcucuaaccuaagcgaacacuguagaguucauaguggagaaagaccuuuugagugucuggaaugugggaaagccuucgggugccauucuagucuucugcgacaucagagaacacacacaggagaauggccauaugaauguggugacugcgggaggcuguuuaggcagauugucagccugauuacacaccagaggacucacacuacagagaagccuuacgaauguggacagugugaaaagucuuuuagucacaaagccacgcuuacuguacaucagagaguucacacuggagagaagcccuaucacugugaagcaugugggaaauccuucagccaaagcgccaaccuuauuaaacacuccaaaauucacacuggagaaaagccuuauaaguguggggaauguggucuaugcuuucgccagagagcuacccucaugaaacaccagagaacccacaccucagaaaggccuuaugaauguagagaaugugguaaguucuuuaaacaguacuucuaccucauugaacacaguaggauucacaccacaacagaauuuuaugaguguggacagugcgggaaaucuuauacccaaaacgccacccucaucagacaccagcgaguccauacaggagagaguccuuauaaguguaaggaguguggaaaagccuuugaauacaaauccagacuuaaucgacaucaaagaacucacacuggugaaaggccuuaugagugugccaagugugggaaauucuucagggaaagcuacaaucuugcugaacaccagaaaauucacacgaaagcaaagccuuacaauugugaucagugugggaaguguuuuagccggagagcugacuugguuaaacaccagagaguucacacuggugaaaggccuuauacauguggugaaugugggaagaccuucagccgaacuaccaaccuuguucaacacagaagaauucacacuggggaacggccauacgagugugaccagugugggaagucuuuuagccaggugucuacccucacuaggcaucagcuacuucacacuggagaaaaaucuuauaaauguagcaaaugaaggaaagccuagacaacucucuagcaucuucuaacaccaaaagauagaccaucauaauuccuggaagccaacccuugaaagcacccucaggccucgaaagauguugcauuguuuuucacuguaacaaacuagagagccucauagaguucuaggccguguaacuuguacuagagagcuagucugcauguucuagacagucuguuuccauugccagaauuaaauagcugccauaaugucucauagaaacugucacuccucuagcaccuugcccugaguguauauccccccaacaugcccauauucuccccuucccuaauggaagcuucaacuuccugugccuugcaaaugaccuucauccccuuuucucacugaauauguaugggucuguauuuugucuaaacgaaccuggucugggauuagauggaggcuccaucaaggaauaucuucucaagucuuugucucacaugauucauguggcuguuuacaugauaggaacuagccagagacuuccugccauguuaauaugcaauaauaaaagaccuuauggauuuuuuuucccauguau

SEQ ID NO: 3547 - RNA, 18546 nt, Mus musculus
cggaaacaugaauccugagucucucggcgccugggcugcugcagcucacgcagcugccggggucugacagggguugcgagaggcagguccuguucagagcgagcuccgagcggcggcucgucucggggucugugggcgggacccgcugucaccccagccgacguccucgggccucgggugucacuaugagugacugcugugggugaggcacggguaggaccgcgaguaacugugaggcaggggaaugacgcuaagugacugucugaggcagggggaugacucugagugacugcugugggugaggcacggguaggaccgcgaguaacugugaggcaggggaaugacgcuaagugacugucugaggcagggggaugacuaugagugacugcugugggugaggcacggguaggaccacgaguaacugugaggcaggggaaugacgcuaagugacugucugaggcagggggaugacuguggguguguuucugaggcagggggaugacgcugagugaggcaggggguugacuguaaguuucugaggcagggcagggcaugguggugccuggacaucauuaaucccugcacuugggagucagaggcagggggauuucugaguucaaggccagccuggucuacagagugagcuccaggacagccagggcuacacagcgaaacccugucucaaaaaaccaaaaaaaguuucugaggcagggggaugacugugaguguguuucugaggcagggggauggcgcugagugagugugugaggcaggggcaugaugcugugugaggcaggggguugacuguaaguuucugaggcagggcagggcauggugguggucuuuaaucccagcacucgggagucagaggcagggggaugacugugaguguguuuuugaggcagggggaugacugugaguguguuucugaggcaggggcaugacgcuuagugagugugugaggcaggggcaugaugcugugugaggcagggggaugacugugagugaguuucugaggcagggggaugaccacgaaugaaugugugaggcagggggaugaucccuguggccuuugguccucacggcgagugauuugggggugggggaggggucccgcccuggggaaagcgagacagacgggacacgugaauccacacggaccgucuggacccccggccccucccgucugcagcgcggccgccaucgagccucccgguggugacgucauuugaaagaagacaauggaauccucacgacggccgcauucuccucggucaccaccggguggcggcagagagcacgccgggaaaaaccuccgauccggaaguccuccaaggggucggagucugaaaggggaaagcuacgaggaggggacagagacuggagagaaacggaaucacagacacacauuuuguuuaaauggucuaaacugccuguuugguggcauuuagaagcaccacgccugaguucugugccuagagaaacacagcucucuugaaaacaaaacaacaacaacaacaacaacaacaacaacaacaaaacugucccggaugaggaaggcauuuaagucauuucagccaagcugaacacggagacagggggaugacgcugagugagcaaguagaggcgaggcgcggccucgugcggguuuaggucagcgcgcaggggacagagugaaggacacacagcgccucguagccggaggccgaggcgggcagcgaaguggccgagggcagggcggcugcagcgggcggcggugccaaguaggcgggcagugauuuucugaggcagggggaugacacugagugaguuuaugaggcaaggggaugaccgcgagugacugucugaggcagggggaugacacugagugauuuccugaggcaggggguugaccgcgagugacugugugaggcagggggaugacugugagugauuuugucacagucaaagccccugccucgugacagcuuucccagugucguggcagcaccaucgccugccuguucucuucuucagacacuugccccgccccgccugccugccugucacccgccucgcgaugacgucacacgaccugccgcagacagccgcgcugaagagaggaggaugaucuaggacgcuguccggguggacggccacgccgcaagacgcggcccugcaggugaguaaggggugugcggugggugcccggaugcucuuccgggagccgccagcgggccagaggcugcggguggagcccgggucggggguccgcggcccccgcagcguccccugaaaccggaagcggggccggccuguggcugcugccgugccucccgcccacagcugccgcuccucccgcuguguccgccguggcgagcaucagacggggcguggccuggagacggggcguggccuggagacggggcguggccuggcgcagguccgggagugagccgagucucggcgcgcucacccgcagaagcugggccggggccggacagagagaccucagccucucgcuaggagggggaggggauucugugccgacgacgacacagagaugcuaaagccagagacccagagaaggagccgcucuggaaagaucaccgggaaccauguuccuucugccaucgugccggcggcauaaaggcgucuuuauuccuucuccucgcagaggccgcuucucagcagcgaaccucaucucacgcaaaccgaaaacuccggcaacuucucagcugccaucuaaaucgguuuggcgggaucgugccaggguccggcacuucaaugccgccccuccccccccccgcaaauguauuuuaaaauagauuuaaaaauaacggcauucaauaaaauaaaauguagucuucagagaucacggaccgcugugaaacgugugugugugugucugugcgugugugcgugugugugugugugugugugugugugugugugcgugugugugugugugugugugugcgugcguguguguguaugugucugugcgugugugcgugugugugugugugugcgugugugugugcgugugugugugugugugcgugugugucugugcgugugugugugcgugugugcgugugugcgugugugugugugugugugugugugugugugcgugugugcgugugugugugugugugugugugugugcgugugugcgugugcgugugugcgugugugcgugugugugugugugcgugugugugugugugugcgugcguguguguguaugugugugugcgugugugugugugugugugcgugugugugugugcgugugugugugugugugugugugcgugugugucugugcgugugugugugugcgugugugcgugugugugugugugugugugcgugugugugugcgugugugugugugcgugugugucugugcgugugugugcaugugugugugcgugugugugugugcgugugugugugugcgugugugugugugugugcgugugugugugugugcaugugugcgugugugugugcgugugugugugugugugcgugugugugugugcgugcgugcgugugugugugugugcgugugugugugcgugugugugugugugugugcgcguguguguggggggggaguuaaugcgugaugacagaauggguucaaggacaguuugggcuacgccagacucugucucaaaacaaacacagagaaggaauuaguggucgagcccuggccuaacaugugaaagguucaucuaauacacaccaacacacacacacacaguggcacggagagguggggagagagaaagagcaggagggagggagauauaaaguagagaguuccugaaucaugccgccauaucuauguuguggucccgcuuaguuucucgguggagccggggacggaacccgaguccucacgcgcgcucugcagacacucggucccgagccacacacgagccccgucugcguuuuuaacggguggacuucucuuccaggagugacuagcacggucagggcgggagccacgagcgccucugggaaccucauggacuuccucgaggagcccuucccugacguggggaccuacgaggacuuccacaccauagacuggcugagggaaaagucccgggauaccgacagacauaggaaggugggcgauccugugcugaagagguccuugcccaucguuccacaaagcuuccaucucuugguugggaugugagccugaggccgugugucgcaugucgguuccacagagagaaagaacuagugagaaagcagagaaaaagacugagagugacaauggcagauaccugggguagaaauacgaccagugccagccacaaggggacccuggagccagaaacauucagacuccaucuugacccagauaccuugaugggacuggagucuggagcugucauuuuuugggccucauuuucuuauccuugaggauggaggugaugacauugaagaucggggucggggagcaacucgcuaugucgucaugcauccacuuggcauucaguacacuggaaugguacaaaaugcaguuauauaguaaaggcugugggcucauugaaaaggaauaaguacagaaugcuuuuucagaaagggugugacuaaggguuugggcgucagaucauggugcugcaucgcugcaugaaaaaugugacugggaaucugguggcuucauugcauccgucuccucagucucgucguuuccugagggaucugucucagaggacgaggcgugacccggacgaugcguucugaucaaucgcucuguguccuuccuugucagaucaccagcaaaaguaaggagucuauuugggaguucaucaagagccugcuggacgcguggucgggauggguggugaugcuacucauugggcugcuggcagguauguguguggugcuccgugcacccccaaacuccauacucgugggaaaccacgcagcuguggaagagucuagggagaccuagaaacuaguacgauuuucucacggcuccgauggugggacgggcgcagauacccgacugccuggaugggggcucccuugguuucauuuggguuccucuccuagaguaaucacacacguccucugaauaacuaauuuaccagagauuaccacaagggcgcacuguugcaccacagaccaaagcagagauggcucacaacacaaagggcguaggcgaaggagauggauuggacgaagacuaaugugaccgaacacuugaaaaaugauggguuuuggggacggucaucagaucuuguuuaaaugucacuuuucacuugaaauuugaucacuucucuaaaagauacaucuuccucuccuugaaccuguuccucaaccaguucugcgagcaugugugugugugugugugugcguguguguguaaaacagcuuugcugaauuauauuacacauauugagugauuaacccauugauaguguacagcuaaguggguuuuagcauguuuacagaguuguguacuuaucaucguggccaauauuagaaugauucuaucauucucaccuuaauauuaucuguacguuuagcuacagaagaaccuaaacuacugucggguucaguagcaacgucaugucauggguguguccucgguuuugagaagacccugucaccucucccugugacaguucucuguaaauucaucuguuucucagguaccuuggcuggagucaucgaucucgcuguggauuggaugacggaccucaaggagggggucugucuguccgcauucugguacagccaugaacagugcuguuggaccuccaacgagaccacuuuugaggacagggacaaguguccccuguggcagaaguggucagagcuucuucugagccagucagagguaugucgucaucuguuuuugcaggccugggaggaaccuaucacagcuucgcuuucuccgauggagauggugggccuggggacgcuguugaaguuugcuauggcucgucacuucuuccuuguuuugugucugaucucuagggcgccagcgcuuacauucugaauuacuuaauguacauucuaugggcguugcuguuugcauuucuggcugucucccugguacguguguucgcaccguaugccuguggcucuggcauacccgagguaagccgugggugaaguacugugcgccuacucuuauccccaccauaagccugguagacaaacccuguagguucgcuucagucguuaagggaacuagaauauaaacaaguuaaguuacuucacuaaggacucaaaguuggcaagcugugaguugaaucuagcaguaauuccaauguacaccccaaauugcaaaaaaaaaaaaaauuaugugucuaauuaaaaugaaaaaagggauuaauguuagguggacaagaaaacaagcagaaaaugucuuaguuguuauaauuguuuuauuuuguuaaugacuggcauucaucucuuacuggguuuaauuuauaaauuaaacuuuaauguauauauagguugacauauucuggguuucacguguccacuggaggucugugucuccucggauagauaagagggccacugcaauaagauacaaacuucugcugguacaaaauucuagucgaaucaggaagugaaauagccuuccaucccugugacuuagggagucuuguucauagccauggcaguuucuuguccaacccuggaccauuccuccucacucuccaucuucauuccucuucgcucuccgucuuccguugcagauaaagacuauuuugaguggcuuuaucaucaggggauacuuggggaaauggacucuucuaaucaagacugucacccucgugcucgucguauccucuggccugagccuuggcaaagagggcccacuggugcauguggcauguugcuguggcaacuucuucagcagccuuuucuccaaguauagcaagaaugaaggcaagaggcgugaggugagccaguucccuaccaccuccacugacaggggacaucauuucucggagucucuaccucaucccauccacaauaaaguccauagggcucacauuuuuaaaauuagguauuuucuucauuuacauuuccaaugcuaucccaaaagucccccauacccucccccccacuccccuacccacucacucccacuucuuggcccugguguuccccuguacuggggcauauaaaguuugcguguccaaugggccucucuuuccacugauggccgacuaggccaucuuuugauacauaugcagcuagagucaagagcuccgggguacugguuaguucauauuguuguuccaccuauaggauugcagaccccuuuagcuccuuggguacuuucucuagcuccuccauugggggccaugugauccauccaauagcugacugugagcauccacuucuguguuugcuaggccccggcauagucucacaagggacagcuauauguggguccuuucagcaaaaucuugcuaguguaugcaauggugucaguguuuggaggcugauuaugggauggauccccggguauggcagucucuagaugguccauccuuuugucucagcuccaaacuuuguaacuccuuccauggguguuuuguucccaauucuaagaaggggcaaagugucccacauuuuggucuucguuuuucuugaguuucauguguuuugcagauugcaucuuguaucuuggguauucuaaguuucugggcuaauauccacuuaucucacuuuuaaugucuccauuugcaggugcuuucagcugcagcugcugcuggugucucuguggccuuuggugcuccgauaggaggugugcucuucagucuagaggaggugagagggaccaaaaugggcuuucaggguuuggaguagcgagaaauacguggauggcugacagcauagaaguauugaauacgcuucuuggagucaauuagggaaaaggguuucugcuguuaaaugugcucucauguacuauuuucgaaauugccaauauaaaguuuuuggagaucuuucuagugugggaucacaaaccauuuagcuuccaacuuaguuuugaaaauuaagggaucauuucagggguugggcuuuuuuuuucucugaaaagaucaggauagauaacuauguagguuucauuagccauacauuuugccauagccuuuugacuagacuugcagcaaucuccauguguagacauggcuauauggcugaaaacuuucuuuaugggcuuugaaauuucaccuuuauuuaguucuuaugugucacgaaaaugcuacuuuuugaaugaauauuucagguuauaaguaguuaaauuuguuaaucuaaacauucaugaacauaaaaauucugcugccauacagauauauuuucugggucagacuugacuuguaagcuggaauucucuagcccucagucuauucuguuguucauacaauaagaauuauugaguuugggaggacuucugagacauggacaguauugugaguacauauacuaauuuuuucauuuaugcucagguccuggaccauacuaaacauauaccucugagcuauauccaagccuuucauuucucuucaaaacauagcacaaccuauuuugguuaaagcuguccaacuuuuguuauacuaagucuuuuagugcuaggaugugaacccaggaucuuaugacuauuagauaaacacuguaccaccaaguuguacucucaguuuacaaguucauauuuagacuuuauuuuucacgggugacuuuuuggugacaacgaaaccuaaacugauaacacgaguggaauauacucuuggucuuagacuguguuuuuuauuucaagugccagcagguagcugcuaagccaagccaagggaaaggcucuaagcaguccuuuuuucuguucauucugugauuuucuaucuaucugucccaggucaguuacuacuuucccuugaaaaccuuguggaggucauucuuugcagcccugguggcugccuucacacugcgcuccaucaaccccuuuggaaauagccgccugguucucuuuuauguggaguaucauacacccugguacauggcugaacucuucccuuucauccugcuuggagucuuuggggguuuauggggaacccucuucacacgcugcaacauugcuuggugcaggaggcguaagaccaccaggcugggcagguacccaguguuggagguuauugcggugacagccgucaccgccaucguggccuaccccaaucccuacacucgccagagcaccagugagcucaucucugagcucuucaacgauuguggggcucucgagucuucucagcucugugacuacaucaacgaccccaacaugacucggccuguggaugacauuccggaccggccggcugggguuggaguuuacacagccauguggcagcuggccuuggcacugaucuucaaaauagucauuacuauauuuaccuuuggcaugaagguaagucaagcagaaagaaggggaagagggcaugacuuuuuuuuggggggagugggagacagcuaauuauccucccaauaaaauuaugauuugaagacgagaaacguuaaccuuucuugaaagcucaccacuaccaacaccuauuagaccacacagucugcuuucuugcugcccuugagaucgcuggaaaauauucugaaagcuucuuggaaaacuuugaguugagucaggaaggggauauuuuucuccucucccccugauagguguguccagccaucacccuuuggagagagcaguaagucuuugaaaagcuuuuggaggauccagggcagcuauccugacaugcaguccacucaguuuauuuuaccugggagcagaugaagccccacccccacccccaauccguucucaugcuguggcuuugacauuuaauuuucaaagccggcgugaaugacgcagcuaggggagugagaaagugcugggaggcucagguggcagaugcuggccuggaaugucaucugcagugaaguuuauucuuucaugcgcagcaggccaaggggcuggccuuggaaggagaggaaaugaaagggucaaacuguguucuuuaugagucgcgguggacuccacuaccuaagcgacugugugggucaaaucauucgucucaccuuuccccagcuuccuuguuuugaagagcugugucuccugugagaaccuaagccaaauaaaugcaaauguugugggggugggaggcucucacucuuccuuggccugggugauccgggccuccuuuucucaggcugccccuuuucugugugcuccuucgagauucccucaggucucuucauccccaguauggcugucggagccauggcaggccggauggugggaaucgguguggagcagcuggccuaccaucaccaugacuggaucaucuucaggaacuggugcaggccuggagcggacugugucacaccagggcuuuaugcgauggugggagcugcagccugucuagguacagccauagguggggaaggaggagggcagggugcugaucuaccuuagaggucagacaagaagaaagagaggaauuugggcauuggcuuugcuugggauaaggauaggcuauacucugguaauaaguaaaucccuacaucuugguaguucaugccuuguucaacacauacgcgagcgcucgcacacgcacacccacacacacacacacacacacacacacacacacuuucacauguuuuagaaggcucuccucuguccagccauucaaaagcccaggcugaucuuacagauguaccaucuagaacacuguuuuucaaacugaggaucacaaccacaaggguugccuuagaccaugggaacacacacacagauauuuacaucacaauuuaugacagugucaaaauuacaguuaugaaguagcaaucaaauaacuuugugguuggggaucaccagaacacgaggaacugcauuagagggucacagcuuuaggaaguucuagaagcacugaucuagaauauggcuuuguaacaagugguauuggagauacuuuuccuuaucauaaauacaagugccacuuguguagcguguguagagggcacagaggcuccuuagcucaugacauaggacuuccuugaugauagauaucuuguaucuugaguacuaagguuaagaaacccugauugauuagaguaacauuuuguuggaauugcccuugaaugccuagggaaagcugggucccuguucagucugacauucuuucaaauuucuacaacucuuuggcuucugaguugcuugugccgucagaagucuggauagucugguagaauucacucauccaaaagccaggcaacgggucugggugaauauauaacccguguuccucguuggaguagaacuccguuaggcaaugcacaggucccugaugcaaagcuggguugaacagagucugagcccagucguuacaugggacugccucuuuggaacaaguaugagaaguaccgaaaguucucguuagagauucugcuggggaugaaauuaugaucugucuguuuguuuccgcagaucacacguucauggggacuagggcugggcuuuuaaaucucauuguccuuuucuguucuagguggggugacuaggaugacagugucucuaguggucauuauguuugaacugacuggaggucuggaguauauuguaccccugauggcagcugcugucaccagcaaguggguggcugaugccuuugggaaagaagggauuuaugaagcccacauccaucugaauggguacccauuucuugaugugaaggaugaguucacccaccguacgcuggccacugaugugaugcggccccggaggggagaaccgccauuaucgguacuaacccaggacagcaugacuguggaggacguggagacucucaucaaggagacagacuacaacggcuuuccugugcucgucuccagagacucggagcgucucaucggguuugcccagaggcgggagcuaaucuuggcuauaagugaguaugaacaaggaggcuuucacauuuuccucagagacagaugguaguuuuguuuuauuuuuuguuuuuuuccauagaaucaacacaugaguuccagggaguuccuugaguugaggacuuccuugauaggcccccaacaugucuaagucuaagugcucaguccuuagccuguguacauaugggcaacaaaauggauucaguagguuguaugugcuuaguauguauaugcauauguauaauaacuauagacgagagcuuaguauguauaugcauauguauaauaacuguagacgagagcuuaguauguauaugcauauguauaauaacuguagacgagagcuuaguauguauaugcauauguauaauaacuguagacgagagcuuaguauguauaugcauauguauaauaacuguagacgagagcuuaguauguauaugcauauguauaauaacuguagaagagaauaugagauuuaggugauaugagaggaaacauaggaaagguuggaacgggagaaggaggcguggaaaugauacaaauacacuguacccauauauuuaauucucaaaaacaaaauuuaugacgaaaaaguaaaaaccagagauuuccaagcacugauuucagcagauuugucaucuaggaucaggcuaagauacaaauucugauuuaacuggcucacuggguuuugagacucuauauucuuucugagcuucccagucacaccauguuucugaucacaauugcaaagaguuaagauuucaacucaagaguuacccugagguagauuagauaguucuggcagugaacuuucuggucacagcagggccucucagagcaugugagggggaugccagauccauagauguuuggcuaaagugcuuguuaugacugugccuuuugcccuccaaacuccuuuuugagauucugagaugcugcaugugggcaaguggggguagcgaaauacaaagcuuugguaugcggcuuuaucauuuuuucucacucuucuagaaaaugccaggcagaggcaagagggcauugugagcaauuccaucauguacuucacagaggagccuccugagcugccugccaacagcccacauccacugaagcugaggcgcauuuugaaccugagcccuuucacggucacagaucacacccccauggagacggugguggacauuuuccggaaacuggggcuccgacaaugccuggugacacggagugggugaguauccagacaagggaagauugaguacauagugcggccagcuuuaaugcgucugcccuuaaggaagucaugauccauuggguuggacuaguccuggacagaugcuaccacuaaacucaguuggauguauugagaaagaaaucuacaagaggcucgagaacuuugagcagagguagggaccaguagccugggaagagggagaggcuucuaggcuaaacuacagccuggcuucagucugaagguuaaggcaaagggagcaguuaaagaacaacuccuuucuucugccgugugacacuuggcuuagggagaagguguaguuaguucugcuauuccaugccauaaaugucacucaaaaucauaguaguaugccaaaaggagcagcuaaaggaaguuauggggaaaauagacuugggugcacaauacucaaaaccuucaucgaugacacaccauuuuuaaaggaugggaaccuaaaacacacaaaaguguguauauuuuacacuggcugaaucuuugagaaauauacagauauggcaauaaauaguuuauuuucccucagaaaaacucacauuggcuguaaggugaacaucugaagagcuguugcucuaaagugacugucaaggaguaaagggagaaaaugggacuucaucacagcaagcuggaggaguguggcuccugacucuuacaugaggacagcauguugguggaugaccagugugugugugugugugucuaugugugugugugugugugugcauguguugaguuuagcugagaacaacuuuucuuugcucaccuacuuuaucauggauauuauuacccaaaaguaaaugccacaucucuguuauucucagacaguugccucauacaacaguguauauuaaaaaaaacaccuuuuuacacaaacagaaacaguauacugaggaauuugauagucuaacggcauuaucucugaaacuuuugcuuugcguugucacaggccaggaaaucaacaacacgaauaucaaguugcuaugauaaugccuggguugcuggccauucuucagguucaaggagauggcccacguuccguauccucaaaacauuggauagagagaggugcuagaagccauagacaucuauccacugugcucccuaugucagaggcugauguaagcgauguugauauccaacccaguucaggccucuguagaauucaagcugaccugucuuaacagcaucugcuauucuagagucaacacacgacagugucuauuaguccucaacaaggguguuuucauucuguuggaucuggggacaguuuuagaugccacaagccaaggaaguggcgguauaguugcauaguagauaggggaugacgguguugcuaaaaguccuacacuguacaacacauuuccugcaacaaacccacaaauuuggcuuaaaagugucacacuagugucauaguagaaggauccuggguugacuauaguuucuaagugaggaaucuuacucauuuggcuucauaggacuacagauucuacaagcuuucaguguacacauugaccugcacaacuccuaacuggugggacagguuucuccuucauucuaacugaggcuauagaucacaacugcccaugaaauguagagguagucuuuacuuucucacacuugaaaauacauuagaaugcccucacuagaggauaaacccccaggugaaacccauuuucuguuuuccacuccagacugggcucugaggucuuggguaaggucugagaaagugaguuuuuaacaagcuccugggggucgcacucugagaaaaauucacuuugcuaagagaacacgaaaugcuagaguguuauuaaaugucuaauaaaagagugaaagguuaaguuggugugaaugcucauagggguacaguaucaucaaaggagcccuauuuacauccuagucucuguaaacaaugcucccuugguuuguacaguucggauaacccuauaagaacaacucugggaacugugucccugaugcaguagguaaagugcuugcugugcaauugugaguugguaucuccaacacugucagaaaagcugugugugguauugcauaucugcaacaccugcacuaggagguacauggaucagaaaauaagaguguugcuugaagcucauuggcucuaguccagucuagcugaaucaaugaguucuaggcucaaugaaaggguguguaaaaauaaaaaagguaguuaacaaugcacgcagacucauaaguugaccucugaccuugacauauaagugcacaaacaaguacauauaccacacauauacauuuacacacacacacacacacacacacagagagagagagagagagagagagaggacauacagacacagacccuaagaaacugacgcucugacacucuguauaaguugaaaaugauagaaauuuggaagaggggaugguauguauauuuggucagaaguuuauguuuuauuuuacauauccaguaacauaaaauuaagaguagaguauuuuggguuuguugaugcagucuuacuuuguaucucagacuugccuggugcugcuuauguaagucgggcuaacccagacauaugaugcuccucuugcauuugcucacuuugugcuaguauuaaugggaauauacuauaaugucugacuucauuucuuauacuaagaaaauaccuuauauuuggacuuucuacaguguggucaaguugugacaguagcuuuaaccacccuuuauaaauugauuacaaucuuaaaauugaaaccauuguaucagucacuguaguuucauagauugccuauguaacaaacaagcuugcaaucucaguggccuaaugcaaugaaaucuuuuugaugcuagggauaaugauacacacacacacacacacacacacuccuagcacuugggauauugaggcaggaagaccaaaaguuugagucuaaccugaacuacaaguuccaaauauagguuguauagggaaacucugucucaaaacauacaagcaaggaaagagagagagaaagagagagagagagagagagagagagagagagagagagagagagaucuuauguaaguacaggcucuucacgagucauugaaggaccuaugucuuuggaucuagugggauauaaaucagucuucuauacaucaaagaccuucccugcuucucccaucucaagauaccaggugaagagaggggaacagaagagaauugcacagaagaccugagagagcuaccuauuacaugggcaauuggcuggagcuuacucuauauuguuuaacuauucaggaagcuaggaaacauugccuguaccuucgguuaggcuaacuucuuuuuucuguuuuguuuuuacuccaggagacuucuugggaucaucacaaaaaaggauguucugagacacauggcccagauggcaaaccaggacccugaauccaucauguuuaauuagcaauaagaugggcauuauuuugagaagaucaauaauuauaucauuuuuaaagaaauaaccaagugauacauuaugauccuaaugaaaaaacuugcacugaaggcagaaaaagaaaagaaaagaaaaaaagaaaaaaaaagaaagccuuauuugaauuugaaacgagggggaaaagggugaaacuuuuuuaaaaggcaaaaaccauaaacuaguagucauuuuauagcuuuaaccucuuaugaguucaaagcuguguuucuuaauaaauuuauuaacugcuuuugggguaugugggaggguguaaaugacaugaauuauacaaagacauggaacacaggaaacauuggcacauuuacucaagguugauauucguaauuuuggaguacacaugaagcuuugaguccaaaagacaaagggguauucgcaugcuacuguuagauauugguuccuaaaauuuugcuaugauguuacggaaucauauugaagauauugcauucagagaaaagaaaauuaaaguuggaugcagugaaagcuacaagcaggcccuaauagguggucuacucauggccaucucauuucuugccuuuguucucaagccuguuguuauguuucuuuaucagucugcaccagauucaguagugcccaccauaaugagcaugaagugaaagacuucucgacagaagacuucaagacuggacuaaauguuuggacuaugaaccauguaguucuauguggacauuucucuuauaaaaggggacacauuuuuacuuugaggggacacuugcgucaucacugauuugcaagcccaaagcaucaauuucacuuauuuauaugguuacuugugcauuugacguauugauuaguccagcacuucccauggauuauugcccgugugcuccuagauugcuguagugugguuuuguuucuaaguagcaugugcaauacuuaaaaccagcuauccaguguuucuacuuaacuuucuucucaggucuuccagauagagccaugaugagagugaggcauaugaguucucagugggaacuccuccaaauggauuacaagagaaauaguaaauugauucuaaaucuguuccauucucuucccuguaggauauaaaauguccaguuuuaacgccuaagcauggacuuucaaacuagcaaucacagcgcgggacagagucacauuuuauacagccaauugaagcacugggucucuuuguguuugaacuuaauggcaauuuuauucuuuaaauucugcacaucugucuuuucuucaggaaggaauuaguguuucaggcccaucgcaugaucuguguaagauuugugucacuugccauuucacuucaucuuugccccucacuuuucacugagucauccuccuccuuuucaaucuuacugucauuggguaucguugaaucacguaugugcacuugacuguauguaauagauccugacagugcaccuaagaaaccugggacauggccaguccaggacugucucuacacuauugccaggguuccaaauucuucugguauuucauuuucccucuucuuauucucuguccucuggcuuacugccucauaguuguaaaauuguugcccagaugccaggugcgaugucuacuuucugugagggaaggagggggagaggcgaguacgaagaugaauguguauaucuuucccagagaugcgcagcauacaaccauuggcuggaaaucuguuauaugccccauucgccuagaugucuguaaauacaggaaggaaaauuguuuuagcuauacauuauaacacauuacuuucuggauggaauuucgauucuguggauagggaagugggauugguaucugucauauuaaauuccaacaucaugucccugcca

SEQ ID NO: 3548 - RNA, 1374 nt, Mus musculus
ugugaaagguucaucuaauacacaccaacacacacacacacaguggcacggagagguggggagagagaaagagcaggagggagggagauauaaaguagagaguuccugaaucaugccgccauaucuauguuguggucccgcuuaguuucucgguggagccggggacggaacccgaguccucacgcgcgcucugcagacacucggucccgagccacacacgagccccgucugcguuuuuaacggguggacuucucuuccaggagugacuagcacggucagggcgggagccacgagcgccucugggaaccucauggacuuccucgaggagcccuucccugacguggggaccuacgaggacuuccacaccauagacuggcugagggaaaagucccgggauaccgacagacauaggaaggugggcgauccugugcugaagagguccuugcccaucguuccacaaagcuuccaucucuugguugggaugugagccugaggccgugugucgcaugucgguuccacagagagaaagaacuagugagaaagcagagaaaaagacugagagugacaauggcagauaccugggguagaaauacgaccagugccagccacaaggggacccuggagccagaaacauucagacuccaucuugacccagauaccuugaugggacuggagucuggagcugucauuuuuugggccucauuuucuuauccuugaggauggaggugaugacauugaagaucggggucggggagcaacucgcuaugucgucaugcauccacuuggcauucaguacacuggaaugguacaaaaugcaguuauauaguaaaggcugugggcucauugaaaaggaauaaguacagaaugcuuuuucagaaagggugugacuaaggguuugggcgucagaucauggugcugcaucgcugcaugaaaaaugugacugggaaucugguggcuucauugcauccgucuccucagucucgucguuuccugagggaucugucucagaggacgaggcgugacccggacgaugcguucugaucaaucgcucuguguccuuccuugucagaucaccagcaaaaguaaggagucuauuugggaguucaucaagagccugcuggacgcguggucgggauggguggugaugcuacucauugggcugcuggcagguauguguguggugcuccgugcacccccaaacuccauacucgugggaaaccacgcagcuguggaagagucuagggagaccuagaaacuaguacgauuuucucacggcuccgauggugggacgggcgcagauacccgacugccuggaugggggcucccuugguuucauuuggguuccucuccuagaguaaucacacacguccucug

SEQ ID NO: 3549 - RNA, 8173 nt, Mus musculus
cgggauuuccggcugcgcucuguggcgcucauuuuagcgguuuuugggucccuccuuccagaucgugugcaagaccccuuuguccagagguguacggaucgaagaaucucaaaggagcgguucuaagggcguaauauucaucgcagccccggcacugacaguggcaguauuguccaggucccucguccccguuuccccguugucugcgcucgcuuacuuggauggcugugcccacgcucaugcaccaggcuuagguaaguggugcgacauuuguggcucccuuguccucgccacuuaucuugcagagucggaauuagggaguccccuuaagucgcuacuccccagaucccuguauuaguaggaguacgugauucggcuuuucuauuugcaaagcuacaaugaggaggcggagugguacagccagggccauaguguguguaauuucuuggagcgacgcugaaguguggacuauuuaggcccguaauaaugagaugaaguguuguaccauuuuccccaugacaggaauucguguuauggaaaaacuacacagacuugaguguggguuuuaggguuuccaaaaagcugcugcucgugaugagaguauguauguauauauguauguauauucucaucucagcuaguucuuggaccacccuaggguuuuccaaccugggaguuguguggagauauauuauaggccaguugagucauuguucaaggguccauaaguaagcacaagcacugaggauuuaggaucagauguaacgagggcaucccuaugucacuuugcuccggguugggagaggguauaggaaaaccuaaagcuuugggucccugccaucauucauaacaucucucaucucacagguguccaugacugcagaaauggauauggcccucaugcaggugaggagaauauguccuaggcugucacugagauauuugucuugagucaaaggggccuuaacaaauugaagauuggaguaguuccuuuugguaacaaacaauagaaugugaucuguaagguugacgcaggcauugauuggcauguguaaauguuuggagaugaggcucaugugguucauagaaccccaaguguuuucuucugagggaagugaaagcagcagggcaggauucagaucuggaaugaaucucagcguucugcuuuagagugaugagaguaauucaacauuuagggaaaggaaagggaagaggagggaggugaucuaaucuuagucacauaagccuccauguuucuguggcauggagaacccaguuauugugaggaagucaauaagaccaugggggaagcugccauaauaguuugggaaaguguuagcagugauuacaccagggugaagauggaggaaguggcaggagucuagauuaguuuugaaauuggagcugcuuagagucucagauuuuaaagaagggaagauacuauuuauacaggcuguaggacagugguucucaaccuuccuaaugcugccauccuuuaguuccucauguuggggugacccucaaucauaaaauuauuuucauugcuaccucauaacuauacuuuugcuaccuuuaugaacuggaacauaaauaccuguguuuuccuuugguccuaggcauccccgugaaagggucuuuaaccccaaaugagucacagcccacagguugagaaccacugcuuuaggacuuuaaaaucuagaaggauggauacuccaucaaauguaauauaaaguugguaaucagguucguuuccauuuagaauauuuuuuaauuguuuuuggcuacuucuaaggucuuucacaaucaaugaaggaagauaucaugugguagguggcuuuauaggccuugaauuugagaggaaguuuaagauagauauaucuaaaaaaagugcuggucaguguuuagcaaaaaaaauguaagugugcauugauuguaaguagggguaguucuguuucucguaacaguaauauauuagcuacucaggaacgguggaacaaugauugaguuuuggacaucuggguagaagugauagccauuagaaacacaguuaugcgagaagaagccauugauggacaugagcaagaggaugaucaaaguucuaaggcuuauggcaauaagguagacacagaggcagcaauacuaaguagaaggugucugguggcuagaacuaaauauuuuuguuucuucaaauuuaacuuguugaauccuaaucucuguggccuuuaagaaauaauuaauuuaggugggauuagugagugcccuugaaacaaggugccccaaaacuaguuaaugcuccuuccaccauaugagcauaucaaaggaaaucagugcuuuaucacuguugaggggauguugaaaaucagccgaaguagaagacaaggguguggcagacugcaggugauucuggguagcuaagauugaagcaaagaacaauuggucuuuggagcaggauccuggacugcuuguaacaguugguaccauuggagguuuagagaauuacuugauccucuuuuauauuugccuacugcucucugaauguuguaugcuaaaucuguagggaagauagugauacagcuaagauauggagaagggguuuaaagguaggucugaggguaagacugagaauguagucuaaggagggaucaugaucuuuaagaguucgacccuuaacauugaggauaaaggggugaagggugaacucaucuaauuguaucuaagagggaccaucaggaagaccccugagaaauugucugccaagaacagaugcagccuuauauaccaguuuagguaguauuaguuuauuugcugguggugcuaugacaacaauacuggaacaauuggaauauaauuguuaccagagguagugggacuggauauugcuugagguaggaauauggggaagagggagaagaugagauggaugaguaaauugguauucuuggcaacauggggagaaguugacuauggaauaaacugucccuauuaugcagggcugugugaccuuucaagauguggccauuugcuucucccaugaagaauggagacuucuugaugagacucagaggcuccuguaccucaguguuaugcugcagaacuuugcacucauaaacucccaggguaaggcucucacaugguccuaguauccugaaacccccuguccucuuuuucccuaggcugacuuaucuuuccauacuagacuuugagaccuauuaauaucugcauauucucgguauauauguuaugugugauagcgcugaacugugucuacuaccucaaguaaaucucucucuguguaaccuaauacuuucuucccgcuuuauggaaguuggguaucuuguggucauccuaauuaaugggugucaucuugcuugucuugccacuagcucugucuacaaucaugacacuuggcaugacaagugcuuagcagugaccagcuugcuuuuuuaugacugcauauggcauggcugcaguuuuggaaucauguauuuuuuucuugcuagacauugauuuuggauauuuuaaaacuaguguuuucuuuccugggaucuauagcaaucuuuugugagauacccuuguuaaccacuucuuaugucuuuucuuucuugugaaccuuugucaugaugucacauguagugacagcauuucauuaggucacauguaaugauaucaagcucgggaucugguucuucugaaaagcagccauagcuuuauaggaggccuggaugugauaagugccaucuagaggaaggcaaaacauccaggcuaccuuccaaaacauccuguguccaccaauuuaggugcaaguacuaccagccaagccucauuuucauauuaucuucaccagacaugguaguguucugccuucuaacuuuaucuaugaucucugucaccuggguauccccuucuccaugcggcucauauucuucugugcuauacuguuccucugugguuccuuugugguuccuagaacuaccucagacacaauucugagcacaugcuauacauuuuugauuggaguucugaggcuugcauguaaccuauuuucuguaaagcuuacauuuagcaacagcaaaugacauccugcuucacucugucauaaauuuuauggauuuggaagcuaaccaugaugaauguaugaauauuguguucuaguaucauauggccauugguaaaagaguuauagauuaugcccuugugguucauuugguggccuuuauucugugaggccuucccaguucuguucucuuuagagacccgauguuuccaugcagauccuuccuacccauccauuugucuuugggggaaacauucuguggaguguucguaugcuugggcuuccuccucugaacauagucaacauugcauuucaucaguaauucucuuucagguugugggcauaaaacagaagaugaagagcgaaggguuucuacacgagcgucaaaggguuugagauccgagaccacaccgaaaacuaaccucugugaaaagugugucccgauucugcaagacauuuugugccugccuggucuaccugggcagaaacauaguacagaggcaaguucaaaaguugaucagcaccaagaccauaauaguacaggaaaacccuuggagaagaaugcugacaggucuucauaccuguucuaccugucagcaaaguccuuccccaguugggauguugaaaaagaccucccagauauacugagccuucugaagucucaggucugucccaaaacuaagaaguacagaaaaagcacugaggguaggaaagaaacaagucaugaaagugacaagucagaagagugucagagccuuuccagucaaaagcaaacacuugcucaccacccaaaaaccuccaauggaaagaaacuuuaugagugcagcaaauguggaaagaccuuccguggcaaauacucccuugaucaacaucagagaguccacaccggagagaggccuugggaguguagagauugugggaaauucuuuagccagaccucccaccugaaugaucaccguagaauacacacuggagagaggccuuaugagugcagugaaugugggaaauuauuuagacagaacuccagucuuguugaucaccagaaaacucauacuggagcaagaccauaugaguguagccagugugggaaguccuuuagucaaaaagcuacacuuguuaaacacaagagaguucacacuggagaaaggccuuacaaguguagugagugugggaauuccuuuagucaaagugccauucuuaaccaacaccggagaauucacacuggaguaaagccuuaugaauguagagaaugugggaaaucuuuuagccaaaaagcuacccuuauuaaacaccagcgaguucacacuggagaaaggccuuacaaguguagugagugugggaaaucuuucagucaaagcuccauccuuauucaacaccggagaauucauacaggagcaaggcccuaugaguguagccaguguggaaaguccuuuagccaaaaguccggucucauucagcaucagguaguucacacuggagaaaggccauaugaaugugacacaugugggaauucuuuuagucagugcucuagccucauucaucaccaaaaaugucauaacgcuuaagaaaccucaugaaagcagcaaauguggauaagccuucagcugaaggccuaacaucauuuagcuccuccaaauccguacuugagaaaaagccuuagauuuauagggaaugcccucuuuuugguuuugcuuuuguuuuuuguuuuuuaaaguacuaugacacuagaaccuuugcagaggauccaacuacaauguaagguugaucuuccaguauccaggaaucagauuccucaggaauucaggcacaaguagguucagcaacugcuuugcccauccugaacuggccaagaccuuugccauuuuuguaccaguguuugugguagaagcuaucagucguucucuaccacaugaccagugugcaaugauuacaccaucaugguaaggaaaggcaaacugcagauugccuggaagaauucuucaauggaggauuuauggaaaauuggucccccaguuuuaacugauuaaaauguggauaugacuaagauuucaccaagaagaucaaauuuauugucugcuaaagaugucuagaauuugcuucccugcuucuuuuaaaaaguagcuuuuaaucugugucacaugacaguuaggugaauguuuccagccuucugauuaucaguuggucacugccuucuccccguugcucugauuuguacacugauaaaugccuuaucccuaaagcuaccuuacucuuaagagugcaguuuacuaagugggaaggcugguaaacagacugaucauuuuaggaaagaauggaaagcuuuuauagagggucucaacuugguuuaccucugcacggacagcaaaauaaagaaagcaaauuuguauugcuucccaggccaacagcugggacuucuuuauuauaguuuaugaauaacugaauaaguauucauguacaugaagaucuaguugaaaacuuucugugaucaucucaagaagaugucuguuauuuccauaagcuccuuuacuuguggaaaugaaaugaauuggcucauuucuuuuucucaaaggauguccuaaaaaugccuaugaugcagagagacagcucauaaagcuguauaaagagugugccuggauaggaauuauuccauaggcaccagccaauaagaugaccacucaugaggugaucagagcuagaugugaaucaucauuggcauacaaaagauggguauaguggagucuucagccagccagauggaaugugacucuuuuaaaagugcacacaaucuuugucuuuggcugaauucacaggacuuaaagaucuuuguauuuacaauagcugaggucauugucaaaaaugguaugguuuugugggauaguggaguuuaacuugaucauuuaccuccagucuuguuauagagauaggaaaauaaggaaaugaagauucuuuagucuuagaauguagcuguuauaauugcauuccagcugcuguguuugcagucugguauucacaaaugucucugccauuuccugcauuaacaaaaggcugcccuuaucuguauaugaggacagaguucaaucaaaaugggggauaccaagccuucugguuugcagaaauuaggaguucugagcuuuguacuuugagucacuuuuuauaaaguuuaucaauguuuuagugaaaugcagucaacucugauuuauccuugaaaaaaaucuuaaaaucaucuuugugaugauggacuugucugugacuuaccucacccuguuaagaucucccuuguguucucggacuuguaaguguugaauagcuuauauuuggcucuuaagagugcaguuugugaaugaaaacaaaagguuuuuuuuccuuagauacagugucuuuuaggaauacauaauuauuuugagauucaucacugcugcuuuuuaauaacuuuauagugcuauaccauguuugguuuuguaacuauacaacaauuuauugaucuuuuuuauucauucggcucuugguugaauccuuucuugagcuguuacauauuauggauaugagcauuugauucaauaugcuuacauuuuuaaauuccucucgagccaguaauuaaguauaugugaaugcuucuauuuuuaagaaagugucaaacugguauagauugcucuagaucagugguucucaaccuuucugaugcugcaauucuuuaauacaguuccucaugcugugguaacccucaaccauagaauuauuuuuguugcuacuucacaacuguaauuuugcugcugguaugaauuguaaauauuuguguuuuccuauggucuuaggugacaccugugaaagggucauuugacucccaaaagggucacgacccauugagaacaacugauguagacaguguaugaacauucuugcuaguacuugugugguuaaugaguuugcuuugagccauuugaauagcuguauaauaacacacuguauagucuuaauugcuuuuuucguguuucaugauacugaauauuuuuguguguuuacuugccaaguguauuuuuuaaaacuuguuuuuuugccuauuuucaagugaaaauucauguuacuguccuuuucauuaauaaauagauguacacuaacaau

SEQ ID NO: 3550 - RNA, 695 nt, Mus musculus
cccccagucacugagcccgccgccgaggacucagcugccucccccucgagcccccucgcuucccgacgcuccgucccccccccccgcccccgcccgccuucucccgcagccgccuuccgcaggccguuuccaccgaggaaaaggaaucuuaucguauguccgcuauccagaaccuccacucuuucgaccccuuugcugaugcaaguaagggugaugaccugcuuccugcuggcacugaggauuauauccauauaagaauucaacagagaaacggcaggaagacccuuacuacuguccaagggaucgcugaugauuacgauaaaaagaaacuagugaaggcguugaaaaagaaauuugccugcaaugguacuguaauugagcauccagaauauggagaaguaauucagcuacagggugaccagcgcgagaacauaugccaguuccugauagagacugggcuggcuaaggacgaucagcugaaggcucaugggauuuaagagcuuguggcucucugaagcuuaagugaggauuuccuugcaaugaguagaauuucccuucugucccuugucacaaguuuaaaacccucacagcuuguagaauguaaucauuugggguccgcuuuuaacuuggacuaguguaacuccuucaugcaauaaacugaaaagagccaaaaaaaaaauuaaauuaucuucaga

SEQ ID NO: 3551 - RNA, 4313 nt, Mus musculus
cagaugaagcagagccaaggcagggacacacagugccucccugggcuucuuggcaucacccuugaaguucacuggagaaagaggugauguggagaaguagguaaacuucccuuucuuguggucuugaaugugugaguauauguguauuuauguguguguauguguguuuauuuguggacuugugagaagauucaucacaauuauggguagaucucaguaguucaauauugccguuuggaagcuuuacugaucaagagguugauuuuucuaaacucuaaagaaaacucugaguugguaaccauucagguauguguguggauauuuguuugcuucucugugaauuuaauauuccugguuauucauuuuaaauauuuucuuaugaaaguauuauucucugguacuuuagaaugagacggaagggugaaacuuaaaauuugaggaauagcaaaauaauucccaucuuuuccaagaggggaacugacaacauugcuguguucguaagaucucaugacagaucuaagcacccuagauacaggacuuucugguuauugagucaauuuauuuucuacuuuucaguuguuuugcccauuuccaauuccaugcaagcagauugaaaggacuauagugaaacauuuacugucaggaaccaauaaaaccaucugugacacaaaucucauuugguuuuguguuuguuuuguuaacauuaauuauguguuuuuuucuuuuuuaaaauucacagcuuuuacaguacauccgucaacuguuagcauuuuccuaaagucacaaaacagauacuaaacugcuauaguugaaucuuucagaccauugucaccacaauggcuucacagcaggcaccagcaaaagaccuucagaccaacaauuuagaguuuacuccaacugauaguucuggugugcagugggcagaagacaucucuaacucaccaagugcucagcuaaacuuuuccccaaguaacaauggcugcugggcaacucaggagcugcaaagucucuggaagauguucaacuccugguugcagccagaaaagcagacuaaggagcagaugauuucucaauuggucuuggagcaguuucuccucacugggcacugcaaggacaaguaugcuuugacagagaaguggaaagccagugguagcgauaugaggagauucauggagagucugacugaugagugcuugaagccuccugucauggugaguuccucuggggcuuaguagaaggaaaggcagaaacauuugggguuugggaaaaguaggggguuuuguauuguuuuguuuuguuuuuucuuugauugcuugucuauguuguauuuuacaaaggagauuauauucuguaccaaaaacauuuauacugaagaaaaaugauugccucaaauuaucaugaauauagcagaaaggagauuaucaauuagguuugauaugcacaacuaagucuaguuuauuuacauguuaguagagagaaugaagaauuguauuugggaggacuuuaaggauguagaggagauaacuugugugcgagacccagcuuguuccuggagaugcuuacugaguauucaugaggacuauguuagauccugccaugaacacuuauacacaggguucacaaugcuagccugugauccguggaaguguggcaaaaauuugggauuaaauugauuagauggauucucaaauuggcuauuacauaucauugacucucugucuagaaaacugaggugucagaauggaaaaguucugauauugaaauaugguuggugcuguauacaaaacagcacuauacccauaagaauuucugggaugcauaauggugcuucaccaaacauucaaauuuggauagaccugauaaagauuuaauuauguuggaugcuuucucaaagccgugauuugcaaaauucuuaguuauuuacagaaauugugaaaauuugaaaauauucuaccaccccauacaugcauuccuauauaccaauuaaaaaugcuuccuauuucagauauuuuguuuagauuuuuauugguuuaguuguuugguucauuucaugguugcuugcuugcuuguauuugugauuuucaacacgguuuguuuguuuguuugcuuauuuuucgagacaagguuucucuguauagcccuggcuguccuggaacucacuuuguagaccaggcuguccuagaacucagaaaucugccugccucugccuccuaaguuuugggaucaaaggcaugugccacaaccgcccuccugcagcaugguuucuuuauguaguccuccuuggccuuggaagcagaggaauuacccucccuuugcuucucaaguguuaguuuaaaugguuuuuggguuuuguuuuagguauuguuuuuguuuuguuuuguuuuuugagacaggauuucucuguguagcccuggcuguccuggaauucacucuguagauaaagcuggccucaaacucagaaauccucuuucuucagccucccaaauucugggauuaaaggcacgugccaccacugcccauguaaauuaaaucuuuugaccacaccuugcaaguuaagaauuauacugcauauaaccuuugaguuuuauuuuaaguuuaaaauuucauacuaaguacacugcuccccuaauauccaguuauguuccugagagcaggccuugugauucuuugagacacuacauccaaaacaaagaucauguaaaguuaagacaaucugaaaacaugggcuagccaguuuaaggaaggcuuauccuccuucaauguguugaccaguuaaagaaacuaugguuggcagagcucacaggaacacaaauuugagugucuauagggacaaugaguugacauuugaaaacacauuagcuauagugacuuuagaagucagaauuugugagugccaggaaugaucauuagacuuaaggccuagacaaaugagcuagucaauauuccagucucccucugcuagcagguugagguuaggugucugcaauccacaugcucaugcauaagaaggacaugucuucccuuacagguccauguuucaaugcaaggacaagaagcccucuuuucugaaaacaugccauuaaaagaagucaucaagcuuuugaaacaacagcaaucugcaacaaggccaauaccagauaaugcacagaugccaguagacaccacacaagauagauuauuggccacagguuaguugguaaccuggauaaaagagucauguuuugaggggguccauuuuggguacauuuucauaaauugucuucuuuccaaagggcaagaaaacagugaaaaugaaugcaacaccucuugcaaugcuacugaaguaaauguuggugaaagcuguaguggaaaugaaaaggacucccuucuuauuacccagaaagaacaaaaccaugagcaugaagaggggaauguuguuugucaauucccucguggugccagaagagcaagucaagacaccuccagucaucauguagacuucccgagugcucugacuccugcagauguccccauggaggaacaaccaauggauuuauccagagaaaacaucucugaggacaagaacaauugcuauaacacuuccaggaaugcagcuacucaaguauauaguggugauaauauucccaggaacaagacagacucccuuuucauuaacaagagaauauaucauccugagccugaggugggagauauuccuuauggaguuccucaggauucuacaagagcaagucaaggaacaucuacaugccugcaagagucacuuggggaauguuuuucugaaaaagacccaagggagguaccaggguugcagucuaggcaagagcagccuaucucugauccuguccuugguaagaaucaugaggcaaacuuaccaugugaaagucaucaaaagagauuccauagagaugccaaacuauacaagugugaagaauguucuaggauguucaaacaugccaggagccuuucaucccaccagagaacucaccugaauaagaagagugaauugcuuugcaucaccugucagaaaauauucaaacgaguuucugaccuucgaacccaugagaucauacacaugucagaaaagccuuucaagugcagcacaugugaaaaguccuucagccacaagaccaaccugaaguaucaugagaugauucacacaggagaaaugccuuaugucuguucccuauguagccgucgcuuucgccaaucauccacuuaccaucgucaccugaggaauuaccacagaucugacugaaguaucuaacauccucagcagagacugguagggcuucagccucaguaugucaucuucu

SEQ ID NO: 3552 - RNA, 4828 nt, Mus musculus
cagaugaagcagagccaaggcagagacacacagugccucccugggcuucuuggcaucacccuugaaguucaccggagaaagcagugagguggaggaauagguaaacuuuccuuccuaguggucuugaauguguaaguauauguguauuuauguguguguauguguguuuauuuguggacuugugagaagauucaucacaauuauggggagaucucaguaguucaauauugccuuuuggaagcuuuccugaucaagagguugauuuuucuaaacucuaaagaaaacucugaguugguaaucauucagguauguguguggauauuuguuugccucucugugaauuuaauauuccugauuauucauuuuaaauauuuucuuaugaaaguauuauucucuggugcuuuagaaugagacagaagggugaaacuuaaaauuugaggaacagcagaauaacucccaucuuuuccaaagggggaacagacaacauugcuguguucuuaagaucucaugacagaucuaagcacccuagauacaggacuuucugguuauugagucaauuuuuuuucuacuuuucaguuguuuugcccauuuccaauuccaugcaagcagauugaaaggacuauagugaaacauuuacugucaggaacccauaaaaccaucugugacacaaaucucauuugguuuuguguuuguuuuguuaacauuaauuauguguuucuuccuuuuuuaaauucacagcuuuuacaguacauccaucaacuguuagcauuuucguaaagucacaaaacagauauuaaacuacuauaguugaaucuuucacaccauugucaccacaauggcuucacagcaggcaccagcaaaagaccuucagaccaacaauuuagaguuuacuccaacugauaguucuggugugcagugggcagaagacaucucuaacucaccaagugcucagcuaaacuuuuccccaaguaacaauggcugcugggcaacucaggagcugcaaagucucuggaagauguucaacuccugguugcagccagaaaagcagacuaaggagcagaugauuucucaacuggucuuggagcaguuucuccucacugggcacugcaaggacaaguaugcuuugacagagaaguggaaagccagugguagcgauaugaggagauucauggagagucugacugaugagugcuugaagccuccugucauggugaguuccucuggggcuuaguagaaggaaaggcagaaacauuugggguuuggaaaaaguaggggguuuuguauuguuuuguuuuguuuuuucuuugauugcuugucuauguuguauuuuacaaaggagauuauauucuguaacaaaaauauuuauacugaagaaaaaugauugccucaaauuaucaugaauauagcagaaaggagccuaucaauuagguuugauaugcacaacuaagucuaguuuauuuacauguuaguagagagaaugaagaauuguccuggggaggacuuuaaggauguagaagagauaacuugugugugagacccagcuuguuccuggagaugcuuacugaguauucaugaggacuauguuagauccugccaugaacacuuauacacaggguucacagugcuagccugugaucuguggaaguguggggcaaaaauuugggauuaaauugacuagauggauucucaaauuggcuauuacauaucauugaaucucugucuagaaaacugaggugucagaaugguaaaguucugauauugaaauaugguuggugcuguauacaaaacagcaccauacccauaagaauuucugugaugcauaauggugcuucaguccaaacauucaaauuuggauagaccuaauaaagauuuaauuauguuggauguuuucucaaagccgugauuugcaaaauucuuaguuauuuacagaaauugugaaaaguugaaaauauucuaccaccccauacaugcauuccuacauaccaauuaaaaaugcuuccuauuucagauauuuuguuuagauuuuuauugguuuaguuuugugguucauuuccugguugcuugcuugcuuguauuugugauuuacaacaugguuuguuuguuuguuugcuuguuuguuuauuuuuggagacaggguuucucuguauagcccuggcugucuuggaacucacuuuguagaccaugcuguccuagaacucagaaaucugccugccucugccuccuaagugcugggauuaaaggcguaugccaccacugcccugcugcagcauuguuucuuuauguagucuuccuuggccuuguaagcagaggaauuacccucccucugcuucucaaguguuagguuaaaugguuuuuggguuuuagguuuuguuuuagggauuguuuuuguuuuguuuuguuuuguugagacaggauuucucuguggagcccuggcuguccuggaauucacucuguagauagaccuggccucaaacucagaaauccucuuucuucagccuuccaaauucugggauuaaaggcacgugccacacagcccagcuaaauuaaaucuuuugaccacaccuuacaaguuaagaauuauacugcauauucucuuugaguuuuauuuuaaguuuaaaauuucauacuaaguacacugcuccccuaauaucuagucauguuccugagaacaggccuugugauucuuugagacacuacauucaaaacaaagaucagauaaaguuaagacaaucugaaaacaugggcuagccaguuuaaggaaggcuuauccuccuucaauguguugaccaguuaaagaaacuaugguuggcagagcucacaggaacacaacuuugugugucucuagggacaaugacucgacauuuggaaacacauuaucuauagugacuuuagaauucagaauuugugagugccaggaaugaucauuagacuuaaggccuagacgaaugagcuagucaauauuccagugucccugugcuugcagguugagguuaggugucugcaauccacgugcucgugcauaagaagaacaugucuucccuuacagguccauguuucaaugcaaggacaagaagcccucuuuucugaaaacaugccauuaaaagaagucaucaagcuuuugaaacaacagcaaucugcaacaaggccaacaccagauaaugagcagaugccaguagacaccacacaagauagauuauuggccacagguuaguugguaaccuagauaaaagagucauguuuugaggggguccauuuuggauacauuuucauagauugucuucuuuccaaaggacaagaaaacagugaaaaugaaugcaacaacucuuguaaugcuacugaagcaaauguuggugaaagcuguaguggaaaugaaauggacucccuucuuauuauccagaaagaacagcacccugagcaugaagaggggaauguuguuugucaauucccucauggugccagaagagcaagucaaggcacccccagucaucauguagacuucccgagugcuccgacuacugccgauguccccauggaggaacaaccaaaggauuuauccagagaaaacaucucugaggacaagaacaauugcuauaacacuuccagaaaugcagcuacucaaguauauaguggugauaauauucccaggaacaagucagacucccuuuucauuaacaagagaauauaucauccugagccugaggugggagauauuccuuauggaguuccucaggauucuacaagagcaagucaaggaacaucuacaugccugcaagagucacuuggggaauguuuuucugaaaacgacccaagggagguaccaggguugcagucuaggcaagagcagccuaucucugauccuguccuucuugguaagaaucaugaggcaaacuuaccaugugaaagucaucaaaagagauucuguagagaugccaaacuauacaagugugaagaauguucuaggauguucaaacaugccaggagccuuucaucccaccagagaacucaccugaauaagaagagugaauugcuuugugucaccugucagaaaauguucaaacgagucucugaccgccgcacccaugagaucauacacaugccagaaaagccuuucaagugcagcacaugugaaaaguccuucagccacaagaccaaccugaagucucaugagaugauucacacaggagaaaugccuuaugucuguucccuauguagccgucgcuuucgccaaucauccacuuaccaucgucaccugaggaauuaccacagaucugacugaacuaucuaacauccucagcagagacugguagggcuucagccucaguaugucaucuucaaagagagaagaauguugcaaguaaauuguacugucccaauaaugauauaacaugcuuguggauugccacuuuuauguuuuguuuuguuuuuuauuuuguguguguguguauguaauuuuuugucuguauuuccauauuuccacagcauaaguuauuagaauacuuugcuguuaauucuugaguugcuucuugcuuuuagacagugucuuucugguuggcagcuuuauaaaccugucuuucuggcacuagaguuuccaaacauuuucugaucuccacuuuuauucucuacaguguucuugacagaagccuggcauucccucugacauuuucuacauguugggguuuucaucccaagucuuaggguugcaaguuaaaugcauugccucuucagacaucucaugccaugucuacugcuuacaguucaagaauauuucucuacauuacuagaacgacguucaaaguggaauaauaaauaaauaaauaaucaacaauug

SEQ ID NO: 3553 - RNA, 4855 nt, Mus musculus
cagaugaagcagagccaaggcagggacacacagugccucccugggcuucuuggcaucacccuuaaaguucacuggagaaagaggugagguggaggaguagguaaacuucccuaccuaguggucuugaaugugugaguauauguguauuuguguguguguguguguguguguguguguguguguguguuuauuuguggacuugggagaaucuucaucacaauuauggguagaucucaauaguucaauauugcauuuuggaagcuuuacugaucaagagguugauuuuucuaaacucuaaagaaaacugacuugguaaccuaccagguaugugugugaauauuugauugcuucucugugaauuuaauauuacugguuauucauuuuaaauauuuucuuaugaaaguauuauucucugguacuuugaaugagacagaagggugaaacuuaaaauuugaggaacagcaaaauaacucccauguuuuccaaggugggaacagacgacauugcuguguucuuaagaucuuaugacagaucuauacauccuagauacaggacucucugguuauugagucaauuuuuuuuucuacuucuuuucaguuguuuugcccauuuccaaaaccauguaagcagauugaaaggacuauagugaaacauuuacugucaggaacccauaaaaccaucugugacacaaaucucauuugguuuuguguuuguuuuguuaacauuaauuauguguuucuuccuuuuuuaaauucacagcuuuuauaguacauccaucaacuguuagcauuuuccuaaagucacaaaacagauacuaaacugcuauaguugaaucuuucacaccauugucaccacaauggcuucacagcaggcaccagcaaaagaccuucagaccaacaauuuagaguuuacuccaacugauaguucuggugugcagugggcagaagacaucucuaacucaccaagugcucagcuaaacuuuuccccaaguaacaauggcugcugggcaauucaggagcugcaaagucucuggaagauguucaacuccugguugcagccagaaaagcagacuaaggagcagaugauuucucaacuggucuuggagcaguuucuccucacugggcacugcaaggacaaguauacuuugacagagaaguggaaagccagugguagcgauaugaggagauucauggagagucugacugaugagugcuugaagccuccagucauggugaguuccucgggggcuuaguuggaaggaaaggcagaaucauuuggguuuggggaaaaguaggggguuauguauuguuuguucuuugauugcuugucuauguuguauuuuacaaaugagauuauauuccguaaccaaaauauuuauacugaagaaaaaugauugccucaaauuaccaugaauauagcagaaaggagccuaucaaguagguuugauaugcacaacuaagucuaguuuauuuacauguuaguagagagaauuaagaauuguccuggggaggacuuuaaggauguagaggagauaacuuugugugagaccaagcuuauuccuggagaugcuuacugaguauucaugaggacuauguuagauccugccaugaacacuuauacaccggguucacagugcuagccugugauccguggaaguguguugcaaaaauuugggauuaaauugacuagauggauucuuaaacuggcuauuacauaucauugauuuucugucuagaaaacugaggugucagaaugguaaaguucugauauugaaauaugguuggugcuguauacaaaagagcaccauacccauaagaauuucugugaugcauaauggugcuucaguccaaacauucaaauuuggauagaucuaauauagauuuaauuauguuggauguuuucucaaagccgugauuugcaaaauucuuaguuauuuacagaaauugugaaguugaaaauauuccaccacaccauauauacauuccuacauaccaauuaaaaacgcuuccuauuucagauauuuuguuuagauuuuucuugguuuagauguaugguucauuuccugguugcuugcuugcuuguauuugugauuugcaacaugguuuuuuguuuuuguuuauuuguuuguuuguuucuguguuuuuugagacaggguuucucuguauagcccuggcuguccuggaacucacuuuguagaccaggcuguccuagaacucagaaaccagccugccucugccuccaaagugcugggauuaauggcgugugccaccacagccccgcugaagcaugguuucuuuauguaguccuccuuggccuuggaagcagaggaauuacccucccucugcuucucaaguguuaacuuaaaugguuucaggguuuuguuuuagggauuguuuuuguuuuguuuuguuuuuugagacaggauuucucuguguagcccuggcuguccuggaauucacucuguagauaaaccugaccucaaacucagaaauccucuuucuucagccucccaaauucugggauuaaaggcacgugccaccacugcccagcuaaauuaaaucuuuugaccacaccuugcaaguuaagaauuauacugcauauacucuuugaguuuuauuuuagguuuaaaauuucauacuaaguacacugcuccccuaauauccagccauguuccugagagcaggccuugugcuucuuugagacacuacauccaaaaaaaagaucagguaaaguuaagacaaucugaaaacaugggcuagccaguucaaggaaggcucauccuccugcaauguguugaccaguuaaagaaacuaugguuggcagaucucacaggaacacaacuuugugugucucuagggacaaugagucggcauuugaaaacacauuaucuauagugacuuuagaagucagaauuugugagugccaggaaagaucauuagacuuaaggccuagaggaaugagcuagucaauaauccagugucccugugcuagcagguugagguuaggugucugcaauccacgugcucgugcauaagaagaacaugucuucccuuacagguccauguuucaaugcaaggacaagaagcccucuuuucugaaaacaugccauuaaaagaagucaucaagcuuuugaaacaacagcaaucugcaacaaggccaacaccagauaaugagcagaugccaguagacaccacacaagauagauuauuggccacagguuaguugguaaccuagauaaaagagucauguuuugacgggguccauuuuggguacauuuucauagauugucuucuuuccaaaggacaagaaaacagugaaaaugaaugcaacaccucuuguaaugcuacugaaggaaauguuggugaaagaugugguggaaaugaaauggacucccuucuuauuauccagaaagaacagcacccugagcaugaagaggggaauguuguuugucgauucccucauggugccagaagagcaagucaaggcaacucuagucaucauguagacuuccggagugcucugacuccugcggauguccccauggaggaacaaccaaaggauuuauccagagaaaacaucucugaggacaagaacaauugcuauaacacuuccaggaaugcagcuacucaaguauauagcagugauaauauucccaggaaaaaaacagacucccuuuccauuaacaagagaauauaucauccugagccugaggugggagauauuccuuauggaguuccucaugauucuacaagagcaagucaaggaacaucuacaugccugcaagagucacuuggggaauguuuuucugaaaaagacccuagggagguaccaggguuggagucuaggcaagaggagccuaucucugauccuguccuucuugguaagaaucaugaggcaaacuuaccaugugaaagucaucauaagagauuccguagagaugccaaacuauacaagugugaagaauguucuaggauguucaaacaugccaggagccuuucaucccaccagagaacucaccugaauaagaagagugaauugcuuuguuucaccugucagaaaauguucaaacgagucucugaccgccgaacccaugagaucauacacaugccagaaaagccuuucaagugcagcacaugugaaaaguccuucagccacaagaccaaccugaagucucaugagaugauucacacaggagaaaugccuuaugucuguucccuauguagccgucgcuuucgccaaucauccacuuaccaucgucaccugaggaauuaccacagaucugacugaacuaucuaacauccuuagcagagacugguagagcuucagccucaguaugucaucuucaaagagagaagaauguugcuacuaaauuguacuuucccaaugaugauauaacaugcuuguagagugccacuuuuauguuuuguuuuguuuuguuuuguuuuguuuuguuuuguguguguguguguguguguguaauuuuuugucuguauuuccauaguuccacagcauaaguuauuagaauacuuugcuguuaauucuugaguuguuucuugcuuuuaaacaguggccuucugguuggcagcuuuauacaccugucuuuauggcauuagaguuuccaaacauuuucugaucuccacuuuuauucucuacagugguccugacagaggccugccauucccucugacauuuuucuaccuguugggguuuuaauccacagucuuaagguugcaaguuaaaugcauugccuuuucagacaucucccaugucaugucuacugcuuacaguauauuucucuacauuacuagaaugacauucaaaguggaguaauaaauaaauaaauaaucaacaauug

SEQ ID NO: 3554 - RNA, 4830 nt, Mus musculus
cagaugaagcagagccaaggcagggacacacagugccucccugggcuucuuggcaucacccuugaaguucacuggagaaagaggugagguggaggaauagguaaacuuuccuuccuaguggucuugaauguguaaguauauguuuauuuaugugugugucuguguguuuauuugaggacuugugagaagauucaucacaauuauggguagaucucaguaguucaauauugccuuuuggaagcuuuccugaucaagagguugauuuuucuaaacucuaaagaaaacucugaguugguaaccauucagguauguguguggauauuuguuugccucucugugaauuuaauauuccugauuauucauuuuaaauauuuucuuaugaacguauuauucucuggugcuuuagaaugagacagaagggugaaacuuaaaauuugaggaacagcagaauaacucccaacuuuuccaaagggggaacagacaacauugcuguguucuuaagaucucaugacagaucuaagcacccuagauacaggacuuucugguuauugagucaauuuuuuuucuacuuuucaguuguuuugcccauuuccaauuccaugcaagcagauugaaaggacuauagugaaacauuuacugucaggaaccaauaaaaccaucugugacacaaaucucauuugguuuuguguuuguuuuguuaacauuaauuauguguuucuuccuuuuuuaaauucacagcuuuuacaguacauccaucaacuguuagcauuuucguaaagucacaaaacagauauuaaacuacuauaguugaaucuuucacaccauugucaccacaauggcuucacagcaggcaccagcaaaagaccuucagaccaacaauuuagaguuuacuccaacugauaguucuggugugcagugggcagaagacaucucuaacucaccaagugcucagcuaaacuuuuccccaaguaacaauggcugcugggcaacucaggagcugcaaagucucuggaagauguucaacuccugguugcagccagaaaagcagacuaaggagcagaugauuucucaacuggucuuggagcaguuucuccucacugggcacugcaaggacaaguaugcuuugacugagaaguggaaagccagugguagcgauaugaggagauucauggagagucugacugaugagugcuugaagccuccugucauggugaguuccuccgggguuuaguagaaggaaaggcagaaacauuugggguuugggaaaaguaggggguuuuguauuguuuuguuuuguuuuuucuuugauugcuugucuauguuguauuuuacaaaggagauuauauucuguaacaaaaaucuuuauacugaagaaaaaugauugccucaaauuaucaugaauauagcagaaaggagccuaucaauuagguuugauaugcacaacuaagucuaguuuauuuacauguuaguagagagaaugaagaauuguccuggggaggacuuuaaggauguagaagagauaacuugugugugagacccagcuuguuccuggagaugcuuacugaguauucaugaggacuauguuagauccugccaugaacacuuauacacaggguucacagugcuagccugugauccguggaaguguggggcaaaaauuugggauuaaauugacuagauggauucucaaauuggcuauuacauaucauugaaucucugucuagaaaacugaggugucagaaugguaaaguucugauauugaaauaugguuggugcuguauacaaaacagcaccauacccauaagaauuucugugaugcauaauggugcuucaguccaaacauucaaauuuggauagaccuaauaaagauuuaauuauguuggauguuuucucaaagccgugauuugcaaaauucuuaguuauuuacagaaauugugaaaaguugaaaauauucuaccaccccauacaugcauuccuacauaccaauuaaaaaugcuuccuauuucagauauuuuguuuagauuuuuauugguuuaguuuugugguucauuuccugguugcuugcuugcuuguauuugugauuuacaacaugguuuguuuguuuguuugcuuguuuguuuauuuuuggagacaggguuucucuguauagcccuggcugucuuggaacucacuuuguagaccaugcuguccuagaacucagaaaucugccugccucugccuccuaagugcugggauuaaaggcguaugccaccacugcccugcugcagcauuguuucuuuauguagucuuccuuggccuuguaagcagaggaauuacccucccucugcuacucaaguguuagguuaaaugguuuuuggguuuuagguuuuguuuuagggauuguuuuuguuuuguuuuguuuuguugagacaggauuucucuguggagcccuggcuguccuggaauucacucuguagauagaccuggccucaaacucagaaauccucuuucuucagccuuccaaauucugggauuaaaggcacgugccacacagcccagcuaaauuaaaucuuuugaccacaccuuacaaguuaagaauuauacugcauauacucuuugaguuuuaauuuaaguuuaaauuuucauacuaaguacacugcuccccuaauaucuagucauguuccugagaacaggccuugugauucuuugagacacuacauucaaaacaaagaucagauaaaguuaagacaaucugaaaacaugggcuagccaguuuaaggaaggcuuauccuccuucaauguguugaccaguuaaagaaacuaugguuggcagagcucacaggaacacaacuuugugugucucuagggacaaugacuugacauuuggaaacacauuaucuauagugacuuuagaauucagaauuugugagugccaggaaugaucauuagacuuaaggccuagacgaaugagcuagucaauauuccagugucccugugcuugcagguugagguuaggugucugcaauccacgugcucgugcauaagaagaacaugucuucccuuacagguccauguuucaaugcaaggacaagaagcccucuuuucugaaaacaugccauuaaaagaagucaucaagcuuuugaaacaacagcaaucugcaacaaggccaacaccagauaaugagcagaugccaguagacaccacacaagauagauuauuggccacagguuaguugguaaccuagauaaaagagucauguuuugaggggguccauuuuggauacauuuucauagauugucuucuuuccaaaggacaagaaaacagugaaaaugaaugcaacaacucuuguaaugcuacugaagcaaauguuggugaaagcuguaguggaaaugaaauggacucccuucuuauuaugcagaaagaacagcacccugagcaugaagaggggaauguuguuugucaauucccucauggugccagaagagcaagucaaggcacccccagucaucauguagacuucccgagugcuccgacuacugccgauguccccauggaggaacaaccaaaggauuuauccagagaaaacaucucugaggacaagaacaauugcuauaacacuuccagaaaugcagcuacucaaguauauaguggugauaauauucccaggaacaagucagacucccuuuucauuaacaagagaauauaucauccugagccugaggugggagauauuccuuauggaguuccucaggauucuacaagagcaagucaaggaacaucuacaugccugcaagagucacuuggggaauguuuuucugaaaaagacccuagggagguaccaggguugcagucuaggcaagagcagcuuaucucugauccuguccuucuugguaagaaucaugaggcaaacuuaccaugugaaagucaucaaaagagauucuguagagaugccaaacuauacaagugugaagaauguucuaggauguucaaacaugccaggagccuuucaucccaccagagaacucaccugaauaagaagagugaauugcuuugugucaccugucagaaaauguucaaacgagucucugaccgccgaacccaugagaucauacacaugccagaaaagccuuucaagugcagcacaugugaaaaguccuucagccacaagaccaaccugaagucucaugagaugauucacacaggagaaaugccuuaugucuguucccuauguagccgucgcuuucgccaaucauccacuuaccaucgucaccugaggaauuaccacagaucugacugaacuaucuaacauccucagcagagacugguagggcuucagccucaguaugucaucuucaaagagagaagaauguugcaaguaaauuguacugucccaauaaugauauaacaugcuuguggauugccacuuuuauguuuuguuuuguuuuuuauuuuguguguguguguauguaauuuuuugucuguauuuccauaguuccacagcauaaguuauuagaauacuuugcuguuaauucuugaguugcuucuugcuuuuagacagugucuuucugguugacagcuuuauaaaccugucuuucuggcacuagaguuuccaaacauuuucugaucuccacuuuuauucucuacaguguucuugacagaagccuggcauucccucugacauuuuucuacauguugggguuuucaucccaagucuuaggguugcaaguuaaaugcauugccucuucagacaucucaugcccugucuacugcuuacaguucaagaauauuucucuacauuacuagaacgacauucaaaguggaauaauaaauaaauaaauaaucaacaauugc

SEQ ID NO: 3555 - RNA, 4831 nt, Mus musculus
cagaugaagcagagccaaggcagggacacacagugccucccugggcuucuuggcaucacccuagaaguucacuggagaaagaggugagguggaggaauagguaaacuuuccuuccuaguggucuugaauguguaaguauauguuuauuuauguguguguauguguguuuauuuguggacuugugagaagauucaucacaauuauggguagaucucaguaguucaauauugccuuuuggaagcuuuccugaucaagagguugauuuuucuaaacucuaaagaaaacucugaguugguaaccauucagguauguguguggauauuuguuugccucucugugaauuuaauauuccugauuauucauuuuaaauauuuucuuaugaacguauuauucucugguacuuuagaaugagacagagggugaaacuuaaaauuugaggaacagcaaaauaacucccaucuuuuccaaagggggaacagacaacauugcuguguucuuaagaucucaugacagaucuaagcacccuagauacaggacuuucugguuauugagucaauuuauuuucuacuuuucaguuguuuugcccauuuucaauuccauucaagcagauugaaaggacuauagugaaacauuuacugucaggaaccaauaaaaccaucugugacacaaaucucauuuggguuuguguguguuuuguuaacauuaauuauguguuucuuccuuuuuuaaauucacagcuuuuacaguacacuaucagcuguuagcauuuuccuaaagucacaaaacagauacuaaacugcuauaguugaaucuuucacaccauugucaccacaauggcuucacagcaggcaccagcaaaagaccuucagaccaacaauuuagaguuuacuccaacugauaguucuggugugcagugggcagaagacaucucuaacucaccaagugcucagcuaaacuuuuccccaaguaacaauggcugcugggcaacucaggagcugcaaagucucuggaagauguucaacuccugguugcagccagaaaagcagacuaaggagcagaugauuucucaacuggucuuggagcaguuucuccucacugggcacugcaaggacaaguaugcuuugacagagaaguggaaagccagugguagcgauaugaggagauucauggagagucugacugaugagugcuugaagccuccugucauggugaguuccuccggggcuuacuagaaggaaaggcagaaacauuugggguuugggaaaaguaggggguuuuguauuguuuuguuuuuuguuuuuucuuugauugcuugucuauguuguauuuuacaaaggagauuauauucuguaacaaaaauauuuauacugaagaaaaaugauugccucaaauuaucaugaauauagcagaaaggagccuaucaauuagguuugacaugcacaacuaagucuaguuuauuuacauguuaguagagagaaugaagaauuguccuggggagggcuuuaaggauguagaagagauaacuugugugugagacccagcuuguuccuggagaugcuuacugaguauucaugaggacuauguuagauccugccaugaacacuuauacacaggguucacagugcuagccugugauccguggaaguguguggcaaaaauuugggauuaaauugacuagauggauucucaaauuggcuauuacauaucauugaaucucugucuagaaaacugaggugucagaaugguaaaguucugauauugaaauaugguuggugcuguauacaaaacagcaccauacccauaaaaauuucugugaugcauaauggugcuucaguccaaacauucaaauuuggauagaccuaauaaauauuuaauuauguuagauguuuucucaaagccgugauuugcaaaauucuuaguuauuuacagaaauugugaaaaguugaaaauauucuaccaccccauacaugcauuccuacauaccaauuaaaaaugcuuccuauuucagauauuuuguuuagauuuuuauugguuuaguugugugguucauuuccugguugcuugcuugcuuguauuugugauuuacaacaugguuuguuuguuuuuuugcuuguuuguuuauuuuuggagacaggguuucucuguauagcccuggcugucuuggaacucacuuuguagaccaggcuguccuagaacucagaaaucugccugccucugccuccuaagugcugggauuaaaggcguaugccaccacugcccugcugcagcaugguuucuuuauguagucuuccuuggccuuguaagcagaggaauuacccucccucugcuucucaaguguuagguuaaaugguuuuuggguuuuagguuuuguuuuagggauuguuuuuguuuuguuuuguuuuguugagacaggauuucucuguggagcccuggcuguccuggaauucacucuguagauagaccuggccucaaacucagaaauccucuuucuucagccuuccaaauucugggauuaaaggcacgugccacacagcccagcuaaauuaaaucuuuugaccacaccuuacaaguuaagaauuauacugcauauacucuuugaguuuuauuuuaaguuuaaaauuucauacuaaguacacugcuccccuaauaucuagucauguuccugagaacaggccuugugauucuuugagacacuacauucaaaacaaagaucagauaaaguuaagacaaucugaaaacaugggcuagccaguuuaaggaaggcuuauccuccuucaauguguugaccaguuaaagaaacuaugguuggcagagcucacaggaacacaacuuugugugucucuagggacaaugacucgacauuuggaaacacauuaucuauagugacuuuagaagucagaauuugugagugccaggaaugaucauuagacuuaaggccuagacaaaugagcuagucaauauuccagugucccugugcuaucagguugagguuaggugucugcaauccacgugcuugugcauaagaagaacaugucuucccuuauagguccaugucucaaugcaaggacaagaagcacucuuuucugaaaacaugccauuaaaagaagucaucaagcuuuugaaacaacagcaauaugcaacaaggccaacaccagauaaugagcagaugccaguagacaccacacaagauagauuauuggccacagguuaguugguaaccuaaauaaaagagucauguuuugaggggguccauuuuggguacauuuuuauacauugucuucuuuccaaaggacaagaaaacagugaaaaugaaugcaacaacucuuguaaugcuacugaagcaaauguuggugaaagcuguaguggaaaugaaauggacucccuucuuaucauccagaaagaacagcacccugagcaugaagaggggaauguuguucgucaauucccucauggugccagaagagcaagucaaggcacccccagucaucauguagacauccagaguccuccgacuacugccgaugucaccauggaggaacaaccaaaggauuuauccagagaaaacaucucugaggacaagaacaauugcuauaacacuuccaggaaugcagcuacucaaguauauaguggugauaauauucccaggaacaagucagacucccuuuucauuaacaagagaauauaucauccugagccugaggugggagauauuccuuauggauuuccucaggauucuacaagagcaagucaaggaacaucuacaugccugcaagagucacuuggggaauguuuuucugaaaaagacccuagggagguaccaggguugcagucuaggcaagagcagcuuaucucugauccuguccuucuugguaagaaucaugaggcaaacuuaccauguaaaagucaucaaaagagauucuguagagaugccaaacuauacaagugugaagaauguucuaggauguucaaacaugccaggagccuuucaucccaccagaaaacucaccucaauaagaagagugaauugcuuugugucaccugucagaaaauguucaaacgagucucugaccgccgaacccaugagaucauacacaugccagaaaagccuuucaagugcagcacaugugaaaaguccuucagccacaagaccaaccugaagucucaugagaugauucacacaggagaaaugccuuaugucuguucccuauguagccgucgcuuucgccaaucauccacuuaccaucgucaccugaggaauuaccacagaucugacugaacuaucuaacauccucagcagagacugguagggcuucagccucaguaugucaucuucaaagagagaagaauguugcaaguaaauuguacugucccaauaaugauauaacaugcuuguggauugccacuuuuauguuuuguuuuguuuuguuuuuuauuuuguguguguguguaauuuuuugucuguauuuccauaguuccacagcauaaguuauuagaauacuuugcuguuaauucuugaguugcuucuugcuuuuagacagugucuuucugguuggcagcuuuauaaaccugucuuucuggcacuagaguuuccaaacauuuucugaucuccacuuuuauucucuacaguguucuugacagaagccuggcauucccucugacauuuuucuacauguugggguuuucaucccaagucuuaggguugcaaguuaaaugcauugccucuucagacaucucauaucaugucuacugcuuacaguucaagaaucuuucucuaaauuacuagaacgauguucaaaguggaauaauaaauaaauaaauaaucaacaauugc

SEQ ID NO: 3556 - RNA, 1025 nt, Mus musculus
cucaguauccuugcugggguggguggcccaggguuucuugcuccuuggaggccauguaggccaugagguccaccucccuguugcuguagccguauucauuguuauaccaggaaaugagcuucacaaaguugucauugagagcaaugccggccccagcaucaaagguggaagagugggaauugcuguugaagucgcaggagacaaccugguccucaguguagcccaggaugcccuucaguaggcccucagaugccugcuucaccaccuucuugacgucaucauacuuggcagguuucucuagguggcaugucagauccacaaugaauacauuagggguuaggaacauggaaggccaugccagugagcuucccguucagcucugggaugaccuugcccacagccuuggcagcaccaaugaauaauguucugcgcagccccauggccaucacggcacagcuuuccagaggggccauccacagucuucugagugguagugauggcauggaucguggucaugagaccuuccucaaugccaaaguugucauggaugaccuuggccaggggggcuaagcgauugcuggugcaggaugcauugcugacaaucuugugauugucauauuucucaugguucgaacaugggggcaucggcagaagggguggagaugaugacccuuuuggccccacucuucaagugggccccggccuucuccauggugguuaagaugcuaguagacuccaugacauacucagcaccagcgucaucucauuugauauuagcaggaucucucuccuggaagaugguggugggcuucccauugaugacaagcuucccauucucggccuugacugugcaguugaaucugccauggguggagucauacuggaacauguagaccaugugguugaugucaaugaagggaucauugauggcagcaaucuccacuuugcucaguauagagcagaaggcaguucugguaaucaggcacccaauacggucaaaucuguucacaccgaccuucaccauc

SEQ ID NO: 3557 - RNA, 2813 nt, Mus musculus
gaugggcaaauuaucaaacguaaaccuggcaauaguaaguguucaaccacuuacuguuauacauguaaauauguaaaacacagacugucugaaaugcuuucacaccauaguacaacuaaagcauuguauuucaaaccacagucaacuagggacuacucacuuuuuaaaaacagaaaucuacuaaaaaccugaauguuaacuuguacugggcaaauguaauagaaacgagcucuguacaaugcauucccuaauguucuacaguugugaugcuuaauguaguagccacuucgguguaauaacacagaaucugaaauacagcaaauaccccaguguaaauacuacugcuuaaggagcacaaagguaaaauaaaauguuacugauaauuucauuuguuucuuauuuagcgcauguguguauaugggcacuaugcuauccacguggguaccaacuucccagucuugauccucucuucccaccuuuugggucucaggaaucaaacucaggucaucaggccuaggggcaggcacuuuaccugcugagccaaaucauugcccuccaucuccuucuuucuucuuuccuuucuuucuuucucucauguaaauauuagagaacuucaaguuucaugugugguuaaugcuuuauuuccaucaaauaaagcaacuaugaaagaucagcucucugaaagcuuuccacacaguauagaaugucuucuguuucuagugugagaguuuauaaaauugauuuuuacuuacuucaaaugcaugugugcacaguaugugugugacggugugugugcaugcauguguguguugggagggugcauguguauaccugaguguugacagauguugaaagagaguuggauacccuggaaagggagucaaaagugauugugaauguggguggugggaaccaaacucagguccucuggaagagcagcaagcacucuuaaccacugagucaucgcuccagacccacugaguuuucuuaaaacacaagaaaagcaucuuaacaggguucuccacauuauuguaguauagguuaguuccaagugcauccuucaaacagaagcaucccagcagauauuucuaacccuuccauugauuguguuaacugaguccacugauggggaaacaaagccagggcuccaauucaaauggucuccuauguuuuuauucaguggugcuuaggguugaagugagggcuucacaagugcuaggaaagcccuccuugccacugaacuacaagcacauccuuaaaacaucuggauauaagaaagaaacguaguaagaauaaaggcuuccucuucucucgauccugucaccagcauucaaauuuuuccuggucuuagauuuagugaagaguaaacucagaugguuuuaauucauuauguuucuaagguucauuuucagucuguuguacaggagcaaaauaauuccaguuuauuagagauauaaugucucauggguuauauuccauggacuagauggugaguugcuauguuuucaaacuacacuugaguauaaauuuuaacaguaacuaaagagaugcugauagucacugccacuccuguucacugagucucccagaaauugcuacagugugacgucucuguauuuaaccugggaaaauggugcacugaaaauuucuccuguuggaacaccuagcaaaagaccucaugcauagugacuccugcugcuuggucagggaggggcucuuccugaaggcuuugccacaguaguuaaaacuccaccaggcuuccagcagaggcaguaugaauccucugaugccuggcagaggcacucuuuguacaugagggacuucuuucuguuaaggauuuugguugcuuuugguuuuuuuguuuguuuguuuuccuuaacaugcaaugaggugaccacugccauugaaggauuuuuccaacucuacccacuucccagucucucuccaaugugaauucuauacuuaauaagguaugagccaccaaugaaagccauuccacacuccacacauuuuguccuaugugaauucucagaugcauaauaaggcaggagacuccaggggaaugcuuuucauacacauuacaucugcacagcucuucuccaguaugaguccuauggugaaaaacaaagaaagaacggaggcugguggacuucccagaauggacacaucacagucagcaucccccauauggguccuuucaugcuucaugaaagcacagagaacacugaaggaucccuguacuuaaugaacucugaaggcuuucccacauuuaccacgacuugaaggacucgucucccacaggaauucuuugacgcacagucagguuauaauuguugaagaagaauucuccaguaauaggccucuuucgacugagacugagacaagacuucuuguucuguucugaguaccgccccaaaaucaaaggcgagcauccuggcuuauccauuggugauguugcaaagaaacuaggagagauguggaacaacacugcagcagaugacaagcagcccuaugagaagaaagcugccaagcugaaggagaaguaugagaaggauauugcugccuacagagcuaaaggaaaaccugaugcagcgaaaaaggggguggucaaggcugaaaagagcaagaaaaagaaggaagaggaagaugaggaggaggaugaagaggaugaggaagaggaggaagacgaggaagaugaagaugaagaagaugaugaugaauaaguugguucuagcgcaguuuuuuuuucuugucuauaaagcauuuaaccccccuguacacaacucacuccuuuuaaagaaaaaaagaacauc

SEQ ID NO: 3558 - RNA, 456 nt, Mus musculus
uggggagagaaacaaaggagagggaaugagugagaaugagggccaugggggcuacuguaccuugcugauggcacauguucuguucugucucuagcccauggaaguacaagagggauauggcuuugggucagguaaguaguugugccuuggaaauugggcugggugaguaccccgucucugucuuuucugccaacucuuuugucuucugagcagaugaucccuauucaagugcagagccgcauguaucaggcaugaagcgguaaguguggcagcccauugaaguagcagguggguacaguauuggugugguaggaauauaugugagcucaugacaagauacacuuaacaggucccgcucuggugagggagagguaaguggccucuuaaggaaggugccacgugugagccuugaacgccuggaucuggaccucaccucugacagccagccaccagucu

SEQ ID NO: 3559 - RNA, 456 nt, Mus musculus
agacugguggcuggcugucagaggugagguccagauccaggcguucaaggcucacacguggcaccuuccuuaagaggccacuuaccucucccucaccagagcgggaccuguuaaguguaucuugucaugagcucacauauauuccuaccacaccaauacuguacccaccugcuacuucaaugggcugccacacuuaccgcuucaugccugauacaugcggcucugcacuugaauagggaucaucugcucagaagacaaaagaguuggcagaaaagacagagacgggguacucacccagcccaauuuccaaggcacaacuacuuaccugacccaaagccauaucccucuuguacuuccaugggcuagagacagaacagaacaugugccaucagcaagguacaguagcccccauggcccucauucucacucauucccucuccuuuguuucucucccca

SEQ ID NO: 3560 - RNA, 6301 nt, Mus musculus
ugguaaauuaguguccaaauuucuuuauuacagggggacaggaugcacugaguuggggugggguguuuucagucccugcgaagguucuugagccucucuuccaggucugcaucagcaucagccagggcugaggcuguggccucugcuuucuucccaccagcugccacacugagugagccuccaguggagggaaggucugcagagagaguugagggucaagggcugugcuuuguguuguggcugagcuuugggugggaaaauagguggauuuggaacacucacuugacagcucaucugugaggcucagucccagcucauccaggaccugggacacaacagcaucacuaggaaagaaaaagaacucaucaggacuacgaauggguaaggguccugguaaauaucccugccuuccugucaaagucucacaccucuccucuucaucuuccucaucacccauggcaucaucaauugcgucauucaucauuucuuccuucauguccaugaucucugccugccguucaaacuccaucaugaucuucuggaucugggguaauuucagcuggaagaaggcagggaggguaagugaccugcuugaaggucaauggggaugggaaaguggauugggagggacaaaccugucuguucauagugcccauggccuuaguaacacccuucauggcuugugccauugaguuguuggauuuuagagucuguaucuugagggacacagcuuggauguuggcccgcaucaacacaaacuugcguacauaucuccggguacgcaccaggucuuuugccaugauucgaacagcauccugccgagugggcaagagaaggaugacgcugugagguuauacuuaaggucacuugccccuccaaaaucucaccccucucuuagggauaucacuccucagcccauauauagcccaaaguagccuccuacugacaauucugccucaaaccucccuuaaugaggggacuauaggcauuggcuacuaaccuaaguauaggaauguguauauaaaaggccuaggcucaguaccuauuuccuucaauguacagagucaccuccaggauauccacaaccuuuuuauucaauuugcacuccuagacuguaucaagaaucugucuugggagccgggcagugguggcacacgccuuuaaucccagcacuugggaggcagaggcaaguggauuucugaguucgaggccaaccuggucuacagaugagugccaggacagccaggguuacauagagaaacccugucuccccccccccccccaaaaagaaucugucuuuggccagggauaugacugagguagggcccugccccauauuuacaaaauccuggagucccuggcagugaauuaaaaaaagacguucauccagguuguaucuagaaccacauacaaauccauucaaggugcagcuucuauucccuaccuaaauguugcuggcacagccccaggaaauaaccaccucugagcaauuguucuuguccuuacucccauccuuaacucuugccuauucaucacagcucacacugcaaccuacauuucugugugucugguccaccucuacuccuuagcucucuuggucucccaguuugcuacuugacuuggcaacauuuggcugucgugauggcuagcuuucuggaagcucacuuguacuaucugugaagagguccucccugacaccccaaauugggaaauuacuguuaacccuucaugauaguuugcucaaagcacuguuucacuguuauccuuaaaacaaugacugagacggcaccuugcuucgugucccauaucacuugacacuuaccaucuggccuugcuuugccaucuuuuugauguccgcaaugauuuucuuuuccuggguuucuaguuucugucguucccuguccaguucucucauggcucgguucagggcccucugguuuugccgaaguaguuccucuggcgucuuccggcgcccaaacaacagguccauggugguaagacuccaccagcaggucugggacaaccgucagaacuagcuguagagugcagggcccagggcagcaaaagacagaaagggucacauaaguagauaggguguagaaacuggagguacgcuugaguagucaaaaaggauuagccggugagaacuaguuauacauuucugacucaagcacacccacucuacucucugcucugcuuccacagacgauggggcaagccuguuucugacuuaagggugugguucugaacuguuccagggacccagaccugaguaggcacaucaaggugauugaguacugaggaggggguaguugugaggccccucgacaagggaggauagaauggaguagguucugaaaugugaaguugggcccuaaggugggguaaugggcaugaaugccaaggaaaccaggcucgcgggcguaggagugacguucucaggcucaggacgugacagacacugaacaggucuuggagauguugagccugcguaccgagggcaggaagaggugaagaccucgauguggguagggacaggcggaccgcgcggcauccgaugccucggcccaaagcccccuccuacgcugccuaccaaacgggaccugcggcucagcagagaccacucaccggagccgagagaacgauggguuuccgcuuccgggucacgccucuaccccuccgaagccuugagacuccaccaacgacaaccccucgguucgguagccccugcugcggccgccguuuccggauuaagcgaccugacgucacacgacccacccucuccgggaaugcugggaagugcuaggacgcacgcgcacagccagccacagaagcgcaugcgcaaagggccacgcaccucagcagaagguacaggucccacccaagccagccucacaggcccauggcgggagcacagcucgacuggcuauucauucuggaaggcccauacuccacccacuuuugggcaguuaauaaauggcauuuuagcaagugcuuggcucgaaccaaauuaggcccacacauggcauaaaggggcaagccuggaaaugacuuguaggcucccuuauguugguguaagguccaggagcugaaauuagccgauucuuccauugcuugcaccucaucccagugaguggucccacccaauccacggccacauuuaucuucauuauagacgcugguggaccucacuuguaccucccaccccacagaaggaagaggcagaggccaugcaguaacauuccccuuuaauagccuggugggaccuccagugguggugggguggguugcuugggccuagcgacccaggcccauugcccacuuaccccacagucaagaguggggaguuggacagcacccagcgggagggggggggcgcuaaacaagccaauucauuucccaucgcugagcaggucgggggggaggcagcaccgaccauaaucacgugguggucaaaaaaaaaauaacuaggggcaggugacagggaagagaggcaaggccaaggcaggggccaaggcuaccccacacaccuuacccgggcccccaauaaauauuugcaggggaugccugggccgguaacccuggcagggauggguaauugcuaacccuauuucaggcagcgcucgaaguagguggacccgauguaaccaccucucauggagcgcugcacauuuuguucaaacagccgccgguuguucugcaggaccucagcagccuccuuguucaguggguccucaggguucggcuccuguggccgguacaaguggaagucaacaggcaagagagaggcagauggccaacaaacccucagcuucaaaugccuaacccuacuuaccaagaagagauacugcaggccauaaauuauggaguuuaucguaaggacuggcuuccaguccucucugugggcagagagcaucaagguuaucaggggcuggugagugggaggcugcuacaggcccugcuaauacugaacagguuaggcccauagaaggccuuuuaacauugaagugugagaucuaagagugaagauacgggacagggcaggacacagagaaagccaaggucaggucauuagaaaaacaacuaagacagaaacagauugaccauaaaggggagggaaggacagagauagaugcaguguccacagaaggcugaggauaccuggaaggcaggucuugggagggaaaggaaggcagugcccucaccugaggauguugaggcagacguugcccucgaggucaauguugggaugauaaaccauuguuucacacuucaccuugggagggucauguggguaacccugucccaccuggcuccagaaaaagagaaaggagaugggaagguguaaaaagagaaaggagaugggaagguguuuugguuguacccagucuucuccacagagcuaccuuuguacacuugagacucaccuuaaagcugaauacaaacuugccacuuuuguagaagcccuggaagaggaagggggagagugaaugaagacccuacucuuauggggccaccccuggucuguucuugggaauccugcccuguuuuacucuuacuucaucaggacagaucaccagcuugaaguugaggaggucgucugggucugagaagcugaugucacacgucuugggcagguucagcucguuaaugucuagguuuggacagcauggaaagggagagaaacagguaaaagaaaggaggucugggcaugugucagcagaacccauaaguucgcuuucuagaccugaagagcuuugugugguguacuuuaacucagucuguacuacuccauauucuuuccacuuuccagucucuacguggacucuucuggauacacaguaucccauauacaagcaucuucaaguauaacugcccaucucuugggaaaacccuuacccagcuaaguccuccacaaguucccacaacauaguccccaagaaccucuacucccauaacccuugcuuccaagaacccugagcaccuuaaaccugagguuuucuaucucuagucauuaucuccacucacuacuguuuaucuguccaccgcaauucaaggaccaugacaccggccccccaacacuaagucaccccuucucaucaaccacccaccuccacuguccuuccucgucuccaucuuauuacaagcccaagaucccaucucauccuugagauuuccuguaugguagcuuaaauugacccacacucacauuuuuuaguuccuguaaccuucuuuucucccuccucuucaccucaaacucaaaauugcucugccugacccucuggaccugagucuugggccacgaguccccaguuuaaaacacuaaaccgucucccacuuauucccaauucguaaccuucacaaucuucacgacacggcaccccagagcaaaguucucgucugacucucaaaacuauaccccuccccuaacagauuccgcgucccuaacacuccaggcccgaguaucccaacgccccaaucuaugacccucccuagugaccgcacccccagucccgcaucacaacccucgaaaccugaccaccaauaccaaauaucaggggccgcauuuucucgccacggucccugaccucgaacgcagggucccgaccccuacccuucugaauccggagcugcgccgccgacgccuucuugcugcugcccuuggugccgccggccgacuccuccuccuucuucugcugcuucagcgagaacagcuugaucauccugccgccgccgccgcagcccgccgccgcgggggcccgggaccccggccacccggccccccgccgccgccugcgccgcuuccgcuccucggacccgcuaccgcggccuccuccgcugccgcucgcccggccugccgcgcugcuccgcgcccaccgcacggcccgccucggcucccguaguccggcucuggccuggcuaagcaccucggguguguucggaggugcucgggaggacucggcgauccucggccccgccccugcuacgguccccgcgcccuccucccccucuuccgcuugggucuggugaggccccgcugcggcugcggacgccggccuuuacagguccgccgcucucccgccuacuugcucccucugcuaggaggcugcggugagguggaaggaggaggcgguagccgcgcuugcggcggcaggguaccgcaggguaccgguggaggcucagcuuccgcggcaggcgcggcuucgaugcggaggucggcaacggccucgggcgccccgccgcuucggcacuuuccgucgccugcccacuucgguuuuuccugccucagcugugcucugcg

SEQ ID NO: 3561 - RNA, 1840 nt, Mus musculus
uuaauuucauguaugugaguacacuguagcugucuucagacacaccugaagagggugucagaucccauuacagaugcuugugagccaccaugugguugcugggaacucaggaccucuguaaguacggucaaugcacuuaaccacugagccaucucuccagccacucuauuccuuucuuaaguccccauaauuuucaguguugaucucuccugucucacaggcuaccaaagauccugaguuaagcuaagcauaauuuagaauccaaucugagggguagugaaugaacacaggcaggcaagugcuaccccagucaguagaacuguaggaccagaaagauuagccagagccccauguagccacagccauaggacuuuagaagggucagaaaaaggagggauguaucuguaaccacagcacucaggaaacagagacaacaggaauaauguuaguucaagaucagccuggacuacgugcugaguuuggacuacagagauggauccuaucuggaagaaagcaagccagaaaaacaacagcugcacaaaaauagucagcauagauaguaacugacaaaaaugguaacugacaagacaguaaugaacaguucuagagugauuugucugagucucagaaugagcuagccuuaaaaagucaggaggaggagggugcugcuggcuaagucuggaauguagaaccgcgggucaugcuggguggcacaaaugcugucagauggcaaagagcagaacagaguccgaaccuguucuggccauguuuuucaagcugugaccagacaagcaacaagaagcauuuagacucuggcuucggcuggauuccuagaugacagccugaagucacugacccauccugagcuauuuccuucugccucccaagcacccuaagcucacucaacauaagccaaucgagaggcacaaugccacucgagagagccaaugccacuucugcuguucucuaagccgcaguuaugaguccuauacccacguccaccuuggacccuagaacuacacaguugcucacagccuguugcacaauagaaaucuauuuuaaggaacaagagucucgauguguugccuaggguaucccugagcgccugggcucaagccaacuugaugccucaagccuccagagcaauucgaaauuuaaacuaguuuacaucaauccgaaucugggauugcggugggauuaggggagccugcuucugcacccuucgacaacgucccuuaaaacguccaggcccugcguuugcugaauccucagagagcaaagauccagucuagcccgguuccgcugcgcuccgcguaaguguaagauugaauggaaccaccgagagccaaacggccacucacuacccgccucgcucaaaaauggucgcaagcacugcuuccuacucuacugggugcgcgucccaggaaguacccgcuagaccgccgaauagucaccuccacaaacggaaauacccgagcuuaaccgaaaaagaccgaaccucaaacuacaaugaggaggaaccagggggcugcaaggguugcgcaggcgcagagcacagcugaggcaggaaaaaccgaagugggcaggcgacggaaagugccgaagcggcggggcgcccgaggccguugccgaccuccgcaucgaagccgcgccugccgcggaagcugagccuccaccgguacccugcgguacccugccgccgcaagcgcggcuaccgccuccuccuuccaccucaccgcagccuccuagcagagggagcaaguaggcgggagagcggcggaccuguaaaggccggcguccgcagccgcagcggggccucaccagacccaagcggaagagg

SEQ ID NO: 3562 - RNA, 12464 nt, Mus musculus
agacggggagacggcguccuagugagagcggugauuggugcagaacccugcaaaucccuggaaggccgguagagaacugacauuuaaaaaaaaaaaaaaaaaaaaaaaguggugggggcaugcgcagucuggaagguggugcuugaauccguugccccccgagaggauugugcacgucgucggggcccugacgccugaauucguggccgggagugugggaagagacguccaggagugcgagcugauuauugcaaccagcgcaauccccuagggacgggaagaaggguagaaacggaggcuggggugggggaagggcagaagggcuuggagcugcgcgcaaagcagucugggauauguaguuugauauggagcaagcgaacgagagugcgcauguucacgagggcacagccucccucggagcauugaaggaaggcugggagucccuucaccucaaggccuagggaggagucuggguagaguggacucugggauuccagcugucuagcuagacccggagcgccgguaggggguccaggaacucccagcaaaccggcccugugcugacgcgcuaccgcgcugaucgccacaggugccacggcgaccggacacauuggcacccuaaagcgaggaugcucacuuagacuucugggaaauguauuuccggaaccucuucuugcuuuauggcuguuccaaguuucucucaggguuucgaguugacuuagcacccuaaagagcagagguguaacccacagaaaucaagcugccucuaagcugaugccacugcaauaguaaauuuagauuuucacaaagucccaguugcagaaaguaucaugggagaagucaguccuuuuuacaagugaggaaacuauagcugacauaggcacagcaaaaguaguacccuugcagacuguuggucuaaugaguugagagccuuuaaggguacccagaagucccagucaccucccaaccaacuaaacuagagagcugaagacuuguaucgcuguuggaugugaugaguuggcuucugguauuggagauauauggaaaccuguuggccugagagaagcugagaugggggauuggguggaguagggcuguccccuugauaccacauugggaaaggaauguuggggccugagagagaggccaaguccaagacuggguagaaaacauuaagggacuuguuuguuccaccgcaaaaggcuguccacagggacucuuauugggaguccaggaggaggcagcagugguacugaugucugggugcaaguagagaugcagcuauagaaaagaauaggauguagggaagagaaauguuucuaagcuuaagcaacagccuguauuuagaacagaguaagcuaccagacacuauauaggcccggcggaaaugaggucuacaaagcacauggcucauauagaguucccacggaucucugggguguggcuggccugucagugccuguucccucggguguccucuucauggcgaaggucucggaugaaaggacacagcauggcacucagucagcauucgcugccccuggcuguccuuauuacacaugccuuguacuauuccuucccuagggacagacacuggccucaaagaccggaucugguacuccugaugagacccacugugcugggcuccucgggcugugcacccccagaaaaugagccugcucuggugaagcuggaggacucugacagcgacgaugagagagaagauauauugugggacccaggccuugaggcugcacgucuacgcuuccggugcuuccgguaugaggaugcaauagguccucaggaagcccuggcccagcuccgagaacugugucaccaguggcuacgcccagaaguacauuccaaggaacaggugcuagagcucuuggugcuggagcaguuccugggugcacugcccccugagauccaggcccaagugcaagggcaguggccaggcagcccugaagaggcugcugccuugguugacagacuucgaugggagcuugauggaccucggaaaugggugagucagaaacggaaaagacggucagggcuggagcauugucauguuuugccucacucuagaagugccaugcccagccagacaugcuccuuggucauauagauguguccaccuauaacggauccuuugugaggcuucucaggauaagagcuaauuccuguauuaucugucauccccacagcuagaugagacacaaaggguaccaugcaauccccucuacgcgcaaauaguccuuuugcuuucugcucaaggucaaaagaggggaaggggaaguucaggacuuuggaugaccuagucaguuuauauuggaguuggugcccguagaccauggguugugcccagccccucucucucccuggucugugcaucucuguaggucacaguccaggugcagggcaaggagguccuaucagagaagauggaacccuccagcuuccagccaagaccucacaucaagcuucagacuccagacccuggggcugagacuccccaaggagccaugcaggaauugccacugaaccuaccaaugaaagaggagacagaguuguuggggaauccaggugagagcaggcaaagugggcaggcccuaaaaccuagaugggcaaagcuacuccacuuacugagccaggcccuacgagauaaaauaguuccagugugccuuucucucccuuccaguccagccagcacagacacugucccugaccaccauagccccauuuccaagcaucauaggauaggcugacucacagagauacagaugcacaaaccagugcuuccagaaaacccuauuugacaccauucccacugggccuucagcugcccuaccuugucuuucccagcuucgagauugugcccauaucucccuuaugucugaaaccuagcaccucuaagaaagguggaaacuuucuugagcugccugaccccacucuuucucccuagagcuccuggaaucugggccucuuccugcugcucaagaggcugcagccacucuccuaccuaaggagacccaggugagaccuauacagaauauacaagugacccucuugcccuaugaguuuauaauggcugggugucauauagguccucugaagccagccaggcacaguccaacauugaccacugugguuucagggccaugggacaacacuggaccagaccucuccucauagcgacacugagccugaugugcccccauggagugaggacccuaugccccuguggcaugaggaaguagggggcaucuuuucaccagguuagugagauggacaaggugggacugaauccuccucguguuccacuacaucuaugagcccucugccccuacucaagacaguccagucacugcggugccuccuuuagccuucucuguuacugaccccuuucugacucugccuugaaucauaaugucuuccugaaaacaaccccucccagucaaagcauucuaagugaccuccacauucgggugugcaucuugccuguuggauaacagaguagggaaguuugggaccuauugaagagcguuuaauaguacacaaggcaagaguaguucagacacaacauaggcaccuacugaagacaaaccagaaugcugccgggucauccaggcuccugucuuucuugguuuacuuccuuaugugcaugcaucauccugugaauucuacuaugggaaguaaaacucuguaagguuacaggucugaaacauaccugucuaggccuuauuagaugguuuauuuuuccauuauuggaccucagggauugugcaugcuagguaagcacacuaucacugaacuacacccccaguuucccaccaguggauuauggauaagaacucugcuauugagccaugccuccauccucucccuggugaauuccagccuuugucccaccacugaagcaauguguuagcaccuccuaggcuggaguuuuaccacugagcuccacccucaauucuaaaacuguucuguccgacucguucucaggaauuuuuuuuuuaauugcuacuguugauagguccucucuauuugaaauucauauaucucacugguagggaauugucuugaaauguuucuuggagcaugaugugauggcucugggaugguccucuaguguuaucacaccaauuuuccacccccuuuguugugugugaguuucaacauguguugugugucacagcacgcacauagaguugggaugacaaacugcaggagucaguuuucuuucuccacaguguggcuccucagguuccagcucaggucaucaugcuuggcagcacccuaaggcagaaaagagcauccagcauaagcgccugcugcugccgccucagaauucaccugcccugaccagcacugcuuguguugcacagggaccacuuuguccugcuuggaccccgcuucccucuucauccacagcuccagucucucagcucucuugcaggcacauuggcagcacugcuucgggcccccccacccccaccccccggcugcuuccuccuccuccggcugcucuugcuguagacaaccauaccucuugcuuucaagcaucaauucaucuucuccuccaugauuccuggcaugccccuuggccacuuguuucauccuccagcugugccuuuuguggcagauggaguuuugguuauuuagagaagggucuacuauauccuaggguggcuuggaacucaguauguagcugagauugaccuugaacaaaugaugcuccugacucuacuuaccaagugcugggauuacaggaguaggauaccucuccugguuuaugcaguguugggauuagaacggcuucaugcaugccaccagcauuuuaccagcugagacaaauccccagcccuauuagugauuuuggugguggugaugugguguguuuguuuguguguauauguguuuauacacacauguaccagggauuaagcccuagacuuuugcacaugcuaaacgugcacucuauuauuagaguuauacucccagagauuguuuuaguacuuaauuaugaugcuauuuuaaauguuuaaaugguuaagagcacugacugaguucaaaucccagcaaccacaugguggcucacaaccaucuguaaugagaucugaugcccucuucuggggugacugaagacagcuacaguguaauuacauauaauaaauaaaucuuaagaaagaaagaaagaaagagagagagagagagagagagagagagagagagagagagagagagagaggaaggaaggaaggaaggaaggaaggaaggaaggaaggaaggaaggaaggaaagagccugucuucauagagcuauucuacuagcugcuuugaguagcaguauguacucgugugugcagucaagcaacaucucaguguccuggagucccugcauuugggaugaauccuggcuagcuacagccuagccuagaagcaguaaugauuugacuuauccugagucagaaggcucagcagaaccauccuuucuaaaucagcaucaacacuuugcagcuagggcuuguccuacauaguuagcagguaguaguccugcucauaugaaaccagccugccaggaggcaaaagcaagcuaauuucacaaagcuauaugagcucaggacaguagccauaguuaaugcauucacauggugacaacuccaaaugguauacaaagaguacaacaguguagugcagccgggcggugguggcgcacuuggaaggcagaggcaggugaaauucugaguuccaggccagccuggucuacagagugaguuccaggacagccagagcuacccugucucgaaaaaaacaaacaaaacaaaaaaacagugcagugccccaucaguuuccagcagucaacaugacagguucugucugugccuuccagaaagagucuguaugccacggagcagacacaauauaaucaugcacugcguagcagugguuagucagcccaggccacagacaacaauuaucucaguguauugccaaagcuccauauggugcugcacaccuagcauuugggagguggaggcaggaguuaggcagacgcuagaggauuguaugucuucaaagccagcuuguacuguaaugugagagccugccucaaaaauuagggcuggcagccgggugugcugccuuuaaucccagcacucgggaggcagaggacagccugggcuacagagugaguuccaggauagccaaggcuacacagaaaaaaaaaaaaaaaaguuagggcuggcaagauggcucaagaagaaagagggcuugcuccugaaccacaacuugaguucaaucucugcgacccacaugguggaaggagaaaaucacuuccuauaaguugucuucugaccuccacauauuguaucauggaagacauguggccauauauauauuuauauccacagcaaaaauaauuauuuuaauguaaaaaucaaaaccacuugacaacaccuuucuguagaguugucccuuuaguuaaccaacauauaccuguacagccaggugcucaguagccuuuuaugaacacagguguagggugaaacacuguuucaaaaauacacagcaaaccagaaauggcagcacaagauuauaggcccuuaaucccagcacugggcagucaaaggcaagcagauuucuguggauuuaaagacaaccuggucuaccuagcaaguuccagaccagccagggcuacauagaccuguugauuuauaccaaaaauaaaaaagcagaaagaugaaaaugguuuuuuuguuuuuguuuuuuuaauggagcuggagagauggcucaaugguuaaaaauacagguugcucuucaggggacauagguuugauucccagugcccacaugguagcucaaaaaugucccagagaaucuggcuggccauugcaggcacugcacacacauaguacacagacauacauacaggcaaaacaccaauacauauauaaauuuuaaaaauuuaaagaugaaaggauuuuuguuauuuggaguguguguguguguguguguaugugugcgugcgguuuuuuuaguuugauuucuuucuuuguuguuguuuuucucuagguauucagggauucuugauccuacuuuuacucagaacugguaucaaauuuauguuagucuuucugccucagacaccaaaaguaucugggauuauaggcaugcacaacuaugcacuggcaagaaaaaaaaaacaaaaagaaaauguuuaaggggccagagagauugcucagcagaugagagagcauacuguuugcagaggccugaaauuguauuccuagcacccaggucagguagcucacaacucccuguacaucuaguuccaggggccccccgauccucucuucugagcucugacuucacugcauucacaugcucauagacauacacauauauggagacauaguggugcacaccuuuaauucuaguacauggagccugaagaguucuaugaauuugaggucagccuugucuaaaugaugaguuucaggcaagccagggcuauacagacccuaucucaaaauaaaaacaguguuuuaaaaugaacaacucuggagcuggaaaaaaugaaugaaugaaugccucggaaaccaucuuuuuuuuuuuuuuucuuuuugguuuuuugagacaggguuucuuuguauagcccuggcugucuuggaacucacuuuguagaccaggcuggccuugaauucagaaauccgccugccucugccucccgagugcugggauuaaaggugugcgccaccaugcccagcucaaaaaaaaaaaaaaaaaauauauauauauauauauauauauauauuuuuuuuuuuuuugagacaggguuucucuguguagcccuggcuguccuggaacucacucuguagaccaggcuggccuugaacucaaaaauauauuuuuaaugaacaagccagacauagugacacacaccuuuagucccagcacuugggagguuggaggccacugguuugcauagugaguucuaagacagccagggaugcauagugagacucugucucgaaaauaaauaaauaaauaagaacaagccuugcuuggcgagaugguucaccagaauccccauggugaaaagaccaaagccuccagacaguccucugaccuccacguguguccuguagcauaagugcacacacacaccaauaaacaagcgauagguuuuaaauguguauuauaagggggggaugggagcaagagagagggugcucagugguuaagaguguuagcugcuuuucagacccacuucaggaaguucacaggggaucugaugcccucugaccuccuaggguaucugaauacacauggugacacaaacucauacagucacauauacauauaauauauauauguauggcucguggaugcccaaaugaccuuauucuguuccuguuuucaugccauaugcuuugcaaacaccaggggucaccacaggacuucagacagcucuguagacuccuggcucaccguggucacuccuuugucaacaguucuuuuggauugcuucucauuaaggacuggaaaacucuuuucauagaucauuaacacaaggagggacacaacuacuagacaggaguacuuaaaaguggaauuccugggacaguguagaacacuguuuuaauguuuaugagguuguuuugguuuugguuuuuaggauaguaucuuauauaacccaacuggcuuugaacuugauuuguuuguuugacaaccuugaacuucuaucucugucccucagagucugggauuggaaauacuuaccaucagugcccugagcauuuacuauuuugauucaguuuuccaacccaacauguguugcaccagcaaugcaugcaaacacuuaagauuuugguaacaaggcuagagagauggcucagcaguuaagagcacacuggcuuuucuugcuguucccagcacccacguaucagcauacaaucaucuguaauuccagugucaggagauccagccuccucgucuggccuucucaggcacucaagccaccuggucgaacacggugagcagacauacaugcagccacaaaaaaggggggggggggugacucaaugguagaauauuugccuaggaccugagaccuccuggguucaagucccaucucuggaaaaaaauaauugcugagaaccagaaacagagugucaauucagcccuacuguggauuuuucaaagcagccacuagcauauucuauggaguuuaaacaauuaguuacuuuuuuuuuuucuuucacauucacauccuuccacaguguggcuggcugucaggucacuguugauuuaugggaucucuguaguaaauuaauuagcccuucaucucuggagaguuguuagguuggcuuuggauucugauuuccuuugauguauucaaauuuaucuuccuuccuuuuggugcuuccuggauuuucugucacccauuuugucuccauucccaguaaucuugguggucacaucaucccuugaguauccucuuacacaagcucacccuauaguccauugugccugaggcuggcaccuuggaaggcucacucuguagcaaggacauacuucuacauagacaguucccauguugaucacauguaggucguguucaucucaccucuaacucccaagccuucauagaaucuccuugccugggucaucucaaguguggcaagucuaaacccaaggcuaaagaacuacauuauuguaaugcugccugugaugucaccucuggcuuuuauugaaucuacauucuucucugcauuuuccaagacccucauuggccaccuaaacugggcccuccugucaccccagaauucuuccaaaaagagguucccaccccgaaugacuuaagucaaaucagaaaagccuuugcagacaccucaguguuccccucaggguucugcccaucacaaggaaaccuguucagauagagcagccacucuuaucuccuuucugccucaccaaccaguuccaagccuauaguucaggcucccagaguuccauggguuagagcagaaagcgagucucuaaaagaaugggucccguugugcaggguuuacgcugcagauggacagcaucacggcagagccagauaugaugagcccccaccuccauguccccugggaucuggacauggcuagccucucuggacagauacaguccccuaccacggaagguggcuuugcccaugcccuuguacuccccagcgacccaggaggugaacaggacccugccugcgaggaucccugccccagugugggcccagcauugguggcgacucgauggcaugccccaaggggccggagccagagccacccucgcucggggacuggagccaugcgaggcggccgcugcgacguguguggcaagguguucagccagcgaagcaaucugcugcggcaccagaagauccacacaggcgagagaccguucguguguggcgaguguggccgcagcuucagccgcagcucucaccuacugcgccaccagcucacgcauacugaggaacggccuuucgugugccgcgacuguggccagggcuucgugcgcagcgcccgccuggaggagcaccggcguguacacacgggcgagcagccguuccgcugcacagaguguggccagagcuuucggcagcgcuccaaccuacugcagcaccagcgcauccacggcgauccgccugguccagcgccauccauccugccccucgccggagucccggagcccccgggccccuucccaugcagcgagugcugcgagagcuucccacgacgcgccgugcugcuagagcaccaggcggugcacaccggggacaaguccuucggaugcguggagugcggcgagcgcuucggccgccguucggugcuguugcagcaccggcgcgugcacagcggcgaacggcccuucgccugugccgagugcggccaaagcuuccggcagcgcucuaaucucacccagcaccagcgcauccacacuggagagcggcccuucgccugcgccgaauguggcaagaccuuccgccagcggcccacgcucacgcagcaccugcgugugcauacgggugagaagcccuucgcgugccccgagugcggccagcgcuucagccagcgacucaagcucacgcgccaccaaaggacccauacuggcgagaagcccuacugcugcggugagugcggccucggcuucacgcaggugucucggcucaccgagcaccagcgcauccacacaggugagcggcccuucgccugucccgaauguggccagaguuuccggcagcacgccaaccucacccagcaccggcgcauccauacgggcgagcgacccuacgcgugucccgaauguggcaaggccuuucgccagcggcccacgcucacgcagcaccugcgcacucaccggcacgaaaagcccuucgccugccaggacuguggccgacgcuucaaccagagcaccaagcucauccagcaccagcguguccacagcacugaguaguuguacagcacugagcugugaaaacacuucacaagguuguugugaggcaggcaucucccaacaggccccaguaaagccugggcuucaggaggugcucaauaaacacaugaugucuccccaaccugcacauuucuucugcccacuuuaccgcuguuuccaugcugguauaagcuaugcaaacacggcuuccaggggaggcuccacacccccuuccacaguagcacaccugcuuucuugugggauauacucuguagcauaccucuggcuuauacagaggggaugcccagccucagauggggaagaguagccacauucacaaaggaggaaaggguucuccacggcugccaugggucuagucaagagagaggucuaccaacuaugucacugguaggugacugaaaaggguaguccagcuggcugugaugguacacacguguaaccccagcguucaggaagcuuaggcaagaggauugcagagaguuugaguucagucugggcgacaucauaagcuguuauuucaaaagcacacauugagugugguggcacacucaguugggggacagagagacaagauaauugccaaaaguucagcagguuaguuuauguaacaaguuccuggacagccagaauuagugagaaccuaucaagcaaaaacuccuggcagagacauaaaauacaaacgcggugguguggugcaugccuugugaccguccuagcuauucaggaggcugacauaaauggacugcuagcuauuuccaggacugcuuggaggccagggcuuugcaguaggaugguucagagguaaaaccccuugucaucaaggucaaacugaugaccugacuuugaucccuggaacccacauguuggaaggagacaaccaauuccugaaaguuguccucugaucuccacaaucuguguuuucuggguuauguuugcacgugcacauacacaaguaaauaaguaggg

SEQ ID NO: 3563 - RNA, 890 nt, Mus musculus
auuagcaguggcauccucuugcaaaaaagguacauuuaaaguuugaaaaugaagaaauaaauuuggaaauaaguuuccuauuguucaacagaacauaagggcagacaguuggguagccugaugauaaaacuccaccaaucagauccaauacuggguugcucuuggguugguaaagugaauagaaggugacaaagguauuugaacaauaaaaaaacaugaaaaaagccacaagcagaaggaugcuguggguggcucucuuuucagaagaugcauggagagagacacugaaacuguggacaugccguguacuccuauugugucugaagaggaggcucaccauguagaggcuggaccauaucaugagaaacacaaacaggacgucucuaauuauuagugcaguuacaagugacuugguggugugguggcgaaccuggcuacuucggcaguauaucugggaauacuuugaauccacaaaagugaaguugauuuuucccuuuauguuuucaaccaugggaagauagagaaauguguugaugauccacaugaugaggaauaagggaaaaaugcaugacucaagcuuggauuuaagccaugcccacuuggaauguuuagaacugagagugauggcuugaaauacacuuaguagcaagauaguacagagggaaaggccccuaguaacacuguaugcauacaaaacugccuuacauacaacaucauggaaaaggauccugacugcaaaggaucucaugacaucuggcaucagcuugaacaugaugcucaaaacauugacaagcauuagaugugugaagaucauaucuacgggcuucuucugaugaggcugaacuaaaaagauguacauguauaguaugaagaggagcaaguuucccaug

SEQ ID NO: 3564 - RNA, 1386 nt, Mus musculus
auuuuuuuucucuucucagccauucauuuucaagccccaacaugggaagugguaggggaauaucuguaggaauacaauuuauugucugcuccuccacucagaaguagcccugugucuguccaguccacacuuagaacuuugucuucaugagcagcuagaucauagagaggagccuuacagcuucuugcaucccauagcuucacaauguuaucuaaagagcccgagaucagcuguuguucauggguaggaaaccauuucacugaugucacccagccugugugugaggugagagacagcgacaccaaaaaaccaucuuuaguucggggaucccacagucuaauaugccugucugugcuuccagaugucaaacguuuacaaaggggagaauaggaaauacaauuaaacacuuuauuuccugucagaguugacuuaagaccgccagacucaacaucccacacucuaauugugugaucccaagaugcacuacagauuucuucagcaucugaccaaaggacugaggaaauugcuucuguguggcaagagagggucaccaaggguguucuuguuagucccaauuguucugguuuuugcuuuuuucuuggacgauuuguggcuucuuccauuucaucuucuucaucuguagggacuguagaccagaucuuuagcaucuuaucccaggaggcacugcaaaacuuagcucccgagcuaucgacugcgauggcgcccacacucccagcaugcccuuggcagcagugcagagcuuucacuuuguucuucucuacauuccacucccauaagagaacagucugguccaucgaggccgucaguaguaagcagaacaaacugucuuuuuucacccaagccacaucuuucacaacaucuguaugucccacaauugucauuacugacuuuccuuccaaggaccagauuugagaagucuuaucauacgaaccagacaggauccauucuucugccccuuuaauugagcugauccagucaucauggaacaugcacugcuuuggcuggggugcgguguacuuuuccacauauucuaguuccacaaccucuuccgaugaaauguucuccaguuccguguguuugaccaagggcacucgaagaaacuggcucuugauaaggaaaucaaacucgacauguuuguggaguucauuuuuggucuccagcaacuuauugauaauguuacuaaggucggcaacuucagcagcggcagggauugagaaagggacaucauccacugcguauuucuuguucucgcuguagaaacgugccuggaguugugccauggcugaauauacauacacacgaggcuucuccacgaaaaugugugcauugauaaucaaguagcucuaagguagguugcgccgcaau

SEQ ID NO: 3565 - RNA, 3980 nt, Mus musculus
ggacagcagcugugaguugacuggccacucucaucuugcccaccacaauuugccugcuccugucucccagccuccaccuuuuguggaaccucuucaauauuuagucuacaaagccucaaagggacccaagaugucauauaaucccuaaaagauaaggauaucagggccagacagagauggccaugaccgauggccacugggaaacaaagcaggaauuucacagccaagaggguauaggcuugaggagggcaagucacaggcaaaagguaaaacagaacccgacucugcuaguggguguaacagucaaaaaucugacccagcccaggcuggaucgcuacacugccugcaccccaccucuaucagcugcuacauucacuccaguagcgacacgcgcgacaggccccaaaaaccugggcgcugucccgaggcgaaccauggcauccuguauaacgaaugcuccaauguccuugcuuuaguugguaaauggaucugggugcuuucccuuaagacugcuuuauuauaagugccucuauuugacacacagcuaaguuagauuccucaccaguccugggcaguccuugagccgaccaagggcuuugaauucaguaagaauguugccuauucagugacauucagaauugccucuaguauaguaagagagauagugaaagaaaucagacauuacuaucuacuacacagaguuagaaauuucagggcaagcuacauccauaugcaggaauuuaccauuaucuaggaaguuugugaucuaaggagaaaccaaaguagauacuuacugaguuacacccauacacaggaauuuacaauggcguagggggaagguggacuauacaacagacuagaauaggaacuaaggcaagggcacaaagcccuagccccugacuucuaagauaaagcugaccuuggguggggcugcuuuugaucccagugguuaacuuugaauuuuauuccagcugguuccugacaguccuuuguguuugcauuccucuguuuuguguaggagucauaaagguaccucacuggugugucaucuaacuucccuauuuucuucuguauaaaaaguuugaugcucuauuugacacauuacauucagauccacacucccgguuugucccccauucucgcccaucuguccgagacccugauucccauggauugaggggggccaacugggcccaguccauggcaaucagcuccacuguauugaggauaauagaucuaucucacauaguggcugggagacuagauggggagacuagguacagggcagaacacacuucaagagagaucaguaacuuuccacugucaugacagcuuauacugaaugcaggcagacaucaauaaucaaccacaaaauuuacccuugaacucaaggauccuucucuaggcagcaucaccaauggagaauaguuagcccaugacauguaugguuugauaugaaaugcucuccacaggcucauacuuugaaugcucaucuacagcuuggugauacuauuuggggaggcugugaaaacuucaagaaauggggccuacccaauggaaacaggucacuaggucacuauuuaagagguuauacaggucuugguccuggucuuacucugcuuccuuaugugcugugaugugaggagccucccccacacacuccuguugccacaaacccuaccaugccuucccuaccaagauggacccaaacuguccaagucaugaacuaaaauauuccuuuccuccaucaaguggucuaaccauaguaauacaaagguaacuaaaaugggcuuccaaugcaaagucagaacugggucauguuguuauuuuucucaugagagggcagucagggugugugcagugucugcaacugccaagugcucauaagcuagacccauaugccuccccacugucaugagccccaugcuuaccuggcaauguaccuggcuucugaguggcggcaggcaacaaaaaggcccuugauaauguccaucuucuuggccauggacuaaacaaaguagagaauaggcaaggaaccaucagagaacauuuuucagcuuuggaaaaucugccacugccaugaucaaccaccacaaccuguuguagugucuuaaucugagagcaaugacaaugagccucucucccuuuguccaacaagcauuaacaaguguccugacacccaagagaugcuagguucuccagagaagaacaaaaagagacacuguaaauugcacaagcacaaacgaacacuaagguacacaguccccaccacaggcuuuguucugggucuugggacauuuggagguugggauaagccacccugcucuacuuacagcacugccagugagccgggcaaugucacagaauuuggugaagacuccagaaauaguaaguggagguggaggcagcaugagucucugagugcugcggcuguucucggccaccagccccacaucccccuucucagcuaccucagcccggauggacuccagcugacgaccuuaauagaugcagcaguggggaagaaaguagaagacgacacugcaguaaccugucucuauucauuggcuggauauuucucuagcuaucuggaauuaggggacuucccccuugucuacagauugcuucguugcuaguaaaugccugcucccauuaggucaguguaaaaagccuaagcaacggucagucugagaaagacaaggagcugugugagcacaaccagacugggagucauguauagauagaacuaaaaccuauggggugggauggggccaauggaaguggagagggcugccuguucaauccuuaguugaucucuaauagucccucuuguuuauuguguuucuauuguucugccuuuuaaaaaguaugaguugugccuugaccuugcuuaaguuugaaaucagaauccuaauuuggaacaauuaagguaagagcaggaggcuggcaagauggacaagcaaguagucaagauaacucaaugguuuucaucacuccuccucuccaucccacagcucuuauuccaacacaggcugugccuccccacccuguaaugcccagaccuugaaacuguggccuugucaaguacucuuccauuggccucuuccucuaccuuuauccccggucccaaguuuuucacaaacuucaagugaccccucucauuggaucccuaccuguggccugggcaacggccuugaggaggacaccaucaccaacacccagcucuagucccugcugagguggcccgaggcgguugaggcugagauagagaacagggagcaagucuggaggggacagggccaccacggagcgcagcagguugcucaaugucuccaccaucuugagccuggaagaaagggccaggauauguccaccuaugucaaggucagugagguguugcaucccaggaaguucgaaggaaaaaugaaaagaagagaaaggagaaggauaaagagccaagggaacaaugacagcuuguuuguggaagggugacugaaaaaaugacaaugaagaugaugcuaaucacugacagagaacagcagccaugcacagacacuuccucaaaaaggcauuggcuuuaaccccuuuccaucacuuuaacugauggauucaugcccacucugagacaggugacauuauuguccccacuuuacagguaagaaaacaggcacagcaagacuugcccaaggucaggaagcuaagaagcaucaggcugagggucaggccaagacuguccacucuaggacacucaagccacugaaaaugauggccauguuuccugaaaaugcuguuugcccaacuuacguggucuaaguaaagagccaugugagcuggggauauaguucaguugauagaaugcuugcacagcauauacaaauccccauauaaacugggguguggagacgacaggcaaucuaguacucaagaaguagaagcagaaagagcagugcagggccagcgugagcuacaugagacugucu

SEQ ID NO: 3566 - RNA, 10758 nt, Mus musculus
aaguagaauuuuccaugagcugucacagaucucucacagggacugaggaagaagcuaagagaaacaggaggaguuggcaaaggauugagacaaucaggaagcuggguugccugcugcaaggaaguaggaaggaggggccaucuugacaucagagcuuggugaacacuaccugcuccaaugcaguuuccaauggguccugccugcaucuucuugagaaaaggcauugcugaaaagcagcgggugagguggggauggugcagagaaugauaggaagaucaagggggucuggggcauggggaaaagaagggguaugcaaaugcugagcagcaaggggagcagguggagagagcacaaacugaagcucagguagcacuguuugggcauaagggucagugaucagaagucagaagcagagggguauaguggagugagacauaaaagagagaugcuauggagccauuguugacagcaucauuguuucauaugggaaaucauacaaugaugauggugaugguguuaaugguaaugcugcuucugcugguggugaugacauugcuggugcugacgguggugaugaggauggugaugacaaugaggauagugaugguggugcugcugcuucugaugaugauuauggugaugguggugaugaugcugaugaugguauuaacaauagcuauugcuuauuaagucuugcuguuuguccagucuugugcaaaaggcuuuacgugcuugauggcauucaguccucagaacagcacaugagguuugguauaauuucauuccuauuuuacaaggaaguaaaauuguaaacugaggccauuaagucaugaaguaguuuguuuuacgccuauacagccaacaugugucucuaucuaucuaucuaucuaucuaucuaucuaucuaucuaucuaucuaucuaucuguuaauucacucauuuauuuacuuauucagucauguuugagucucaguagcauauucuucauuguaaggccuuaaaauuaccagagagggggaaaaagaaaggagcggugaaaggaauaaggggaaaagauagaagggaagagaagaggaggggacacagaucaggaugaggcaaggcauggaagggaaaaauaggggaaggagaaaaggggaagagagaugagggaagguaagagauuucaugguuagaaaagaagagagaaaauccacagugaggucucccagaauaagguugauaagaaguuaauuaccagacacuaugccugcuaaccaagcauacccucagguguacucaugauuagggaacaaugaccagcaauucccauauguaagacuaagacugaauauucuacgaaaaccccucugagaacugguuucacacaggagaagcucaccccaggaaugaggauggaggugcuagagucagugggauguagcagaaagaauuuggcauagcauucaggaguucuacauccuacucucaauccuguaucugaucuuugagugacuucaaaggaguaugcaugucauaaaagcagaagaggguauuguauuugggaagaaaugggauuggaaagaguggaacauguacuauaugugguggugccaaagucagcaaagaacaaugacauaggugugugacaacaucaugaugcaaaacugguuuuuuggugauaaaacaaauuuaguuuuaaagguugaagugucugaguauguaucuuaguugguagaguuuaucuagcacauaugaggcccuagauucaaucuucaguaccauacaaaguaggugugguggguugugucuguaauucuagugucugucagauggaggcaggaggaucaggaguucuuuuuagguauuagccuggcuacaugaaacuaucucaauaaauauguaauagaauaaauaaauaagggccaaugagauagaucagaagguaaagggaccuguugcuaaauuugauuacaugaguucuaucuccagguuuguguauggagagaaccaauugccucaaauuguccucugauccuucacaaguacuuggcaaguacuugcauuucaaaacaauuaaacaaacaaacaaauaaauaaaaggaaaauagaacaaauuuauuuaucucucccuugaaagggaauauucuauuuaugagcugugugaccuuugguaggcucauuaaaucuuuuuauucuuuagcuucucauggguaagauaagaauauuugagucuaccucagugaugugguucugagguauaaguauaaugacaguacucacacagagaucccucugaacacaguagaugagacauaauguacuuucuuuaucuggggaaaaaguucuuaucacaggauguuugggauagaaaguuggagauuaagaugcaaaggugggagacaagaaaugaguggggaugggagaaaagggucauuagagaagagcuggggaugggaguuguauuagagggaggaauaugaaaguuagaggaagacugugaagguaaaaaagcuugauggaacaaugggguuuuuuugggaggugggaauuauauuucugacucuuucaauauccucuccuguguucuuuucaggagagaccacugggacaggaugagcuugaugguaauuccuuucucagaugcccuuccauguagucaccuauuacugcucucuucuccugcauuucuguguaaauuaccccaugugaagaaugcuuuucuccugugucccugaucaaauauaaucugcacagcacauucugggucauuuuagguucuacuccuugaguguugacaggugucugucucauuugcauaagucacagggacuuggaaaugaugcacauuuuagagugauuuaaaaaguuaccuuuugaggggguuguuuuugagaucccuuucaaguucacucaagagucugagaacuucagugcucuuagggucaucuucuuacuaacacauuuuuuuuauauuccugcuuaaaaaaugaaccauauacuucauuaaauguauucuuuguagauucucuagcuaugucucauugauaguuucaagggauaccagucuuccccaaagacaauuucagguugcucuaacacacuucucucuuaacuuuuagagcuccgggaagcauuucuugaauuugacaaggaccaagauggguucaucucuuacaaggauuugggcaaucucaugagaacgauggguuacaugccuacagagauggaguugacugaguugggccagcaaauccgaaugaaccgugaggacaaggggcaggaggcaucccuggaguuggggacaggguggguuguaaggaagauuuuuagguugagaguagcacguuaaauaggaaggugguuaaggggaagagccaucugccagaaagcagcucaggcuauacuugaagaaguugcauuugaaguaguuagaaagagauggagcuagauacuaguugcaccuuuuacuauuaaaaauauuaaagauuaaaaagucauguguaucaacauuuugccugcauguauaucuguucaccaagcaugugccugacacguugagagugucagguccccuggaacuggguuauaaacagucaugagcugccacaugaguucugggaacuaaauccaggucuucugcaggaauaaguagugaacuuaauacuguaucucuccagcuucucacuuuaaaauuuuaaauuguaauuauuuuguguguugagggaggauggggguacaugugaaugucacaguauuugggugcugauuggagaacaauuucaaggaguuggcuuuuuccuuccaccacauggguucuggggcucaaacucaaugccaucaaguuggacaggaaguccuuuuuaccugcuaagccaucuaccugguccaugagucccacuuucauuauuuacuuauuguggucauuuucaacaguggaauacuucuggaauauuccugguuuucaguuuccccaucuaucaaguaaagacaugauuauggcuuacuuauucauuguguuguggaaaggaaaggaugccacugugggaaaggucauauuccccauuauuccuuacugaaugcaacauuuuaucaguagaguucauuguaguggggcuugauggauguugagcaugaaccuggacuugggacuagugcaacucaguagcauugcucaggaauacaucauuaaauggaaaucaaagucaauucugugauugaagccauaauuagguuggauuuugggcaugaaucugaguuaacaagauuucauuucauuucauaauaguaaagucucugucugcuaguuucauuaucugcauguucaagcaauugcaacagaaaauauuuagaaaaaggaacugcaucuacauuaaacacauaaggacuuucuacuucuguuucuuaaauaauacagcacagcuuuuauucacagaacaccucaguauaguagauaauggaaaaucuaaaggugacuagaacauaugggagacuacaagugcaagauacacacauuaugccaguuaugacaggaacuugggcauugauuugcuuugauaugcuauggauguccuggcacaagucuucaaugaacacaaagggaugacugucaccauaacugaaagagagugguccacauuuaaaucuuuguuucuucuauuggucucuagaugggggagugcauaagcuuuaaaccaauaagauauuuucugagugggucuggacagauuacucagugguuaagaguguacuacuuuuacaaagaaccugaguuuggaucucagcauccauguugggcaucucugucaucuguaacuccaucuucaggagaaucugaugcccucuucuggccucugagguaacugcauuuauguguacagacacacacacacacacacacacacacacacacacacacacacacacacacacacacacacacacaaacagagagaguuuaaaaugaauaaaaauuaaagagauuuuuaugaagguuaccuaguuauauguauauccuuugucuaauaaguucauauuggaacaaccugagaacuuggcuggguagagguaggaacucaaagaaaaucauuagcauccaggagacugggaacugaccuuuuuauggcuugaaugggagaguagagggaugaaaacucagugccuguggaaucauugcuaaccauguuucuucuucuucaguugguggccguguagacuuugaagacuuuguggaacugaugacccccaaauugcuugcagagacagcagggaugauugguguccaggagaugcgagaugccuucaaggaggugaguuaauaacuccauaauucugagagaugggcaagggagacaccauggggcuaauuuuauuaguguacacaguagacuguucccaacaaaagcaacuaguugugauuagguacgaggaaggagaauaacauauuccaaacauuuggcaauauguauucaucugauuuuacccucacauacaauauuacgaguaaacacaguuccuaucauacauaugaagaaacugaggaucacagaugaaauccaauacucucuguuuccccagguuguggccucuugcuuccugcaauaggaaagaagaaucuaagaauuugauauauuuagauggggggagcuguucuauggaaguacauucuagggcaggguauucuagggcagagguucuauuauaggaaaauguuuguagaagggagccaagaucaagugauggacauaacaagaaacagacaaggucuccgggaugugggggcaugguucagugguagauccccugccuaaaaucucccagugaggggcugguggugugucucagugguagagcaucugccuagaauccccuagugaggcgcuggagguauggcucagugguagagucccugccuagaaucccccaguguggggcugggugcuugguucaguggcagagcugcacagaaccucccagugaggggcuggagauguggcacagugguagagcacuugccuagaaucccccagcaauggccuggggguaugugguuuggcacuagaaaauugcuuuaggguguacaaggccuuggucccucuuuagcuuucauuucauauggauucugcuacccuuuuucccacuuuccuccucccuuaaaauaucuucuuccccucuuauugucgcuuucuaguuucauuucugaaucugguuuguuuaacacagugauuuucaguaccguccaucuuacaaaugucaagaauaaauuuuccuuugugaccaaacaaaaucagaaagaaauuaaauauuuaugauaauuuaauacugauagugacaugggcugaugacccaaguucagcccucaggacucacauaguguguccugcaaguuguuauccuaccuucacagugcaucauggaauguaugugcccacauguguauacacacauaaagaaacaaacauacagauauuugcacccaaccaauggacagaagcugcugaccccugugguugaauuagggaaaggauaauuagggcaagguugaauuaggaagaagcugaggaggagggugacccuguaggaggaccagcagucucaauuaaccuggaccccugagaucucucaaacacuggaccaccaaccaggcagcacacaccagcuaauaugaggcccccaacacauauacagcagaggacugcugggucuguguucagucagagaagauguaccuaacccucaagagacuggaggcuccagggaguuuagaggucugguuggguagguguuggguauuggguacaucccuguggagacaggggggguggggauaugauguggaacaguuggagggugggccagugggggaaauaaaaucuagaguuuaaaauaaauaaauaaguaaauaaauaaaugaaaaaacaaacaagcaagcaaauaaauguaauaauuuauuuaaagacaugguaagcaaacagaagcucuuggucaugacagaucugucacacuaguugugaugaugauuccuugagucuaugcauaugucuaaacucaucuaguugaaugcaucauacauaugcauagcuuuuuguauauaaaugauaccccaauaaauauauuuaaaauaauguaggggaaauuuuaaaaaauaauggugaugagccaucauuccaguaggugauauguucuaagugcuuagcuuaguucuuggccuccauugagugacuagaagcuggacuuugcucaaggccauucucuucagugaagcugauauggccucauuguuucuguuuaguuugaugccaauggagauggggagaucacacuggcagaacugcagcaggccaugcagaggcugcugggggagaagcucacaccccgggagauugcugaggugguacaggaggcugauaucaauggagauggcacuguugacuuugaagguaauacuuuggggaagaaauccaggaaucuacaccugugacuucucuaugugguucucccuccaguucaucuacucuauaaucuucuccaaguccucauuugaagguguguucucauuucauguguguugcugugauaaagcagcucacucacuggucuuugcucagcuagcuuucucauguagcccagaaccacuuguccagggaauggugcugcccagaguagacuggggacuccuguaccaauuagaaaugaaacauagacccacagauaugcccacaggcuaaucugauucugguaguucuucacgugagguuuccccuuuccagacaacucuugguugugucaaguugacaguaacuaugaacuaguacucugugggaucacauuugagggaggcaaauuuaaacuuggcuauaucaaguuuauauugugauauucucugaauuaagguacucagcaucuaguuauugccuucagguugggucaaaaucuauagucuauuuuucaauccaugccuauuuagccuacccagucuuaucuuuugcaaccaugaugugaauuggugugcuuuggggaacauguuuccuauucugcauccuucaacuucucuucccuguaaccuauguccugcccucuuguucacuuauaauacuuauaaauccuucaaggaaacaagccaacaacaccccuuugucaagaaucuccccucucccuugucugaauaaauuaagccugacugugaacuuuacaggacuuuuuguucuuuucuauggaacauaucuuguguuuguuuccaugcugcaggacagaugagugucucucucucccaccucucccucucucuggcguuugugugugaagucaauggacugugugugugagugugugacaugcacacucacacaauucagaaaaggguauuuggcauccugaucaaccacuuuccacuucauuccauggagacaggagcucucucugaacuugaagcuggguugguaguuugcaagccccagcaauuguccucuuuccaccuccaacaaaacuaugguuacagguucacaaugggauuuuuaugucaguaccagggaugcaaggcaagcuccuccuguuuuugcagcaaacacugauccagcuucccagucauuuugagugaaguuuggaaaucauaucugcucuacagguccccaaauggaaacuuaguaaaugugguggguaccugcuggaucuuaacagucucaaauauaccaugugcaucagugaaaguggggacaaauggagaugaggcuaucaaacagauuuaagccaacuauaaucaagggaaggauaggaugaccucaaaacacaguggggccagcaaguucaucuggaauuaagcguaaacaaagcaagggggcgaucuguuccugcaggguuuucuauuuacuguccacuugaucucaaacaggccaguuucccguacuaggcuuuuauuuuuguagaauggcacucuuccaggaacacugaaagauagaacaaaggcuagaaauauaacuguagguaaaagcauuuguugcccaaguaugagaaccugaguuuggaugccuaguacccagggcccugugccuguaacuggugguagguagggcuagaaagcagaaguucacugaaguuccuuggccaccagccuaacaaaaaauuggugagaagagucuggagagauggaucagugguucagaguauuggcugcucuucuagaagucacaucacccacagaguuucacaacuccaauuccaggagauccaagauccuuuuuugcucuuacugggaaugacauguacacgguacgcauguauacaugcaugcaaaauacaaauacacauuaaaacaacaucaacaucagcaacaacuaauaaagccccaggugcagugagagacccauuuucaaaggaauaaaauaaggaggauuacagaaggacacagggcauccuccugugcccucuacaugcaugcacaggugcaugugcaucugucuauacauucauauaacauacauaaacacacauacacaccaugaaauaaaguacuaauaauuucuguuuauaagcucuuaguauuuuaugaacacuauguccugagaguucaaugacuaauaucauugccugcaacauaggagaagcuccccaaaguaacuccaggugcuuuacagaggagccucacaggaaugguuguuuucuuuucuuucuuucuucagaguuugugaagaugaugucucguugaagagguaauagaagcuccagacaccugcugccuugucaacauggcugagcacuuguagagcacuggauacccagaauaccuuaaaggauggagggugggaguaggcuugccccaguauggacuggggugcaacugcaaacacuugcuuugcuucuugggagcagagacauauauagaagcaaguuuagaaggaagacucuauguauauaaaucugaauuauacuaggaucuagugccacucaagcaugccagaagcuaugacaucauuuccuaaucucuuucccaccacauucuccuuccaugacucccuugguuaaaagauggugugggaacuuuuucacaguccaaaagaaagaaaagaaagccuuucaaaaaguuacacacauagcuuaucuuuccccugacuacucuaaaaacgaccccauuuccuucucuugguaagagagugucccacuagucacaggguuauaaugaaaauccuaauaaauaucaguuuagaaaugucucaggaagaggcauucacaguuguguuuuuccaguuccccagaagcagagucugucacucccccuguaaacaucccugucccugcccuagugugagauaacccuggaggaacugagcuaaacugcaaaucuggauuaucaagguuuaguacaagcugaucccugcgaauauuuaauccccugcaaaaucagagagagagagagagagagagagagagagagagagagagagagagagagagagagagagagagaaagagagaauuccccaaaucccuagcccaagccaagugacugcagcauccuuccuggaagcccucugcugcuguguugaucuaucccuggcuucuccgggcuucuuucucuaccuuagguaguuugugaacuucaccccucauguauggaucuggacccuucaguugcuuuaucauucaagauaaagaauuugugucauaucuuccuccaagcuuuucuugcauugaaguucauuaucuagaaauauagaaaaugucaucugauccuugauccaauagcuucaauuuacaugacugaaauaaaguaaaaguagaagaagau

SEQ ID NO: 3567 - RNA, 19498 nt, Mus musculus
aaggucaaccaacucuagaauuuuaauuuaguuaaaaauaaauauaaagguccuucugucgguuggucuggaguggcgcagcaggagcagggccaugaggaggauaaaagcagcccccuugaugauugaaaaugaccaagcacccaccuaacagacgaggaaucagcuuugaagugggagcccaguuggaagcucgggaccguuuaaaaaacugguauccagcucauauugaggacauugacuacgaagaagggagaguucucauccauuucaagcguuggaaccaucguuacgaugagugguuuugcugggacaguccuuaucugcguucuuuagagaagauccagcugaggaaagaggguuuacaagaugaggauggaucgucuguacuuacacuguaaaauuuuaugauggaguaguucaaacugucaaacauucaugccaaagcuuuuuccaaagaucagaauauuguggguaaugcuaggccuaaagaaacagaccacaaaagucuuucaucgucuccugagaaacgagagaaguuuaaagaacagagaaaagucacggucaaugugaagaaagacaaaguggaaaaagccuuaaagacagaaaagcggcccaagcaaccugacaaagagggaaagcugaucugcucagaaaaaggcaaagugucagagaaaagccuuccuaagaaugaaaaggaagauaaggagaacauuuccgagaaggaggaggaguacuccggggaugcccagguguaaaaggagccugagaaggacccuguaaagaguccacaaaagaaccugaaggagccaaaaagaaaacgaggcagaacccccuuccauaacuccuacagcuguggauucaaacucucaaacuuugcaaccaauaacauuggaauugagaagacggaaaauaucaaaacgaagugacaccccauuaaagcgucccagacucgacagaaauucaccccaggaacagucaaaaaacgcucagaaaauagugccaaagacuuauccaggagacgguccuccaggcuguccacuagugggccccgugagauccuagauccugacucaauuguaccugaucugguucauaugguugauacaaacccucuacuggacaagucacccagugccaaggauucugcugaaggucagcugaagucuccauuggaagcuggccaggucucuucugcauuaacuugccaccccauuggggauggccugggggcugcagauuuggaauugaauugcaagucaaugggagaaaacacgaugaaaacagaaccuguuucuccucuuacugaggugcaggaaguuucaacuguugaaguuccaaauacuuugaagaaagcugaugacucugugaaguugaaugugacagcuguggaccugacuguuugaaauuuuuccgcaaggcuaaauugcugcacuaucauaugacguauuuccaugggauggagaagucaccagagccagaggagggcccagggaagacgcauguauagacucggggcucugcggugccugacaaggccagccaggagagccuaaccaggaagcgggucucugccaguucccccacugcaaaagagaaggaaaagacuaaagagaagaaauucaaagaacuugugagagugaagccaaagaagaaaaagaaaaccaagccugaaugucccugcagugaggacaucagugauacuucccaggaaccuucuccacccaaaacauuugcugucaccaggugugggucuucacacaagucugggguccauuggagcccgcagcuccaugggucagauaauggaaaccacaaagggaaauugaaaacuugugaggaggauaauuugagcgaguccucuuccgagaguuuucuuuggaaugaugaggaauauggucaagauguugauguggccaccaauccaggugaggagcuugaggacaacgaccgcuaugauuuugaggugguccgcugcaucugugaagugcaggaggaaaaugacuucaugauucagugugaagagugccagugcuggcagcacggggucugcaagggcuuccuggaagaaaaugugccugagaaauacaccugcuauguuugccaagacccuccaggucagaggccuggcuucaaguacugguaugacaaggaguggcugagccggggacacaugcaugaccuggaguuucuggaacagaacuacucccaccagaaugccaggaagaucguggccacccaccagcugcucggggacgugccgagagugauccaagugcugcacggccugcagcucaagaugagcauucugcaaagcagagagcauccugaucugcggcuauggugccagcccuggaaacagcacucgggggagggaauagcacaucccagacacauccacaucacagacuccaggagcgaggaguccccaagcuauagaacuuugaauggggcgguggagaagccaucgccccugccccgaucuguggaggaaucuuacaucaccagugagcauugcuaccagaaaccucgugcuuauuauccugcuguggagcagaggcuagucguggagaagagaggcucugcccuugaugcugcagucagccccucugugagaacggcgaugacucccucuccucucgccuaggcuggcccaucgaccaagacaggagcagaggcgacauagaucccaaacccagcuccccaaaggugagagaguacauuuccaagaaugucuugcuagaagagaugccugcgaggaagcugcuggacagagguggagaagggcuggugagcucucagcaccaguggcaguucaaccugcucacacauguggagcaggaugaggugaggaaccagauggacuccauugagaaggagcuggacaugguggagagcuggcuagacuacacuggggagcuggagcccccagagccacuggccaggcuucugcagcucaagcagcugcugacugaccugggcaagguucagcagaucgcccucugcugcuggacaugaaauuggccacccaagacauuuggagcacaguccuggcaccucugcaaggggagcuucccauauuuaaguaaauaaacuuagcaugcuggaugcacgugauacugacugacaucagggauuuggccaggagugugauggacauggggacaaagagacaauuuuggcugcuggaggacagggcucucuugaucuagaagccaacugcaaagucagcgcauagucuuagaaucccauucugugcacaucguugaacgaagcaagucuuugcacaucuucaauuggaaucgugccacugaugauaaacaaaaugagagccaaaaaaauaaacccuaguaggaaacaguuguaaauucaauuugcaguuuauuuaauugacuuuugagucagguagaggcauaugccaaccccuccgauuucucugccuggugugucaugugggcagcaggcacccaccgcuuucaucccuuagcuucacuggaaugcugggacuucacugugcagugcaguuuucugaaggcuggguccuuacugcucugcucccucaagacuuccuuuucucaccucaucucuugcaugguuucacgguaccagcgacaagguuuuauguuuuaacuccagagucagcugggcuguugcuuccacagccaagugaaacugcuaaaggaggagcuagaaucuugauguaaugagaaucuacaaggaauuccagaaggaagcagucagggucuggaacccaaaggacagcauuuucuacccacuuacuaauuucaacugcuucccaguucuauuuaaaguuaugaaaaaauguuucccaaaauuuucgaacucuuuuacuguaaagauuuguuacaaagaaggugggaaugaccuugcuuuaugucucaucugcaaacuugcaacucuguugcuuguuucccuccucccuggaggcugggguagcagucgccagccacuccacucuuucaauuccccaucuguguuacuuuaugagaugaagguaauuaugcugauuaugguccagguacaaccucuuuguaccuucacagagauguuuguguuguuucuucuuucgcagguucugguuccaugugucauugcuguguuguuugcuuaguuuuaucuuacuaggugaaauguaaaagguucugugcugugaggacuucauuuucaccaguuuuugcaucacuaucgguaaacuuuguuugauuuauccaucaacauccacagauucauuaucaguuuuggaaucuguaauguucuaggcugcaaauauuuacuauguaaacaucaaggagccaaugucaguagcuaccaacagcagcaccucucgcugccuuaggagugguuaaguuucaggcuuaacaggccaucauggccauaaauucaggcuuguauacagagaagcuuuagggaaugaaggcccuuaucuaaaaaucuguucaccaucuaauacaaaaugugcuguggagcaagcaugaguugaccugguauagcuuagggaaugugugauguguaauuaagccaacagagucccuuacaagaggccgcuucccacugcucacauugaugucuucuugugggaagaagugcuccaagaguacacaugccaucacgguucuggauaauuuaucauagagcuacauuuugagacuuguaugauaauugucugaaagggaaagaaacaagauacuuaaagcuacaacugugugagguaugaugauuguuauauuagauaccaauuuggggccaucaaaguggcuuaguugggagaggugcuugccaccaagucugcugaccugaguucaagacccaggacccaauagagagaauugacaccuucaaguuguucugugacacacauacacacaaacaaauguaauaaaggauuuugaauugaggcuuuucuuuuauguaacuacucuuuuuuuuuuuuuuuuuuuuuuuuuauagaagguacuuaacacaguucccacaguggcuccagccacugccuuuuuaaaaaaauauuuauuuauuuguuauauguaaauacacuguagcugucuucagacacuccagaagaggacaucagauuuuuguuauggaugguuguuagccaccaugugguugcugggauuugaacucaggaccuuuggaagagcagucggcacucuuaaccucugagccaucucaccagccccuuauguaacuacucuuaaguaucacaucuggggaagcuguaaucuugaaggcagucaguuuugugugguucaaagaaggaagcagaaacugaaugaugcuaaucuugccaugugguccuuacuggguuuaucauuuagguuuuguaaaggacauaaucugguuucauuuugacuuuuguuuuuagggaaacaaagcagacuccccauauucugauaaccucaguucuucccuaacuuaaagccauguugaggggcuacacucccaguuccugggucaaagugaauucaccccuaacuuggagcacuggaaucuguucuuugcaaacaauguuaucauuuagaaagaugugcacuaccuauguucugucuguuaaaaaaaccuauccaccuauagaaagucaccuugacaaaacaguucugguuugaucagucauucuuuacuauguaugcaagguggauccuggcugagccaacauugcacuguggaugcguaucuguguuuacgagcuauuagacagaaggcacuguacauaugaguguugcuuucaagcaauauuugcaaaacaugcaaacuucuguaucuggaaaaauaaaaccaguuucuuguuaaaauaaauaaauaaauaaauaaauaaauaaauaaauaaaauauuuugagugaauguccauuacuuuuuaugguacacucuuuauguuuuguuuuguuuuguuuuguuuuuuuaaacuugcuacaggaugcauguggaggucagagcacuuuuuucaggacucggauccuccuuccaucauacuguuucuggggacuaagcucguaucaucuggcuuggccccaagaaaccccacccacuaauaaaucuguuggcucuguuuuuuuaauuuuccucaaaucauuucuuuggcagcaugucaaaaauacuauuuucaaaggggguuaagaaaaaauagauaaauuugacuacauguuagaaagcaucuugaagaaagcaauguacgucacugagaaaaugaacguuaaaacuacggugaggaauuauuccaauaaaaaaaaaaaggaaagaaagccucuuaagaccugacacagcgggcaggcaagaugguucagcagguaagagcacaaacugcucuucugaagguccagaguucaaaucccagcaaacacaugguggcuuacaaccacccauagugagaucugaugccaucuucugguacaucugaagucagcuacaguguacauauguauaauaauaaauacguucuuuggcuggagcaagcagggacugagugaggagggccgacacagagugagcagcaguacuaaaauuucgauuuacaacaaucaggcacacaacuaucuguacaacuacaguguacucacauacauaaaaauaaacaaaucuuuaaaagaaaacaaaaaaagaucugacacaguacacugaucucacugggcaugcaguacuugggaccucuuggguccugagaagcaaaaacagacagcaaagucagcuuuccucacagaauuagaauuugcuccuuauucuggauacuucuauuucaauauauagcaaacacuauuuuuaaauguuucuuuaaucuugaaaauugcauauagguauacaauaaaauaucuauguuuggugguuugaaugugguuggccuagggagugacacuguuaguagguguggucuuguuggaggaaguaugucacugugggggugggcaaagauuacuuccugcuagacuccugaggaugccagucuucuccugggugcauucagaucaagauguagaacuuucagugccucuagccccacuucugccuggaugcugcccugcuuccugccaugaugcugauagacugaaccguugacaugguaagccagccccaauuaaaugcuuucuaugucuugaaaaaaaaagaaaaaagaguugucuugauuaugguaucuuuucacaggaauaaagcccuuacuaagaccuaccccauauuuucaccuuuaaacuuaccccuccauucucccccuuugcaauaauuuucaucaguggaggagauauaaggaaccucuaauucuuccaggguuaguggagggagucaauauauuauuucauuuuuauuuuaugaauaugaguuugccuaaauguaugucugugauucacauuaaaaucagugcccaagaaggacagaggaggguaucagauucccugggacuagagucacagauauuuuugagcugccacguggguacuaggaaucgaucaccuguccuccagaagagcagcuaauauucucaacugcugcacucucucuccaccaccaccaaaccaaguuugauuccuucaaauuuucuuuugccauuauuagguguacauacagagguugggugaugugcugccaacagaacacugggucaaccaaaagcaugcucauaggaacgucuauauccugaguggauauuggccucccauagcugcucagauaguaaacccuuucccuagucuuccucaaccuauucuuuggccacuccuugagaucacauagccauauccaaauggggaaaauuuguguaaaaauggcuuggaagagugacuugauaucuaagugaaguuuucacccuuuccuugaaugugagauucucaacaggcaacaagcccaccuggaaugagcuugugccaacaagcacaguugaacugguucagguuggugaugguggcagggaagguaaugccacauaacaccaggacccuucccaaauucaucucucuuuuuuuuuuaacaauuacuagauaguuucuuuauuuacauuucaaaagcuauccugaaacaacuacuagauaguuucuuuauuuacauuucaaaagcuauccuucccccgccuugcgccccuacccacucacucccacuucuuggcccuggaguuccccuauacugaggaauauaaaguuagcaauaccaaggggccucucuucccaaugauggcugacuaggccaucuucugcuacauaugcagcuagagacacgagcucugggguuacugauaaguucauauuguuguucuaccuauagggcugcagaccccuucagcuccuugggugcuuucucuagcuucucuauugggggcccuguguuccauccuauagaugacuguaagcauccacuucuguauuugccaggcacuggcauagccucucaagagacagcuauaccaggguccuuucagcuagagauucucucuucuaacucuuguacucuguuggugaucuguaauuccugacaucuuuccuagguuuuccauuaccagguuugccuccauuuguguuuucuuuauuauuucuacuuccacuuuuagguccuggaugacuuuauucaauuccuacaccuguuuaucuguguuuuccuguguuucuuucagugacuuauuguauccuccuuaaagacucuauuaucuucaugagauaugauuuugugucagcuuucugauuuuccaggucuguucuuguauucagggcuugcuguugugagggaacuguguuuuuuguuguuuucuuuuuaauuuuuuuauuagauuuuuuauauacauuucaaaugcuaucccaaaaguucucuauacccuccccccacccugcuccccuacccacccacuccugcuucuugacccuggcauuccccuguacuggggcauauaaaguuugcaauaccaaggggucucucuucccagugauugcugacuaggccaucuucugcuacauaugcagcuagagacacgagcucuggggauacugauaaguucauauuguuguuccaccuauaggguuacagaccccuucagcuccuuggcugcuuucucuagcuucuccauugggggcccuguguuccaucuuauagaugacugggagcauccacuccuguauuugccaggcacuggcauagccucauaugagacagcuauaucagagucccuucagcaaaaucuugcuggcauaugcaauagugucuggguuugguggcugauuaugggauggaucccuggguaggguagucucuggauaguccaucauuucgucuuagcuccaaaauuugucucuguaacuccuuucauggguauuuuguucccuauucuaaggaggaaugaaguauccacacuucggucuuccuucuucucuuuuuucuuguuuugcaaauuguaucuuggguauucuuaauuucugggauaauauccauuuaucaguaagugcauauauaaugacuucuuaugugauugggguaccucacuaaggaugauauccuccagauacauccauuugcccaagaauuucaucaauucauuguuuuuaauagcugaauaguacucccaaaucuuauuaaaugauguacuauguucagugugugugguucaugugugcaugagauuggggccauuuacaguaucacagaaguccuaacuguggucacacccuccaaaagaauauaagucucccuccuccagcaguaaugguucuucaguaugggaugaaaccuagagaccaugugccccaucagugacauuuuggagcuugacauugugcagguaaccacagcugcuauguguucauguuugucauaucauggugaacaauuugagauacauuaugaacacuuuuagaaauuacuuguucagcaaauggauucucucacauugcauaccgcuucugucccuuacucucuuucuuauuaagcauccauaacauaaauauucuccuuaagaacuccaagccugagccgggugugguggcacaugccuuuaaucccagcacucaggaggcagagguaggaagauuuaugaguucgaggccagccuguuuuacagagugaguuccaggacagccagggcuauacauagaaacucugucucaaaaaaacaaaaaaaaacaaagaacaaaaacaaaaacaaacaagcaaacaaaaaaagaacucuaagccuaggucauauauauauauauauauauugauauauuguucuguguuuugguaaaacuuuugagauagggucccauccuauguaaccauggaugggcugaaaauauacaagaaguucaggcuggccuuguacucauagagaucugucugcuucaacuuucugaguguugggauuaaaggacaugccaccaagccuggcucuuucugaaauuucacuacauggugaaggaaguaugggaaauaaguaugugcacaugagugauggagcacauagauggcagaagcccucauauuuccuggaacuguggauacagaugcuuaugggcugcccaaucugggugcuaggaauuguacuuggguagucuggaaaaacaauaaacacugcuacccucuaagccaucucuuccaacuugguacauuuuauuccuuaaacaauuuuauguagggaaacaauagagcaugaggacaguuuuaaauuuuucauucuuaugagaaucccaagagauacugguguguugucucagaagaggaauuuaaaaauacagagaaacuuuuuccucuauuggaaauguucuuaaaaugugucauuauuugaugaguaaauauacuucuuuuaaauuaauguuaagaaauuuggcaggauaugaguaauaugaaagcaaaaguuguguaaacaaggguggguucuaauuuucuaauuacgggggauuugauauauauauauauauguguguguguauauauauauauauauauauauauauauauauauauauauauauauaucaaaaaaugaaaaugaagauguccuaucuuggucagcaacgcuccccuaaagacucauagagugucucaugaaaauccuaacaccaggcaagagaagcccucuuuuaauuuugguugugguuuuccaagagguuucuaaaacugcuacagcuguuugcccuuaguggcaccagucugcucaggguggaaaguaaagccucauuucugaaaacaucaugcaguuucgacauaggccaagaggacccaagcugacugaaaugccucuucccuaaggaguagccucuacuuuaucagaaggagccauauaagcuucaaauagaaagaaguaaccaacacucuuacccagcuuugucacuuauaaacuaccacagugaucagccuggcaugguaauuuuuuggguguuguggcauguauaacuugguguuuaucaguaacccucuaauugggucaaccugcucagggagaguaaucauguguaauucuggaaaccuagccauuuacccagaggucaugaagucauagaucuuguaggggaaccuacaccuuuguguuuugaaaugaacauuaucgucagcuucacuauaaauaugucuuuauacauuccaauaugugcagaccucacuccccaucaaggaaauuucuccuugccaugauugaugccaugagagaaguccaaccaaucaaaaugcagaguugcuggcuccagucccaacacauauaucuacaaagcaacuccugcaccucaggcuaaggcaucauugcgggaaaggggggaggaauuuugcagugagauugucuccuagaaaugucagagaugcuacacccauaaagaagucucacuaacauaacuaaacaaaugcaauaccuauaggcauggaaacauguaaagaaaaaacucaugagaccucaacauuagaauuauagacacuaaaguaauugugagagugggagaaauacuuuucaccaggagaugagcacagcuguugucuaucuauuuccaaauugucagucuugaaaaagcauaaauacaaguaacaccguauagacugagcaaguuauguacuuaggaauauuauauaugcaucaacaaucaaagaaaaaaaagccaugaauuugaaagaguuuaagacgggauacaugggacaguuuggagggaagagagaggagaagaacgugauacaguuguguucucacaaguuaaaaauaaaaaaaaauaaaacuuaucuuaaauuaaaaauuaaaaucaugauuauaaacaagcaaaaacaaauaucuacauguuaagauaucauaaaugcaaaggccuagagauuaaaaacucuugccaacaauauacuaaugagguccugaggacugugucucaguagagcaccugccagauuuaccccagugaagaacucagugaaguagcccagagguagauagaacacccaucuaaaauucacuggugagacuggugacaugucucacccacccuucacuagcauaucauuuauauacccugggcucaaucucuagaauuagauagggggaaaaaaaacaaaacaaaacaauaucucuuacaaguuuuagucacacugccaaacuucaugacaaaguguuauuuaaaugccuacaaauccuagucaaauucaguuuucuguuuuaguucaaauuacaaaccuucugcugcuuccccauguuuuccucccacauaaaauugugguaucccuuauuuucccacaugugaggucgccuagcaaacauagauggcaacuaggaaccacaggacccaugaugaggcucuacacuccuucuggaaggcugguguguuacuucccucuaguggccacucagcaacauaacaguuaugcugccuggagccucuguuuugcacuggcagaugaagugguuugcuauuucuugugagccuacuggauuacgaaguaacaaagaaaaccagucuuugaggacugcaaaagacacaaguuacauuucuaguauccuugucaagugguucaaaacuaccuguaacucuaagugcauacaccccaacauccuccucuccuuugaggccaacuguguggacauauccacacaccacaacaaaaaacaaaugaaugaacaaacaaauaaguccauucagccugaguuacauaaaauacuggcucaaaugaauggauaaguacuaaauaauguggacacaggacaaaaugguacaugccuucaauuucagggagcagaggcaagaagaucuccauaagucugagacaagucuuaucuacaggcuacacaggacuauauaaugagucccugauucaaaauuauauuaugaugaggcgcuggagugacacauuagcagcuaauugcacugguuguucuuccagaguaaacaaauuugauacccagcacucaguaggguaugcacacaaccaucuguaaccugacgcccuuuucuggccuucaauagcaucauucacuaaaaggcuauauccuggggcuaaaaacuggauuugugcugcuuucugccagauguccugaggcuacaguacugagcucagcucuaaauggaccuucacuaauuuucuaaugucugucugccugucucucugccaaccugccugcuuaccugucuguguauuuuaucugcacugcaugugugugacuugugcccucagagaccagaagaaggcacaacaucaccuggaacacaugguuaugagccacuauguagagucugcaagucaaaccuguugugucuuuagcaagaguaguaauggcuccuaauaccagaucaucccuucagcaccuauguuauuuuaauagacuuaucuauuuuauauguuuaugugaaugaccugaauauauguuuauguaccaugugugugcuuuauagacacagagguaccuggaacucagugguggugagccagcuuguacaugcugaaaacugaacccaaauacccuggaagagcagccagugcacugauauuucucuccagcaccucauuuuuuauuugagccuaauaugcuuuuggguacuuuaaagucucaccaacacagcugcccaagagacaugcaaacauuuauaaggaaacacucacaguaccucaacucuauaggcaaccaaggaacacugagauaaggaggaaucaucuuccccagggaaaagcauaccaauuagugguccaauaccaaauggugaacccugaaaacauacuaguggcauuauauucacugaagagaguguacccaugcaauuaagaauaucuaucuaucuaucuaucuaucuaucuaucuaucuaucuaucuaucuauuuaucuaucuaucuaaacacauauaauaacaaugaaaagaggcuaugaauauuuugguuuuuuuucuuuuuuucuaaaauuaauuuauucacuuuacauacuggucauugccccauguacccuuuuccauaauccuccccaaucaucuccccuccuuucuccucugagaggguggaacacccccucucccugcuuauuucccugucccuggcacaucaagucucuucagggcugggugaauucuuucccacugaggccaaacaaggcugcccagcuagaagaauauaguccacugacaggcaacagguuuaagggcagccccugugccaguuggaagggacccacaugaagauugagcuauacaucugcuacauauguaaaagacauuacuagguccagcccaugaaugaaauggcuaugaguuuaaaugugagcaaaaagaaaugcaugagaggguuuagaaggaggaaugagugguggggaguaguauaauuauaauaucaaaaauaaaggagauuuuguaagguuuaucuuauuuuauuuauaucucucugugugucuuuauguguauaugcauauguucaaaagcuacccauaaaggccagaagagggugucaggaucccauggaacuaaguaacaacugguuuuaaguuaucauauggauccugggaacuaaaauucuguccucugaaagagcaccaaaugcucuuaaccucagauccaucucuccaguucccacuuuaauuuuugauugacuugcaaaaaaugucaugcauauggaaacuggguuugucagagugcuugccugagauucaugaagcucuguauucaauaaacagcaauaccuguaaucaugucauuagggagacgaaugcaggaagaacagaauuucaggaucauccucagcuacauauaguuugaagcuagguuggaguauaaagacccuuauaaaaggacuccagccuuuaaugcaauccuagaccuuagcacaacugacuccaugguggaaguaccacucaggacauaaaacucagaauguagacagcaccacuugccaaaaugaaaacaaagaucuaauuuuacaacauccauaguucagggaaaaucucuaacuguaccaaccuuaccuuuuggcuucuuuaguuugucuucugucuaacuguucuuguuaacugaagugugugaauccaugacaugauuauuuugcuuaaaagcucacccugaaacaggucaguguuacauucugacccagaauacuagugcaguugccacccugcucaaauauuuuucuaucgcuuuaaaucuuuaucugagcauaauccucggguagauaccccccaacucucagucucaaaacaaaaauaaugauuuuucccccucaaauauucuggcauguugaugaguagauaaaauacugguauacgaacaagaugacuggagaguggauuccagaugaauuauuagaagauggaagcagaaggaucagaaacucaagucuuguucuuucuuguaaauaauaaacuuugaccaggcugaauucagugaaaaugcuuaucaaugaaugagaagcuugaaugugcuggugcaugccuugggagacaaaggcagguggaucucugugaguuugaagccagccucuucuccaaagugaauaucagaauaucuagaguuucuaugcagaaaaaccgugccucaaaaacaaacacacacacacacaaaaacaaaacaaaacaaagcaaacaaaaaaaaagaagaagaagaagaagaagaagaagaagaagaagaagaagaagaagaagaagaagaaaaagaaagaaagaaagaaagaaagaaagaaagaaagaaagaaaggaaggaaggaaggaaaaaggaagaaaggggaaggggacgggaggagagggaggggaggggaagggaggggaggggaggggaggggaagggaggggaggggaggggaagggaagggaagggaagggaggggaagggaaaggaagggaagggaagggaagggaagggaagggaagggaaggggaggggaggggaggggaagggaggggaggggaggggaggggaagggaagaauccaggcccacccucuauguauucaaaacacuuguuuacucuauacaauccaaucuccaugcacuggugaggcuggagagucccaggucaccacccuugcuuccucucucaggcuucagguuuggugcucaacuauuagcaugugaaauaaucuccucaacaacccccagggcaaugcagaggcucuacaaguuuuugaucucucagagugccaggaagucuucuucccuucagccuagaggcaggaucugguuuaaggagagucagcauaucuguacacucccacuaaggcuaggauaauaagcaggaggggccagguguggugauucaccccugugaucccaguauucuguagugggaaacaggacagucugguauuccaagccaguuuggguuaagugugugauccugggccaaucuagccuacauaaugaguuccagggcagccaaaccuauaccuugagacccuaucucaaaauaucaacuaaaaaagugagacauugucugaaaacaaaacaagaaguagauagucaaguugucucagcaaaucacaguuucacuauuucacaaauuucaacuaagucuaaaaauaacaugaguucuaucacugaaacacccaagguagaaagagaaaaccaacuaccaaaugcugcccacugaucuccauacaugugccaggaaacaaguauaaacauacaaauguaaacuguaauuuuuccuuuuauuucaugcuuuaaguauuuugaauacaaaugaagauauguggccacagcaucagauaucccugaacuggagaaacagauaguuguaaucugccacauaggugcugaacauggaauccagaccuucuggaaaagcaagugcuuuuaacuggcagagccaacucucuaacucccaaaccaaauuuaaaagccuucugacagagacagcuuauuaccuaccccaucacaccugaucuaaauauguccugcucccaccaagaccuccugaacuaagaggauuucaauauuugcuaaaugggaacagcuaggccaaagagcuaguugugaggagggagacuguagcucccaaaugaucauaagaaggcacaaaaagggaagaagaggaugcugugugggagucucauguggaguguuagcaaccagacaucuucacagaacuaccccaaggaccuauugaugguaauauaaaucaucauuagcugccaaaaugugacauguuucugcuguuguuaggaguagaauaucguuccuaugcacaugcucuauauccucuuauaaaaagccaguacccuuccuccccaagcucuuucuccuuccaucuucacuuagaggcagccucugcauacuccuucucccaagaaaauucccaugugaggucugucagaugcugugacauaaaugauaacacaaaguauucagaaggauacagccuucacaaaaugaucacaaacauuuccauguuaaaauuguccagucuacauaaauuaaacugaauaaaaaucaucaaaguucuugagaauugacuauacugaacaacugaauaucucauauauauauauauauauauauauauauauauauuagguauaguuaggcuaugugccaagcacaaaggaugaucuggguuguggggaggagagcuggaguucaaggucaucuucugucuccuggaaguucaaggguagccugagcugcauuagaccaugucucaggauaagcuuuuaaaauguccaguauggaaugcugagggugagagaaauagucuucuucaaauucaaauugguauuuuccauuaccaaaagucagccuuacaaacacacauauaaguaagaguauaaggaauaagcaguguuuaucuaacacaguguguguguguguguaauaacuauuaaugaaaaaucuaugaauuugaaagauagcaaagagggauuaaugggaggguugaaggguuugagggaagaaaaugaagggauaaaugaggugaauauauuauaauaaaaaaauagagaaaauuucaggauuagggcuaaagaacaguaauaaggaauuuguaccaagugcauaaaacacagguucaguccucagccacaugaaauaaaucaauagaaauaauauccaaggguugaacauaaugaaagugaaacauuagaaaugaauauaaaugguugaaugcaaggcaagcaggaagaggccuauggggaagaagggaccaaggggacaaggaaguagggauaaugugaaaacaccaaaugauauuuauggauuuguauuguuugguuuuauuguauuaaaacaggcucucacugaccaacuaaaaagcauacauggguuggaccaaacuccucucccugaaaugugcagcaguugugcagcuuggucuucaugugggucccccgaacaacuagagugggagacgucugucccugacuuuguugcucaccugggaugacuugacuggccucaaugggagaaguugugccugguccugaagugacuucauguuccaggguggguuggaaggggaugggggacucuauuuuuuuucccucuaauaccacuguauugauacaccaaaagcuuuguaaauaguuuauuuuuggucuggauacuaggugaguuuuuuaaacuauuuuuuuucuuauaaaaagcaauuauuuaauugggacuggcuuacaaguuuaaagguuuaguccauuaucaucaaggugggagcauggcagcaucuaggcaggcauggugcaggcagaccugagaguuuuacaucuucauccaaaggcuguuaguggaagacugacuucaggcaacuagggugaagauccuaagcccacacccacagugacacaccuacuccaaccagaccacaccuauuccaacaaggccacaccuccaaaugguaccacucccugguccaagaauauacaaaccaucacauacugcucccuggcccccauagacuuguucaaacacaugagucuauggggggccauauuuaaacauagcauaaugcaaaaugcauuuaguccaacuuuuaaaguccucauagucuauagcagucucaacaagguuaaaaguccaaaguucaaggucucuuaugaauucauccaaucacuuaccugugaucccuaaauaaagaaaggaaaccaguugggcaaacuucaaacucugcaucuccauggcug

SEQ ID NO: 3568 - RNA, 1009 nt, Mus musculus
auaauuaagaaaauauuuaauaaaaaagaauuacagagacaaaguucggaaaugagacugaaggacauuuucaauguccaaggccucaaauuucucaauuaccugggaccuccugcuguguggggugcuggggcuggguggggagaguagugggggcagcuguuccucagcccucagguccugcuuggccuucuccagggagaaguagccgcucucuacccguacuuuccgaccaccauccacacgguccccacuuauggugcuuucaucuucuuugcuuucuaguccugguucccguggggugcaagcagcaggaggcuggcuuuggcugggacuuugagcuggacucaggcuggucccaucagguuggucuuuggcucucauuucuuccugccagaguguggauuugguggugggaacuuucucagcacugggaaugcugcugcugcuaccacugcugccgccacuacugcuagugacagccaucuuagcaggcccaggcuccugugggguagguggcucuacuuuccguuucuucuucugguucugcuuguugguucgaggauacaccaugagcaucucuaaccacccacugaugaucuccuugguuucugcccugauaaaauguuccuugucaggugucaggaugcagagggagaacuucugcccugugcgggccuccccauccaccacaucugugcacugguucauguugauggugcccugagggaggguguugggcaucucauccagggcauaucgcaagaggccaugcucauaaaggaugaagaaucgucgcugccauuuccgugaccggugcacuggguugucaaagucagugccaucuggagccaggagcagccagccaccauaaauggguuuugccugcgucagguccucgucguugagcagaugcgacucgcggggcuugaagcaguucugacacuugcucuuguugaagauguuggccugaaauuuccugcacggguuuuccuuggccgccgacaug

SEQ ID NO: 3569 - RNA, 1009 nt, Mus musculus
caugucggcggccaaggaaaacccgugcaggaaauuucaggccaacaucuucaacaagagcaagugucagaacugcuucaagccccgcgagucgcaucugcucaacgacgaggaccugacgcaggcaaaacccauuuaugguggcuggcugcuccuggcuccagauggcacugacuuugacaacccagugcaccggucacggaaauggcagcgacgauucuucauccuuuaugagcauggccucuugcgauaugcccuggaugagaugcccaacacccucccucagggcaccaucaacaugaaccagugcacagaugugguggauggggaggcccgcacagggcagaaguucucccucugcauccugacaccugacaaggaacauuuuaucagggcagaaaccaaggagaucaucagugggugguuagagaugcucaugguguauccucgaaccaacaagcagaaccagaagaagaaacggaaaguagagccaccuaccccacaggagccugggccugcuaagauggcugucacuagcaguaguggcggcagcagugguagcagcagcagcauucccagugcugagaaaguucccaccaccaaauccacacucuggcaggaagaaaugagagccaaagaccaaccugaugggaccagccugaguccagcucaaagucccagccaaagccagccuccugcugcuugcaccccacgggaaccaggacuagaaagcaaagaagaugaaagcaccauaaguggggaccguguggaugguggucggaaaguacggguagagagcggcuacuucucccuggagaaggccaagcaggaccugagggcugaggaacagcugcccccacuacucuccccacccagccccagcaccccacacagcaggaggucccagguaauugagaaauuugaggccuuggacauugaaaauguccuucagucucauuuccgaacuuugucucuguaauucuuuuuuauuaaauauuuucuuaauuau

SEQ ID NO: 3570 - RNA, 5209 nt, Mus musculus
auaaacaucucccuuggguuaccucauccaaacuuuauucaaccgggaacaccuggaaacauggcugccugucuucuugaagucuugagguggaaagggaaagcaaagcaggagggugggugggaaacaaugggggaauucagagagagagguggggaagagggcaggggggcagggcaggcugcgugcacggguagauucuggggaggcacccacagccagaauccaucucuggccugacuugguggccgcaggaacaucgaggaaagaccacaggucuaagacauuucaguccuuccugucaugaagcggcugccaaggaaggccggccaggagcuuucaggacugcagagaaagagagggaacagucagcuugagaggcagaggagggggcuguagaagggaaggcugagccagguguggcuggcaugcuauacaccuacagucuuaauagugcuacuucagccuccaaaugcuccuuucacagacgagccacuguguguggccgagcagagacucuaacuagauuccugaugcaaagcgugcugagagcagacaucgaauccaugggaaacggggcaugaugcccaauucuaggccgagggagaggaaccaaaaccaaggccgcgaggauggaaggauguaucuucuagguuguagggucagauauuagaacucagcucggacugggcccccucauacugccugguugugaagaaggcugaguuuagagcacaucugcaacaacuggcgagaaaacaaaaaccaaaggaaacccaaggcuccccucucaguguaagccaaccugacacaacugucucaaauuuaaaaaaaaaaaaaagaaugaaaauucagcuagcucagugguagagccccugucuagaaucccccagggaggggcugggggcguggcccagugguagagccccugccuagaaucccccagugaggggcugggggcauggcucagugguagagccacugccuagaaucccccagggaggggcugggggcguggcccagugguagagcccuugccuagaaucccccagugaggggcugggggcauggcucagugguagagccccugccuagaaucccccagugaggggcugggggcauggcucagugguagagccacugccuagaaucccccagggaggggcugggggcguggcccagugguagagccccugccuagaaugccccagugaggggcugggggcauagcucagugguagggcauguguaaggcagaguucaauccccaguacuaauaaaauaaaacuaagaaugugcugugaagagggaacagggcuguauuccagaagacaucagguuagacacaaguccuuggccugcucccacauggcauggcuccaggucauaucaaaggggcaaaggugacccagggccaaacugcuagggcucuuugcuagcacuuuguuguuagauuuuuuuuuuaaagauugauuuauauauuuauuuauuauauguaaguacacuguagcugucuucagacaccccagaagagggagucaaaucucauuacaggugguugugagccaccaugugguugcugggauuugaacuucagaagagcagucagugcucuuaaccgcugagccaucucuccagccccuguugcuguuagauuucuucauuuuauuuuacguguuuaguguugugccuguaagaaccugagcgcuuggugcccauggaggucacaagaacacaucagauucccuggaacuggaguuaggaagcauuggggaccgucacauggugcugggacuuggacccaggcaagagacacgguuguagcuggcaucgagcucacuguggagucaagcguaacucugaacgcuuguuccucaggccucucuaccuucaaaaugguggggucacaggcuuuucccaccacgucgauucuuacauguuuuguuucuguauguguaugaaguguuugcauguaugucugugcaccaugugugugccgugccuucagaggucaggaggggguugucagcuccuccggagcuggaguuauagauaacuaggaaccaccuuaucaauaccaggaacugaccccacauccuccgcaagagcagccagugcucuugaccaccgagacaacucuccagccucacuguuuuguuuuguuuuguuuuguuuuguucagacacggucuccugagguccggguugguuggcuucuaacucguggcaauccuucugcuucagccuuagagaugcucacucaaucccuccccuggugcuaagauuauagguggaagucacuuuaccccugcauuacucuauguguuggcgucggaagucugagcuucccgcaugguaggugagcacucuaccgacggagcaauguccucaacccaagcccaacuucccuuagcauccuccauuccugaaucaagaagggcacuuaaggcaagccccugcccccacccccaccccuguccccauccccuccccaguaccacucugcaaccuaccaaguaucacacccaacccuccuggcuccagggaccccugggauguggccaucucccacucuccacucagagaguccauacacagggaaagauacgacaccgcaagguggcacccucccccccccaaacagucucccuuaccccugccucuagggcucacuggcacugagccaaggcagcuuugauggcggucaccaguuuccggaacuugcucucuguauccacauagccaucaccucucugaggggcagagaagagaguugaacuaaucuccacacaccgaccaacccacacugacaccccacccaacccccacgaggcaggacucggauuuaccuucuuggaguggaccaacuucccggcuacugucacuucaaagaacccggugaccuggggaguccccucgccacacugagaaaauaaggcauuaagacggggcuaagaugaccucucugggauacuuucuccaucacaucccagggagugaagaacauagggcaaaaggauagagaggauuggccuaacccauucccacugccucccagucccaagggacaaacaaggcacgucaugauccuaugcccauucuaagacucacaauguccaggcauccggggaacucauguucuagcuucuccuugagcuggagguacuggagacaggguacagggugggggugggguuaucacagccaggcccagcaaaccccccuacccuacccacccugaccuacuucacucaccuugggcuuauagccucaagcuccacugucaggugaauccaggguugucgcagcccaccaagacagcauggauccaaggcaggacagguacccaagggaggcaggcaauagcagugcgaugaagguaaagagagacagagauccagaugagaacgcagagguaacaaagacccucaaaagaggggaagaugugcucaucacacagagagaugugugcgacagugcgaagauacauagaaagcccaccccaaacaaaagagccaagauggagaggcgggauggcaaagagaucacagguuccacauagagaugccaauggggagggaagcagggaaguaaauuaggacaaaugcugccucaguagaaucucacccacccacucccucccccgccuggcugucacucaggaauccaagcucucuccagcacccaguacaaaacauaagcuccccaaccccauguccccuaccucaggccauuuugggccuggaaucuggugcaguggccucaugggagccucaauuuaucaaagcaggcuguugaaagacauccugauaacuagggccugaucagaccccucaaggggguugggagggaggaggccacacccagcuagguggaccacggaccccagauucaaguuacaggguuaucgguaguaggaccucaggcuggcccugccucauuuccagccucaguuuccuccccuguaagauggagacagaauggcuggagagccccucaauggacuucaggggugcagaauccauucagcaagcacuuuucaaucacuuacugcaagccagcugauuaucagaugcagauggaggaaaaagucaucaagagaaaauggcuggucuuucuacgccugccucuagcaggggcacaauuaauagcgcuggcagguaacuaaccaacaucaucaccuccuucacacuacagaaggggaaacugaggccagaaaagaacugggguuaacagcaccggcacucacugaucagaaaccaguaagaguuuuuuguuuuguuauuuguauugcugggaaccgaacccaggaucuggugcaucucaugcaaacacucuaccacugagcuacacccucacccuacaaucuauccuauauuacuuuuucuuuucggggcacagggucuuacuacaucaccccgguugccucuaacaagcagcuuagcuggccuggaacuaucuaccugccucuacuuccgaaugcugggauuaaaagugugcaucaacaccaccacuccgugacucaguucgcccuuuucauguacacacugggaggugcgaccacuguuaacucacacuacaauccagguacgggacauccccagaccucccaacagcgcuuaugaguaaacccccaacuacaccacaccuuguauucucuaacucaugccgcucagugagggggaagggaaacagccugucgggaaggaaagguccccagagaaacccgaugcuacccuuccccuccccucagcgcugagucacguguucaaaguggccccaaguaucaguuuccauuuucacuggugagaugucacucagaugucagaugccagggaucgggcucaagucucuguuaccuccaucccacccgcuuggaaaucccucccuuugggucugaaauacagucaucguacucgguuaccagacccugguagauagggggaggggcaaagaaaagggugggagagggucuccuggcacaaagguuggggagcagagaaagggcacaacgagccgggagcaggaaaagggggaacugcagucacccggacuuaccaauacacgacucgaacggcgagcgccauagcugcacgucgcauccccgcacaacacgaggacccgacccacaagcaacaaggaccucaagcucugagcguggggccgugcgcacagccgacugccucacgagucagagcaaaccaagugcg

SEQ ID NO: 3571 - RNA, 524 nt, Mus musculus
cuuugcaucaggaaucuaguuagagucucugcucggccacacacaguggcucgucugugaaaggagcauuuggaggcugaaguagcacuauuaagacuguagguguauagcaugccagccacaccuggcucagccuucccuucuacagcccccuccucugccucucaagcugacuguucccucucuuucucugcaguccugaaagcuccuggccggccuuccuuggcagccgcuucaugacaggaaggacugaaaugucuuagaccuguggucuuuccucgauguuccugcggccaccaagucaggccagagauggauucuggcugugggugccuccccagaaucuacccgugcacgcagccugcccugccccccugcccucuuccccaccucucucucugaauucccccauuguuucccacccacccuccugcuuugcuuucccuuuccaccucaagacuucaagaagacaggcagccauguuuccagguguucccgguugaauaaaguuuggaugagguaac

SEQ ID NO: 3572 - RNA, 9933 nt, Mus musculus
ucuuuuacuuuuuuuuuuucaagacaugguuucucuguguagcacaaaucuuuuaaaaacgaaacacuuaggacuagcugugaugacaacaccuuugauuccagcagaggcaagcugauuuccccgaguuugaagccagacugaucuauacaaugugucacagcaaaaauaaaacaaaaacuuuaaaauuuauuucuuuguguguaugugcccgaguauguuuguaugcacacaaagaggccauaagaaaccauuggauccccaaaaccuaacuguauaugaggcugugaggacccgauaggagaacuggcuggggacugaacccagguccucugccaaagcagcaaacacccuugacuacugaaccaccucuccagcuccauuuuuucccuuuaagaauauaaacuugggccggguguggugacucacgccuuuaagcccagcacuugggaggcagaggcaggcggauuucugaguucaaggccagccuggucuacagagugaguucugcuuuuccagagguucugagguucagcagccacauuguggcucacaaccaucugaaaugggaucugauguccucuucugguguguuugaaguuagcuacaguguacucauauaaauaaaauaaucuuuaaaaauguacacuugguuuuuugccaaagguguuucuaaacaggaaaugaagagggaccccgaucuccuaaaaugcuuggaucuuggacacuuaacuggaauagucacuuaguuuuucugcuucaugaaggucuuauagauuccagucugaagugugugacaucuggauauaugaccuacugguuacaaacacuguuggaaauuaaaauugcaucaauugggcuggagagauggcucagcagguaagagcacagacugcucuucgggagguccugaguuaaaaucccagcaaacacaugguggcucacaaccauucguaauaagaucugacguccucuucuggugugucugaagacagcuacaguguacuuagauauaauaagccaacagaggucccaaauucaauucccagcaacuacaugauggcucacaaucaucuguacaguuacaguguauucauauacauaaaauaaauauuuuuuuaauuguaucaauuauacgcacuagcaaaguguggugguguuaagcugaaaucccagaauugggaggaggaagcaggaagaucagagguaacccucgguuacauaaaguaugaggcuacaugagaccccacccaagcaaaaacuacaaaaauaacggaaguucuaagauaaauagaaugccaagagugacagaugcaaccagggacaagagaguauuaggacaacuuacaauaggacacagguuaugagagaccacagugagaucugaaaauugagcaaagaucugaaggaacugaagaagaaacucaugauccacagaaaguggguauggcucaaugaagagaaguaggcguggcucagugguagaggcccugccuagaaucccccagugaggggcuguggguguggcucagugaucgaguguucauagagcugugcucuccacauauucagcacugaaggcagacugugguggagaggagcugugcuaagaccugggcagcagaggaggggcagaagaaaauaacaagaccccagcguuuggucacagaacuuuauugaggggcggggcuccgacaucugcacagcuacaaccugaggacagagggcagaguugagguggaugagcggacagcugcaccccacagccuuucucacuuaaugccccuucugauuugagacuuuugguugguucccuuaggcauccucuucaccccuacucuagauuccugagcgcccacugguugaccagucagaggguuugggaagggccugacacuggcagcuuucaaaagggaggaaggcuaagcuaccacggggcaagguagaccaugguucacagaaugucagccagccacaugcuggugggccucacuuacugaaucucacgguaggcccgcuucuccaccagcuucacuuuguauuugcgcuugaaccuggggaaggggaaaaugugaugagcaucccuuaucucaggggguugggggggggaguauggaagugucucaacccacccccccaccccaccccuauccuucccacaguggcagaucuuacuuggcucguucucggggcucaaucauauuucucuucuggaagcucuugaaccugucucggagaaugugaccuucuggcugugggacagagggucagagagacuuuagcaggguccuagauagcacugggguucagacagagcucugcaucuuccuaaagccuccacagaguacccccagcuacacccugcugagcuccagggggcucuauacugaagucaaugugugcuauccuagcuaggcucagaggacagaggcuacaacugcaaaaaauggaaaccucaaagccaggcuaggccccagcacagcuugaggagacucacuagggcugacaagagacugugacaaaaggccuucugagggucagaaacucacaccagcaccugcccuccccaccucacccugacccugugcccucaguccccaggcaauggcccaacuggcccagcccagggcagccauggugucgcccacagcccgaguaggcacggggagcaaggaugguuaucaucacugggcacagggucccuauaacacucugcuacccucauggcaaguaccuucaguguccugagugagccagacaacucagagcugagcugcacaucaaugucaggagccugguaccuacagaacacaggguugagacacucagggauuuggcucucacagagccaagaaaaaagcaugauauaacuugcagacccccauuuccuggagcccuagccugugccucacuugagccgucccagccuucggggcuugucagccucugccagucgccguaugcgccgcugcucccuccggcgugccaguucugccagccuucgggccaccugggccuugaucccacgcagccugaaaaguucuuggugcugaagccgggcugcccucagugcagccugcugcacccgcuguggacagaggguaagagcucagccuagugccacucugcccagggccuuccucacccagggcccacaaagccaugaccucuccuuugauggcacugguaucgggucacucgacagcuguuugcccugucacccacuucuguccgagggcccuguguggccacaagggucacagagcagggugcucaccagcuugcgagcagcuuucucccgccgccgcugcugcuccgucuucuucuccauccucuucucaggaccagcagcaccagugggugagaucucgguggucccaucaccagccucuggcugcccggcacggccugccucaugcucauccucaccaucagacuccuccagcaggcccucacacaucucccgaaacacggacuccuagggagcaggguggucagcaagugggggcaggugagguuacaggcgggugacaagcgguggauggggcucaccuggguggcagcuugcucugaggugggcagggccagcugucgcuccagcuuuucugccucuuucucacgcugcagcuccaccucaugggccucucgaagcagggccugggcagaggugagaguuuggggugaaucuaauaucagggaugucccucugauccuaccccaugccugagucuuagcgcugauccagcucauggcuccacccucuacacacgcccaguggagacaucugagcuacucucacccucacccuaugcuggguucugauuagauggucuggucccugaacagacaaauucagggaaggaagcagguggggccugagguaagggaggguaaaugggagcgaggacuccagacagugaaaccugcacuggguuaggccaggaacccacugcacacuaaccuggugaucuucaaagguuggguuguaggaggcuccugcaggaaucaccuccacugcaggcaccugggaaggcuugauguggaggcguuguggccgcuggaggaagacaagagcagggaggcaggaugaacuccaugccaagaaccaccaguguaccccuaaaaugccuacacugaagccccaagaccagugugagacuguuaagacguggggccugacaaguuaggauucagagaacugagucuuacuaaaggcuucacccuacacccuuuuccgugcucagcuuuccaccaugggaggcacugauaccaggcccuuccccauggagcaaaggucccuuguuaccugcccaccagcccaucucacaguuuuauugugagauauaaaggaccaggagccagacauuggagcucuuccaucuggggugcagggacucaggguucaugaggccaggaccucacacccugcacaggggauaccugacccuggaaugagcaaucccuccacaggaagggcuuugcaggccacaagacccacgagggaaaugggacagcaucugcuuuuccuuuuugaaagaggauuucucugcauagcccuggcuguccuggagcucacucugaaggccaggcuggagagccuucuguucccaccucuggagugcugggauuaaagggggugcaucaccuuugcucagcugggggagggggagcgugugacaugcugggucuauauacccuggcacacugccacauuggcugugcuguaggcccuccgcugccacagcaaaguaugggugacaacucuggugcccacgugguccaaaaguucccagagaacaugaagaccagaucuucacaucagaaaccucaggugaccagcgcccucuacaucaagcugucuugccccccccccccccgccccaucuagucuuuuuccugguauaggcccuacauuaagugguucccuacuaguucaaacuuccccaaccuggucccuugaguucugagacuacugucuuaggacuuugcuccccguacguacauggugacucagggcccacugcauacccguggcugcacaggucucuggcccugcucugccucguagcuucugugcauuaagccccucugccuauggcugccuugcucuuccaggucucuagccccaggggcuuuucuccagugcuggcuccuggccucccugaagccuggcuccuaagcucucauuuccuggagacacuuaacacagggaugugaaggccaagguuucuuccagacccacagggagaacacaucaccccaaaagugcuaagauuccauaggaccuggcccacagcagcaaacacuuagagcucaagaugauggccacaaaccaaccuccaaccuacagcgccagcagugagcacuggguuguuuucagacauuucuucuuuaacccacacucuacaguuugaggaaagaauggaggcacugagguaaggucaccuucccaaggucggucaucaugggagcuaggacagggacacagaccacuaggaugacaggcauggggaccaugaagaagcugcccucccuaccccacugcuugccuaugcaaacuuacccucacgccuuucuucuuggucuguuccagaaaaaaugcauccugaccaaucaaaggcguguccagagggucugcagggagaggagagcaacugcaaugagcuuucuagcagagaagggaguuugugccccagggacccuaccagucccuccauugcuaaaaaugacacugaaauccaggcaagggaaguugcucaggcucccagggccucaaaccacaucucgaugggacuucacaaaugggggagacugaagacugggaagggagccccacaagcaggaaaggauggcccugaagaccucagacucccugcuggaaguuugucaacauccacagagcaugcccguggaugccacacucuuggacagucaguguacaacauggacaacugcccacaccagucaugcccaccugcaagagagcagaaucacucacugucuggguuccagaggucauagaagggucgcucaaugauguccuggggcccagguuuggccuuuggugugggagggcuaaggagucgggccugugccuugcgcacaucccugggcaguucgcccugcuuugccaguuucucccauaacuccuccuuucgccugagcuucuuggcauuagggaccugaugugcgaggaugcugaguaaggaaagaguggcaacugguaaggcagcagcugagcaugaugagccccucccagcugggcuguuccugcugcucagcagccuuucuccugccugccucagcauagccuucuugucaacuggcucagcacagaaccucauacccacuacuacauuuagaucugagcauucacaacaccagaucccgcagacucccucagggcagcggagccugcuagccuguccucucucuccuagggcugacgcuucuuuaccccauagucccaguugguucaggcuacccugcugccagggcugaauccucuaagccacucuccagagacccagcuauacucuagucugcucucucaacugccuccaccacgccaucucccuacagucuucagggggcagggcuggaaggacucacucuuugggagcagggaucuuagaaugauucucaagggcaaggucaacccguaaggguuucuggagacgcugugacuucuucuggaccaagguccucuucuuucuugguucugcaggggacaaagaggggaagagacuuuaccuuaggccuccuucccucccuucauaaaccaauccccaacuucaggucaaccagggccugauggccuucaaccuagguaacacagccuaagguucccagacugacccuguucaccuacaagggaagauccuagauuaagaacccagagucccaagccgggcgugguggcgcacaccuuuaaucccagcacuugggaggcagacgcaggcuggucucugaauucgaggccagccuggucuacagagugaguuccaagacagccagggcuacaaagagaaaccccaucucgaaaaaaccaaaaaagaaaacccaaaaaagaacccagacucccagauccgauccaccacagccucggcaagcaggagauaggccuugugauggggacuaaguccccacagaccuaucuggaaggacucauagacaaagcagggaaaggaccucagaacuaacagggaagaaagagggcaggcacccaggaggacugagacgcaggcuguggcccucucuuagcacucugcuuucuacuuuccaaagcccaucaggagaacaucagaugcugcagaacccacuaaggaggccgaguacaguggugcacaccuguaacacuaaagcucuggagaccgaggcaggaggauugagucuuuggccagccugagcuaaacagagagaaccuaauuccaaaaaguuaacaggacacaggaauaccugaggaacacacacaaggccccggguuccaccgagcacugaaaauaauaaaagcagcagcaacaagccacaaaaagcugaauacugaacugcaggauggugcagaggcagaggcagaggcacggcucuagcuaccaagccuggcaaccugaggccaaucccaggaucaugggggaagaacugacucagacaugguacccuccagccacacacaugccagggcacauccuagauggugugcgcucauucaagcacaugcacacccuaacuagaaaugaauguaaaaacaaaaagugaacgcuagcuucuuuuauggauaaaacgcuauagguuggccaguuggcuccuaccuguaauccaagcacuugggaggcugagguaggaggacguuaaguuccaggccagccugggccacaccgugaccuuuuagguagccuacguacagaagaagaccuugucucaaaacaaaaacaaagcauagcuauuacugaaucaaaaaugaacauaacucagaaugauaaacgccauguuuccccuugcacacagaaccuagauuuaaaacuccaugaccuggccugaguggggcagauggaacccauuaccuuagauguuaacguccccggguccccacacagcuucccuggguucucccgaccuugucaagaagguuuucaugaacaggaccccuugacucacaucgugcauacuaaagugccuggcugcuggcaaagcugccagcuuguucugcaaagccacuggcuguccugcuggaccaggcacuggcuuguuuucaguaccugcugaaccaggcuucccauuuuaaguguuuuucugccuccuuggugaaaaccccacucagcaaagcaaucccuaacuugcccuuauuuucaugucccagcaggucccagcccaaguucugcuggaguaaagccaucuugccaagacauguuuccuuccuccuggcuaaaagagauccucuuguucucucuguuuugagacaaggucucauuguguaggccuggcuguccuggagcucacuauguagaccaggcuggccugcaacucagagaaauuaacguuguggguuaucaugcuugcuaucauauucuuuggggaagggggacaaaaaaaaaaaaagcugaaugauacagcucaauaaaaccaaacaaaaaugaacaacaggucaccuuucuuaaucaucucaagcuuguuucaaagccauucaaaguaauucuuuauacuaaagacugccccuucuagucuccagugguaaagcauaccuuuauuuccagcacucaggaggcagaggcaagcagaucuaaguuugaggccaauaugguauacaugguaagacuguggugaugaaccacacccagcacugacucggggaggcagggacagguggauuucugaguucaaggccagccuggucuacagagugaguuccaggacagccagggauacacagagaaacccugucucgauccccccuccccuccaaacuugugaucaagacuguuuccaaaaugagagagagagaaagagagagagagugugugugugugcuuugcuuuaaauuaugucaucaaugcagaucucacgggugcaagacucagagaaccaccagcacacaacuucauaagagcacuccucaccuuuucucuugaauccuguguccacgaagaagagcuuuucguuuggggccucugccaacaagccacugaaggauaaaaaugcagacuauuugccaaaguaaugcuggaaagauaacagacccuuaggggucuaacuuuuugggcccaucccaacucuuccucaaaccaugggcuacaccuggagcuuucacacagaauuuaaaauguaccacgauggggugaacguacuuuauucucuuucacuugaaauucaaacucuguagcaaaagguuuuaaugccagcacuccggcggcagaggaaacuugaguucggagccaggcuugucuacauaccgagugccaggucguccuacauagugaggcccuguuucaaauuuuaaaaaaaacuaggggaaaacuuaaacuuuguugggauuuucgcacgcuuauuuguuaaagauacuauugauaggucucccacaccgagccgggaugcccgguccgucuagcaccaggucgcaaagcgcacggccacgccaccggaagucccgccccacguacccggucgugcgcuccuguagccggacgucuuccaggaacuggucgaccucuaaccccagcggcuccucggcgagccuccuccagccgcgcuucuuguuucuggggccccgccgccgccgccucagagcgggauccaccgaggucggccgcagccccaggaagccagaguccgccuggcuucucgagccgcgcuucucaccgucccuguuaccacccgcagccaucuucuuaaaggaagagcuuagucgcucuaacuccgauauccgguuuggaacgugcg

SEQ ID NO: 3573 - RNA, 9933 nt, Mus musculus
cgcacguuccaaaccggauaucggaguuagagcgacuaagcucuuccuuuaagaagauggcugcgggugguaacagggacggugagaagcgcggcucgagaagccaggcggacucuggcuuccuggggcugcggccgaccucgguggaucccgcucugaggcggcggcggcggggccccagaaacaagaagcgcggcuggaggaggcucgccgaggagccgcugggguuagaggucgaccaguuccuggaagacguccggcuacaggagcgcacgaccggguacguggggcgggacuuccgguggcguggccgugcgcuuugcgaccuggugcuagacggaccgggcaucccggcucggugugggagaccuaucaauaguaucuuuaacaaauaagcgugcgaaaaucccaacaaaguuuaaguuuuccccuaguuuuuuuuaaaauuugaaacagggccucacuauguaggacgaccuggcacucgguauguagacaagccuggcuccgaacucaaguuuccucugccgccggagugcuggcauuaaaaccuuuugcuacagaguuugaauuucaagugaaagagaauaaaguacguucaccccaucgugguacauuuuaaauucugugugaaagcuccagguguagcccaugguuugaggaagaguugggaugggcccaaaaaguuagaccccuaagggucuguuaucuuuccagcauuacuuuggcaaauagucugcauuuuuauccuucaguggcuuguuggcagaggccccaaacgaaaagcucuucuucguggacacaggauucaagagaaaaggugaggagugcucuuaugaaguugugugcuggugguucucugagucuugcacccgugagaucugcauugaugacauaauuuaaagcaaagcacacacacacacucucucucucuuucucucucucucauuuuggaaacagucuugaucacaaguuuggaggggaggggggaucgagacaggguuucucuguguaucccuggcuguccuggaacucacucuguagaccaggcuggccuugaacucagaaauccaccugucccugccuccccgagucagugcugggugugguucaucaccacagucuuaccauguauaccauauuggccucaaacuuagaucugcuugccucugccuccugagugcuggaaauaaagguaugcuuuaccacuggagacuagaaggggcagucuuuaguauaaagaauuacuuugaauggcuuugaaacaagcuugagaugauuaagaaaggugaccuguuguucauuuuuguuugguuuuauugagcuguaucauucagcuuuuuuuuuuuuugucccccuuccccaaagaauaugauagcaagcaugauaacccacaacguuaauuucucugaguugcaggccagccuggucuacauagugagcuccaggacagccaggccuacacaaugagaccuugucucaaaacagagagaacaagaggaucucuuuuagccaggaggaaggaaacaugucuuggcaagauggcuuuacuccagcagaacuugggcugggaccugcugggacaugaaaauaagggcaaguuagggauugcuuugcugagugggguuuucaccaaggaggcagaaaaacacuuaaaaugggaagccugguucagcagguacugaaaacaagccagugccugguccagcaggacagccaguggcuuugcagaacaagcuggcagcuuugccagcagccaggcacuuuaguaugcacgaugugagucaagggguccuguucaugaaaaccuucuugacaaggucgggagaacccagggaagcuguguggggacccggggacguuaacaucuaagguaauggguuccaucugccccacucaggccaggucauggaguuuuaaaucuagguucugugugcaaggggaaacauggcguuuaucauucugaguuauguucauuuuugauucaguaauagcuaugcuuuguuuuuguuuugagacaaggucuucuucuguacguaggcuaccuaaaaggucacgguguggcccaggcuggccuggaacuuaacguccuccuaccucagccucccaagugcuuggauuacagguaggagccaacuggccaaccuauagcguuuuauccauaaaagaagcuagcguucacuuuuuguuuuuacauucauuucuaguuagggugugcaugugcuugaaugagcgcacaccaucuaggaugugcccuggcauguguguggcuggaggguaccaugucugagucaguucuucccccaugauccugggauuggccucagguugccaggcuugguagcuagagccgugccucugccucugccucugcaccauccugcaguucaguauucagcuuuuuguggcuuguugcugcugcuuuuauuauuuucagugcucgguggaacccggggccuuguguguguuccucagguauuccuguguccuguuaacuuuuuggaauuagguucucucuguuuagcucaggcuggccaaagacucaauccuccugccucggucuccagagcuuuaguguuacaggugugcaccacuguacucggccuccuuaguggguucugcagcaucugauguucuccugaugggcuuuggaaaguagaaagcagagugcuaagagagggccacagccugcgucucaguccuccugggugccugcccucuuucuucccuguuaguucugagguccuuucccugcuuugucuaugaguccuuccagauaggucuguggggacuuaguccccaucacaaggccuaucuccugcuugccgaggcugugguggaucggaucugggagucuggguucuuuuuuggguuuucuuuuuugguuuuuucgagaugggguuucucuuuguagcccuggcugucuuggaacucacucuguagaccaggcuggccucgaauucagagaccagccugcgucugccucccaagugcugggauuaaaggugugcgccaccacgcccggcuugggacucuggguucuuaaucuaggaucuucccuuguaggugaacagggucagucugggaaccuuaggcuguguuaccuagguugaaggccaucaggcccugguugaccugaaguuggggauugguuuaugaagggagggaaggaggccuaagguaaagucucuuccccucuuuguccccugcagaaccaagaaagaagaggaccuugguccagaagaagucacagcgucuccagaaacccuuacggguugaccuugcccuugagaaucauucuaagaucccugcucccaaagagugaguccuuccagcccugcccccugaagacuguagggagauggcgugguggaggcaguugagagagcagacuagaguauagcugggucucuggagaguggcuuagaggauucagcccuggcagcaggguagccugaaccaacugggacuaugggguaaagaagcgucagcccuaggagagagaggacaggcuagcaggcuccgcugcccugagggagucugcgggaucugguguugugaaugcucagaucuaaauguaguaguggguaugagguucugugcugagccaguugacaagaaggcuaugcugaggcaggcaggagaaaggcugcugagcagcaggaacagcccagcugggaggggcucaucaugcucagcugcugccuuaccaguugccacucuuuccuuacucagcauccucgcacaucaggucccuaaugccaagaagcucaggcgaaaggaggaguuaugggagaaacuggcaaagcagggcgaacugcccagggaugugcgcaaggcacaggcccgacuccuuagcccucccacaccaaaggccaaaccugggccccaggacaucauugagcgacccuucuaugaccucuggaacccagacagugagugauucugcucucuugcaggugggcaugacuggugugggcaguuguccauguuguacacugacuguccaagaguguggcauccacgggcaugcucuguggauguugacaaacuuccagcagggagucugaggucuucagggccauccuuuccugcuuguggggcucccuucccagucuucagucucccccauuugugaagucccaucgagaugugguuugaggcccugggagccugagcaacuucccuugccuggauuucagugucauuuuuagcaauggagggacugguagggucccuggggcacaaacucccuucucugcuagaaagcucauugcaguugcucuccucucccugcagacccucuggacacgccuuugauuggucaggaugcauuuuuucuggaacagaccaagaagaaaggcgugaggguaaguuugcauaggcaagcagugggguagggagggcagcuucuucaugguccccaugccugucauccuaguggucugugucccuguccuagcucccaugaugaccgaccuugggaaggugaccuuaccucagugccuccauucuuuccucaaacuguagaguguggguuaaagaagaaaugucugaaaacaacccagugcucacugcuggcgcuguagguuggagguugguuuguggccaucaucuugagcucuaaguguuugcugcugugggccagguccuauggaaucuuagcacuuuuggggugauguguucucccugugggucuggaagaaaccuuggccuucacaucccuguguuaagugucuccaggaaaugagagcuuaggagccaggcuucagggaggccaggagccagcacuggagaaaagccccuggggcuagagaccuggaagagcaaggcagccauaggcagaggggcuuaaugcacagaagcuacgaggcagagcagggccagagaccugugcagccacggguaugcagugggcccugagucaccauguacguacggggagcaaaguccuaagacaguagucucagaacucaagggaccagguuggggaaguuugaacuaguagggaaccacuuaauguagggccuauaccaggaaaaagacuagauggggcggggggggggggggcaagacagcuugauguagagggcgcuggucaccugagguuucugaugugaagaucuggucuucauguucucugggaacuuuuggaccacgugggcaccagaguugucacccauacuuugcuguggcagcggagggccuacagcacagccaauguggcagugugccaggguauauagacccagcaugucacacgcucccccucccccagcugagcaaaggugaugcacccccuuuaaucccagcacuccagaggugggaacagaaggcucuccagccuggccuucagagugagcuccaggacagccagggcuaugcagagaaauccucuuucaaaaaggaaaagcagaugcugucccauuucccucgugggucuuguggccugcaaagcccuuccuguggagggauugcucauuccagggucagguauccccugugcagggugugagguccuggccucaugaacccugagucccugcaccccagauggaagagcuccaaugucuggcuccugguccuuuauaucucacaauaaaacugugagaugggcuggugggcagguaacaagggaccuuugcuccauggggaagggccugguaucagugccucccaugguggaaagcugagcacggaaaaggguguagggugaagccuuuaguaagacucaguucucugaauccuaacuugucaggccccacgucuuaacagucucacacuggucuuggggcuucaguguaggcauuuuagggguacacuggugguucuuggcauggaguucauccugccucccugcucuugucuuccuccagcggccacaacgccuccacaucaagccuucccaggugccugcaguggaggugauuccugcaggagccuccuacaacccaaccuuugaagaucaccagguuagugugcaguggguuccuggccuaacccagugcagguuucacugucuggaguccucgcucccauuuacccucccuuaccucaggccccaccugcuuccuucccugaauuugucuguucagggaccagaccaucuaaucagaacccagcauagggugagggugagaguagcucagaugucuccacugggcguguguagaggguggagccaugagcuggaucagcgcuaagacucaggcaugggguaggaucagagggacaucccugauauuagauucaccccaaacucucaccucugcccaggcccugcuucgagaggcccaugagguggagcugcagcgugagaaagaggcagaaaagcuggagcgacagcuggcccugcccaccucagagcaagcugccacccaggugagccccauccaccgcuugucacccgccuguaaccucaccugcccccacuugcugaccacccugcucccuaggaguccguguuucgggagaugugugagggccugcuggaggagucugauggugaggaugagcaugaggcaggccgugccgggcagccagaggcuggugaugggaccaccgagaucucacccacuggugcugcugguccugagaagaggauggagaagaagacggagcagcagcggcggcgggagaaagcugcucgcaagcuggugagcacccugcucugugacccuuguggccacacagggcccucggacagaagugggugacagggcaaacagcugucgagugacccgauaccagugccaucaaaggagaggucauggcuuugugggcccugggugaggaaggcccugggcagaguggcacuaggcugagcucuuacccucuguccacagcgggugcagcaggcugcacugagggcagcccggcuucagcaccaagaacuuuucaggcugcgugggaucaaggcccagguggcccgaaggcuggcagaacuggcacgccggagggagcagcggcgcauacggcgacuggcagaggcugacaagccccgaaggcugggacggcucaagugaggcacaggcuagggcuccaggaaaugggggucugcaaguuauaucaugcuuuuuucuuggcucugugagagccaaaucccugagugucucaacccuguguucuguagguaccaggcuccugacauugaugugcagcucagcucugaguugucuggcucacucaggacacugaagguacuugccaugaggguagcagaguguuauagggacccugugcccagugaugauaaccauccuugcuccccgugccuacucgggcugugggcgacaccauggcugcccugggcugggccaguugggccauugccuggggacugagggcacagggucagggugagguggggagggcaggugcuggugugaguuucugacccucagaaggccuuuugucacagucucuugucagcccuagugagucuccucaagcugugcuggggccuagccuggcuuugagguuuccauuuuuugcaguuguagccucuguccucugagccuagcuaggauagcacacauugacuucaguauagagcccccuggagcucagcaggguguagcuggggguacucuguggaggcuuuaggaagaugcagagcucugucugaaccccagugcuaucuaggacccugcuaaagucucucugacccucugucccacagccagaaggucacauucuccgagacagguucaagagcuuccagaagagaaauaugauugagccccgagaacgagccaaguaagaucugccacugugggaaggauaggggugggguggggggguggguugagacacuuccauacucccccccccaacccccugagauaagggaugcucaucacauuuuccccuuccccagguucaagcgcaaauacaaagugaagcugguggagaagcgggccuaccgugagauucaguaagugaggcccaccagcauguggcuggcugacauucugugaaccauggucuaccuugccccgugguagcuuagccuuccucccuuuugaaagcugccagugucaggcccuucccaaacccucugacuggucaaccagugggcgcucaggaaucuagaguaggggugaagaggaugccuaagggaaccaaccaaaagucucaaaucagaaggggcauuaagugagaaaggcuguggggugcagcuguccgcucauccaccucaacucugcccucuguccucagguuguagcugugcagaugucggagccccgccccucaauaaaguucugugaccaaacgcuggggucuuguuauuuucuucugccccuccucugcugcccaggucuuagcacagcuccucuccaccacagucugccuucagugcugaauauguggagagcacagcucuaugaacacucgaucacugagccacacccacagccccucacugggggauucuaggcagggccucuaccacugagccacgccuacuucucuucauugagccauacccacuuucuguggaucaugaguuucuucuucaguuccuucagaucuuugcucaauuuucagaucucacuguggucucucauaaccuguguccuauuguaaguuguccuaauacucucuugucccugguugcaucugucacucuuggcauucuauuuaucuuagaacuuccguuauuuuuguaguuuuugcuuggguggggucucauguagccucauacuuuauguaaccgaggguuaccucugaucuuccugcuuccuccucccaauucugggauuucagcuuaacaccaccacacuuugcuagugcguauaauugauacaauuaaaaaaauauuuauuuuauguauaugaauacacuguaacuguacagaugauugugagccaucauguaguugcugggaauugaauuugggaccucuguuggcuuauuauaucuaaguacacuguagcugucuucagacacaccagaagaggacgucagaucuuauuacgaaugguugugagccaccauguguuugcugggauuuuaacucaggaccucccgaagagcagucugugcucuuaccugcugagccaucucuccagcccaauugaugcaauuuuaauuuccaacaguguuuguaaccaguaggucauauauccagaugucacacacuucagacuggaaucuauaagaccuucaugaagcagaaaaacuaagugacuauuccaguuaaguguccaagauccaagcauuuuaggagaucggggucccucuucauuuccuguuuagaaacaccuuuggcaaaaaaccaaguguacauuuuuaaagauuauuuuauuuauaugaguacacuguagcuaacuucaaacacaccagaagaggacaucagaucccauuucagaugguugugagccacaauguggcugcugaaccucagaaccucuggaaaagcagaacucacucuguagaccaggcuggccuugaacucagaaauccgccugccucugccucccaagugcugggcuuaaaggcgugagucaccacacccggcccaaguuuauauucuuaaagggaaaaaauggagcuggagaggugguucaguagucaaggguguuugcugcuuuggcagaggaccuggguucaguccccagccaguucuccuaucggguccucacagccucauauacaguuagguuuuggggauccaaugguuucuuauggccucuuugugugcauacaaacauacucgggcacauacacacaaagaaauaaauuuuaaaguuuuuguuuuauuuuugcugugacacauuguauagaucagucuggcuucaaacucggggaaaucagcuugccucugcuggaaucaaagguguugucaucacagcuaguccuaaguguuucguuuuuaaaagauuugugcuacacagagaaaccaugucuugaaaaaaaaaaaguaaaaga

SEQ ID NO: 3574 - RNA, 20708 nt, Mus musculus
cagggggcgcccgaggcuggcgcgggcuaggacagggggccuggggcccgcccugcucgccgcuccuagcgcacgcggccccacccgucucacuccacugcggacaggacagagcucgggcugcuugcucugcgcuccccagaucccuggugagugcuccccaaaucccaccucucacccucgcuccccucuguaacagucugugcacucuccgucccagucgcucccaauucccacacuccaggacuacccccaccccuccucaaaucuucccucaaccuccucagaucuccccagccucucuuuaguacuccguauagcccccucccccucccccucccccaguucucccagucccuacccagccuucaucuuugaagacucccccuuugaaguggccuucuacccuccacacccaucucugcuccccuugguccgucuugccacccaagagccuucucuugccucucgaagugcauagacucuucagccaccccuuuuugagaugccccucagcugccucccugccugggacauuuccaggguucccucucuucaucuaugucacagguucuuccguccguuauuucucccaccccuccaauccauuuucuuuccacucuucccuuuuccuuuaagucacaaugauuuuauauuuugauuugcaacguuugggguuuuguuuguuuguuuugauauuuaaauugucccaucuuugagucagauaugguggcacacuccuugaaccccaagauguagaaagcagaggcaggcagaucucagucuaaggcuaaccugggcuacauagguccaggucagucagagcuacauagugagaauguagggggcggggaugucggagaggaagcuggugguggagaguucacugagagucagaacuggcugcucuuccagagguagagguagaggauggucccgaacuucuaaucuugugucugccugccuagugcugagauuacagauaugcacucugcccuacaugguagcucaaaaccaucuguuacuucaguccaggggaauccaaaauucuuuucuggcccccaaggggccaugaacauggaacacaggcauacauaaagacacauaaaauauuuuuaauaaaagaaaaaaaaaaggaaaaauugucucaucuuuggcuaaggagagccauuucaggcugagugcuggguggccuuugagcugacucagacuggcuuguuccuuccuaaccuccaagccccaggcccagccccagccccagccccagccccagccacagccacagccacagccacagccacagccccagccacagccacagccacagccacagccacagccacagccacagccacagccacagccacagccacagccacagcucugggacagcugcucuucuaaggagcccuccauucuuucugugaggaaugacaguuagagacuccaaucugaccaaaagcuggcucuucaaagucacuaaaauaagcgucuaccuauggagcaaggggagagacuauuacugacagccaggagaugcaucaacccagacaccacaggcucgugaaggcauugaggcacuacagagagcacggucuggcuuuaggggugcucacuacugcaagguuggugacaacuuucccccuaagcuuugaggccuaacaugggagcccagcuggagugcuuuccagcucgaugaacccgugcaagcuacugaugccuuccugaggcucaguuuccuccgugaaacaguguggguaagguugaggaauagcuggguuuguagagugcuugccuagccugcuugaagccugagguucuagcccccaacucaggauaaaagucagcaugccagugcacaucuguaagcucagagcuagggagguagagacaagaagaccagaaggucaagauuauccucuguucaagugcaucaugaaauacacaagacaugauaucaaaaagaaaagaccgccgggcauaguggcgcacgccuuuaaucccagcacuugggaggcacaggcagguggauuucuuaguucaaggccagccugaucuacagagugaguuccaggacagccagagcuacacagagaaacccugucucgaaaaaucaaaaaaaaaaaaaaaaaaaaaagaaaagaccuaauauggggguaaugguagagccaccagguagucaugaaaauuaagggagcuggcacaggguuaugaguguggcucagugauuaagagucccugccuagaaucccccagugaggggccgggggcguggcucagugguagagcccugccuagaaucccccagugaggggcucagguauggcuuggcuuuacuguguuugccuagcaugcucaagauucuggguucuguucuagcaucacaccccaaauaugagcuggcacggugucugguuuauaguuuucacgcaucuuuccaaugacaagacuccuccuggccugggugcaccuagguagccucuacagccuuguuucucaucccucuggcacugcauccccaccagacaauucucaacucccagcccccaagagccugucccacccuugggccuuuguacauaccauccucugcguaagaccuuugucuugccugugcuccacaaagaagcucagaagucagccuuucccaggccuuugcugaccccguggucaguuucccaugcccccucuggaugccuggaauucugcagguaucacuaacuguugggugcccaggcccucaguugugggcucugguuggaaggcaacuggacuuuauggcucuuaucuuggaugauagcuccugcagcaucgagcgagccaugucagugaagauauguuuaaugauggucaugugauguaaugaugcacggauuuagcaaugacuuucuuuggaugccuuuugagauagggucuuacacguugcccgguccagcuuugaacuucugaucuuccucccucagcuucccagggucacagauguacuuaacuauauccagcucagggaugcauuucuuccccagcaguuccuuccuuugcuauagucucucuuauuuuucaaagcacuuccucuucuugaacccagacagucucaugcuagccccucccccuccgucuuccuaucacuggcucggccugcuccucccaguaucuauagccauacucuagcagucuuccauuguguuccccccucuucuggcaggugagcucuccaccuuguagucuccuugggugacccagugggcaucgaaagucaccauguucagcuggcugaagaagggcggggcccggggccagcgaccugaggccauccgcaccgugaccucaucccucaaggagcuguaucgcacgaaacuucuuccccuggaggaacacuaccguuuugggucuuuccauucaccggcccuugaagaugcugacuucgacggcaaacccauggugcugguggccggccaguauagcaccggcaaaaccagcuucauccaguaccuucuggagcaggaagucccuggcucccgcgugggucccgagcccaccaccgacugcuucguggcugucaugcauggcgagacagagggcaccgugcccggaaaugcucucguuguggacccagagaagcccuuccgcaaacucaacccuuuuggaaacacuuuucucaacagguguggaaacugccagccaggaggggggcgagggacgucugucucagaauacuucuguccuucucagcuccgauacucuucuuucugccuacuucuuucccuuccugcgccugccccccuccccuauuggggccugggcuccaauugugccucugccgcugagugcugggcagccuuguucaagugacuuaacuucucugugccucuuauguucaucuggaaaaugaagguaacaacaguagugauuugggauaguccuagacacagauaguuuuauauaaauccauugaugccucuggacuuucuucuuuccuggacuucuguccucugcaccuaccguucuuuaugguaccauuagugucccuucuucauaucuccuuuugcccuccuuugcguugaccccugaccuucugucuccccauaucccagguuuaugugcgcccaacuccccaaccagguccuggagagcaucagcaucaucgacacgccuggcauccuaucaggugcaaaacagagagugagccguggugagugaggaggaagcccaggcugagggaggaggcugcgccccccccccccccgccccacucgugucuugcggaagaggcuggugucuauacacacaggucugagggaggaggcuuaggccuggacuucacuguguacaggaggugggcagagccuucaccuuuagauuuaauagaggagacuggggccuccuuugguugucccuuugcaggcaacuggagcuacagaagacaggcauuccuuccacaggacuggugguagggcggggagacacgagugaacacaugcgaacaggcugcugccacaugucugggcgggccaggaggguggaaagaaagagaagaacagggacagaaacugaggguaaggggcaggagauacucagaguccaggaagagacaggguugggcagggaggcccugggccccaugcuugucccucugagcuccuggcucagagguugggccacagaugaagcugagagggagaaucugggugggggccaagaccuggccuggaauuuauaaacagcugugcagggggagcggcggggaguaaauuccagcagagccuccagugagcacaucccuacccacucugccuacccucuuagucccgcuccuaucccagucucuguccccucccccacaccucccccauuccaguaucuggguccaaagccccucuguccaucccugacaccacccucaucucuaggucucugccagggaauuagggcaaaggaggcaacaguguggggcagaggggacccaaggccaggcgggaggcagggccagggcagggcuuuggcuccaaaagugccagugccccuggccgcuauccagcagagcagccccgagggagaaacacaggaggcagcugcagaaacgguugcagugcucugccagcuggagguggggggagcagcggggaggaauuccuggugugcuuagcccuuggguugggccuaaaugauggagggagcccaaggccccagcuuccacaggaggugaagaaggguggggauggggauccccuuccucuggcccuggaggcauaggagguggagccugucuguccagggggacuuguggggguggugagaacuggggaaauccugggaaaaguagugugugaugggugugggcugugugucugucugugguggugugugcugacaggcgugcauggaagccaugacucugaaguagugugaauugauggaaguaccucuaauugugacuaguugugauuuuaugugaucuggagagaagguguggggcagggggacauagagggauacugugaagcuguuuuauugcaguguuggugccuugaacacaguggacaagcaugccacgcccccagccccucacugggggauucuaggcaggggcucuaccacugaaccacgcccgcagccccucacugggggauucuaggcagggucucuaccacugagccaugcccucagccccucccugggggauucuaugcaggggcuguaucagugaguuacaugacuuacgaagugugugugcacacgugcauacacaugcaugucugaaucugucuucgucugugugaguuauacugugcaucuugaaagguguaaaauugccagagagaacuaacucauguggcagugcacauucuagugcugagaaagcugggacgggaggauugugacuaguucgaggccagccuggacaucacgguaauaacugcagcacaguguguguucaaacgggucuccauacuagagagugcaccaaucucucuguuugugauggcauacccauaucugugcaggucccagacucugacauaaauacgugucugggagccugugucuggcuccaggagacucugauguauccaggcuguuugaugcugggugugcacuggcagaaguguggcugacugccuggggaagcuugcccuggugugacuguugccuggagugucucucuggcacaccuccagucuggacucugauauauauuuuuuucauuuccuuguuuuugacacagagucuuguuccguaguucaagcuggucuagaacucacuaucuguuccaaauuggcccccagcugguagcaauccuccuaccucagcgguucuugcagugagaugacaggcaugcaccagugccccagggcuuuauuccuugaaacuauaacuuacacaagccaccuuguauuucugugccucgguuuccugccugagaauggggaggaugcuguagggacuucugagaaggguuaaauuagcugcaugggcgccugggugaugggcaaggagaacuguuuuucuugggugaacaucgcgucucugccacgucuccauucccaugcugacucaaccucccugucccuucucccucccuuucuccaucccucccuuccucccucccucccccucucucucaaccccaugagacacacuuuccaaauccaggccaggguguauguagaugcuaguggggggaggagaagcccagcugcugccccuacagugaccuggcccuuccuuccccaagaacaauguccuugcccuuccccucccaccagcaaggaccaggcugccccugagccuuuguuugggggggggggguugauuagcagcuauagcuacugaagcgacuccuacucuguugccuccuguguucauggcuucugugucucuguuuccucaguuggagaauggagucauaaauugcuugcuuauaauuguguuuugccagaugagugagucuguucuaccccugagcucaagucaggacaucagugaugguccuuuauccugucguuugcuggcucuauaacaucuccuccaggaaguccuuuuagauccacacuuaggccaggucacaggacucuagggaacucuccacagcuuccaggaaccucacauccucugaagaugaauucguccccugacucuaagggcagaguuggugucaccucaaccucccuuucugcuggcaugauggcacacaccauuuucaguuuuuccuagagauaagcucuguuuuuuaugugugguuguuuugagacaagguuucucuguguaguccuagaugucuuagaacucuggccuugaacucaccaagaucugccuugugcuggacuauaggcagccucaaccgugcccuagccugcccuuuuuuuuuuuuuuuuuuuuaauuuuaggggauaggcaaguucagaaagauuaagcuguuugccuaauauaacacaguaaaugggggcagggcagugauuccugacuggcaggucagggguaggucuuacgcucucagcucucuaagcuuugcucaucagugaaugcaguaagggaaugaguaagggugagaaguaccgaagggcaugaaugagagaaugaaugaaugagugaaugaacgaaugagggagggacuggaugcacacaaaaaaucgcauguguaugcuggcaagaacagagcacugcuggagagauggcucaguggguaagagugcaaauugcucuuguagaggagccaagcgccauuuccagcacccacgcugggccguucacaccacuugucuguaacuuuaccuccagggaaucugacaucuauggcuuccauggguaccggcacucauguguacaacacccucacacacacaggugcacagagacacacacagacacacacacacaaacugacacccacagauaccuauacacacagacacauacaaagacacacacagguacauaugcauacacacagacacacacagacauacacacagacacauaaacacacacagacaaacagacacacagaggagcagacaaccacacagauauacagacaaacacagacagacaaacacagauacauacauagacagacagauaacagacacacaaauauauaugcaucacacagacacaaacacauagacacacacacagaagcagacagacacagucacagacauacacacaaacacacacagacauacacugauaccuagacauacacagauaccuacacacacacacacacacacacacacacacacacacacacacaugaaaauugaccuagcacucaauugcugucacauucaccaagucccaggaagggcucuugucaggggcauggcaggugcuaugagugggcuuauaaguacugggagucucuuugagaucauuuuagcauuuuucuuugugacaaggucuaauauauagcucuggguguucaggaauucacucuguagaccaggcuggcuggccucaaacucaaaagagcccccaccugccuccgccuccugugugcugggauuaaaguuaugcaucaccaucucuagccacuuaggaaaauuugaaaaguauguguguacuggaggucuggcucugugguuaggagcacuugcugcucuugcaaaggacccaaguucauuucccagccacccaugucagguaacucacaaccacccaaaauuccugcugcaggcagucuguaugacacacucuggccucuguaggcaccuguacaaauaugcacagacaaacccacacaacccccccauacacacacacaaaugacaaaaauuuaaaauguauauaaaauuuguaugcauauguguacuagugugaauguacacauggaugcagguguccaggaggccagaagagaacacuagaucuccugguauugcaguuacaggaggugguaagcuaccugugaugggugcugggcaccaacuaaacuggggucuucugggggugcaguguguuuucccaacugcugagcccccaacuuuagcaucuaaaaguauuuuuaucaaacuuuauuucccguguggcuauaggugggaauaugccacagcauaugagaggagguuagaggacaacugcaagucguccgcucugagcugucuugcaggccccacgcuucaggauuuuaacugcccauaaauacauccguguuaaaacaaaucccuaaugucugccuagggaaugaaugaaaaagccaacgauauaggaaccaggaggguagaggggugaaggugagacagugaaaaggggugggggcaugguugccucauaucaggaagccagaaggcuugagggucuaaucaaaagcuuggugcugagaaguggcaguuaugggacacucauggaggcuccgggcuauuuggcauacacaggaaucacaaaguuaacgugagcagccggucagugguggcgcaugccuuuaauuccagcguuagggaggcagaggcaggcagaucucugaauuugaggccagccuggcccacagagugaguuccagaauagccagggcuacacagagaaauccugucuugaaaacaaaacaaaacaagacaaaacaaaacaaaacaacaacaacaacaaaaaacauucugagcauguguaccauccaguaucagcucaaaagaacuguuaacuuuguccccgucucuugcuugcuccaggcuacgacuucccagcuguccugcgcugguuugcugaacgcguggaccucaucaucuugcucuuugaugcccacaagcuggagauuuccgaugaauucucggaggccaucggugccuugcguggccacgaggauaagauccgcgugguacucaacaaggcagacaugguggagacacagcagcugaugcgcgucuacggggcgcucaugugggcgcugggcaagguggugggcacgccugagguccuucgcgucuacauuggcuccuucuggucccagccgcuccuugugccggacaaccggcgucuuuucgagcuggaggaacaggaccucuuccgugauauccaaggccuaccgcgccaugcggcgcugcgcaagcucaacgaccuagugaaacgggcgcggcuggugcgggugagcacaucggguccgccggaggacccggggaauuuaagggaggguugaaagggagaucaagagaugagggaggaagucaggaggcuguaugagcgcugaaggaaacugaggaggaauugggaaggacuuugugagucuauggaggacugaugauaguagacuuaaguuggaagccuugaagagauuggacagauuuaucuuuucuccuucuuuucugcuugugcaguuagguaggcgccaccuaggucccagaucaguuaauucuccugcuggauuggucuggugcagcguggacugagggagggaguacugugcaaagggucccucuuccaccauugcccugaguuugcauguuuccuucuuugaccuccucgcucuccuauuccacuaaacaaaagcugaguccucuuggugacugucuuacuuuucuauagcuguagagagaugccacggcaacuuauaaaagaaaccauuacugaugcucaugguuccagaggguuaaaguccaugaccauugugauggggagccuggcagcaggcaggcauggugcaggggcaacagcugaacauuuaagacagcacaagacagagagagcaggagagugcuaacugggaauggugugguccuuuuaaaccucaaagucuaccccccauaacauaccuacuccaaccaggccaugccucuaaauccuucccaaacaguuccauaaacuggggaccaaguauucaaauacauggacccaggagagucaauucugauucaaaucaacacagccuuucccuaccuccucgccucucacucccuucccaucagccacugcacuucacacugcccucaguccuaccucaggaccuucgaacucaacugcuugcucuucuggguagcccuugacuuugcauauggcucacucaaaugucaccuucucaggaaggugccacuccuuuaaugagcguaucugcuccagauuuacuccuaacccuauugugauaucccccccccccacagccccauguugucaucucauaugagccugucagggggccuccucaacuccacacucaaguccucagauaccuggcaucuuagaauuccuucagugagugucuccagugccugggucugaauugcucuguaaauauuuauggaaugaaugacacuccggggaacuucagcuugaacaaagucacuucugugccuagcccucugcugggacaugccggggaugcagcaauggccaggccaaggcuguucuugcccuccccaauggggcucuaggucugaaugccccagggcgguuucaggacccagucuuugcuggagaagacagacagauccaucccguaacagugauagccaagcaaggcccagucucagggcuggguggaaucaggaagguuuuguagaggaggagggccuuugauagacagugagacuggggagauggugggagucagagcacugccgagccuauggaucuuaugauuuuuuuuuagggguaccagggagacacaggaagguuuagagcaggacgacaggauugcacucaagcugccuccuggagagaggauuugugucuaggaagaaccuagugggauggaggacauagucugccucaggcugggcuccagagaggaagagggggccaagggcuuuacuuuuagagccgaguguggcauucacaagggaggccgccagagaggagguggagcaggaagcugggcagaagaggccaagaagguucuaggugguagaagcauccgaggugugguuuaaggagcuggagaggggugagucaccaccuccaaccccaccgcaggaauccucuaaggcagcaccagguacccaaggcgacugccccaggcagccagaacuguccuuaaauccccaccgacgucucccuuucccaauucuuuccuccuguccaugcucuuuuccuagucuucucucuucccaccucucccuuucuccuucucaguaaccccuggcccaccgucacucccccucugcaggacacucuugggaagcagaauucagagcuggggcccgcggcaccgggaccaaggagcggggccggacaccuggcgccccggccaggagggagguggcuccggaaacucaggacaaaccccggcguccgacccgcgccccggcccugcccacgccacccccuuaucucuuccugccaccuucccaugcuuccucucuggaaaagccaucagcgcucccgccugccucuuucugcuauggaagccauggcaggaccuccccuaccacgguccuggcagacucuguccucccauuugggccucccuggaaggccacgccccuugaauaacaagccacgccucccccauugccaguccuugcccauccucaggccgagccccucauuugcccauucucucagucagaagcuucuccauuaauucacuuuagcaggccacaccuccuccccauuggcucauucucacuggccacauccccacacauccuuccucauuagccugcuuugguagguccuguccuucccaagaggcccacuaucucaaacccuaacccucccguuggucagccauuccucauugcuuucccggcaaacccugcucuuccuuacugucuuuuucugcucaaccaugcaccuucuccauugacuccugguagcaggcggugacuuucauccugaccacaccccuacucugauuggccucucugaccuguaggccaugcuuuccucuaguccugcaaacucaucccagugccucucucugugccucagucuucaggguuggcucugaccaaacuucaugaugccaccccacuuugugagcacacccucccacaucccccucacaaaugacucagacacacuugguccggucaccaauaacagcacacguggcuuuaaccuaucuugaaaacgcucuccuuuguuggcacaaggccauuaaggccaaaaagcugcucauuaaggguccuugauaacccaccccagugccucaguuucauaucuguacaaggcaaggcguggaugaucgcucuggcucugcccguugguggaaguauaaaccacuagaaggggcgauuccagaaugcuguaugcuugcagacaagaucuggaaagaauuuaauuuuuuuaaaucacuguugaauguuuuugauuauuuuauuuuauccugugugagcaugauauaugugcugcacaugcauucauaugccacuuucuaucuauugaggccagaggacaacuuguacggguuuccuccuuucacgugugggucccagugacccaauucaggguuggguaugagcgucuuuaccccugcccauccauauccuugauuuauuguuucuccaucugaacaugcauuuucaaugauggagcugguuguaaacaacagacaugccugcgguucauuauucugccacccucgauucuuuuucaauaacuuaugagaauguaguucaaagguucucaaguucagugguuuaucccacaaugauuuccugagugacacugugcauauugucccaggacuggagacagaggaaacagacaaggccuggcagagcuuguagucugauggagggaaacagagugguuagauaaaauaacgauggcucccgcccaacugugaaaaagacaggcuggagauagucagauggcuaugacacgggcacucuucacggacgaacucagugggaccacugggacagagcuccuggcagagagcauggccauaugcaaaagcccuggggugggguaaaauguugacguacuggucguugagaaauacggugagcaguauacaacggggaaagacaagggagagacugugggugcagcugcagcagucagucagggaggggaguggguagcugucgagaugcucaacaguuuagagcacugcugcuuuucuagaggacgaagguuugguucccagcauccacauggcugcuuacaaucagcucugacucuagucccagaggaucugaugcccucuucuggcaacugugggcacugcacacacaugugcucagacaugcagaaaaaacacccauacacaaguaaaaguuuuuaaaugcaaaccacaaauugaagucuuucuaaccucagcauucaggaggcugaggcgggaggauugcuaguuuaaguccaacugaacuuuuuuuuuaaucuuugguuguuguuguuguuguuuuucaagacaggguuucucuguagcccuggcuauccuggaacucagaacgccugccucugccucccaagugcugcgauuaaaggugugagucgccacugcccgacucuuuuuuuuuuuuaagguuuauauuuauuuauuauauguacauacacuguagcuguugcugucuucagacacuuuuucuucuuucuuuggccccgcuugcucugacccaaagguuuauuuauuuauuauauguaaguacacuguagcugucuucagacacaccagaagagggcaccagauuucauuacggaugguugugagucaccaugagguugcugggaauugaacucagaaccuuuggaagaguucagugcucuuaaccgcuaagccauucuccagccccaguauuugcuugaugaugucauuugcucuugcaacucaggagugguggacacaggccaucuuuguuugaaggcuuccaugggauggguggauuuuggacauccuuuuccagagcuaggcacagcuaagggccacuugcucugggcugaggccaagagccuuggagggaccaucaggcugugaagcuggauaggaaugcgaaccagagauaggcaagucccagcucugggcugguauguggguguggccaguuugcacgaacuuaaagcuaggaggagcuaggaugguuuagcagagaggggagcuuagguugaauuagauaagacaauaggauuuaucugccugucacagaaagugagguuucagucagacaugguggcuucaagcugcaagcucagcauugaagaggcugaggcaggaggaugguugcaaguuugaauccagucuggggugcguagugcauccuucucucacaaucccaagaggaaagcugugccuggggaugcacacuugucauccugaacucaggagguggaggauggaggaccagguguucagggccaggcuggguuagagagacccugucucagagagaaaggaaugcagguucccaggcccugcccacucccagccuccuccuggugacuguacuauguaugcccuucugcagguacacgcuuacaucaucagcuaccugaagaaagagaugcccacgguguucgggaaggaaaacaagaagaagcagcugauccugaagcugccugucaucuuugcgaagauccagcuggagcaccacaucuccccuggagacuuuccugacugccagaagaugcaggugcggagccauuccagacagggaggcaggguguugaggagagaguuuccuggggguucugagaauggagccuagaaggcuggagggcuguguggcauuuucauccagggggaccuggcuuuaugaguuagggccacagagugcagagaaaaccuauaauaguaguuaacauggaaguuacuuuuugcccuuauuaagucuccagacucuacucagggucaggcaaccuacuauggagccuaggaccacuauauuucucuuccaugccugcccaugaccaagaguucucaugguauuaauggcuacaggagcuccauucauugugccugcauuccagacagcaagaagagcaagagaagcugggcaguggcucagagcuuaagagcacuuacugcccuuguagggguccuaggauucaagccuuacacccacauugaaguucacaaccaucuauaacuccaguuccaggggauccaaugcccucuucugaccucaacaggaaccagauaugcaugcucuuucagaggaccccgauucaguucccagaauggaugguucauacgguggcucacaaccaucuguaacuccaguuucagggcaugugauacccucuucacgccucugugggguuccuacauaugugcaguacuuauguuggaacccauacauacauuugugcucauacacaaacauaaaaauaauaaauuuaaaaaaaccaaaauggaauuguagauuaagcuauuuuacauaaccacauacagcuuguggguaccauauuaaauuggauaaugcaacucgugcuuaaagacaauuggcuggagcuuagucacacggccagcuggcuguccugcaugcuaagaaguguagccuuuccaggcaggcgcucaggugauuuagcacacccagcuacucggaaagcugaagcaggaagaugacagauugaaggccgguguucacaccuuauaaagaccaugucucaaacaguuuaaaaucagagaaagagaagugguaguacauacaugcuugugaugacauuuguaaagugaaggcagaaaaaucagaaguuugagaacaucucaacacagugagguggagaguagcuuggguuagaccagacucuugacucaaagcguggauaacauaaaacaggacugggcucauuagugauagaguaucugccuagauuuccccucggccugacccucugaggaacugagggcguggccuugcgaacguggcccugaccugugagcuuuuccauuccucccaccaggagcuguugauggcacaugacuucaccaaguuccacucgcuaaagccgaagcugcuggaggcgcuagaugacaugcuggcccaagacauugccaagcuuaugccgcugcuucggcaggaggagcuggagagugucgaggcuggagugcagggcggugcguuugagggcacccgcaugggccccuucguggagcggggcccugaugaagcaauagaggauggugaggagggcucagaagaugaugccgaauggguggugaccaaggacaaguccaaauacgaugaaaucuucuacaacuuagcuccugcugauggcaagcugaguggcucuaaggccaaaaccuggauggugggcacaaagcuacccaacucugugcuggggagaaucuggaagcugagcgaugucgaccgagacggcaugcuggaugaugaggaguuugccuuggccagccaccucauugaggcuaagcucgaaggccauggucuacccaccaaccuaccccgccgccuggugccgccuucuaagcgacgacagaagggcucugcugaaugagacagcagcgacugcuggcucauccucccucuuugcccugcuguggcuccuccccagcuccaguuggcuacacggcuacacgcggaucccugcucuggcccacucacccugccugccuacccugccuggcuauaaggacuugagcggggagauucucucccacaccagacauucagugaaagcacuuauagaggaccaggggggagugacaagccuucucugucaguccuucacaccugcaccuucacauacacggagcuuaucacagaaacauacacagacauccauccaucauucauauaaagaccuguuuuuuuccuuuuauuuuuugaaagagucucacauaaccuaggcuacccuugaacuucuuauguagcugaggaugaccuugaacucuucaucuuccuggcuccacuucugcgugcuggaguugcaggcaugaaccaccaugccugguuugugcaguccugggguauguacccagcacuuccugcauacuaggcaagcacucuagcaacugagcuacauccacagccccauccagauauuuauugagcacuuacuguaugcugggcccugguggaaccgacucucaggagugugacaucuacacagucacacaaacacugauaccagcaagacccccuuuuauaguuaagcagcuacuguuacucagccaugcuagggcucccuacucuuuuaugucuucaggugucaggcucacuggugguucagagcagacacucagcuuccucgcuccucucaugaaccucucuuucgcuuuccuacccacaaauccuaaauucugaccacauccacuucacaaagauugugcagcagauagaaaaaccgcaacuuccuggcuccuucggggaugguuuccauuccccagagcccaugguuuccccagcgugugggguugggaaccaaaguaucuggccccucugcccaccuucagguccuauuuaaguaaagucccuaucaaagaccgagaccauggggugggaauaggagaugcuuuaccaaagcccagguuuucauggauauccuggggcauugggaauucucggugcuauagccucuccuccucucuacaggggccucacacacuuuaugucuuagcauccuuaguaccugacccuggugggagaaaaaaauaagauggggcgggggggggggcguugaggacagcuagaaggggcugaaaacccaagagugucuccuacggggccaauaaagccaaagcugcugcuugugucgcugucaggcuaucuuggggcggggaccccuaaggaagaggugccuggggaaccauucuggcucacaggggcggugcaguuugugacucaacucugcgcugacucagucucgggcugggggccaguccugcauauuuuccgaagaaaaguuacucagggcccuccccacccuugggacaccccucccucccgcuuuccgccuuggggccugggaacccaguucugggcguggacgaggaccagugccaguuuguguacaguuugcccuuagucuccaaagcaccuuccaacgcgcacugacacgaaucgaaugcaccagagcagauccuguagcccgagaccacuggguccuggaggaggagggauuagugugagagugcacaggacacugauccagcccacacccggugcgcccgagacacuuuggccuggagaaucucccgcccacgcacgcccugcuccgcagcccugggcgcccucugguggaaagguagugacucaggccaggccaucaccucaauauccugcccagggaugagcugaguucuacuuugaccccggggagacauguucccuccccgugccuccccacccccucccccuuuaggaguccauuuuaauuccagcaugccaaucugagccuggggcggggguggggagcagugugugcucaagucauuaaucccagaacagaggcagaggcaggugguggaucugugaacuggagggcagccuggucuacagagugaguuccaggacagcuagggcuacaccgagaaacccuguaucgaaagauaaaggugugguguggcuagggcuguaguuaacaguacuugcccugcuuacacggggcucaguuucccaccuuuugcaugaccugaaaacaaaacccuuuguagaucucuuuggaugacuaccacuuuccaggggccuggggaugggggauggguguggaggcagugauaguuggcuggcacuuggaugcuaggcaccaauauucuagauuuggaccuuuaaaacugaguucaugcaugcacaggucuguggaucacagaugugauggggucuggagauugaaacaggguccucuggaagagcagccagugcuuuuaacaucucuucaggccacauacucagcuuuuaaugauaaguuuaaccgcugaauaaucucuccaggccaauuacucagccuuuuuuuuguuaaguuuugggaacuuaaauucaggucuuuauuguuugcccagaaagcucucuuacccacugagccauuccccaacccuuguuuuucauuuugagacagucucucuacccuaaacucauucugcuguccaggguggccuaugaacuugccauccuccugccucagugccucuugaguagguagguaagguuaaaaaugaacagcacuacccagcuauuuuuuuuucuuuuagaguguguguguguguguguguguguguguuuuauacaggcaauuccauuggccugcuuucagggacccagccagugcuuacaucaugaccuacggcagccagauguaccaguagauguaaggacccaccugccaccccagcucucucucucugaucuccaccaccaauguucccucuccuucucuguccccucucucugcccucaugauucugccccccaucugucugccugucuaucuguccacuugucugccucugucccuucaccaagucccacaguacucuugcguuccccccaauaaaccuuuacacuaggucuguuuuaugguguaacuucucagggguacaccuuggccaggcccuccaaaaauacucccuugccacauuauauuucauaacggcguguaagcauauaugccaccacagcauaccuugugaaggucaagaacaaacagcuugcagguauuggcuuuuuccaacauauggguuaugaggauuaaucugaggcuuggcagcaacagccuuucucuacugagguaucuuggcagccccacacccagcaucuucuuuaauaaaaagaguuaaagaaaauuugacuggacuccgucccuuggcaguuacuauuugggaaggagggguguccuucaauggcauacacacuggucaguugccucugaucuaguaacua

SEQ ID NO: 3575 - RNA, 19540 nt, Mus musculus
cguguugggggggggggggucaaggugcugagugcgguagccggagggggcgugccgggaggagagugccucgcagcuugagcccacugguugguucgcaggguucacgugggguggcaggccugggugacgucaacgcagcgggcggagcuccgcugagugcgcgguguccggggccugugagucgucgccaggcugugucgggccugagccgagcagcugcgcgacgucauggacaacuccgggaagcaggcugaggcuauggcgcugcuggcugaagcggagcgcaaggugaagaacucgcaguccuucuucuccggccucuuugggugagcaaugggcgaggcugggcccaaggcggggaagagcgggcucuucugcucugcacuuugggagccccucagcggccuugcaggcccuggccguggcccuauggcugacgacacccgcugacugguggccgcgccuuucccaggccggugcccguggaucugugcggcccaggcugccggggugaggacaccagaccgaggggacccgggcuggggcguccuugggcaugaugagccggaguacgaggugugagggugaguggggcccugcuaagagugacugauggcgaggccuggacugagagguggagacuugugcuuggggaacaagcaugaauggacagugacacugguuuuagccaagacaauggugaugggaggaugaggcacacaagagaaucauuagggugguaggaccaccgccuacuaggugguccucaagucuggagucugaacacacccaggagguggcaaauaccucacacaaaguuuaugcaaguuugccaucuucagccauauuaacuuaggagcagcagaacccaugcuugggaugcgauuccgagguuucuuuaucuuaagggaguaggucucucugaaagggcuuguugguaaaaacuaacugcagaaguuuguuaugaguauaaacuauguguacugugcucagaauugagucuggcccucugaaaggcucaucaggcaggaagaagcagacucagagaguguaagaugcugauggggaaaccaagaugguaggaauuggagugcuugaggggucuggggagagggccagagccuugggauauaggaggggguagggggagacgacacuacauggcagcaggcaaagcucuugaaggaacaggcagagaggaacacuggggaaagguccaggcagguguugaggaagagcugugcagggguaggacacaaaaucagaagccuccaaagcaaggauggaaggauacagaagacaaccaggaaguuggggaaagcucugggagagacuguuauaagcugggugaggacagaaagacaugaaggggagggagaggaugaagccaucccuuguuguuugccaucagauaauguuuagcaaaggaacuugaaaaauguuuauaccugcugcacagacaucugguuaaugacaggcuaugucaguuagaugagaauguuucauuagagagagugugaguguguguguguguguguguguguguguguguguuucuucagucuucacaagggaagaaguucagguuaggcgugguguuggggcggugccucccgcucaguuuucagcaguaguuuuccugauggcucagugucugaucucuuuggcccagagagauaaguguagaguugggcugcucccaggggagcagcuguguguccaccuguuuaccacuucccagccacugguagagcagagcuuucugguauaagguauacguuuguaucaugcacuuaaaguucuugagcugaaaagaaacuuugagaacuugagggaggcuuuuggugaggagugaagcugggaacaguggccugggagggcagucuaggcaucagggauggugggacagggacagagauggcuucuuagagggugggcuuucauccagggcugagcaggagaucuaggggacucucaguuggagagcagcagaagggagaagcuugagaaaaggcccagaagccugccugcugaaggaagaguuaguacaggcagaguuccaaggcagaccaugacuuuggggggugggggcuggacauagaugaagccugugagcaugggcuuggauuugagguacuggggagccugcgggauuuuagugagggccuguugcaguggguuccucuuuuacccuuuagaaaaaaaacacacacacauauaacagcugguuaugggacagugauguggaaggaacccuguuacagcaauaguggaucaugccugccaguugcucacucugcugcccagcccugccugggccagguagucaacuuuauguaguaugcacacuguggagguggguaaaggauaaagugggcagccuagacuugauuuauuugucuagcagcacaagaagcagaggggacaccagguggucagaccuggccccugggguuccauagcccccuccauuagccuagugcuucugaagcccagagacuccaggacacucaugccugcuguggacacuguguguagggaggguguuggcagacuaguuugaggugcugccucccuuagacugcugccugcccccacaguaguuuucuacaaacauuugaaagagcaaguggguuucuucugguccuuccaggaagacuagaggauguacuauagggaagugagcagggcccacuggaacucaggggccuuggaaguaccccaagaucaccuggagagaaaccaccaccagacgggcccaccucuuggaacuggggcugccugguaagcauuugacaagcagcccucgcucagcugcucucugaggcaucuucugcucuugggaaugcccgugacgacagcuuccccggccucugcucagguuacauggggcaaguaggcuacucucacccaucuucacccgucuagauuucugggcugguagacacuagggggcuuuaaaacaccauuuaguucaaggacaaagccgguuagcaccuucccuuggugaugggcaugccugccugagagucugauacccuuccccuccuuuugccccucugcugugacccauagggacugaauugguccugaaggacaguucuguucuguagggcucuuccugaucccuaacuucgcccuauaaccuucucuucaaaaacaaaaagacuagcacucgggaaccagaggcuggcacaucucuguaaauuugaugucagcuugguauacauagggaguuccaggacaaaccauuuccugugggaugccaguguggcuggggaguuucuuccuugacgagacaagcucagagugagcccuguuccccggauguuucuguagaguaagcaggcuggccgggagcacagggauuacugggugugaguaugagauguccacuggugucaucgcugcaaguugagcuggaggcucggggaaacuggaggagguggcagaguguucuguauacaaacagccagaugacauguugacaagcugguuccguuugagcugccugaagacaggcaccugcaaggccagcucuggaagggagucggacuccugcuugggaagggaggguuccuccagcugggcccacaggcguucugcagagccuggggcgauucugcuuugugucggcgccccugccaucuggaagaaguucacuguccuucccgguaggagccacagugcucaacagcugcaaggacacacagcugaaguacacagcaggauggcuccuggccagucugcagggcagguuugucggggaauccuagggcuccuggcuuagucacacagagguucccuggcaccuccuguguggaagaaguugcugagaggccggggcaaccccagcacuuuuuuuugaggaaagcaaaugucagcauucugggccauaaggagggagauccugucggggcacacagaggaggccuuccaggcuguaugagcaacaccugugacccuuccuugagcuggcagugugaugggacaguagacucacuauuaacuacaguguugucccaguguguccuccccuaaccacccuccacccccaccccccaccccacagacaucagcaucugcucagaucucuuccaugagaggggguagcguuuauauaaacaaaugguacccuuugagucacagguuacuuccuuaugcaaugucagcguggaaggauugccugccccccugugacaagggggaagcuaggacauacugaagacagcuauagguuuuuagaacauucgugauccugauggguccccaccaugggugcagacccagagacauaggccacuguccugucuacaguggcagauuggugcaggaaggggagacccgggacucuagaaacaaaggaggugugcacagcucacaagugaggaggccucagaacccacgcugagcugcugaaguggggaaacauuccuuagucugccucuguguggucugaugacagugacacacccgcaaggugcagagcccugucccugugacaggaaaggcaaggaugcaucacaacuacucugaaagcgcucacuguggaggggauuguuuccucugcucugcagccuccugagcaccucccaggcacugugccuaggccagguaccaagugugugcugucucucagauuucucccaggucagguucagucuauugugcagcugaggagaggcaggcucugggguacuagcccaaggucacagacacagacaagugccugaacaguuccugcuagucacugucuuacagacacaugugagaggguuccaagaagauuugagggcaugguggcgagcuggugauccuuucucucuggguccuccugccugugcugaccugugagggcuggcuauauaauguguccguuaccuagaggaugcuuggcaacuccagcaagagcagaguuguucugucagcagcccagcagugcgugcuguucucuguguacucaagaccggcaugcaccuggccacccucauuuucaagaggacacugggguacucaacaagggacaggcagugucagcuugcacaugcucccacaggucccccagcaacagcaccaguggagaacccugcugggagccaggagugauuguggcaggccauggguucauuguauuaguggaaacuaaguacccuggguggauaaucuggccagugagccuuaaguccuaggagagaacagggaaccaguggcuguggcugccagaaggacagaagggacagucucagacucgagacucaaacugggggcugcaaagggaaugaaauggcaugguucuggagcaagaaaguguucagggaauggaggcaggagucaggccggccaagccuguccugcagaagccccuggccacugccaaaagcgccugcacuucccuggcagcauucagcacuccauauggcagcugugccugggaggccugaggcugcuuccuccgccucuugggggagcagagcugagcgguaauuauagacagccugcaccaggccagccccaaccaguucccucuauucccagugaggcauggagcugugggcugaagagugcaaccgaggcagcuuggaggaggucagugggggaggcugucagcugucacaugcagcucuacccaaagccuucagggcgcagccagugagccuguggugccucaugcaggaggcauccuuucaguggucagcaguucuagucaggccacacaguaaagaggugacugaaacagcuuccccaagcuggugugggaagccuuggugagccagcagaggagcagcauagcacaguggaucugagggcaucuucuuucccgccacucucacucagccagacagagcaagcccucuacucuuucuuguccugccugcuccaaccuaguugugcuaugcccugcccuauccacccugcugacuucccuuccuugguuccucaaccauguuugcugacucagccucugcacacgcugugcaucucaccuccagugccacugaggaccgagcccuggccucacacccucagguacagcccucaugcuaagcagcugugagcacgcauauugauacuguggacagcaggcuuccuucucggugaacagccaucaucaaaccuucagauacuuguuuucacagcuaaggaauugugcauacggcuuucuucaggauuuacuggguaaccuacacaaguggauuugccccuugugacuuuccucacaucagcaaaaggaauugggacucuggagaucuucuguugccaucucacagaggcagggcaaggaccaggguaugauagggcaggaggcagccuggggccaaagcaggcaguaaucccucuggcuuccccugcuguagacaggucagcccagcuuagcgugggaucagagagcuucaggcagcggcuugguagacuuagugcugagucugccuguugugcugagcuaaagccaaccuagccagcagugacuguucaucaccacucugccucaggcuucuuggugacacuggacacaucugcucugccaggagcauuuggggccucagaggacuuaguucuacccaccaaguacugauuagcuggggaucacuggaaugugauguguggcugaugucugugagcagggacuauucagacaauauuccaaaggguggagagaugcacuuaagagcacauguuguucuugccagaggacccagauucaagucauagaauccacauggugacucacgacugucugugacuacacuuucaguauaccggauggccucagcugacuuucucggcacccagauggcaugcaugcauguaugcauacauacauacaugcaggcaaaacacucauucauaaaauacauauaaaaaaagaauuucagggauauagcuuaguugauaguaaguuuggcuggcaugcacaaggucccacguuccgaguaccacauaaaaucaagcauaaaggcuaaccucaguacauaacaaaauugaggcuagucuggguguugagauacaugagacucugucagagacagagaauaugaauauuccuggggcuccagguaucaauggcagagcaguugagcaugugccaggcucugauuguauuucuaguacaucccgagaaacauguacaucuaguacauuccaaagguccuuguggguguuuuacauccagguucaaggggccuuccugauuuauccugugcugacagcaacaugaacauuucugaccucaccauggcugggaguggcucaagagaagacagggucccaguaaugugggggagagggacauggagucagaggagaggguggacucugaggaaacacuuuaccuggugcuguuuggacucaggagaucuccaggcccacccaccuauugagcacaugcgcaggcauguucagggcugugggugcugccccacacugaucagggcuauguucugucuuagaucacacaugaacacaguagcccccacagcugugugauagagccaaguucccaauugucauccacgcugcaucuguuaacuuggggaguacagggcagguggugaggauaguguauguggcucuucaugaggaaauguuccuuuuugguuuuuuguuuuuguuuuuguuuuuuaaucauuaccaguuugggaagguuucaaauccguuugaugggauuggagaaugucaucaacugaucauguggugaugagaguuugaacuuuugucaggucacagucuucaugggcuagugcucguuggaagacugaacggaagggacuuaggcguuugagcuaguaaggaagcuccccucuccugcgcgcccaccuccccgcccucagcccagaagguucauaugaaccucuaggagguugagaagcaggaguaaagcccaaagagguaucccugauuucaaaauaucuacaagauacuggggcaggagauauagcucaguggcagaauacuugcuugucuagccaaagucagaugugacaguacaaggccauagugggcugaggagucuuagaucccuucccacuguguaaguuugaguccagccugggcuguauaaaacccugacccagcaaagagacuaaaaguccucuccacuugugcgucuccuaggcgacuacccuggcgcagugaguguacagggugguuuugcauuuccagaaugcuaugccaagugccuuugcacuucuucugguuugugucuuaggauaaauugcaaaugguguuguucauugcugggcuacagggucaaauauaaauccugauaauaaaacauacagugcuggagauagagcugaguuugccuagcauguaugaggcuguccccaggaccacaugggucuguagugcauaccuguaaucccagcacucagaaggcguuggcaggaagauccagaguuugaggccagccuagacaacaagaaagccugguuaaaaauaagguaauaaaauauauaaauuuucggaaagcuaagaugugcagaugguaaaaaacaaauuaguaacauaaauguguacaguggauaagccaccacccccagccccaguucugcaggcucuaccucagcaaacaaugcucuuacuagguuuggguauauuuuuccagaaauauucaguguuuauauaaauacguguguuuugggagcauuuuguauuuauguuuugugauaguguuucuccauauggcugucaugugccguaucugccuuguucugaagucugacaacacacucuguauugaggccuuucuggaaccauggccaugugcaaggaucaggguccugaggauccccccagaaugcuuugcagucuccucaaguacaggaaucuguagauuuccuaggucuaaguauaccaccuaggcaggaauuagaaggggcugaagaaucaggcuguggaggaggggaggucaggaaucaacaucaccacuaccaugggagcccacacacuccccucuagggauggcacuaacaaccuccucccugcagauugccuguaugcagggcuaagagcacugcucagcugacagcagggcagagcacggauuugcuuucugauagaagacuggaugaucucuucaucucuucccuucccuucuccccuagaggcucauccaaaauagaggaagcaugcgagaucuaugccagagcggcgaacauguucaagauggccaagaacuggagcggugcgugcccucagcccacaggccuggcccugcguguggccuugaaguccccucuucauccucaggaugccacagcaugagaccaaauggggugcuuugccccuugaguugggauggugguaggaugucuuucugagaggaggcauggaggacauucacuugccuccagaugagaucuuuuggggcagcccaucacuguguggagccuaccaagcuugaucuuauaguauggcuuccauugucagcaagguugaucaguaggguccagagcuacaagguaguagacucaguuauugccacauccuaugaguggaguucccaaagucuagcacuccaaggccuguuuuuuaaucacagguuguauuccugccccuccccauguucaaaacagaaagaagucuuagaccauuuguuccauguuuucaacuuuguuuuuuaacuauguagagaucuccuagaaauaauucaggagccaaguguuccagcacuccagagcuggggcaagaguuuaaggacccccugggcuacguuggggauuugagauuauucugcaauaaaagaaaaccugucucagaaaaccgaaacaguaggguaacaauggcaaguacugcuacuguuacugaugagguagucagauaaugguagcgcaaagcccugguaagcuuuguguguccugcuguacucaggugagaggcaagccaguccucccaagcucggcugggacuggaggaacacuuuagcccagcugaggugauccugaagcacugccacagugggggagaccugcugccuccccuuggccaggcuuggggaggucugugagcagaauaggauguccuggcucucaggcaugagcacuggcuuuguggacucuggcucuugcuguccauauccugucucccuuucuaggcgaggacucguaauagggguguaccugagagcuuuggggaguugaggagagaaauggguucaucuccccuguaccuucccagagcaccccucauacccuccccgucucucccuugcuuucuguuuagguccaggcuucccuguucaaggggagaguugcuaaacccaagagccuggaugucuuguauuugccaugcucagcuaugccugccuuucauuucucucuguggaagugguggcucugggguugcuggcacaggcuggguggaggguaugggguugguacuggguucacgcuggcugaacccaguguauaccugggacuaggcuucccaaggcagcuuucugacauccucauucaaccagaaaggaaacucucucugcgaaggcuaccauugggcuggagugggcugaucuuggccucuaccugggacuuuagcugucuucuugagagcccaaagugccuccuggggcagcgacugaagcugggacaaucuguucuauucuagcugcugggaacgcuuucugccaggcugcccaacuacaccuacagcuccaaagcaagcacgaugcagccaccugcuuuguggacgcuggcaaugcuuucaagaaagcugacccccaagguaagggccugugugagccacggauaaaaagcagcugagugcuguccccacauccucaggugucugugcagaucuggguuuuuccaguggcugacacaugauaggccaggagcaaaacaagcccuaacuucagaauuggcuggucuuuggcuggcacuggcguccugcccugcagguggcaccucucccacccuggugugcaaccaucacccccuccccggcuuugagcauuugggagugggaguuccauuucagacccacuuuuugccagggagccaggcaaagcuguucaguugucagaauuagcaugcagaagagagcagggcaguccaggaugagccaaguaaaguggaaaucagcuugaccucgcuucccugcacuccaggaagaagcagagcgaguugccagagcccaguuccuuaaagcagaaccuauggggacagaagccugguuuggacacagcccagugcauggacaucaggguuggauuuccugggcuaggggguuugcuuucgauauuuuuauucacuuauuuuugugaugcuagggauucagcccggaccucugaugugcugagaauaugucguacacauccccaguucccaggaugguucuuuuuuuaaaucuuagagccacauagauugcuaacuuuaaacuuuggcaagcagaggugucuaaugaagucauggugaugcgugccuaucaucuaagcauuugguagguagaggcagaaagaucagguauucaaagccauccucagcucuugguacaagugaguuugaggcaagccugggccuaugugagacuaagucucauaaauaaaaauuuaaaauaucuaggauuucuuuuccccuugggagaauggaaaagaagugaauauucuuuucaaaggaggaugcucaguguuugaacaaaggcccaccucuggggagaaggcaagcacccuguuuucuccagcaucagugaagagcugccauugucucagaaccacucccaguuagagagaugacaguguugacucugugccugggcugacuggucacuccugcuuguuuagcugugaugugguggggcucaggccuggcaagcagagcgagauggaugagcucucaucgggcuaggacuuagauacacccaggggcucagggcagugcucuccuccacacagcuauccucgugcuuuccccucuuguauuucuggagauacugcuuggcaccugugccccucggcugccgcuccaucaggaguggccgggaggacuaguuccugggugguaguggcugccagcccgcaggaugccagagcgucaggagcucauugaacagaacuggaccucccagcuucuggucaugucauuuuccucuggagacccaggugugggcaauguggagguguacugaggcugcugcagccaggggugugaaggugcagaggguagacugcgagaggccugccuuacagggcagggaaagcacaguugugagagcagagcuucacacaacuauuaagggcuguuaaggacuagggacucaggcuggacagggagggauggcagcugugugacauccaguccuacugccagggugcccuccccagucacaauugcacagauggggaaaaggagaguguuugcaugggagacagggcucacagagaagaguagccaagcaggggaaggugcccgggaaccugagcucacuuccccuccccgaggaucccagggcccugggcugcaccaugaaacugcuuccuggcuccaucacucucugggcuuugcuuucuccucagugauagcguagaccuaccgugacgugugcauagcaguuucugauauccagaagggagcuacucugagcucuagagcuucccucauguggcuaguguccugggaaacagcuggaaggccaggggaggcuugaacacccaguuuauucaugagggaucucccuuaccugucugaucaccugcccuauggucucguccaucaucucuuuaggaaucucaccugaggcuuuccauuagcagcagcugauggccugagaauuuaacccuuugaaaguaggagccugcugugcaugugcacgggcagggaaauagucugucuucacaugucuucuaucuaaccccacgcccacugguguuuccuggaugccugcuauguauaagaugccuuuucauccauccccucuccuuaucggagcuugcaauuuguuccuguuuuauugugaaccgugcuugcuucuaucugcauauggccagggacuucaagguaaugcagaguugagcugggcucuguaacccucuaccugcucucuacaggcugaacacccaggaguguaggaacagaccuguggcaucagauaagcccuuuggugaaagcagauaagggugucagccugccacuuuccaagcuguucccagagcaaggagccaaggcucugugaauccauguuucuccccugcuucuguggcagagacugccccaccaaccgaucccaugccaacaggccuuagcuacugaaaucccugcaggaagcaaccucaucccaagagagcccaggcagcccuggagccuuccuagcacgugcucuauaguccuucuagacccuugaccggcuaugccuccccaaccccauucguugcccaguacuccccuccugagauggugguuagaagauacugagaguucauuuccaucugcuagaaugugccucccacucaggccucucuccuccaaauaacuuguuuaaaaaaaaauccuuuucccaauuuaaaaucuuagaagaaaugguacaaugaagguagccugguaccauccugguguuugguacagcuugcuauucaagcagccagcagggccaggaucuuuuggguacacuaaggagaggacagugcucuugagcugggggugcagagcccccaugagaguccccagugcucaaugcauccagccuucucuacaggaggggccagucaggccaguaucaaggauagggccugcucaaaguaaagccuccaaggacagaugcugagcacuguagccccugccccagcuuagcacuggcugucaguuugcccuuugaugguagggcuuugauagucugauucagacucugugggagucucacugugccacugugcccugauccugcuugaaagcugggaauauggcugccuaagggagagggccucccuggaaagaugugugcaguaugucucguaugcagaaauacccacucugaccagguugcccggggccuaggucucccauccuuuccuuccgguugcucuggagauccuaagagcccugaagcuaaggcaaccacgugccugucaucucccucagggaguacagucugccuccugucuucaggaccugcuauaaugaccucuucaucuucucuuugcucccuagaggccauuaacugucugaugagagcaauugagaucuauacagacaugguaaggguugcuugcugauccugccuugcucuguccucuccuguuuaugcugugcuuuagagggcagggauuugaucgcugagcugagcuacagaacggggugugugcugcagccucugcucauguccucaugcacaugcugccucuguccccuucgugauccccuuguggcugcaguguccaugcaguacuucccuugccuggcccuccccugaugucccuaggagccugagaaaugcucagucucccccucuaggaaggcuacuauccugagagacagcugcuagguagucggccacacgaggccacugcucuuauuaguucauugcuguccaucccuucaugagucgucucccugucuuguguggucagacccuuuaccgaggugggaacccaaggaggcuggacuggauugggugagacuugguauggaauacaucucuggucacaucccuuuacugugcucucccccugcccccagggcagauucacaaucgcagccaagcaccacaucuccaucgcugagaucuaugagacagaacugguggauguagagaaggugagcugguaucaggcuggcugugccugggccucuggcgcuccuguucccacccaccaugaugcccuucccugugaucuuggaaggcaggggaggcuguguuaaagcacugcuccaccuuguccuccguuccaguugccccguucucaugucuccccaggccaucgcccacuaugagcaaucugcagacuacuacaaaggagaagaguccaacagguagccccuccccagccugccccuccucaugggacuugguacugucccuucaugccccuccuucccacagcucagccaacaagugucugcugaagguggcuggcuacgccgcacagcuggagcaguaccagaaggcuaucgacaucuaugagcaggugggcuuugccuggcugucagcuucugccacccaccucugccugccccagcccguccccacucuuucccagaccacucucaccaaaugcuucuuccaccuacaaccugucuuaggugugcccugccccuccucauuggcucugucuccagagcuggguauccucugcagaaaaaguaaggcaggaaggagaagaaucagcagaggagggacccugaaccaugggcagcagcaagugucaugugacacuguguuugggguggggcaggcuguggccgugggagaagggcaggcacuauuucucaugcucccacaacugccaccucucugcccacuaaaugccaguuuccugcgugucuugcaguggugcccccucgccacugacuugcuucccuugcuccacccacacccuagucaugucucuggucacucuggcaacacuucguaaccuugcugaacugucucuguucacugucauccugagguccccagaccucacaguaggguaugaccuucacccuugaguugccugccuaagcucauggugauauguggcuacagguggggaccagugccauggacaguccccuccucaaguacagcgccaaagacuacuucuucaaggcggcccucugccacuucugcauugacaugcucaacgccaaggugaguccccaccagccagaccaccuuuccaggcugccauugucaacaggccaagauguuccucagugucagaggccgguuuaucuacuuagccccuacccuuugguuaggauggaaaacagucuggaugcuuuucugaguucccagcugcuggcuggcuccuugcuggccuguccccuuuaugggacuguguauccugacugucccauuuaccuauggugcagaagcugcugaaccccaggcacaguuccuaccaagaccugggacucuuggugggacaacuuuaccuuuggcucuaugccugcccacuaaauuucagugcuucugggcaagaggucagagacagggauagcaaugguugguagaaggaucuggaaacuggacguuggcuuucaaucccugauagccucacaggggcuauaugaugucugguugccccacagucuccuucccugccugaguauagcuggcagcugugcauuugggggagguagaacaguuugcuguuuuuacuuucuguggugggcauggguucugagccucaugucugcuaugcaaaugcucuaccacugagccacauccuggccugcacugaugaauuaugagcacgcaguuggguuuugucagaauaagcugcacccccccccccaacucaccuaguauccccaguaaguuuucccacugccacugacccacucaaggcccucacaggguuccaugugugaaagcgcagcuguaggccuggcaugugcaguaggcucuuuugcauccuucccuacuccaugccuggaaagccugccccuuucuaccaccaccccugccaccuggacucagcugaguugggggugacaccaucaggcccgagucaggugauccuggagaccagggcaugaagcgucaaaucagaacugccagccggugguuuuggugcuccagucuuucuuagcuuuucucgccguuucucuccugcugcucagcucgcuguucagaaguaugaggagcucuucccggccuucucggauucccgggaaugcaagcugaugaaagugagcaucggaucuggcucgcccugaucuggguguggaugggcagggaagcccagaucugggucucagcugggguaaccaccaaaauugccucucggggcuguguuugauuugguuuucuccugccauccugcucaguucucuaccugaaacaaguacaguuaacgcagggaccguggagagaagugggcagggccaggaggugggcuuuccccugcacaugcaccacacugucccaacuggggcagaaccugucagugugggguccuccuugcaguuucaccccacaacaucugcugggucuggcugacucugacccuguuugcagaagcugcuggaagcccaugaggaacagaauguggacagcuacacagaggcggugaguggcuggcacagaaguucuggccaguggaucuucuccaacgugcucucucauaaauuuuacucuacuuaagccaagcagugauagcacauacuuuaaucccgauacuugggaggcagaggcaggaagaucucuguaaguucgaggucagccuggucuacagaacaaguuccagagcagccagggcuacacagagaaacccucucaauacuuccccauucccaaaagacucugcccuacuugaacucuaggcccugggccuugacuguaauuuucuuuccggugagucauccuggaacccucaguguuugccccacuuuauagaugguggcacaaaagcugaggagagacugguacuugccuuggucccuuggaauuucaguccaucucucugccccacaaaccagaaugucugaagagccugcccccguggacagcaaggcuggcuggaccccucugcugauuguuucccuuucccacuccacccugaacauuuguuuccaacugugucuaccuugguucucuagccaguacuugcugcugacgucacucucugggugcccucaguaaccaggccccugacuuggcacggaggugggagaggcaguguuuccaugccuccaugccucaauuccacccacaaagccagggugcuuggaggucuuuuaaacuacaagucuuuuccugccaacuuauacuccaagcuuugcaggcugaggugacagggugcucucuaggaaaccucaggacuggggccagggaggguuccaggagagcagugugucauggcucacccucucugugccauaggugaaggaauaugacuccaucuccagacuggaccaguggcuuaccaccaugcuucugcgcauaaagaagaccauucagggugacgaggaggaccugcgcuaggccuccagccacugccuuccacccaucugucuaucacagagguggagccagcaccucccaccaggagucugaaggagugggugcaaugugggccacauucuccagcaccaggcgagcucuccuggauggcuggucacccgcugcguccuucacccugccguuuauuuaagcccccagaggugcccuccugcccuggaaaguccaccuggacagauucuccaauucagacuucugugugcuucaggaaccagaggucagggucuggucccaucuccugaccagcaguguacuaaggcuguuuccauaucuccuaccuuguccccuagcagagauaagaacacagguagcucugagacuugcucucccuggcuggggguaaccucugccccuggagccuucccuuguuccuacaaugccaaccucucagguuagacccagcccuggagcucauggggugccuuggcccugcccugcgcaccugcuucucuccaugcauccaggucuaucgaccugaagcugcagcuggcccaaaaaggacaauaaaaccugccacuuuugcaugagccucuugagcugucccuuugacccucggugcccuucccuuuggaccuuggcuguccuggaggaguuggagguuucugcagcugagccucagaaccagagugcuuucuagaagcuguggacuggcccaagaugacgggagccucauacccauuucacccugcagggggucugccagggcuggccuccuuccaugggauugcccugacugaagcagacagccuaggagaaaaaguuggccuuccacacaucucgcucugcuccccugucccuccaguguccccaacagcuucauucaguugauaauuuggcccucagcuuuggagaacccugaggcuggaggcugacaacuuuuuuuaccaugggauugccaagaagccuugugagaaugucccagccugcugcucugguuaggcugagguuaauacccugguguuguggaagcuuccuaaguggcucagauacauacuaggguugaaaacaugguuucuaaguuucuacaugagucagaagcaaccugaagagaagaaaccgcacagcugggaaaauggggagagcuuaguguguaagaacacuuacuacaacagacaggaggacccaaggucagauauucagcacccaugcuaaaaacacugguuugaccacaugaacacgugagucugcaagguggggcagugacuacugcuagagccugguggccagaagccuggcagcagcuucaacaaaaggacccugucucaaaggaauaagagugacagaauaugaccagauaacugucuuccuguguauauggguaugcacaagauacaucuauuacauacacaaauaauaaaaacgagaggccaugccaaccugcaca

SEQ ID NO: 3576 - RNA, 1692 nt, Mus musculus
cggggccggggcucggugggcggggcuagcguucagaagcuccguaggccuccggcuucaacagaguaggaaccuuagcuccggcgggcagagggaugcuagugugcagagcugcagucggucgaagaaggaagggguucgauuagcgcggagagggcugagguagaaaacaggaauaggcgguuggaaaugugacagcuagggcgggagaagagcgagugggcguggccuugaggggguagagcuaagaaaucuugauaguggugggucagaggcgguaggggcgugucuaggauguagcugagcuggggggggggugcugucugacaaggcgugguccuggaaggggcguggcuugcuugaggcgguccuggggugggggcggggucggugcaggcugagugggcagcgcgaugcggggcucgagcugcgugggcagugguggcgagagcccgggugguacggggcugagcgaggguccccguggccgauggcugcggcucgccccugucugcgccuacuuccuguguguguccuuggccgcugugcugcuugcuguguacuacgggcucaucuggguucccacgcggccgccugcgggccccgccgacccccugcccagcgcugcggccgcuccgugugcucgagcagcaccgcccgccccgccuccggccgcacccgcauccuguuugcuuggggccuccggcgggccacgaccgcagccaggacugccacggagucgccgccacagucgccgcccagcuccgggagcgacgcgggagaccgcgcgccgagcgccuggauagucuggcccgcccccaccguggccugcgucugucuaucugcaccaccgggccucgccugcgcggcgccgccucucuccuugccgcgguccugauccugcccgaccuuauuccaccuugcuccuucccgggacucagcgcucaucggcaauaaacuccagccucagcuggcuuaccuggucuguggucguuggccucggccgcuggucccuucuagcuccguggccgcgcggccuuaaaggcuuuccucucucauugcucacauguaauuuuuggguuggaauggggagaagcggcuugccaguuuucggggccauugaaggucagauacuguaaaggccuuaccaguuuucggggugucaucucguauagcuucggagacaguggugcgugcuggaaacugcaguugguauaguuugcaauggcagggguagaggaugucacccguaagcuagcuuguccugguuuggguggugacauuugcugcuuuggaaguguggagcauauagcugaaccaaaccaaaacuggucugcauugcuguuggugccauguugagacugguguagcuucugauaaagaagucaugcgauugaguccauuuucccuuacccaugacuguggcuuggccguaggcaggccugggauauacucugcuggccagcugcaagaagggguuuccuuuauggccugccuucccccuaggcuggacagcaucaggaaccugaggccucuugucagaugggaguguuaccuguccugcugguucccuucuguccuaccagcaucccccacgggaugauguacagcaauguacuuaaaucucucuggucuuguaaaaggaagacaacacauuguugcucagaauuaaacuagugaucgaaaccugag

SEQ ID NO: 3577 - RNA, 9940 nt, Mus musculus
gaagugcugggaagacagguguaagugacuauguuuauuucuuuaacaagugucuuaucucacauggcugugugacacccuuucacagcgggcccagugcugggcacccauagguaaguaauauacucaguaaguuuggugacaguuugggugagacagagagucugucaagugccgugagagaugucuacggcuugggaggaggaagggucacuguuucaaaagggaagggaaauaaaugacuuuuagaaaagggaaaggaaacagaaacaacagacaggaugaaauagggugcagggggcugcccgggcaugucugugccaggagcacagggcugccucuuccccauuuguccagugccagauggguauuacgccaggcgggccagguguuuaaguucacgaguguaacccgccaucaagccauuuagcaggaaccugucucaggagugacuuugugagcacaggucugggcucaguuucuucuguaugugacuggcauguuuuguagggucagccagugcagucuaguggcugugcuucagcuauugcgggugucagccugagagugcuauuuggauuggagugugugucccucugaaccugccaggaaguuguucugagaaggggucagccuuuaguguagugugaaugcccuaggcaucuggggacacggguuugugcgucggagacuguuugaauauuguuugugcaacuacguuuuggguugucacugucugugugugacccagugagccaguaaguaagauaaucuggaugucugggucugugugagcucguguguccaggcccuuguccugauguguaucugugccucuggucugacuuugugucccuguggcucagucaucacugacucagugcacccuggcgugccaguccguuagucugagcguacuccucaggugugggugugggucccagucagugugucagugugucaagcguguguccggacacccuaggucugggcuguccccacgcugcuccuccugccuggaccaggccucgccccgccccucuggcugccgggaaaccccccgcgccgagguagggggcgcggcgcccgacugcaagccccgacuuguccccagccgcgggcggggcccuggcgucacgcgggggcggggcgugggagccagcgagaggcggggcggggcggccgccgagcgagcggggcccggggaucugccgggaggccugagacgcggcauagagccacaugcgagcggggagcccaggaggcggcggcgacaccagcaagcaagcagcagcagcggugauccggacacgaagacuccagaagcagcagcagucacugcaguuagagcagcaggagcagcagcaaggugccucaauagcaacccacucggcgggcgagcccuccagaaggcaaccgcccgccaccccaucgccuccuuucuccggaguguucaugcccccggggugagugagcaccccgauucccgaagcugcuuacgagcggcaaggcccggagggcucccuggaggaggugacggggugcacgggccgauaggacggucgccuugcauucccgcagcuugugccccagcuuucaucacugggacuaaggcugggccaggcgggcgggaaggaagcaccugggacucagggcgcccugucugggcgcacaggugccacagcggucuggcggguuuguuuacaaacaaugggguucgggcucgcccgcgcccccugguggcuagugagaccugggaggagcguggccccgggcucgcucgagucccccgagucccacugcgggaggguuggggugggggguggcaccgaggaucggccacacccagagcgcgcgcccgccgggggcggcgacagggggcggcggaggcuguggcucccgcgggcgggggcugcgccccagcaacagccgguuauuggccccgcgcgcgcugggcgggcggggcgggcgcacguggcggcgucgagggggggggcugugacagcggaggggcggcggggaccgcgcgugcggggcuguggaucugcaggugucucgccugggugugugugcucguguuuggcucccgaguuuguaucccuacaccgagauguuggcguuugucacccggaggggugucugcgugaguccuugcccgcgugucugcgggguggggugcaccuguccguuuacggguguggguggccaccccccaaaccagaguuguauacgugugcucuuaaggggugaaaaggggaucuguaucugucgcuugccugguaguguugguggugguggugcggacgaccggggcacuugagcuguguuugugugucgcuugagugagcuguguugcugugcaggggucucgcccaagugugcgcugcguguguguguguguguguguguguguguguguguguguguguaugcgcgcgcgcgcgugcugucucugggugucuccaagacaagcaucugcuguacccagcuuuugggaugggaugccacccagugccugaucgcucgcugggugacuucugagcagcaaaaggcacacaaggcacgcugagcaugaagggcuuugggggugggggggaucuagcggguucagugccagccccucucucugcaugcagugugugugugugugugugugugugugugugugugugugagaaagagagaggggggggugagagugaguuuugggucugagggguuugucucugugauccaggcuaugugucauguggugcucucucucuguaguguuuauagcagucacgugaggccaguguuuucugucucugcauuaggugugugugcugcugggcucuguguguguguguguguguguguguguguguguuuucuggggcugacaguuggcugugguguauuggggcugagaguagaggcuggaccuauggcuucuaccagcugcggcuggugccucccgauguggcugccccgcacacgaggggggaugauguaucuggauaugaugacuugugucuauguguggcuguugugucccaggagcucaaaguugggggggggugcacauucagguguguuuugagaugaugguggugcaugugcuaaggaauaguaaggggggugucuuuggguugucuguguguaugcgggagaaacacguugaagacuugagucuguugugcuucagugugugacggcugcauugugggcgggugagcgcuggcaugucagcagcgggucagugugagacugguguaaauauguugaaagggcucuggauggcugugugugcaugucuguguccccauguguuucugggugagccaccucacugggggagcgggaggggcgguaaaguuggacacuucucugaguucacuggugucuucccauuacacacacacacacacacacacacacacacacacacacacacacgguucucugacagcaccguguauccugggagccccagcaccccuucugcgcucuucucuguugagaaaguucucccuggcccaagcccugagaguaguaggcaguuuuccugguggguuuugcuacaaaccccagacgcagucugugcgccccucaccaugugucccggccaggcugucccuggggucaucccuuccugggugggagugacuuccaggcagggugucugcgaggugggguccugcaggccccccccgcagucgccccacugaccucccgccgugucccgcaggcuccagggagcgccauggcccgcgcacgccaggagggcagcucuccggagcccguagagggucuagcccgcgacaguccgcgccccuucccgcucggccgccugaugcccuccgcuguauccugcagccuuugcgagcccggccugcccgccgccccugcugccccugccuugcugccggccgccuaccucugcgcccccaccgcuccaccugccgucaccgccgcccuggggggcccccgcuggccugggggucaccgcagccggcccagaggcccgcgcccggacggugagugcccgccccgcacccggggaagcugaagcgggaguggagcugaguggggccaccgggaggguguggccaguguggucuuuguguagcaagaaccaggaagacagagugggagacauggauggaggggccaagucgagugggaagucccucuuagaaucugacugcaguccccggaguugcaguccacgucccuucccgggccucgggcaacagcuguuucucagcuccccucccccagcccgggucccugggcgccccccacccccaugaggauugcagugggaaggaguguggccagugggaggacugucaccucaggacuuuggggaggggucggaggccuuacccuuuuauuugaaucucuuuggcacuggcaggguuaguccgcagucccccaggaggaaggagagggggaggggccauuguguugggaaagucccccucggggagagggugaggcucagggagggaaggguuaaaggucccucgccugaugggcuguuaacccuguggugcccggcuacggggaaugaccaucuggguuucccuuucuauuugcccccaccuccccaugaagagagaaaaacuuuccaacuuucccugcguuucaggacuagguucagagauaauggaaacugaggcucaggaucuagugugacaggaccgaggcacaaggaugagugccagaggggguggagcacaaagucuaacccaguaccccugccacccucacccaaacccuaguccucuuggguuagucccaguuuggccuucuggucaucaggccaaugccacauccggggguguggccucacugugguugggcaggagugagcuggagaccugaggguagugacuggguggggucaguggcgguauccccgugugaccuuggucacuucuauggguggagccucaguuuccccgucugucaaauagaacaggcuagauuugacccuguauuaaaauagggguacuuaggucggauaaguugagggacuuccacauucauaugagcuuuaauggguaauugaccauccaggugaccccagagccacuuccguaagaccccuuucuagggccugugggaaagagugggaaaaagggaauuucuauggcugaguggagaagaaagcacaguguagcuccugggcgccuccgggcagacuggguggauggugaccacgccccuuuccccucacccagguccucagcccucccugucaccagcccagcagcacuuagagucgcccgugcccagcgccccggaggcccuggcaggaggccccacccaagcugccccgggagugcguguggaggaggaggagugggcccgggagaucggggcccagcugcggcggauggcggacgaccucaacgcgcaguacgagcggcgggugagugcggggcggcaggcagguggggagggggcugcacaccccgccagaugugcugcagcugcuggcccagcgcgcgcgaggucgcgccagggacaagcagaugggggugugggggaaggaauggaucugcuggaugcugggauccggugugggccagaucaggacuggagccccuagccagggucggggaaagcuacucggagcccgcggucgcggggacugagggcggcgcucggcgcggcggcuccuauaucccgggcuauuuauagccggugagucagcaacgcgccgcgcccgccgcgcccgcccccgccgaacugcgccccgcagcgccucccgccggcugcuucgcgccggcaccucccuggcucgggcccgccacuuggugcuccuagaucggagccccccaugaaacccccagagcccgguucccgccccuagcgcugugcacucugcacauggcccuugcauuguuugcugauuucaacagagagagagagagagagagaggcgcaccccacugacguuggauggguacaggucccucacucugcucccuggcccugucgccuaccuuuuguaaaagggacauccucccagcagcgacucacucccagcagguguuuuuuuugcacccacuuacaugcacagccaggggcguuguuuuuagcucccauccuggcucuggcgcgccuucuaacuauggcuuuccaaaguccuccaucuccuucauugguuaccacugagcaaauccuagagacuaggcaaguagcauggcccgguggcagcaucccguaaucccaccuacucagggagggagaaagaaaguucaaagccagccugggcaaccuagugagugauauucugcuucagaaauagucuuugaaguggcucagaggauaaaggugcuugcuaccaaaacugaugaacagaguucgauucccaggacccacuuaguaaaagucaagagucuaaucuuacauaguguucucuaaccuccacaugugcacacacagauccccccucucucucucuuucucauacacacacagacacacacacacacacacacacacacacacacacacauuaaugguuaagagaacucuuacagagaaccagggucagguucccagcugacaacugccuguaauuccagguccagggauccaaugccuucugguauuugccagcacguacacauuaguuuguuuguuaguuaguuuguuuuuuaaagauuuauuuauuuuauguuuaaugaguacacuguugcugucuucagacacaggagaagagagcaucagaugguugugagucaccaugugguugcugggauuugaacucaggaccucuggaagagcagucagugcucuuaacggcugagccaucucuccagcccacauauuauuuuuuuuuuaguuuuauuuauuuacuuauuuauaauucaggggaggcugauguagcucaguugguagagugcuugccuaggagagagacacugacccuuaggucugugggucaaggucacccucaaauacaguuucaguuccaggacauccugugcgacaugaggugaggucucaaaaacaggaagauuuuuuucuuuuuuuuucuuuuguuuuuucgagacaggguuucucuguguaguccuggcuguccugcaacucacucuguagacuaggcaaacuggccgggaacucagagguucucuccuccugcccuucccccacucaagugcugggcuuaaagguuccacucagcugagcuuuuuuuuuuuuuuuuaaacacaugccuggaauccaccagugaguggcaaaagguguggcuuagcagcaaacauugucuagcauuaguguuuucuccucuuuucuaagagauggccaucucuggcuuggcccaugugcuguugucuucagagugaacacccagggcuccgugcucccccuaauaggcuaaguauaaugauagugaacucacaagguggcauccaccaccucgcccaguugcaaggaggaggagggcacaggaggccugggcuaguucugggcauguacucuaauagggucauuagccugacaucuuccaaauggauuacauucuucacaaccaagaacaugagcccgguggaucugcuuggccauaaccaguggaaggaccaaauaaaagcuugcucucucucucucucucucucucucucucucucucucucucucucuuccguucuuccuuccuuccuuucucccuuccuuucuuucucuuuucuuuucuuuucuuuucuuuucuuuucuuuucuuucuuucuuucuuucuuucuuucuuucucucacucucccucccacccucccuuuccuuccuuccuuccuuccuuccuaccuuccuuccuucuuuccuuccaacacuggcuguccuagaacacacuauguagaccaccaugcuagccuugaauucucagagaucugccugccucugccucacaaguucuaagauuaaagaugugagcuaccacacccagcauucuuucuuucucucucucucucuuucucucuuucuuuuucucuuuuccuuuuuuuuucuuucuuuccuuuucuuucuuuuucuuuuucuuuuuuaggcuggcucuuaauaagcuguucacacuggcuuugaacucacuuuauagcucagacaggcuuugaacuuuugucuuccugccucagccuccugagucgcugggauuacaggccugugccaucacagaagaaaucuagaugcuacaucacacuuuuucucuaccaccagggaucgaacaagaguuucccugaagccagcauugccaagagauaccuucucucagccuugcuggcauggccugcuguucucaacacucuuccggggugguuugagaacugcuuaggcugucgggcugcuccuuacucucucccaugucccaacagccuuuuguuugguugguuugauuuuuccaguuaggagccugugcucuagcacaaauuuagugaggcacacuaagaugaguucgagccaccacgccugucucucaccuugagugggcugcguuucagcccaccccuuagagcccuugugauucguagggugugugugcuaggcucuaugcuaugggaauucugccccagccccuucccaccuagguugggagagugugcccuggugagugaggggcugaaaaauggcugguaagaggguugcgcucaguuuugggaccgaucucgaacccacaccuuuugcucacuaacccacugucugcggguccaagcuaauuccuacuuccuccucuccccagagacaagaagagcagcaucgacaccgacccucacccuggagggucauguacaaucucuucaugggacuccuccccuuacccagggauccuggagccccagaaauggagcccaacuaggugccuacacccgcccgggggacgucggagacuuggggggcaggacccccuccgccuucugacacccuggccagcgcgggggacuuuuucugcaccauguagcauacuggacugccagccuugcccgucccaggggcaggcaagggaugccacucgagcccgggcagccugggugcacugauggagauacggacuuggggggacccuggccucccgaaagccagggaagggagggcugaaggacucauggugacugaggggguggggaccgagccgcccgccucugccgcccaccaccaucucaggaaaggcugcuggugcuggcugcccguuccagcugcaggggggacgcuggggguguccccagugcgccuucacuuugggccuggccucaggccccuggugcuucccccccuccuccugaggagggggucugugaagagcauaugagccaaaccugaccacuagccuccuggagccagagaauggggggcgugugaaggccuucuuaacccagugcccagccaucuucccugagccgccggcgggcggugaacgaugccugccucaccuucaucuggggguguccaggagggguccagacugugaauccugugcucugcccgggaccacccccccccccccaauccccauccaucucauugcauagguuuagagagagcacgugugaccacuggcauucauuuggggggugggagauauuggcggaagccaccccagccuuaguccccagggcaaagcgcuggggaggaagauggggagucagggaggggggaagucucagaagagggaggagucugggagcggggagggacggcccagccuguaagauacuguacaugcacugcuguagauauacuggaaugaauuuucuguacauguuugguuaauuuuuuuuguacaugauuuuuguauguuuccuuuucaauaaaaucagauugaacagugaacacucuuuuuguuagcuuuaccagugacagagcaucuggcacuaccuguaaggacaugaaagaaacgguguguguguguaugugugugugugugugugugugugugugugagaaauggcucagugguuaa

SEQ ID NO: 3578 - RNA, 9940 nt, Mus musculus
uuaaccacugagccauuucucacacacacacacacacacacacacacacauacacacacacaccguuucuuucauguccuuacagguagugccagaugcucugucacugguaaagcuaacaaaaagaguguucacuguucaaucugauuuuauugaaaaggaaacauacaaaaaucauguacaaaaaaaauuaaccaaacauguacagaaaauucauuccaguauaucuacagcagugcauguacaguaucuuacaggcugggccgucccuccccgcucccagacuccucccucuucugagacuuccccccucccugacuccccaucuuccuccccagcgcuuugcccuggggacuaaggcugggguggcuuccgccaauaucucccaccccccaaaugaaugccaguggucacacgugcucucucuaaaccuaugcaaugagauggauggggauuggggggggggggguggucccgggcagagcacaggauucacagucuggaccccuccuggacacccccagaugaaggugaggcaggcaucguucaccgcccgccggcggcucagggaagauggcugggcacuggguuaagaaggccuucacacgccccccauucucuggcuccaggaggcuaguggucagguuuggcucauaugcucuucacagacccccuccucaggaggagggggggaagcaccaggggccugaggccaggcccaaagugaaggcgcacuggggacacccccagcguccccccugcagcuggaacgggcagccagcaccagcagccuuuccugagaugguggugggcggcagaggcgggcggcucgguccccacccccucagucaccaugaguccuucagcccucccuucccuggcuuucgggaggccaggguccccccaaguccguaucuccaucagugcacccaggcugcccgggcucgaguggcaucccuugccugccccugggacgggcaaggcuggcaguccaguaugcuacauggugcagaaaaagucccccgcgcuggccagggugucagaaggcggaggggguccugccccccaagucuccgacgucccccgggcggguguaggcaccuaguugggcuccauuucuggggcuccaggaucccuggguaaggggaggagucccaugaagagauuguacaugacccuccagggugagggucggugucgaugcugcucuucuugucucuggggagaggaggaaguaggaauuagcuuggacccgcagacaguggguuagugagcaaaagguguggguucgagaucggucccaaaacugagcgcaacccucuuaccagccauuuuucagccccucacucaccagggcacacucucccaaccuaggugggaaggggcuggggcagaauucccauagcauagagccuagcacacacacccuacgaaucacaagggcucuaaggggugggcugaaacgcagcccacucaaggugagagacaggcgugguggcucgaacucaucuuagugugccucacuaaauuugugcuagagcacaggcuccuaacuggaaaaaucaaaccaaccaaacaaaaggcuguugggacaugggagagaguaaggagcagcccgacagccuaagcaguucucaaaccaccccggaagaguguugagaacagcaggccaugccagcaaggcugagagaagguaucucuuggcaaugcuggcuucagggaaacucuuguucgaucccuggugguagagaaaaagugugauguagcaucuagauuucuucugugauggcacaggccuguaaucccagcgacucaggaggcugaggcaggaagacaaaaguucaaagccugucugagcuauaaagugaguucaaagccagugugaacagcuuauuaagagccagccuaaaaaagaaaaagaaaaagaaagaaaaggaaagaaagaaaaaaaaaggaaaagagaaaaagaaagagagaaagagagagagagagaaagaaagaaugcugggugugguagcucacaucuuuaaucuuagaacuugugaggcagaggcaggcagaucucugagaauucaaggcuagcaugguggucuacauaguguguucuaggacagccaguguuggaaggaaagaaggaaggaagguaggaaggaaggaaggaaggaaggaaagggagggugggagggagagugagagaaagaaagaaagaaagaaagaaagaaagaaaagaaaagaaaagaaaagaaaagaaaagaaaagagaaagaaaggaagggagaaaggaaggaaggaagaacggaagagagagagagagagagagagagagagagagagagagagagagagcaagcuuuuauuugguccuuccacugguuauggccaagcagauccaccgggcucauguucuugguugugaagaauguaauccauuuggaagaugucaggcuaaugacccuauuagaguacaugcccagaacuagcccaggccuccugugcccuccuccuccuugcaacugggcgaggugguggaugccaccuugugaguucacuaucauuauacuuagccuauuagggggagcacggagcccuggguguucacucugaagacaacagcacaugggccaagccagagauggccaucucuuagaaaagaggagaaaacacuaaugcuagacaauguuugcugcuaagccacaccuuuugccacucacugguggauuccaggcauguguuuaaaaaaaaaaaaaaaagcucagcugaguggaaccuuuaagcccagcacuugagugggggaagggcaggaggagagaaccucugaguucccggccaguuugccuagucuacagagugaguugcaggacagccaggacuacacagagaaacccugucucgaaaaaacaaaagaaaaaaaaagaaaaaaaucuuccuguuuuugagaccucaccucaugucgcacaggauguccuggaacugaaacuguauuugagggugaccuugacccacagaccuaagggucagugucucucuccuaggcaagcacucuaccaacugagcuacaucagccuccccugaauuauaaauaaguaaauaaauaaaacuaaaaaaaaaauaauaugugggcuggagagauggcucagccguuaagagcacugacugcucuuccagagguccugaguucaaaucccagcaaccacauggugacucacaaccaucugaugcucucuucuccugugucugaagacagcaacaguguacucauuaaacauaaaauaaauaaaucuuuaaaaaacaaacuaacuaacaaacaaacuaauguguacgugcuggcaaauaccagaaggcauuggaucccuggaccuggaauuacaggcaguugucagcugggaaccugacccugguucucuguaagaguucucuuaaccauuaaugugugugugugugugugugugugugugugugugugucuguguguguaugagaaagagagagagaggggggaucugugugugcacauguggagguuagagaacacuauguaagauuagacucuugacuuuuacuaaguggguccugggaaucgaacucuguucaucaguuuugguagcaagcaccuuuauccucugagccacuucaaagacuauuucugaagcagaauaucacucacuagguugcccaggcuggcuuugaacuuucuuucucccucccugaguaggugggauuacgggaugcugccaccgggccaugcuacuugccuagucucuaggauuugcucagugguaaccaaugaaggagauggaggacuuuggaaagccauaguuagaaggcgcgccagagccaggaugggagcuaaaaacaacgccccuggcugugcauguaagugggugcaaaaaaaacaccugcugggagugagucgcugcugggaggaugucccuuuuacaaaagguaggcgacagggccagggagcagagugagggaccuguacccauccaacgucaguggggugcgccucucucucucucucucucucuguugaaaucagcaaacaaugcaagggccaugugcagagugcacagcgcuaggggcgggaaccgggcucuggggguuucauggggggcuccgaucuaggagcaccaaguggcgggcccgagccagggaggugccggcgcgaagcagccggcgggaggcgcugcggggcgcaguucggcgggggcgggcgcggcgggcgcggcgcguugcugacucaccggcuauaaauagcccgggauauaggagccgccgcgccgagcgccgcccucaguccccgcgaccgcgggcuccgaguagcuuuccccgacccuggcuaggggcuccaguccugaucuggcccacaccggaucccagcauccagcagauccauuccuucccccacacccccaucugcuugucccuggcgcgaccucgcgcgcgcugggccagcagcugcagcacaucuggcggggugugcagcccccuccccaccugccugccgccccgcacucacccgccgcucguacugcgcguugaggucguccgccauccgccgcagcugggccccgaucucccgggcccacuccuccuccuccacacgcacucccggggcagcuuggguggggccuccugccagggccuccggggcgcugggcacgggcgacucuaagugcugcugggcuggugacagggagggcugaggaccugggugaggggaaaggggcguggucaccauccacccagucugcccggaggcgcccaggagcuacacugugcuuucuucuccacucagccauagaaauucccuuuuucccacucuuucccacaggcccuagaaaggggucuuacggaaguggcucuggggucaccuggauggucaauuacccauuaaagcucauaugaauguggaagucccucaacuuauccgaccuaaguaccccuauuuuaauacagggucaaaucuagccuguucuauuugacagacggggaaacugaggcuccacccauagaagugaccaaggucacacggggauaccgccacugaccccacccagucacuacccucaggucuccagcucacuccugcccaaccacagugaggccacacccccggauguggcauuggccugaugaccagaaggccaaacugggacuaacccaagaggacuaggguuugggugaggguggcagggguacuggguuagacuuugugcuccacccccucuggcacucauccuugugccucgguccugucacacuagauccugagccucaguuuccauuaucucugaaccuaguccugaaacgcagggaaaguuggaaaguuuuucucucuucauggggaggugggggcaaauagaaagggaaacccagauggucauuccccguagccgggcaccacaggguuaacagcccaucaggcgagggaccuuuaacccuucccucccugagccucacccucuccccgagggggacuuucccaacacaauggccccucccccucuccuuccuccugggggacugcggacuaacccugccagugccaaagagauucaaauaaaaggguaaggccuccgaccccuccccaaaguccugaggugacaguccucccacuggccacacuccuucccacugcaauccucauggggguggggggcgcccagggacccgggcugggggaggggagcugagaaacagcuguugcccgaggcccgggaagggacguggacugcaacuccggggacugcagucagauucuaagagggacuucccacucgacuuggccccuccauccaugucucccacucugucuuccugguucuugcuacacaaagaccacacuggccacacccucccgguggccccacucagcuccacucccgcuucagcuuccccgggugcggggcgggcacucaccguccgggcgcgggccucugggccggcugcggugacccccaggccagcgggggccccccagggcggcggugacggcagguggagcggugggggcgcagagguaggcggccggcagcaaggcaggggcagcaggggcggcgggcaggccgggcucgcaaaggcugcaggauacagcggagggcaucaggcggccgagcgggaaggggcgcggacugucgcgggcuagacccucuacgggcuccggagagcugcccuccuggcgugcgcgggccauggcgcucccuggagccugcgggacacggcgggaggucaguggggcgacugcggggggggccugcaggaccccaccucgcagacacccugccuggaagucacucccacccaggaagggaugaccccagggacagccuggccgggacacauggugaggggcgcacagacugcgucugggguuuguagcaaaacccaccaggaaaacugccuacuacucucagggcuugggccagggagaacuuucucaacagagaagagcgcagaaggggugcuggggcucccaggauacacggugcugucagagaaccguguguguguguguguguguguguguguguguguguguguguguaaugggaagacaccagugaacucagagaaguguccaacuuuaccgccccucccgcucccccagugagguggcucacccagaaacacauggggacacagacaugcacacacagccauccagagcccuuucaacauauuuacaccagucucacacugacccgcugcugacaugccagcgcucacccgcccacaaugcagccgucacacacugaagcacaacagacucaagucuucaacguguuucucccgcauacacacagacaacccaaagacaccccccuuacuauuccuuagcacaugcaccaccaucaucucaaaacacaccugaaugugcacccccccccaacuuugagcuccugggacacaacagccacacauagacacaagucaucauauccagauacaucauccccccucgugugcggggcagccacaucgggaggcaccagccgcagcugguagaagccauagguccagccucuacucucagccccaauacaccacagccaacugucagccccagaaaacacacacacacacacacacacacacacacacagagcccagcagcacacacaccuaaugcagagacagaaaacacuggccucacgugacugcuauaaacacuacagagagagagcaccacaugacacauagccuggaucacagagacaaaccccucagacccaaaacucacucucaccccccccucucucuuucucacacacacacacacacacacacacacacacacacacacugcaugcagagagaggggcuggcacugaacccgcuagaucccccccacccccaaagcccuucaugcucagcgugccuugugugccuuuugcugcucagaagucacccagcgagcgaucaggcacuggguggcaucccaucccaaaagcuggguacagcagaugcuugucuuggagacacccagagacagcacgcgcgcgcgcgcauacacacacacacacacacacacacacacacacacacacacacgcagcgcacacuugggcgagaccccugcacagcaacacagcucacucaagcgacacacaaacacagcucaagugccccggucguccgcaccaccaccaccaacacuaccaggcaagcgacagauacagauccccuuuucaccccuuaagagcacacguauacaacucugguuugggggguggccacccacacccguaaacggacaggugcaccccaccccgcagacacgcgggcaaggacucacgcagacaccccuccgggugacaaacgccaacaucucgguguagggauacaaacucgggagccaaacacgagcacacacacccaggcgagacaccugcagauccacagccccgcacgcgcgguccccgccgccccuccgcugucacagcccccccccucgacgccgccacgugcgcccgccccgcccgcccagcgcgcgcggggccaauaaccggcuguugcuggggcgcagcccccgcccgcgggagccacagccuccgccgcccccugucgccgcccccggcgggcgcgcgcucuggguguggccgauccucggugccaccccccaccccaacccucccgcagugggacucgggggacucgagcgagcccggggccacgcuccucccaggucucacuagccaccagggggcgcgggcgagcccgaaccccauuguuuguaaacaaacccgccagaccgcuguggcaccugugcgcccagacagggcgcccugagucccaggugcuuccuucccgcccgccuggcccagccuuagucccagugaugaaagcuggggcacaagcugcgggaaugcaaggcgaccguccuaucggcccgugcaccccgucaccuccuccagggagcccuccgggccuugccgcucguaagcagcuucgggaaucggggugcucacucaccccgggggcaugaacacuccggagaaaggaggcgaugggguggcgggcgguugccuucuggagggcucgcccgccgaguggguugcuauugaggcaccuugcugcugcuccugcugcucuaacugcagugacugcugcugcuucuggagucuucguguccggaucaccgcugcugcugcuugcuugcuggugucgccgccgccuccugggcuccccgcucgcauguggcucuaugccgcgucucaggccucccggcagauccccgggccccgcucgcucggcggccgccccgccccgccucucgcuggcucccacgccccgcccccgcgugacgccagggccccgcccgcggcuggggacaagucggggcuugcagucgggcgccgcgcccccuaccucggcgcgggggguuucccggcagccagaggggcggggcgaggccugguccaggcaggaggagcagcguggggacagcccagaccuaggguguccggacacacgcuugacacacugacacacugacugggacccacacccacaccugaggaguacgcucagacuaacggacuggcacgccagggugcacugagucagugaugacugagccacagggacacaaagucagaccagaggcacagauacacaucaggacaagggccuggacacacgagcucacacagacccagacauccagauuaucuuacuuacuggcucacugggucacacacagacagugacaacccaaaacguaguugcacaaacaauauucaaacagucuccgacgcacaaacccguguccccagaugccuagggcauucacacuacacuaaaggcugaccccuucucagaacaacuuccuggcagguucagagggacacacacuccaauccaaauagcacucucaggcugacacccgcaauagcugaagcacagccacuagacugcacuggcugacccuacaaaacaugccagucacauacagaagaaacugagcccagaccugugcucacaaagucacuccugagacagguuccugcuaaauggcuugauggcggguuacacucgugaacuuaaacaccuggcccgccuggcguaauacccaucuggcacuggacaaauggggaagaggcagcccugugcuccuggcacagacaugcccgggcagcccccugcacccuauuucauccugucuguuguuucuguuuccuuucccuuuucuaaaagucauuuauuucccuucccuuuugaaacagugacccuuccuccucccaagccguagacaucucucacggcacuugacagacucucugucucacccaaacugucaccaaacuuacugaguauauuacuuaccuaugggugcccagcacugggcccgcugugaaagggugucacacagccaugugagauaagacacuuguuaaagaaauaaacauagucacuuacaccugucuucccagcacuuc

SEQ ID NO: 3579 - RNA, 2970 nt, Mus musculus
ggucacacacuaccggcacauauaacugaaguggagacacagccagauacaccaauagguauugcguuccgggauagaguugcgggcagaucaccaaugguugugucgcuccucaugagugaugugaccuccagccuacaguaggcccguggggcggagcuggugucgcggccccauugcgagccaugggaggcggcugguggugggcucgggucgcgcgccuggcccgccugcgcuuccgggggucucugcagccuccucagcggccccgcagcgggggcgcgcgcggguccuucgccccgggccacgggccacgcgcgggagcgucgccgccuccaguguccgagcuggaucgcgcggacgcuuggcuccuccgcaaggcacaugagacaggucaguggcaggggccggggucguucgcgcuacaaggagagggguuucaaugugcacgugggaguggguggccagaguaaggcaagcaucugcugggaacagggccugugcucagcgggggcagcuuccucaugugagcgcagggaaccgguguuggggguuggagauuuugcagccuggccgcauaggacaccaucuuucggguccuggcuaaagggguacagcagggauuaguggggguggggaggaggcuacgguuaggaagaaguaguuggcagcaccacacugccuaggugagagaccguuccagaggcagcugggagggaacaaguugcuugagacagggguauccguuaggauuacagacagaggggaccacuuggaauaaaacaagaguguggcuacccgcagaagauggggaaguuccggauuggaccagcguguaaccaaugguagagaagguggcugcugauuggagggagaggugaucuagacugcagagggaggaaucucaaacgaggcaaugaguugagagauuggagcuggucugguguugaauggggcuaguagugggaacagccuuuuggcagcacucagguacuugagugguggggagguguggacgcaaggaugaggccaugcuagguaggagcgguuaccacacaggggaagggacaggcuggagaaguuugucccagaggucugagggagagagggaagaccgcaggaugcacaagggaagacuugggaagacuuucuauccucaaacuucaauucgugcucuagauuuugaacgucugggacagaaggguaaaggaaugggacuugcauggggcuucccggaagggauccgcaucuagaauacuuuugucuuguggcugaauagggugagaggggaucuaggaagcagggcuugcugaugcagagcuccaucccccaacuccccgcagcuuuucucuccugguuccgaaauggacuucugucauccggcauuggggucaucuccuucaugcagagugacaugggccgggaagcugccuauggugaguacagaccaucccuaugggaaaugggccccucccccuuuuccuccaguucugaguccuccuacccuaacaguuggaaaaggagagcacucccuccauuuucucuugccucacuaguuacaucuccucuuacaccuccuucaucggcauugugaggaguccaccagacaguuuccaaguagccuugacuuauguggacaccuuuguuuauaccccagaccagccccuuuggauauugaauuucuccuccaagucucacauacuuccuuuuacaaagucucauguauuugaguccuugucugccuuuauuuguuuguuuguuuguuuauguauugcuauaacgggaaggaaagcagccuacuaguuaagugcugugucacugagcuacacaucgccauccuuccacuggaauuuuuuagccaagugcucuaccuuugagccacgcccccagucccucacugggggauucuaggcaggggcucgaccacugaacuacaucaccagccuuuuuguuuuuuugagauuuauuuuuauuuuauguguauauguguauauggagaccaugugcaugccugguacccaugaagccagaagagagcacaagaaccccucggacuggagguacagaugguugugagccaccauguggguucugggaacugaacucaggccaucugaaagagcaacaaguacucuuaaccuugaagccaucucuccaggacugccccccccaccccaccccuucccguguuauuuugaggcagucgcaguagcccgaguaagccuuccguuagcuagcacugcuccagccucucacuagcugacguuagaagccuugucccgcccugugcucguacugacucauccuccccacccgucacccugucagccccuugggauacgcuggacccuguaacuauugacuacugcuccuucuuccacaggcuucuuccugcuggguggccugugcgugguguggggcggagccuccuaugcggugggucuggcagcgcugcggggacccaugcaacugucgcuugcuggugcugccgcuggugugggggcaguguuggcugccagucugcucugggcuugugcaguaggucucuacaugggccaguuggaacuggacguggaacuggugccugaggaugauggggcagccaguacagaaggcccagaugaagcgggcaggccacccccugaguaaacaacagggcuguggggacuggcugggccugacgacugggacauuaaaaccugacccuuccgcaguucaagacucugagugauagcuccuguuaucuggggagguggggaggggagaagagggcaaccuuuggggacgaggcucaguggguaaaggcacuugcuccuaagccuggcgaccugaguuugauacucaggaccugcgugguagaagaagagaccuaauuuccacaccauaccacacauggacacacauacaaguaaaucaguucaaaggaacaaggccaagcaaucaugagaggcagcauccccggggagggag

SEQ ID NO: 3580 - RNA, 7508 nt, Mus musculus
cggccgucccggcggccauugcuccaagauggcggcggcggcggcggcgggugaggcgaggccgggccgggcaggacuggggcggggagcgcgggagggcagcgguggcgcucaccugcagcucggcgcgcucggccucccagcgggccuucucggcuucgaagcgugcccacucguguuggauaaagugcaggauccccggcaggcugaggggcuccgggcccgccguagggcccgggcugccuccgccgccaccuccuuuuccuaccgggccgggcccaggagcagggcuggaggccggggccgccgccgucggguugggagccgugcccgagcccagagggcggcaggaggaggcggccgaugcgaccgcggcggccgcucgcuccuccaucauggaggccccggggccggcccgcgcgcccgcuguaccucgcgcgccugcgcggacgcgcagcuucacacuucuacacccccgccucgugugcgcgcgcgcgcgcgcugggcgggcgaggggagcggggacaagcacggggcugggcgcgagccucgcccacccacccgggucgaccccgguggugcgcgcgggcgggggugcugacagggagggggagggacugccucuacguaggcaaaggacccagggucccucgcaauugucuccuuugcggucgagagaccagaccggacuuuuuuuucugcauucuccccaaugucagaguccuauccccuccaaaugcaaauacacccccaucucuuucacuuagugaagaaaaaaaaaacaaaaaacaaaaaagacgaccugggguggggagugggcucugaccagaggaagucgguugucauaauaacccuauccaaucuggaggccccuucccaguuugcauauguggagucccaaaccucuacuaucauugcacuaggaggagguugcuaagguaacccaagucccuggugguucuucugacccuauccucaucaguuacuauagcaaccuccccucaccuagagcucagguagaaaaaaggcccagccccaaagacauuccucuaagaggaaugccucugucccacuccucccccagccaacccaguugccauuaccaugguaaccaucuccccuucccuuauggaaaguccauggauaaaccaaccagguguuuuuauuuagaagacaagugcugcugugggacaguugcuaugguuacagggccuggaccauuuccagggagaugagaaacaguuaaauccaugcccugguuacuauaacagggcaaucucccacagucugaugauccuagcaaucagguccuguaagauaggggauguuuaggauuagcuccaaaggaugcaugagucuagagaagagguugucaugguaacaguugcugucacuucugcccuucuggacaccaucauggaagagggauaguuauagcuuacaauugaugacuccuacccaccacaucacuccugagacgacugaagugguaaccaggcuuauggacuucaaauagacaaaagagucugugacuucauuagcuacuuucacgggcggguagaaugaaauugcacuuuguugggaggggcuggcucauuugaugcuuucugguuccucccucagcagggcagaugacccaaggugaaaccacucuucuugaucacccucagccugaaaccuagggagguaagagucccuggaugucacaguaaucacauggguaacugcccuuucuauguccuuaaaggcuuuccugaaugggucuccuuuuuguaccuacugugauugaaaaggcuaaggcuaauuccaagugaugcauacgcuuagauuuuuuucauguguuuguuuauugugugcaugugcauguguggaagucagaggcugaguugccggaguugauucuuuccuuguauuguuuggguucuggagacuaaacucaggucugccuugguaucaagaaccugcugggccaucuuuaaacacuguuuuguuguuguuguuguuguuguuguuguuguuuuucugacagucucauguagcccaggcuggccucaaacucaagcaguggucaaggaugaccuugaauuuucaauccuccugccuccaccucccaagugcugggaauacaagcauuuaacaucagacucagcguauauaaugugugggggaagaaauggaaagcuaguaugagcucagauucacucucuucccugaccacuuuuccuaggcaaggccccauguuacucacuccugcucccggcuggucuccuaccuuaccacuaaggugugccugucuucucagaucugcagaacacagaggcugggguuggagcugaggagacagcucgguugguagagcgcuaguggauaaugguagugugugccugugaucccagcccagccuuugccuuguagcagugucaucccucagcuacauaccuagugcaaggucaaccuggcccacauugagacccugucucaaaaacaaacaaacccaaaacacccuggcacaaaguaccuacuuguugauaaggugacuuucggcuggaaagucacaugccauauucagcuuuaagaccacccaucagcuuagcuguaguguaagaguugggauaugugauugcaaacaagaauuagcuggguggacagugguauacgccuguaaucccagcagucagaaggcaagagguucuuaguucaaagccagacuucaauacuuagugagacccccucucaacaaaacaaaacaguuuuuugguugugagacaaggucucuguacaccaggcuggugucggagucauggagaugccccuguuucugccucuggaaugcugggauuaaggcaaguaccauuggcuuacugguuugaagcaggauuaguaaccagcuucuucuugcaucaacucccgcgucccucuuuucagauguauggcuuuaagcaagugccuucaccucucagugccucaauucauuaagaguaugaguguuuuaccugcaugcaugucuacacaccaugugcaugccuggugcccacaaugcccacagaggccagaaaagggcaccagagucccuagaacuggaauuccagaugggugugggugcucuucaccgcugacuucucucuccagcccugcuuuguguuuguuuguuuuuucccccuucuucuugauuguauuguaguuuaaacauaaaguaacuuuucauguuaugcaauaacaccgcuaaaagccacaccccccaggggacccccuugauggugaauuuuagacuagccuucugucuuagguaggguuuuacugcuauaaacagacaccaugaccaaggcaagucuuauaacauuuaauuggggcuggcuuacaguuucagagguucaguccauuauccucaaggcaggaacauggcaggauccaggcagguguggugcaggaggagcugagaguucuauauuuucaucugaaggcugcuagcagaauacugaguuccaggcagcuaggcugagaaguacaaugacacaccuacuccagcaaggccacacauccuaauagugccacuccuugguccaagcauauacaaaccaucccacccucuauugcaaagccaugccuccagcccugcuuuaaauuaaaaaagaaaaaaaaaaaaaauagcacguauagcccuggcuagccuggaacucaccccauaaaccagacuugcuucaaacucauggagauccaccugccucugccuccugagugcugggguuaacgggaagccacuguugcuucuuuccuccuuuuccuacuuuuggauuuuugugguuugguuugguuugguuggguugaguuugguuuagauuuuugagacaugcuugccuuucccauccuccugccuccucuuuccaagggcugaauuacagaauguacuauggcuuuuaaacacugugauccugggcugaagagauggcucagagguuuagagcacuggcucuuccagagguccugaguucaagucccaugguggccuauaucucauuuauaaugagaucuggugcccucuucuggucugcaggcauacaugcaggcuguguacguaauaaauaaaucuuuuuuaaaauuugugaucuaauauuccuaaaaucaaaugcaucacuggcacacucacaguucaguaguacuaaguacaucuacaacagugugguguccacaccuggaaaccccacaucgggagguagcugcagaaagaccaacaguccaagacuggccucugcugcguagccugggauaaugugugaaacuacagcccucuaaacacccucacauuguuaggcaaguaaggugucagaaguguuucaccuuacaaaacuaaaacugggugcugggguugugcuuaaaccaccuuccuggauccaccagugaggggcugggaguggggcuuggugguagagcauuuguccuggguagggccccagguucaaccaguucacagcucucccuccacccucuggcagcgaccagcauuguuuuuuucauuugcaggggugauggguucaauuuuugguuuuaguuuuaaacaggcccucacacauuaauuuaagaacucacuguguaacugagugggaaaagugaccccaugacgugaugcuuacaaguggucuguuuagggcaggggcaugaaccaaccuaggaauuccuggagggccugaaaucagauccaggaagggcaacugagaauucaaggguaaggaaugcugacaacuugcuccacacucccuuuucauccugucuccccaggaugcccuggacgccccagcuagggucugacaucaggccccaugcggcucacccgcugcugggcugcccuggcagccgccaucauccucaaccuccuagucuucuucuaugugucauggcuacaacaccagcccagaaacucccgggcccgggguccccgccggacuucugccauuggcccccgagucaccguccugauucgggaauuugaggcuuuugacaacgcggugccagagcuaguggauuccuuuuugcagcaggacccagcccagcccgugguaguggcggccgacacacucccuuacccaccccuggccuugccucgcauccccaacguucgccuggcucugcuccagccagcccuggaccggccagcggcggccucgcgcccggagaccuacguagccaccgaguuuguggcucuagugccugauggagcgcgggccgagucaccaggccaccuggagcgaaugguggaggcgcuccgagggagcagcgcgcgccuaguggccgccccggucgccaccgccaacccagcgcggugccuagcucugaacgucagccugcgggaguggacugcgcgcuacgacccagcucccagcgcgccccgcugcgacgcuuuggauggcgacgcugugcugcugaugcgcucccgcgaccucuucaaccucucggugccccuggcgcggccgcuggccaccagccucuuccuacagaccgcccugcgcggcugggcagugcagcugcuggacuugaccuucgccgcggcgcgccagccaccgcuggccaccgcccacgcgcgcuggaaggcggaacgugaggggcgcucacggagagcggcgcugcugcgcucguugggaauccgucuggugagcugggaaggcgggcggcuagagugguuuggcugcagcaaggagagcgcgcgcugcuucgguacgguggcgggcgacacacccgccuaccuguaugagggccgcuggaccccaccuuguugccugcgcgcgcugcgcgagacugcgcgcuacguggugggcgugcuggaggcggcgggcgugcgcuacugguuggagggcggcucgcugcugggugcagcucgccacggcgacaucaucccuugggacuacgacguagaucugggcaucuaccuggaggacgugggcaacugcgagcaguugcggggugccgaagcuggcucgguaguggaugaacgcggcuuugugugggagaaggcgguggagggcgacuucuuccgaguacaguacagugagaacaaccaccugcacguggaccuguggcccuuuuacccccgcaaugggguuaugaccaaggacacguggcuggaccaccggcaggauguugaguucccagagcacuuccugcagccacuugucccccugcccuuugcggguuucauggcacaggccccuaacaacuaccgccgcuuccuggagcugaaguuugggccuggggucaucgagaacccggaguaccccaaccccgcacucuuaagcuugacaggcgguugaagcccugguacccacaucuggggcuaggugaacagcaggguacaagagucuguucuugccucggauuguguauggaucugaaccaguuugugauuggguaguggggcugugcacuggagggaagaaaaaaaaagggugaacuggccaaggaagauuggagggaacacacaggacaguuucagcuuuggcgggaagcagaacccaaagacuggagcaacucagccucaugagggaggaaagugguggccuuugauagaaaagcccagggagucuuuagggcucugcauagucucugcccuauauuccaagagcuguaggcccuuggagagugagauccggagaacagacgagccagccucagucuaccacauacaacuuagguaucccuggaccaguuaguuacccagucuguuucauuugagauaccgaaugccucccuuuguguuuaggauccucaggacgcuuggcuccagugcuugcuuccuccacuagagggcacuucugucccgcuucaguucguguuugaugaccgcucgcggcucugcuucaucaccuucaucucugguuuucuuggaguggcucugggaggugggacagcacuggccaccuccucuccuccccgaauguggcacuuuccuuugagagugcugcuugauguaucugcugcuucuaaccccaucuugcucuuggaggacugacugggcucucucugguuugggaucuggccaaugcauuaccucuuuauuucagcccucugcaccuguuccccgccuucccccucccuucuaggaagggauaaaccuucgccauagcucacauuuacaaagagcuuucgggcucaggcauacacucggaagugacagcugcuauuacguccauuuuccggggaggaaaacugaggccaaaaugacagucacuugccaguaaucagauauuuuaggaaguggcuaguaagggacuugaauucagaucaccguuucaaggcccacacuucauuuccucucuagguucugcuguagaaauaguacccaaguggagccuugccauggcugugccacucaaacagguuuaaaaaaaaauucucauuuaauuaugcauauaaauuauguucaaaccagucuguauauuguuaaauaagacuuaaauuaugcuacuuuaaaguuuaaaaauucaagacaaauagagccguuuguuuccuugcuucauucu

SEQ ID NO: 3581 - RNA, 12389 nt, Mus musculus
cauugugauuauaaagaaggcguggccacagccccaggaucgccgcacaaaggggcguggcgagucugauacccccguagguaguccugggcaugcguuguuaaggaaaaauggggcggggcggagcccugcgucacggaaggcaacaaccaauaguaggucguugucgugccuucaggggcguggucauguagaugaggcgcgggugggcggcccaaugggcgggcgccuaugcagaugagacggugacagcccggccagcgggcgggcgggcugcuggggcggggaggugggaccggcgagaggggcggccguggggcccggccgggcuggggcggggggccgcagccaugauccgggccuucucguucccggugagcccggagcggggucggcugcggggaugguuggaaggcagccuggccgggcucugcgaguugcauuggcuccgagagaggcaggaguaccgcgugcagcaggcgcugcggcuggcccagcccgggauggggggcgccgaggcugaggacgaggaggacgccgaggaggacgaggaugcggcagcggcgcgcagggccgcagcagcccuggaggagcagcuggugaggggucgccuguccgugcguccauccaugcauuccucccucccccauucguucccccaccucccugcuccuguguccgucugucugucuugguaguguaugcucagcacaccgguccuaggguaggggagcaggcagggggaaagagauaagacuggagaccuggcuuuuccuacccccaaauagagcugauagggaggaugcacggccuccguuggacucagcauggacccuguuaaccguccuggaugccuaguguguguuaaaccaaacauucgucuucuuacagauuuccuauuucaugaggguuugaaaguccccauuuuacagagaaaaaaacugaggcuuagagacaggaagagacucacccaaggucacacagccggcauucaaacauaaccucccucugggccccgcuacccggaauccaucuucaucuuuccuuaagucucggggugcuuggagaucccuggagggggcggggugggggaaggggaaucuucaggccucuggagagagagaccggcugcugagaaacccccgaacagucccugaggacccccgggggcauuuugaucaacccaaugacacuucuuucuucuacuuggucccauggcucaguaacacggggaggccaggugaagauagcuagggagugaggggagagagaguaugauucgccgaggaacucuaaugaugacuuucaaauugaaaaggcuccagcucuuucucccucccuacaucacuccuugagucuggagacccuuuccgguuguugcuccaaccuuuccauaccccagcaucucuguuucauuuccuuaacacagucucugucucuauggucuuccaagaccuguaaagcuuccaaaaacagaggagauuagaaauggggucguggucugucucuaggccucaauguuuuucugccuaaugucugucuccaucucucuucccuucccccagcccacuccccuggcccaucccaucccgguaccuaagccucuauguguguacauguguguggucagagcuucccguuuagggaaaccugagccgaggcuguggggguggagacggggaucuggcuguugcugaccucggcugcccccuccccagaugggaaauggggaaaggggcugaggccagacgcccagccccacccccaaccggccugacggugcagggagugagaccuuacacauucuucuccaagcagaaacagcugugggaggccccgcccccuccaaaaguuaccgaggaggggagguguucagccgcuaccccugcccuccgcugccugcgcuuugccagaccccuccauccaguccacuaagagggugggagaaggcaccacugcagaccaguaguggucuggccucucucccuccucacucucugccccucuucucagugcugaguccuccugguuagcaugaaguggugaugggagagcagaccuguaccucacacuccaccccuuccccaauguaggcaguagaggcucucagccaggccucaaagaggaggagguggaaggcugggacaggagccugccugauggaggaguagaaaagcgcuaaauauaaacaccucagguguugagggcuccugggucuuucagaagaggaaguggggucacuccugauuccagaaacccccugucuuauaagacaaccuacaucuccauccaucacucagaaacacccccuaugaaacaaaacagaaaaccccgaaguuagacuuggugacucugugagacaugaugugggcaugucacauucagaguggaaguauugcagagagaggggaguggauauuguguauagagggguccuguugcuccuaggaaggaaaaauaucccuuccagcaagaaggacuuggguuagacuugcagaaggacuuuuuuuuuuuuuaagauuuauuuauuuauuauauguaaguacacuguagcugucuucagacacaccagaagagggcaucagaucuuguuacggaugguugugagccaccaugugguugcugggacuugaacacuggaucuuuggaagagcagucggguacucuuacccacugagccaucucaccagcccaggacuucuuaacauagaugaaagggcaccggaauguaaagagaggaaaaaagauauggggacauuugggcaaagaagucucuggggacaacaggucauuuagagaugaacucaggcugucuguuccccaacucuugacuccucccccugguggaaaaacugagaugacaguuauggaauccaucacucccccaaaaguccaucauuuuacauauaauuuuaauuaugcaagcaguguuagaaauuauuccuuguaagauacugucuuguaauaauguaaacuggccuugaugaagugcugaaaaagacaacugauuuuucaauuccuuuuagcuuuuccuucgagcuauuaaagaccaagucaugugaugccacauugcagauaaggaaaguaaagcccagagaggucaagacaccuaccuaaggucuuacagcugggcaguggaagagaugauuggaucuuggacacugagggccaagucucaccuuaaauauucauuggcccgcacaguuccccucaucuuccauuugauucccuaugcugagaaggccacuaccuuuugaauuggcuugagucuguucugauuuuuuucuaauguaucuacucucaaaaacaguuugcaugccaggaaagagauggagaauaccgggcaaagcuuugguuuuuuauuuaccaauccaggggauggaacuaaggguaaggaacaggauaggcaagugcuguacuauucagccacgcccccagccccucacugggggauucuaggcaggggcuguaccacugagccacgcccccagcccccucacugagggauucuaggcagggucucuaccacugagucacgcccccagccccucacugggggauucuaggcaggggcucuaccacugagccacacccccagcccccucacugggggauucuaggcaggggcuccaccacugagccacaccucuagccccucacaggggcucuaccucuccuccuuuguuguuuucaguuuaguuuugguuugguucaguuuuugagacaagaucucaguguguaaccccuggcuggccuggaacucaaagggauccaccugcuucuguaucuugucuggcccuagcccucuuuuugaggcugggauucucugauuccuagacaggcuuugaacuuugcuccugucugcuucccagagcacugaagaaugucaaaccccaccccuggcuugucucgaagguuuugcuguuuuauaaaaguccaguuucuugggugaggucccaagacuuugcccaugguccucgaaaugggguccagccagaagugacaccagguauggaaaugguuagauaaugcaaauuuggggguucaaaucuagguauguccagaagcucacaagcugggacuugccaacuuuggguuuugaagagcccccauguuuggccggacuuaggaccauugccaacuccugucggcagugcagcauauagaaugguggcccccccauuagaucaucaccacugggucugcacucaggagugcucucaucugagcacucgggcccucuggagaugaaggcaggaagauugaaagugagucauccuuggcuacauagagagugcaaggucagccuuggcuaccugaaacugucuccaaacccaaaaaagaugauggcguuguaguugucuucgcuuaagugaagucugcucugcucccaucaugaugaaguuacaggauggcacauuuuaaagaaugugucccugugacugugauucuggcuuccucccuccccugcauguccuuucucugcucaguacuguaucacagaaaaaucugccuucaucccucuuaacaacuguguaguauuccaccacgaacauucuaguauucauucaucagacguuuccuaaguucuaagcccaagggagaagagugccacugugaacauaaaaccucuguccuagugagaaaucacuucuuauugggagacaugauaaaccagugacacuuuuugugcaugugcgugaggaagcaugagaaaagggagaacgacagggugcagaauggcaaagggacuauuuuuaaaaggcagaggaugggagaucacaucagaaaagcccaagcaguguguguguguguguguguguguguguguguguguguguguguguguguagggggcgagggucauguugcacaccgaaugcagugguaaccagagggccaugguaaccagagggccaagcagcagaccagucugguccacuuggaacaugacacaggcaguugauggcagccugugggguuuuuguauauuuuuuuccucagaugccuccugauaguauaugcacaaacuuuucuuuuuucuuuuucuuuuuaaguuaagguugauugauuaggccacgggcauccaagugcacccagagugggggacauuuguugaccuucauugcacagacagggccacauggggguuucuuucuguucugggaggggaagaggccaggccuggaggagacaagggcuggggggugggggaggacuguggcugcugccuagagccaggccagucuuucugcccuaaauaggcagggcugggugcuggccccgcccucccgccagcuuccagacaagccgcuuuugucugagggucaacugucugccccuggcagccgcuaccucuggucucacugaguccccugugagacauucccuggcccugccucuguggcuuccaaaauaagauaaaauccuagauuuuuuuuuuaaauuguagagacagggucuuguggaccgggcugcccucagacucaguagguagacaagaauggcuuugaacuccuuauccucugccucuaccucccuggucagugcuaggacuacaggucuuuuauacaauacuggggacuaaacccagaguuuccugcuaggcagucacucuuccaacuuagcuccaucccccaucccagucccgagugccuuggucugugcucacugcugaggccaccaggaaggcuagauuuacagagggacuuacaggaggcacgaaggguguggcuccuccugaagggaagaauugugaggcguuugaauugcacugcuuguuuguuauaugagguugccagucugcugcagcagcagggagcacuaagggggaacuuccguaagaacuucccauuggugauaaagggaaguguaguaccucccgaaaagagggucaaaacugaugaggcagccucaagaccacccuuggaucugccugcucccgcacccucgcaccccgaccuuuaccacugaauucucccacagcaagaagaccugaacuuaaagcccucauguacugugucaugugccagcaacauccuacuagaaggugcaggcaagaagguuauggguucaaggucauacuccccauacagggcaaguuugaggccagccugggcuuugugcgagugagacucuggcucaaaaaggggcugggguacaucuagggacuuugucucaauaaggugccugccaguugagcaugaaagagcugacuuugagucuccgggacccaccuaagaagccaggcaagaggcuggggugagccugggagagucaggaggguuguggagcucaucagaacaaggcuagccuaagaaagugagacucugccucaaaaaacuaggcgaaugaagcuagagagaugguuccgugguuaagagcucuugcugcacaaucaugaguucgaaucccaucaccacaugggaagcagaaugucuuauaugugucucuaacugcagcucucaagaggguggagacaggaaagucacugagcaccugaggcgcagguucagggggagauucugccucacaggaauagacagagagugauagagugcacuugacacccuccucugaccucugaccucugaccucugcacucaaguacagguguacacacaugcacacacacacacacacacacacacacagagucaccuacagacauagguaaauauuuuuuaaaaaaauaagggagcuaaaaaaaaauaagggagcuggguaugguggcacacaacuuucaucucagcacucaggaagcagaggcaggaggaucucuuugaguuaaggccagccuggucuacaaaggguguucuaggcuauuagagcuaaauagugagacacucucucaauaaguaaaugaacacacaaacagggcuggagagaugaugaaguggcuaggacacuggcucacuucaagaggacaugaaugugguuccuagcacccguguggcucacgugugucuguaacuccaauuccauggaauccaaugccuuauucuguccuccaugggcaccagguggucacaggcauaggugugggcaaaacgugcaugcguguuaaaaaaauugugugugagugauggaauaaaucuuuuaaaggggggggguagccaaugagauggcucuguggguaaagggcacucauugccaagccuuauuacgugauucagucccugagaccuacacaguagaaggaucugagaacugacuccuuccuacaagcuguccucugaccuccacacaugugcacgugugugcgagcucacacacgugcgcacacacacaaauguaaaaaaauaauaauaauguggcaagucaaugagaaaggcaccugaucauccuuucauugucccacccccaaauaagaagauagcaggagcuggagagguggcucaguuaagagcacuggcugcccuuccagaggaccugagcucaguucucagcacccacauggcaucucacaaccaucucuaauuccaguuccaagggcucguacauccucuuccugucucuuagggcacuggacacacauggugcucagacaaacauucagccaaaacacccaucuacauauaguuaauucauuagccaauuaauuaaucaauugauaagaugccaguugugguggugcacaucuuuaauuccagcgcucaggaggcagaaguaggcagaucucugugaguuccaagccagccuggucuacagagugaguuccaggauagccagggcuacagagagagauccuaucucaaaacacaaaaagacaaaacaaagaugugaagagagacaggagaaaagcuagucuaauaggguuucaggagcagaugcaagcauagcuaauagagaaugaacuaacaaggggcccuucugagucuuagcucacauagauggggcuacagcaugaagacuggaaguuagccuuaucuuccuaacggagauaagggacaggggacugacauuuccaaauggaucucugccaggaauucaugaacaggaggcagguggguucuggagccuucuaacggccuuguuuuucuugugcuucaggaggcccugccugggcucaucugggaccugggccagcagcugggagaccugagucuggagucugguggccuggaccaggagagugggcgcagcucaggugagggggugggguuucuccaggacaccucagucuuucucaguaucuaucucugcagucccucucucccagacccaccucuucccuuccccaccccugcccccuaauugucucagcuucuuccuggaauccaggcuucuaugaagaccccaguucuacuggaggcccagauucaccacccuccaccuucugcggggacaguggcuucuccggaucuggcuccuauggacgccugggucccucggacccccggggcaucuaugccagugagagacccaaguccuuagguauggcaggugggugggguccucugacagucagaagauagcuuugaacauaaaauuggguccaauuuggacucccaguccuggcuaggauugucagucuuggugcaguuuuagcaucucucuuccuucugagcuuucauuuaguuaaugcgauccuaagagugucuacaucaccagacauugggagguauaccuuacuugggggggggggcaggguuaaagauuuauuuauuauuauauguaaguacacuguagcugucuucagacacaccagaagagggcaucagaucucauuacggaugguugugagccaccaugugguuggugggauuugaacucagguccuuuggaagagcagucaguguucuuaaccgcugagccaucucuucagccccuggggugcaccuuuacuccuagcacucaggaggcagaggcaggcagaucucugaguuugaggucagccuagaguacauuuaaaguuccaggucacugucccuaauacacacuugccccuucucuccaucucucucucuccuccuugacaggggucucuauuauauagcccugcuaucuuggaacucacuauauagaccacacuggccucagauucacagagaucagcugucucugccuuccaagugcuggcauuaaagguuccugccaccaagccuggccucaggagggagcuuuagaaagccucacugagccccugaccccuggcauuugggagaaaugagaggaauaggccaaacugacacuggagaacaggccaggaagcagaaaccacaagcucaaaggccagaggccgccaauuuggggcauuuaggaggucaacguggcugcagauauaaggauaugaaugggcaguguaagcagugggugagggucagagcaagacaagaaauggagacuugaagggaucuugccaucaaccauauaggaggggaugagugaggcguggucuuggggggggaggcguggcuugcccuauccagaccugggagagaagccuugauuuuacucugguuucuauguaacccuggcugaccugaaacuccuuauguagaucaggcugacccgccccuuccccucccagacuugcagcaguucuccuguuucagccucuccaguguugggaguguuggcaggugugggccaccacauccaacuuaauuguugguugaggcaggcucucacacagcccaggcuggccacagacuugcuauguagcugagggcgaccuuaaauuccugauccuccuaccuccaucuauccugugcugagacugcaccaguaugcccaacuuauuuuuaauuuuuuacagaagugggggcugggguggguucucccaacaugcucaguaacugagcauggccuccacuuccucaguuuugugacagaucacguucaccacgaagucgguuacguauuuauuuuacacuauuaacuugcuacauagcucagguuggcccaggacuggaggugauccucuugccucagcugcuucaauuccaggcuuaaaaaggccuuugagaaucccuccuuuuuugcuucugccucucuccugcaggcgacgccagucccagcgccccagagucggugggugcccggguugcagugccucgauccuucucagcucccuauccgacggcagcagccggagcugagaccugcucauccgcggaacggcgggcucgugccgggcccuuccugacaccuagcccacugcacgcgguggcucugcgcagcccaaggccaaguggacgcguaccgugcggcucgccggacggggcggccagccggccccuugacggcuacaucucggcgcuccugcgcaggcgccgccgccggggggcgggccaaccgcgcacaagucccgggggcgcggacgggggcgcgcggcgccagaacggcgcgcgcccgcggccgccugaagcguccccgccccccggaggcgcgcgacccgcgcgggaaccgucgacagagcgcgccugggcugcggcgugggaggcggagguuccacccgaacccgcgccuccggccgccgcgucgccgcccuccaguccggcagagggccgccucgugaaggcacaguacaucccgggcgcgcccgcggccuccaggggccucccgggccgcgccgcgcgccgccgggcuccgccgcuuacgcgaggucgcaguguggagcaguccccgccaagggaacggccgcgcgcugcgggccgucggggccgccuggcagagccgucggggcgucggggaucgccgagggcgcgcaaagcggcgcgcucgcagucugagaccagucuacugggccgcgcgcacgccgcuccgccacccaaguaccccacggccgagcgagacgaaccccgaccgccccggccccgucguggcccagcgcccacgccgacgguccaggccugccgucgguggcguuccaccgcugagaucgacgcaccggauggccgccgcccccgagcccgcgugcccgcgccacgaggccccgcacccucgccaucugcgcccccgcgccggcuguuguacgguugcgcaggcagcgacuccgagugcucagcgguagggcggccggugccgcucggccgucggaugccgucuggaugcgcuccaggaggcuauggcgaaagcgagucgagcgccagcgagggcgagucgcccgccuucagcucugccucuagcgacuccgacggcagcggaggccucguguggccgcagcaacugguggcggccgccggggccucgccgucggggcccgggggugcugcugguggagggacgccugcgggccccgccaaggucuucgugaagaucaaggcaucgcacgcgcugaagaaaaagauccuucguuuucggucggguucucugaaggucaugacgacugugugaguuggggcgggaugggcuugaacuucacuucaccuccauggccuccgcacccccacacuucucauccuccaacccucuccacacccaccuuccaaagaccaccaguuuucucugcuuccaaagacccuccucacucacugcccgccguccauagccguccuggagaggccgccccucuccccccacggggaggcgcccagauugucccacgacagcugguuuucaaagccuugaaccagaaggcaccccuccgugggccacacucuccccaucuguacaauggguguacgcaaaugcaguaauucuguucgggucucuccuccuucacccccguuuuaauuuuagaagcuuagucuguucuccacuucucugacauagccuucucauuccucuuuuccuugcccagauaggguccccuucucauucacaaagugcccccuccaugucccuggacccuuaggauacccccuggggcccccaagucagagacugucugacucagguuaugccuacagagugccaugcccuggaagaggaaguggcacugucuuaggggcuuugagggucaaguaggaguugccaacaccuggaaaggacucuuucugcuccauccuuggacagucauggggaauugggagguuagagagaggaaggaagaugguuucaaucucgugccucuccccacggggggugggggacgcugaaugacccucagcuguuccaauccaguggguuuuuuugauuuguuuguuuuuguuuuuuuuuuuuuauuaaagaaauuacuguauuuauuaugacaauggugacuccccggugcauggggggccagauucuguguguuucucuaaccucuuuguaaauaaaugcacaguguuacauaccccuggauucuuguucugcacugaaugagagcugcgucccuuucaaccugcauguauggagcgccuucaguuugcuguggagcggcagugagcccagccagguggugggcaccaggcugaauuugaaugucgcuucacggccauuuuucuuucccagugacucugacu

SEQ ID NO: 3582 - RNA, 12389 nt, Mus musculus
agucagagucacugggaaagaaaaauggccgugaagcgacauucaaauucagccuggugcccaccaccuggcugggcucacugccgcuccacagcaaacugaaggcgcuccauacaugcagguugaaagggacgcagcucucauucagugcagaacaagaauccagggguauguaacacugugcauuuauuuacaaagagguuagagaaacacacagaaucuggccccccaugcaccggggagucaccauugucauaauaaauacaguaauuucuuuaauaaaaaaaaaaaaacaaaaacaaacaaaucaaaaaaacccacuggauuggaacagcugagggucauucagcgucccccaccccccguggggagaggcacgagauugaaaccaucuuccuuccucucucuaaccucccaauuccccaugacuguccaaggauggagcagaaagaguccuuuccagguguuggcaacuccuacuugacccucaaagccccuaagacagugccacuuccucuuccagggcauggcacucuguaggcauaaccugagucagacagucucugacuugggggccccaggggguauccuaaggguccagggacauggagggggcacuuugugaaugagaaggggacccuaucugggcaaggaaaagaggaaugagaaggcuaugucagagaaguggagaacagacuaagcuucuaaaauuaaaacgggggugaaggaggagagacccgaacagaauuacugcauuugcguacacccauuguacagauggggagaguguggcccacggaggggugccuucugguucaaggcuuugaaaaccagcugucgugggacaaucugggcgccuccccguggggggagaggggcggccucuccaggacggcuauggacggcgggcagugagugaggagggucuuuggaagcagagaaaacugguggucuuuggaagguggguguggagaggguuggaggaugagaagugugggggugcggaggccauggaggugaagugaaguucaagcccaucccgccccaacucacacagucgucaugaccuucagagaacccgaccgaaaacgaaggaucuuuuucuucagcgcgugcgaugccuugaucuucacgaagaccuuggcggggcccgcaggcgucccuccaccagcagcacccccgggccccgacggcgaggccccggcggccgccaccaguugcugcggccacacgaggccuccgcugccgucggagucgcuagaggcagagcugaaggcgggcgacucgcccucgcuggcgcucgacucgcuuucgccauagccuccuggagcgcauccagacggcauccgacggccgagcggcaccggccgcccuaccgcugagcacucggagucgcugccugcgcaaccguacaacagccggcgcgggggcgcagauggcgagggugcggggccucguggcgcgggcacgcgggcucgggggcggcggccauccggugcgucgaucucagcgguggaacgccaccgacggcaggccuggaccgucggcgugggcgcugggccacgacggggccggggcggucgggguucgucucgcucggccgugggguacuuggguggcggagcggcgugcgcgcggcccaguagacuggucucagacugcgagcgcgccgcuuugcgcgcccucggcgauccccgacgccccgacggcucugccaggcggccccgacggcccgcagcgcgcggccguucccuuggcggggacugcuccacacugcgaccucgcguaagcggcggagcccggcggcgcgcggcgcggcccgggaggccccuggaggccgcgggcgcgcccgggauguacugugccuucacgaggcggcccucugccggacuggagggcggcgacgcggcggccggaggcgcggguucggguggaaccuccgccucccacgccgcagcccaggcgcgcucugucgacgguucccgcgcgggucgcgcgccuccggggggcggggacgcuucaggcggccgcgggcgcgcgccguucuggcgccgcgcgcccccguccgcgcccccgggacuugugcgcgguuggcccgccccccggcggcggcgccugcgcaggagcgccgagauguagccgucaaggggccggcuggccgccccguccggcgagccgcacgguacgcguccacuuggccuugggcugcgcagagccaccgcgugcagugggcuaggugucaggaagggcccggcacgagcccgccguuccgcggaugagcaggucucagcuccggcugcugccgucggauagggagcugagaaggaucgaggcacugcaacccgggcacccaccgacucuggggcgcugggacuggcgucgccugcaggagagaggcagaagcaaaaaaggagggauucucaaaggccuuuuuaagccuggaauugaagcagcugaggcaagaggaucaccuccaguccugggccaaccugagcuauguagcaaguuaauaguguaaaauaaauacguaaccgacuucguggugaacgugaucugucacaaaacugaggaaguggaggccaugcucaguuacugagcauguugggagaacccaccccagcccccacuucuguaaaaaauuaaaaauaaguugggcauacuggugcagucucagcacaggauagauggagguaggaggaucaggaauuuaaggucgcccucagcuacauagcaagucuguggccagccugggcugugugagagccugccucaaccaacaauuaaguuggaugugguggcccacaccugccaacacucccaacacuggagaggcugaaacaggagaacugcugcaagucugggaggggaaggggcgggucagccugaucuacauaaggaguuucaggucagccaggguuacauagaaaccagaguaaaaucaaggcuucucucccaggucuggauagggcaagccacgccuccccccccaagaccacgccucacucauccccuccuauaugguugauggcaagaucccuucaagucuccauuucuugucuugcucugacccucacccacugcuuacacugcccauucauauccuuauaucugcagccacguugaccuccuaaaugccccaaauuggcggccucuggccuuugagcuugugguuucugcuuccuggccuguucuccagugucaguuuggccuauuccucucauuucucccaaaugccaggggucaggggcucagugaggcuuucuaaagcucccuccugaggccaggcuugguggcaggaaccuuuaaugccagcacuuggaaggcagagacagcugaucucugugaaucugaggccaguguggucuauauagugaguuccaagauagcagggcuauauaauagagaccccugucaaggaggagagagagagauggagagaaggggcaaguguguauuagggacagugaccuggaacuuuaaauguacucuaggcugaccucaaacucagagaucugccugccucugccuccugagugcuaggaguaaaggugcaccccaggggcugaagagauggcucagcgguuaagaacacugacugcucuuccaaaggaccugaguucaaaucccaccaaccacaugguggcucacaaccauccguaaugagaucugaugcccucuucuggugugucugaagacagcuacaguguacuuacauauaauaauaaauaaaucuuuaacccugcccccccccccaaguaagguauaccucccaaugucuggugauguagacacucuuaggaucgcauuaacuaaaugaaagcucagaaggaagagagaugcuaaaacugcaccaagacugacaauccuagccaggacugggaguccaaauuggacccaauuuuauguucaaagcuaucuucugacugucagaggaccccacccaccugccauaccuaaggacuugggucucucacuggcauagaugccccggggguccgagggacccaggcguccauaggagccagauccggagaagccacuguccccgcagaagguggaggguggugaaucugggccuccaguagaacuggggucuucauagaagccuggauuccaggaagaagcugagacaauuagggggcagggguggggaagggaagaggugggucugggagagagggacugcagagauagauacugagaaagacugagguguccuggagaaaccccacccccucaccugagcugcgcccacucuccugguccaggccaccagacuccagacucaggucucccagcugcuggcccaggucccagaugagcccaggcagggccuccugaagcacaagaaaaacaaggccguuagaaggcuccagaacccaccugccuccuguucaugaauuccuggcagagauccauuuggaaaugucaguccccugucccuuaucuccguuaggaagauaaggcuaacuuccagucuucaugcuguagccccaucuaugugagcuaagacucagaagggccccuuguuaguucauucucuauuagcuaugcuugcaucugcuccugaaacccuauuagacuagcuuuucuccugucucucuucacaucuuuguuuugucuuuuuguguuuugagauaggaucucucucuguagcccuggcuauccuggaacucacucuguagaccaggcuggcuuggaacucacagagaucugccuacuucugccuccugagcgcuggaauuaaagaugugcaccaccacaacuggcaucuuaucaauugauuaauuaauuggcuaaugaauuaacuauauguagauggguguuuuggcugaauguuugucugagcaccauguguguccagugcccuaagagacaggaagaggauguacgagcccuuggaacuggaauuagagaugguugugagaugccaugugggugcugagaacugagcucagguccucuggaagggcagccagugcucuuaacugagccaccucuccagcuccugcuaucuucuuauuugggggugggacaaugaaaggaugaucaggugccuuucucauugacuugccacauuauuauuauuuuuuuacauuugugugugugcgcacgugugugagcucgcacacacgugcacauguguggaggucagaggacagcuuguaggaaggagucaguucucagauccuucuacuguguaggucucagggacugaaucacguaauaaggcuuggcaaugagugcccuuuacccacagagccaucucauuggcuacccccccccuuuaaaagauuuauuccaucacucacacacaauuuuuuuaacacgcaugcacguuuugcccacaccuaugccugugaccaccuggugcccauggaggacagaauaaggcauuggauuccauggaauuggaguuacagacacacgugagccacacgggugcuaggaaccacauucauguccucuugaagugagccaguguccuagccacuucaucaucucuccagcccuguuuguguguucauuuacuuauugagagagugucucacuauuuagcucuaauagccuagaacacccuuuguagaccaggcuggccuuaacucaaagagauccuccugccucugcuuccugagugcugagaugaaaguugugugccaccauacccagcucccuuauuuuuuuuuagcucccuuauuuuuuuaaaaaauauuuaccuaugucuguaggugacucugugugugugugugugugugugugugugcauguguguacaccuguacuugagugcagaggucagaggucagaggucagaggagggugucaagugcacucuaucacucucugucuauuccugugaggcagaaucucccccugaaccugcgccucaggugcucagugacuuuccugucuccacccucuugagagcugcaguuagagacacauauaagacauucugcuucccauguggugaugggauucgaacucaugauugugcagcaagagcucuuaaccacggaaccaucucucuagcuucauucgccuaguuuuuugaggcagagucucacuuucuuaggcuagccuuguucugaugagcuccacaacccuccugacucucccaggcucaccccagccucuugccuggcuucuuaggugggucccggagacucaaagucagcucuuucaugcucaacuggcaggcaccuuauugagacaaagucccuagauguaccccagccccuuuuugagccagagucucacucgcacaaagcccaggcuggccucaaacuugcccuguauggggaguaugaccuugaacccauaaccuucuugccugcaccuucuaguaggauguugcuggcacaugacacaguacaugagggcuuuaaguucaggucuucuugcugugggagaauucagugguaaaggucggggugcgagggugcgggagcaggcagauccaaggguggucuugaggcugccucaucaguuuugacccucuuuucgggagguacuacacuucccuuuaucaccaaugggaaguucuuacggaaguucccccuuagugcucccugcugcugcagcagacuggcaaccucauauaacaaacaagcagugcaauucaaacgccucacaauucuucccuucaggaggagccacacccuucgugccuccuguaagucccucuguaaaucuagccuuccugguggccucagcagugagcacagaccaaggcacucgggacugggaugggggauggagcuaaguuggaagagugacugccuagcaggaaacucuggguuuaguccccaguauuguauaaaagaccuguaguccuagcacugaccagggagguagaggcagaggauaaggaguucaaagccauucuugucuaccuacugagucugagggcagcccgguccacaagacccugucucuacaauuuaaaaaaaaaaucuaggauuuuaucuuauuuuggaagccacagaggcagggccagggaaugucucacaggggacucagugagaccagagguagcggcugccaggggcagacaguugacccucagacaaaagcggcuugucuggaagcuggcgggagggcggggccagcacccagcccugccuauuuagggcagaaagacuggccuggcucuaggcagcagccacaguccucccccaccccccagcccuugucuccuccaggccuggccucuuccccucccagaacagaaagaaacccccauguggcccugucugugcaaugaaggucaacaaaugucccccacucugggugcacuuggaugcccguggccuaaucaaucaaccuuaacuuaaaaagaaaaagaaaaaagaaaaguuugugcauauacuaucaggaggcaucugaggaaaaaaauauacaaaaaccccacaggcugccaucaacugccugugucauguuccaaguggaccagacuggucugcugcuuggcccucugguuaccauggcccucugguuaccacugcauucggugugcaacaugacccucgcccccuacacacacacacacacacacacacacacacacacacacacacacacacacugcuugggcuuuucugaugugaucucccauccucugccuuuuaaaaauagucccuuugccauucugcacccugucguucucccuuuucucaugcuuccucacgcacaugcacaaaaagugucacugguuuaucaugucucccaauaagaagugauuucucacuaggacagagguuuuauguucacaguggcacucuucucccuugggcuuagaacuuaggaaacgucugaugaaugaauacuagaauguucgugguggaauacuacacaguuguuaagagggaugaaggcagauuuuucugugauacaguacugagcagagaaaggacaugcaggggagggaggaagccagaaucacagucacagggacacauucuuuaaaaugugccauccuguaacuucaucaugaugggagcagagcagacuucacuuaagcgaagacaacuacaacgccaucaucuuuuuuggguuuggagacaguuucagguagccaaggcugaccuugcacucucuauguagccaaggaugacucacuuucaaucuuccugccuucaucuccagagggcccgagugcucagaugagagcacuccugagugcagacccaguggugaugaucuaaugggggggccaccauucuauaugcugcacugccgacaggaguuggcaaugguccuaaguccggccaaacaugggggcucuucaaaacccaaaguuggcaagucccagcuugugagcuucuggacauaccuagauuugaacccccaaauuugcauuaucuaaccauuuccauaccuggugucacuucuggcuggaccccauuucgaggaccaugggcaaagucuugggaccucacccaagaaacuggacuuuuauaaaacagcaaaaccuucgagacaagccaggggugggguuugacauucuucagugcucugggaagcagacaggagcaaaguucaaagccugucuaggaaucagagaaucccagccucaaaaagagggcuagggccagacaagauacagaagcagguggaucccuuugaguuccaggccagccagggguuacacacugagaucuugucucaaaaacugaaccaaaccaaaacuaaacugaaaacaacaaaggaggagagguagagccccugugaggggcuagagguguggcucagugguggagccccugccuagaaucccccagugagggggcuggggguguggcucagugguagagccccugccuagaaucccccagugaggggcugggggcgugacucagugguagagacccugccuagaaucccucagugagggggcugggggcguggcucagugguacagccccugccuagaaucccccagugaggggcugggggcguggcugaauaguacagcacuugccuauccuguuccuuacccuuaguuccauccccuggauugguaaauaaaaaaccaaagcuuugcccgguauucuccaucucuuuccuggcaugcaaacuguuuuugagaguagauacauuagaaaaaaaucagaacagacucaagccaauucaaaagguaguggccuucucagcauagggaaucaaauggaagaugaggggaacugugcgggccaaugaauauuuaaggugagacuuggcccucaguguccaagauccaaucaucucuuccacugcccagcuguaagaccuuagguaggugucuugaccucucugggcuuuacuuuccuuaucugcaauguggcaucacaugacuuggucuuuaauagcucgaaggaaaagcuaaaaggaauugaaaaaucaguugucuuuuucagcacuucaucaaggccaguuuacauuauuacaagacaguaucuuacaaggaauaauuucuaacacugcuugcauaauuaaaauuauauguaaaaugauggacuuuugggggagugauggauuccauaacugucaucucaguuuuuccaccagggggaggagucaagaguuggggaacagacagccugaguucaucucuaaaugaccuguuguccccagagacuucuuugcccaaauguccccauaucuuuuuuccucucuuuacauuccggugcccuuucaucuauguuaagaaguccugggcuggugagauggcucaguggguaagaguacccgacugcucuuccaaagauccaguguucaagucccagcaaccacaugguggcucacaaccauccguaacaagaucugaugcccucuucuggugugucugaagacagcuacaguguacuuacauauaauaaauaaauaaaucuuaaaaaaaaaaaaaguccuucugcaagucuaacccaaguccuucuugcuggaagggauauuuuuccuuccuaggagcaacaggaccccucuauacacaauauccacuccccucucucugcaauacuuccacucugaaugugacaugcccacaucaugucucacagagucaccaagucuaacuucgggguuuucuguuuuguuucauaggggguguuucugagugauggauggagauguagguugucuuauaagacaggggguuucuggaaucaggagugaccccacuuccucuucugaaagacccaggagcccucaacaccugagguguuuauauuuagcgcuuuucuacuccuccaucaggcaggcuccugucccagccuuccaccuccuccucuuugaggccuggcugagagccucuacugccuacauuggggaagggguggagugugagguacaggucugcucucccaucaccacuucaugcuaaccaggaggacucagcacugagaagaggggcagagagugaggagggagagaggccagaccacuacuggucugcaguggugccuucucccacccucuuaguggacuggauggaggggucuggcaaagcgcaggcagcggagggcagggguagcggcugaacaccuccccuccucgguaacuuuuggagggggcggggccucccacagcuguuucugcuuggagaagaauguguaaggucucacucccugcaccgucaggccgguuggggguggggcugggcgucuggccucagccccuuuccccauuucccaucuggggagggggcagccgaggucagcaacagccagauccccgucuccacccccacagccucggcucagguuucccuaaacgggaagcucugaccacacacauguacacacauagaggcuuagguaccgggaugggaugggccaggggagugggcugggggaagggaagagagauggagacagacauuaggcagaaaaacauugaggccuagagacagaccacgaccccauuucuaaucuccucuguuuuuggaagcuuuacaggucuuggaagaccauagagacagagacuguguuaaggaaaugaaacagagaugcugggguauggaaagguuggagcaacaaccggaaagggucuccagacucaaggagugauguagggagggagaaagagcuggagccuuuucaauuugaaagucaucauuagaguuccucggcgaaucauacucucucuccccucacucccuagcuaucuucaccuggccuccccguguuacugagccaugggaccaaguagaagaaagaagugucauuggguugaucaaaaugcccccggggguccucagggacuguucggggguuucucagcagccggucucucucuccagaggccugaagauuccccuucccccaccccgcccccuccagggaucuccaagcaccccgagacuuaaggaaagaugaagauggauuccggguagcggggcccagagggagguuauguuugaaugccggcugugugaccuugggugagucucuuccugucucuaagccucaguuuuuuucucuguaaaauggggacuuucaaacccucaugaaauaggaaaucuguaagaagacgaauguuugguuuaacacacacuaggcauccaggacgguuaacaggguccaugcugaguccaacggaggccgugcauccucccuaucagcucuauuuggggguaggaaaagccaggucuccagucuuaucucuuucccccugccugcuccccuacccuaggaccggugugcugagcauacacuaccaagacagacagacggacacaggagcagggaggugggggaacgaaugggggagggaggaaugcauggauggacgcacggacaggcgaccccucaccagcugcuccuccagggcugcugcggcccugcgcgccgcugccgcauccucguccuccucggcguccuccucguccucagccucggcgccccccaucccgggcugggccagccgcagcgccugcugcacgcgguacuccugccucucucggagccaaugcaacucgcagagcccggccaggcugccuuccaaccauccccgcagccgaccccgcuccgggcucaccgggaacgagaaggcccggaucauggcugcggccccccgccccagcccggccgggccccacggccgccccucucgccggucccaccuccccgccccagcagcccgcccgcccgcuggccgggcugucaccgucucaucugcauaggcgcccgcccauugggccgcccacccgcgccucaucuacaugaccacgccccugaaggcacgacaacgaccuacuauugguuguugccuuccgugacgcagggcuccgccccgccccauuuuuccuuaacaacgcaugcccaggacuaccuacggggguaucagacucgccacgccccuuugugcggcgauccuggggcuguggccacgccuucuuuauaaucacaaug

SEQ ID NO: 3583 - RNA, 4109 nt, Mus musculus
auaaaaaaauaaaaagaaaucaucaaaaaauuuuguuuucaaaauaagcuagugguaugggcaacaccaugugaaaccuggaugcguucuucgggggaugagcagagaggcccauaagucccgcccaggagggaauagaggacaugaggcagcuggggcagggagcuaguacuuggcgccucagucaggaccucucgguuguauaacugagaaggaggccuucaauuccaacagaugugaaauaguuauccugcaacuagugucucgaguucauggggaaaaugaaaaaaauagaaacauacucaucucgugccgggcugcagugcuucaccauccacaaagcucuccacacacgcucagaaagaaagagaagagacggacgcagacccccccacccccagcaccaaaaguggcccccacguucugcccuugacucguuuuuuccccuaaagugcaggcaccaccaggucaccaaguuuauuggauucauacuucugcgggggaggauaaagcugucuugagggcucagagcagggugcaaaagagucgcuugucgcggaagggauucucggcggcagggacaggagucaccagugggucauccuuagcgugcguuucgcagaaagccaaaagcucggcugcugccugcgacaccugcaggugagggauagagaugcaguugacccgcccuagcuugguucccggggaguguccaaauucccgcccuguuuccugaccacgccucgacuggccacgcccccggcccacgccccaccuucccaucccaccucagcucuaggcuccgcccucaacggagccuaaugcagacccucaaccuauuuccccaucgguuuaaugcaccuucaugcgaucgauguucacuuccagcuucagcugcuccacggucuugcgggccucagcaaucuuggccauguuguuggacauggcugcagcaggaaagggguuaaaugucuggcaggaguguggacugggggcuggaacacucuuggaucccccggggaguagcgagaagagguggcgugacccagucaguaacaggagacgugguugggacuaugagugaaugggaucccagagacagguagaggaaaggaugacgacucaagaagacaggauggaggggugcacggauggagguaucaagaggcugcuggaggaagagcagaggggcugggaaaggaaggagggauggauacacaggaugggaggcugagaggcagguggaggagggagggccagaaggacagggccacaggugcuugaucagaaucuucucauccaggugcccucacccccugggggauagagccugagccaggaaggggggccccuccccaggccaauuagcagcgacuccagggagaacugagaauuaagaucucggcgggaggggcacagaggaggccucauuagggccucagcagcagcugcccccucugccacccucagggacccacccccucuccagcccugacugccucaaaggcuccucugcucauuagcaggcaggggagaggguuggggcaagccaacccagccagccauucggagugguagagagggugacaagugaaaaagccaagggagggacagagugacagaaaugacaggcaugaagaaggaaaauagacugaggauggagauagagguacugggggagagaugaugaggaagaggacggggggggaggggggaggaacaaaaggaggaguagaagcagcuacagacggaccagaaacggaggagauaggaagacggagacaggagaggagaaacccagacagagagggacauggcaggguuagaagagaaaugaagcaaggaaaaaggagagagauugggaggcacaggcagaaggagaggacagaggagaagacggagacacacggaaguauaaagucauugauucucucagucacccauucacucauucagucccacagggacagauaguggccaucuaagcagcuaccaggacccggacaggagcuuccuaccuaccuguugcagcucagggcugggauggcugaugggugacagaggcugacagaggcaguggcugguccucuucccagccccgcccccucccccggggugcagccccucaggaccgccuucuccuccuaagcaccaccugucuccaugcccugggucugucucugaguccucuccuugcacugaugaaucuuccuccuccuccuccuccucccccuccuccuccuccuccuucucucucucucucuuucagccauuccuguuuagagccugucuuucucuggagucccucugucacacuugcacuaaaagacgggcccuccagguguauacgcucaugcacacaagccucuccucuucccacucagccucccacucuuucacaggccaucagaguagcagccucaccccaucacagcacaucacagcacacagacucaaaagucgcucacacagggaugcauccuauuuugcugggucacugaguaacccagucccgccccaccccccacccccccacuuaacccaacacacaaugacaaagguccuuaauauaccugcccacugcugacacucaugauuucucacagcagaggucacugcacagucaggcacaguaucuuagagagucaaauguauacauuguuaccuaccagugcagcuuuaacuucuccugaaguucgcauucacacugucuuggagucucacacaaccacauacugguucagccucacugccaagcgcuccauugccuagugugacagagaaccacgugcuuuucuuuccaggagcgccuuuguguggucacauuuacuccuggucaauuuccugauacacaguggcccacauucucccuccccauacugugucacauguuauuacuaucauagcggcacagugucuuuugguaucauacauuguugacauuugauaacauggucuuuuacacacacacacacacacacacacaccauugugggcacagccuuugcugggccuugaagucuauacuacaaacacuugucacacucacucacucacuguuucucucuucuacauucaacauucccugucucgcagacccuguaaacucaccucugccacccagaacaaucacacaccuuugcacaggcagucacaaacacaagccaaccucucagcgucacacguggucacccaguuucucaggacucaccaguguggcagacauacugucucacauccacacaguuggccacacuaggucccucucccgagccucccucuugcauucgaucauuugaucacuugggcauuccagcuccccugacucucuacgcucuguaacacgcguggucacccuuacauguggucagacuuacgaacagucuccaggcagguccucucucagguccaaugccauacacaguggcccacagucucgcugauaaaguguaacaaguauaacauggucagccacacaucacaccuacucuaacagucccacugaaccccuucuugucauuccuaaucucaccuugucacacagucacacaucaucugcuggcgucccacaccaccucugaggcgugcccuuacacuggcgugggucgcaccaccucuggacgucgcauccagaccacagcaucgcuugcuugccucgccgccaucaaggacucccuauuggccacacgguggcgcccgcgaaccaaagucgcugcaggagcucaagcagaagaagaggcgaagacuaggcguccccguccgcccagcagaagauagaaacgggagaucugggggacccaagaaggauaagagagggagauggcucccuaggaaggugaaaguagugagggaucagagugagaggacggaaaaugggacagagaacuucagagggcggugagaacugcaaagagaaacagaacuaaguucacagagagacagacgaaggauagaugauggaugcacagggagaggccacaggagacagauacacagacugagccuuggagacagacacucagagaccgagucaagccugccaagagacaagagagacagagggagccuuccccgcuggaccacacggcggaggccgugccuauagggag

SEQ ID NO: 3584 - RNA, 4418 nt, Mus musculus
ggagggagaagcugacagagaucuacacagacucgcacacagacaggagagacugagggacuucagaaggcagaggugcuggagggucuagaaagcagaaaugucaaggaggugacagagaaguguagaggaaagaacaggggguaggggacagggaacacugaggcacaaagggacaaggaccugacagagaaggaaagaaacaggagagggacagacacaggagaagacagaaacaaaagacagaaacacacgggcaacugggaauugacuggcagaucccagauccuaugaagaugauggccagcgauggacauccuggacccccuucugucacuccugggagcccucucagugcagguggcagagaguggcagggcauggcaggcuccugcuggaauaucaccuacguucaagacucgguaggaccugccaccagcacgcugauguucguggcugguguagugggcaacgggcuggcauugggcauccugggugcccgacggaggucacacccaucggccuuugcgguguuggucacugggcuggcggugacggaucugcugggcacgugcuucuugagcccugcaguguuuguggccuaugcucgaaacagcucucugcugggccuggcccacggugggacgaugcugugugacacuuucgccuucgccaugacguucuucggccuggccuccacgcucauccucuuugccauggcuguggagcggugccuggcacucagucaccccuaccuguacgcccagcuggacgggccgcgcugcgcccgcuuugccuugccuuccaucuacgcuuucugcugccucuucugcucacugccccugcugggccugggcgagcaucagcaguauugcccagggagcuggugcuucauccgcaugcguuccgcccagccuggcggcugugccuucucccuggccuacgccagucucauggcccuguuggugaccuccaucuucuucugcaacggcuccgucacucucagccucuaucacauguaccgccaacagagacgccaccauggcucguuuguaccgaccucucgggcacgagaggaugaaguuuaccaccugauucugcuggcccucaugaccgucaucauggccgugugcucccugccucucauggugagugucccucggagcuggggugcagggggaggaguggagggcagcauccaucugugcucuccacuugucgugucuauuugacagaugugaaaaccgaggcucagaaagggucagauggugacuuuguguuccauguacuccugaguacuccaagaagucucucugcuuucuuuuccuccacuagacaaucucuagcccuuagcuguccugucaacaccucucagccggcuccccuauccaacacaccguugugauaacaggauccacaacucacgggcacuugcuuucugccgacacaacgcuuaauggcauuccaaaugccucuucagaugaauuucaaauugaccuuacacaaucauuucagaagcacugggcaggaaaugacacugaagucccauccugucaaccucuuuauagaaagaugauagugcuugcugcccgagaucacacaggcuggcugagucuccuccauccuggcucucuccucccggagccuggccauauaaccaugagcaccccacacacucccugagccugggcccugcccuugucccccacacccuucuuucagccucacagggaccuugugcuguccccucccacuauagcagccaguggggcuagccacguuuuuaugcuggggguuggaacacgguuuggaguguauuuggggugcuggagcccuuugaggauuaacaaugucugacaaacucaucuccaaggguggcuccacacgaggcuuugggagccucagcgggcucaggcuucucugugggcuggggguggggugggguggggagucgccucagcgcaaacggugggucugguaggucaguacccacugccccacccugucuuuccucugcccgguguuugcuauguccuggggcuuuccugucuucugcuccccggaugccugcacacguuagcaacucagccugcaucuuucuucaucuuaucucauuuccuuccccuccggcugcauaaguccccaucccuguggguaauaagugggagguggggugaaaggaugggggaggaccacccaugaugcaucugucaccuguucugccccucagauccgaggcuucacucaggccaucgccccagacagcagagagaugggggaccuccucgccuuccgcuucaacgccuucaaccccauccuggaccccugggucuucauccuuuuccgaaaggcugucuuccaacgccucaaguucugguuguguugccugugugcccguucuguccauggggauuugcaggcgccccuuuccagaccugcaucggggagaagagacccaccggcuccuacuucucuccaggcuaaggaagggagcugggugccccugucguccuggggcacgggacagguggcaccauugacugcugugccucugacugguggugacggcugcucugugggaaugccauccaagucagaggccaucgcugccugcucccucugcugauaucugagcugguccugcaugucauccuaagcccgcugucacaggaccagaagccagaagaucagggacucaacugacgguagcagaaaccacauauuugauccccagagucugggggugucugcugcugcuucuccuccuucgguaugguggcuagaggccuuggaaagagggugagggaugccgaagguucuauggcucucaagaaggauucucucaaaauaaccagggccugggcaggcugcucuggccccugggcuccuccauccaucucucugucuaaauauuuagggagcagaaaaauucccagaggcuucuguggacucgagucuacugggguuagagugucugcucuccucuuccacugagggggccccuggcugcccaccccagguccccaggggacacaaggcauuccagcaacuucugcagaaaugugucugccucccccauuucccauccccuaucugacuuggaaaucuugaaccccuaagaggaagugagaagaaaggagggccacugcacugcaggugacauugcuggacacaugccuggcacagaaauggucugagaaaugccacagcuaucuuggggaacugcgcugugugaacuuuggaggagggcacagggacaaggcggagaugguggugauguagcaugcagaggcuccaaaggacuucacaggcaugcuuccuaggaugcaugucccaagccugugcccccauccuggaacaacuuacugccaccuuucagaacuggaccacaacucaccaucuuuggaaucuccacaaaaguuucccucauucauucaacaaacucccgggggacccugaagucagcaggcacucacucuuccucccucggaucagggucgcagaaaagucccaggccuccaagcaaagaauccugggugcguggaaaugagcugccuggcaugaggggaagugagucagcuggagggccgggcugcaugcgggagggcaagccagugcuccugcugauguuucuccugguuccuguuucucagccacuccggucauucguccucccacuccaucugcucggcagcauauuagcaaagccucuccagagaaaguggaaccagggcccagagagggcaaagcccaagcuuggaccacacagcagaacuuucucacggccucucugugccucaguuuccucagcucuaaucugacaggggugucuugaggaguaaaggacucucucccaaaagaacacuuuaacacaggaccuggaaggaagccacagaggguguuacuguuacugcugucaauauuguuaucugggcaaacauagaaacaaaaaacuagaaaauaaggcaaggauuucuccugaguuuuuuuuuuucucccaaguaaguauauuuccaucacacucagaaaaagcaaagagaaucgggagaagagaaaacaggcagagguaagcuggguguggaggugugugccacaacgccucggcccuucuucaggcaggaggucagaguucaaggucauccuccacuacauacaggguucaaggucagccugggguauuugagacucucaaaaccaaaugacaacaacagauaaaaccacaaaacaaaccagucugaguugaccagucaguccucagguacugaaagauacuaucugaugccaguugcugacuuuguaaaugauccaaauaccacugaauggauaauuugcugugaaugauaaaugguuaaaaugguaauuuuuauuuacggguauuuuaccacaauaaaaaaaauguaauagugaaaaaauaauga

SEQ ID NO: 3585 - RNA, 4932 nt, Mus musculus
uggagaccgccggggaugcggaucugaggaccuugugcaggaagcaagugcgcaugagugaucuucaacgccagcuggccagcucgguauagaucaaggcugugugaccugugcugacuggagcugaagcauagggacggaguccuggccucuuuggggccagagccugcgcuugggaaagcagcugugcuccaggcuccuagcuuugaccugggugaguugucagaagcgggggaggccagaauaucccugugaaccuguggagcgccaggcuccaggaaccauauucaggacacgugagcaccaggggcccaggcugggaaggaggauccugggagcgggggugggggguagcggggaggagaggcgcuauggacgaggcguuguguaaggccaaagcuguggaggagucaggggagaccuauauuccuguccaucuuccaggggauuugaccucacugccuuguuacuuugcaggauucauauuuggggagccuuacuuuaccuccacccccuuucuuucacgaacagguagagcagaaagaugucggagcccguggccaugacccugcuggaagauuggugcaggggcaugggaauggacauccacagaucccuguuggucacugggaucccugaguacuguagccacgcagaaauugaggagaccuugaaugggguccucuugccacugggcacauaccgugugcucaacaaaauuuuuuugaggcaagagaacgugaaggcugcucuaguugagguuagcgagggugugaaucugagcucuauaccccgggaguucccagggaggggcggugucuggagaguggucugcagggaucccacccaggacgacgacuuuuuaaaaaaucugaacgaauucuuggauggcgaaggacgcacuugggaggauauggugcgccucuugaagcuuaacccuaacccaccgcuaccgaauucaaaccagccuccaccgaacugggcagaagcccugggguugcuccugggugcaguaguacaggucauauucuacauggaugcugcaauccguagucgggaugaagaagcaagggcugaggaggcugcugaggcugaguugauggaggcuugggcuuccacagcgaggaagagaguaaagaaggaacccgggcugggcgucgaagugggcucagcuuucaagauggaggaccgaaacuauuggaagaacacagaggaccauggugacccuccaaaaccucuaguucgcaggccuggagguaagauucgcuccaggaggaggaagcagaaaaaaaaucuuaagcaagagccaauaugcuggaggaaaucccagggcagcaauuacaacagcaauuacaauaagguuaauuuggaagcuggugaagcugcccagagcucagagaucccagagucugucaagagcaacaaaaaacccuuugugaagcaggaagagacaguauggaagaagaaaagagucuggagggaucccagcgaucuuccucggucugcgcugccugcagcugacagccccgggaaccuagaggauucagaucaagaugguggaccggagaaccccgcaaagaagaaagccaugaccugggccucuaacaagaucccuguccccacgaggaagaagaagaagauggugagcuugggcacucucuccuauguccugcuugaugcugaagccaccaagaacaaaacagcgauucugaagaaagggcuuggugcuagaagggcugugucgguaccucaugaugcaccugcuucaacauccaggccucagaagaccaagcugggagccuucccucgagucuccaaaggugaaugcacauagagaugacuugguuaguuaaggugggguucagugggguacagagggggccacaacaggguaaccaggaggaccucaggauauugggggaggaaaaaacaagcuacccucccaggugaggauuaucaagcaagaggcugggccucccuccuagagcccuuacuaggcaucauuggggucaagguugacccaugaccaucugauccauuucccuccauaaaaauguagcaguuuuggcgcaggacaucgugucacaugcuuguaaccccagcacuugggaggcaaagcagaggguugagaguuuaaggucagcugggcuauauaaaaauuuaugauuugagauucuguagucuguugagguguagggaucaaaggcuaacguuucuagggccuggcuggguagggguggagguggggguggccacgguccuggucucaggagauucccaggcaguaaauaucuaauuaugguucuuccugcuucccuugguguguucugaucuauccauagauuccaggaagcuaugauuuggggaacccuguacccacggaggugagagagcaucaaggaagaagacucaaguuggaagagaacuuuuucuuugugguugaauaaaaccugacugugaaccguugggggcccagugugccugugugggucagacucacacaggcaauggauguaaggccuuagguugggggauacugucagggggagauucccucugugucuuuuccugaguuggagccacuuuucauuucugcacagccucaaagguggacaagguaauaaauagcuuuggaaaauucuagaacguucuuucccuuugcccacaaaggggcucacgguauugcgcacccacauucagccuuuauucucuucuaccccugcuuuuucuucuggaggcauagcuugccugcucggccugcggcccagaagggcauguagacauuuuguuccuugcacuguacgaauuugguaagucagaccuugcucuuugaagcuugcuguguggauucuucaguguucacccuccagcagccuaaauggaaauugagauccugagaguuaguucugggaaaaaaacaaacaaacaucugccugcccuugaauccuucaguuuucauugucuuugaagaaaacuaggggcaaggaagaugguucagugcauaauagggcuugcagugcaagcuuaaggaccugaguucuaauccccaggacucacauaaaagucugugccuguaacaccagcaucagguggugcagacaaguagaccccaagagcuugcuggccaaccagccuaucugaaauagugaacuucugggcuggggaauccccuagugaggggauaggggcauggcuccgugguagagccccuguucugaauuccccaauaaggggcugcaggcaggguucagugauagagccccugccuagaauccccuagugagggguuggcgcggcucagcacuacaccccuucccagaaucccccagugaggggcugggagugggcuuagugagcuucugccuagcauaugcaaggcccuggguuccaucuccagaaccaauaaaaaacaaaauggaauaaaaauggcacuuuaguucccaaaugcggugauacccucuuuagaagccugugguggaaaggagagguugauagaauuaaauuucuagcucuaauuccguugaccucuaucuuugaggcuuaaauaaguugcucacauuauagucagaagaagaaaaucugucucuuuuuaaaaguuucuuuaaaaugagcugaucucuaccuucugaauuuagugcugccauuaaaucugaccaugccucauucugugugccuguaaaccagagaggauggugccacccccaucugugguuucuaaauuauauccugaggacuccuuuuucauguuuaaaagcaugaaagagaggcuucagauaugggugagugggaaaagggguuugacaucaagcccgagucccuggguucgauccccaggacccacaucacggaaagaaagaggugaccccugaaaguuuuguucugaccuccacauuuauuccauggcacaugcauacccccauaaauaaauauaauuaaaaauuauguguggaagaagcaaagguguugguguguggccguaaccccagcauguggagccugaggcaggagaaugucucugaauucaaggccagguugggcuacagaguaauauccugucucaaaauaaauaaguaaauaagaacaguuuuuuuaaagugugggaaaacaacaacucaguuguguuguaauccaaaauacugcuguauucccuuguguguauaaauaacuguaucugguuauccacacugugcuuugcguacaauuguauuuuccuuuguguauguguguguucaucuaugcauaugugcauguguguguauguggaggcagaggauuaccuagggugucacucuucggccaccagccaccuuuuuaugagacaggguucucucacuggcuugaaacuggcuagcaugcuaggcuggaccggaacugcagggcucuccugucucugccuccccagcucuagggcuacaagccggcgcuaccauguucuuuuucuuuuugcacagguucuggggaucaaacucaauuccucauucgugcaacaugcuuucccuacugggcugucccugccacccccuaaugaaguuucuuguaaaugugaacuuugaggagaagggucggaagguguggaagggauuggauccccugcauguccuguaacaauauccugagugaguuuaugcaucucugugucuccaucuccuguucagccgugauugacauuagggucacuagcuaauaaucugggcuaaccugggacagcgaaggauuucuggccuggauuuccagcccucucgagauuucaugaccacucccaccuucaguuuucuugaucuaaaaacucuugucagugagucagucaaccaccagacacguuucuugugguaaaccuugagacucgauuacaucuuuguugaaguaguacaucgguacaacuaucaaugaauguaaaugugugaguguaaaauaaagcuguguaaaugaagu

SEQ ID NO: 3586 - RNA, 1125 nt, Mus musculus
ugccggagcaagugcagccgccacugccacauccuggucuuuaacucugucacagggcacagggcgaccucugggccagccauaagaaggaccuauuucaccugcgagucgccaccccaacacucacaaggguggcagcagcaggugggagaccagugaccucggguccacagagauugccaaaggccaccggcagcgcaggggaagucugcaucuucaaacucuccuuggagcaaccuugccuaagaccugggagccacgacuacucagcuccaauuccguggcugacgugagucacucgcagggggcaggcugcagacggcugggcugggcagggguccucuugacugaguuggaccaauugggacuaucgguagccucaccugugaggccuuguuuucucaucacucuugaaaagagacuucagcauccuggauccuucugugguuucucgaggcagcuccacagcgcagcagcgcgcguacagcugccucaaggaguugggcaaaaugguauuuggagugcaggacauugcauuguuagaacaugguugcaaggccuuggagguagacaguuacaaguccuugaugaucuuggggaucccagaggacuguagccaccaagaauuugaagacaucauacggguuccccucaaaccacugggcaaguuugaaguggcugggaaggccuuucuggaggaggacagauccaaggcagcuaucauuagguuggcagaagaccucaauuacgaugugguccccagggagaucaaaggcaagggcgguguguggagaguggucuacaugcccaaauggcaggacauugaauuccucaccaaacucaauauguuccugcggagagagggcaggacgguagaggauguggcccgcauccucaggcaggagcugugucccaccacgcuaggucucggagagcuaccucccaggaagggcugccugucuccgcaaggggagaaugaagacaaggggcccaucaccaaggguaauggggugcccccucuggaggacccagagaaggaggacaagccugaagaaggaaagaagggcaagaagaaaaacaagaaaaaucggcgccgacagcaggcuucugauaagaagcugugag

SEQ ID NO: 3587 - RNA, 3532 nt, Mus musculus
caggagagcagagcuuggaaacagcacgagagcugaagcuuuucacagaggguacacagagcaggaggcaggugguagaggucaugauggacugcguugcacuuuccuguaaagucuguaccuccuggcaggggcuccugcucacaggugaggaggcuacucuuuagcacugagugggagaaggggaucucacagcuuguugaaguuccugaagaagucaagaaccuggggauagucuuaggguuuugggaaguagacauagacaggaacaggaacucugcaacagaaagugacacaagauaguauaauggagaaauagcaccauuguuuucuauugaagucaaucgcauggacaacuguauucuaaggauugauguucccaaccaugagagugacuguccaauuuaaaaaaaaaauaggaagaugauuuaauggucaugcuguuggcugccaauccuaagacagcaauucaauucccaacacauacaaggugugugauuuccauguauaugcuguguaugcauucaccuauacacaaaugcacaugagugcacacauauauaaacauucaccuuccucacacauacaaacaauacuaaaaucuuguacuaaauguuucauuagcuucauauuucagcauuuuucaguguacuccuggauuggaauaucccuggcacaugcauucuccaacucauccaaagguauccaagccuuuaucaguucuggacuuuccaaagauaucaggcucaucuuguuucuaauaaaucucuagacuaauggaauauaaguuagaccagaaagaacaucuagaaguagaaucagagaauucagaccaaagagagaaaacaaaaaaucaaaaaaaagaaaaaaaagaaagaaagaaaggaagaaagaaaggaaggaaggaaggaaggaaggaaggaaggaaggaagggaaaggaaaggaaaggaaaaggaaagaaaagaaaagaaaagaaaagaaaagaaaagaaaagaaaggaaaggaaaggaaaggaaaggaaaggaaaggaaaggaaaggaaaagaaaugaaaagugacgaucucuagagcaagagguaacaggagaugccaucucagcccaaguacucugaauauaggcaggaagcugagggcaguguggggaguccuugaggaacccaaggaaagaguuccauacacagaacagaacagguucagggcaacugauggagcaguggagguuauauuguucaccccuuccaaguaaaaaagugccacucacaccuacccaccuagaguaagugaugaucugucaacucaggacacagaucucaucuuuccaucaaauauagaggucccaauguucaugaaauuucucucuuuccuucuagucucccuuuuaaccugcuggcugauucccacuacuucccagcucaccaucaaaucagugccucccauugcuguugaaggggaaaacguucuucuguuugugcauaaccugccgaagaauguuaaagucuuuuccugguucacaggagcuagagugcucaagaguugugaaauugcaacucaugugauagcuaucaaugcuacugugaucggacuuucacauagugguagagagacaguguucaaaaauggaucucugcugaucaagagugucaccaguaaagacucaggauacuacacucuacggauacuugaugcaaacucaagaccuaaaauaauacguacagaauucuuuguacacaguaaguaauuuuuugugugaacucuguuguuggguggggucuaguccauugaacauucugaaaaaugucaggccuaaacuggaucuccugacauuuugucucuauguuguuguuugaggauuuagugcaggacaugcauuugggguacaaaguuucauggaauggaauuccucacuuggcugcaccugcagagagguagacuugugcugaguaacucagacaaggaugucagccucaacccagacccuuggaccucucaccaaaaacgugcacacgaguugaggaagacaugaggaaacuaugggaucuucagugaccuuggauccagaccucuguccuagacucagcucagagugacagaggacagaagagcuaauuucagagcaacaaggcuuagggggcccugcuggagguaaaggaguucuucaaggauggaguacugagcagacaucagaggcuguagagaaggcagugaaugcugagccuuguagacagucaaggggaaagucccauacagaaguucauggguaccaagugcaugaaauuugugugcugaccuccaccgaguaggauagauacacccucacucacagaccaaggcugauucauaccugcucagggcucagagauauuucuuccuacuaaaugcagaagaaccacuuuugaggguuuccauuucuuuuucuuuuuuccauuuaggcccacuuuuagguuacaagaagcaucucaccccuucucaacucaaaauugcguuggugccaccuaggguugaagaaaacaucaauguuauuuugugggucuuucagaugccaaagaagcuucaagccuuugcuuggcacaaaggaguacuuccacuugaccauuugaagauagcaagccauucauuccuaaccaauucaaccaugcuggggcaugcauauuaugacagauugacaguacgcaacgauggguccuugcuucucuugaaugucacaaagaaugacacagggcuuuacacccuacgaaccauaucuguugauuugaaauuagaaugggccauuauugaaguccaaguaaacaguaaaugauucuuugugacuccugggugauggugggguuuauucuucucuguaaacuuaagacagugagguuucuauucuaccucccucccaucuggaauguguacucucacuuggguuugagccuuuaguaaaagacacacaucauggggcaaauugaaauacaucagaagccuugacccggcuggaaccugcagacgguaguaugguaacucaguccaggugucuuagucaggguuucuauuccugcacaaacaucaugaccaagaagcaaguuggggagaaaaggguuuauucagcuuacaauuccauacugcuguuuaucaccaaggaagucaggacuggaaauuaaacaggucaggaaacaggagcugauacagaagccauggagggauguucuuuacuggcuugcuuccccuggcuugcucagcuugcucucuuauagaaccaagacuaccagcccagagauggucccacccacaaggggccuuucccccuugaucacuaauugagaaaaugccuuacaguuguaucucauggaggcauuucuucaacugcagcuccuuucucugugauaacuccagcuguauccaguugacacaaaacuagccaguacaauuuaccccuugucaacuugacacacaaacacaucacuaguaagccucaacccuuacauuuuuauucauccccaagaucuaaauaacuuuaaaagucccacagucuuuacauauucuuaaaauuuca

SEQ ID NO: 3588 - RNA, 40849 nt, Mus musculus
aaugggggcgcagaagggcguggccuugacugccaugggcgugaccuugcgcgggugggaggggccaggacgcuguaggagccuagcugagaagaugcucgggccagcaaccaccaccagcagcccggucucugcugcugcccucgcccgccgccccccgggcccccacuagcgaccgccuccgcuucuuaucuccggccccccgcccugagcagggccuugggaggggggcucggccccucgcaucuguggggagcccucaagaaaggguacagagaggguguccugucuacaccucugcaccccacuggcucagugaccggcuucggugaucuuugagagaccaggaccccaccccucaguucuccaucccagaccaccccccauacccucuccacccugcuccccuccguccuccagcucugucagcgcuucccccccccagcccccucccgcuucccuccccgccgcuccccucccccuuccucgccgcccccuccccucccccucccuccccucccccuccuccgcccccccaccaugaggaugauggccgccggcgcggugcacggccucuucacggccuccgcggccccgcagccgccgccgcccccgccgccgccgccgccgccgcagccccagccuccccagcagccgucgccgccgccacagcagccgccgccgccgccgcagccgccgcagcagcagcagccgccgccccaggccccccccauggagcccgaggccccggauucccgcaagagaccccucgagacgccccccgagguggucugcaccaagcgcagcaacacgggaggugaggcaaagcugagggaccgcggcguggggcguggggggggaucgcgcgccgaagggggcaucgccguccuccaucauccccccccaucccuggcuggcaggugcaagugcuucagggaggggaggggcaccccuccgcgaggagauggggacccggacggaccccuuucucuugucgccgaggccccgggggcugagagcuuugucugcgacgaaaggggcugggggggagggggugguaaguguccuugugguguaugagggaaccaaggaugaggggcgugggucccuucugggccaguguguccuugaggggugugugaugugacccuuucggggcagggguguucccucgggcuugcgugucccgguugggggaggggaaggaguagagucaggccuguggaccgagagcuucugagccucacucccuggggauguccugaacaaggguugucccggaaaggggcggguguggacaguaugcaggaccgugcauggagacagacuggguggguguguugggugacauggaagaaaggguggguguguaaaacuggaggggaaagagauggaaggcuaggacagguguguauccguggugggucguguagggccuggauaugugacauuaagggaccauggaugugacgggguaggggugugugaguauguguguaaaagagagccggaugugagguccuccaagggaaggugcuuaccagcccggagggggcucuuguccugugacacaccagugagaggggguguguaacaugcagggggguguguagggaggcagaaaggauggacucugggugugaaccgugagaacauucguggaccgggaaaagggguucugugugggggauaccgcuguguauaggguggagugggaccaguagaagcuggugcuaggaugugacauggaaaaggguguaggugugacucuagagaggcugggugugacacauggaggugugcaauagugacaucagagggggguguguaacugggggggauggggggaugaaaagggagagcuggggcuugugguucagugaaacccauggaggguguguucccaaggaaaucggggggaaaaauggaguuccaagcgacuggggacauaugcuuaaaacacccuggagcuuggaguugugugacacccaaaacuguguagauguguauaagacagagagcucuguguagaauaacugggugugucacgcuagagaugugggggagaugcaggguguacaagagcagaggacaugggugugugcacacguguaugaggcagcucaguguuagacgccucggagaugugucagcugcacaaaacgggcccucuacgugugccauccgggagaggugugcacagcagagaaacacaagccaagcacaggacuccacuuacuauccucgauguuagggaacaaguagggcaugggagaagagggauccucagggcgcuucggaucucugauaagaagacccaaaaauauaauauacagauugauucucccucaugagugcccuguucaaaauccccuccuaaucuuguucuugucuucaacaaacaguauaauauccuccagccuggcuuaggugcccacuucccacccaggcauaugcacaggcucccacuucuugcucucacccccucaccucaagccaggugggacaggaucccaaguuccuuuggauccaugggagggugcucagcagaaauugaaggaaagggaaguugggggagggguggaagagaauuuccugccuaucuuccugcacccacccccaacacacguaugaaaauguccaaagccgacuuccuuucuuccuuccugcccugcugcaguugccagucccaguaaggcucagggacccagauuuggcuaggcggcacauuacagcaagcagcugcuaaagaaggccccuucaagugcugcccuguggugccuacugccaucaggcaggcuccaagaucugggugaauuucccaacacaacccucagaagacauuauuugaggugcguuuuuaccggugagggaaacugaggcucugcaagauaaaacaucuuguccaaggucgaaggcuccuaaguggcagguccagaauuuauugaacccuggacuggcuggcccacugggauuucaaugcuuccuucuacauugcugaaacuaagggaccaugacugcagacccuuccucaccuccaaaccaaguaugaggaagcaggccaggagauacaaaagggcaguccucaauugagagggauagucuggggcaaggcaagcgguaaugacuuugaucucgaauuuucugguuccuuucaaugggggacggugguggcugugggacacuugauccaccccugccccuuuccaagcuucuguguccccuacuucccaauacagacaugacgauaacuacauugauaaugucauaauggcuggcaauaucaaugcuuaaugccugacauacaauugcaucuccuucucccaaugugcuaugauguuuaaaaaaaaaaaaaaacaauaaauuauaauaguggcuaacguuuauggugccgggaaguauuauggaauguacugaacaugggucauugaguacuuccaauucuguuaaccaucuuucaaaugaacaacugaagcacagaacuggaaacuugggcaugauuuucccauucagcuaagaggaagcaggauuugaacucggagacugacuccaccguguggacagacucuauggugaauguccuguugagaggacucugagggucagagugaugaggaccucacaagugagagcaaugcauacagaccuggcucucgcccuccuccuuguucucaggggcaguggaagaccaggagauaguguucccucuggcuggugucuggacaccuggcugacaggugccauugggagguaaaagaaauauucagggcaagaggauuccaguagagagacugggagaaaauacaacucagggaguuauuugaagaaauaaaagaaacuacauguaaucccagcuauguagcggcuaaggcaggaugauuucaaggccauccugggcuacauagccagacccucucucaacaaauaaugauaaauaaauaaagugaaugaacaaauaaaaaaugaggcuggggauguaguucagcuagggagccuuuaccuagaauccccuagugggugccuggccuagaaucccccagugaaggggcuggggguauggcucagugguagagccccugccuagaauccucuagugaggggcugggggcguugcucagugguagagccccugccuagaauccccuagugaggggcugggggcguggcucagugguagagccccugccuagaaucccccagugaggggcugggggcauggcucagugguagagccccugccuagaauccucccaccccccgugaaggguugaaguauagcucaacgaucaaauacuugcccagugugcacaagacacugaguugcauauccaguaccaaggucuggggaggaaaccugucugguaaacuuaagaauguccccaggagagccugccucaagguggcucagcuggaauaggugcucacugcauaagccuggucauguggcugggauccccgaaucccauguaaagugagaggagauguccacauggcacaugagcccacacuugcaucacguacacacacacaauaauaaaaaaaaauaaauuuaaaggagugguaccuauagugcagaccauaauauucccuguauucccaccucuacugccucaucgccugcaggcaaagguguaccucacaccccaggagccccccacccagaucucaaccccaguagcccuuacccacagcacaaagaaaggucaccaggacaagagcccuggcacaaugaggcuggagagauggauggcucagcaguuaggagcacauguucuugcagaugacucugguucaauucucagcaccuacauaguggcucacaaccgauuguaacuacaguuccagggacccagugccaccuucugccucccaagagcgcuaggcccgcauguggugcacauaccauguuggcaaacauugcuuuaagauuuauuuuaugucucugaguguuuuacucaccuggaugucugugcacacuguacuuaagcaaagcacuuauacacuuuaaaaaaaaaaaaaaaaaaaaaaaagagucucggaaggaagccuugcuagguccaaagcauaucacugccaugugcuugguaugggacucacagcaagugaugccaaaggugcaagccucuaucuucccucuggaaaauggggacaguaaaugguuugagccucagucuccccucuggacaauggggaaaguuaguuucuguucuggauaaagugacuggucugggugguucugucuaguuacugaaauucccugugagagcuagacauggugacccaugcuggacgucccucccagcagccacguggguucuggagauccaaacuccaggcccuugcuggcauacaccggcacugaggggccauuucuucaccccaucauaacucccgacuuggccaccaagaaucuggaaaacuaaucccuuauuuauuuauuuauuuauuuaugguguuuuuuuguuuugggggguuuuuguuuguuuguuuguuuguuauuuuuuuugagacagggucucucuguguagcccuggcuauccuggaacucauucuguagaccaagcuagccuugaacucaagagauucaccugccccugccucugccuuccaaguacugagauuaaaggcgugagccaccauggccugguagacuaguucuuuuuugaaaauuauuuuuuauuauuuuaaagugugugugugugugugugugugugugcgcgcgcacacacacacacacacacacacaugcacauggucacauguguggaugcccuuagagucguggcacuccccuggaccuggaguuacuuuauaugugcucuuaacugccuugccaucucuucagucccaguuuuuagguuuuuuuguuuuguuuuuguuuuguuuuauuuuguuuuuuggacauuuaagagagaguugcccuaagggggcuuuacccuugauuuuuguuugguuugguuuguuuacaaucguaugacauuuauucauucaagcugagggcgugucaggucagcuuguagaaacuggcucucuccuuccacauugugggucccaggcaucaaaugcaggucauugcauuuggugacagguaccuccauuuaauagucauucugccagccccaccuuaacccccuccuuucuucuucuauuuuggaaugcuagggaauugaagccagcacuuucaggcaagugcucuaccccugugccccaggcucacugugcacuagucucucagucucucuaacugcaucacaccuucagaauguuacccugaacaagcacaauccagauaggcugcuuuucugcacagacugacacaugaucauucauggagggaccccaaaugccugauaucccaccccuccccagcacgugcuaccacaccauacccuccauguccaguaacaccacccaugcuuccagugacauucucaacccuauacccuggccuccgcuuacuuucauauaacaugucaacucucccaucccagcucccacaagaacagguaccauaaggaccacaccccaacuuugauucucucuaggcaugguagagggaaaaaacaaccucucuaagaugugugggucuuugacuccgugugcauaugaguaugggcauguuguguguaugugcauguguaugugugcguaugugugugugugcaugugugugguguguccauucauuugugucugugcauguguuugugcauguuuguauacauucauguauguuccaugugugugcaugugugugucuuguguggugugugccugugcguguacacauacauguguaugugugcaugcaugaugugucugugcaugcauguguugcauguguguuugugugugugcauguguauauguguuuaugugucugucugugguguguguguguguguguguguguguguguguaugcguggugugucugugaauggauguguugcauguguaucuguauguguguaugugcaccugcguguaugcaugaaggccagaagaagaucucccauguccucuguugucacuuucuguuuaauuccuuugagcugggggucucuacuuaaauauggaccucauuuauuuuuggugaggcugacagcaggcaagugcuagugagccucccaucucuacccagcgcagcacugggcuaaaggcauauuugaguguaagacuuuguguauaggugcuagaauccagacuccgguccccaugguugcacagcaaauacuuuuaaccacugaguuaucucuccaguccuaaauguuauuuggcuuaugugugugcaugugugugugcaugugcaugugccugugcgugcgugcaugcgugcgugcgugcgugcgugcgugcgugcguguguguguguguguguguguguguguguguguuguuuuguaguaagauaagagauuugcuauguaguccccacugacuuugaauuugaagcaaaccuccuaccucuaccucuuuaguacugggauuacagauaugugccacugugacaggcugggcucuaauuuuaucacuggugauccccagagaacugagccaccuuacaggacucugggacagugucccuuucuuaccuugagaguccagaucccuuggguaaacaaagccuuaucugcaaggcagggcacugguugagugugcaucauuaagagaggcaggcauaaaaggaagaguuggccaggggcacgguaagcagaaggagccagccaacccagauucgccuugagauggacacucuugauacugucgcccugggggagacaggcaaguggggcaugguagcuuucuucauggacuucucuguugcugucacugggagcuguggaaacccccaaaggagcuacuaagaguaggcuggguguagacgagugugaguucuggccucuggccucucuucuucacgggcacagaaaauuugacauuagcuauugagacagggaaagguuugcaaagucuagggguuccagguucagcuaaggucaaugucucugccuuugcuauagggaacagaagcuuggcuuccucccagaagaggcgggauucucuggugugacaugccccagacaggaaggauagguggaagauucugcaaaggacaggcaacagauagagcacaguagagaacuccagaaguuaagaguuuugaguuucugcaggcugaagggcuaugacuguuggguuuuuucuugacuaucuuaaauuuacauugauacaccugccaaauuauaauuuacuggcaaugguuuuuaaaucucauugccacucuuuugggucaaaggguuguuuucucucgguucauuuuuugguguguaaaacaaugaguuuuuagcucggcagugguggcgcacgccuuuaaucccagcucuuaggaggcagaggcagguggauuucugaguucgaggccagccuggucuacagagugaguuccaguacagccagggcuacacagagaaacccugucucaaaaaaccaaaaaacccaaaacagaacaaaacaaaacaaacaaacaaaacccacaaugaguugggguuuaacgguuuagauuauauguagucacucagugugugugucugugucugugugugugucuguguuccugcauagucgaaugugugcgguuauaugugacacagcacacauguggaggucugaaaacagugguucucucuuucuaccaugugggccucagaggucaaacucaagguguaggcuugguggcagaugccuuuacaugccaaagcaucuugcaggccccucaucgugacauuuuuguaaguaaaucaugguacuuuguucaugcuuccccucgguuaccuucccuugcuccucccuucuuucccuaauaccaaugauccuuuugauuucauaucauacauggaggauacaaggauggauggauggacagaugaauggauggacagaugcuacauacauacauauauacauacauaauacauagauaaauauguuuuuaaaacagggucuuacguagccuacauucuccuugugcucuguaaguggccuggcaugaccuugcuccugauccuccugccuccaauucccaaaagcugacauuacaagugugugcgaccaugcccaggcuauguaguccuagggaccaaaacuuaggacauuaugcaugcuagagaagcaaacuaccauugagcuacauccccagccccaauaaucagagucuacaacucagagaagcucacugucuuuugcuuucuuugggguuuuugucucuugcauuucuucuuagaaacagccucacucacauuggguaggcuguccuguccuaucgcucuuucuguaguccaggcuugcuuuaaacuccugauccuccugcugaugccucacuagugcugggauuagaggugugcccuguugugguuucugucuccuuuccaccacaguuguuuguuuuaauuaaauuuaguuaauuaguuguucacucuguguaugugugugugugugucugugugugugugugucuguguguguguguucaaaugugcacgugcacacccaugccguggugcacgauagagaucaaagaacaucuugagaaguugguucucuucuuccacucugaggaagaucaaggguucgaacucccgugaucagacuuggagacaagcacccuuacccacugcacaucuccacaguccagguuucuuuggauguuuguuuguuugcuuuuuguuuuuguuguuguuguuguuuuucaacagaaacucugcaauucaggcagggcuggacauuccaaauacuucagcuucccgagugcuaggauacaggacaugcacagucaugccuggcuugaaauuuuuugagccaccucaccaacccagaauuuccccccuuuaaauaaauguguaaugugucuuaaaaguaguuuagggggaaagauacuguguggacuggacuauauucccaccaucuaaugcaagcauggucacugagcagguguucagggagggcuuguugcagaaagagaaggaagaagaaaaagagaaggaaagaugucaugauucaggagcacguaguagggcagaaaugaaguacguggcaguaaagaaagcuaaagaaagcuagcaagaugaaacaacagguuaaaaaauacuuccuaucaagucugaugaccugaauucacucuccaggaccugcacaguagaaaggagagaaucaacucuccagaguuuuucucugaccuccacacucacucgaugacauccaugagugucacacacacacacacacacacacacacacacacacacaccaggggaagugaacaaaauacaauaacaacacuuuacaaaggaagagauuccagacaggagcucaagcacaggguugccuucaugucacaaggccuucucuagacaggaugagagaaugcaaugcuggccuauaauuccaggcauucuggacacugaggcaaagaggaucuugagcugaaggucauucuggguaacuuagaucuuagcucaaaaucagaagcuaaaaagaaagcuggaaauguagcucucugauagaguacuugcuucaaauauacccauucuggggucuggggguguggcucagugguagagccccugccuagaaucccccagugaggggcuggaguguggcucagugguagagcacuugucuaauauauaggaggcucugaguucaauccaaucaauaguaccacaaaaaugaaaaaaaaaaaaaaaaagaagaagaacaggugagauugcucagcuaguaagacacuuacuaccaugugugaugauuuaaguagaaggaaagaacuggcuaccacaaauuauucucugaccuacacaugugcuacacacauacauucacacagaaggugggcuaaaaagacaguucaaagagaauguuccucuuccauaaaguagggcacagcauugggcagcccagggacuagauaaugagggacauagaguuccccucuuucuccuaccucccaacagaaugcccaaaccuuaagcacuguuuccacucaccaagcccagagcacccuuuaagugccgggcacugagcugcauuuuacuacaagcucuucagaggcuaaggcagggagaucaggaguucaagcccucccugaacuagauaaagacaacuugucucaaaacaaagaaaagaacaaaaacaagucccagugcaauugguggugcucaucuuugaucccagcagucgaggcagaggcagagaggcagaggggcagaggggcagaggggcagaggcaaucucugugaguuggacaccagcugguuuacauagugaguuccagaacagccagucucauaaacaaacgauggauuguggugaucacagugacauauggcauguauaaaugcuauguucacagaauauucgagcuacuuuccaguuuaucguugaaugauuauaucccuuagaagucagugcaacuguuucuccaauuuuaccguuaggauauuaagucccaaagaaguaggacaacauauccaaagccauacagauuuuauuuucuuucuuucccuuucuuuuuccuuuuacuuuuuuuucuuccuuucguuuguuuguuugguuuuauuguuguuuuucaagacaggguuucucuguguagcccugacuguccuggaacucacucuguagaccaggcuggccucaaacucagagauccaccugccucugccucccgagugcugggauuaagagugugugccaccaccgcucugcuccaguaauaagauuggcacuacauuugggauugucugccugcuccauacggaacuccccagcuagagccugaggggacacagggcagagggaaugagguguggaugucccccgcuuucagagacaauagauaauuuugagccucagaaaggaagcgaggaagcauaguugucaugguguagccugucauuccaacacuugaaugacugaggcaggaagauuauaaauuugaggacagccuaggauacauggcuaagcugcaucaacaaagagggggguggggaaagaaggaaagugaauugagcagggguccacaugauggaugagaagacucccugggggagucaggggagguuaauuaccuaauaggcuuaauggucugauuaggccauuuuaagaggauugcugugggcucaauaaaacccuuuuauucuugacuuccucuuagugcuuagaaggacagguccagccacugugccccgcacuacccuauaaaacauauuagggacccagaacccucacucugaagggccugugcugagguggggagaacaucuacccauccagaucaacuuuguuuaguuuaugacgugcuaggggaggagcuaaggaccuggaacacaguaggcaggggcucuaccccugagccacgcccccagccccuaacugggggaaucuaggcaggggcucuaccacugagccacacccccaaccccucacugggagauucuaggcagggguucuaccacugagccacacccccagcuccuuacugggggauucuaggcaggggcucuaccacugagccacacccccaaccccucacugggagauucuaggcagggguucuaccacugagccacgcccccagcuccuuacugggggauucuaggcaggggcucuacuacugagccacacucccaacccuucacugagagauucuaggcagggcucuaccacugagccacgcccccagccccucacugggggauucuaggcaggggcucuaccacugagccacacccccaaccccucacugggagauucuaggcagggguucuaccacugagccacacccccagcuccuuacugggggauucuaggcaggggcucuacuacugagccacacccccaaccccucacugggagauucuaggcagggucuccaccacugagccacgcccccagcuccuuacuggggaauucuaggcagggucuccaccacuuagccacaccucccaaacuacaaauaacauuuuucuaucugcucugggaggcagcuuuguucaccaugcugccaguuggggauucuguguuugaugguaaaaauagauauacucuaucugucuuagucaggguuuguauuccugcacaaaacaucaugaccaagaagcaaguuggggaggaaaggguuuauucagcuuacaccuccaaacugcuguucaucaccaaagaaaaucaggacuggaacucuuacagggcaguuggaacuuggaggcaggagcugauacacaggacauggaggggugcuauuuacuggcuugcuucuccuggcuugcucaguuuacuuuuuuauagaacccaggaccacccgcccagggauggcaccauucacaaugggcugggcccucccccuuugaucacuaauugagaaaaugccuuacagcuggaucucauggaggcauuuucucaacggaugcuccuuucucugugauaacuucagcuugugucagguugacacacaaaaccagccaguacaacaucugaaaggaaaaguugaaauuucugggggacaagaaaagcccuuaagccuugggaagcaggauggcccaacacccuuucuuuucccacuuugucccaagccuaaugugcagugucacaugguguaagggacacagaugugcucucugcugaugcgguccauauuggcccuaugugauaaauugcuccggauagauuaagcuaggugugggggagggggcucuucagucuucagcauuccaggaaagguuuucaggauagguggagcuccugaaaagaggcgauagagaggaaaugccaggccaagagcaucagccggggcccugacgugggucgggacagggaguauuugaagaaauaaaaggacagugaaucucaagcccacaggcgaugaggaagugagaccaaguaaccgauccacaucacuaaaggccuugagagaagcuugcagaguuuccauccugggaacaccuggggcuaacaauuuguuuaggagugaccuuaaagauauaccucaagaaugcauuagcuaagugguguccgcaugacugcauuaccgaggacauuggucuauaagaaauaaugcccaggggucagcaggauggcucagcagguauagaugcuugcugucaagccugaugacuugaguucaauccuugggauucacacagcaagcagaaggugagaacugaauucuacaaguugucucgucugaguaaagccuagcccagucagugaguuccaaaccaauaagagauucugucucgaaagccaaugacaucccaucuuguccucuggccuccacccauaugcaaacaugccugcauacauggaugcagcccccaaccgugcacgcagggaaaaucuccaauccagcccuugcccacugucccccaccuugugcuucuaacgccugucuuuuucaccuuugcccuacauucugcuccugucacggacaucagggaauagucuugucuuguuuuugagauugagucucauauagagcaggcuagccucagacucacuguguagcugaacauaacccugaacuccugccucugucccccaagugcugggauugcagaugcgcaccaucauacuuuauuuauauggcaucaaggauggaacgcagggcuuuaugaauucugggcaaacacucaguuguauccccagccuagaagaacauucuuuaaagaaaacaaaacaacaaccacaacaaaaaugaaaaaaacaagccacuuaaaaauauuucauaaagguggguauggugguacacacuuuaaucccagcacuugggagauagaugucuaugagccuggucuauauagugaguuacaggacagccagggcuacauaauagagagacccugucucgaaacaaauguaguguuuuagcuuauuuuuguaucugugugugaauucacaugcacacacaugugccauggcacacuuuuacagaucagagaacagcugacaggagucuguucucuccuucugcaauguguguccuggguauugaacugaagucacgucaugucaggcuuggccguagacuccuugcaccacugaaccaucuugcuggcuccagagaaauauucccaaaucuuaaauuaguucacaccccaucgaucccuaguucccacuuggaguaagagucaaaggcaucccugugguccacaagccucaccaguccaccaucaccaccgccuucucuccuucuuccuucccccucacuaacacacacgcugucuccuugacuuucucaacagcucacauaccaucccacucggagaccuucacuccugccaagguggcucagcuccuccuccauaccucaaugacaguagcccaggauaugaccuccagagcaaggcugaggccacauuucagcucuguacucugucagcucggugacucugagaugauuccuuagucuuauuucuucaucuguagaauggguuucuuugaacgaacagugugaaaauuaaaacaaccaaugucuguaaagaauuucugguggaaucaaguguuuaucaggugcugcagaugaauggugaauaaauaugccuacucagagcugggccugauggccagagagagaggcaugccaccucacaugcucugaaggaugaggcaagagaauccccaaguucaaugagugcuugggauacagagugagucaaagccagccuugggcaaccuugugagauucugucccuaaauuaagaaaagggccuggguaaagccccuccugagaaucccuagugaggggcugggggaguggcucagugguagagccccugccuagaaucccucagugaggggcugggggcguggcucagugguagagccccugccuagaaucccccagggagggggugggggaguggcucagugguagagccccugccuagaaucccccagggaggggcugggguguaguuugcugauaaaguauuugcaagaaagccuugguucaauacccaguaccuaaaauaguaaacaaagguguuggccuuuccuggcccucacaucuggccucacauuccucugccccuccccaccccuuuuccugcuucuuuuugcucucauacuauucugcuuccucccaucuugcaugaacuauagcauggcuccuuucuaaaagaaugucauugucugagcucuagcuuagguuccucaaauucucauggccuuauuugcacacaaaaugaagagaugcuuuugcuguuuccuucauggcuguuucccccacgcuaauggcaaggauguacacaguaguuguuuguugaaugaaugaaugaaugaaugaaccaaccaaucaauccuggggauucggcuuagcugacuagagugcuugccuagcaagcaugaaauccuggguuccaucccuggcaccacauuaaaaacaacaacaaaggaagcaugguuaggaauuccugugauuccagcauugggagauggagacauccucagcuauauaacuugaagcuagcaugggcuaugugagagccugccucagauagauagauagauagauagauagauagauagauagauagauagaaagaauauaagucagguauggugauguacaccuuuggucccaucaccagggauauuggggcagaugguuauuugugaucgagaugagcauccucuauagaguguguuccagaccugcagagcuacauagugauacuuuguuacaaaaggggaaagaaaaagaagugaaugaaugaagauggucuuaugcuaucuuucuaacugcuguugccauaguaacaagccuuccuaaagugggaccccucccucgcucauucccucccacccuguaugcccugcagaggaaggcgaguacuuccugaaggugcucauccccagcuacgccgccggcucaaucaucggcaaagguggccagaccaucgugcagcuccagaaggagacaggagccaccaucaagcugucuaaguccaaagacuucuacccagguaagccucagaccggccaggucccugagcuggacuucucucuucuccuuuccucuuuccugagcccugggugugaagaaggauuguguuagggacaguuagagugauggaggagggcuacuuucucuccccuuaaagagcuugagcugccugcugcccaaggggccuggccugagcagaugggggugggggcagggccagacaaugagcugcugcauauucauggaaucauuugcauuaugccaggcaguuguguuccuucccacacaccugcugccuccggacagucaguuggagcagccagggugggggggaggauggcaggugucagggcugggugggggcagcccucugaauuacucacaccccucuguccauuuggauguauuaaucuaacuugcauccaauauacucugcucugaguuauuugggagaaggggcauuuaaaaauauuuuucuuucauuuuuucccccuuugaguuagggcuucacguagcugagagugaucuugaacucgucauucugccuccgccucccaagugcugggguuacagaugcgugccccaugcccgcucuguuuucuugggggcauuucgaaagagagaugaucucacccuguagcccauucuugccuguaguuuccaguucuuccccugccucccagugcuggguucacagacgcgagccacuguguccugccugaugcuucuuacacagcuguuucugcccggcccaucuuuugugcccuucugccucucucugcucuugucucuagggacuugucuggguaucugcaucuccugucuucugaggcucucauucaguccaucugucuguccuucugucugccaucccuuucuguccucccaucuacccccugcuucccaccaccacccuugucucagaacuucauuugacccaauuuaacgucggcccuggggucaaggaggggggacaagccauugcagguguuugcuccccucuuuggcuucugccucuguucacuugucucugcuucccuuuagguaucucucuuggaaaagucucagcuucccacgacuuuuccuuucuuauucagcucagcccaacccauucucugucuccuccuagacuccaucuccuucggguuuuuuuuuuuuuuuuggauaaagucuuaugaagcacaggcuagccucguauguaccauauagccaaggaugaccuugaacuccuccugcuucuccugcuuccacauccaacacguuagcauuacaggcuuuggcuucuuguaugcuagguacuccucuaccacugagcuacauccucagcccccaaccacacguguuuaaacuacucucugcucuaagagccuuucaacucucucacucccaagagcaaagccugagcuuuggccucuaggaaucccggccaggcgccagaacugcguccagcacacaguccaccacuggggcuacagcauccuuaauccucuuggauuuuuaaaaaaaauuuuaggucagauaccagagauguagcacaggguuuggauucucucucucucucucucucucucucucucucucucucucucgcucucacucucucucgcucucuuuccucucauucccuucuucccucucuccucaauccucccuuucuuucucuucccuaccuccuuucccccuuccucccccuccuccucacucuugcaguccucccuccucucuuugucucuauccuuuccucaccuucuugucaccccucuauuuuuucuuccccaucuucccuucccuucucuuuccucccuccucccucucucuucucucccuuuuauccuauuccuucucucuccuucucccccucuucuacuuuucccucucuuucccucucuucucucuccuuuucccucuccacaccccugucuccucccucuucccucuucccuccuccccucuuucccugcccuccucccuucccucuuuuucugccuuccuccccucuuucccugcccuccucuauuuuucugcccucuaccuuccuucccugcccuccucccuucccucuuucccugcccucucccuucccucccugcccuccucccuucuuuuucugcccuccuccccucuuucccuguccuacacucuucccucccugccucucaucucacuaagcugcuuugaccaagaguuuagagaaaaaucuaguaacccaggcgccccaccuccuuuucucggccauccuggcccaguuuccucuuucccauucuagcccacaccgugugggugagaccucucugcccaggacaucugucugaggacacuuagcuccuugccucugcaucacauucugugcuaugagagggugacauucccucuccccagcucagugccucacccagggccaggcuacugggacacccacagucuuugaugcucuuacacuaccacauaucauguccaugagcaaaccaaugugagccacuucucugugcaucucacagccagacaaccuucuccugacauggaccaugcaggacuuagagaaccuggugccucagucagggacaugggguguggcuucuucuaacccgacccuacauccaucccuagaacuccagaucacacaguuguuauggcugcaugucugugagguguauuuccuugggccccugauugaugaccuuucauuaagucacccaacacacauucauucucuauguccccaguuggacagacgugaacauagcaauaagagaagucgauuuguucucauggaucucaagcuaagaagagagacccagagucacugacgaugacccagaaugcccagggcuagaauaggaaggucagagaaagaugggagcugagacaaaguguuugacccagacuagagaggacagaguugcccagaggggaagccuacaacggugaccagaaggugagcuaaggaaggguaaagaaggggcucgagccacacaacaaaagcugggacaugguuugcuggaaggugaggcugacauguugaaaacagaagagaaaggacagcagagaaacuaagugacaguaucaggccuuggcuaggcaucauggugugggccuguguucccaaagacucagaaggcuggacuuggagggaucacagguugaaggccugcucuaguaacuuagcaagacccugaauuaaaggaggggggcagagcauggcuuagagccagaguauuuauuugccuaacuuagaauucccccagugaagggcugggggcguggcucagugguagagccccugccuagaaucccccagugagggcugggggcauggcucagugacagagccccugccuagaaucccccagugagaggcugggguguggcucagugguagagccccugccuagaaucccacagugaggggcuggggcuggggcucagugguagagccccugccuagaaucccccagugaggggcuggggguuuggcucagugguagagccccugccuagaauccccagugaggggcugggggcauggcuuagugauagagccccugccuagaaucccccagugaggggcuggggguguggcucagugauagagccccugccuagaauuccccagugaggggcugggggcguggcucagugauagagccccugccuagaaucccccagugaggggcuggggguguggcucagugguagagccccugccuagaauuccccagugaggggcugggggcguggcucagugauagagccccugccuagaaucccccagugaggggcuggggguguggcucagugguagagccccugccuagaaucccccagugaggggcuggggguguggcucagugguagagccccugccuagaaucccccagugaggggcucgggguguggcucagugguagagucccugccuagaaucccccagugaggggcugggggcauggcucagugguagagccccugccuagaaucccccagugaggggcuggggguguggcucagugguagagccccugccuagaaucccccacuguguggcucagugguaaaggcacuugcccagcauaugcaagggcucaguccccaguaacaaaaaccaaagaaccaauguugagcuaagguuuccguacaugcacuugucuguuucacaaagcuaaaccuacccagccuuuaaccccagagagaaggagucagagcaugcaaaaaaagugccuuaucuugguaaugaagcccaaaagcucagguucaauccuuccggaucuuucaugauuaagugaagaacugaaaagcaguaaguacugacgcaagccacaaacacuccugaucacuuaccucauaaagcuaaaaugccaccagagcuggggcauguguaaaaagcucugggccugacucccauaggcaaaacacaaguguguguauggcgaucuucauaauuguuauugauuuauaacauagcugcaccaaagugcaaacucuuaagcaucuaccuaaugacuuuauucauauucuuucuuaacuuucaaagcaaagucucaaagcuggagagguggcugagugaccaagagcacuggcuguuuguccagaagaaccagguucaguucccagccccccacaugguaacuuacaaccaucucucagcuccagucccaugggauccaacagccccuucuggccuccauccaggcaaacacucacacgcuuacagugaaaauaaacaaaucuucaaaagcaaagcuucagggcuggggagguggcugagcaguuaaaaccacuugcugcucuuucagaggacuugaguucgauucccagcacccacaucagauaacucauagacacacaccugcaacuccaguuccagggcauaugcacucucuucugguacacacacacacacauacacacacacucucucucucuucugguacacacacucacacacacacgcacgcacacaggcacucaaaaacaagucuaagccaagcacauuuaaaaagauaaaauaaaauaaaaaguaaaagcaaaggcuuugcugugcaugcccccccaugguuguucauucacgugugcgcacguacacacgugaacucauacacccacacaugcauagggcuaauaacucagucucaaauuuaacacugaaugaacugagauuuagaaggcagaacccacacuagguauggugguguauaugugucaucaaaauauuugguaagcuggggcagggggguagcagguucaagaccaaucuaggcuaccuagcaagacauugcuucaaagcaaaaacaaaauggcagaaacuugcaaauauggguaccugaguucgaauccuagaccccauggcagccgggugugguaggguauguaauccuaacacugcugugacuacauggggaggcagguagaggagaaucuccaaguguuugugggagacuuacgucuguccuacuguguacuggggaaaaagacacccuaccucaaaugaagugaaagacaaagaccaacaggugagguuguccccugaaccacacauacacacacacacacacacacacugucucugaugauucuguaccaugggugaucugggacaagaccagaguucuccguguccuuagcuggacaucaaggcagcugagccauggccuaucuccugugucagcgaacaaacugaaaccaaguccucagaacagugcccagcguugagcguuauguaacccccggcuguuauuacaggucacuucuuaaggauuuaacaggguccccuuaccaagcucuucuggaccccagggaaagaacuacauggggguggguaugcacaggcuuccugaguuagaaggaagcccuacagaaauggcgacccuggccacuucucccaugcuauccucuggguugcccuucucccccaccaccauccccacccucauuccuagccugauccacacccuuuccuauuuacacccagacagaggcagccuacagcugacucacccuuggcccagaccgagcuauuguucuuggguggagugggacauaaaagugaggaccauguugccgagggcaagggcaggagcugucagcaucacgguuggccaacagacagggacaccccagacccaugacagugucgucaaagggccagacugagagauaacaagggcaggccaggguuguacaccuggcacaccgcucugaagugcuccacagacaaagacacucagcacuaagugucccagacacacaggcacaggaccuggcacacauucaaaaccuuuuacagacccagggagcugaccauacaagcugagucccucccggggacagaggugcucacacaucacguuaaagaggcccagguacaccaaggcucucauauucacacacaggucaggugcaauugaggguucuuugucucuaaaguguauacgcuuggaaaugugcacaugccaucugagcagccucauacagacauuuaugucugucuguguccucaucaagccaguaaaaggauggugacugaguccucuguguguguacaugugugugugugcguguguguguguuuauacacgcuaauauuuuuacaccacaugcugaucacccaggcagccugggaacacuuagaggggugcgcuguccuuaugucuugcucccacagaugcaaacccacacugccaguggacaggguucagucacugcacagccucuguugcuuacaugcuaauaaugucuucccacuucaagccuuguuacuccagucguuguauuauauuaccuguuuugguguguguguugcuggggguugaauccaggaacuaauacaaacuaagcaaguaccugacugaguuauacccauaaccccuauugggagauucugggcaaguguugguuuuaggagucuacuucuaagucacgcucccagccccucacuggguauucuagacaggugcucuaccacugagccacgcccccagccccucacuggguauucuagacaggugcccuaccacugagccacgcccccagccccucacuggguauuuuagacaagugcucuaccacugagccacaccccuagacuuacccucgcugggggauucuaggcaggggcuaaaccauaauccaggacacaguguguuucuauugcaaucucuucuggacuuucucuuagacacacacccagaauggucaucucuccaacccugcccaaguacacagagauacucucacagcucccugaaggcagccucacagguacacacacagauugaaaugucacccaucaucuuuucccucuggugcauauauuucagcaucacccagcuacucuuauccccuuccccaauacacacauacagagaaugccaggucagaccugccgccaguaccuggaagagcuccagaaagggcagcuggcaaccccacccuccauuucuagucucuuggccccuauuuuuuaagaguugccuuugaccuagccugcucuuucccuagccacaccccugcccucccccacacccagcccuccaucugguggcucuaggcuugcacucuggccucucuucugccucccccauccccccaccuuucccccauccucuccaaaagcccagaggccaggcgcuguaggcuuucagugguugccauagcaaccuagccucaucccucaucccccugggggugggcugaggacccggccagccagaccgauaaggggguuccaguuacuguggcaaccguuucgggccuaagcucucugcuucuggaaggggggugagcagcgagugaaugguuaccacagcaaccagggggagcccauaagaacugggaagaggcagcugagcccuaccucccgugcccagggcugcugugggcacuuaagcaucauucuuccacccccccacccccggguuguucuccgggagggagauaaaguacagauuauaaaacagggauuccauucauucucugagcuagcuacccagcaugggccagucacccacaucagcuggcccagaccuuggccuuuccauuccaugaaauggagccagucugucaggaaugucuccauugcugucugaugugugcccucugucccuuccuuaacaggaacuacagaacggguaugccuaguacagggcacggcagaggccuugaaugcuguccacagcuuuaucgcagaaaagguccgagaaaucccucaagcgaugaccaagccugagguggucaacauccuucaaccccaaaccacgaugaaccccgacagagccaagcaggucagcugggaacugacaguggguuucuguaaagcuggugagguucugugagaguugugauucuuucggcaaaugccugcaagugguugauauucgaaaaucagcucuaauagucuagaaagggcuccacacugcugguagugggcuggauucagaagaacuggagaccaagacuggcacccucccauucauccauccuuccggaggugcccuaccuccuuuccuuuucacucuuaucucucaaagcaaccugccuccuacuuccuguguucaccggaagugauuucacugacagcccaaccccuccagaauuuuagaagcagacuuuuuaucucccuccucccuaauacccauuauggggauagagauaaguguuuugcguggagaaagagaggcugguccccauuuuauccaacccugucuagaaaggauggagaagggaaggcugcuucucgguugccuuaguuaccagaaagcagugguguaagggggcguggcagagaacggaccaauggcuucccgagccucuuugguugccaugacaauguugcgccugggacaggugggcucuuagggaaagucccuggauuuggcggucuuggguuuuuugguuugguuaggguuuuugguuuguuuuguuguugaggucccgauccacuggagguugcggggagagaggaacgcagggaugguuacaagcucuuccgguucccuauucacucccaaauauauaugagcucuggacacaaaggagaaaaguccugugcgggcuagcagggcgucuaaaagagccagacuagaaagcaaaggcuugguacuaagcugagaaucuuaagcccuggcauugaggagaccauaaaccugaauucccccaaacuuuuggggacacgauggguggagagcccuggaggaacgcguuccauauaacugcuccccaccaaaaaaccgguacagcuuugaggcuuggugcgcgcggcugcuguccuuggugcugaagaggcugugcuccuagagcccagccaggccucuccaaaaugccugcacacccaucgggcguagauuccacgcaggucagagagacuguacguggccccuucccuccgcuuuggugugaccacaaaggagugaggguucauagaauguggacguugcgugggaaauggggucaguaccauuuaggcccuacacccagaaccaggaucuauuauucuuuaucuuaucauuccaaggcuucauucaaaaaagugagaguguguggcaggaggcccuagcuguggagucacauuucagcuggaucuucugcucuuucuuccuaccuuuuggccuugagcagugacaagauugugauugcucguugccugguuuuucucauuuguaaauauaucucaugguauagauucguggauggugguuaguucaguaguguuugcaaaaaguauuuagcuuggaugccuagugcauagacaguucaaacacgcaccgggcauagugguauauuguaauccagcaugggguguuggaggcaggaggauggagaacauuucaggcuauccuggacuacauagcaagacucuucucucccccucagaaacacaauguccgcuguucuggauuuugguuuugagacagggucuguacuauauccaaaacuggccuugaagucacagugauccaccugccacaggcuucugugugcugggauuaaaggcaugagcuaucauauguggcuuucuuucccuuuuuuuuuccuuuggcacgcacaugcaugugugcauaugugugcguguacgcuuguauauaugaaugaggguuuguauguguacaggugcacagcaugugugcacagguauauauggggauguucaaggauaaugccaggugucuuccucggucuuucuccacuuuauuuguagagguggggucuuuugcugaauuggccaaucuaacuagccaccuugcccugaggaugcccagucucugccuccucagugcugugauuacucacggugcccacaccugccuggcuuuugccaagaugcuagcaauucaaccuguccuugguacuuuaauuaaaugagucauuucgcaaaccuuuuuuauuuuuuucucucucuuaucuuuggaccuagggcauuuuuguuugggggggggggguuggaguuaagguuggccucagauucaugagguagccagugcuaacacuacccaucuccuaagugcugagauuacagaucugcagccccauauccugucuaugaggcgcuggaaaucugucccagagcuuugugcaugcuaagcucaaaaucaacccauugauaugcuaccucagacaagcuccagcguuuucucccacuaccaaggguuucaaggaugacgucaaccuuagagcaguaagugucuuaacccauugagccuccucauuggcuauuacaggacuugucuuuaaaaaaaaaaaagauuuauuuuuauuuuaugugagaacacugucgcugucuucagacacaccagaagagggcaucagaucccacuucagaugguugugagccaccaugugguugcugggaauuaaacucaggaccucuggaagagcagucagugcucuuaaccgcugagccaucucuccaaccccuacaggacuuaucuuaauccggacggccauccacuuuucuucuuuggauuugcuguguuuaggcauguuugccuccuuuucuuuuuuuucuuaagguacagcaucgacauccaaauguuuucaagauguaggcaguaagggcaguggcucucugaaggaccaguauuuuaacacagacaggacagcccuugaucagccucauccaauucuucuccuagggagcacaaacuguuuccacaucuugcaggcaucucaacaaaagaagcuauagcccucuggaagcuguuggcuuucgaagguggaucccguucuuaguuuauucuuuuuauuuuauucuauuuuguuugacacaaggucucgcucuguagcccaggcugaccuggaauccuccacguagcuccagguggccucaaucccaaggcuacccuccugucuuagcucugaaagcccuagguuacaggcaugagccacugugcuaccugcuauacaaaaacuuuagaaaauuccuggcaagugcuggcugccaccgccaggcugacuguccuugauaguucugcuuuggaauuuuccaugagcuuauaaauccccaaggcagacaauggaguuccucuggccucucaacugcuuccagggcugugcucugcgacuccaagguucuaggcacauaagcuacacaccuguaaucccaucaccuggaaggcugaggcaggagaaucucaaguaguaagaccccuauagucccagcacucaggcagcagaggcaggcagauuucugaggccagccuggucuacaaagugagggccaggacagccaggguuacacagagaaacccugucucgaaaaacaaagcucaaaucgguucuucugugagcauagauuguuauuuugagaucuggcuccucuccuuuuuaaauauccuuucucacauuuauuuacuuguauguaugcacgcauauaccauggccaaagguagcagucagggaacaacuuaagguaucgguuuucuuccuaccacguggguuauggagaucuaacucgggcuugggcuuucaggcuucguuccuguggaugcaucucaucucaucggcccagguuugacuguggucacugcccuuccacugugacccacaguaaaugaaaaaccuuauaaaagguucaaauauguuuuuaaaugacuuacugguuucacucagguuuugcucaggauucuauuucugggauaaaacauugaccaaaaacaauuuagggaagaaaggguuuaccuggcaucagagaaagccaaggcaugaauuugacaggagaaauuaaagcagaaaccaugguuccagcugaugauaagauguaaccauaggaauauggaucgcacuaaccaugacacguagaaauaugguuugcacagugacaauuuacucacaucugcaguuagccagggcugcugacccaugccuguaauuccuguuacucgggagucucagcgccaucuacauagcguguuguccaaauuagggagacacuaccuuguaagaguaaagaggaaggcuagggguguagcucagugggagagcauccgccuagcaugcgugaagcccuggcuagagugcccacuaccaggcaaaucagggacaugugcagcccagaggcuuuagugugugcacagaauuuauuuuaaacacagaguaucgcuauuguagaccaggcuggccgugaacucuuagagauccacauuccuccgccucccaaguccuggcauuauaaacacgugugucaucaugcccaguuacaaugauuuauuuuuuauuuacuuauuuauuuacauccaaaaugccaccuccucucuggggcuccccccucagagucucuacccccauccuccauccccuuuuccucugagagggucccccccccucagguauccccgaccuuguugcaucaagucucggcaagauuaggcacauccucucccacugaggccaaacaaggcagcccuguuggggaauggauuccaugggcaggcuacauuggggacccacauggagacugaacuacauaugugcuagggccucaguccagcccguguaugcuguuugcuugguagcucagucucugacagcucccagagguccaaguuauuuuucuguuuguuuguuucuuucuuuuuuuaaauuuuuauuugugcucauuaaguuuuguuucauuuuauuuucuuuugagaugagguuucacuauguagcccaggcuacccuugaacucaugagccaaccacugaaguuccugaauguuaggauuacagucaucugccaucccuggcuuccaaaagaaauccuucaaaacauuuuucuacacucaucaggggaaaaagugugugugcuuguacuggcguugguucucuucuuccaccaugugggucccagggguggcucagcuccuuaggcucagugacaaauccacugccccuccaaagaaaccuugauccccuuagccguugcccccaaucccuuccccagcuaauuccucuccuucucccuaagccaucacuagucugugucuacagauuuuccuguucuggacacuuuagaaaugcuuacgucguagaauauaaaaucaagcaggguguggugguguaaaccugcaaucccagaacucaggaaguggaggcaggaggaucagaaauccuuagcgacauagugaguuccaggacagccuggacuauaugaaaccacgccuuuucaaacaaaacaaaccuaaagggcuggacagauggcugaacaguuaagagcaguggcugcucuucuagaggacccagguuugauucccggcacccacauggcuauucacagucaucugugacaacaguccuaggggaucugaugccgccuucugaccucugcaggcaccagggcaugcacaugguacucauauauacaugaaagcaaaauacccacacacauaaaauaucaauauuuuuuaaaguagaagauucuguggccagccagagcuaccauugaauucuaggauauuucuacuauuccugcuagcagucaccccaaguccuaucucccaucucuggcagccacuaaucuacuuuuccuuugaugugaggugagaagcaugcgaaggccauagcagaaaaagugguaccccccccuccccccauugcucuccguuucacugacuuuaggaugucuuaccaaagccagcagcucagaggcuaggacgacuguccagaaagcuccuggggucugucagucggccucagugcuaggauuacagcacauauagcuaugucuggcuuuuuacguaagugcuggaaauucaaacauagcuccuucggcccagacaguuggcucuucagagcucgucucuguucugaaggacuuggguucaguuccuggcacccgccuggcaucuaucagcugccuccaacuccaguucgauaucccaguacuagaaaguaaugauguuaucacaguucacacccagacuccacaaagcaauaaagcuaugguccagagugauuccccagacuauuuuugguuuggagcuuuuuuuaaaaaaauuaagucuuacaguguaggccaggcuagcucagaacucauuguguugugcagucuggucuugaacuuacaaucuuccagccucagccugaagccagccugggcugagagaggggagaaauggaaggaaagaggaggagagagaauuguguaaaguaagauuuggaguuuugagagagguacugggaggugggggacucagagccagagcucacacaggcagaaguugggaggaauggugcaggcuugggacagucacaagaugggcuuccaguaagcagacaggccauuauucauaaaccguagagacauuucaggucccagagauaagggccagguuuucugagggacuguuccugacaaaguuuucccugagacagggucuugcuuauguauauguauauuguuauauauguguguguguauaaauauauacauacauacagagagagagagagagagagagagagagagcgagcucaggcugaccucaaauuugacauccuucugcauguagcacaccacgccccgccaaguauuuccaaauuuucuuuuaggaacuaguaaggcugucauggcguucaucagaguaccgcagugggccugcugauggacccuagaggaaagacaaaacaaaaaacaaacaaacaaaaaacccgcagaagugauuugagacggcugcgcgccccguucucccccgcgcagacucugucucuuucuccccccacgcaggccaagcucaucguccccaacagcacggcaggacugaucaucgguaagggaggagcgaccgugaaggcggugauggaacaguccggcgcgugggugcagcugucgcagaagcccgagggcaucaaccugcaagagcgcguggugaccgugagcggcgagccggagcaggugcacaaggccgugagcgccaucgugcagaagguacaggaagacccgcagagcagcagcugccucaacaucagcuacgccaacguggcggggcccguggccaacuccaaccccaccggcucgcccuacgccagcccggccgacgugcuccccgccgcggccgccgccucugccgccgccgccucgggucugcuaggccccgcggggcuggcgggcgugggcgccuuccccgccgcgcugcccgccuucucgggcaccgaccugcuggccaucagcacggcgcucaacacguuggccagcuacggcuacaacaccaacucgcucagccugggccucaacucggccgccgccuccggcguccuggccgccguagccgcaggcgccaaccccgccgccgccgcagcagccaaccuccuggcguccuacgcgggggacgccggggcggggccgggggcgggggcagcaccgccaccgccaccgccccccggagcgcuggguuccuucgcucuggccgcggcugccaauggcuaccucggugcgggcgcggggggcgcggcuggagcggggggcgcgccccugguggccgccgcggcugcggccggggcugccggcggcuuccugacggccgagaagcuggcggccgagagcgccaaggagcugguggagaucgcggugcccgagaaccuggugggggccauccugggcaaagggggcaagacgcugguggaguaccaggagcugacgggcgcgcgcauccagaucuccaagaagggcgaguuccugcccggcacgcggaaccggcgggucaccaucacgggcagccccgcggccacgcaagccgcucaauaccucaucagccagcgggucaccuacgagcagggggugagggcuucaaacccacagaaagugggaugaggccuguggugugcguccccacccccucccgcuccucuucccuccucuucccccucuuccccaacucccgccagacuucagcuuggugugacuccugcuuggcuuggaauggggcugggguaggccuggcugcacccucccuucugguagucauaggcaggauugagugacgacugaggagggggcuuuugagcccccuccccagccuugaauugacccccuccuuccucccucccugugcuugacugggccugacccaccucucccgggguccaggucuaugugauaucuguauauauugcauuuuguugauuuuaauagaaaacaaagcguuauuuucucuuucuuucccuccuuuuuuuucuuuuuaacuuuuucuccuucuucuucuucuuuuuuuuuuuuuugauaaggacccccccuccuuuauaagauuuuuguuguuguuguuaacauaugggaggaggggagggagccuucaggucaccuggaaugaggugccucucccaaacacaacauccugccucucugauugcaguuccagaaccuggggaagagacccaaguaggaguagagguagccacccaggagucagagcugaagugagggguuucaaacauagacacucaccccgguccgagcccccaggauccccacauuuccucagcuccucucucccccugcaguauucccuggaauggaaguguaacuuucuccguugagcagagcuauuccugcugggaaugacuccagcucugggaugcugcagguccugugagccacacuauugugcgaggcccaggagcagcuggcuguaacaucuuagggcucuuccuagaggaacgaggguccguguugugaugucacugaaucaaguauuuaccgggugcuuccaguaacucccuaugaugucauaggaaggauuuccucagaggcuacuuccgguacugguuagagaaaaucauuuccugugaggucccaacaaaaggccucaaaggucgcuucuguagauggcagaggcauguacuuccuguggaaucucgaggucacuuccuguggcaucauagggaugaagcaugcgcuuccgguguuggacaguggccagucccuaagauucccccuccucccucuacacuccucuuugguggguguuggcccugggugagggggaauccuuaggaagaaugggacuuggguuuaacauggaagauuguaagggggaaaaaaaauccugucaggguuaucucuguccagacacgcuaucugugaacuugccuugacaggcacgaaugggagacgaagcuagugaaaaugaaugauugcuaaagauccccccuuccccaccccugccuuuugugugcaugccugugucuacgugguuucauuucauugauggaugagccaaauguaugguggcucugucaggccagugugaucugguguagaguucagugagccuugcaaaguuuaggguaucucgggcugaaaugccuugcgcagucugccgaauuugaagcuuggcggcuuccagggagcugguguauguugacgaucuugauuggucagaaauguuccagugugcucagccuuauuagacucagaggagcuaggagauucucuggaaguacgacaaaccaggcuacccugggaguugucuugggaguggcucacuuggcaugguggcucuggucagcucugaagagucagggccugaaaaaccuauagacuaggauugcugagacaucccccuguccccuaacaucgcccccucucuguuggagagcaccuucaauuuccuccaaccccaagcaggguccucagagcccugucuccaucaucagcaucucugggggagggacaccccaugcccacucccuccuccauccauuccuaggucuuccagacccugcucuucuccauggcuuuggggauaucuggccuccuuguuucuaucccuacaaaggagcugggaggagagagaccacccagaugaugccuacuacagccuucaagccugggaggcccccccuaccccgugcuagagagccaccccaaaaucaaaaugugaaaaucccuagaaagcaauagccuucgagguaccucgcacugacucccccucccccagcccuuccacaggaaugggaggcuauggcuugagcacuggggugacuuuuuuccauguccucaucuccccagugaggggcaggccccauuuccuugacacacccccaucucccaccuccuaucgcugcugccccuuuaucccuaaucuccacccugagcccagauggagauuuuagugccaaaacaauucuugauaccacuuuguacauaucuucuacaguuggggcugcugagauuggaggugggggccggcccacagggccauugcuccccuccaccucuuaaaugaccuuacaguauuucauguagcuccaccugcauguggguaguaaaguaucuagcuggaauccccccccccccgcgcgcgcgcgcccguaaaacccucaggcuccaugaggaggggaaggaauaggggugaagcaauguccaggauggguaggugggauaaagacacucuauuuguaaaucaucugugcccucucuuggacagccugcuuuccauaagcccauuggcuggagucuggguccauucccugugugacaugcccguguucucagggauccauucccccaccagccagggcuaucugaaaaguaguuugcuagcuuaguaagcugguccacucaccauguuggugagugaggaguggcacaccuccccacccgcauuguacccugggaaauuccaucaucuucccuaucccuugaaaaucccuucugaaauccaaccucagucuuucuguacuguaguugguccagaagggauacauaaugcaggucagggaugagaauuacuuuuaaaauaauaguaauaacaaagcucauuccccgccccuucugccuguuagccaaucagaucgcaaaggaucugaccggccuccuugcaucccacucuucagcaccaguaggugcuuaguaagauaguuaaguguugccugcauugaacugucucaucugcccuccugcuuccgauaccccugcccccagcauucuccucugccucccuaaggcccacuggguuuuccucuugugguugccccucccccacgguucucuguccugucucuaccuuugucuguauucuucuccuccugaauucucgacucucauuuccccuuuaaaagcaaaaagugccaaacuuccucggaacugagccgaucugggguggggggaugaggaucuuagauggagggaggaaaccaccucucuuagaggggggggggccuuaagaggcaaagaaaacacuuuaggaugcugagcuaaauuggauccccuuccucguuccucucacccugaguuuuuucuuagaaucuuuauaagaaaaaaagaaaaagaaaaaaaaaacauuuucaacuaaccccuacuuuuuuggauuccucucccccaaauuccaccagccaaggagaacccccuuugccuuucucugggcaaauccauugaaacuggggauggagagaaagacuccacccucuuuugcuagcccaacgggguggcugcuggggaaggaccucaaagcaugacaagagggguucgaaagugccaaauuucaccuucuucauccugucuugggcagggcucugagccagccugcccggucaucagcuuugcccucucccagccaucucuccgugggcgggaaaauuuugccgcaauaauuagcagggcagggaucggaaggcagggauuuugcagucucugucuguacuggacuuggaggugggaauuaugggagcguggcaagagucuuuaaaaugguuggggaccuauacucggaauauuacgguaccacuuguuuucccacgguauuuuuuuuuuuuuccucucuccacucuugaccaaccaaaucccuuggaauaucggaccuccguucccaccucaguucuguuucuucagcccgccccuguggccaacaccauccuuauuacuuuauggcuagcuggucuccagcuauuugaaaaaggagaggagguucucccuugcauggacucuugcuguuucgagccuaacagguuaauuugcaaaagcguucaccagagcagcggugaagguggcaaucuaggcguccaggaugcuccacuagguuguacaccugucggacagccagacaggccuucugcccagggcaucagccccaagcgccauccggaauugaggccggcgucgucaaaaccugaacugguugucaccaugggggagcacagaaccgcaauacccaggucggggggcagagaagccugguuuacgcuuuguggaguguggacaccgagccuugcgguccgagcccucucuccaccacagucagcggucucgaugccccagcugguguguccguuccaucggguccccacggcuaucaucggaggcauagacaaccucccgcuuaguggcaggagggagggaaagucucuggaggguggugguggugaagacugcugguuuuuaaccccuucucagacagucuaggacacuggucuccuuagaauuaauauagggagacccuccuccuuccucccuuccccccacccccucccaccccccacaaaaccaccaaccucucaucuucuaagugacuccaucaccaccggccaccacgggaaccugcggccucauugcuccagcccgccccacucgaccgucagacucgcuccaucgaacucuuuuaauuaacccuuucuguguucaucccacggaaaaccugugugucuggcagggaagccagggggguggaugcuaagggcaguugcuaccuucccuccaucuccucccagcgcccaugccuccccaugccaugccccaauccuuaucccucaccccuuaggauccgccuccccugggggcacagggaucuucuagaaauaccuuugcaguuuggcuuugcaaaggccggccuagggggcguggccuccccaucggagcgcucacucugacuguccuccccguugcccccacccacuccccacgccuucauuguaaauagucacuuuuguacuugguuugagccaggcgacguggggagugucucucucuuucucucucucucucucucucucucucucucucucucucucucucucucucuuauuuguguuggcaucucaacuccuggaggcaugguccacaucccgguucgauuugggagaaacccaaggugugccccgccaaaauguuaaggaucucgagagaacaguauuaacucggacagcuggcuggggugcacagguccuccgaccgggaggagggagagaaagccuuuguucuugagauccugugaaauggguucguucuccgagcuuucugaagaaccuugguggagcugagaauugaaucucuccucugcuuccucuguuggaggcuggcucaaaaagaauggcuuugggauggggcagucuuuggagaauugacugcugaauucuuccugggaccugaagcuaaccucugguaggcuuguuuucuugcaaagagguagucagaugaacaucccucuccaaccguuagaggaaagguccaagccccgcggcuggcccugccugcugccacucugccgcauuauaguuugcgggugggacgggcagugaaguggccaugccuccaguuucuccauucaaaccccucuuaacugauuuccuuccauccucuuugaccagcgccgccgcccacuuccucucugccaccuccagaagcucuuggcuggggucaccgcacucucuucccuauccccccaucgccaugccugggccaugcccacaucucccacccacucacccaccccccaguguccguugugugaccuagugcaccauguauuagcuuccauggacccccccccccaccuacccacuccccgcucccaccacaccccucccccaccccuucucccucggcgacuucaccuuuuuuugccgcgauaaacgucaucucagcaucugugucuaauguugucuuuuuugcuuggcaucacacacgccuucuuaacccauccccuucccucucccuccucccugacaccuccacccucauccucaacucuuuuccccuuugucccccaucccccacccagggcucugggcauuuaagggaggggggaccuuuaaggauggucucagaggagggagggguguguucucugauuugggugaacaaaugagaguaagcauggccaaagaaaguaaguguuucaaggcugaacuuguccauccaauauccaguccugggaaccauggucaccagcagccacacauacacagaacccacagacagcuccuggacacccguguccacugggagcagcuccucgacuccaguagcaccagaauagcccggggccaggugcuuggagcgaugcaagaccccaccucagaccccugagauuuugcccaucugagccaccaaccuugccaacuguagaaugaaaagguuuuuuuuuuaaauguuauuucuacaucaauuguuuaugcuugaauuuaauacaucauucacuuuuuaaaggguuuauuaagcaccuauguguaaggcacuguucuaagugccaaaguuagaaaaugaacuaaacagacccaaacaugucugccuucagggaauguguguucuacuggaauccaaauucuuucuuaaccuaaagccuggcacacaauacacacacacacacagaacacaucugggggcuucaggccaucagccagagggguaagucuggcaaacacagaaccaguucccaaccccugaacagcauuugcgugggaaacucuggcuugagaaaauccaagauggcaccaggcguggcggcgcagguuugucaucacaucacaggaagagaaagggaaguggauugauuagcaagagcuggaagucagcuuggggauuccugagggcugguggccaaccugagccguagcuaaugaguucccagccaggcugaguuacauagcaagacccugucucaaaaaagcuaaagagaaagaagaaaauaaacccaagauagggucugguugcuaucgcaagcaagccuccaugggcaugggguagccacagccaauucccaacaugcacugcuccuuuguguuaacugccucucccccuggauggguugaaggaugcagccccugagaaaaugcuuaacaaaaaugaccugcauuuuagaaguuaaccaugaugcuggaaaccugacauggagacagauuguuggaaguguguaggcugcguguucuacagggagugaagaagggggauacggcccagaacaccuccuauccucucugggucugagucuccacaaauagaaagcgcccuucauaggugugcuuaccuucuggaauaucguauaaggaugugucgaucacuucaucagcgucuaacaacacugcuuaacaggcggugguuaccuggaagcuccccagcuauaaaaagcaaaaaccaagagaggagagggugggaggagagaggcuggagaccccgaca

SEQ ID NO: 3589 - RNA, 3223 nt, Mus musculus
cuuaaagccccagcuccauaaugggccugacagcacugaccuccuacuuuuuagcaaaaaugugguaaacacgccugaccgaucugggcgugaacaacgcacuguaggcuucaggagugcugguaguuguuaaagaaacuggcuuugggacucaccugcccgucgauccugccugcgguccucugacaacacauaccguuguguacuagcggucgaagccugcggcugugaagaggcggcugcccgggacuccucagccccagagccagcccccggccccgccacacccggucccaggauggcgaaaauagucuccuccuccgcagagaaggcguccucagcggcgggccccgcgcccugcguggaaugcggcacgcgggccagcuucuccuuggugcggcgcuugaagucguuccaacgcuucugaaccuccuggcccgugcguuuccagcuggugaugccguugauuuugguggcgaugcugucccacacucgccgccgcucggccacgcucacccgacggcucugcgcgccguagagcugaggguagugggcgcgcaccucucggaucaggaucugguucuccucgaaggagaagcgcggcuugcggagucggguggucuccuccgcuucgcccggcgccgccgccgcggucgccgaggccauggcgcccccagacgccaccgaucggcugccuggcgcauggggggcgccggcucugcgggcaaagggcgaacagcgcuggcgguggcucgguguccccgugucgccccgacacgggcuccucugguccccugugcaaaaguggugaugggagcggcgaggugcugaaugcaaucaaaggugcuuccucguaggugacacccgcccagugcccaucuugugcuucacgcggccgcuagugccucgcggaggaguugauggguacuggggggacggacggucuggaaggauggagggaaaugagcaaaaguggaagggaaaagggugccacagcaggaguuagaggagaacgggggcgcaguagaacaggacagggcaagaguaacggggaugcccagggggucgaacaugcaugaugcugggaagugaugccaacugggcaaugcagcagacggggcauccagaucagagaggagcgcuggggguucccaggguagugggugucaguucuagggucccugagagaggauguccaagaauaaagaugaaauggaaccuucuaguuaagacggcaaaauauuaaagcugagggucugcagggauuaugggggugcugggauugcuggggaaagaaggggaguuguggagauaacggggguccgagauaagaggggggacccccgaggcuuuuuuuggacuccaggaagagugauggagcacagaggauggggaccccaguugggccgcgggucacucaccgugccgccgcagccccugccugccggugggucagggcuucggcuucugcggccucuucccucccccccuacuucucccucccccucugggccccgcccccaguagcauugagagccaagacgcaugcgcgccgggcgaacgcggucuccagauacccugacagagcugcguucucugagccgugucucccagcacugcgcaagcgcagaacuucccgucgccuugcuuuaccagaaggacacagcugcgcagccgcacauuuagcgcugaaguagguucccugggcucuggugcucaauugcgcaugugcaaaccuacagcgcgcaugcgugucacuggcaccuugccugcgaugguacccaggacuaaaucccagugcgggcgcaguagagagagagaugcugaagagagcgcuaggaccaagcggaguuucuucccuuugaguaguccuuuagccuacuaagcaaagucuuauuuugagaaaggggagaagagcuucauuuccaugacaacugcgugggugggggcugggggcguuaggaaaccuugcccacgcccaaucccuccucugcgcaggaccacucggaaacuaccuccuacggacugaggcggggcaccuggaaauauuccccgcccaugcagaggcgguaaccauagcaacccagcaaccucccaauggugccugggaggcccccuguccacaauuugacgucauggcucggagagggaguucaaaggcaggaauuucuugaaggguggggauggcgauccuagaaaagcgcagagcaggagugauucgagagcaccacuugaaugaacuggauggccggauggcagggugaaaauuuucagugcccgcaguuucaaggucauuggguaaacggcgcuucguucaucuuuccgacaguuacacauaagcucucacauauccauauaaaaggcaaauuguguucacuaccaaaaaauuguuucugagggcaucuuacuaaguaucccaagcuggcauugaacaugcagcaguaucucugcagucaccagcgaggcuagaaaaaagacaggauaugugcggacauuacacauaaggaaaagaugacauuuguauuaagacccgaagcagagagggagggcuggagcucagcaguuaccaucucucccgggaacaccagaguuaggaucucuguauccaaaggcgggggcucauaaccauccuuagcuccagcacuguugcccucugcuggcaccaggcauggacaugguggacaaacauacaagcaggcaaaacacucauauacauaaaagggagaaaauuucuuuuucuuuuuuuuuucuuuuuggugugggugugugugguugguuccuuuuuguuuuugagauacgggguuuuuuguuuguuuguuuuuguaaccuugauuguccuggaacuagcgcugugguggaggaugaccccgaaaucacugagaucggccugccucaagaguuuggggacuuauuaaaggccagccacacuaccaccggccuaagauuggguuuuaauuauguauaugcaugugggugcuggugccgugguugagaggaucuugcagcuggguccaccugcuucugacucuggaguucugggauuaaaggggugcugcuacuccccgaugcuggcuuauacuuuuuuuuccccuaaccguuuugugauagggagcccaaaguuuaaaaucuaucaaaacucagaccuaguaguuccuagucucacaagauggaagggaacccaugggugaccagaacuauagagcccuagguucaaucuccggua

SEQ ID NO: 3590 - RNA, 7991 nt, Mus musculus
uuggucuuucuucccagcuacuguggaggucugagguaggagaaucugggagcccagggccuaccuugggcuguaugcacuaaguaccagugucagucuuuuggagacccugccgcaaaccaauggagaaagggcagguuaauaaugcuaggucacugggccagugugccuggggcucaaggguuuguuccaggccugaaaguaaauggagagagagcugggguguggggagaguucugugcaaggcagcgccuagaggcagaguccagucugaguguuagccacauuauugucaucucaguaaauucauguauacucacuucugaaaaguagguuuuccccuaggagagauccugcgaacacugggugaagugacccaggcaaacugcuugcuccagccucuugagugcauggcuagcuuaaggaauggucaccagugggcgguccauacugcuucaccacuguaaaccaaggcuuggagaagucuggugacuuccucaaggucaugccggcagagcugcuguggagacaucccucucuucagccuucacucuggauuucuuugagacagggucuuacuaugugcccuaggcuggcuuugaacccacuguggaggugaggaugaccuugaacuuauaauccuccuaccuccaacucccuaguuuuggcauugcaagaauguucuaccaugccugguuuaugcagcacuggggauagaacccagagcuuccuguaugcuaggcaagcccucuucccacuaagcuauggcgauuuucuccauaacucuucccuuagaugccugcccuaugcugacacaagucagggcuugacacaguucucugguggagaaaagagugacucagccagguagugguggcgcaugccuuuaaucccagcacucgggaggcagaggcaggcagauuucugaguucgaggccagccuggucuacagagugaguuccaggauggccagggcuacacagagaaaccaagagugauucaaggacucaagguaacaggccuaggguggagaacucagggccugagggagccagaaggauauauaugacccagucuuggggauguguagagggcuggcuucuggaaggggauggugucagagcugacacacacaguauggaggaggaaaggcaugauggcaggagacucaaggaaguuuuggugagguuggauuggaaccaaaagauuacaaggaggacuuuuaaaaauuauuuuaagaagugaucagagagauaagcaggagccagacaaguguuguauauuggguaaaggugaaaggcuuagugugugugagccuuguguggugguacaugccacuagugagguagaggcaagaucaggaucucccuaggccagccugggcuauaugagagccaguaucaaaaaaucugggugcauggagaagaaagacaugcucuggggaggcacugggggggggggcauaggcaugauuccaacagguagucgucgucgucuuuuuuuuuuuuuguaaagucugaagguuuuuuuuaaaguauagaauagaguuuauucagggcauggggaaaggagucaagaggguaauggaggcagagaaagguagagagagaaagauagaagaguagaagaggccagccaugagcacguggagaaagaggggguagggagcaggaaagcaagagaggaacaagagagcaugucugaaguguuuacuuacucugugugugugugugugugugugugugugugugugugugugugugcgcgcgcacaugagcaugggaucauaaggaaaguuucagucagaagugucuccaccauggguucucaggaacgaagucaguuuaucagguuuccacggcagccaucuguacauacugagccaccuuaacuggccccuucccuagggaguuuauaggauucagaaagguucguuucccuaccugaagucacacagcaagcacacagggagauguugaacagaaucagacgcccaacuucuacuugacuugcacuuguugcccauuaacugcccgguuaauggggaggacagaaugcagucaacgguuaggcuuggaacgcacucagcaggcguggaaacagccagaagcccaaccuacauucucaauuugaucucuuucugugaaaccagagcaguaaguuuguuacuuguucauguguugugugcauguguauaggaacgcaggcuuucgugcaugugugggugugcaagcacacuugcuggcagcccaaagucgcuguucagaguuguugggagcugcuuagucuuacagucuuuugaggcagguuuguucaaucaaacccagagcucauugaucuggcuccacccccaacccccacccucacccccagucagcuugccguggggauuuccauaucugccuuccagggcuggaauuacaggcuugcugccauuccugccuaucauauauguggcuucagcucuggcccucacgguuccauugacucacccccugaacuccaacuugcuuacuuagaaguuguuacgaaguguuuuaaaaugcucgaucaaugucuauugagguccucuuccuggggauggauacggagauacaguggaggacgagacaaauuccuuccccuuagggagcugauguaguugggggauacaugccacaaauagucagcacacuacacauaaugucauauagauaauaacuauuaacaggagaaacaaugccuacugaaaggcaccaggcaggggcagcucacacugaaagcguagugcucaugagguuggagaaagaagcucuugagucugaggcuagcccggaaugcauagagagccccugugccuagaguaguuaagagugauaauguuuuguacagugaggauagucagggagggcuuuccuggagguggugaauucaagcugcagcuuacauucacagguugagccuaguggauaucugaggggagcccgaguguggcaguuagagagaaccacacaguaaaggcucugaggcaagcguguccccaaccaccuggucucucuguguaggccuggcuguccuggaacucacuauguaaaccaggcuggccuugaacucgcagagauccacugccucugacucuugagugcugagauuaaaagccuguaccauagcacccagccuaccugaccacuuaauccugagucagacuuacaaagcggaaguuguugucaucaaaggagaggagcggcuggcuugcaucuuugcuggcacugggaacugaacuaagggucacuuauuucugacauaauauuuaaaggauaugacagccacacacgguggaggcagauguaaagaaaccaccccaagucugaggcuggcuguccuacauagugaguucuaggccagccagagcuacgcagcagaacccuguccccccaacacaagacaccuccccaaccaaaaaagcuaaggguggccauaaacaccuuuaaucuucacuugggaggcagaggcagguggaucucugcacucugguuuacacagcgaguuccaagacagccagggcuacagaaaaacccugucuuaaacaacaacaaaggaucccccaaaauggaggggaaaaaaacaccuaugauguggcuuaguggguaaaggugcuugcuaccaagccugauaauuugaggucaaacgcugggacugacaugguggacagagaaacacgguguccugugaccacuacaugcacaacacagcauguguaucugaacaccccccuaaauacaaauagauuuuuaaaaacuuaaaaaaaaaaaaaaaaaaaggaaaaaaggccuaggccaauagcuuagugguagagccccugccuagaauccccuagugaggggcugggggcguggcucagugguagagccccugccuagaaucccccagugaggagcugggggcguggcucagugguagagccccugccuagaaucccccagugaggggcugggggcguggcucagugguagagccccugccuagaaucccccagugaggggcugggggcguggcucagugguagagccccugccuagaaucccccaaugaggggcugggggcguggcucagugguagagccccugccuagaaucccccaaugaggggcugggggcguggcucaguggagaaccuaccuauguauaaggccuggagucccaucccuggacugggaaaacagcagguagcacgacgacuccuuaggugguagagcuuaccuagaauaauuagacagaaagacauggguugcaugcccaggagaaaugaguucucagagaaaccacuuaggguugaaaccagagccaagaaaaggacuggcagccacuuuagauaauagccaggacauuucuccuugaggaggaagcucuauagccuccagguaccccagacaccacaccaguugcccuauaauccuaggcagucacugacuuacugucugccucuacagaucauccuggucaagauaccuuguauaaguggaagcagacagcaggcagucaucugugucauuguggcuuucugaaguguuaauguaaccacacaacgcuggggaaggacugagagugugcugggugaggcuggagggagaagcaccuagaguggauguuggauuuauuuauguuuaugugggauugcaucuguuuggggauagugucuuaagaaaaaagugccagguguggagguacagggcugugaucucagcuacuaaggaggcuggaguagcagaguugggaguucaaggccagccuggacaguuuagcaaaugccugucucagcaagcaggggagcuggagagauggcucagcaguuaagagcauguacugaguugggcagugauagugcacacuucuaaucccagcacucaggaggaggaucucggcgagucugaggucagccucgucuacaaagaguguccaggggcuggugagauggcucaguggguaagagcacccgacugcucuuugaagguccgaaguucaaaucccagcaaccacaugguggcucacaaccccccguaaugagaucugaugcccucuucuggagugucugaagacagcuacaguguacuuacauauaauaaauaaauaaaucuuuuaaaaaaauaaauaaaauaaaaguccccuagucuugcagguuuaaaaaaaaaaaguguccaggacauccagggcuuuuauuauacagagaagcccugucucaaaacaauaacaacaaaaauaaaauaaauaaauagacugggggguagagagagagagagagagagagcgcucaguuaguaacaugcuggccacacacguaggaaguccugaauucaacccaagaacccagccaggcucacaauccugguguaguucacauggaugaaaucccagcacugaaagaguggagacaagaagccccuggggcacacuggccaggcagccaaaccaaaucagcaaacuccuggucaggaguuguucaaaacuaaguugggacaguucacauacacaugcauguacauacccucccuacauauacauauacauauacauauacauauacaugcacgcacagagaauacuacuaagaaaggguacacuuaaugguagauacauacauaacccgaaugaaucuuugguccaacuccaggauaggaaaagaaugagggaugauggaguuuuauuucagccccagcaccuggacgauggagcugccaucuucugaggcagggguggaugacgaacuccguucaguagugaguuugaggugucuagacaaagcacagauugugagcacugcccccuagagaugccuaagagccgcuggaacucaggagcgagguucagcucacccagaacaccgucucucagcagacacuuuaagccccaagagugugaagggcgccugagauugugacgacccagcaggcugggauagaacuaggaaauccugccauccuggcuggaaagagcaugcaagaguuaggaccaguguaccagccacucugccucuuucaauggacuccaacugaguccaugcgggaguguccagaugguucugcgcuuuacggagcccacaaagccucuuacuaccauggggucugucagacuuguaaggcuuuuguccacuaaagcuggccaccaaguugcucagucgguaagucaccaggguucaugccucacacugggcgccaugcauaaccaugaggacuuucucugcuugucccagauuugaauacugacacacagucuuagauuuauuuauaauagcauuaggccucagcuuacucuuguucccaaccaggucuuacaaccuacauucugccacguggcuuguuaccucgaagucucacagccuggcccugauucucccacgccugacuguuuucccagaauuccuaucucugccagaugucccgccucuucuccccuccuuugcuguaagcccuuaguuuuuuucuuaaaccaauaggaaggugagagagggagagcuuacaaaauaggaugcaggugaugagcaauuagacaggaugucgggccuguaaaucagaugcccgccugguacagauaucagcagaugaauaguacaccaccagucuuuacacagugcauaaaaggaucacccccaacacaguuuaaugcauccgcuccucggcauucaaagacugacuucaugagcguucccuggcauguucuaucuaggugguauuacuaguguguuccuuuuugagauauggucuugcuuuauagccuagguucgccugcagcuccagaauacaaguauuucaaacaaaugccucgauaguggccuagcgugugugucuguguguguguguguguguguguguguguguguguguuucugaugugggagaggucuuaaaguguuuuuauuccuucuuuuugauauggucuaauguagucaaagcuggccuuuaaucuggguauauaguggauguaggccuuaaauuucucaaaccuccugccuuggcuuccuaaguacuagggugccagcaugccuggagggugguguucuuagaaagccuaaaucaagccaggcaugguagugccaccuguaauaccugcacuuaggaauuggaagcaggagaauccggaguugcaggcuagccuguaucaccuagagagacccuguuuccuugaagaaggagagacugagagacuguacuagggauaggaagccaaaacaggaaaugaagacuugcaggcccuuugugacuuaaccaaggucucuaucuuuacagauacaccagcccagagcaagggaggcuccagcagcccagaguccugggcccggcccucuugcaauccccaagaagccaaggagcgugaguccacguccccugcagccaugcagccuguccagcugccccgccuggccuugucuccaccgcucccugccccuccaccaccacccacggcgcuggcccaaguggcacccucaucuccuagcccaacuccuccucggcccaccucagccccagaacagucccuggacuuccugcgggcucagcaggagacugccaaugcuaucagggagcuggcuggcacccuucggcagggacuggccaaacugagcgaggcccucagugcccuguuaccccuuuugccgggaaccccagcugacccgcugcccccgcccccaccgccaccuccgcccccaccucccaaaccaguccugccacccucugcccccaagguggagcucgccccagagccugugucugugguagcugcuguuguggauggggcuguaguggcagcgaggggagugaucaucucccccaggagcgaggaaggggugcccaaaccacuacccccagccccaccacuuccccuccacgacucacccccacacaaaaggaggaaagguuucccuacacgaaagaggcggggccgcuggaagucuccgugaaaucuacccuuguccaagcuccugccugcaaccccucucccugcuuggcgcaggcgcagucg

SEQ ID NO: 3591 - RNA, 30282 nt, Mus musculus
ccucaggauuucuaaccuggcgcagcuacgcccucuuuuauuuguguuaaggcaaagcuccaggaggccccgucccgccccuccccuccccccaaacucccgcagcugucagcuguuccccuugcucucggguucccugguuucugggcuggaggucuucaaggcuucuuccacagcauggcugagguucugggggcuccgcucauccuuggagcucgacccgacugcugcugccuccugguggcgggagagggcaagaagcagugggucaagagcuaguuacccacucagacccauucccagggcucugcugcaaucuauuccuaccuuaggcaggggccccucgagacuagaguccagcagugugguuucagccagccccgagucgucguccaugcugaugaagauggccggggucucgcauucgggacccuccucccgguauuccaugaccuccucagcuggggugggcccagcucgggcugcugcuggcaccgagggcguugaggacacacaggcagcgggcgcuccgaugccugugggcuucugcuucuguuccuccuccagcugccucuucagggccuucuccugagccaaucgcaggccgaugagguccugagggggccguggggcaggggccggggccggggccggggccggggccggggccggagccggggccaaagccagagccaagggcuccaggucauccuggggugggagaagcacucagcucaggaaggguacaccuaacacacacccgcauccuacccccacccacgcaucaggguagagaaagcagagcacucagcgcugcugaaagcaaagagcgcacaucgcauagacuuuccauccuggugcaaagguguguggggucggcggccauuuuccuuuaccagggacaaaaucuugggagacuguggguuuaaugagcggacgucuuggggugagaggcacagguaggugggcgucauugcgcucaccucuuccaggggcccugaaggugcuuccuugacuucgggcuccugcuuuccaguggccuccaggauggucaugauggaguuggggaugugugcuugcuaggugaagggaaaggcaccucucagaaccccauaacauagaaccaaaccuuccagagcuuuccugcucacucggcuccacucuaccacacccaguuaccugguggggagugaaggagcgcacaugggccaacaguggcucccggagcucagggcacuugucaaagacugcgccaagcugcuguggagguagcugcaggaugaccuggaaacucuguggcuuggugcgcuggcagcacuugaugaagcccucccauaccuugggguacuuccauaccuguggggcaggaggggggccguuaggcacagguccaaccagccaccuccuuccugaagacaccgccaugacccaggacccauaugcugucacuugaaaucuuacuccaggguucauacaccugccuacccaggaauuugaguuccucacagcaaacuaccaggacacgauacaggaaaggggccccgccuccaaucccuagguuagcacaucaucauaugcuaggacagcaccacuucguggccacacucaauaggcuggaggaugggaccuuagccagaugcugccuagggacagccugugcucugacuccagcuuuggcauggaggacggauucaauuaccauuuccagucuaagagcuggugcagcaggcuugcaaucccagcaggcaagaggaucauuacaaauuugagucaugguuauucugggcuacauagcaagacucuuaccaaaacaacucauuccuaauucuagucuuguuaaagacaggaugcuuucagcugagcuguguguccugcagugcccaggagugggguaaagaggcauacacaccucucacauccccaacuguucucagugucacccugcaaccagcuggagggaguggugagggcacacugcaagcaggacagucgcuccacagauggacccugccuuccaggcaccugagguuugucccacuguggcugacugccuggggccagggcagguuaccugcuucaugaugagucgggccaggauguucaugacgaagccccccaggcggggguacauggugagggacuggaugacgguccgcaugagcagcaugggcagagggcuuugcuccaucagcugcugcaucaccacagcuagcacuuccgacguguacacauuccgcuccgcaaaacacagguugguggcugugaggaggcggagaguggccuauccucucugccuggauguccccauuaagugggaccccccccccaccaagcuucuccaucuuuaucacaaaagacccuuuaugaggcuacucaaugacucugccccuagaagacugagauagguguauucaaccccaggauaaugcacgcuggaccaaucuggaggacauaggcucuucuggcagaguaugcugccacacccuggggccugcccuaacguaagaauggcuauaacccacuaaggugagggaggaagugcugccaguaccccuagaaucaauccccaggagagggaggcaggucucugccagagagcugaccagucauuagggucugaugguguagagcagauacgaugagggacgcucaugaaaguaacagggaagggagggguaagaguggggugagggccaacccaagccaagugcccacagguuguggaaagaugucacacugaagaaagcauggagcaggccuugcuugaggucuagcuccugggagugggugucaguaucagggucaacugggcugagaggcgaucccaggagcugccucugaagcccuuccccaaacaccacuggccaugugagugugucaaucaggaagucuuuauugagcaagaagaaagcccaccucccccaucccugagaggccgaugcaggcaaggaugauccuguaaagaggaggcccauagggagaggagggaccuugcagcaaacacauaggcugaagggcagaggagaaaggacuggcagaacuugaggugccuguugcuguggaggcguguuccacugcugcccacaugggccugacaccagcuugucuacccagccucuuguguuucccagccucucuagccuuucccacucagcagcccaagaggucguccaaaaggucagccuguccuccaccccagagggugcaugaggccaagccgguuuccucccucacuuggaaaccucugcucagcccuagaucugacaggcucaugucuguugggucugcucgcugaagguaaccccacuugagaaagcccuuccugaguccuggccaggcuggaucagcuaucagugucccaguguguccccagcacugugcuggggcccagggaggccagggcuucucaccugaugggacaagggagauguggugagaucugugggguaccuaggaagccuagaggcugugaacugacaagaauucccaaagaaacugccagacugugcaagguagaugccugucuucagccauccgcaugacuuuuggcagggcccuuucuucucucuuugugacuagauuucuauucuggauccacgauggcuguguuucuaaaucccuuccaauuauguucaaacugcccuugggaaugggcugcuauagagucaagguuauuuucauugcauuuaaggaucaagaagcaaguguguggauagagauagaacacuuaccuagcacaugggaggcugcgcuagguucauucccagcaugguaaaaagugugugugugugugugugucccacaaucccagcugauaccccuccccuuucccugcagccuccucugcccugucuucacaagcccguugucagggcugcugaggaaggcuaggaagcggucccugaagcagccacgucaggcagaacaagaaaggcagggacagagaagaagcuacccuaaagucagcagagagguuaacugauagaugacagcagggcccuccugggacagagccgauucugggccaagucucuagaggaggaaagaaagagggaaaugauggcuuccucccaggggaggcucgugagcagagcccuucuugguuuggcuccagucuggcucagacugugugacccuggcaacugauuuagcuucugugaauuuugugcccuaucuagagcauacuuaccaggagauguggguggcaggguuuguggcaugaagggagagccuggcucggaggagaugccugggcagaggaagccugccagagcaucaccaagccccaacuauggacgucucugacgccccagcucaggccugccaucugcucgucugcagaagcccugugccuccgugggcccugcuuccuggguuccucgggguagguaggaagagggauguccuguacucccgaggacuaccuggugcccaggcaggcacauguguguaugugcuauggguggagaccgggaagggacaggucaggcaucaggccauagucuucgaugcaguagaaccaugugggugacugaggcccugccugucugugggagcuggguccuggggaaacaggggugccucaccuuugaugauggacuucaugucacacuucacagagucaauauugugcaaugcaaucagcagcucuccuggauucaggggggacagggccgaguuccccucaccugcaauggguggcaauagggggaagagagacaggacaggggccucagcaaagagcuggaucuuaggccagcuuuggguaaauacaaaugaggaacccucuugcuucuugggcugggggacaggagacuaaaugaaguggcugcaagucuucaccaccuuuuuagagcuuccuugcugugaccccucugucuccucagugcacugggcuguguacccaaaaggcagggaaggcccaccagccuaggacuaacucuacauaagcacauaaacuugguaugucuguauguggccgcagggaccagggaugaggaagucauucauauacaucucuggcuauuuuuccaccucaaauacuuuucuuuguuucucaccaugguggacaacagagacucuggucucuaaggccauucccaugagagccucagugcagcugggagguaagcuggcgaggagggagggcaccuaccgugcugagugccuagcaggcgguugaagacuuccuucaccacaaugggguugaguuugaugagcuugggcagcgccuggaucaccucuuucuaaggggaugggggaugagagugaugaugggcuggguggccccacauccacccacuucacagaggacacuaagugucaugacacuuggucccccucuccccaaagcuauuggcuacuucugguggacagugucauccccauucacacccacauggugaugaaccauccuuggcuccaaaauuuaccauggacauaagcugggguguuacccauaggccaggaacuauaguacacacaaacacacacacacacacacacacacacacacacacacacacacacacacacacacacacagagccacaccccacugugacacuugaacagugacugacgaggcugagaugggucuggggaccuacuucaaaacuaggugugcaauuccagcccaucugccaugaagugggcugaccaccugucccucuccuccuucccuaccuucuccaacccauugagcacggggaugaggaagcgcacaucaggcagccguuugugguacaggucucggacccgcuucaccaguucuggggaugguggcacuuuggggaagacagagaaaagcugaguugagaugacagggaggggccaggggagaugagcacggauuaggggacagaguuaaguuuaugggaggggcaggacagucccaaagcggaaucccagccucuccuucccuaaauggagcucauauauuuucacuacagagugaggcccaaggacagaagaacuagaggggcacaggcacuagagacacagcagcucuagccccuacagggcaagagcaggugggauggaugguagaaggcagggcccccagguaccuuugucggugaggcugugcaggcagcgggugaccagcgucucugcccccuugggacaguuuucuaccagcagcagcagcucuggagaguucaugcccaucccucggaucuagaugcaggggggagcaagagcaggugaugaggaguaucugaagaggcugcagaagcuggggugguaacgguuacugggcucccggucucuccuacugucagccuggagccuugauaugccauguccuccuccuagcaggucaguccccuaccgucucacaccucccaugcccaccccccugcaaccgcugucacuccauuguggcugagggcacaggcacgugcuuccgugaacaggaagcaugcuggcugcugcccuuggcgucuccaucuguggaugccgagggacgcugagcgagcgagcuugccuugcacuucucuuucccagugcugggcuaagcaucucaggaaggaccugacccugcccuucuccaggugaacugaaaauuuuccauaauaaagaugucacaagagagggggcucucuaaugagacccgcucaaaaacaaagcaaaguuggggacagaacugacauguaaaacucagaguucugaacccagaagcaaacaggacagccaucugagccgaaucucaggacuguguggcucaggaccuuugguaacagcaugaggaaagaccagcagaaaucaaaacagaagcucagaugcuaauguggccacugccugggggagugggcugcacccccucaugucagggcagcgagaucaacagcagaacaugaagcuagguguguccacuucgaguucuguaccugagcagcacuaugccucccuacauguugaagaaugugaggaccacccacaggcuaaagccacgaauccagaggaacagcuaaaauugggaaucauuuuugcccaagugggccaggagccucaccggcugcucaaugacccucagcacuguccgcuugaugucagcgauggcuucaguguacacggcugccagcucauggaucagcuugugguucugaggcaggagagccagauacagauacaaacacugcuucacuguuuccucuguccagggugcggccaccucugacaggacaggacaggauggagccauguaucaacagaagccucuauucccuucccaaagcccuguccccagugucugugcuucucagugaagucagugggaagaugugcgaagcuaacccugcauccuccgaguccugucacgacugacuacagccucaacauaaacaauggcuaucugucaggcacaagggccagcccagcugguaguccugcuacccuccaugccagucccuauauacuucagcagaaagacccucacugcugacccuuggugccaccaucuccacuacagggaaacaccucugcucacauccucccuggaccucacaccucucuugggaggggcuuucuacaucccugcugaaccuucugucuguuuggcaggaucugggacuaugcuaaguuugcucuccuggucuucuaguuuccuaccccugcagucccuugucugucuuggcccugcuugcuacuacccagcagcuauucuaguagaguggccggaguggguggggcucgacacagaucagaugaaccugcaucaaaccuguguccuugucggcuccaaacagcaccgaggguggguugggguggaccaggagcugcagguaguugagggcaaauuucuccacauacucucgaagcugcuccuucucauacauucgcuuaaugaagagcaaggccugggagcgcaccugagggcaggcaggaugggugagaaggaagugggcagugggaucaugguaauggaggggcugcuggggagaaacucagccugaggcccaggacagcagcgcccuguaucccaagcugcggcugcugcacuucucagucccaucuugcuacucccuccuugcuugcuccucauuccucaagagugacucucccugccaaguggccuuggcuuuggaacuuggcaggacaggcagcccagugccuggaagacaugucacuggccaagcuucauuucacucagacaccaucugcuggaagccacaggggcagagucuggucugaaacacgaguuuguaccaaaugacagcacagggccagggccagaggugcugugcuaaugguacgaugacugaacaugagccaccaggaggcuggugacaggguacuguagggacaggucucaccuagagaacagcuaguguguuacaguagcacacaucuccuccuccaggaagcuuccugaaccccaucccuagucuacucagugcccuaccuggccacugcauacugugacaucaccccaccuguggucacaugggcuccucuacuagcugcugcccagguuacaggucagcaacaugagugugaacagagggagugggcauggcauccucugagagcauauauauacacacacacuuggucagauuagcaccugacccuaugguaaugucacaccauggcaaaugaaaugaaaacaagaguuugaagaaaaaggaaagccaagcuggccagcuacagacacaagcucacccuguccuucucgugagagcugaggucaagaagaacgugcagauacuggaacuggcgagaagggcgcuugaagaucaggucuccaagugucgacaugcccagguaggcacgacucugcagagggggggugaugcucaggcuguugugcaagcuuacucuuguccugcucccucucucaaaccaaguccccaggaccuucaugccacaccugccuccaugucuacaugacagagcggcagccagcucaccucauccucacaguacuuccguaucaccuccaaggcacucucagugaucaguggggccuccaaaaccaccuugguaaagauccugcccaagaaagaccaggucuugcaaggcagccacauguuguggccccaagcucacaacagcuuccccgacccuggggcccagcuuuaggcagguuagagucuggugccugaaagcugcugacuggcagauggagcgcaggugcucccucucugacacuuucuuccuuuugcuagaacgggaugcaacuaagggcuucaugccaggguggugcucaccacugagccacugucccaucucugggaacugucaguacacaugggaauaugaagcccagagggugacaggucacucagaccaaguagcagagucggaacaccccacccccauccccagcauggucugcacacacuucacagagagggacauggagagggcgagaggucaagcuuggguggcaccaaggagaaaagagaaaugagacacuggaggggacauggggcuuauggccaacccauuacccaucuuucuggucugguuucucuuguaguccagagagcaggcagaugaggcaauccucauauuuguccagagugccugaggucccugcugccagguaggcauuauauuccugguagagccaggcaaaagccagguccagacgggcccggacaucuuccaggauaaaggacagcaccucugccuugaauccggagucgaacuguguuacgaggcuggccaggaucuugaugcgcaccuagaaguaaguaggugagcacauguggcaguguggcuggccacuggggcagacuucaaucgugccuugcacuccugcagccagggucaggaaugcccagugcaauuggguacaguggcuaacaucuauaauuccaguacccagagcgcucaaguugaaggccagccuggugagacauucucucuaaacaaccaaaucaaucaaugacucaucagucaaccaaccaaucaagggaggcagcaugaagaagcauaaacauagcagucucacaucaugugucaguggacaaagaagaaacaagcuaucauuaucagcaagccaccccaggcuccuagguaaggaggcaguaaguaaccaggcacuucacugcauagggaaaggaucgagaagacucucuuuugucaccuguaggcaugaagagaaugugaugaaaaacaagaaagaaagacuauacauuaucuuuaacacccagaacacucuuguggaacuggacaugaaacccaggcccugccaugcuggugcagggacuacaguguccacacacaacaaguaaauguuuaaaauguaauaaaaagcuuggaaugauagcacaugccuuuaguccuagcacuugggaggcagaaaguaggcagaucugaguucaaggucagacuggucuacagagugaguccuaagacugcuaaggcuacacagaaaagcucugcuucaaagaaccagcacaacgaaacaaaacaaaacaucagaaaauaaagguuggagagacggcucagugguuaagaucacuucaguuugguuucuaacacccacaugguugcucacaauucccuguaacuucaguaggggaccugacauccucuucuggccucugagggcuucugcauacacacagugcacauaaacucaugcaggcgacacauguauacauaaucaaacagacacauuuaaaaaaaguaaaacgggggcuggagagauggcucagcaguuaagagcacagacugcucuuccagaguucaauucccagccuccacaugguggcucacaaccaucuguaauagaaucugaugcccucuucuggugugucugaagacuacucauauaugaguaauaaauaauguaaaaaauuaaauaaauauaauuaauaaauaaaucuuuaaaaauaaaauaaagcaaaacccuugaaggcagggauaucugaaaucagagccgcccucagucaauccugucuguacagguccuacugccuagaaggccauagcucugauuuugcaguggguggagucaagucuggaggagcucggagcagcugagcuaagggcuaguaccacaggaacuuuucccuaggcugagugaggagcguaccugggcugccccacugcaggcuacagccuucucagcccucaggauccgcuucacagcuccuagcuucauggcuuccaccugggcaucugucaggggcuucagcacaucgcucagacggaagaucuucuugcgcccaccugcgccugccagccuacauaagggcagggacaaggaaggcauguuuucuacagcccagucagccuggugguucccaggcuggaacugggucacggagacacacagccccuccacaccucugaacuccgagagaggcucagugggcugggagaucagaaucaggaagaaauugugauuauuucugccauggagugugucucccugugagaacaggccgggaccagaaggggcucagguagagaagaguaagcagaaagaugcugaacagggcuugcaguauaugggcugcagacagaauggggagcagagcaagagacagaaaggaagcaaguaacguuccggugacgcucagauguuaaccccaucugauuucaugauaaaagugauggggaaaugaagaugguaaugcuaaccaggagccccuguugcacgucaggaagcagacuaacugccucaccgcaccauggcugugccucccagauucucuuagugucucuaccaccauucuccgaguuaggagagaaaaagguguggcugcagaagccacagaagcuugguggucccugcacugacuuugaggcagaggaaaagcugguccagcccucagcccgccuuacacucacagggcccacacgccagcuacaaaaggacucaccguggcugcgugacagggaugauggguucuggccuccucuuggccugggguaccuccuccuccaagggagacauggugcucugagagccuaccacagagauggccuggcccugcaccgacaggcgccgcuugaucaggacgcucuccggcuuuaccaccuucuccuccuugggcuccuccuugcacuguuucgucuguuccacaccugaauggaggcggucacagggcccaccauaucagcaccaucaccugaccccaggcuccgcuguacacgcacagcaccuaccacacuauguagcccaccuaacaaaugauccaaggauggagccagacuauuucauuccagaggcacagccguugucacagccucaagguauguaucacaagcagguucucuuaauguuuguguggcaugcaugagugugcuugugugguauguguguacuggugugcuagacugcauacacacauggaaggcagacuuguaucuucacuucucuauuuauuuauuuguuugcuuauuuauuuuuucuuuugcugcaggauuucucuguguagaccaggcuggccuugaacccagaaauccaccugccucugccucccgagugcugggauuaaagacaugcgccaccacggcagggcuccacuuuauuuuuuaaugagacaagaguaucucuguguagcccugguuggccuggacucaaugugugugcucccacucugcccuguuuucuuuuucuacauuuuauuuauguguugugcguguauauguguacagaggucagaggacccuuuuguggaguugguucuuuccaaugggucccagggacgaaaaacucaggucuuugggacaggcagcaaguaacuuuaccagcugagggccauuuagccagacccacauuacuuucuaaaacagauuacccauggaacccagagcuggcuguuucagcaagacugguugaccaggaaaaugcccagaaccuacaugugccuguccuauccaaugcugugguuugggugcacaucaccuuggcuucucuguggacauuauagauuggaacacaaguccucaugguuacaucuuauuuaucuguauggggauacacaugcauaugccagggcacaugugugcaguuuucuccuuccagggaucacacuuuggguuugacagcaaacacguucacccccgagcugucucacuggcccauuagagguuugcaggucagggucucaugcaccccaggcuguccucaaacucacuauacauccaaggaugacccugacccugacuuccuaccgcugccuccugggaugacagguguaugcuacugaggcaugcuaauuauaaacagucuuuagcagcagagggcaugugacuugacaacaggcucagggggaaaccugagugcaucaaagacccauacguagccacugcucagagcagcuauguuugaaccagggcuggcaaggcucaguggauaaaggagccugaguucaagcuuugggacccacaccaagguggaaggagagagcaagccuugugaagcucacagccaucuuggcacugcaguugugcaugcgccacucacgggucauaguuauacuucgagaccaugcgguggugagagcagcucacaccucuaaucgcagcacucaggaggcuaggccagcacaggcuguacagcaagacccugucucauggaagacaaaagccugggcuugagagauggcucagugaugaagggcacgugcugcucuugcagaggaccugagcuucauucccagcacccacaaccucuauaauucuuccaucugcaaggaaucugacacccucucuuuacgugacaaagcguucugaugaaagagggacagacuccaaagcucaaaggcucagaaaccugauacaagucagccuggacucaagguaagaucagcugaauuucaaagcccaggaccugaagacaccgaguacucugcauaaugacaaacccaugacaggugacaccuuagauggcacaugaccaucuccacagcuuucccaguaaguagaguuugcugccacagcauggcccaguucagcacaaacucaccaggacccaguccugcagcugucaucuguguggccaugagucgagccaggugcuugaucugggcuucagugccugcugacuccacagggguguagauggcuuggaaggaggcaggcauggucucaggcagguacaccaugcugaugaggaccugugggaugcccaggaaggagaaccuuagcuagcucauccuuacaauagcacgggagaugcagcagaaacugaggucggggcuggggccacucuucuugcucuagcuuucuagggagccaaugacugccacacugucaccugggagaguccccagccccaugaugaucgagaaaaggugcaucuaaggguaggagggaagcccuggcugaugcuagggaggcagccauaguguaggguaggcagagaaaacacugggaucaggccuccugucccuggaugacuucacccuccucaccagauuggccacauugucaggugucagcagaggcugcaagaacucagcagugauguccgugucugacuggccugagaucugggcugacgccuuugacgucccugaugggccaggcuccaagucuuuguccucaucgucuucucccaaguugggcucugagaggggaggggaucagaggcuggcucccagacugcagcaggaccugugcucaggaagcccuagcaagucacugcaaggagcagccacacagcagccaaggaccuaggcugaaaagugccacagguccccaggcagcaacaacucucccccguucucaguucucacuagggacauggcaaaaauucaaaaaccucucacugaucccauuagguuccaggacaaugauaccaucgauacaucccauacugaagauugguggaacgcagaggcucgcacucaccaggcaggugccccagugggagagaguucugcuguuacugcaggaggcagaggcaggcagaucucugugagucugaggccagccuggucuacagaaugaaucacaggacagccagggcuacauagaaucuuaaaaaaaaaaauaaacagggcuggagagauggcucagagguuaagagcacuagcuguucuuccagagguccugaguuuaauucccagcaaccacauggugguucauaaccaucuguaaugggaucugaugcccucuucugguguuugaagacagcuacaguguacuuauacacaugaaagaaauaaauaauucuuagaaaaaaauaaaaucuuuuaaaaaagaaauugauucuagacaaacuacagacacagaaaaccuuuacggagaugucccuuuguggugcucuaugguuagaugugcagaguaguccuauagcagggacacauuauagagcacuuagccaccauuaaaaaagaggugggacagggguagauuuagcuuagccuuuaaaaaaaaauaccccaaauagcaguucacagccaucugcaauuccaguuccaggggauucaaugcccuuuugugucuucuaaagauaccaaguauacaugugauaaacauacauaugugugcaggcagaguaucacucauaaaauaaaaugaaucuaaagaaaaaauuaaaauaaaaagauguagggcuagugauguaucucaguagggaaagguacuuucugcacaaaccugaaaccucaaaaacaaaacaacccaccccaagaauuucagaaaugguguguguauguauauauguguauauguauauauauauauauauauauauauauauauauauauacauauauauauacauauacacauacacacacacacacacauauauaucacacacgcacauauaauuucauuuacucuaggaguggucugcugcaucuauaucuacacgacagaagagggcaucagauccccuuauaaaugguugugagacaccaugugguuguugggaacugaacucaggaccucuggaagagcagccagugcucuuaacccugagccaucucacuaguccccagaaauguucuauaaacaaacacagaugacauuuuuaaauccuauugguacuuaggcagcuauggcccauacuacuguuaaauaccacagaagucacuucaaagcugggguggugacacacgccugccauccccacacugggaggcugaacuaaggcugugauuaugucucaacaaaaaccaaaaaugguaaaaauuacaaaguuaaaaaagaaaaauccaauuuuacauauauauguacauguacacacacacacacacacacacauggaguaaaggauaagugccuucuacacguguaaaacagaaaugaaaccuugaaaggcaggacacacucagccaucacucauuccuuucuuuaacauuuagauaaauccuaauuggcuacacacaucucccagcaguccagggguggaggcagaaagaccauuugcuccuagacuauucucaaggucaaaaccuaaagaagcauuuacuaauuggaucauauaucccgguuauuuuacuuagcuaugcuuacugaagcacgcuguaauguauauuaaagcaacgugacagagaccguuuaggaaagccacuagcuacaagcccaggccuuaugccccagcucacccagcuucaucuucuugagcguggaaucuguaucgucccggggccgcuugcgggaguccuugcugcuaggcauguuucgggcgaucucagccuggggcgugcccagauccaccagcaggguggugaucugggccuggaacuccaaggaggcagggugcuugagcacacugagcaagugcagcuuaagguucuuccgcacacugcucaccugggacuuggccagcguugggggcagguuggcugugcggacagaggcaggagcucagugcgguggacaguucucaauacucagccccaggcuugggugggguguuugcugacauacccugggaaguuccuaggcucccagaagaacucacaggacuuguagccuuccuccucucaagcuaagacugaaaucccaagagaccucuaccacauuaguccuuuaaggugcaggaaaaccuaaaugucauuucucugcacaccacgccucaggucucagcucugugcuaacccuggagagagcuguaacugcuaccuuuuccacaagccgcucaacugcugccacagcucagcccgauccuccugccacuggcaugagcagcccagucucagccaccucagugaacaagcugucccugcuccacauggaacgaggccucgaacuuggccuuugcaguacccagcacccacuccucagcuagcgccacucuuuccccugaggaaccacccugucuccauccucuguccaagugugcaagagccuggggccaaugagaacacuguguuucccuggccacugugauugguucagcagaaggcccacagugucugcucagccaaucauaaacaaugagcaucagcauuugacuuuugcuggaaugaugggguaagagucgugcacucucccucuguugcuaaguggauaggaugggagccuugggcucuggggccaucuuuacugcuucagcaaacagccagaaaacaaagccaacacaagaguccagagauggagagacuagauccaugaccagcauucacucaugccucaacaccagacucuuuggagcccuaugcagguucuaaugugggaauuaucaccagccuccuuuccugagggaucaggggaggcugagugucgggauccugugggaccagcaucccgagcuagcauugcgguacccacacuacaacuuuaucuaacguggagcucacagugagcagaguuuaacaguuccuuaggaaucagcaagcaggccaggacaguguggggcacccaaccuaccaugcagagucucauaggccuggaucaccucggacaugaacaugggucucuggcgggcgauguuggcaagggagccgagcgcuguggucagguugauggaggagauggcggggugcaccaugaacuucagcagcugcuccacagcugccuugccuucuucccauaggacaucuaaugagguaagagaggagcagucacgggcccuucugucaaccugacuggaugcagacucacacacacagcccacaggcccugggacagcaccgcucucagucuaguccuccagagucagcaccugacacugugaugugaagucauggacucacauuauaggaaauuaaguaaacuccacuccaucugcagcuacacuguaucuacaggcaacagcauugugggaugcugccuggcacguuuuuuuaaaggcagggucuuauuauguaagcugggcuggccucgaacucaugaucauccugccuccucccaagugcugguauuuuauaauacccaguguaugcagggcuggggaaauucuggggcuuuacggcaggcaagcacuuuaccaauucauauauacagcccaggccuguaaucucacccaacuuggaagguucaggucagagggucuaaaguucaaguacucuuagcuacccaagggauacaugaaacugucugaaacaaaacagaaaaagggcaggugggaagacagaguaacugagaggagggcuggugacugcacacagggcacuaccacacucacuguacuggauguaggggugaucucgaggaaugcgguccagacugaugucaugcuccuggcgucgugggaccucugagucagccaugcggggugacagggugacaaugaggcccuccacaaacuugauggcauguguacggaugccaucguugucagaauccaaaagcaggaugauuuccccagccauagaggacaccaugucccagcaggccuccuggagaucacugaugacucgagacuucaccauccacuuggaaagaccaggaguagggacagagagacaagacaacacaucaacugucaggagacucugccccacccugcggacugaaugaugaugcgcacauucacuugauuaaaccaacagcuacgcucagugcugggugaggcuaggacaagggugccuaagacgcuggaguagucaccucgggagagauagcucagcagcuaaagaagacuagcugcucuuucagagaguccagguuggauucccauaccuauacagcagcucuuaauuuucuguaaccauagcucuacaacugaugcucucuucuggccuccacaggcuuugcacucacacugcagacauacgugcaagcaaaacacucauauauguuaaaaaaaaaaaaggcagugauuaacuggcuuucacuugcuaacagugaaugaccucacuguuaugaccaaugaccucauuccagugucaaacagcagucgaggaagacucgugagcccuuaccacuuuaagauauguuuauauguguauggguguuuuaucuaugccuaucugugcaacaccuguacagaguucaggucagaggaggucaaaagagagcauuagauauccugagacugcuauuauagaugguucugagacaucaugugaguggugggagugaaccugggucccccuuccaacagcucagccaucucuaaagauucaugaucuuuuuuuuuuuuaaauugcuauucuuuuuugagucagagucuuccaagguagcccaagguggccuugaacucucucugccucagccucccauaugcuggggugagcaacccaugccuggcugaggugauucuuuagucuaugucccucacugggcuaggagcucugugaagacuacuagaguccuaguccugaauguccccugcaucaccuggcaaaggacuugagaauagaaauucucagggaauguuuguugaaugcauaaaugaguguacccauaagacaacaguagaugcuuugacuacucucaggaaagcaaaccucacuugugacaagcuugcacuagccaggacuggcaguacaagccauaaugcagcuaagggaagaggcacagacagggagagagaaauucaagguuucccuggacaacucagaugggccauggcucaagacaagcacaaaauggggcuugaguauagcucagaagagcagugccagccaaauauaugcccagccuuaaccucagcagccggcaacaaaccaagccaacucugauguggcuuuaacugcuuuuggaaggcccagccgguccucaccuguagggccaccuuguagagcugggucauggugaggauggccuucuuaaccacguucacauuuucaucccgcaauagcauguugagguuggcgaucaguuuuagcagcagcucaaugucccgcuugcuaggggugggguggggguggggggaagagaagggaucuggucauguggaccuugagguaggagguggggucacagggcccacaaaucaagaaacuguggaggcaugagauucuuugucaccaguacauacaguagugggggcugaugccucccuacaucguggagcugcccucagccccugguaccaucuacaugagugacagccggcgacuaucagagugugaccagagacuuccguuccagccccagccugccucuaccuacuaccuagguagcuaaggagaaccuugcacuucagguccuccuguccccacacacugugugcuaggauuuacacaugugcagcacugugcagauuuacacggggaugggugcuggggauggagccgcacggccuaagccacacacccagcccugugccagccucaccucacuugcaggaacaccuacugcagagguaguaaaaacagccacaaagacaucgagggcuuggcaaaaggacuuaguuuuguuuugguuugguuuugguuuuuccagacaggguuucucuguguagcccuggcuguccuggaacucacuuuguagaccaggcuggccucgaacucagaaauccgccugccucugccucccaagugcugggauuaaaagcgugcgccaccaccgcccgguuagcaaaagaacuuaguaaaaacaccuaggguuguuuuacuaggguuaggguuaggguuaggguuagggcuagggcuagggcuagggcuagggcuagggcuagggcuagggcuagggcuaggguuaggguuaggguuaggguuaggguuaggguuaggguuagggcuagggugccagccuggaggcuuccacaguagggacccuucuguaggacugagaacugacagggucacuuuaguugccagaaagaauguaaggccuccaaugaugucugguugaggaagaaaggccagcccagaacucagcacauuaaugggauuuuuucacaacauaaaauucuaauccuauucuaaacaucaguugcaccauuuauaaaauaugaaacauuaugcugggugguggugacacauacacacgccuuuaaucccagcacucaggaggcagaggcaggcagaucucugaguugaaggcuagccuggucuaccgaacaaguuccaggacagccaaaccuguuggaaaaacaaaaccacuaaacaaaaaaagauccaaaacaggagcugaagagauggcacaguggucaggagcacuggcugcaggccuaggcuacaugagacacucucaaacagacaaacuugacugugagaugccagaaggcagggcaguagacuuugcuccacacugugucuucguauucuggcauguauuugcuacacacacuauuguugugugaacccagaaaauuuagcacagcuggguauggggacacagguuacaaucccagccgggggugugagguguguguguguacugcuccaaguucaaggucauagugggaaccugucucuguccauuuucccaguaaagcagcaacugugacuaugugcacacugggguuagacauacaggauaaaauacccuagguuaaccaagucaacucaggaaaauccacuugauccuccaagccuacuuucucuauuaaacacaucaagaaaugccucaaagcuuugugcugcccccuaggaggaacaacaauaugaacuaaucaauaucuccagagcuuccugggacuaaacuaccaaccaaagaaaacacauggugggacucauggcucuaccugcauauguagcagaggauggucuaguuggucuucaaugggaggaaaggcccuugguccugugaaggcucuuaugccccaguauaggggaaugccagggccaggaagcaggagugugaguagguuggugaguagggggaaggggauaggggauuuucggaggggaaacuaggaaaggggauaacauuugaaauguaaauaaagaaaauaucuaauaaaaacaacuaaaaaacaugccuugccgggcgugguggcacacgccuuuagucccagcacucaggaggcagaggcaggcaaauuucugaguucgaggccagccuggucuacagagugaguuccaggacagccagggcuacacagagaaacccugucucaaaaaacaaaacaaaaaacaaacaaacaaaugccuugugcugaaggcugaacaacagagcaaucaggauucaagcuccuggcuggcuagaaggauaacaaagagcaguuuuaucuccuccccucacagagccaaaaaugaggagaaagugagcugucugccacgucucagccagggugacugacuggcacaucugaggcugcugaggucacaggcaaggacagcgaggcuggauuagacgccuuugcuuguacaacaucacuguuagaaccaaccuuguuuaaggcagacagcaggacaaggagccagcaagacacagaggcccugcugugaggcugacauucucuuguggagaauuacccagggaguuucaaggaaugcacaacagcacaaagggcagggccaaagucaaugcuuaggaagagucaccucagcuacccugcacaagugacggaauggccaaguggggucacaggucaagcagaagcagacucgcuaugaaggccucugguguuuugugaggagcagaacagauaaagggccagagggaggggucaggcucagaaagaucccauggucucucagcagcagaucaucuagcuaugugacaaacaggugagggcugugacuccccccaggaagauagaugcuuaagaacuaggucauggggcuggagagauggcucagccgguaagggcacugacugcucuucugaagguccugaguucaaaucccagcaaccacaugguggcucacaaccacccauaaugagaccugacacccucuucugguguguuugaggacagcuacagugaacuuauguauaauauuccaggaauugugggcaaaacucuuguuccagaaacaaggaggcagagacaagaggaccaaaaauucagagugggcuccaggauagucugagccacaucagacuuugucuaaaagcaaaacaaaaauuagacugaugucauuuuaaaauaguaagagggcaugaggagugaagugggcuagagagaugacuuagcaguuaaaaaaaugcauacugggcuggugagauggcucaguggguaagagcacccgacugcucuuccaaaggucuggaguucaaaucccagcaaccacaugguggcucacaaccaucuguaacaagaucugacgcccucuucuggggugucugaagacagcuacaguauacuuacauauaauaaauaaauaaaucuuuaaaaaaaaaaugcauacugcucuggaagacacucugaguucaauucccaguacccaugucaugucagcccgguggagagaagccuuggagucagcggcugagaaacgugagcugcugucuguauucugaaggaagacuggucccuucuaacaaacaaaucaccuaugaaguauuggcugaggcgcauucagggcugcaauuccauuggguguaugcuggggaaaucuggaggacacaagccaugacaacuaggcaccccuaaugaugccccauaccaugccuccucaaugaagccaaugacaaacuugcgcacuucaauggauuugucugcuuggaaagcgaugaucuccuguaaugucagaggaagaugggucagggcacacgggagaguaccaccuucccuucaccuuauccccaggcuggucacucacauccaggaaguugucaagcagggugggguccuuguugaugaucagcucuuggaccugaguugaagaaaggaggagcagacauaaacccaggccccaaaggcaggcguggugguucucauaauuccaguacaaggcaggcugaggcaggacugucauguucucaaggccgucuagacuauggacuuuaucuaaaacacuaaaaauaagggcuagcaagauggcucagaggguaaaagacacuugccacucccacuugaagaacugaauagcaucucugggagccacuugguguaaaguuguccucugagcucaaugugccuguccagauauacaggaaauagugaaaacaagaauaaggcccacagcuggcucgggguaaaacacuaccuccacaugcaugaggacagagcucagcucucagagcacuaccgcagccgcagcucuuuggaggcaaagacagacucccaggaacccggcuagcuagacuaauggaucagcaagcgcuggauucuacugagagaccagagagugacggaaaaacacaucagcuuugggccucuacaagacugcauaaacaucucauaccaagcaaccaagcaccuauaccaugugaacaagaauacacaccagacagcgaaaauaauugguuaauuuaaaugcaggaguggggagacagcucaacaguuaagagacuggaugcucuuccagaggaguagauuugguucccagcacccagcuacaaccaucuauaacuccaguuccaggggaauccaaugcccuugucuggccuuugucaggguuguaugcacauggugcacuuacacacauguaggcaaaacauaaaaaagagagaauaaacaacaaaccucaaauagaaauaaauccagauguagucuaugcaggcaggaauggggagcagucagcacuggcggcucugacccuccugacccugaaucucaaagcuacacuguugagacccucacagaugaaggcucucacaagccacggggaggcacacugugcucauugcaaagaggaaaggaaacaaugacaggcacaggucugccagaggucagaguggucuacaggucugaggucugcugugccaugcagaaacuccagguggcgccuucgcgcucuacccaguccuggaucuugagaaacacugaaggagcaggcugcacagcacugcacugcacugcacucuggggcacagguuguguacaggugugcaugugcaaggcaugauguauggcacagguguaugugagcacaggcauguaugaaugcagcacaggugugcaaguguauguguacaggcauguaugagucacacgugcagggacuaacgguccucccucaguggcucugcccuggcuuuuguccugcccucccugucccuuacccccaccucaccuguuugagcacugugaucuuggagucauuggugaucaaugcagccugguucagaagaucuaccaccuggaaggacagaagaaccaggugucauggcuggucuugcuggccaggucaaucccugcaguccuccugugcucugcugucuggcaggagucacacuuccccacucccagcccugugcuacacucacccucucagaaguggucaugccaucgaugcuuggcccuucuucuugugugaaaaacugugaugccacacuccggcgggugacacuguccccgcugcugcuugccaugacugcugucagguucucccuggaaaagaagcuagugaguuucccugcaaagcccucgucccuccucuaggguggguaugggguuuauguccauguacaggagauacagugcuucaugucuacuaugggguuuuuuccuuuaauucaggguuggguuggucucugacuagguagccaaagguggccauuaacuccuaguccuucugugccuuccaagagcuggaaugaaaggugugcacagccacacaugguugcaggccagcuagggcugcauagucaagacuccccccuccccccccaucucaaaaaaaaaggccaccucuauaaccagguguggugcuacaugucuuucaucucaacauuuucaagaugcagguagguagaaacaucaggaguucaaggccagccucaguuauacagugaguucaaaacuagacagugcuacauaauacugucucaaaaaggaaggaaggaaggaaggaaggaaggaaggaaggaaggaaggaaggagagacucauuacaauacagcauccuuaagcuauuccuucugugaaaagggagaaagaggaacuacacaauuaucacaaaaucauucugacaaaaucaugaaaugacucauagacaaggcaccacaucuggcauuacuuuuaccagcaagcagcauaauccaacuaaguguucuuaaauagggagacaggcuacaaagacucucacaugcuacaugcuaaaggacucuuugugagcuuuguacagcaugugcaaggcccugaggggcccaggccugacacugggauaaacaaacaagccuacagauggcacagcuguaagacggaauugagacccagacaggugcacauaccuguagucuuaacauacuugggaggcaggagauugugaggucuaagccagcugggcagcuaagacccuguuuccagagaggagagaaaggaacauggaaaacgucuauagugacaaugcagggguucugcgaggagcaugagagagagagagagagagagagagagagagagagagagagagagagagaguuagagagagaaaaugaaugaaucuauuauaugaagaaaggcugaggcaggaggauuacacugagcuggauacagugugaagaagagaaaaaggcuaaacuagguguuuuaaaagauagaacugaggcuggagagucagcucagcuggugaaagccacuggcugcuccuccagagaaccugaguuuguugauccccagcacccacaggacagcucaaaacucuaacucuaguccuaggggaugugagacccuggccuccacauacacuuggugcagagacauaaauagaagcaauaguccauauaugcaaaauaaacauaaaacuuaaauuuaaaaagccagcuuagauuacuccuaaauauaaauggggcaacugaaaaucuagaagacaauauugcugguaacuaagguuuuguuaucuuuuuuguuuuguuuuugcucuuuuguuuuuucgagacaaggcuucuuuguguaacccuguucuagaauuuguucuguagacaaggcuagccuugaacagagauucaucugccgagugcuuggaauaaaggcaugugcugccaccucugguggagguaacucauuuuaaaugggauuaaccuauaaacuaaauagcaacaccccugcuagacaucacaugcaaauaaauaaguuuauugccaggaucuuuuucuuuaaagcuauggaguggaaguaauuugguaggucuaaguggauuauaaacccuauguagaccaggcuggcgucaaacucagagaucugccuaccucugccucccagugcugacuaaaggcaugagccacuagccuggcuaaguuuuaucuuuuuaaagaugugauggcuagccgggcgugguggcgcacgccuuuagucccagcacuugggaggcagaggcaggcggauuucugaguucgaggccagccuggucuacagagugaguuccaggacagccagggcuauacagagaaacccugucucgaaaaacuaagaaaaaaaaaaaaaaaaaaaaaaaaaagaugugaaggcugccggucaguuccacauauugcuuagagucagggccauagccacagcccuguccucaaggccuccaccucccucuggccacccugcugucagcuggccucuucugcccccagaagagggccuccuuagugaggccuucccuacuccaaauguacacacacacacacacacacacacaccccacauccaaugcauuccuuuuguuccaugcuucugaccauugccaugccacaugucuguucauuaagccaaggggcauggccacaugacauaccacacugcuccuggaaccagaacauaaggaacuccacccuccuucuggaugauacaccaagaaccagcaaaacuccccuuccucuuuaaucuucugggcuuuguuuugucuugaguauauauuccuauuucucuuuuuuguuuuucuuuuuuucuuuuuuuaauuaguaaaauggauguucagcugccuaucgguaucagaaauugacccccaggacucccuucauaucaaaaaucaggccguaaauuaaaacagcacuguuuggccagauagggugacauaccccuuuaaucccagcacucugggcagagguaagacgcucucaguuugaaacccaucuggagucgcuggaagaaagaaagaaagaaagagagagagagagagagagagagagagagagaaagagaaaaggggugggggagaaagaaagccaggugcugguacacaccuuuaauaccaguuacuugggaggcagaggcagacguagcucuacaaauucaagaccagcuuggucugccaagugaguuccaggacaaccaaggcuacaaagagaaaccuggagguaguggcgguggaggaggaggaggugauggaugaggcacuguugggcugggcacauagcucacuugguauucagguuuuuacuaugcacaaagccccaugcuccauucccaguguguucaagugcuacacagaccuucuagcauacuguuaucaucucuuaggcugugcuagcuggggaacucagggcuuguauaguaagagcacuugugugccaaguaacuuuguaaucccccugccccagucucuuaacuaggucugugucaucaagucuggcuuaaaucaccuccagaugaccuaauucaacauacaauguaaacaacguuguuacauuguauuguugagggaggauguaaaauuuuaaagucaguguaaaccauuuuccugacuauuucaaucuuaagauuggcugaauccacgcaugugaacuuccaagacaagcugauggucaacuuuauagaaacuauuuucuauuucacuuuuuuuucucuuaguaaauacugagcucagucuauuuuccaccuuccuuucuuuccacgguugcaaaucauuuuauuacguaaauauagugauuucugcuagacuucccacugaaggacagccgggauguuugcagucuggcuaucagaaacauuaacacuguuuuccccucucugguugugugcucagcauugaaccgccccucccaccaggaaguacgaugacuuucccguuauccuaaagaguggaucuccaaguguuuuuguuuguuuguuuguuuguuuguuuuuuguauuuucuguauucauucaacgagcaucgccuaagcaacaccaguguauguugggcgcgagcugugcugggaggcaggcaccaggacacacucuguccucucuuacacagagcccagggucagggaccuccucacgcagcacacaaauaaaauccuaauaacaaguucgaccacacgugacgagaaggcaaggcaaggggaccuaggagagccuucagcaggcggauuugaggaaggagggaggcaaacggagguuuugcaggggcagugacguggggugccgagccccccaaccccgaagaugaaagggaguuaggccgaaggauaacagcacguuuccagggcgggggacacuggggaggaacagccugugcaaaggcccggaggugggaagcuucgcacacggccagucuggggaagugaagggcccggugcagcagugugcggagcgggggacgagccagggccaggcugguggcccaggaggucugcgcggccacgguggaacuuuggccccgggggaccgggaagccaaagaaggcaaggaugggucccgagcagugugggaagaagcgggggcccgcgaccccgcugcucccggcccucgccgaggcccuccccaucgcucgcgccccggccuugucagcgcccccccuccccccaccccaggaccucacgccgccacccgcucaccgcgacuccggccucugucccccucgcgcccccucagcagcgccucuccgcagacgcugccgccgccgccaucuuccgcccgccgccgugacacggcgcaggcgcugcacuaguagggccgccgggaaauggaguccggcaccgcggccgguccccgccccua

SEQ ID NO: 3592 - RNA, 6584 nt, Mus musculus
acacugugcaaacaaggacuuuaguauaaauaagagguccaggggaacaaggagggcccucagggcuuccauaauuuaacacuuucaaaaucacagaccauagcaagggguggaguuugggcaggaguggggauggccccugcccugcccucucacccagggguacugugggcuaagucucucccaggagugaacagucacaugcugggacagggauaugguuaacacugauguuucagagaacaggucauuguacuuggcaguggguggaggacagggccaaggccacacaggacacuacauccccauggcugggccaaccuaggggacccccaguaugugugcagcguggggcuuggagcaguccuuccaucaugauuagucuuguuaauacagugauucuugaggucagcggggaggguuauggcuaggaggccgggaacaugggacauccacauuucacaccacagugccacugggggagcugccugguugggaggagaugcccuggggagaacaagaggagaaagguggauuagacagcaccugggcuucugccagaacccggagaaggagccacccaaaggccuuggagcugcugccccagcugggaucugccccccaggccuaaagcugcuguccuagcuaggaacaaacagcucggccgucuccacugacccagaguagcacuuccacaguaauguggccccagguguccugggcauacaggggacgacaguggagagaaaagaaacugggguccacuugcagcuucagggguuguccuaccucuacaacugacuugcugggugaccugggccaacuugcuugcccugccugggccucggucuccucgucugugaacuagggagacagaggggugucugugagaacucagucaacucccgcagcccuacuagccuggcaguggcucugcaacugccugacguucuaaggcuucuggacucuagccuuccaaagcaagggacugaaggacugagggcagaguaggguccuagacacugagaccacaugcucaagccugaccaggugacaggccugcaccucaccaacuaagagcacagccacugcacagcccaucugugagacccaaugaccaggaccacacagcagcaagaggaagugcaggccuggacccuggcuaauucccauccaggccuucagcagcuggcucagaaacagugucuaagaggcaggccagaagugggcccccagcucaaucacaucccuagaccugaauaaaguuucaccaucuacacuucagauuuccuauaaacacagguucugccuugagugugaaguacuaaggaugagccauaugggccagcagaggcucuaaagacguuagcugugguuccccccauucugucuccuauaccugaccuuucugcugacggauaacuggcauccgguagggacagaacuggugccccucagcgcuugggcaggugcggacucaccgccuugccuggccgggcccaggugcagaugaggcccucuuggcaggcagugaugauacaauccuccaggaacaguagcacggucaggcguuccugagcaaucuucuugcacacgagaggcuccagcaguggcaccucauggauccgagggcacagugccgugcccagcaccuuagcuggguccaaucggcuucggggggcaggaccacugagcuugucauugcugcuauugcccccacugccaccgcggcugauguuucccaggcuaugguagcguuuguguuccuucucagcuccccggucccgccgcuccugcagggucaguguggcaaagcggccaaugcugaaugguaugccaggcuccaucgaugcacuaggcccaccagccuugccaccaccagcugggugugggagacuguuggaacgagacagggagcggggcagggggccugcaccugucucuccggcccgagaacuaccagaagcuggugggguggcaccaggugugcccggaagggugcggguacgggccagagacggaugaggggagagcacaucuucugugaggucccacaggcagaacuguguguccuggccagcugagccaaagcgguacgugauggagccagccuugggcaguggggacacuggggcuccugugucugagcuggugacuucaggcuccuccucuucaccacugggaucuccaucagcacuggcugacgccgccuccucugcgcgagugguguagggaucaaaggcuacagcguugacccaggacuuguggccauggccucgagccaccacacgacccuccgugaaggaccacacagugacuaagucaucuuccccuccugucaccacguagcggccaucagggcuccagcacacacacagcagacccccaaaguagcucuucaugagcccacgcagaagcaugcugucaaaguggaagacacgcaggcagccauccuggcugacacaggcuaagugucggccaucaggugagaaugcaaacucauugaggggccccucacccacugcccacuuggcuaguggauugcggggugccuugcuuuuggcugcauagacagcaaagcccucacccuguuucagcagacuauacuggggugggguggaggugcaggggugacugacguuguagagguacagguggccacuggcgugagaagcaaggaacagacucucugacucaggcagccacuucaaauaugucaccuuggucuugucaaucagccgcugcaaagggaacaccagggugggguugggaaguggugaguacuccugacaggccacaucuuauccuggaccccagcucucccacugacugagacagaaggcagguggcacagggauacugggaagggcugccagugaagagcuccauggagccuccauuauccuccacccacuuaacuguggcucugucuucacugccagcugaaagacaagaacuucaacuccagaacaccaggguccccugaggaaggauccucaucacuagucuggcccccagcagcugaaacaacacucagaggacaugcccaagcaaugucccugcacaaacugauggcaaccucacccuaucagccacgucaaaacccuccaagccucucuccucugcccacaaugaagucaaagcuuucaacaaaagccaugggcuuccagagccaagugcucacagcccaggccacucucaccacccacaaugccucacugcuggccccagacacauacagcugccucucaccccccacccccaccccacccccccguccgcggccugagagucggcuugaggcagccacugugaugacccaacuucucugggaccaagaagugggaccaagcugcuuacuugcucaaagcugauaaaaccaccaggccugcaauugucucuacccuacggcucaggcacagccgcagcugggugugcaaggcuacuccucagacugcuacugaagaggagggcaccguccuuccuacagcuuuccaggacaaucagagccagcaccuccugcucuuucucagaauacaucuucugucuucucucccucaacugcuacccuggcaacauggcccaacggcuguccuguuucguggaauuuaucuaagauguuccuucuauucuguagcccaggcagaccuugaacuuuuggucuuccugccucagccucccaaauaguugugauaacagaccagugaucugaggcccaguccuuucuccccuugaauguccuucccuggagguuucuuugccuccuuuuggcuucacuucaaacgccagccccuccauggcuggcaggccgcaagcaggacaccuggugaaucugugugacaugcugccugccucaagagaguggcaggggcaggccuucugccugcucacugagcuaucacuggucugcaaggaggguccacugcugugaacgggugccugaguuucuaauccacucacugcucugcuucuccacucccuucagccacuugcuuauuuugaaaacauuugugggucaccuccccuggaccagugacuguagacagagcacaaggcccucccugcugcuugcugagcuguccuggcuccuuugaagccaggcuagcaaauccuugugaaugagcuuaaagcccugugagaaggggacacaaguccuacuuugcagaagaaaacuaaggcucagugaacaaaucacuuucccaaaaccacauagugaguccaaagagcccagaauuugaagcuagcaagaauaucaaaaaucaucccaaguggcuaugagccucagucuucucaucugugagaugggcaccauacuuucuuauccaucaguggaugagaacccaaacaguaaagcauucuuccaacauagggcuggcacagcagaaaacugggaaauaguaagcacaauggcacaucaguagcugucugucacuuguccccucucccuccuccugccccuuucaagccuauucuguuuccaggcagcuuagugcaggcagggguggguagguaggugagaaggggagggcucgcgugcuuagucaccucuucauugaauagcuugcuggugucuuucuugaugagguccagauacugcaccuggccggcagagaagcccaccagcagggaaauggucucuguggcagcugugaacugguugaagucguggcaggugggcuggguccccuuguagauccgcuugucgaugggcuuguugagaucgauggacuugaaccgcgggaggagacgaguuaaccgguuagagcaggagaggaaggaagaggagcugaggucaggggaaaccgcuaagaggaagcaggguuaaccucaagggaaguggggagugggguggagaggagcaggcaaccacaggccgggagggaggggacucaaacccaggacggcacacacaagcucacaugcacacgaucacacagcgcccagugaagaccucagagccugucuuuccagcuguaauucggggacacuugcccacagcaucagggaucagaguccccugggccuggagcugacucucccccaguuuucccagccuccgucacaguagcaacuccaguaggacaauagucuaagaccucccagacccaaggaugcaaaaauccccaaauuuaggauuuccgucaucuuuucccuguauguacacauaguauacgccugcgugguuguuguguguuguguagagauguagaggucagaggucaacaucgggcaucucucucccuggcuuugcaucuuacauuugacacagggucucucagugaacccggagcucaccaguucaacuagacuggcugccaugaggccagaggauccuccuaccucggcagccuugacaugggauccugggauccaucgccaaagccucauuuccuucagccuggagccccuaaacuccaggacaucugcugugguucagccagccaucagucacuacagucccucauuaucaccacuggauucuccggauccccaucucucugucucccccacuuccucacgucaccccucuucuaggauugcuuuacagauaucugucacaccuggggauguccccugccaggaacccccaucaauucagagcucccaucauuuugccaaacccccuucauuucuuccaaagccauuagacaccauauucuuuaggagcuccuucaccuguugcuuugcucgucgaccccuaagccacaccucggcuccuuacaaaucccgucagcccuggguauggcaagucuuaagacucccuccaacaggcccagaaggcaggaugcauuucuccguucuccauccccugggccuguauccucuuaggauuccccaaagcccacagaauaucugucaccuccgugaccccccucccccauuuccucccagaagcgccaucacguccugaacacucaccaccggagagaaccuccccacgcaaagauuccccugcaaccucucaggacuccauuagcuccaggauccaggcuccccugggaugcccaaccucggggccuucugucacucugggaccccagcgcucucggcaccggaguccccagcaagcagagcacucacccgcuggcucccgcugcggcagcagccgggguagaaauaaagcucccggcccagguugaagcagacgcggucuccucccgcgcccaguccggagggcguggagggcggcuccccagcgccauccgggucgccuaggcgcaccaggcugaggcggacggcgggcagcgcgggcccgggcccggggccggcgggcggcggggacgacgcgggacccgcggcgccgggcccggaggcugcggcgggcccgggcgggggcugagugggcugaggcggcgccggggucugagcggaggucgggcccgaccugcgcgucgcgucgccggggagcagcuuguagaagcccucgcgggugcgaaacugcgacuugaucuccgcgcagucgcccauggcggcgcuggggcccgggccgcccuccgcgccgcccgccgccaucuuggccgccccccgggccgcaccgcagcccgaccgcccaccgccagaccccccagccggaaguugagggg

SEQ ID NO: 3593 - RNA, 9975 nt, Mus musculus
agaacuggccagagagacccaagggauagucagggacgggcagacaugcagcuaggguucuggggccuggacaggggcagccaggcccugugacgggaagaccccgagcuccggcccggggaggggccaugguguugccugcccaacaugucagccgaagugcggcugaggcagcuccagcagcuggugcuggacccaggcuuccugggacuggagccccugcucgaccuucuccugggcguccaccaggagcugggugccucucaccuagcccaggacaaguauguggccgacuucuugcaguggggugaguauggauaggaagccugggguugggugcaaggcagaggugggucuacagggcaagaaugggcuauggaggggcaggagggccuggaaagggcuuuuuguaagggagccaagcagagcucaugaccugaccccaagcuccccuggugaggcaccagggucagugaggccaccuaugacucagccagugcaggcuggggugggcauagccuccugcuaucucagcacccacacuaggaccuggcagcuuucucuuuuaggacccuuggcuccucaaacuggcuucauagcccuccccaguuucccagaguguggggagggacagcguggggcagcugccaggguguggcccauaggcagguguuuggcgucugccuccccagcugcccugacagguguccaggagcuaugagggcacugugacucacagaggcccugggggagaaccagcccggcagacaggcgccaccgagcacccuuucuguuccccaaauuaagaggaaggaacaacuucagcuucugagugugcccaucccuagcacucugaucccgcccagccuuugugggccagauuggucaucccuccuggcuucucaucugcuuuugugguucuagcucaagaccucuaauuccucugcugacuuaaaugcccuuccccagaggucuucucaggccuaguggacaagcuuggagccuuaucugcuccugcccaacauugagccaaagcuccagcuuaccccagcuuccuuacaaguaacgaccuguuuuguugcucugugccuauuauuaaggguccaggucuugauucuuggcugucugcccaugugugugacccuagugcauucuccccuccucccccguuucacagauggaaagguugaggccaucgguuagacugcuaagccugugaaagacuuuuucuccucuccagucuuuagugucucccucaaccuuucuuuugaaggaugggguuugggcuggcaggguaaacugagaacuggggugggggcagggggucugacccucugggaaggagcaguccuuuuguggccugagcagcauccugugggccccuccccugccaggccugggcgggggagggggccuggguucccgcugccuuaaaagggcucaacgccuuggcucucuccuccuccccaccccccagccuuggcccuagcuguaucuuccccggcugcccacuuucccaaaccccuuucuucucugugaccccaucuccccgcuuccccacacgucccuccuccauccuuacuccccggccuuagaacuucccuaagggagaucugaccucccucugcccaccccgcacccccagucgccagccucagaccuagcugcucuccccucuggcugaaccacccuagcacaggaccuuauacccuggagcuuugguuauaagaagacucuccuucacccuuuggaaaccaagaaagcccuuccaacaguguccaggaugcuggagggcagugacccucccccacuucuucuucgugcuggcugugcugacacagcuccaguucgagguuguggcccgagacauuaagugagagccccgggugaccugacuuagcacccugaucaucacaugggagugaaaggccugaugcgccagcuucucccacugccucccuuucugcccugcaacccuguggaaacaggcaguucugggucccacaaacaucacagagguuuugaaagcagaauccuaaagccgauuuaaggggcagaaggaaggaggcuauaaagucacuacccuuaccgcuaguguucugaugacccuugguucuucuucccccacccccgcccaguggagcccauugcagcaaggcuuaaggagguccgacugcagagggaugauuuugagauuuugaaggugaucgggcguggggcguucagcgaggugagucuucaguggccugggaauggaacuuuacuugauguggguggggcauaacagcuggggcagagccuuaaaaauugaugaaugagcuugaauuuaaggcuggaggggugggggcggagcuuguggucagugggcggugugcacgugagggcggggcuaagguuggguggagauaaggguggaguccugucugggugagccuugcugguuuucccugccaccucuugcugucaucucgguuccguauuuagguagcgguggugaagaugaaacagacgggccaaguguaugccaugaagauuaugaauaagugggacaugcugaagagaggcgaggugagggccagggauuagggcagcgcccucaucucuccaacucaccuccuguagcuucucuccuaccucacaggugucgugcuuccgggaagaaagggauguauuagugaaaggggaccggcgcuggaucacacagcugcacuuugccuuccaggaugagaacuaccugguaagcuccggguucaggugacuaggaaagagugacaguuacaucgccccaagucaagaaggcuggagaagggagaagcugcuguagaucgggggggugggggugggggggacacacacaggggaugggggacggggguaggauugugucucaaguauaggagagaccuuccuugagacaggagugauaucugguuuggccuuuggauggggcgcucucucacugugcggggguccucugugcuugggaacggggugucuuugggagucuugggggcuaccaaaccccugugacacacccgcucccaguaccuggucauggaauacuacgugggcggggaccugcuaacgcugcugagcaaguuuggggagcggauccccgccgagauggcucgcuucuaccuggccgagauugucauggccauagacuccgugcaccggcugggcuacgugcacaggugggcguggcggggcccuuggaggguuagcagaauuugugugggaaggaaggguaccugaaggucagaucccauuggggacagaaucggggucuagaauuguagaauccugggugggguggaaguggaucgagcugacgggcccuaagagggaagguuuucaagaaagcacacuuucccucuucucucuaugcacagggacaucaaaccagauaacauucugcuggaccgaugugggcacauucgccuggcagacuucggcuccugccucaaacugcagccugauggaaugguaagaagagccuggcgaaacucuccucauuggugaaggaccggauuagggggcggggcuggguugaggagcaggaggggagcuuggucugggauguccugcgcaccauauuuggacagucaagggaaagguuuuaagcauucaggucugauuggcacaggugaggucgcugguggcugugggcaccccggacuaccugucuccugagauucugcaggccguugguggagggccuggggcaggcagcuacgggccagagugugacuggugggcacugggcguguucgccuaugagauguucuaugggcagacccccuucuacgcggacuccacagccgagacauaugccaagauugugcacuacagggugagcacaagcaccaugcaggggggcugacuuaguggcuugugcucccagacugucuuuuuuaaaagauauuuauuuauauguguguguuuucuguguauguauaucugugcacugaguaggugugcgaaggucagagggcaugggauccccuggaacuggagucacagacuauugugugcugccaugcugagugcugggaaacagaaccuugaucacucugcaagagcagccagugcacugaaacgacagagccagcucugcagcccagggcuaacuguugcuuuucuuucuaaauaggaacacuugucgcugccgcuggcagacacaguuguccccgaggaagcucaggaccucauucgugggcugcuguguccugcugagauaaggcuaggucgagguggggcaggugauuuccagaaacauccuuucuucuuuggccuugauugggagggucuccgagacaguguaccccccuuuacaccagacuucgagggugccacggacacaugcaauuucgaugugguggaggaccggcucacugccauggugagcgggggcgggguacguaccugcaguuccugauccguugaggggacuucccuagccucuuccauaaaauuggggugauuggccaggugugguggugcauaccuuuaaucguagaacuucauaggcagaggcagguggcucucugguaaaucaaggccaucuuggucuacauagugacuucuaggccagucaggagugagauccucccuugaaaaauaaaaaaggggguguugaccuuccugggucccaaauuauuauccuagagcacugcuauguauccacucagguaugaggacacacaggugaccagucccaaagacagugagugaggccucacucuuggcaguacuaaaauugauuguagggggcugggcucuugacccagccuggaaagugcuggagggcuuccuggaggaggagacuagcugagcccagaaggaugcaggagauccuuucucgggugagugcucucagcauuuuaacaagcucuaggcccugcagagagaagucuggugugggcagagccccaauagaaagcaacaagauagaagagaaaaugguggaguuuguuagugggggcaguuaugccgugaacauagaggggcgaagggccaucucggauaacugcuagccacaagagcccugucugucuuccuaggagacgcugucagacaugcaggaagacaugccccuuggggugcgccugcccuucgugggcuacuccuacugcugcauggccuucaggugagcacgacugcccccugcuggggccugugugcaggcccaccacagccacucaauugaaggcucagucuucaaaccaaguauuccuaggagcugucuaaguuaggcuuucugcugcugcgaugaacccugacuaaaagcaagcuggggaggaaaaggcuuaucgggcuuacguuuccacaugggagcccaucacugaaggaagccaggacaggaacucacagcggggcaggaacguggagcugaugcagaggcaauggaggggagcugcuuacugacuugauccuuaugucuuccucagccuguuuccuuguagagcccaggaccaccaggccagugagggcuccacucacaaugggcugagcucucaucuaugaucacuaguuaugaaaaugcccgauaggcuugccugcagcuucaguuuuugaggcacuuuccuuccuuccuuccuuccuuccuuccuuccuuccuuccuuucuuucuuucuuucuuucuuucuuucuuucuuucuuucuuucuuucuuucuuucuuucuuagucuuuuagagacagggucuuucuauguagcucuggcugucuuggaauucauucuguagaccaggcuggucuuauuuauuuauuuuauguaugugaguccacuaucacuguccucagacacaccagaagagggcaucagaucccauuacagauggcugugagccaccaugugguugcugggaauugaacucaggaccucuggaagagcagccagugcuccugcccuguagaggcauuuucuucaugaaggcugucuccucucugaugacuugaugacucuagcuuguugugucaaguggacauaagacuaggaaagcagcuacacaugcacuuuguuuauuuuuguuuugcuuuuugagacugggucucuccaucucauagcucuggccauccugccuggugacauuccaguccaguuguauaaccuaagaaucugagacucagccuugcagaauccugcuauuaacgggucuaggacacuccauagaauccaggaucuuagaaaaacaaaccugaagugugacaguuuauuuuaagaacacaauuggagcacauaacaauaauacaacuuuucaguuuuaaaaaguuuucugucuuguuuuuugaggcaggagcuccuuaauauagucuaagccgcccugcgagugcugugauugaugggcauguaccaccaugccuagucaauaaagccuuuaaaaagcauccguuaugcuggcuguggugccacaaaccuguaaucccagcacuuagaagguagaggcaagauuaucagaaauucaaggccauccugggcuauacaguaaucuaaggcuagccuggucuacaagagacucugucuaaagaaacaaaagauaaauagcacccacuauugcuaggcaauauaacccuauaaccccaccauugaggaggcugaggcuggagcaucacugcaaauuugaggccaggauggucaacaaauaagucccagagcuggcauagaggaacucugucucaacaauaaagagaacuuaucuagcauuuaugaggguaaauaaaaauuuaccauugccacaaaaaauguaaaugaagagacugcuuuuaggagugaacugggaagcagggaacacuuagaggaugcucacucacacagguauccaccaucaggcaugccucaggccugcacagggaaggacaacuuguuucaugauuugcaagcagcaucccaugcuccuuagagcggguugggcccagcccacccucuguggaguuaucgcucagccaggcagcaaggcagccaaggugcugaggcccuggcagucugcucucuucucugcucugaaccuccuuuagcuuuagccuaggagccuggccuggugcccacaggcuagggagucccuagccucuuccucuucucagagacaaucaggucccggaccccaccccuauggaacuagaggcccugcaguugccugugucagacuugcaagggcuugacuugcagcccccaguguccccaccggaucaaguggugaguagacugagaggugggcaaagcuuccuggguggguguaccugcagugccaacugccaggcuguuaauucaguaggacacuguccccaacuggcccaacugcacauccuguagucaggaggcacaggcagaaaaaucccaaauucaaggcuugcucccguuauguaaugagauccugucuuggaguaaaaaacaaagaagagaacuagggauagcucagagguagaugcucuccuggcauggggguggggucagaaagcaacaccaaccggggccugggagggagggacugccaaccaccuggaggagucugggguagacuuggugaacaaaguucagaggccaucaggugggaugcugguuucuuaaaagccacagauagguggguagcauuggaaagaggagugggggguugcagaaagugacaagacacaaacuggggaggccuaaggguaaagccaggguugucugaagcacuguggagcugggaggaacacgcuaaacuucugacuucagcccuucaguuccccuguugacuacacuguccccagggacccagggauggggagagguggacgggggagggaaguacgggacugauccagcuccaggucccaacucugauccccaccgacaggcugaagaggcugaccuaguggcugucccugccccuguggcugaggcagagaccacgguaacgcugcagcagcuccaggaagcccuggaagaagagguucucacccggcagagccugagccgcgagcuggaggccauccggaccgccaaccagaacuucuccaggucagggucacagugcuggggugaggggagaggagagcagcaacccucgcagucuccucaccgauaggucggcucacuccccuaucuuucccagccaacuacaggaggccgagguccgaaaccgagaccuggaggcgcauguucggcagcuacaggaacggauggagaugcugcaggccccaggagccgcaggcgagucccucaccugcuuccagccaagggggcacuggguggagauggggggcauguugggugugugaacccucggggcaggggaggaguccaggcuggggcaccgcagccgcgccacugccuuucuccuccauccuccacacuccauacaccucucucuucuccuuccagccaucacggggguccccaguccccgggccacggauccaccuucccauguaagaccccucucuccccuccccgauccccaucuuagauaugcuacccacagcccuucucccguccacguuuaggguccauucuccuuggggguuccagaagaaagcugcccuucacucauccauucagcaugcacuaucuaccagcucucccucguuucaggcuucucgccaaauccuccccaagggaacucccuauacucccguucuggccucgacuagauucccgcacugccucucgcccugcugcugggcuccgaucgggucaccugucccuucucucuccagcuagauggccccccggccguggcugugggccagugcccgcugguggggccaggccccaugcaccgccgucaccugcugcucccugccaggguaugucccacguccgcccaccacgggccucugccuagcucugcccacugagugucaccacugcuugcugugccucuguggagcucggcccaccgcagggaggggggguauucgggcggccaaucaacacaggcugcugcuaaguagccaaugacgaguuccaacaggagcucuuucuugcgagcagaccaacuuuagcugcgggcuguggggaccagagaugcgcucagaggcccaucuauggguauaggcugggcggcucccaggagccagugggccccuguagccuagugcuaauccaaccuucucuccugcagaucccuaggccuggccuauccgaggcgcguugccugcuccuguucgccgcugcucuggcugcugccgccacacugggcugcacuggguugguggccuauaccggcggucucaccccagucugguguuucccgggagccaccuucgcccccugaacccuaagacuccaagccaucuuucauuuaggccuccuaggaaggucgagcgaccagggagcgacccaaagcgucucugugcccaucgcgccccccccccccccccaccgcuccgcuccacacuucugugagccuggguccccacccagcuccgcuccugugauccaggccugccaccuggcggccggggagggaggaacagggcucgugcccagcaccccugguuccugcagagcugguagccaccgcugcugcagcagcugggcauucgccgaccuugcuuuacucagccccgacguggaugggcaaacugcucagcucauccgauuucacuuuuucacucucccagccaucaguuacaagccauaagcaugagcccccuauuuccagggacaucccauucccauagugauggaucagcaagaccucugccagcacacacggagucuuuggcuucggacagccucacuccuggggguugcugcaacuccuuccccguguacacgucugcacucuaacaacggagccacagcugcacuccccccucccccaaagcaguguggguauuuauugaucuuguuaucugacucacugacagacuccgggacccacguuuuagaugcauugagacucgacauuccucgguauuuauugucuguccccaccuacgaccuccacucccgacccuugcgaauaaaauacuucuggucugcccuaaau

SEQ ID NO: 3594 - RNA, 9975 nt, Mus musculus
auuuagggcagaccagaaguauuuuauucgcaagggucgggaguggaggucguagguggggacagacaauaaauaccgaggaaugucgagucucaaugcaucuaaaacgugggucccggagucugucagugagucagauaacaagaucaauaaauacccacacugcuuugggggaggggggagugcagcuguggcuccguuguuagagugcagacguguacacggggaaggaguugcagcaacccccaggagugaggcuguccgaagccaaagacuccgugugugcuggcagaggucuugcugauccaucacuaugggaaugggaugucccuggaaauagggggcucaugcuuauggcuuguaacugauggcugggagagugaaaaagugaaaucggaugagcugagcaguuugcccauccacgucggggcugaguaaagcaaggucggcgaaugcccagcugcugcagcagcgguggcuaccagcucugcaggaaccaggggugcugggcacgagcccuguuccucccuccccggccgccagguggcaggccuggaucacaggagcggagcuggguggggacccaggcucacagaaguguggagcggagcgguggggggggggggggggcgcgaugggcacagagacgcuuugggucgcucccuggucgcucgaccuuccuaggaggccuaaaugaaagauggcuuggagucuuaggguucagggggcgaagguggcucccgggaaacaccagacuggggugagaccgccgguauaggccaccaacccagugcagcccaguguggcggcagcagccagagcagcggcgaacaggagcaggcaacgcgccucggauaggccaggccuagggaucugcaggagagaagguuggauuagcacuaggcuacaggggcccacuggcuccugggagccgcccagccuauacccauagaugggccucugagcgcaucucugguccccacagcccgcagcuaaaguuggucugcucgcaagaaagagcuccuguuggaacucgucauuggcuacuuagcagcagccuguguugauuggccgcccgaauacccccccucccugcggugggccgagcuccacagaggcacagcaagcaguggugacacucagugggcagagcuaggcagaggcccguggugggcggacgugggacauacccuggcagggagcagcaggugacggcggugcauggggccuggccccaccagcgggcacuggcccacagccacggccggggggccaucuagcuggagagagaagggacaggugacccgaucggagcccagcagcagggcgagaggcagugcgggaaucuagucgaggccagaacgggaguauagggaguucccuuggggaggauuuggcgagaagccugaaacgagggagagcugguagauagugcaugcugaauggaugagugaagggcagcuuucuucuggaacccccaaggagaauggacccuaaacguggacgggagaagggcuguggguagcauaucuaagauggggaucggggaggggagagaggggucuuacaugggaagguggauccguggcccggggacuggggacccccgugauggcuggaaggagaagagagagguguauggaguguggaggauggaggagaaaggcaguggcgcggcugcggugccccagccuggacuccuccccugccccgaggguucacacacccaacaugccccccaucuccacccagugcccccuuggcuggaagcaggugagggacucgccugcggcuccuggggccugcagcaucuccauccguuccuguagcugccgaacaugcgccuccaggucucgguuucggaccucggccuccuguaguuggcugggaaagauaggggagugagccgaccuaucggugaggagacugcgaggguugcugcucuccucuccccucaccccagcacugugacccugaccuggagaaguucugguuggcgguccggauggccuccagcucgcggcucaggcucugccgggugagaaccucuucuuccagggcuuccuggagcugcugcagcguuaccguggucucugccucagccacaggggcagggacagccacuaggucagccucuucagccugucgguggggaucagaguugggaccuggagcuggaucagucccguacuucccucccccguccaccucuccccaucccugggucccuggggacaguguagucaacaggggaacugaagggcugaagucagaaguuuagcguguuccucccagcuccacagugcuucagacaacccuggcuuuacccuuaggccuccccaguuugugucuugucacuuucugcaaccccccacuccucuuuccaaugcuacccaccuaucuguggcuuuuaagaaaccagcaucccaccugauggccucugaacuuuguucaccaagucuaccccagacuccuccaggugguuggcagucccucccucccaggccccgguugguguugcuuucugaccccacccccaugccaggagagcaucuaccucugagcuaucccuaguucucuucuuuguuuuuuacuccaagacaggaucucauuacauaacgggagcaagccuugaauuugggauuuuucugccugugccuccugacuacaggaugugcaguugggccaguuggggacaguguccuacugaauuaacagccuggcaguuggcacugcagguacacccacccaggaagcuuugcccaccucucagucuacucaccacuugauccgguggggacacugggggcugcaagucaagcccuugcaagucugacacaggcaacugcagggccucuaguuccauaggggugggguccgggaccugauugucucugagaagaggaagaggcuagggacucccuagccugugggcaccaggccaggcuccuaggcuaaagcuaaaggagguucagagcagagaagagagcagacugccagggccucagcaccuuggcugccuugcugccuggcugagcgauaacuccacagagggugggcugggcccaacccgcucuaaggagcaugggaugcugcuugcaaaucaugaaacaaguuguccuucccugugcaggccugaggcaugccugaugguggauaccugugugagugagcauccucuaaguguucccugcuucccaguucacuccuaaaagcagucucuucauuuacauuuuuuguggcaaugguaaauuuuuauuuacccucauaaaugcuagauaaguucucuuuauuguugagacagaguuccucuaugccagcucugggacuuauuuguugaccauccuggccucaaauuugcagugaugcuccagccucagccuccucaauggugggguuauaggguuauauugccuagcaauagugggugcuauuuaucuuuuguuucuuuagacagagucucuuguagaccaggcuagccuuagauuacuguauagcccaggauggccuugaauuucugauaaucuugccucuaccuucuaagugcugggauuacagguuuguggcaccacagccagcauaacggaugcuuuuuaaaggcuuuauugacuaggcauggugguacaugcccaucaaucacagcacucgcagggcggcuuagacuauauuaaggagcuccugccucaaaaaacaagacagaaaacuuuuuaaaacugaaaaguuguauuauuguuaugugcuccaauuguguucuuaaaauaaacugucacacuucagguuuguuuuucuaagauccuggauucuauggaguguccuagacccguuaauagcaggauucugcaaggcugagucucagauucuuagguuauacaacuggacuggaaugucaccaggcaggauggccagagcuaugagauggagagacccagucucaaaaagcaaaacaaaaauaaacaaagugcauguguagcugcuuuccuagucuuauguccacuugacacaacaagcuagagucaucaagucaucagagaggagacagccuucaugaagaaaaugccucuacagggcaggagcacuggcugcucuuccagagguccugaguucaauucccagcaaccacaugguggcucacagccaucuguaaugggaucugaugcccucuucuggugugucugaggacagugauaguggacucacauacauaaaauaaauaaauaagaccagccuggucuacagaaugaauuccaagacagccagagcuacauagaaagacccugucucuaaaagacuaagaaagaaagaaagaaagaaagaaagaaagaaagaaagaaagaaagaaagaaagaaagaaaggaaggaaggaaggaaggaaggaaggaaggaaggaaggaaagugccucaaaaacugaagcugcaggcaagccuaucgggcauuuucauaacuagugaucauagaugagagcucagcccauugugaguggagcccucacuggccuggugguccugggcucuacaaggaaacaggcugaggaagacauaaggaucaagucaguaagcagcuccccuccauugccucugcaucagcuccacguuccugccccgcugugaguuccuguccuggcuuccuucagugaugggcucccauguggaaacguaagcccgauaagccuuuuccuccccagcuugcuuuuagucaggguucaucgcagcagcagaaagccuaacuuagacagcuccuaggaauacuugguuugaagacugagccuucaauugaguggcuguggugggccugcacacaggccccagcagggggcagucgugcucaccugaaggccaugcagcaguaggaguagcccacgaagggcaggcgcaccccaaggggcaugucuuccugcaugucugacagcgucuccuaggaagacagacagggcucuuguggcuagcaguuauccgagauggcccuucgccccucuauguucacggcauaacugcccccacuaacaaacuccaccauuuucucuucuaucuuguugcuuucuauuggggcucugcccacaccagacuucucucugcagggccuagagcuuguuaaaaugcugagagcacucacccgagaaaggaucuccugcauccuucugggcucagcuagucuccuccuccaggaagcccuccagcacuuuccaggcugggucaagagcccagcccccuacaaucaauuuuaguacugccaagagugaggccucacucacugucuuugggacuggucaccuguguguccucauaccugaguggauacauagcagugcucuaggauaauaauuugggacccaggaaggucaacacccccuuuuuuauuuuucaagggaggaucucacuccugacuggccuagaagucacuauguagaccaagauggccuugauuuaccagagagccaccugccucugccuaugaaguucuacgauuaaagguaugcaccaccacaccuggccaaucaccccaauuuuauggaagaggcuagggaaguccccucaacggaucaggaacugcagguacguaccccgcccccgcucaccauggcagugagccgguccuccaccacaucgaaauugcauguguccguggcacccucgaagucugguguaaagggggguacacugucucggagacccucccaaucaaggccaaagaagaaaggauguuucuggaaaucaccugccccaccucgaccuagccuuaucucagcaggacacagcagcccacgaaugagguccugagcuuccucggggacaacugugucugccagcggcagcgacaaguguuccuauuuagaaagaaaagcaacaguuagcccugggcugcagagcuggcucugucguuucagugcacuggcugcucuugcagagugaucaagguucuguuucccagcacucagcauggcagcacacaauagucugugacuccaguuccaggggaucccaugcccucugaccuucgcacaccuacucagugcacagauauacauacacagaaaacacacacauauaaauaaauaucuuuuaaaaaagacagucugggagcacaagccacuaagucagccccccugcauggugcuugugcucacccuguagugcacaaucuuggcauaugucucggcuguggaguccgcguagaagggggucugcccauagaacaucucauaggcgaacacgcccagugcccaccagucacacucuggcccguagcugccugccccaggcccuccaccaacggccugcagaaucucaggagacagguaguccggggugcccacagccaccagcgaccucaccugugccaaucagaccugaaugcuuaaaaccuuucccuugacuguccaaauauggugcgcaggacaucccagaccaagcuccccuccugcuccucaacccagccccgcccccuaauccgguccuucaccaaugaggagaguuucgccaggcucuucuuaccauuccaucaggcugcaguuugaggcaggagccgaagucugccaggcgaaugugcccacaucgguccagcagaauguuaucugguuugaugucccugugcauagagagaagagggaaagugugcuuucuugaaaaccuucccucuuagggcccgucagcucgauccacuuccaccccacccaggauucuacaauucuagaccccgauucuguccccaaugggaucugaccuucagguacccuuccuucccacacaaauucugcuaacccuccaagggccccgccacgcccaccugugcacguagcccagccggugcacggagucuauggccaugacaaucucggccagguagaagcgagccaucucggcggggauccgcuccccaaacuugcucagcagcguuagcagguccccgcccacguaguauuccaugaccagguacugggagcgggugugucacagggguuugguagcccccaagacucccaaagacaccccguucccaagcacagaggacccccgcacagugagagagcgccccauccaaaggccaaaccagauaucacuccugucucaaggaaggucucuccuauacuugagacacaauccuacccccgucccccauccccugugugugucccccccacccccacccccccgaucuacagcagcuucucccuucuccagccuucuugacuuggggcgauguaacugucacucuuuccuagucaccugaacccggagcuuaccagguaguucucauccuggaaggcaaagugcagcugugugauccagcgccgguccccuuucacuaauacaucccuuucuucccggaagcacgacaccugugagguaggagagaagcuacaggaggugaguuggagagaugagggcgcugcccuaaucccuggcccucaccucgccucucuucagcaugucccacuuauucauaaucuucauggcauacacuuggcccgucuguuucaucuucaccaccgcuaccuaaauacggaaccgagaugacagcaagagguggcagggaaaaccagcaaggcucacccagacaggacuccacccuuaucuccacccaaccuuagccccgcccucacgugcacaccgcccacugaccacaagcuccgcccccaccccuccagccuuaaauucaagcucauucaucaauuuuuaaggcucugccccagcuguuaugccccacccacaucaaguaaaguuccauucccaggccacugaagacucaccucgcugaacgccccacgcccgaucaccuucaaaaucucaaaaucaucccucugcagucggaccuccuuaagccuugcugcaaugggcuccacugggcgggggugggggaagaagaaccaagggucaucagaacacuagcgguaaggguagugacuuuauagccuccuuccuucugccccuuaaaucggcuuuaggauucugcuuucaaaaccucugugauguuugugggacccagaacugccuguuuccacaggguugcagggcagaaagggaggcagugggagaagcuggcgcaucaggccuuucacucccaugugaugaucagggugcuaagucaggucacccggggcucucacuuaaugucucgggccacaaccucgaacuggagcugugucagcacagccagcacgaagaagaagugggggagggucacugcccuccagcauccuggacacuguuggaagggcuuucuugguuuccaaagggugaaggagagucuucuuauaaccaaagcuccaggguauaagguccugugcuagggugguucagccagaggggagagcagcuaggucugaggcuggcgacugggggugcggggugggcagagggaggucagaucucccuuagggaaguucuaaggccggggaguaaggauggaggagggacguguggggaagcggggagauggggucacagagaagaaagggguuugggaaagugggcagccggggaagauacagcuagggccaaggcugggggguggggaggaggagagagccaaggcguugagcccuuuuaaggcagcgggaacccaggcccccucccccgcccaggccuggcaggggaggggcccacaggaugcugcucaggccacaaaaggacugcuccuucccagagggucagacccccugcccccaccccaguucucaguuuacccugccagcccaaaccccauccuucaaaagaaagguugagggagacacuaaagacuggagaggagaaaaagucuuucacaggcuuagcagucuaaccgauggccucaaccuuuccaucugugaaacgggggaggaggggagaaugcacuagggucacacacaugggcagacagccaagaaucaagaccuggacccuuaauaauaggcacagagcaacaaaacaggucguuacuuguaaggaagcugggguaagcuggagcuuuggcucaauguugggcaggagcagauaaggcuccaagcuuguccacuaggccugagaagaccucuggggaagggcauuuaagucagcagaggaauuagaggucuugagcuagaaccacaaaagcagaugagaagccaggagggaugaccaaucuggcccacaaaggcugggcgggaucagagugcuagggaugggcacacucagaagcugaaguuguuccuuccucuuaauuuggggaacagaaagggugcucgguggcgccugucugccgggcugguucucccccagggccucugugagucacagugcccucauagcuccuggacaccugucagggcagcuggggaggcagacgccaaacaccugccuaugggccacacccuggcagcugccccacgcugucccuccccacacucugggaaacuggggagggcuaugaagccaguuugaggagccaaggguccuaaaagagaaagcugccagguccuagugugggugcugagauagcaggaggcuaugcccaccccagccugcacuggcugagucauagguggccucacugacccuggugccucaccaggggagcuuggggucaggucaugagcucugcuuggcucccuuacaaaaagcccuuuccaggcccuccugccccuccauagcccauucuugcccuguagacccaccucugccuugcacccaaccccaggcuuccuauccauacucaccccacugcaagaagucggccacauacuuguccugggcuaggugagaggcacccagcuccugguggacgcccaggagaaggucgagcaggggcuccagucccaggaagccuggguccagcaccagcugcuggagcugccucagccgcacuucggcugacauguugggcaggcaacaccauggccccuccccgggccggagcucggggucuucccgucacagggccuggcugccccuguccaggccccagaacccuagcugcaugucugcccgucccugacuaucccuugggucucucuggccaguucu

SEQ ID NO: 3595 - RNA, 8993 nt, Mus musculus
ggugucgugcuuccgggaagaaagggauguauuagugaaaggggaccggcgcuggaucacacagcugcacuuugccuuccaggaugagaacuaccugguaagcuccggguucaggugacuaggaaagagugacaguuacaucgccccaagucaagaaggcuggagaagggagaagcugcuguagaucgggggggugggggugggggggacacacacaggggaugggggacggggguaggauugugucucaaguauaggagagaccuuccuugagacaggagugauaucugguuuggccuuuggauggggcgcucucucacugugcggggguccucugugcuugggaacggggugucuuugggagucuugggggcuaccaaaccccugugacacacccgcucccaguaccuggucauggaauacuacgugggcggggaccugcuaacgcugcugagcaaguuuggggagcggauccccgccgagauggcucgcuucuaccuggccgagauugucauggccauagacuccgugcaccggcugggcuacgugcacaggugggcguggcggggcccuuggaggguuagcagaauuugugugggaaggaaggguaccugaaggucagaucccauuggggacagaaucggggucuagaauuguagaauccugggugggguggaaguggaucgagcugacgggcccuaagagggaagguuuucaagaaagcacacuuucccucuucucucuaugcacagggacaucaaaccagauaacauucugcuggaccgaugugggcacauucgccuggcagacuucggcuccugccucaaacugcagccugauggaaugguaagaagagccuggcgaaacucuccucauuggugaaggaccggauuagggggcggggcuggguugaggagcaggaggggagcuuggucugggauguccugcgcaccauauuuggacagucaagggaaagguuuuaagcauucaggucugauuggcacaggugaggucgcugguggcugugggcaccccggacuaccugucuccugagauucugcaggccguugguggagggccuggggcaggcagcuacgggccagagugugacuggugggcacugggcguguucgccuaugagauguucuaugggcagacccccuucuacgcggacuccacagccgagacauaugccaagauugugcacuacagggugagcacaagcaccaugcaggggggcugacuuaguggcuugugcucccagacugucuuuuuuaaaagauauuuauuuauauguguguguuuucuguguauguauaucugugcacugaguaggugugcgaaggucagagggcaugggauccccuggaacuggagucacagacuauugugugcugccaugcugagugcugggaaacagaaccuugaucacucugcaagagcagccagugcacugaaacgacagagccagcucugcagcccagggcuaacuguugcuuuucuuucuaaauaggaacacuugucgcugccgcuggcagacacaguuguccccgaggaagcucaggaccucauucgugggcugcuguguccugcugagauaaggcuaggucgagguggggcaggugauuuccagaaacauccuuucuucuuuggccuugauugggagggucuccgagacaguguaccccccuuuacaccagacuucgagggugccacggacacaugcaauuucgaugugguggaggaccggcucacugccauggugagcgggggcgggguacguaccugcaguuccugauccguugaggggacuucccuagccucuuccauaaaauuggggugauuggccaggugugguggugcauaccuuuaaucguagaacuucauaggcagaggcagguggcucucugguaaaucaaggccaucuuggucuacauagugacuucuaggccagucaggagugagauccucccuugaaaaauaaaaaaggggguguugaccuuccugggucccaaauuauuauccuagagcacugcuauguauccacucagguaugaggacacacaggugaccagucccaaagacagugagugaggccucacucuuggcaguacuaaaauugauuguagggggcugggcucuugacccagccuggaaagugcuggagggcuuccuggaggaggagacuagcugagcccagaaggaugcaggagauccuuucucgggugagugcucucagcauuuuaacaagcucuaggcccugcagagagaagucuggugugggcagagccccaauagaaagcaacaagauagaagagaaaaugguggaguuuguuagugggggcaguuaugccgugaacauagaggggcgaagggccaucucggauaacugcuagccacaagagcccugucugucuuccuaggagacgcugucagacaugcaggaagacaugccccuuggggugcgccugcccuucgugggcuacuccuacugcugcauggccuucaggugagcacgacugcccccugcuggggccugugugcaggcccaccacagccacucaauugaaggcucagucuucaaaccaaguauuccuaggagcugucuaaguuaggcuuucugcugcugcgaugaacccugacuaaaagcaagcuggggaggaaaaggcuuaucgggcuuacguuuccacaugggagcccaucacugaaggaagccaggacaggaacucacagcggggcaggaacguggagcugaugcagaggcaauggaggggagcugcuuacugacuugauccuuaugucuuccucagccuguuuccuuguagagcccaggaccaccaggccagugagggcuccacucacaaugggcugagcucucaucuaugaucacuaguuaugaaaaugcccgauaggcuugccugcagcuucaguuuuugaggcacuuuccuuccuuccuuccuuccuuccuuccuuccuuccuuccuuucuuucuuucuuucuuucuuucuuucuuucuuucuuucuuucuuucuuucuuucuuucuuagucuuuuagagacagggucuuucuauguagcucuggcugucuuggaauucauucuguagaccaggcuggucuuauuuauuuauuuuauguaugugaguccacuaucacuguccucagacacaccagaagagggcaucagaucccauuacagauggcugugagccaccaugugguugcugggaauugaacucaggaccucuggaagagcagccagugcuccugcccuguagaggcauuuucuucaugaaggcugucuccucucugaugacuugaugacucuagcuuguugugucaaguggacauaagacuaggaaagcagcuacacaugcacuuuguuuauuuuuguuuugcuuuuugagacugggucucuccaucucauagcucuggccauccugccuggugacauuccaguccaguuguauaaccuaagaaucugagacucagccuugcagaauccugcuauuaacgggucuaggacacuccauagaauccaggaucuuagaaaaacaaaccugaagugugacaguuuauuuuaagaacacaauuggagcacauaacaauaauacaacuuuucaguuuuaaaaaguuuucugucuuguuuuuugaggcaggagcuccuuaauauagucuaagccgcccugcgagugcugugauugaugggcauguaccaccaugccuagucaauaaagccuuuaaaaagcauccguuaugcuggcuguggugccacaaaccuguaaucccagcacuuagaagguagaggcaagauuaucagaaauucaaggccauccugggcuauacaguaaucuaaggcuagccuggucuacaagagacucugucuaaagaaacaaaagauaaauagcacccacuauugcuaggcaauauaacccuauaaccccaccauugaggaggcugaggcuggagcaucacugcaaauuugaggccaggauggucaacaaauaagucccagagcuggcauagaggaacucugucucaacaauaaagagaacuuaucuagcauuuaugaggguaaauaaaaauuuaccauugccacaaaaaauguaaaugaagagacugcuuuuaggagugaacugggaagcagggaacacuuagaggaugcucacucacacagguauccaccaucaggcaugccucaggccugcacagggaaggacaacuuguuucaugauuugcaagcagcaucccaugcuccuuagagcggguugggcccagcccacccucuguggaguuaucgcucagccaggcagcaaggcagccaaggugcugaggcccuggcagucugcucucuucucugcucugaaccuccuuuagcuuuagccuaggagccuggccuggugcccacaggcuagggagucccuagccucuuccucuucucagagacaaucaggucccggaccccaccccuauggaacuagaggcccugcaguugccugugucagacuugcaagggcuugacuugcagcccccaguguccccaccggaucaaguggugaguagacugagaggugggcaaagcuuccuggguggguguaccugcagugccaacugccaggcuguuaauucaguaggacacuguccccaacuggcccaacugcacauccuguagucaggaggcacaggcagaaaaaucccaaauucaaggcuugcucccguuauguaaugagauccugucuuggaguaaaaaacaaagaagagaacuagggauagcucagagguagaugcucuccuggcauggggguggggucagaaagcaacaccaaccggggccugggagggagggacugccaaccaccuggaggagucugggguagacuuggugaacaaaguucagaggccaucaggugggaugcugguuucuuaaaagccacagauagguggguagcauuggaaagaggagugggggguugcagaaagugacaagacacaaacuggggaggccuaaggguaaagccaggguugucugaagcacuguggagcugggaggaacacgcuaaacuucugacuucagcccuucaguuccccuguugacuacacuguccccagggacccagggauggggagagguggacgggggagggaaguacgggacugauccagcuccaggucccaacucugauccccaccgacaggcugaagaggcugaccuaguggcugucccugccccuguggcugaggcagagaccacgguaacgcugcagcagcuccaggaagcccuggaagaagagguucucacccggcagagccugagccgcgagcuggaggccauccggaccgccaaccagaacuucuccaggucagggucacagugcuggggugaggggagaggagagcagcaacccucgcagucuccucaccgauaggucggcucacuccccuaucuuucccagccaacuacaggaggccgagguccgaaaccgagaccuggaggcgcauguucggcagcuacaggaacggauggagaugcugcaggccccaggagccgcaggcgagucccucaccugcuuccagccaagggggcacuggguggagauggggggcauguugggugugugaacccucggggcaggggaggaguccaggcuggggcaccgcagccgcgccacugccuuucuccuccauccuccacacuccauacaccucucucuucuccuuccagccaucacggggguccccaguccccgggccacggauccaccuucccauguaagaccccucucuccccuccccgauccccaucuuagauaugcuacccacagcccuucucccguccacguuuaggguccauucuccuuggggguuccagaagaaagcugcccuucacucauccauucagcaugcacuaucuaccagcucucccucguuucaggcuucucgccaaauccuccccaagggaacucccuauacucccguucuggccucgacuagauucccgcacugccucucgcccugcugcugggcuccgaucgggucaccugucccuucucucuccagcuagauggccccccggccguggcugugggccagugcccgcugguggggccaggccccaugcaccgccgucaccugcugcucccugccaggguaugucccacguccgcccaccacgggccucugccuagcucugcccacugagugucaccacugcuugcugugccucuguggagcucggcccaccgcagggaggggggguauucgggcggccaaucaacacaggcugcugcuaaguagccaaugacgaguuccaacaggagcucuuucuugcgagcagaccaacuuuagcugcgggcuguggggaccagagaugcgcucagaggcccaucuauggguauaggcugggcggcucccaggagccagugggccccuguagccuagugcuaauccaaccuucucuccugcagaucccuaggccuggccuauccgaggcgcguugccugcuccuguucgccgcugcucuggcugcugccgccacacugggcugcacuggguugguggccuauaccggcggucucaccccagucugguguuucccgggagccaccuucgcccccugaacccuaagacuccaagccaucuuucauuuaggccuccuaggaaggucgagcgaccagggagcgacccaaagcgucucugugcccaucgcgccccccccccccccccaccgcuccgcuccacacuucugugagccuggguccccacccagcuccgcuccugugauccaggccugccaccuggcggccggggagggaggaacagggcucgugcccagcaccccugguuccugcagagcugguagccaccgcugcugcagcagcugggcauucgccgaccuugcuuuacucagccccgacguggaugggcaaacugcucagcucauccgauuucacuuuuucacucucccagccaucaguuacaagccauaagcaugagcccccuauuuccagggacaucccauucccauagugauggaucagcaagaccucugccagcacacacggagucuuuggcuucggacagccucacuccuggggguugcugcaacuccuuccccguguacacgucugcacucuaacaacggagccacagcugcacuccccccucccccaaagcaguguggguauuuauugaucuuguuaucugacucacugacagacuccgggacccacguuuuagaugcauugagacucgacauuccucgguauuuauugucuguccccaccuacgaccuccacucccgacccuugcgaauaaaauacuucuggucugcccuaaaucccgcgcaauaucucuguuguggaaaggaaaccgccccgcaggccaauggagaguccaauagagacaaccaauggcuugagugggagcuagaggggaggcaaagcgcacgaaucagguugaaggguggggcuuaggcauccagccaguaggagagaagcaacaagccaccagagacaccaccgccccccacccucccccccagcugugacccagcugugccacucaaguuuggaaaaaaguaggggguugggccagcagcgggcacaccaucuucccacugcgccugcgcaagccacgcgcauccgcuuuuuggaccgacacuccagaaaaguugcugcaaacuuucuagcgcgauuccccgccccuccucccagcuagauccaccgccuacccgcggggccgggaauuccgaggggcggagcacggcgcggagaugggaagggagggggcccuucaagggacccgggagaugggagcggcuucgcgcccuuaacccuccggacggcccauuaccuucuccguugcucugauagggaaacugaggcccugagucagaggcacacaaggggggaaggccaaaagcgcggccagagacggagggaaaacaaagaauccugacagcccgggaggggggcggacacacagggacaaggacagacccgagugcagagcugggucuagucuuugggagggggccagaagacugcaaggggaccgggggggggggcggcgaggaggacugggcggaggagggggcuggggaagcccgcgggaggcggcaaaggagggaggaacuuuccaaaguugccaaacauggcuaccucgccugcggagccgagcgcggggcccgcggcucggggggaggcggcggcggcgaccgaggagcaggaggaggaagcgcgccagcuucugcagacucugcaggcagccgagggggaggcggcggcggccggggcgggagaugcggcggcggcggcggacucuggguccccgaguggcccggggucuccccgggagaccgugaccgaggugcccacuggccuucgcuucucgcccgaacagguggcaugcgugugcgaggcgcugcugcaggcgggccacgccggccgcuugagccgcuuccugggcgcgcugcccccggccgagcgccuacguggcagcgauccggugcugcgcgcgcgggcccuaguggccuuccagcggggugaauacgccgagcucuaccaacuucucgagagccgcccuuuccccgccgcccaccacgccuuccugcaggaccucuaccugcgcgcgcgcuaccacgaggccgagcgggcccguggccgugcgcugggcgcuguggacaaauaccggcugcgcaagaaguucccucugcccaagaccaucugggauggcgaggagaccgucuauugcuucaaggagcgcucgcgagcggcgcucaaggccugcuaccgcggcaaccgcuaucccacgccugacgagaagcgccgccuggccacgcucaccggccucucgcuuacacaggucagcaacugguucaagaaccggcgacagcgcgaccgcacugggaccggcgguggagcgccuugcaaaaggugaggggggaaccgacccuccuuccucgguggccgcuggagucugcgcaagugacccuuca

SEQ ID NO: 3596 - RNA, 8993 nt, Mus musculus
ugaagggucacuugcgcagacuccagcggccaccgaggaaggagggucgguuccccccucaccuuuugcaaggcgcuccaccgccggucccagugcggucgcgcugucgccgguucuugaaccaguugcugaccuguguaagcgagaggccggugagcguggccaggcggcgcuucucgucaggcgugggauagcgguugccgcgguagcaggccuugagcgccgcucgcgagcgcuccuugaagcaauagacggucuccucgccaucccagauggucuugggcagagggaacuucuugcgcagccgguauuuguccacagcgcccagcgcacggccacgggcccgcucggccucgugguagcgcgcgcgcagguagagguccugcaggaaggcguggugggcggcggggaaagggcggcucucgagaaguugguagagcucggcguauucaccccgcuggaaggccacuagggcccgcgcgcgcagcaccggaucgcugccacguaggcgcucggccgggggcagcgcgcccaggaagcggcucaagcggccggcguggcccgccugcagcagcgccucgcacacgcaugccaccuguucgggcgagaagcgaaggccagugggcaccucggucacggucucccggggagaccccgggccacucggggacccagaguccgccgccgccgccgcaucucccgccccggccgccgccgccucccccucggcugccugcagagucugcagaagcuggcgcgcuuccuccuccugcuccucggucgccgccgccgccuccccccgagccgcgggccccgcgcucggcuccgcaggcgagguagccauguuuggcaacuuuggaaaguuccucccuccuuugccgccucccgcgggcuuccccagcccccuccuccgcccaguccuccucgccgcccccccccccgguccccuugcagucuucuggcccccucccaaagacuagacccagcucugcacucgggucuguccuugucccuguguguccgccccccucccgggcugucaggauucuuuguuuucccuccgucucuggccgcgcuuuuggccuuccccccuugugugccucugacucagggccucaguuucccuaucagagcaacggagaagguaaugggccguccggaggguuaagggcgcgaagccgcucccaucucccgggucccuugaagggcccccucccuucccaucuccgcgccgugcuccgccccucggaauucccggccccgcggguaggcgguggaucuagcugggaggaggggcggggaaucgcgcuagaaaguuugcagcaacuuuucuggagugucgguccaaaaagcggaugcgcguggcuugcgcaggcgcagugggaagauggugugcccgcugcuggcccaacccccuacuuuuuuccaaacuugaguggcacagcugggucacagcugggggggaggguggggggcgguggugucucugguggcuuguugcuucucuccuacuggcuggaugccuaagccccacccuucaaccugauucgugcgcuuugccuccccucuagcucccacucaagccauugguugucucuauuggacucuccauuggccugcggggcgguuuccuuuccacaacagagauauugcgcgggauuuagggcagaccagaaguauuuuauucgcaagggucgggaguggaggucguagguggggacagacaauaaauaccgaggaaugucgagucucaaugcaucuaaaacgugggucccggagucugucagugagucagauaacaagaucaauaaauacccacacugcuuugggggaggggggagugcagcuguggcuccguuguuagagugcagacguguacacggggaaggaguugcagcaacccccaggagugaggcuguccgaagccaaagacuccgugugugcuggcagaggucuugcugauccaucacuaugggaaugggaugucccuggaaauagggggcucaugcuuauggcuuguaacugauggcugggagagugaaaaagugaaaucggaugagcugagcaguuugcccauccacgucggggcugaguaaagcaaggucggcgaaugcccagcugcugcagcagcgguggcuaccagcucugcaggaaccaggggugcugggcacgagcccuguuccucccuccccggccgccagguggcaggccuggaucacaggagcggagcuggguggggacccaggcucacagaaguguggagcggagcgguggggggggggggggggcgcgaugggcacagagacgcuuugggucgcucccuggucgcucgaccuuccuaggaggccuaaaugaaagauggcuuggagucuuaggguucagggggcgaagguggcucccgggaaacaccagacuggggugagaccgccgguauaggccaccaacccagugcagcccaguguggcggcagcagccagagcagcggcgaacaggagcaggcaacgcgccucggauaggccaggccuagggaucugcaggagagaagguuggauuagcacuaggcuacaggggcccacuggcuccugggagccgcccagccuauacccauagaugggccucugagcgcaucucugguccccacagcccgcagcuaaaguuggucugcucgcaagaaagagcuccuguuggaacucgucauuggcuacuuagcagcagccuguguugauuggccgcccgaauacccccccucccugcggugggccgagcuccacagaggcacagcaagcaguggugacacucagugggcagagcuaggcagaggcccguggugggcggacgugggacauacccuggcagggagcagcaggugacggcggugcauggggccuggccccaccagcgggcacuggcccacagccacggccggggggccaucuagcuggagagagaagggacaggugacccgaucggagcccagcagcagggcgagaggcagugcgggaaucuagucgaggccagaacgggaguauagggaguucccuuggggaggauuuggcgagaagccugaaacgagggagagcugguagauagugcaugcugaauggaugagugaagggcagcuuucuucuggaacccccaaggagaauggacccuaaacguggacgggagaagggcuguggguagcauaucuaagauggggaucggggaggggagagaggggucuuacaugggaagguggauccguggcccggggacuggggacccccgugauggcuggaaggagaagagagagguguauggaguguggaggauggaggagaaaggcaguggcgcggcugcggugccccagccuggacuccuccccugccccgaggguucacacacccaacaugccccccaucuccacccagugcccccuuggcuggaagcaggugagggacucgccugcggcuccuggggccugcagcaucuccauccguuccuguagcugccgaacaugcgccuccaggucucgguuucggaccucggccuccuguaguuggcugggaaagauaggggagugagccgaccuaucggugaggagacugcgaggguugcugcucuccucuccccucaccccagcacugugacccugaccuggagaaguucugguuggcgguccggauggccuccagcucgcggcucaggcucugccgggugagaaccucuucuuccagggcuuccuggagcugcugcagcguuaccguggucucugccucagccacaggggcagggacagccacuaggucagccucuucagccugucgguggggaucagaguugggaccuggagcuggaucagucccguacuucccucccccguccaccucuccccaucccugggucccuggggacaguguagucaacaggggaacugaagggcugaagucagaaguuuagcguguuccucccagcuccacagugcuucagacaacccuggcuuuacccuuaggccuccccaguuugugucuugucacuuucugcaaccccccacuccucuuuccaaugcuacccaccuaucuguggcuuuuaagaaaccagcaucccaccugauggccucugaacuuuguucaccaagucuaccccagacuccuccaggugguuggcagucccucccucccaggccccgguugguguugcuuucugaccccacccccaugccaggagagcaucuaccucugagcuaucccuaguucucuucuuuguuuuuuacuccaagacaggaucucauuacauaacgggagcaagccuugaauuugggauuuuucugccugugccuccugacuacaggaugugcaguugggccaguuggggacaguguccuacugaauuaacagccuggcaguuggcacugcagguacacccacccaggaagcuuugcccaccucucagucuacucaccacuugauccgguggggacacugggggcugcaagucaagcccuugcaagucugacacaggcaacugcagggccucuaguuccauaggggugggguccgggaccugauugucucugagaagaggaagaggcuagggacucccuagccugugggcaccaggccaggcuccuaggcuaaagcuaaaggagguucagagcagagaagagagcagacugccagggccucagcaccuuggcugccuugcugccuggcugagcgauaacuccacagagggugggcugggcccaacccgcucuaaggagcaugggaugcugcuugcaaaucaugaaacaaguuguccuucccugugcaggccugaggcaugccugaugguggauaccugugugagugagcauccucuaaguguucccugcuucccaguucacuccuaaaagcagucucuucauuuacauuuuuuguggcaaugguaaauuuuuauuuacccucauaaaugcuagauaaguucucuuuauuguugagacagaguuccucuaugccagcucugggacuuauuuguugaccauccuggccucaaauuugcagugaugcuccagccucagccuccucaauggugggguuauaggguuauauugccuagcaauagugggugcuauuuaucuuuuguuucuuuagacagagucucuuguagaccaggcuagccuuagauuacuguauagcccaggauggccuugaauuucugauaaucuugccucuaccuucuaagugcugggauuacagguuuguggcaccacagccagcauaacggaugcuuuuuaaaggcuuuauugacuaggcauggugguacaugcccaucaaucacagcacucgcagggcggcuuagacuauauuaaggagcuccugccucaaaaaacaagacagaaaacuuuuuaaaacugaaaaguuguauuauuguuaugugcuccaauuguguucuuaaaauaaacugucacacuucagguuuguuuuucuaagauccuggauucuauggaguguccuagacccguuaauagcaggauucugcaaggcugagucucagauucuuagguuauacaacuggacuggaaugucaccaggcaggauggccagagcuaugagauggagagacccagucucaaaaagcaaaacaaaaauaaacaaagugcauguguagcugcuuuccuagucuuauguccacuugacacaacaagcuagagucaucaagucaucagagaggagacagccuucaugaagaaaaugccucuacagggcaggagcacuggcugcucuuccagagguccugaguucaauucccagcaaccacaugguggcucacagccaucuguaaugggaucugaugcccucuucuggugugucugaggacagugauaguggacucacauacauaaaauaaauaaauaagaccagccuggucuacagaaugaauuccaagacagccagagcuacauagaaagacccugucucuaaaagacuaagaaagaaagaaagaaagaaagaaagaaagaaagaaagaaagaaagaaagaaagaaagaaaggaaggaaggaaggaaggaaggaaggaaggaaggaaggaaagugccucaaaaacugaagcugcaggcaagccuaucgggcauuuucauaacuagugaucauagaugagagcucagcccauugugaguggagcccucacuggccuggugguccugggcucuacaaggaaacaggcugaggaagacauaaggaucaagucaguaagcagcuccccuccauugccucugcaucagcuccacguuccugccccgcugugaguuccuguccuggcuuccuucagugaugggcucccauguggaaacguaagcccgauaagccuuuuccuccccagcuugcuuuuagucaggguucaucgcagcagcagaaagccuaacuuagacagcuccuaggaauacuugguuugaagacugagccuucaauugaguggcuguggugggccugcacacaggccccagcagggggcagucgugcucaccugaaggccaugcagcaguaggaguagcccacgaagggcaggcgcaccccaaggggcaugucuuccugcaugucugacagcgucuccuaggaagacagacagggcucuuguggcuagcaguuauccgagauggcccuucgccccucuauguucacggcauaacugcccccacuaacaaacuccaccauuuucucuucuaucuuguugcuuucuauuggggcucugcccacaccagacuucucucugcagggccuagagcuuguuaaaaugcugagagcacucacccgagaaaggaucuccugcauccuucugggcucagcuagucuccuccuccaggaagcccuccagcacuuuccaggcugggucaagagcccagcccccuacaaucaauuuuaguacugccaagagugaggccucacucacugucuuugggacuggucaccuguguguccucauaccugaguggauacauagcagugcucuaggauaauaauuugggacccaggaaggucaacacccccuuuuuuauuuuucaagggaggaucucacuccugacuggccuagaagucacuauguagaccaagauggccuugauuuaccagagagccaccugccucugccuaugaaguucuacgauuaaagguaugcaccaccacaccuggccaaucaccccaauuuuauggaagaggcuagggaaguccccucaacggaucaggaacugcagguacguaccccgcccccgcucaccauggcagugagccgguccuccaccacaucgaaauugcauguguccguggcacccucgaagucugguguaaagggggguacacugucucggagacccucccaaucaaggccaaagaagaaaggauguuucuggaaaucaccugccccaccucgaccuagccuuaucucagcaggacacagcagcccacgaaugagguccugagcuuccucggggacaacugugucugccagcggcagcgacaaguguuccuauuuagaaagaaaagcaacaguuagcccugggcugcagagcuggcucugucguuucagugcacuggcugcucuugcagagugaucaagguucuguuucccagcacucagcauggcagcacacaauagucugugacuccaguuccaggggaucccaugcccucugaccuucgcacaccuacucagugcacagauauacauacacagaaaacacacacauauaaauaaauaucuuuuaaaaaagacagucugggagcacaagccacuaagucagccccccugcauggugcuugugcucacccuguagugcacaaucuuggcauaugucucggcuguggaguccgcguagaagggggucugcccauagaacaucucauaggcgaacacgcccagugcccaccagucacacucuggcccguagcugccugccccaggcccuccaccaacggccugcagaaucucaggagacagguaguccggggugcccacagccaccagcgaccucaccugugccaaucagaccugaaugcuuaaaaccuuucccuugacuguccaaauauggugcgcaggacaucccagaccaagcuccccuccugcuccucaacccagccccgcccccuaauccgguccuucaccaaugaggagaguuucgccaggcucuucuuaccauuccaucaggcugcaguuugaggcaggagccgaagucugccaggcgaaugugcccacaucgguccagcagaauguuaucugguuugaugucccugugcauagagagaagagggaaagugugcuuucuugaaaaccuucccucuuagggcccgucagcucgauccacuuccaccccacccaggauucuacaauucuagaccccgauucuguccccaaugggaucugaccuucagguacccuuccuucccacacaaauucugcuaacccuccaagggccccgccacgcccaccugugcacguagcccagccggugcacggagucuauggccaugacaaucucggccagguagaagcgagccaucucggcggggauccgcuccccaaacuugcucagcagcguuagcagguccccgcccacguaguauuccaugaccagguacugggagcgggugugucacagggguuugguagcccccaagacucccaaagacaccccguucccaagcacagaggacccccgcacagugagagagcgccccauccaaaggccaaaccagauaucacuccugucucaaggaaggucucuccuauacuugagacacaauccuacccccgucccccauccccugugugugucccccccacccccacccccccgaucuacagcagcuucucccuucuccagccuucuugacuuggggcgauguaacugucacucuuuccuagucaccugaacccggagcuuaccagguaguucucauccuggaaggcaaagugcagcugugugauccagcgccgguccccuuucacuaauacaucccuuucuucccggaagcacgacacc

SEQ ID NO: 3597 - RNA, 4008 nt, Mus musculus
ggggggggcggcgaggaggacugggcggaggagggggcuggggaagcccgcgggaggcggcaaaggagggaggaacuuuccaaaguugccaaacauggcuaccucgccugcggagccgagcgcggggcccgcggcucggggggaggcggcggcggcgaccgaggagcaggaggaggaagcgcgccagcuucugcagacucugcaggcagccgagggggaggcggcggcggccggggcgggagaugcggcggcggcggcggacucuggguccccgaguggcccggggucuccccgggagaccgugaccgaggugcccacuggccuucgcuucucgcccgaacagguggcaugcgugugcgaggcgcugcugcaggcgggccacgccggccgcuugagccgcuuccugggcgcgcugcccccggccgagcgccuacguggcagcgauccggugcugcgcgcgcgggcccuaguggccuuccagcggggugaauacgccgagcucuaccaacuucucgagagccgcccuuuccccgccgcccaccacgccuuccugcaggaccucuaccugcgcgcgcgcuaccacgaggccgagcgggcccguggccgugcgcugggcgcuguggacaaauaccggcugcgcaagaaguucccucugcccaagaccaucugggauggcgaggagaccgucuauugcuucaaggagcgcucgcgagcggcgcucaaggccugcuaccgcggcaaccgcuaucccacgccugacgagaagcgccgccuggccacgcucaccggccucucgcuuacacaggucagcaacugguucaagaaccggcgacagcgcgaccgcacugggaccggcgguggagcgccuugcaaaaggugaggggggaaccgacccuccuuccucgguggccgcuggagucugcgcaagugacccuucacaucccucuucgguggcgucggcgagugcauaggcugagcguggagagaccaggcacacccuggguucucugggcaucacugccucaggggcagagguuguuccagcuacuucuaagcugggaacgcagugccaggaaugggggggggggcgggggcgggacgggcagugagaaaagugagguaucccuggaggagcgguaguaaggaagggaaaggggccuuugucuaaggcacccaggguagggacccgcuuuuggggccucugcaaccuggccccucgguaaccauuacuuacacccacccccacgcccccuccagcccaaacagcguggucugucgcuugucuuuguugugaaacgugaaccuucuccggcuccgguuucccuguaacccaagcccuuccccucccaccucagcgccaggccucuagcucuggucucugacgccguggggguggggggugaggaagaacuggaguaaaagcugcugccucacuccgcagccacgcgccugccgacccaggggacuuggggcagucugggugcucggcugcaggccaaggcgacuggaaaacuuuccuccagcuuagcauacccgccgcgcugucaaccccagcaggcuuguagagacccugggauuuggguggguucuuugaagggcuaaaauaguuaaucggagcuuggguugccucugccccuagggcgaugaaaccuucaaaccuaaaaaagacguaacccuuuuuccuuccagcgagucugaugggaaccccacuacggaggaugaguccagccgcaguccagaggaccuggagagggguguggccuccauggcugcugaggcccccgcccagaguuccaucuuccuggcgggggccaccucuccugcaacgugcccugccuccuccucuauccuagugaaugggagcuuccuggccgccagcagucccccagcagugcuccucaaugguagcccagucauuaucaauagcuuggcccuaggagagaacuccagcuuggggcccuugcuacucacaggaggaagugccccucaaccacagcccagucuccaaggggucagugaggccaagaauucucugguccuggacccucagacaggagagguucgacuggaugaggcucagucugaggccccugagaccaaagggguucaugggacuacuggagaggaaaucccaggagcccugccccaaguagucccaggccccccaccugccuccaccuuuccucugaccccgggagcugugccugcuguggcugcuccucagguuguaccgcucuccccuucuucuggguacccaacaggccugagccccaccuccccacggcugaacuugccccagguggugcccaccucucaggugguaacccugccucaggcuguggggccacuccagcuguuggcagcugggccaggcaguccugugaagguggcagcugcagcggggccuaccaaugugcaccugauaaacucuagugugggagugacugcgcugcaacuucccucguccacugcuccagguacccuuucugcuuucuuggggucugagugggcuuggggagcaggugucucccaccugauagucucuuggaguuaagccuacuggcaccccugccugccacccagcaucuuccacuccaccucuuuucucuacaggaaacuuccuccuggccaacccugugucugguagccccauugucacugggguagcugugcagcagggcaagaucauccucacugccaccuuccccaccagcaugcucgucucccagguccugccuccugcccccagucuagcccugccccugaagcaagagccagcuaucacagugccugaaggagcucucccagugggccccagccccacccucccagagggucacacucuggggccaaucucuacucagccacugccaccugcuucuguugucaccucuggcaccagccugccuuucuccccggacuccucuggccugcuuuccagcuucucagcaccccuaccugaaggucugauguugucaccugcagcugugccagucuggccagcagggcuggaacugagcacaggaguagaagggcuggggacacaggccacccacacugugcugaggcugccagacccugacccccagggacugcuucugggggcuacaacagggacugagguugaugaggggcuagaagcugaggccaagguccugacccagcugcagucgguacccguggaggagcccuuggaacugugacugccugcauuuaaccacuucuucugacaauggugucaaggugcuaggacaggaagaggaacccucaguaaaguggcugcagucugaagucccacacuacagcucuccuaccuggauaagcuauaagcccuacaggagcuacagggaccaccacaggucagggaacuguccuccugauggcagaucuuguuacagcccucuccuugcucugccugcccaauaugugugggcacuaggggucuugacuugggcuuugccauccucuacauaauacuagugugagaaggcccugccaaguggcuaauuuccagauggcacccucacuauaacacuauuaauagccccacugauacccauuucccaaaauuuccugagagaccaggguggccuagggacagcccuuccuguugaggagggcugauggguguacagggcccuuccccugcuucccuggacuugagcuccaggauccagccccagaccaaagauuucccuguucccuagggcaacucuggccccuuugucuaguuuguauuguaaaucuuuauuuuucuaggauauguuaugccuccauuucaauuaaagucaaguaaacagacaacagagcuauugaggguaaggguuaccugccagacaacccacccaagagagaacuggggacaaagcccagccagaggcuguggcuuguuuucuuguuuggguugugagauggggaucauguuuuauauagcccaggcuggucucagaucccaucuuucugccucagcuuccugaauguuggaauuauaaacauggguaacuacau

SEQ ID NO: 3598 - RNA, 4008 nt, Mus musculus
auguaguuacccauguuuauaauuccaacauucaggaagcugaggcagaaagaugggaucugagaccagccugggcuauauaaaacaugauccccaucucacaacccaaacaagaaaacaagccacagccucuggcugggcuuuguccccaguucucucuuggguggguugucuggcagguaacccuuacccucaauagcucuguugucuguuuacuugacuuuaauugaaauggaggcauaacauauccuagaaaaauaaagauuuacaauacaaacuagacaaaggggccagaguugcccuagggaacagggaaaucuuuggucuggggcuggauccuggagcucaaguccagggaagcaggggaagggcccuguacacccaucagcccuccucaacaggaagggcugucccuaggccacccuggucucucaggaaauuuugggaaauggguaucaguggggcuauuaauaguguuauagugagggugccaucuggaaauuagccacuuggcagggccuucucacacuaguauuauguagaggauggcaaagcccaagucaagaccccuagugcccacacauauugggcaggcagagcaaggagagggcuguaacaagaucugccaucaggaggacaguucccugaccugugguggucccuguagcuccuguagggcuuauagcuuauccagguaggagagcuguagugugggacuucagacugcagccacuuuacugaggguuccucuuccuguccuagcaccuugacaccauugucagaagaagugguuaaaugcaggcagucacaguuccaagggcuccuccacggguaccgacugcagcugggucaggaccuuggccucagcuucuagccccucaucaaccucagucccuguuguagcccccagaagcagucccugggggucagggucuggcagccucagcacaguguggguggccuguguccccagcccuucuacuccugugcucaguuccagcccugcuggccagacuggcacagcugcaggugacaacaucagaccuucagguaggggugcugagaagcuggaaagcaggccagaggaguccggggagaaaggcaggcuggugccagaggugacaacagaagcagguggcaguggcugaguagagauuggccccagagugugacccucugggaggguggggcuggggcccacugggagagcuccuucaggcacugugauagcuggcucuugcuucaggggcagggcuagacugggggcaggaggcaggaccugggagacgagcaugcugguggggaagguggcagugaggaugaucuugcccugcugcacagcuaccccagugacaauggggcuaccagacacaggguuggccaggaggaaguuuccuguagagaaaagagguggaguggaagaugcuggguggcaggcaggggugccaguaggcuuaacuccaagagacuaucaggugggagacaccugcuccccaagcccacucagaccccaagaaagcagaaaggguaccuggagcaguggacgagggaaguugcagcgcagucacucccacacuagaguuuaucaggugcacauugguaggccccgcugcagcugccaccuucacaggacugccuggcccagcugccaacagcuggaguggccccacagccugaggcaggguuaccaccugagaggugggcaccaccuggggcaaguucagccguggggagguggggcucaggccuguuggguacccagaagaaggggagagcgguacaaccugaggagcagccacagcaggcacagcucccggggucagaggaaagguggaggcagguggggggccugggacuacuuggggcagggcuccugggauuuccucuccaguagucccaugaaccccuuuggucucaggggccucagacugagccucauccagucgaaccucuccugucugaggguccaggaccagagaauucuuggccucacugaccccuuggagacugggcugugguugaggggcacuuccuccugugaguagcaagggccccaagcuggaguucucuccuagggccaagcuauugauaaugacugggcuaccauugaggagcacugcugggggacugcuggcggccaggaagcucccauucacuaggauagaggaggaggcagggcacguugcaggagagguggcccccgccaggaagauggaacucugggcgggggccucagcagccauggaggccacaccccucuccagguccucuggacugcggcuggacucauccuccguagugggguucccaucagacucgcuggaaggaaaaaggguuacgucuuuuuuagguuugaagguuucaucgcccuaggggcagaggcaacccaagcuccgauuaacuauuuuagcccuucaaagaacccacccaaaucccagggucucuacaagccugcugggguugacagcgcggcggguaugcuaagcuggaggaaaguuuuccagucgccuuggccugcagccgagcacccagacugccccaaguccccugggucggcaggcgcguggcugcggagugaggcagcagcuuuuacuccaguucuuccucaccccccacccccacggcgucagagaccagagcuagaggccuggcgcugaggugggaggggaagggcuuggguuacagggaaaccggagccggagaagguucacguuucacaacaaagacaagcgacagaccacgcuguuugggcuggagggggcguggggguggguguaaguaaugguuaccgaggggccagguugcagaggccccaaaagcgggucccuacccugggugccuuagacaaaggccccuuucccuuccuuacuaccgcuccuccagggauaccucacuuuucucacugcccgucccgcccccgcccccccccccauuccuggcacugcguucccagcuuagaaguagcuggaacaaccucugccccugaggcagugaugcccagagaacccagggugugccuggucucuccacgcucagccuaugcacucgccgacgccaccgaagagggaugugaagggucacuugcgcagacuccagcggccaccgaggaaggagggucgguuccccccucaccuuuugcaaggcgcuccaccgccggucccagugcggucgcgcugucgccgguucuugaaccaguugcugaccuguguaagcgagaggccggugagcguggccaggcggcgcuucucgucaggcgugggauagcgguugccgcgguagcaggccuugagcgccgcucgcgagcgcuccuugaagcaauagacggucuccucgccaucccagauggucuugggcagagggaacuucuugcgcagccgguauuuguccacagcgcccagcgcacggccacgggcccgcucggccucgugguagcgcgcgcgcagguagagguccugcaggaaggcguggugggcggcggggaaagggcggcucucgagaaguugguagagcucggcguauucaccccgcuggaaggccacuagggcccgcgcgcgcagcaccggaucgcugccacguaggcgcucggccgggggcagcgcgcccaggaagcggcucaagcggccggcguggcccgccugcagcagcgccucgcacacgcaugccaccuguucgggcgagaagcgaaggccagugggcaccucggucacggucucccggggagaccccgggccacucggggacccagaguccgccgccgccgccgcaucucccgccccggccgccgccgccucccccucggcugccugcagagucugcagaagcuggcgcgcuuccuccuccugcuccucggucgccgccgccgccuccccccgagccgcgggccccgcgcucggcuccgcaggcgagguagccauguuuggcaacuuuggaaaguuccucccuccuuugccgccucccgcgggcuuccccagcccccuccuccgcccaguccuccucgccgcccccccc

SEQ ID NO: 3599 - RNA, 28628 nt, Mus musculus
ucagagagugaguaaagcggcaggucuguaugacuacgcgcugacucgcuccccuccccggcgagggcacuaaccgccgggaaggcgcaccccgacucuuuagacuuaauugggacucaccaggcgccuccuaugggcagggaaaucgacucaguacgugacaucacgcaagacgcggugacgucaguacgucgggacuagggcuccggccacgcucccacgagcggccguuuaacggcaccgcccucugacgcuucacuuccgccgcacauuugcauacccaacguacggacgucgaggcgucgacgcggcgacgucacgagcgcccgccccccccccagcagacaaacacccuccccaccaccuccgccgcgagcgugcaaacgcacgcuccuacguaggcacguaggcaaguccuuccuuacgcaagcacgcacggcccacgggcgggugggggaggaacggcgaggucggcggcgccccgcccagucagcaagguugcgcgugccccagggcggccgccgagaugguggugggcgcguuccccauggcgaagcuguucuacuugggcauccggcagguuagcaagccgcuggccaaccguaucaaggaugcugcccgccgcagcgaguucuucaagaccuacaucugccuaccgccagcccagcgugagucucaccccaaggccucuagcccuuccauucccgaucuuucuaguucaggggaacggcgucugugcuugaccaaucccggcgcgaaccggcaaaacgcuauagccaaugaggauggcuucugcuagaggggcgugucacugacccaauagggaagaagggagagcagucaggggcgucaccgcgcgaguuuggaaugcaagccaauagagaagagggcuucuggcgguugacgucuacaccagccaauaggaugaggugugagaaacaccaggguggagcuuauugucagaaguuaggggcgggaccgagaagaaguccccuuagcgauccgcuucggagccauccuuaagagagacacuugacuacagaaaccccaguuugucccucaguuucccuucggcccugugggugauuugcguaucacccuggguuuagagcacagagcuugugcguuaguuuuacacugaguuagggucgugauaguguuggaaucuugcgaccuggcaaaaggaugaacccagaaugggcguccuuccguuuauuuaugaguuuccucacaccgauccuuuucguucgguagccgcaccgugcaggcuucuuagcccgacacugggaaagauacgguccuaauauguccgcauuaugucaggaacuguaggcagacucgaguuuagagcagccgggugagccaagggagucuccugagcaaagaccucacuugcuucgcaaacgcaccagaugugugcuccuagaaaagacugaucucuguaaagcagagacgagggggaagucuuuguaauuuaccgagaacuaccguucauguuuguccaacgccccauguagcuuauaaaugauaugaugaguguuuguuuugagcugacccugcuuauaaaacaacagggucuaucuacgccaguaccagucugucgaaccaagacucauacagugacaaucuagaugggauggcagagcccacuagguaccugaccugacauagaguacaaagagcacuuccggguagagggaauauuccaacugagacugaagggugaggagaaucucaccagaccacugagggacauuguuggcuccaaggguggaacauaggcacuaaggggacccuugacuuuucuccuccacauguguguuuaauaagauucuuggucauuuuggguuuugguggagcuucugccugggccaaaggucuugcaguggaaauuuugggauuuugaagcaagaaaugaugguauagacucacaucccaguguuugggagguugagacaauaggaacaggucagcuaccuuaagauaccugauugaguucagucugggcuacaugagaccuugucucaaaaccaaagauaaauaaauaacuaaacagacaaaccagccugucauggugguguacgccuuuaaucccagcacuugggaagcagaggcagguagaucucagaucucugaguucaaggccagccugauccacagagugaguuauaggacagcuagggcuguuacacagagaaacccuggcuacaaaacaaaacaaacaaacaaacuggucccauauguuugucaaucucagcacuuggaaggcagaggcaggagagucagugcaaguuaugaaguaucuuuacuuauaaagugaguuccaagaucugcaggacacaaaccagggaugacaacuuaaauuuauagaagaaaaaaguaagccaucgcaggcaggaauuuggucacucuccaagaucacacuccauuacagucaguucaucaugguagaggcuugugccagagccuagcuguggacucuggaccuccuggccuguucagcuuccugcuuuucuuccaaguccugggacuagucuuagcuuugugguuuagggaacggcuuuacccugccccuucaaugaugacuuugggcaggggaacauaacccaccugagccucuguuuccaguucuguacagaggcuauggagagacaggagcaguuagugccugccuacugugguccagucuguauucucccagccuguagggcaccuaguccuuaguggcugcaguggccuugcucucccacuguauggauguccucugugcauuuaugcagccugaaaugcugucuuacugugaggaauaugaagauguaaagaaauccaggccucagggauuccuaucgucgaagauaggccacaaccagaaucaaugccuaaaauauaaaguaggaagucuagccaggcauggggacacauuccagcacuugggacucggaggcaggaggaguaccuugaguuugaggccagccuggacuguaacauaagccucaguuucaaaaccaaaaaauaaaagccuguuagguggcaacaacuuuuguggaagaaaagaaaugaggugaaaggagcucuguaagcagggguucuucaaaggucgcccugccucugcacauggaauggaggagaccaaggcaauucggagagcgcucacgugaggaccgggccugaccacuggaaacaccugggcuuuuugccugaggggcagggcucauuagaagguucugauccuaugccugagugugcaugugcuuugcauguguguauggugaguguaagugugaguguguaugaugagugugugugaguguguguguggccuugaagauggaacacagggucuugugugcacuggguaagaaccuuaccacugaaucacagcucagccucaaggcauaauuuacuaacuuuuugugacuggcucucacguagcccagcgggccucacacuugccauguacuagaggaugaccucaggcuuuugauccccgucucucacugccacaugcagguguacaggcauggaaaucuauacaucuuacuguauggcuucaacaacuucacuguuuuguguuccccugugagccuuccuugcccacucuacugaucccuccucuuuccagccagcccucuuuauuucaugacucuuucuuuccuugagacaggguugcccuggcuagucuacagcuggcuguguggaccaugcugaacucagagagaccucccugccucuggaguucugaaauuaaagauagugccuuauggcuagguagugguggugcaggugccuuuaaucccagcacucaggaagcagaggcaggcagauuucugaguuugaggucagccugaucuacagagaauguuccaggacagccagggcuacacagauaaaccuugucuccaaaaacaaagaacaagauggcgcauuauuauuauuucuaaguccguugaguugguuggcugugcauuggcaagggguuaugguagccugaccauugcaugagcuaucagugaagaauaagucucccuuccuccagcaacuguuaacugcaguaguuccuuaaggcaggguggggccuggggaguuacauuuuaauagaucuuugguaaucauugccugaggguggaugccucaaggagacagcuuacacaguccagcucgguauccuuuaaucugcaguaugacuuggcacuaaaaaaaguucacuagcuaagccuguaaugccagccacucuggaggccgaggcaggagaauugaaaguucaagaccaggcuggggaguagagugcauucacaaccagaacauccuuugagacccugucuccaaagaguggaaaagagaaauaaguagcuaaagcugaaucacagugguggggagcuuucuaguauagagguguggugggccaggcaugcugacaaugccuaccacgccaacacuuggaagguggaggcaagaggaggagcggaguuugaagccaaccugggccacuugaggucuggugcccugcucucgaauucucucugcccacccuugucauucaugacauugacauaguucugcagaacuuuccccaauuggcucugaguugugugucuuuggcagggaucccacaaaguauaguguguccauaucuaucuggggaaggauagguuugggauacacgagauuuuguggcuauguacauguguggccguggucuugaaauggugucaugagucaugguuagcaagucaaccuuccuuuccugucaguggugauuggucuggaaauuuguucaaagguagagcuggcaggagucaggugggagagaauagauggcaaacaggcagaggagacucgugugcuguuggagauguucugagcuuggagagccccaccuagcaggguccugcuuucuuucagucuguucuuccuuuccucacagugcuaagaggcuguggcuguggcucagcgaguucagccgugaguugucgcuccaggucaggccucucucccacugcugauccaucugaggauguuggcgcucagcccuuguguugugcuucacuuuguucuaagacagagccucacucuguagcccugccuggccuggaacuauguggaccaggcuagccuugaacuugagcucccuaccucugccuccuccucagugcugggauuaaaggugugccuggcugccugccccuuauccucacagcuaggaaggccauuguggcugcuacagcugagagaguacagggaagaaguccccggcacuucaguagucaugaagcagaagcccgcccuguaguuccugccugucucaggugauccacacuccugggaggaagagacagccuuacguucuguccaguuccuugaugcacugugcagugacggcaaaugucuuguuuuguuuuuuuggcuuuugaagacaaaguguuguacaguucugggugcuggccuggaacuuguggccauccucuugcuucggaggucuuuugagugcuaggauuuuagacuuguacugcaacuuuucccguggccuccauuacaaaguguguuacacgugcuuccaaggagcugagggugacauugggcaggaagacccugguucacuuguguuuauuucuuucuagugugcugcucauuuuccuaguuugccacaugcaauaagcaagacugugguccuucaaagaugcccacuuuuguauuaguuguauucucaucacuguaaccaaauaccugaggcagacuaauuguauaaagaaaagagguuuauuuagcucagagccuggguaucauuugcaucggcucagcucuuuucauggccuacuugcuguucugggacaucacugugucuguggcucgucucugcuuauaaugccaucaggauucugcaauucuguccuugacuuccauccuagugaucuuagggccuagaggcuccacuuuugagucuuuaccgucuaagucuguacucucuuaaccacuagcagaaauuucuggggacuacacuccugcuggagcucuagggggaaaaacacucgaagguuaggcauggugucucacacuugcaacccacuaacuccuuuucuuucuuuuuuuuauuuuuguuuuuguuuuuugagacaggguuucucuguauagccuuggcuguccuauccuggaacucacuuuguagaccaggcuggacucgaacucagaaauucaccugccucuaccucccaagugcugggauuaaaggcgugcgccaccacauccggccuuuucuuucuuuuuuuuaaauuaagaaaaaacaagguauauuuuuacuuauguguaugggugugugccacaugugugcagguacccuaggagaccagaagagggagucagaucccuuggagcugggguacagaugguugugagugacagggugcugggagccaagcucagguccucugcaagaggaggaaaugcccuuaaccucagagccagcuccagcucuggaggguucuuuuuuuggggggaggggguguuugaggcagacguacacauugagaucaggcuggccucaaucaaaugcaugugauuuuccugccuuagccuccacagcaauaagaucacagguaucuaccaccacaccugacagcagugacccacccuuuauuucuuuuuccuuuuuuaaaaaaaauuauuuauguauuuauuuauuuuauguaugugaguacacuguugcucucuucagacacaccaaaagaggucaucagaucacauuguagaugucugugagccaccauaugguggcugggaauucaacucaggaccuuuggaagagcagucagugcucuuaaccacugagccaucucuccagccugacgaccccuuuguuucuuuagucuguggcuggcugggcucugcugggaaccuccucugugggggugcaggagcugagugacagguggcaggugccaccauggagcauugguaccacuaguucccauggcuucucccuguagucuucuccaccaggcucccagccugcucaucacggucccguucagcaggaagugggugcuaugggccauuaagggcagggccuggaugugcacaguguuaucccuauggcccugucagucggaucagcccugagugccggccacagacagugcaggaaacauaaacugccauacuugaccacagugcaggcacccuuggauuugaauccugguaucaccacugauuggcugugugauauucagagcggguugcccucucugagcauuuauucuguauuucaaaaucaggcaaacaucuggccuuuguugugcaugucuguaaugccagcccugggagucugaggauaggaggaaguauguucaagguucaucuugguuacuagccaguuugaggucagccugggcuacaugagauucugucaaaacaacaaaaggagguagucauaaaacuuaaccccaagauuccuguaugauaguggaaggcucugaccuagagccuguggacugguuguuuucaguggcugggagggcauggagucuguugucaugugagaauagggcuugguacacugauaaggacugucugcccuugugucucugcuuugugauuuccucuggguguguccugggcacaccauuaccuuucugcagaguagaguacuuaugacugaugaccagugcccucugcaugcucugaggccagucgauagcauggcccacagccagccuaaggaaccugggcaaguuauuuaaccuuucugggcccugguuuuguacucuguuuuugaguguccugacacuuuuauaaguuauuaugacaaaggaaaaauauuuuuuuucuuuauaaaauuaaggguugaacucagagccucaaguaugcuaggcaggggcucuaccacugagccacacccuagcccuggccuaaucccuacaugcuauuguaaauguuaguugaaauacauaaaaauuuggugccagcuuucuuuuuauugucaccaucaugguaaugucagcucucgugcuguaagcaccuguucuugcucacacuuaggacuugcagcuugcauggguugugagcccuacauugcaguuggcccucauaggcuuacuacuuacgcaagucugggccuccucucuccaauucuagcuugcuggcaguggcuauuugaccagaagcuucaguuagagccgagcuuggugccacacgccuguaaucccagcaaaugggaggcugaugcaugagguaccugcauggcacugggcuccagugugaggcccugccucagaaaaccaacaagagugggcagguggcacacaccuguaacuucugcacucgggagguagaggcaagagacucagaguucacaggcauucguccucagcucuggacuguuauaggucagccuaggacucaugaggcccuuucucaaaacaaagcacuucagcagcagaggcacacaacaggggaaauauaagcucauauugggaaaauagcugugaauagagacaagugagaaagucaaacucacaagguggcugugaggggcggggccaccugugaaagcacccagugccccagucugccugcaaaugcuccaugcugaagcacaccuucuuauacacugaggguuugaguuuccagaaagagaggcuaggucuccugcagcaagggaagggcuggacccaggccaccagauugucugggaccuuuccagcuccuaauggccugggggaugggagucaugcugcagggaagcugggcacuaggcugccugucaagacacccugggaagaccacagccucggcucucaguggaguuggcaggcuccuuguuacuguugucuuuaauauuguuuuguaguggacaaggaaccuaaaaccccauguauacaccugcuccagcacuggcuguccccucagccucuacauggagguguuguccccugagcuuguggccacuggcuaguccuucuguggguuuacagccuaaguuauauuuugcuaaaaaggaauguaucugucgugccucuugguauuugguuuagagaaguugagugauacugcggcaugcaugggaccacaauagaaaaugcauucccuuuaaucccagcacuuggaaggcagaggcuggcagauuucugaguucaaggccagccuggucuacagagugaguuccaggacagccagggcuacacagagaagcccugucucgaaaaaccaaaaaaaaaaaaaaaaaaagaaaauguguucccuauagacaaugggggcaccacacugagugggagccuaaagagagucuaacaagcagagaccuguaaacacugcaagucacaguauuaccagaugugaacuuaaaauagccaggguuaaagcugagccuggggcucaguugguagagugcuugccuccaugcagaagccccgggguccaggcccaguguguauaaaggguguggcuacacaccaccuuacccagcacucuggaggugaggcaggaagauuagaagcucuuggucauccuuggcuaucguuugaagucagccugagcuacaugagauucuucaaaaaaaaccaaaacaaaccaaaccaaaacaacaaaaaauaaaacaaaaaacaaaaauaccuaaguguauauguuaaaaagauaaaaaagaauaauaaacacaaguaaaacucaggauugccaagaaacuggaaaaauggaaccauuagaacaucuagaaaugacagccccaaccagucaccccucaguuagagaacuaggcuuagccagacaugguggcacuugccuguaaucccaaagccuggggagccaggcaggagaucucaaguuccaggcaagccugggcucuacagugagauccuaucucaaaaaccaaagaaauagcugcugcaguggcucacaccuguagucccagcaccuaggagguggaggcaggaggcuuaguugguucaggccaacuggacuccugaaaaccaucucaacaaacaaauaugaaggaaaaaaagagaagaaagacuagugcuguuguagcccaauaguugugugcuuacuuagcaugcacaaggcccuggauccacccccagcaacacauacucgcaaauagaaaguaccauggagugcagugugcacaucuuuuuguuuuuugggguuuuguuuuugguuuuguuuuguuuuuuugagccaggguuucucuguguagcccuagcuguccuggaacucacucuguagaccaggcuggccuugaacucagaaaucugccugccucugccucccaagugcugggauuaaaggcaugcggcacuacgccuggcagugugcacaucuuuaaucugagcacauaggcagagauaggugaucucugucaacugaaagccagucugauucaggcuagacagagcuccauggugagacccugucuccaggaaggaaguuauggagggagggacaggcaaauacuggauuaaguacagcugcauaaugguuggccaagcagcagguaggugaccuguaggcacaauguggcuuuguggguacuugccugagaugcccaggggugccaccuacauggccuggcccagcugaccuggggaagcacuggcauuuuuauuuuuaaugcucuccagagaaagucacugcccugagaucuauuuauagucuugagagugucacauuagcuccuguguguggcagccaggcuguugaccuccaaaacuuaagaugcucuccugcuaagcaaacacuuuccugugugugugugugugcaugcgcgugugcgugccugcgugcccuucauuauuaccaguuauguaucuugcuaacaugauauauuuaaguauuuuaaaaaaaacaauuagaagggguggcauuaauuauuuuuuauucuuucuuucagucuuucucucuuucuucuguuguuguuuuuagaggcaagguuucucuguguagcccuggcugucuggaacucuagaccaggcuggccucgaacucacagagaaacaccugucucugccuucugaaugcugagauugaaggcgugggccacuaugcuuggucuucauuuuagaauuuuuuuuauccaugcuacccacccucccagugguuuuguguacacaaaacaaugucuuccuucaguuguggugucucacaucuauaauuccaacccucagaaggcuaagauaggaggauugcugauaauucaaggccaaccugggccaaagagugaaauccugccucaaaaaaccauagcggugcucacugugacccccccccccccccgcuguaggucugggcugacguuuggaugcuccaccccacucuugcugcuugacugagugcugugcuccuauaccccagcuccucagaggcuggugcugggcgcuugugaguuuagggacaagcuuggccacugggccugucugaaaagaaacaguuuuuaaucaaccggggcuaggcuugguggcacacaccuggcauuugagaaguggaggcaggaggaucaagacuucuagguuauccucagcuacuuaacaagucugaggucagccugggcuaugugagauugucucagaacaacagagggggcauauaguuaagugccuagccugcuucugucuccauagcuacaaaaacaaucaaccucuucagguccucccacuguguuugaaggcugguugauuuauagugcuguaucacacucuccuuacucaggcugccugcaguacucuggauggacaggagagggcgccugggucaguucuucagcucugugcugcaucugggcuugcucuagcugcauggcaggcacagaaagcugacugaauagcucccugacaguggguguuuccaaaagucuuuguacucuucucaaguuuauugaaaaccagccaguaaaucuuaaccaaaccugcagacagaccuccugccagcuagacaguaaagcaccucucagugguuuggugacucuaucuuccucuugcugacuuuuucuuuuuuuaauucagccaguucucgugaccucaauaaggcggcuagagcugugagcaccaagcuucuuauuucuuuucuuuaacugaacacaugccaagugccugaggaguggagaagauagcguuggagcuccuggaacugcaguuguagacaucuaucagcugcuaugugauugcugggaacugaacucaggucuuugagaagaguggucagugcucuuaaccacuaaccaucucuaaagccucacaccaugcauuugauccuucaggaggcaccugugggugcagcuuagugauaaagugugcacugaggcccuagggcuuagugauaaagugugcacugaggcccuagguucuaugcuggggagugggggugagagcagcuggccaggcguggagaagcaagccuguaaaugcagcccuugaacugcgcggggugggggggguggggggggugggggggcuuuguuggcccagggaguggcacuauuuggagguguggccuuguuggagugggugugucacugugggugugggcuuuuagacccuuguccuagcuuccuggaagucaguauucuccuagcagccuucagaugaagauguagaacacucagcuccuccugcaccaugucugccuggauguugcagugcucccaccuugaugacaauggacugaaccucugaaccuauaauucagccccaauuaaauguugucguuauaagaguugccuuggucauggugucugcugacaacaguaaaacccuaagagagucuuaauguguagcucaggcuagucugaaacagucuuaauucucagccucaauuccaggcacuucagugaaccucuacuguggccauuauaagucccacagaugaagaaacugaggccuuagggcaggaggugguaaauggcuucaagccagacagccugacuccuugguggccuuaaccacagugcccuagggcucaacuccagcuccauuccucaggcagcccugcuaucucccaucagauugcuacaguccuugcucacuccugggaugaugagcaggcaagccuuugagccaugccuggagcaccccacacuugcaccccuuccccuaccugcugcucuccacauuugcaaaaugggaagcagaugcacuaugccagucacacggcaacuaagcagcaggugcaggacuggaacccaggaccacccagcccucagccuccagagcucacaggugucccucuccugagcccagcuggucuguccagaucuggguggggagccuaggcagaggucguucucuggcggagucguuaggagccugcuuuagucaccacuccuuguauuuagugucugcgggugccaggagcugcuguagaaggaaggacugugagucagcgggacagauggugugcaugugugcgugugugcacaccugugaucccagccuucggagucagaagcaggaggaguucaugggcagccuuggcuauacagggugucugucuauaugucugucugucugugugcuugugugccuggugucuguagaggcaagaagacuuggggucuccuggaacuggacuuacaaacugugggagccacccuguggguauugggaauaaaacccggcucgccuggaaaagcagccaguguucuuaacugcuaggccaucucuccgucucccuaaauuuugaauuuuauuuuuauuuuauguguguauguguguaccugcacacauauauaugcaccaugaaggccagaaucagcuggaucuaccuguuguggguccucuacaagaagaguugaacugucucuccaggcuguucuuuuauuuucuugaggcaagcucucauuacauacuagccucauauuuguuaucccccugccucagccuccuaaguguuaguaggaaaggucuguggcacugugguuaggccgccucagagugaguguugagcucacugggagacaaccagagacaaagcagagacugcucggagccaugugauaauuuacugaccaguagcaacagcgguaauuuaauuaugcuauuucuugacaaaugaugcuagauaucuuauuaggaguuuauggugagccuggcuuugugaauggggaguguuccauagagaaucaagucucugaagcagcacaggcugagaaauaaguccuucuuguacccaaaccacuucacugggguuucauuaauacuauucauucuuuuguauuuuuuuaaauuuguuuuuguacacuuaccuggcaggggagauaccaugaucaugaaggugguuuucccagaacgagacucauccauugcacuccaaaugugcugacccugcaguuucuccaaaugcaggaaauucagaguaauuugugguggugggggauuguguuugagcucuccuguggaggguaggggagaaaagaaaagauguauuuuuauuacuuuauguguguuauguuuggccugaguggaugucugugcacaugcuugcaauggauccuaugagacuagaguuacagaagguugugagcugucgugugggugcugggaaucaaagcugggucuucugaaagagcagcaagugcucuuagccucugagccaucccuccagcucuuguauguaaauucuguaaaguuuuuuguuuguuugcuugcuugcuuguuuuguuuuuguuuguuuguauuucaagacauaguuucucuauguaauagcccuggcuauucuggaacuuucucuguagaccaggcuggccuugaacucacagagauccaccugcuucugccuccuuaaugcuggcauuaaaagccuauaccaccacgucuggaugaaauuauauucuauguuuuguuuguguaugugugugugcccacaugccacuacugagcauauggaagucagaggacaacuuagaggaauugaguugaggugucagucacuuuuagugacuuuuacuguaucaucuugcccuugcuaauucuggauguguauucuuauugagauacaacaugcauguaauacuaauggcaggccuaaaguguacaggaaacuggucauaaaggcacaguccugcaguagaagcucuuaggaggcuuucugcccuagguucagucccagccuggauuacacagugagaccuugucucaaaaacacaguaaauaagucaaggaagguggcacgugccuguggucucaggcagaagcaggaaggcgcucagccuuagcuguguagcauauuugaggccagugcaugcuacaugagacccuguaacaaaacaaggaagcaagaaagcaaagcgcaugauggucuacauagugaguuccagaucagccaaggcuagucagugagaccaugucuuaaaacaaaauaaaacaaaacaaaaccaguuuaauaaacaauaaaaacuaaaaugaaggccgggcggugguggcgcacgccucuaaucccagcacuugggaggcagaggcagguggauuucugaguucgaggccagccuggucuacacagugaguuccaggacagccagggcuacacagagaaacccugucucgaaaacaaaaaaaaaacaaaaaaaacuaaaaugaagacaggaaugguggugcaugccugugaugcucacagcuugagaggcugagacaagacuauuccuacaaacucaaggcuagccuggcucuacaugguggauucccaggucagccaggcauagugagaccaucucaaagacucagcugggcaaugauggcacauaccuuuaaucccagcacuugggaggcagaggcaggccagccugaucuacagagugaguuccaggacagccagggcuacacagagaaacaccgucuuuaaaaaggaaaaaaagaaaaagaaaagacuguugaaaguacuuucgugcgcccccuccaucuucucccacuuaauggucucccacgaugcuaagcuggugaagucgggcaccugcccuccccugcuccugaggcucucaagugcugaggagaagcagggccaggcagggagaccucugcucuccacugggcuucaucaguuugcacugagaaccuaggaucggagccucccggcucacaaaagcugcaacccucccucugcauucugggaaggaaaagaaagggaguuggucucuugccagagaagugggcgacugccguggagaaagacagcuggccacucuguguggugaccuacagagugccaguguggcugcugggccuuuauagcuugugugcucuuaacagucggggagcaggugcuugugaccuguuaggggcauggccucccaucugaggaccucugcucuugucagguuucugcucauugcugcucucuggaauuuucuugugcuuugauggaugucucuggagcuaggccugauccuuauggugcagaacuaccccagcuacucaggaggcagaggcaggaggaucaugaguucaaggucagccugugcuacaucuggaaaaaaguaaaaagcaauaggacguaauguuugucaucccagcacaugaggaaguagaaaaacaguccgaggcugaaggucauccuuguccacguagggagcugaaggccagugugagcuccauccauccauccauguaucuaaaacaaaagaugggcuauagcuuagugguagcagguguguccagcaugcaugaagcccugggugcugaccuuauuacugagggaacaaagcccccaggucacccugggaggagauuccauguucccugagugaagcaagggacaggucuugcuuaaggugacugcccacucccaccuuggucucugacuucaacuggaacaagaaaguauuggggguggagcuucggaacacaccugaccucuuucuccccugcaguguaccacuggguggagaugcggacgaagaugcgcauaauggguuuccggggcacuaccaucaagccacugaaugaggaggcagcagcagagcugggugcugagcugcugggcgaggccaccaucuucauugugggcggaggcugccugguccuggaguacuggcgccaccagacucagcagcgcaauaaggaggaggaacagcgggcagccuggaacgcucugcaggaugaggugggccgccuggcacuggccuuagaggcgcugcaggcucaggcacaagcgaugcccuccuugagugcccuggaggagcugcgggaggagcugcaggaggugcguggucaggucugcaaugcucacuguacuuccaagugccaggcagcaucuuccaagaaauagccagcugcuaaggccuggacuuguuugugaccauguggccuccaauagagccuucuccucacaccuccuggcccgggaugcucuggccuagcagaaaccacgaggaccuugauguagcugugacauguggucaccccuuacugacagguucugggcauuuccccagggagcacucagcagaagccuucagagcccauccagucucugacucagagcccucagccccucauuggacuuucaaggucucagacaccugacucuccacugcucuggcaaaggcaaaagauggaaccagggcucaagucugaucaugacauagacaaggucaccugcccaucauuggagcgccuccuuccuucggugaacacaggccaccuugagccuugccucaggucaauguagcucccauggaggcagcagagugcaauugauguucccguucucucuccucauucucccucugagguccccaggggaucacgccuguauagauccccuuacuccucagccuguggcauuaccccauuuccucccuaggcacagacggauccuagcuggcucgauucugaccugucucagucgcagccccgcugcccuauccugaaaugucccugaaccuuguuucggguggcacauauuuccuccuguccuucugugguauuuuucaguuggguggguuagaugucacacacacaccugucugacccuucauaccccuuaggucugggucccucuacccuuucuguugccccaccuuccuugcucgauccccccagacaugacuuacugcugggaaugugauggaggaaacagaguaaccuguucucccaccguucuggaagccagcggcagaggucaggguguuugggccccacuuucuucuggcuucaggggccccagaucuccuagacucuguguccugucuucauguggcuuucucuucccccaccugucucuugcaaggacaccugcccugaauacaagacccacccuaaauuuaggaugaccauauugaaagagccuuuauuacaucucugaagacccuuuuucuaaauggagacacacaggccccaggauucagacauggaguuuucuuuugaaggcccucuauucagcuugcugccuucugccauuuuaaaaugcaaggccccuacuaugcuguuuggcucuuccggcagccuacucauggcuucugggguugggcuaaccacuauagcuccagaaggauugugggugcagcagucacugucaugguuguccaguuccugauggagcugcagaauaaggaggccuccuaaggauauaugaggggcauaauuaauacggaccuucaaacugggccagugaucauuaacaauagagaaauccgggcuugguagcucauaucugaaauuccagcacucugaggcugaggcaggaaugagccugggucccaucgugaguuccuggacagccugcugaaccacagggagagacccugucuuuaaaaaaaaaaaaaaaggcaaaaaguaaaaaagacaaccaagccagacaguggugauacacgccauuaaucccagcacuugggaagcagaggcagguggauucugaucgagaccagccuggucuacagagugaguuccaggauagccagggcuacacagagaaacccugucuccaaaaaaacaaaacaaaaguaaaagaaaaaaagacaaccuuggaggaaaggcagagguuuuggcucugggggaaaaggagccgagacucauccugugaacucuucccacauugggaaacuaaggcucaggaaaagggaagcuaggugacuuggccaagaccccauagcucaggagggaccagaggacccagaagauucuggcugcagggcaagaugagauaaggcccaaccucuucccaguggccagaggcacuggguucugcccucuuaucagaaaagccccaggccacacccaagaugucugacuauagguaacagguucauucucccuggcccuugucccuagagguggcacuuguagggcucccccaaggggaugaaaaugacccauccccaggauuccccagacugaaaccaauacugaaacuguaccucaguuucuucuagaagaagcugaaguuggugucuuuaaauuuaggagcagcugaguuaggugaaagcugaacuagggacagaggacacacauggcuaggugaugaggggaggacagagugaggagccaggaaagcugccuguuugccaugguuaccccuguggagucacuaagaguuccagggccagcccuggccaccuugcccugggucagucuauagcaguuauggcaaagccaagaccggugagggcgcugagcuccaucaggucaguccuuacuccaacagaccagccucacugguggugaagagccccauaggaaugguuucucugcuugcuugggaggaaacaggcaccaagaggaaaugucaccuuugggucacccaagcaugaaaguaggccucggggcccacccugacccaguggagccuucacaugguccugguguauguggacauggcagccucucccaugaugacagugcaggaagccaccgugguguggugugugguuccagaagccucuggggcaggaggccagagcagcuuucauggcucugacucccuacucaugcaauguuacauauccccacaaagggagaaggaggacaauaaauuuaugaaugaagcugguugucuucaauuuuauuugugugugcuuuuaauugaaaaaaaaucaaagggggauggagagauggcugagagguuaagagcacugacugcucuuccagaggaccugaauucaauucccagcaaccacaugguggcucacaaccaucuguaaugggauccaaugcccucuucuggugcaucugaaaacagggacagugcacucacauaugcgacauaaauaaauaaauaaauaaauaaaucuuuaacaagaaggaaagaaagaaagaaagaccgggcgugguggcccacgucuuuaaucccagcacucgggaggcagaggcagguagauuucugaguucgaggccagccuggucuacagagugaguuccaggacagccagggcuacacagagaaacccugucucaaaaaaccaaaaaaaaaaaaaaaaaaaaaaaaaaaagaaggaaggaaggaaggaaagaaagaaaaagaaagaaaagaaaagaaaagaaaaaagaaaagaauccuauagacugacaaauagaagcacuggccaccaagccugaugacuugaguuggauccccaggacuugaugguagaaggagagaacugacucccucgguuguuagaccuccauauuuaccuugaaauaugcacacaaccauaaacacacuaaauaaauaaauaaacaaaaugugaugagaacuuuuuuuuuaauuccagggauggcauaggccuuuaaucccaacacucgguacuccugcuaaacaagaaagacugcuagggggcuggagagauggcucagcaggugagagcacucacugcucuuacaaagguccugaguucaaaucccaacaaccacaugguggcucacaaccaucuguaaugagaucugaugcucucuucuggagugucugaagacaacuacaguguacuuagauauaauaaauaaaugaauaaauaaauaaauagacuacagaagacccugucuaaaccaacccagaauugcagcaggcaugguagcgcguaccucugaaucucagcacuuggggagucauuguccuucucaaaaugaccuuaaaguccaucuuaaccagaaaagcugcccuguucuuugccaugcuggguccccaucccccagucagcugcagccccagucucauggauuuacaacccagugaggaacaacugcacacacacucagcauuaccugguuaugugaguagauggggcuggaccuagacucuucccuucugagugauuuggggcuucagggcauugcagacagaaccuugucauaccagcucacacagccugagccaguguugguggcucugccugucccaucccuggcuguuggucucaucggacaagccaccauaagagaaugaaucuuauacaagcuccagccgguuccccuggccccaaagccaucccuuggcuggccagugugagcacuguggauagauagacuggcaggaaaagccugccuuaguggcuggggugcuaucacccaccaacuggacacaugugcauggagcagcuacuguguccaguuuucuccccgugucuggauaagccagggacaagacaaagcucagcagagccaccauggugcugccauuccagcauauggguaaagagcuggcccuggggaagugaugccguagacagggcucuugucuagcaugccugaagcucugaauccaguccccggcacuacauaaacugacauccugcuacuguggaggugccucaaguucaaaguugaaaacuccauaggaugaagacgcagguaagagcaaucaauccuaacagugcaaagcuuaguagauuaggccccugagcugaagcagucaauaaauguuuauuacaacagcugugcucacucacuuucacauugucgauggccacuuuagcagaauuugagacucugagaugcuugagaacaguuaguuacccacuggcucuuuacaggagaaguucacugaccccacacagcaagggcagacaaaggucacccucucagggagccaagugugguggcacacaccuuuuguuguuguuuuuuuuuguuuguuuuucgagacaggguuucucuguauagcccuuaucuguccuggaacucacuuuguagaccaggcuggccucgaacucagaaauccgccugccucugccuccagagugcugggauuaaaggcaugagccaacaugccuggcugucacacaccuuuaaucucagcauuggagagguagaggaugucagagcucuguugaguucuagguuggccugaucuacauaguuccaggacagccaguggcauguagagugacccugucucgaagaugcagagaggugguggcacaugccuuuaaucccagcaaucaggaggcagaggcaggaggaucucuuugaguuugaggcgagccaggccuacagagugaguuccaguacagccaggguuacagagaaacccugucuugaaaaacaaacuaaauaaaaauggcaaucaaacuaaaccucuggaacaggaggucacuaaggcccuggaccccuugugucaagcauuagcucacucgucuguguuccugauucucaaaccccacaggagcugcuaccagcagccucagaaggccugagcuugcacugcaauccuugagaaggaggggcuuauguaacccauccugggcacacuguaaaguaauucucuucucccuguauguggaucucaggguuguguaauucugugcacaucuguaucuguaacaugauguguguaauguuguauaugucucuggagugacaguuuggcaaagucauuacucaguaggacuugcuacuaugucuucuuuugugguaaucuacuucauaaagaagagcuagcccggugugguggcgcacaacuuuaaucccagcacucgggaggcagaggcaggcggauuucugaguucaaggccagccuggucuacaaagugaguuccaggacagccagagcuauacagagaaacccugucuaaaaaaccuuacugaggaaccaauuuuuaacucccagcacccacauagugacaguggcucacaaccauuucuaacucuaguuccagagaauucagugcccucuuccacacacgcacuuuguccacagacauacaugcugucaaaauauucauacacauaaaauaauaaaucaauaagaacuauauaaauauuugaauauguacaugcauguauguguucugugcauuuaagauauauauuuuuaaacaauauuaucugaaugugacaacacauaccuuaaucucuguucucauaaacugagacaggacagugucacagauuugaggccauccuggacuaaaauaagacaguaaauaaauguaaaaaccaggaacaguggcucaggcuuucaacccaugggaagugauggcaggaggugcagugaaugcgagaccaucaucagcuaugcagugaguguaaggcuagccugggcuacaugagaaccugggccaaaaaacaaaacaacagagaacaggcuuaguguuugcccagcacuaggguggggguggaauuaggacgauaaggaaaucaaggcuaguccgggcuaaguagccacugaagucacuagugaauucagugcuagccuggauuauaugagacccugcuucagaauaaagaaacaaagcaauaucaacaugacucuaaacccuaccaagcauggguggggaugccuucacacuagguuacucggaaacagaaaggaggcucacuagagccugggagucaguccuaagcagucugaggaacacagcaagaggagcagggaacucuguauguaccguagaugcacucugcacuagugugggcaaccagagcagaagaguggauuccugguucauuuugugcaagcugugucgugagucuaauuaaaaugaaaagucacuauauaguuaccuuugccagcagaagugcacacuacuugcuaucuucagugggagcccagauagccagguguaguggugaacuccauuaauuccagaagauaaaccaaaaauucaguaggguguccaguucaaagcuaggcagggcuaccaggcuuuugccuaucucagaaaacaaaacaaaacaaaacaaaaaacagaaccuagccuugucacugaugacauagaugggcugcugaggggcucagcaagcccagagaaacacuucugcuuacuggcugcugcugaagcuucugacucgguuacagaugaggugaugccuucaucuuaagaguuuuaugcuccugagcguaucuacuccaucuucuagaguucucuggccagguggcaaaagccaccugacagaaccuguuuccuuuagauucuucuagaccucugcagcauccuuccuuccagggcagggagcagggccccucuggaguagaguccuuugaccugcuauugcacaaggaacaucauagaauuucuuuauggccagccagaggcacuaagacagaguuucaguggccagcacggggaggucagcuaaaaucaggaacuaugauuaaaaacuauagcuggcagguauagagcacugacugcacuccagagguccugcguucaauucccagcaaccccaugguggcucacagccaucuguagugggauccgaugcccucuuuuggugugucugaagacagcugcaguguacucauaauaaauaaaucaaucuuaaaaaaaacaaaaucaaaugaggggagccauauaacuucaaggguacaaugccugucgccaagccugcagaccugaguucagucccuggaugcagaggguuaaagaagagaacagacucccugcaaguugcccucugaccucucuacauggacacacacacauaaaauaucaaagacaaauauaagcuucagugagugaggcuggcugaacugaugguucagcagguagaagagagcugacgcccaaaaguuguccucugacuucuacauucuccaacuggaacauuggacacacacauacuaaucauaaauacauuguaaagauaaauaaaagaagccgggcgugguggcacacgccuuuaaucccagcacuccggaggcagaggcagguguaauucugaguucgaggccagccuggucuacauagugagcuccaggacagccagggcuauacagagaaacccugucucgaaaaccaaaaaaaaaaaaaaaaaaaaaaaaacccaaagccuugacaacccaagaaaggauucaaaacauuuuaccaaacacccuuuuugagaaaaguacuuagggauauaguccagcaaaucuagauucaaacugccugaauauagaacaugaggucagacauuccagacuccucaagcuugucuccagggaucucagagcaaaaggcaggccuccagauggguacaugcaucuucucacaaaagcgauauucccagguccuaagggagaaacaaauagaagauagaauccagccaggggcggagaacaccuuuaaucacagcacuugggaggaagaagcaggaggaucucugaguuccaggccaaccugguuuauacaguaagcccuuagcucaaaaggaaaaauaauaaagaguugaggaaagaggugagguggugggaagacaucaugggaacacaggccugagccucagggacagccaguguguccaugaccuacugagaaacagccguugaggaaaaacacaagcuuccaagucagaugagggccccagggaacaacugcaguggacagcaagcucuuccgguauucacccagcccugaauggguuuggcccucaguccuccagcauuuggcaggcagagacaguugggcguuuguuaguuccaggccagggguucgagguaagaccuugucucagcacacacuccaaagaacugaaaauacggcucaaguggguuuguaaaugacaacagagcagagugcuggugcagcuuagggaggcccacugugaagacccacagccacugaggagggagcacacuuacaggacucaguuccuuuucagagcuuccuuuuauaggguucaagagaaauuuaguugcugagugguugacagagagcaguucucuuauuuugguugauggguuacauauucauuuuuuucuacuacgcauaucccaucccauaagguaugauuaaaauuuuugauuuguguuuaugcgcauguguccgugugugccauguguguucuagugucauggaggacagaggagggcaucagaucccauggagcuggacugcaggcaguagugagacaugagaucugggaacuggacucaggucccuagcaaaagcaguaugugcucuuaacaucugagccaucucuccagccccagaaugucugguuuuaaccaugcacacccaguuauacaccgauagacuaagauaguaaacagaggacuaucucuaaaauuuacuugaggacacaguuuuguaauuuuuuucaaagauuaauauaugccaggcagugucgguacacauuuuuaaucccagcacucgggggguagaggcaggugaguucaaguucugugaguucaaggucagccuggucuacagacugaguucuaggucagccagggcuacacagaaaaacccugucucgacacccuccucaaaagauuuguuuuuauuuuaugugcaugagugcuugggguuuuauacucuguggccaccuugugacccuaacccugccccaccuuccaaccagggcagccuuuucacucaugcccacuuuccaggaucuucuggacacugguuuuuguuuuguuguuguuguuauuauuauuagugugugucagucauuuauuauuauuauuuuauuauuauuauuauuguuauuauuauuaugugugugugugucagucaagcuuggggcaacucuagagugggcuucuuccaguucugaggauggaacuucgguaagcaggcuuccauggcagacacccuuaccaacuaccaaaccguugcugacucuggacauuauuuaauucguuuguuuuauuuugagaucaggguccauugcuagccuagaaugaccuuuuguuucacucuccgguacugaaaucauggcugccacaaucaccaugaccugcccacaggagggcccucguucuguccaggccaauuuucaaaagaccaccuggaacuuguuccugagugcugagugucuaccucagauaagccuguaccaucaaacuuguaccuaggggaccucgcaugcuaggcuggcacucuaccaagggagccacaucccagccucagaccauuuuaaaaccaugucuucagguucccgcaggcuggagaagucauuauccuaagguugcggacugggugacuguccuguagccaggcaauuaugacuauggcugugauccccaagacaugggggugaggaugggggugggguaggggaguguuugcaguggggugaggagcgucccuggccaaagcaaacuccgacuccucucuucuucccuguaguguaccacuggcuagagaugcggaccaagaugcgcaucaugggcuuccaugcugaggccaucaagccacugaaugaggaugcagcggcugagcugggugcgaaccugcugggugaagccaucaucuuugcugcugcgggcagcugucugcugcuggaguucuggcgccagaagucaucgaaacaccgcagggaaguggcgcagguggccacggugcugucgcugcgggaggauguggaauaccuggagaacaugcuggacgaggugcaggugcaggugcaggcagcauugcccaggaacucacuggaugagcugcgggcagagcugcgggcagagcugcgggcggagcugcggacagaguugcaagcagaguugcgggcagagcuucaagaugagcuacagaaguucagaacccagaucuguaaagauugcuaugagccagagcuuaagccugaacuccaguguccugaggcccccaaggaguagaggccgcaggacucuggccuuggacguggacuguugucugggcuugucacaugacugaccucucugcaugggcccacccccaaauggugccagcuaacgugcccuggucucuggggacagauggguccuaggcugagagaggugugaguaccccuucccacggggucucuuuaacccacuggugggacaugacaggaacccuuccagcuccccuaaccaaaaccaccauugcuugaaugcuguacuuggaaaggagggcaguguguuggggagccgucuaacaaccuuacuggcccaucauacucccugccuuagguucuggagccccaucucccuccaucuaccucacuuuuuagggaaagaggauggggucugcccugcccugcucagucacucugccuaccccaccgcacccccauaacuggccuuuuguaaaggacccaccugcacccuuaccaugugggccagugccaccacccaccuguuuguuucacgguauucucaggaucacccucccuuacugccuuugaucuuccggguaaaaagccacuuaaaauauggcgaacagcagccucaccuucuguccaaaugggacauuccagaaaaccaaauaacucccuuacccacucuuugcuaacccacugggccacgaaggagugguuuaugaauuuaaaauguuuuauaauuaaaggagccccagguua

SEQ ID NO: 3600 - RNA, 1250 nt, Mus musculus
aaaagucuugcuacauuuauuuauucacuguguaugucuguuuauguggggguuagaggauaagcugcaggacucaguucucuccaucagccuucacagaggucuuugggauuaaaucaggugguucugcugguacaagcaucucucucugcugagcuaucuugcaggccccuucuuuaacuuuccaaccucuccuggaauuuagcagugggaagggguccuguugaguggcagagugugaacuguagcuuguccuugcuugccccucugcagaagaaaagccacacagguuggggagaagccccccaaagacgagucagccaguguaaguagggggcuuuuccugcccuauauuccuuaugguguacacuaguacccuagggcagggaggagguguuacagggcugagcuggcuuuggaccugaauauuggcauagaaaggguaguuuaugauacuuguauuuaccgccaacaggaggagucagaggcccgacucccugcccagaguggugagugauagcccuguucuauccauagaaacuauaaauccaaggacacauuguucuuguuuuaaaagcacuacaggggaaaaucugugaaaacaguacuggggauuguaguuuucuaaaauucuuuggccuggugaguugaguggugguaugguacugugggggcaaugcuugucucugaucuuuauuuguugccccacccacccacccagaaccugugagaagacccugggagaagaacagcacaaccuugccaagguaggcuauaaauauuggggaggaacauaauacaaccccugggauaggacccucacuccugcccugugccaucucuucaggaugaagucguccucuucugugacuaccuccgaggcccaccccucgacgcccugcuccagugaugacuccgacuuggagagggugaagcagguagcuuggggaaauagcuagaaagaugccaggagagacagaccuggcuccagaaugguucuaggaaaggcugagaaaccucuucuagccugaggaaaggaguugguggguggggcccaggggacagacgcccacacuuucccaguagcuauagcagaccguaccagucuaucacucauuccugcugaguccccagaauccucaguggcucgagcuauccaucucuagucacaguuggcaggagacuauguacauuuggcaagcuugcuccuggauguucuccaauacuguucugcuggccccaaagaucua

SEQ ID NO: 3601 - RNA, 7361 nt, Mus musculus
uuucauucauaagacuggagcggcuacgccggggacacgcggagccggggcuugcuggacuugacuacuggugacucuuucuuuuucuucuucuuggaggccgugaaaaauuuauauauauauauuuauauauauuuuuaaacuggagagaaaguuuuguggguuuccuuuuugcaagacucuuucuagaucguucuuccgauucguccggaggauagacuuucuuucugugggcuucuggaucgcgccccucugcucucccucauuucuugggacgcuucgacaggauuggaacugcaucugaagcgcacgcugcaccgcggcacugcccggcggguuucugggcggggagcgauccccgcgucgccccccgugaaaccgacagagccuggacuuucaggagguacagcggcggucugaaggggaucugggaucuugcagagggaacuugcaucgaaacuugggcaguucuccgaaccggagacuaagcuuccccgagcagcgcacuuuggagacguguccggucuacuccggacucgcaucucauuccacucggccauagccuuggcuucccggcgaccucagcguggucacaggggccccccugugcccagggaaauguuucaagcuuuucccggagacuacgacuccggcucccgguguagcucaucacccuccgccgagucucaguaccugucuucgguggacuccuucggcaguccacccaccgccgccgccucccagguaaguuuuagaucguaaagauucuacuuuagugguuggggggggggguguuucuuucaggcuaaaguguagauugagcauccucucaaauagagacgcgccaaaacccaggaucugggauugcaauaguucgguuugcacuuugguuuuuuguuguuugcaaacugcaaagaauggagugauguuugcaaaagguuauuugcgcggagcgcgggaaaggaaugcagcugggcaaacguuggcgaugcccggugcaaaguauauacccggugguuagcagaagcugagaacuuuuagccgaaagccggcucccuaagccgaagcuaggcaaguaggggaagaaaaagaaacaaaaaauuccagagaagcuuccaggagccuccuccucuucccucuuccuucaaaacgcggacugcaaguccgcagucacccuccacccagcaagaguuagggccucgaaccccggucacgcugccuccgccuccugcgcggagacguaacgggggacccgugcguaaaggcugacgcgcuggaauccuccgucugacgcggggcacgcacagcgcgcagcgcccccuccgcccgccccgccccugacgucccgggcacguucuauuuuggaacgccgaggccacguugcuaagggagggggcagcguggcuuugugauuggcugucgcggcgcgagcuuuagccaaucagcguucccuuccuauuuguagagcguagcucccuuccuugcuuuuugugguucuucccgugcugggggucuccaagagggagagcuaggggauucuugucgcgaucgggggacucguugucaccccaugggucugcgaggaccuuguguggaccugguccuguugucauaagcuagaggcuuuuggcugaguguuagcgccucuaagggggaacugaaggccucaucccuucuccaggcacacauauacgugcucccugagcucuagacacucaguccuuccgagguguucaaacacuagaugagcuagccuacggagaggcagccagguggucucuaaaaggucugccuucccuuaguucccagggcucugauuggccagggauucagcccuucccucgccacgcccccuagaguaguuaagccucuaggauuccacuugcgggaagggggggggggggcgugauggacgcuucuuggguucggggacgcagauccuaugucaccccauccccugcaagacagucugagagauucucgcugucacuuuucucugccuaucaguucacugaaaccugucagucucacuggggaagagacagacacucggaagggaugcucucaacucuuaggccggucccccaacaccguuggaacugggaucuccgccccugcgggagcccucaugcagugggggguguguuugugugugaguggaggagaggaaggcuugggcuaaggccucucccucucccucccucuguggugggggugggguguuuuggcuguaugugugugugaaugucuguggcuccaucccgggagguuugucaccagguucuguccagccuccucucccacccacccccccacaccuaagagucaccaacccggggugugauucaccacccgcuggaaccgugcaaccuuuccccgaggaagaaggaggagguagaaggcaguugaacagaaucucucauuaaccacugcgucacgguguaguggaaggguggguguuguggcuuuuugccugugacacacacauccacacccgcucacccugugcucacucacaggggucgguguguguuauguguguugggcgugugugugucgguggcuuuguuugugugucuacgccuguguguguaugucucaccccguaggagugcgccggucucggggaaaugcccggcuccuucgugccaacggucaccgcaaucacaaccagccaggaucuucaguggcucgugcaacccacccucaucucuuccauggcccagucccaggggcagccacuggccucccagccuccagcuguugacccuuaugacaugccaggaaccagcuacucaaccccaggccugagugccuacagcacuggcggggcaagcggaaguggugggccuucaaccagcacaaccaccaguggaccugugucugcccguccagccagagccaggccuagaagaccccgagaagagacaguaaguaugaggccucaggaguugggauggaggagccuagcuagggaugugggcucaguuuguacagugcuugcugccaugcaugaagaucccuagcacagcauaagccaggagugguuaugcagaccuguaaccccagcucucagaagguggaggcaggaggagcaggaguucgaggccagccugugcuacuuauggaguccagccugcacugcaagagaucauuauuuucaaaaguuggccuuggggggaggugggugagggaaguaagagaaagugacaguaauuuugucacuuaauaguuggagguuccucugaggccucaagucugaaggaacuuuaccauucuggccagugaggaguagggguuauuauuugggguucaggaggaaggaguuuucuuagggcugauagagguacccccagaucucaugguccuuaucucugacucagcuuaccccagaagaagaagaaaagcgaaggguucgcagagagcggaacaagcuggcugcagcuaagugcaggaaccgucggagggagcugacagaucgacuucaggcgguaaggaggagucugggggugucuugaggccgugcugggagcacucugccuuguucuucccccguuucucacugugccuguguccuaaacgaggaaacccccucuuagggaacaggggucaguauaggcugauggaguggcuccauaugcaugcucagacccaugcccacuuacuuucgacuguuccccacuuucccugaauauguccccacaugucacccuccuggcuuucucucagccuaaggagacaagcuagaggagguaauucucucaccuucuuuccuucacuaaauaauaauccauuuugccuuccugccuccauuuuuuuuuccugagcuggggaucuaccuguguaguucagcccuccucccccaacuugauagccucaaguuucagcccuuggcugagaugccaucauccugacuggcucuggcuggaaacuauuuugugcuaagucaauuccuuaccugcuacuccagcuaucuacaguucugccgaacuugagcugguggcgcccaccaagcccacuucuuucucucuucuaccucagugcaaccccccacacacacaccucaugccugccccuugaaaccagggugugucucugauuucccgucgggaggcugaaggagauggguaacagaaccucauuaaaaacaacacauaagcauuaccuacugacucaacaaacuguaguguuuuucuuuuuuccucucaaaaaauuauuucguuuguuuauuuauuauuugcuuauguuugagugagugcuggugcaccacagcacacauacgaggucagagggaaauuuucauaguuuguucucuccuuccguguugugggugcuugcuggcaaucuccuucacucagugagcuacaaugcccccuucugcccuuuaaggcagaguacuccuuaguacagggggacccuuuccucggccucucaaaguugagauuacaaauguucaccaucacaccaggcuuggaguucuugccuaucagugacguccacuccugccuagcuucuucccaaccaucucuuagucugauggggaaaccgaggcacgaguagcauggucuaccaggauuuccucuuaggggacgguccccucaguugggagggagcuguccagcccccuggaucagcagcaagaauguaugagugugggguugggcgggugaagcuacucuguguggucgcugaccagcaauucuccuuucucugucuccuaugaccuggcccugcugggauccauuaggaaacugaucagcuugaagaggaaaaggcagagcuggagucggagaucgccgagcugcaaaaagagaaggaacgccuggaguuuguccugguggcccacaaaccgggcugcaagauccccuacgaagaggggccggggccaggcccgcuggccgaggugagagauuugccagggucaacauccgcuaaggaagacggcuucggcuggcugcugccgcccccuccaccaccgccccugcccuuccagagcagccgagacgcaccccccaaccugacggcuucucucuuuacacacagugaaguucaaguccucggcgaccccuuccccguuguuagcccuucguacacuuccucguuuguccucaccugcccggaggucuccgcguucgccggcgcccaacgcaccagcggcagcgagcagccguccgacccgcugaacucgcccucccuucuugcucuguaaacucuuuagacaaacaaaacaaacaaacccgcaaggaacaaggaggaggaagaugaggaggagaggggaggaagcaguccggggguguguguguggacccuuugacucuucugucugaccaccugccgccucugccaucggacaugacggaaggaccuccuuuguguuuugugcuccgucucugguuuucugugccccggcgagaccggagagcuggugacuuuggggacaggggguggggcggggauggacaccccuccugcauaucuuuguccuguuacuucaacccaacuucuggggauagauggcuggcuggguggguaggguggggugcaacgcccaccuuuggcgucuugcgugaggcuggaggggaaagggugcugaguguggggugcaggguggguugaggucgagcuggcaugcaccuccagagagacccaacgaggaaaugacagcaccguccuguccuucuuuucccccacccacccauccacccucaagggugcagggugaccaagauagcucuguuuugcucccucgggccuuagcugauuaacuuaacauuuccaagagguuacaaccuccuccuggacgaauugagcccccgacugagggaagucgaugcccccuuugggagucugcuaaccccacuucccgcugauuccaaaaugugaaccccuaucugacugcucagucuuucccuccugggaaaacuggcucagguuggauuuuuuuccucgucugcuacagagcccccucccaacucaggcccgcucccaccccugugcaguauuaugcuaugucccucucacccucacccccaccccaggcgcccuuggccguccucguugggccuuacugguuuugggcagcagggggcgcugcgacgcccaucuugcuggagcgcuuuauacugugaaugaguggucggauugcugggugcgccggaugggauugacccccagcccuccaaaacuuucccugggccuccccuucuuccacuugcuuccucccuccccuugacagggaguuagacucgaaaggaugaccacgacgcaucccgguggccuucuugcucaggccccagacuuuuucucuuuaaguccuucgccuuccccagccuaggacgccaacuucuccccacccugggagccccgcauccucucacagaggucgaggcaauuuucagagaaguuuucagggcugaggcuuuggcuccccuauccucgauauuugaauccccaaauauuuuuggacuagcauacuuaagagggggcugaguucccacuaucccacuccauccaauuccuucagucccaaagacgaguucugucccuucccuccagcuuucaccucgugagaaucccacgagucagauuucuauuuuuuaauauuggggagaugggcccuaccgcccgucccccgugcugcauggaacauuccauacccuguccugggcccuagguuccaaaccuaaucccaaaccccacccccagcuauuuaucccuuuccugguucccaaaaagcacuuauaucuauuauguauaaauaaauauauuauauaugagugugcgugugugugcgugugcgugcgugcgugcgugcgugcgagcuuccuuguuuucaagugugcuguggaguucaaaaucgcuucuggggauuugagucagacuuucuggcugucccuuuuugucacuuuuuuguuguugucucggcuccucuggcuguuggagacagucccggccucucccuuuauccuuucucaagucugucucgcucagaccacuuccaacaugucuccacucucaaugacucugaucuccggucugucuguuaauucuggauuugucggggacaugcaauuuuacuucuguaaguaagugugacugggugguagauuuuuuacaaucuauaucguugagaauucuggguggaaaugucugaucaggagaagggccugccacugccgaccacaauucauugacuccauagcccucacccaggcuguauuugugauuuuuuucauuuuguuuuuuuguauuuugcaccugaccccgggggugcuggggcagucuagcacugggcagcuccccucccccccuugguucugcacugucgccaauaaaaagcuuuuaaaaaacuguauucuuca

SEQ ID NO: 3602 - RNA, 3486 nt, Mus musculus
guaagacauuuuguugguuuguuuuauuuacuuaauguagcugaggcuggccuugcacuuccgauccuccugccucagcuucccgagugcugggaucaaaggugugcaccaccaccgcccagcgauguacuaguuuuuguuuuuguuuuuugagacaggguuucuggguagaccaggcuggccuugaacuccgaaauccaccugccuuugccucccgaaugcugggaucaaaggcgugcgccaccacgcccagcgauguacuaguuuuuagguccauuuccauccaccuccgggccagccucauguagaacccagacacccgaagcuccucagccaggagaauaagaggcagaaccccauuccaaacaggcgggccagcgacagcuuuaaugacagguucucuucuccccuugcccccaggcccgcaggcucuuugaaguacuacacgaacccuuccucaaagugccucgaugaccugcugccaccuaggcccagugucacaauaaagaauuuuccaugcccaggcuccaguggcucugcguguuugcuugggggaggggcagggagugucuauacagcugguuucugaccucagccuggcgagucccuccuucuccccuuccccaggguguuauuacggcuccugugcaagucuccucugcugcuucuccuguccguggaagacaucucucauuggggaauggugucuugcaccucaguuuccugaucccucuuuuucuucuuggaggaucuuugacuggccuugggcucugguuccucggauugucuugggucaaucaccuuagacccgggcuccauugcuuucuguccucucuuuuuucuuucuuucuuuuuuuuuuuuuuuuuuugguuuuuugagacaggguuucucuguguagcccuggcuguccuagaacucuuuguagaccaggcuggccucgaacucagaaaucugccugccucugccugcccagugcugggauuaaaggcgugcgccucucucuuuuuucuugcugggugcuagagcccccuggggcucaaagucaucuggaagugcagccucugucucacccacccgcuuucccuuuuucuucuuugucuucuugggggacacaagagcuacuucagccuggagcccauguucugaauguucggucaccaugaguacuccagggggccccaucucugccuccauccccaaauucugucucuuuuccuuucuccucuucuuugugggggacaggaggaugguuuccuccugggcuuccacaaugaccuguggcugagagucagccacuauaccauccacuuccucugucccaucagcuuccuucugccucuuccucuuuuugguggggaacaggaagguccccucaggaggcucuguuugagccacagguucugugugcuccaccugggaugucucuguccccuuggacuucuuccucuucuugcugcugguggcagaugggacuggcagcucugccacgggcuccauugucuuggcuuccaucuccuccugcaugaaauaccucuuucucuucuucacacucacuccuagguuacccaaggcuguuuuuacuuccauggccccgugccuguucacagccuccugagugucugaggaggcaucuguacccuuucuuguacuuuuccucuucccugaaguuggugaccucagagcugaggcugaaccuggccccgugacgggagggcugccgccaaaggcggagaagcgaggccgcaggccagcagggaucugagguggcagacuuguagggaucagcugcagggggacccgagagagaagauauucuugaggacccuccaugauccuuaagcucccacugggggccggggcgcaggugagucugccaccugccucugaugaagaugcgagcaagguggcuucucgggccuggggacugcugguaaauacccgguaucggugcuucuugccauccaguuugcccuuaacagucuuggagccagaaagagguacacgccgcccauugagacugaggagggaaagggagagaguggcuaaccuuugcccggcuagggugcagcucagagcuagaacccagguguaagacccugaguucuguuuccuguuugcaaccaaacaagcaccuggggguuugcgggcugccuaggccugaccagcccagggccgccuuccagguacugggauacacgcucugugugugugagugaggccagcuuaguacucccucgcucaugcuggccuugaagucuacuguuuuccugccucagccucccaagugcugacauuauagccaauccccacgauuacugguuaagugauguguaaggcaggcaggggaugagucucggucgggcauggaguguguugucuagcaugaacagccucuggauuuguucaucggcacugcauaaaacugggcauaguggcuguauuugggggguagaggcaggaggaucagaaguuuaaauacuacaugggauauaauguucuccaaacggauggagagucgguucagugguugggagcacuggcugcucauccugaggugcugaguucccagcaaccagaguggcucacaaccaucuacagugggaucugacaccaucuucugucugaugcacccuucgauuacgaaagcauagaagcacacagacugcuuauauacauuaaugaauaaagacucuaaaacagcagaaccuguacacccacuuucaaucccagcacucaggaaacgggcuggggaaggcugguucuuugaaaccagcccgggcuaccgaauaagacuguuucaaaacaacccaaagcagcauuuccggguugcucagaaaugccaucuaguccggugguggcaacucgccuuuuuaaccccagcauuccggaggcagaaucucucugaguucgaggucagcuugcucuacauaacaggcucuaggacagccggagcuacacagagaaacucugucucgaauuuucaaaaaaagccuucuaaaguucugguucacguucuacagugaguucagccucuggggugggggggugggggggaauccuccccguagguggccuggaagcgacacucaccauuguggggcgaagucugcaggggcuuggauaagccacaguucuguaucuggaccuguaagcgccuccaaggagaaacgggaggguuccgagucuggcgacaucuccgugaaguggggagggcaggagaaccgaguggcaccugagaggagacagucggggggggggguccuuuugacauggccaaccucucaaaguacccguuggucccucacccgcccggcagcccuccccaaccccuucugcacccagacccucccggaugcccuucgucuccaccaguucaagcuccacucacugcaggccuggguacccgccauuccagcuccggaggggcccacgcaggaccugcgcggaacgcugcccaccacguggauccaagggguggagccgca

SEQ ID NO: 3603 - RNA, 13692 nt, Mus musculus
ccccaguucacaaaguccuaucagauuuuauugugucauggugggugaccccgaacauuucacccacugagguaggagacuggcacagagaugcaggacccaguggcagguagccuggucuccugcgcggguggcucugcacugcaguaagcugaggcaggaugcuggggaaggcgggcaggucugagacguucccaggccuaaacaagauguccacacccuaccccugcccucccuccccgcaggccucagccuaccugaaacagaacaaguaucagcaggcagaggagcuauacaaggagauccucagccaggaggcccugcccgccccacuuggugagcccaccccugcaccuuccugcacccccuccugcaugguggcauuccucacaccugccuccaugucccuucugucccacaggagccccccagggaggcacagcaggcgauacacagcagcagguaagcaggcuccaccucagguccuuguugggcccccaccauguccccacacaucacugugcccuccccagguccugcgcaggagcaguuccuucucuaagcuccgggaauccaucaggcgaggaagcgagaagcuggucucccgccuccgaggagagggcauggcaggggcugccgggugagugccgggagaggucagcagucugucaggaaccauccgugacaucagucagagccagggaucugcagucuucccugucucacuccugucuuuuugggcuccucuucaggaugaagagagccaugucacucaauaugcugaacguggauggucccagggcugcccggacgcaggugaggagucagugauggaguggggugcugcuggcaggcucagcaagccaggaaagguggggccgccuccuggggacucaagguagggaggagcuggugggcagggcaugaaguggcuccaaugucaacuggaaaagaacucuaaccauuccugugcucucagcucucccagcucucaacccggcaccugagugaggccccucggacccugagcaucagcacacaagaucugagcccgcgcuaaguggacuggcugcagaggccacagcuucucaaggaucaggaaggguggguggucacccugcacccugccugggcagcucuuguagaucgcucccugcaauuaaaggcggugcacugguacuggguguuugccgagggcccugggaccuuccagcaccucccaggagccacaggcggucaccccacagccccgcuguucagagcugcugugcgaucugcucaauucgcuguagugucuccucugacugcagcugcuccaggcugagcagcgacaggcccagcugauccuccuggagggaacagagguaaagggcaggagucagcucacacgggcacgcgaugagagagugcaguggcuggaguucacuccuguccuuucgccggaauacggggccagagacgacuaggaagcaugugcacaccugguggagagagaagccgugcggggcccaggcuuacccgguggaagggcugcgccaucugccgcaggaaguacuuggcgaccuguacacccucauccacggucagguugagguuggagucggucaggugcuccuggauccagcgaggcagcuuaccacgcuuguccgcccgagcaaaccgcugaggagggaggggaaggacauuagagcccagguuggagcccaggcugcccacuacccuguacccugggaggaagucgggcuaccuggacuggggugcccaagagcccugagccccaccuugucagcaaagaccaugaguccauaguccgucuugccccugauggcacgacccacacacugggcugcauggcgcauagcaucaaaggugaggaagucguucucucggaucuggaacuggucccgcagauacucuagccgggccugggggaugaggaggcugaggcggagggccugcccuucccccacacccccugacagcacuguuuccccacucaccuugagaauucggcucuggguauagacauagggaacuccaaacaugaucacagcccguccguagugguguacuggggacaggagagcaggauuacagugcaugcuggggcuaaggucaccccagggccuggaaaggggacagaucccgugugguaggaugggcaggaaccugagcuaagagucaggucuacucaccaaagucaaucccuucugauacuuugccccgagccacugagagcagaauggccccacggccauucucgcaugccugggguggggagguggaagucgucacucgucagcccucucccacucacccguuggcugcuggcauuucucugccugucccaggcacccaccucuugguacuucuccagggccacacuggucucagccccauccugggucucaaugaagagcaguuuguuccucuggauguucucaaggaugcccugggggugacagggaggucagaguucagaccacacagagucaagcacugccauggccucccaugaaaacccuccucuaggccccuagcuguccaaccucacuggcaguccaaaguggggagccaaccaccacccacagugggcacggggccccagaguggcuugugacugguggagggucugaccauaaccacggcaggaccaagcagguuguccucagaucagauaggucugucacugcaguggugagggaggggcagcccaccaggacagacguggggaccagaggcgccaggcagcguuaccugugcagcccagugagcaaacucuaccaaagaugcuaagucugggagguuuuuguuuuuuguuuuuuuuuugguuuuucgagacaggguuucucuguguaacccuggcuguccuggaacucacucuguagaccaggcuggccuuaaacucagaaauccgccugccucugccucucgagugcugggauuaaaggcgugugccaccacgcccggcuuuuuuuuuuuggaagucugggaguuuuacuuggauaaaaugaacucuagccuuaucucaccuaguccaaaugagucucuggugucucugcagacagacucuggccucaacagucaggcagacaggcagaugucuguuuuuaguacuagagaucgacugugguaauggccuguauguguuauaugcuagcucuaccacuuaauuaaaccuacagccccucucugugaguucagacuaggcacccugccugagacacacccacagucuacaaugccuguucaaacauaggccucaaagcugggcucagcagucauaagacauggcacccccaugcggaaccaaagccccaaagcuccauccaaccacacagguaugagagcuccuggagccgaaguucugguccagccuaacucuccagaauuuguacagccuaucaccaagccugcuugcuggggauguagucugcaguaaccccaagagcaacgcagcacacaaaccccaaaaguaggguagucuccugugguggggacggguuaagggugcuuaacugcccugcccugugacacaugucaccaguagaaagagggagugaagucauauauaucuaggaagagcagagcugaggguguggugccaggcguaccugcucauaccaggaggccacggugcuuuccauguacugguagcugguaaagaaggccacaaugccaucugggaccacggcggacaucuccagcaggagguugccauaguuucggaucacagcuagaagaguagguuaaagaguggauccucuccuggcucccauugagaccaccuaaccauaucccaaacgcauucucccaagcacaguagagggcugucucccauucccugaggauauauaacuugugacagcaaaagagacauguagaagugguuguuucuuccaugugacacucaggagccagugcccaaaguuccaggggccagugcuuaggcucaauagugcaccuguuagugcagaccuccaagugaagaaaccuaaggcacugaggaugggaacccccccugugcuagcauagaggcugggauaaugcuauggcagcagguccuaggccaccugagacccaccccaaccaagccuacaggugacucaccaauaucuucucuggucucaaauuuggagcugauugcuaccuggucauuaccacggccaaugaucuggaagaaucagguuaaaggccuugagaugaugucucauguagcccaggcuggccuucagacuaggagccuucccaaggcucucuuucccccuaaacccaugagaaggcucuucuccagccuccugaaauucuguguagccaaggugacccugguucuccugcccaccucugcaguugagaucacaggccugcgcccaagugcccggcaugcuaggcaagugcuggagcaaacaaggcccgaguucagguaagccuuaugcagacaacagauuagauggcccaagccuauggcuggcacugcuugggcaagugcuuggagcucaaccaugagccaccugcccacagucacagaguaacaagccccagggaagggcccucugugcuucuaggcaggacuauaccagcccugggcaguuccagacauaggucacccacagcacacaucccauuagcuacccuccccaguccaccaugccagugaguggucagagagacugauccaaaaaccccacagcucugaacccaucugucuaaccccugcugcaaagccacugcccucuucaaaguccaugcucugugagcaugcuguccgguuacagcccccucccccgacaguaagguuaaaggguuucugauugugugccgggcaguaucccagccacccuuggcugcuuguggcccauggcccauggguugaacaugccuagcugcaggguucugaacugcaaagcagagaccaugaggcugagaggacagcucugccccagguuucagagggaggcucauuacucaagacacagcugggugacaaaugacaaagccaucagcacgaugaugccagccaccaccugcccaggccugcgucgcaccagcguacacugugugcaugugucuaugugccauagcccaguggcggcguacacuugguaacuuggugcacccaccaggccugagccucagcugaguaaccggcugccuaggucgaagccaggaggcaggcggcuccccggucucacccacucaccaucgggcagaggcagacucgggccagcgucauggugaagguugccauugugacaggguggaaguccaggaucuugggguagauguccaguggggacagugucuguaacggagacagcaagggagaccucagcaggcuggccggagaccaggagcccgaugaaggagcagcagaguccucaccccagaagugaugaugacagacuggaagcgcucaaacacaggcuugauggccaaggaggcguccauacagcugcgggacaacacgggggucacacggggcagagggcggggccugucccauccacacaggguugcaucucaccugaagugcagaacgggguuggcgaugguggggguccugucgucaaagggcucaaugauaauggugaagccugguggagggagaggccggggagucucagucacucaucaccccgggacagaacugccccagccugcccacuucugcaaacccucaggugcagaagcagugagcuguggcuucauacauggucccgcagguagccaagcccgccauuccccaggcaccucuguccuccaggcucucacuccuguccccgcagagcaaccagagacaugucauggaaccccaaguuugccaguuuccacacuucccaugaccccagaagggugucaugcacucucccaggcugaagagcaagauuugccugcuuuccucccucccauuccucaccgugccucucugccaccaacacaggcuaaguagaggcagggaagagggccgcuccugagggaagcagcaauggcuuuggcaguaagaggcugguaaccagguggaccuggccuugggugccuuccugacuggcuuuuuuuguuguuguuguugguuuuuuucuguugccagcacaggguaccaugacugggauaacacuucacaaccaaggacaagaaaaacaaggauaguucauauuccagagucccacugugagacaccugagggcccccuugcccugagcugcugugccagcuuccacuuggcugaaucccugccccagaggacagugccauggcuccuugcagcaccgcuccacuucccagggucaccuggaaccaucuuugcuccucauucucccccaggcugugacuccgggaaggggaggaugaggcuguuucaguagugcugggccuggccccauuugcuaacugaacaaaugaauacauucauggguucuguuucacuuggcaaaaaugaucgggucuuacguguccagcccuugccaaggacacagcagugaccaacacagccucagucccacccauaagagcucccuuguacuaggggagacagcuauccagagaguaaugaucccaggcgcagcuggaauagagaaggggcaggccucgcauagggugggcugggugccuuucugaaagcugaaggacucaggcaggugauaggaggcguagacaaggaggcuucuaccgauugugauguuguaggugggggaggaggaagagacaaaggccaaagaaaggggcauggugagugcugaaagcuuaaggaagcaggcagcugccaacagccugcaguggggcugauggggggggccuccuccuuccgaggcccaggcuggcccagcugcaggaugccagcugaccugguuuccuggcuacggcaguaauccccagggauaagccugaaaacucaguguggagcuggggggguggggggguggggcagcacacaacacauggacagaggaaacaugacagauggacccaagugacggacccagaagguccugggaggcaggccucuguggaucaucagucuguaucugccucccuugagagcuucaugcccagcgccaugcuuuuccauccuggccucuuccucccauaguucuccccagcacacucuccuguccccauuguccacaguucugcaucuuccugcuacaugaaccucgaaagcaacaaucucaccaagugcaucccuugcccagaaccugccaugguucccuggugcccucagucacacacgaggacuccucaccccacugauggugaggugaccccuaguguccuucuggucagugccacagcacagcccacacacuuguucucugaacacgagaaucugaccacgaggcuccucacucaggcacucuguauggucuugcccccugcuaaugccccacccauguggcugacccccaaguccugcugucagauccccaguagaaaggcgagcucacccuuggcguaagugcugacgagaguggcgaaguuagcaaggagugugagcggggagaagucggccaggucggcaaucuccagggugugcagcagggagcgcaggcguucagcacagaaccugagaggcaacggggucaggagcgggaagcagcaacaggcccgacucucaccauguuucccugggcaccugggcauugugugaagcuaccccauacuguagaagacccccagagcuaccacuccaggcuggagcacagcacauacagugcacaggcucacugcucacacgcaauauccuguuaagacucccggcuagagcccggcgugguggcgcacgccuuuaaucccagcacucgggaggcagaggcaggcggauuucugaguucgaagccagccuggucuacaaagugaguuccaggacagccagggcuacacagagaaacccugucucaaaaaaccaaaccaaaaaaaaaaaaaaaaagacucccagcuagcagucacucuguuucuguccagccagugucacgggcccaacgcucaaggaggaauagccacauacuuucuuagccucacaaaggcugugucaccugcucaucacccaacauagggacacguggcugcggcacucacugccaaccacacaguccaauggaugcccuccacauccaguucugaccugccccuuagccuuaucuaugguccagaccccuuuaucaucagcaacaaggcuugggcccgugguuccccgugcaggccgcaccugaggggcuugcgcuggaugcacacccgcugggccaggccgcucagaaaggcagguggacucuccugcaccacaugcugcacgcgcagacgccacuugacauacuccagcagccgccgcagaaagcccaggaagugcucagccguacggauggagccaggcacagccucugcagggagacccagucaggugguacaggggugcgugugcggggcaggggcuggguggugggggaguggggaguagcucacccugcagcaccucguccggcagcacaggguuggccaggugggcaucugucucccgggccacacuggccucccgcaggcccuccaccaggcgccgguacucaucccgcagccgcugcucauccgucuccuugauccugauggggacaugggacaggagcuggaaugaggcaggugcccagggcacugaggcacacacaacagugggagcagacaggcaccugagcacggucuucuguagggugucuaaguugcucuggcaacgguccagaguccugcgggugagguugacacucauggagucaaugcagacauugucugaggaaagagcaaagggaugaaagccgggcucaggcaggccugggggcagaggcagagggcugccacugucugcacacccugaugcccgcccuccucaccgauguugugagcuucaucgaagaccacaacagccuugcgagccagcucuuuggauaccaggucugcgaucuugggguccaggagguagugguagcuguaaaccaccacguuggcaugcaggaucugggcacaugaagggagagguugcccugggcucugcuacccccgccacacccacucuaucccagguacacagaggugccacaaagacagacacaacgacggguggaaagauggacaggacuguuagccuuuugucuaagcuccaccucacaguuacacggcaauagccaggugugccugaaucacuauaaaaggggcuucuugcccccccccccuugcuuucuugcuuugcucugccuuccugccccugcucuauccucuagucccuucccccaucucucuccaugugcucaugggcaaccccccccucccucccucccccgccuuucucugccucuacuauccucuugacacccuuccccaugcccugaauaaacccuauucuauacuauacugucgugugguggcuggucccucagggguaagggacgccucagcaugagccugcagaggcaccccuuuccccacaccuccauagaacauaucucccccuuuaucuuuuuauaaacacaucaaggaccacccaggcaaggcacaagaaagcagagauacuaggacggagacagacgauccagacaacagacauaaagacguaacagcacagagucaaguagacagaugggccagcagaaggaugggcacgguggcucaugccuauaccccugacagcugagaaccugaggcaggguuauuccaaguuugaggccagcugggcuacaaaugagauccugccucauaaggaaacaaaacaacucuucaccgaguaucgagccaggaaguaggggcaccagcccuggcgcugcccuagggccuucaggucauccagguuguagaugcccgcagggagcggcaucuggcguccauggaugucaaauuccuggggcaaggccagaggguggcagggucagggagagcggcucuggcguggcccccacccugcucaccaguucuaggcucuucccuguaccucauagaagcggcagugaggcaggcuggcauccugcugguacugugcccgcacauacgacgccguuaggcugugacacuucccaucaacauccuucccaaagcgcaguggagucaccugagggggcggggugucaggggacaacauaaaacagagacaggaaguggugcauaucagcuauuguaacuugggucuccaaacucagacaccaggaguaguacgucagcuaggguuugggggcaguggaaaccuucaccugauuugguauuuggucuuuuguucguuugguuuuugguguuuaaagacagaguuucucaguauaauagcccuggcuguccuggacucauuuuauagaucaggcuggccuugaacucacagagaucugccugccucugccucccgaguacugggauuaaaggcaugcaccaccacaacuggcugauuugcuauuugcuaaaagaacuuccugcaguacuguaaguguggagcauggcuaaaaucaucccaucagagcuggacauggcagcaggugccugcaaucccagucacuccgacacugaaguaggaggaauacaaacacaggucaaccugggaaccuggcaacccaccaaacaaaagguggaaaggagcugggggcauagcucagugguagggagagugcuugcuagcacacacaaggcuguauggacaauccauaucacagagaaccagccaagcagagggccagcuggaugguucagugaaugcggaugucuaccgccaagcccgacagccugauuucaaccugggaccacacagugaagagagaacagacucccaaagcuguccucugaccgccacgugcacacacauacacacaaacauguaagguuuuaaaaaacaagugccucaauuucucuccaaacaaacaaaaaaaccccaaacagaaaacaacgaucccugaguggccuuucucugcaagcacuuggcucagcagggcuuugguucccugauguguguggguuguggaauaccggcaugaacauaauggauacugucaggcaggacgugaggcugucaugaaauuaucuuauuuugccuguauauaaaaauacccaauccuuugaguaagcuaccauuuagauuuugaccugucacaggucaaaugugugagucugaggugccauguggaauguaagcaguuucugauccugguacaggugcuacccuuagccauaaggaugagcauuggccuaacaacugagcagcaagccccacucauacugacaacggguucccucuggggcuugcauggaguggcccagggugacagcgcagggcucaccucgggaugaaugcacagguucuuucuugagcucagagccaguccuaagaacggcagcuucucgcccuccugcugcucguagaagcugaguagcuuacgaagcucuucuaugaccugcucagaugaugggagcauuagguggggaccacagggcaagcacaaguccuugcccaccgggcuaccgagggcagagaugggggaccaccaaggcccaggggagggggcagagcaugggucccaucugcauugcccaccuucucaaucucuggcacgguccgugagcaguagauaaguuuggucaccuccagcggauaagccugugggugacagggaccucagccccauccagccccaccccucagcccccacuccaggcacucagaaggccacucacccgcugauaggccacaaucagggccaauagggacacugucuucccagugcccgagggcaucuccaggacuccaugacccugaaaauugggcacagaaguaguaagacacaggcucucugucaucaacguacgcucuggggaacucuccuugacaugccaccacccgggaacagcaaggcaacacacacagcaguggcaucgcugucaaggccccaggacugauagucuccgcuccuccucuucugcuggacuuuuaauuguuaauucuuauuccucacccgccuaccccaaaggaucuugcuaugcaggccuaguaguuacuaagaaucucuggcuggcuuugaacuuuuggcaauccuguugccucuacuuugaguacugggacugcaggcugaacccuauuucuguggcccucuuacugacacagcuaaugaguuuacugagcagcagacaguaggaaccuuuuaccucucaggaucacagcauucuugcuucuaaguagcuccauaaaccuuacuuggaacaagguugugagggcuaauacauuggugggccagcaauauggcuuagcggguaaaggugcuuguggccaagccugaucacccgaguucaauccccaagacauacacggaaggaaagaaccaacucuacccucacgugcacacuguagcauguauacacacauuggaaauaaguauaccuaaaagaaaacuuuuuuuaaaaaguuuguguucagggcuguugaaauagcucagcagguaaaggcgauugcuaucaaaccuaacagccugaauuugaucccuagaacccacauaaaaugauaagaaaucugggugguguuggccuaugccuuuaaucacagcacucaggaggcagaggcagguggaucuuuugggacuuugaggccugccuggucuaugaaacaaguuccaggacagcaaaaaucacacagagaaacccugucucagaaaacacaacgagggacuggagagauggcugagcaguuaagagcacuggcugcuugcucuuccagagguccugaguucaaaucccagcaaccacaugaaggcucacaaccaucuguacagcuacaguguacucacauacauaaaacaaauaaaucuacaacaaaacaaaaccgaaauagaaguggaaggaaaaacccaacuccacaaaguuguccucugaccuccacauacggaaccccuucuucccuccacuauugucacuaccaggaauaccuccagaguuuuccuauacauagcccuagcuagcccgaaacucacuaugaaacccagacuguacuucaaacucgagcaaucuguccucagccacccugucucuagaauuacaggcauaauuguaauuacuaucagucaguuuaugcggugccaggauggaacccagaguuucaccccugcuagcuaggcuagcacccuaccaacugagcgacauuccucgccuuguuauuuacaauuguuguuaguacacggucucgcuguguagccccggcuggccuccaaaaucgcagcgaugcuccugccugggucuuccgggugcugggauagcaaggcccgggccccgaccaggacguuugccugccagaggcaucagaaugcaaggagggcagccucgccacccaccuuggcguccagcgugcgcuugagcuccagcauguaggagaacugcuccggguagauguagucguacgggaaguagaccagcagcccguccacguugagccuggcggcggugaggcgucggugcccggugcucucgagccgccucggccuccgcuccgcccgcccgcccgcccucguggcgucucgccgccagggaccccgaagccacccggaccggucuccgcagccucuccacgccgcgccccagccccggcgacgcccacccgccgccccauugcccaccgcagagccgcccgcucuuucagagaccccaucucacuucauggcggcugaucgcggcguccacacgcccgcuccugaauauucaacg

SEQ ID NO: 3604 - RNA, 5553 nt, Mus musculus
gcaguaagccauucucuccacgaacuccugacugauguggggugcucucuccgugugcucuucuagcagcuguguggaccaggaggaggaaaggagauacguugugggucgucuuccuccccucucaggggcggggcgagccuaccuucuucuucccaccucacaaacauccugggccagguugcugggucgguaguccaugcugccccacuguuccucaucuucuugcaacacucgaagaagggcugcucgggucugagccugcaacagggggauggaccagcagaagucaggcgcagccugggaccuugcucucuccucccaccauccucaccgugaaguucuggguucaacccacaaaccccuaggucaaagcagugcuugggaaaagaagccagccagaaacuccccagccuccuccuucccugucugggguugaggaugacagacuaaaacccugugaguuggcuuuuagaguuucuuuccuuucuucuucuucuucuucuucuuuuuuuuuuuaaagauuuauuuauuuuuauuauauguaaauacacuguaguugucuucagacacuccagaagagggagucagaucucauuacggauguuugugagccaccaugugguugcugggauuugaacuucggaccuucagaagagcaguuggguacucuuacccacugagccaucucaccagcccccuuucuucuucuuuuuuuaaguuuaaaaaaguauuuauuuaauguacauuguagcugucuucagacacaccagaagagggcaucauuacagaugguuguaagccaccauaugguugcugggaauugaacucacgaccucuggaaaagcagucagugcucuuuuuuuuuuuucuuccaagacaggauuucucuguauagcccuggcuauccuggaacucacucuguagaccaggcuggccugaacucaucugccucacucugcuuccugggggcuagaguuacagaugugccagcagugagaaggagccauuugcugcucucucugcacagauguguggacacauuauguauacgcugggcuccugugagcaucgggccuugacaugagaugcugugcccggcuuccucuugcuacuagggaugaaaugucugaacuuaucaaauuucuuugaguugugggguaguaugcuggagaagagacauagaauguagaaacagcaggcaugguggugugggcagagaucucaguacuggggaugcugaggcaggaggauaaggaguucaaggucagucugacucugugucaaaagaaaaaaguuaagaauaaagagauaagagagaaaaagagagagaacgauggggaggaaagggagaaggcagggaaagagauaaaagaagggggaguggaaaagggagggagggagggagggagggagggagggagggagggagggagggagggagggagaacagauggaaggaaggaaggucugcuaugaaucugugugucaauggccauuagacagaacucaggucaccacagggaaagggaaacagcuagugggcaaggggaggccuuccagguccauugugaccucccucuuucuacagagccccuccccaucccaaguggccacuuuggagguaccuucacgucugugacacauucaucuuccagaccccgcagugugccagcagacaggaggggccccagcucuccauucuccaaggcaaccaagucaaccaggcccaggaucucccugcgacgggaaguaagagacagagaggucugugagagguggggcugggcccugggccccuccacgugccccaccgccuugguacuggcgacccugggccacucccuuccucucucgggccagccuuccacaucucucaaaggaagcauuuagaauuauguuucccuuggcuccagcacucugagucagauccccugauggaugguguccgggcaagauacagcugucaaguuggggcuugacaagcugacaggggaagucuugcccaggaucagcuucgccaggaggaggcucccuucccccacugucucaccuggcuggggaugaggguggggauaggaagugggggcuucccaacccagcuucgcacucgccccucucagucaaacugagcaacaucuccaucacuugcuucccaccucccagucacgcacccucagaagacuuuuccuugugggaucugccuacucagaaaugcuaucuuccucugauucuuagcccaugccuuaucgcuuccaagagcuuuccggacccauauccugccucuaccugucauggauagucugagacuucacugacaaggauucuaauggcuaccagcuuuuccuuccugcucuuuuugggacagcauuccgagcuucucauccuuuuaagggacuguguagcccaugcuagccuggauuucacuacauagcccaggcucacuuugaacucaagauucuccugcuccugugugugacuauguuaagcuccagggaccucauuuugucacaguccuucauucucugauguuugauuuggacguggcuaacuucuuucuucccagggaggguauaaagcaaagcccggugggguuaucucuguaucauacucuccaauccccacacccccuccacacacacacaaggauaguccaagcgaagagucagaggcuuaauagauagauacaaaacucuagaacugggagcaagggcccauggugcuguaacagaacucaacaguguggggcagucaaucaacacugaugaagcccagugauacaaagggagugcaguaguuccaggcaccccagcacuaccaugcuuggcugaaggagcuguaaaucugcugcuuacugccauugcaguucccagcacccacacugggcagcucacaauugccugccaggccaguuucaugggguccaacccccacuucuggcugccacagauguacacaugcacacacacacacacacacacagagagagagagagagagagagagagagagagagagagagagagaaaacuaaagagaaaauaaaucuuuuuuuuuuaaaucugccuagccaagugugguggcgcauaucuuugauucuagcacuccggaggcagaggcagguggaucucugggaguuugaaaccugucuggucuacagacugaguuccaggacagccagggcuacacagagaaacccugucucgaaaaacaaaacagaacaaagcaaaaaucuaccuaacagguuuguuucucuagauacuuagaaggcugaaaagggaaaauuggaaguucaaggcuugccugaaauacagagugaguucaaauccaaccugggcuacagacuaaaguucugucuuacauuauaaauaaauaauuaauuuuaaaaaggcugagguuguagcuuagugcagacugcuuuaguaugugagaacaugaaaggcuggaauuuaauucccaggagagagagagagagagagagagagagagagagagacuauguuuguuuguuuuguuuuguuuuuuaagacaggguuucucuguauaguccuggcuguccuagaacuaaucuguagaggaggcuggccucgaacucagagacugccugccucugccuccugaguguugagauuaaggugagagccaccuuguagcuucaugagaucuccuuaucuuaaaaccuauugcauguacucaugguuaagggggacaggcaugccacgugcauguggaggucacuagccaccucugugacauuugcucucuccuuccacccuuccacgggucccagggucccuacucaggcuuguguaauaaguaucuucaccccugaggugccucgcuuguccuuacaauucuauuuuauuugaaacaggaucuuuccuauagucuuggauguccuguggccccucugccucuaccuccccagugccuggaauacaggcaugggccaucacacccugcuggauuauagaacucuaagacucaguaguacugagggccgaugggacagagauuuacaaugccaaaaucuugggacuguuaugguggacagcuggucccauucauguccugaguaguucaucagggaccagauggauccgcagcacugaguuacuaggagggcuguggacaauggcgcugagaacucagaaugagaacauaccaggugcucuaggucugggucuggaaggaccacggcguuaagauuugagguccccaagaggcaaagcucugagaugcagaaugccacuguguacagacagugcuaaugucccaggcuuuggggggaugagugcucggaugcagggaauaaagaagagccagccaggaugggaaccccaaggccaucggcacaaucuaccgagguucugagacugguguagggguggacaugaguaggguaaggucaaugagggucaacgucauauagauggucccacacuugcuagggucuaauaagucaagcauuagaguguuagaccuguaaucccagcauuagggauguccuaguuagcuuuaacugccaacucaacaaaaccuaaacccagagaggagaguccucuccuaaggaacuuuuagauaagucucugagggaauguccugauuguuaaaugacauaggagggcccgguccacuguggguggcccuauucccuaggcagcugguccugaguuagauaauuagccaagacgcagacugucaggcugcaagcagcauuucucuaugguuucugcuccacuuucuuggcugugaauuccuuggucagaggucaugcugugugaaaggaacaguuagccagucugccuuaaguuccugcuugaguuucuacccucguguccuucuuugagggacagugugaccugugagcugaaauauacccuuucuucccuuaaguugcuucuggucaacuuguuacgacaaaaggaaugaaagaauaggggaaguagcggaggaucuuuucaaggugaguuucugaggugucagcaccgcagccaaugauaguuguuaguugggggcggggaggggggagaggagaaggaggagcuggggcgauggguuagugguuaaaagcacuugugguuuuuugguuuuuguuguuguuguuuguuuguuuguuuuuuuuuuuuggcagagguucccagaacccauauugggcagcauacacugggcuguauaacuucagcucuagaugaacacagugccuucuggucucuuggcccagauacacaugcauagaaacaaacauuuuuuuuuuuuuuaaagaaaaaggaaagaaaagaaaagaaaagaaaagaaaagaaaagaaaaaaggcugggugcagcggugcucgcuuuuauaggagcucucaagagguaaaagcgagcggaucucugaguuuagggcaagccuagucuacagagcaagacccugucucagaaaaccucaagucaaccugggcuacaugaaacccaaucccuaaauccaguaucuugaacaaggugccugggguuaaggugagcgcgucccggggcgacccgggcucaccugggguacacaugauugugccagugc

SEQ ID NO: 3605 - RNA, 7710 nt, Mus musculus
ucacuucaacaagcugaugcgcaggaaguggcugagcaguucagaagcucuggauggcaucgugggcacacucggcgcccaggcccuggcccugcgcagaaugcaggaugaaccguaccaggugaucagaugggagggggacagagaugcucagagagcuauuguccugggggagacccuaccaaguggggagucgcuuuucuggaagcacauagguggcuccucaucuggggccugcagagggaagcauggcccuagaaaccggggugcagguucagguuggagccucugcagggaagacuuugggaaagccuagguuguggcacaccuuagggagaguggugugugugggauccgauuaaggaucuguuaggaugaggggauccguagagagucugacuuuaaaggagccgggcacuccgugaggaacagaggguucccacauguauuaggaguguuccgccugugugggcagagcuugaaacagggguccucccgaaagccuacugguugggagcggucuagagcguguccgggucucccaccguccccagguucugguggcugagcugcaccgacgggcgcugguggaguaugugcggccacugcuccgcgggcgccugcgcugucgcucugcgaggacccgcagccguguggcggggaggcuccgcgaggacgcggcgcagcugcagcgguuguuucggcggcuggugagugccaggcugggcugggcugggcaaacccgggggaagggagacagguaagagcuggaggcggggcuguccggagugggggucaguuuggcuuccaaagcaggacagggaagcuggguucgugaugaugcacaccugccgccacccaguacuagggaugcggaggcagaaggauugggaauuucaagaccaagaagaccgaaaaaagggcgggggccuggagagcccugguuacucuugcagagaacacggguucgauucgcaguccccacauggcagcucaaaaccguacuuaauucauccaacacuguauucuggcuucuugggcuccaggcauucauucacauggcgcagagagaacacccauacguuuaaaacaagucuuguuuuguuuuugagauggucucccuaugcacuccugacuguccuggaauuugcuacguagacuaaauuugccucaaacucaccuaacucugccuccugagugcugggauugaaggugugcaaccacuuugcccagcuaaaguauuucuuuuuaaagaauuacguauuuauuuuauauauaugaguacacuauagcugucuucagacacaccagaagagggcaucagauuucauuacagaugguuguaagccaccaugugguugcugagaauugaacucaggaccucuggaagagcagucagugcucuuaaccucugagccaucucuccagcccuaaaguauuuuuaaaggaaaaaaaaauauuccagcuaugguaauccuguaaucacagcacugggagggaugaggcaggagggucaugauuuagaggccaaccuggucuacacauauugagguccaggccaucagagcuaugcagugagaccuugucucaaaaacaaacaaacaaacaaacaauuuucugaauccaaauaucacuaaaugcaagaauuugcagucccaaaucuguugguccaguugucaugggcaggcaggguggcccaugaacucacgaggugcucuagggauucauagccuguguguccuugggaauuuauaguuucacuuacugaaacauuuucaagauaauuuuuguggacuuacaggcagcccucugaaagagcacacgguggcccucuggacguuuuagccaugcuuucugaaugaugacauuccaccccuuuuugguggcagagcagaagacagaacggagagccucgcacacgcuggcccucagucccaccuggaauaacucuaucuuacacuccccuuccccaucaagugucugugcucuagcucuuguuucuugacuauguagccagcuucaaaugccccugccucugccucccuaguguggguguuuuuaaaguuuguuugguuuuggguuuugaaguuaugucucacacaccugagacuggccuuaaauuccuuaugguugaagauggcugaacuccagauccuccugccuccaccucacccaugcugggauuauggguauuugcuaccaaaccuggauggaauugguuagauuuuuguuguuguuguuguuuguuuuggaagaccuguggcucuguagaccaaguuggccucgaacucacagagaucugccugccucugccuccccagugcugggauuaaaggcgugcgccaccacugcccagacaacuagcagauuuuaguuccuguuacccaaucuaggguuaucuguaaaaacucgggggcagauuauauaagggguucuccaucauauaagcaaagcuuguagcuaaugccuugccaggcugccuucugagcccucuuacccauggggaagacuaaagagcuagggaggagcaaggcucagcauggaaaggguauuggggagaaggggcuugcauugggugacccugaaacccuuguucccacaggagucccaggcuuauuggcuugaccaaguggugccacacuuggcagagauccuacaguuggaggacacuccgagcauccagguggaggucggggugcuggugcgggacuacccagacaucaggugaggugcagcaagcccccgggucucuuuggcauccgucccagcguuuccuggccugcgccaaagcaggguggcggcagagagcagagcgugucugacggcuguuuccugcugggaccagggcauucuuaauacgauuucccuccuucugcugccgccgccaccgccaccagggcucgcaaacaaacaagcggucacaggaagcccggggcaaggggggcgcaggccgcccggcggcaggaagggcuggcccugcagggaaccgccggggacacgggggacacacacgggcaugugggcgcacacucaagggacaguagcaggcacguccaaaucuaggugggccacuuccuuuugaccagaccuuccuugucugcugccuacggaugguaauacccuaauugugagcuggcugugggaauuacaccuucauucuuaucuaggacaguuuaacaguaaaagcugcaguccagccagggugugguggcacaugccuuuaaucccagcacucuggagguaggggugagguggauuucugaguuccaggacagccagggcuacauagagagcagagagagagagagagagagagagagagagagagagagagagagagagagagggcaaaaguauguuuuuugaugguuuuuuuguuguuuuuguuuugguuguuuuguuuuuguuuugguuguuuuuguuuuuagaaaugcaaaauaacuuaccuguauaaugcauggucucacaguugucaagugacaagagucugggauuugaaugcagaccagcagaucugauuucaaauccaggacaggacauugucaccugugagugacagacaguggucuaaugaaguagcaaugggaggaguggcuuccuggcacuguggugggcaggggcagcuagucuccacaggagcauggugggaggagggcugaguuugagauuugaaggcuuggagucaagggagaggauucuguucuggagguauaagcgaucucaaggauucccagcauccucaggggauuucugaaguugagucagaguucaggcacagcgaaaugguccagugaaugggaccuugcuaaacucuuagaauuagcuguguuuauuuuauuuuauuuuauuuuauuuuuccaagaaaagguuucucuguagacaaggcugggguuuuuucuucuucuucuucuuuuguuguuuguuuguuuuuaaagauuuauuauuauuuauauaaguacacuguaguugucuucagacacaccagaagagugcaucagaucucauuacaaauggugugagccaccaugugguugcugggaauugaacucaggaccuuuggaagagcagucaguguucuuaaccacugagccaucucuccagcccccuuuuuuguuuuccaagacaggguuucucuguguagcccuggcuguccaauaacucacucuguagaccaggcuggccucaaacuuagaaaucuucuugccucugccucccaagugcugggguuaaaggugugcgccaccacugcccgacugaccaggcuggucuugaacuugcagagauucacuugccucugcuuccugagugcugggauuaaaggcgugugccaccaagccugacaucuuuauucuucuuauuuggggagggaggagcaugcacgacacagugcacacauggggggggggcagaggacacuuugcaagaggucaguucucuccuccaaccguguagguuuugaggauugaacuugggccuucaggcuuggcagcgaguaccuggugaggcaggggccauccuccuaccucagggcugggaucccaggugugaucuaucacaccagcuguggagcuuuguuaugcaucagggauguggaguugagauggaagggcaggggaaacuucuaguagcuggggcuuaggauaaggguuuguggagcagaggugcuuucgagcacaaagaugauuagacggugaauuguagcguggacucuucagaggugcccccguuugcagacuggguuaggaguggcaugaguauccuaggggcugaaagcucaagaaugaucuagaaugaucuaaaugaagagacagugagguuuggaugucagugguggagaagcuuccaaaccagaccugcagaaagaggggguuaggauuuaguggggcgacacucuuaggcugagugaggccaucgggaggaaagggaugagggaacuaaggguuagcuguggcaucugccaaguguuagcauaccuuccggauuuagaaguggcaacucgaguguguaaaucuaccuacucaggagacugagagaaucagaagcucaaggaaagccuggauaauuuagugagacacuaucugaaaauaaaacuuaaaaaagggggcuagaggccgggcgugguggcacacgccuuuaaucccagcacucgggaggcagaggcagauggauuucugaguuuguggccagccuggucuacagagugaguuccaggacagccaggaguacacagagaaacccugucucaaaaaaacaaaaacaaaggugggggggauuagagauaagauucagagguggaacccugcuuagaaucccccagugaggggcugggguguggcuccgugguagagccccugccuagaaucccccagugaggggcugggggcguggcucagugguagaccccugccuagaaucccccagugaggggcugggggcauggcucagugguagacccuugccuagaaucccccagugaggggcugggggcguggcucagugguagagccccugccuagaaucccccagugagugccugggggcguggcucagugguagagccccugccuagaaccucuuacaugugagauccuugcuucagucuccuuuacuguaaauguccuauuaaaggagacugcugagguaaguuagaaugaagauugaaaguuaaguuaaugaggauuagagacacugaacaaaaaguuuuuauuacugagcuuggagguaagaguucuggacgauucuacauggaaaauuuggaaaugucugcaagagauugggacaagaugacaccaggaaaugagacaaagaguuccagaguucacgcaggguacacugaugggcuggguaccugucugggucccaggauccucauggaccuuugucuucccguccucucccaacaggcggaagcauguggcagcccuccuugacaucagaggucuucgaaacacagcugcccgucaggagauccuggcgguggcccgggaccuggaacuaucugaaaguggugcccuaccacccucuagggaccgugccuucuuugccgacaucccugugccccgcacaucuuucugucuuggccucccucuccucuugggacgccucccagugucccggcuggccaggcccaaucuggcuugucugccccugcggccucguccuccaucaccaguuagagcccgagccgaucgcugaggcacccggugcccauguugcugcugauagacccuccucccuuccacgugacucccugccugagacaccgacuucugggauaggagguuccuuagauaacccacccagcccggagcauccccuccagaagggaaacugaggccagaacgagcaaagaguucccccaaggcugccagggucauuccccgcacccuccucccuuguaucccagcauggcauggcggggagccuucuggaaggcuuuacagaaauauccuagccccaccuccuuuccccucaccucaaggucuggccccaauccaacguauuaaggaaugguagauacuuagaauaaagagguuucuauuuaacacuaggaagggcugagucccaagugcaggggcgggaaaacagggcccagggccaagcucucuugcacacacccaaggccaccagggccgggguccaacuccuagggaagccacaaaugaccagauacuccucaguugccguugauaccgaguccuugagcugcgguucugaggccugcacuugucuguccugagccagauaacgcuguuuuauccaucccggugucugauguucuucuaggucugcuuggcacagcccuccccacccgugcuuagcgaguggggggaaaaccuuggcgggagaggaaggagcugggggguugggcuggcagcauccagggcgcccuccuggauugaugcaggaaaaucucagggugggaaauuuuccagccucucaagccggagcccagccggauccaaauccccacagaguccuugaggucaccucccuguugaccucugccccuccggccucagcuggacagcucgugauggaugcuuccuggcccggguuauguuuuauuuuauuuuuuccuuaagaagucagaaagaggaggcagccaggggucagcacaggggccgggguuggaaccucacgcaacgucuugacauugguaacaacauggcggcccuaggcucuagacucugagccuccgggcugugugcugcagaggggaaggugucagucucugugcucugcuuccugcugucccugggaaguggcuuaacuucucuuugcccagaggaugucccuccuccuuccuugaccuucugaaagugacaccucugucauugaugagcaggagaggggaacugacugugggcacuugcacaauuccacauguauuuaaucucagcguggccaugcucugucauugucugacuugcuaucccugucauucaaaagucagcuugauugucgggcuuggcgacagcagggcugugaucccagcagucaggggcugaggcaaaauaacagaaguguuagacuagacuggacuacaucucaagaccccacccuacaaagugugugggaucaggcggggaacggugccugccaccaagccuagcagacugagccuggucccaggacccacaugguggaauccuaaaugucuccugaucuacacacccaugcuaaauaaaauggaauaacaaaugcaau

SEQ ID NO: 3606 - RNA, 33465 nt, Mus musculus
acauggugcauccaugguguuuuccauuuuuuauucuuucaaacaagguguuaaauagcccaggcuggccucagacccagcuucuauuucugguugugagccuagccuguaacagaggagccaucucuccagccccucagacccaacucaaagcagugaggaugacuuugauguccugacccuucugccuccaccucccaagugccaggauuacaagugugugccacuaugccaagucuuguuuuguagcccaggcuagcugaaaguuuuuaaaucuggauugaccucucaaaaucaaggauggggaauaaccacugugcccaacacuaccuagaauucugcuaaguugugagcuccucagaacugccauggaaugcugguccuacuguguacacagaacuguuuugugcuguuugcccagacagacuugcgaaggguuaauagagacccauccaccaguaccccaauaagggcacuggauauguccagauguccgugaaagcaaauggcaccagaguggcuaggauacagucauguuuucacaggucuugguccagugaaggaagucuccuugccaugauguaccagugggcagagccucaggacuaggcgguaaggggugccugggaacaccaccaauuguauccugaagguacuugugucccagaaaggacuugagagacuggggcuagaggugaggcuguggcagagcaugagacaaaggcuggggacaugcagcagcccccuggggaucacauuagcugucuucugagagcacugggucagcagguggaaggggagcccagcaaggagaguggguaugauaccuaccugugaggcaccaucccugcuugacucagcagggagaaguagguggagccugaagcaaccugggguugggccagugccuccuugcagcacugcugauccuacagucugggaagguguagugaguacccccaauggcugucauucuccuagagaggguaagcaggcccugcuccugguauggacaguuaggcucuugagggacacugcaaugacacccaaggacucacucugcuguggcccagauaagugcauacaggccccauucuguuuucuccauugaggaguguuaaauagggcuuguccuucuuggggguagccucuugauucacaggcagacuuggugguguuuaguguuucagguccugccugguggcacacagcuagccacaaauaccagaugcuuuuagccagcagccuuguaggagucuaagauggaacuguuuugggagaccucuugcagggcaguuauccuguuuggguaugugugcuacaguguguguguggaggucagauaacacuauaguugcuucccuccugccucugugugguuuggugaucaacuuagguuguguggccuuguagcacaauggaagugcaaagccagguuaucaggguugcauggcaaguaccuucacccacugagccaccuugcaagccucugccaucuaaguuagcucugacuuacaggcauacaacaccacuguuuuaugcagcacaggguuaacccaggguguuaaaugcugaacaaccccagauuccacuccgucaucaccuccaggucucuugaagaccugagccagcugcaugguccggacaaggaaggcagaggaggugcggugguugagcuuaaguuaaacacccauaugaauuuauuaaauccagacuguguuaaaggguggcggucugggagcaggguggucgggggaugagggacaagaugauggaggaccacaggcgucccacagaggagcccuggccccuuccccgccuggcccacccucggcgccauauuggcuucaccaugauucccgaugguguugggcuggcagggcgagaugucugcaaacacauaggaacagacggauagacaagacgauggacggugccuccacauacacacagccagccccaaccugcccggccccaucucacacaccgggcccuggcccugggggccuccugccgccccggccugaucuguccaggaagagggcgacagagaggguaagggaggggcccgggagguggugguggucagucaccaggagcagauaaggaggacugcaguggcuaauccuuuuucuuguccucugcuggcuuuggaggggcuuccuggggcuggcuggcagugcaggccccagaaguggccuuugggacuguggaggcauccucuccgcugacagcugugcugggugcaggugugagagccccugcugcaguggaugccugggcccuggaugccgcugcugagacauccucuccacucauaccgaacucguucacacggguggggucgacgcgguagauccaccguugguagagguagaugaagaaaaccacaucugggggaagggacugugugagggagauggcccaccgcaguggagaugaggcuccuccccgcccacuguaucccuguguccgcugggccuuaccaucccgcaggcagccgauccgguacaugacaggcaucuugaugacaaaggcaaauaagucaucaaugaaaguguugagggccuuguaggugagcauccgccagggcaaaugggccacagacuugagcuuauaguugaugaagagcuguggugucauagugaugaagccuucaggaagacaaaggaaccaugaccagcuacccaggcucacuuugcuccucuagcacagccuaccccagaucguugcauucucuuuccaacauuuuuuuuuccuuuggagacaggguguugggcuauagcuugggauggccuugaccucagauauccaaccccagcuucccaauuucaagcauuuccugaucuuuauauuaucucuccuggucaguucuggggacuguuaagcaucuuuccucagugggguuccuaaacuccaccuacguacacauuuacugcucugcccucgucuguacucaguacucauugugagugccugccuucucucugcacuuugggauucccccagcacauggauuccucucuguagaccuggccagaggaauccuuauagcucccuauucccaaggcugcccacacugggugggcacugucuggaggccagugagugccaggacagggcuuggcugcugugcuuacagaaagaagcaugagaacaugagccucagauggucugcaggcacagguccuagauguggggucaaggccaggccuggcagccagccccaaggcuguggccuacaagaaugaugggccuggaacuguguggacaugccuuccaggcaggguagagcugggccugcucaccaaaggucagcaggaaaccguagagcaugcugagcacccaggaguaccagcccuugugcuccagguacagaaggcuguagacggcauagcagcccagcaagggaaagaggauccaugacagguaccggaacgccaucuguggggugaugguggggugggggucacagaacaggccagcucugcgggcccugcucagugcuuccacuccuuguccucauccacccacaccugguccagcaggcuaggccaggggaauuuccagguggcucugggaacucuggacuuggccaggaaguagcuguggcaggcggggaacacagggugugauaugggccuggcagugauacuggcaggcaagaccaagggcccagccugccccugaugaguguaggugcuuggagaccaccccagggccaugggagucacucacaucaucauauacuuugguugaagauucaauauagguggacuugucuuugaagguugggcaagggaagauuccugccacucuaugcucccgguccagcuguaaagggaaagucaaggucagcugggaccuggcuccugccacuccccagccagaaccgcccccugcccuuccucacucuucccaguuccccugcccuaaugugaccccaaaaaauccccuacugugaaaauccccuagguccugagagcuaggcaggcauugggaaaccccccagagaccaaggcagguccuggcuaagcaggcgacccccuucccacccugcaagccccacagcaacauagagccugacucacccggacguccaugacuuugguaaucuuccagaggucgaugaggaccccaaugaagacgcugaccuguaccacaaaguuggucucauuguccaggauguaaaggagaaccacaaaggacuggaaaacgccaaagaagacggagcgcacugacagccccuccaaggacugacgacuguuccagaacugaaugucugcagaggaugugggcacagguggucagcagcuucuccugggcugcacuuucucccacaaaagcagagggcacacaggaccuuucccaaggucauaugggauaggaacacauguucccuuagcuggucaccugagggucaucagguguuaaaggaagcagguuagcugggaccauacauggggcuguacacccuugcauggcagaaccugggcagacaccagauccaaaucacacaaugccauccuaccuucccugcacaggaagauccagggugugugccuagggaccuucucuucuggccucccacucaaacugugagcuauccuuggggcacagacaaacccuggauuuuggucuccauguagacaccuggaggaccuaagcugacaacacccugcuauuucuggucucaucaagcuggaucacaagcauucagggauccuggcauccaugacucaggagcauggacccuggcccacauguccaaaccuggggcuuagcacaucccacucauaaggucauccaucccucaaaacaguggggaccuggcacaggggggcaaagucuagcucacacuugcugcuucccaaguguggccaaacuugcuccucacuaaucucuggcugggaacagagccagcaccucagagcaugguggagcucccuguguaaggccuuccaggagaggucacacugaauaccccucaaguuugcccacuauauucuucugggaugccagcuuccgcugcaaugucagugugacagaaguguccaucacuccugucaauuccagaagcuucaggggaccccccccaccccacacccccacuaugguccacccgccuagagcagcuggaaugagugcuguagcagagcugcgcaguugcaggccugccucugccucagcaccuggagcuggacauaacaauggguuguuccagaacuggguagcugcauguuggggccucccugucaggcagagugcugggagcagccccagggcuucccuuucuuuuggcuuuggaguuccccacccugcuuccuggugauaccacccuggccuuggcccaggcagcaggcccagcguaguucugugccucguggggucacugucccucuucagggcuccagcccucuagaguacagagaccccaggcacagaagaagcagggagcagauuacuucaucugcccguugccucaaugucccgggcccccaugccuaccauuuuugaaagccaggaacucaaagacacuguggacaauggagacgaugauggugagugccagaagauacgggcugguuuccagcagagcaaccuggggagagagccugugagcacugcucugucccugcuguggcaccucauuuccaagagccauucccuacauguuccuuggaaucccaaguaggaccucucuagagcugcuccagugaccauuagagagagugucacgggcaagaagaaaacaggagaaaguaaaugagucgagucgggagccggggccccagggugagcuaggguugggggguagggccgcuaggcagucgugaaacagucugggcagccuuggguaagauuccccacuuccccuggccuguggcgccccacacaccuucacugaauccugcuccucauccgauugcucauacagcucgucaccuaagaaguuccagggugacuugguacucugugcagcauagaguugccagcgccauagugacagcgggcagaaagagacacgcagugguaggcuggccagacucucauuaaugggguaguaauccuucugcagguuccaguagucauugaaauagaugaugggguaguagucaccacucacggcaucaaacuucacaucugugggcacauggagcgggcacugcucagccuggccaagacaccacacagcauuucuugacuguaccaugaggagcagaaggaucccaggaccucaaggaaaggaugcaguggcaaagggaguggcccugaaugaaggccaaugaagcuuguuuccaguacagcuuauacugguggucauauacccccaacucuauagaaaacagugagaaaccaggugugaccugacacccagaaacagcagccauucccacccacacuggccaggacuuggcuaaagaagagugugggaagagagaggacaggcauagagugguuaggagaguguggaacuaaaagggucucucacagauggggcugggggaagacaaggucacaggccugagcuucuggcucagcuuacauugguccaguggggguggcacacugcccuucacccaugguguguggucauccacgauguugauggugauguuggggugccagugcgagauuacuucuacagggccauaguccucagcccucuguggggagaugggaaaggagcaguaggccucggacaggcagaggcccccuaaauacuacugcuuaugcccucccaugacaacuggggcagaagaacggccacugcagcuauggcugguaggugcaggcugauacccaucaccuacaugagacucagauucaaccauccuccaccuccucaucugaaacaaggagaggcuuguggaggcagaggcaggcuacucaugcacaggaccaaaagcccagcccagagaaagcaccuuggcauccccucucagaguggcccuacuucacucugagaccaugccuccugcccaaagccagagagaaagguaagcuucuaugccuuuagagaagugcccugguuugcucagcccaccaggagccacagagcugaucaagucuacaacugcuccaagcuacggcuccugcucugcgccauccagcuacauggugucaagccagccucucuacuuguauaacuuggagcaagggucccaggugaaaagggcucagagccagaucuaccccaagggcugccugggcugaccugucugcagacuuccugcugcaggauucugaucucugaacuccucccagggaagugcucagaaguggcagucacuuggccugaccaaaacuugugcgcaacuagguaacaccaugauccccaauaacuccacuucuauuuaccuugaucauuucugggucagcuucugucucuccugucaguagguucuugguuuucugaaaucgccuacgcuuguauuuguugaucacugugggcagagggaggugggugaggcccgugaucccauggcugcugugccccggcuucccacuaaugauuauaucacuugggaagccucaaccaccccccaaauuucaaggaaccaccauuccaccuuuauagagaagcaccacuuauagauuuacccaggcagaaagcagagccucccaucucuaaaaccugcuuggccacucccuaaaccagcaaaggacacacaucugccuggagcccacaccacgccauugcucccuuccucaagaccuccuucuuacauggcuguggccacuguuuuucugcaacugcaccucacuguauaucuuaggcuggcccucagcuugaggacuacaggcaugagccacuucacuggcguucaccuccccaaggaggugauacggucccucuccuggacaggucauuuccaucacaacacauacccaccugccuccuaguucacccauauggucuguacccugggcucagggacagcccacugaauacauggccauacaugggggaguuagagaacgguucuagagaaggucuggcaccagcaacgugagaagccaacaugagaacuccaacacugugaauccccagccacaaguggacuuacuuccccuugcuaaggucaggcuagccaggguucucaccaccuugccugagacaagagcaaaggguugaccacacccucccaacuuagaagucacuagcucuuauucauguugagaaggaaaacugccucccuugcugaaccuaguggugcaagccaguaaucccaaguaguuaauggcugaggcaagaggaucaaggccagccuaagcaaccuagugaaagccucucaaaauaaaaccagaagccacuggagagauggcuuuuggacaacagcauuagggugcaaguacuuauauacaggcaaacacucaaauacauaaaaucaaauacucuuaacaaaauggauguggcugggcaacauggcacaagccuuuaauccuaguacucaagaggugaguucaaggccagcguggugaguuacaggccagccaggaaaguacagagacccugucucaaaaaaacaaaaaaaaauuuaaauaaugauaaaauggacuuaggauugucagugagagagcuccugcauagaauucucccaccaaggagcuuggagguauggccuauaaucaucuccccaggugcuagggauguggcucagugguagaaccccugccuagaaucccccagugaggggcugggggcguggcucagugguagagcccaugccuagaaucccccagugaggggcugggggcguggcucagugguguagccccugccuagaaucccccagugaggggcuaggggcguggcucagugguagagccccugccuagaaucccucagugaggagcugaggguguggcucagugguagaaccccugccuagaaucccccagugaggggcuggggguguggcucagugguaggacaccugucuggaaugucccuguaagaggcuugagggcauagaugacagcacagucuacagugugaaaagcccuagguuccaccaagaggcaaacaaaaaccagaaggccugugcugcugagcugccccauuccauccccacaagggagcagggagcauagagcucugggcuaggaucacauagcucuugucucccacaagcuaagggauguugguguauuaaugccacuuccuggcaccucaguaacuaucauggagaaugaggcuaaagccuacacuucuucaugggucaaagccuacaguuccuacaacauuaacaucauuccauuuuuucuugaugaacuauuuggaaacuagucccgcuuguccagcuggaguaacaagcaccugaaguuggguaucucagagaauaaacuccugggacauccuccaagaagggaagaggcugucaacaagcaacagacagggcugaugaaaacgggauacagacauggacacacauauucacaccacccacacaguagcuuacaaccauucauagcuccaguuucagagaaucugaugaccccugccaucaccagaaauguacauaguacacauacauauaugcagguauaauaucacacacauaaaauuuaguagauagauugacugauucauucuaauacgaaacugcucuaguccuaugggagcagagaagcccuguucuggaagaccaagcuucuaaagcugcugcacccgucuaacggaguugcagaugcugguaccacugggcauaagcuaugggugugauacagaauccacugacacuugucuccccacacaauguaaaacaccauacuuguccaccaacuccaugcugagauaaugaauucagcacuauuccuuugcuuugccugucucuugcugugaaguucgugcugccugugugggagcauuugagugugggcauguggaggccugagaaagacaucaguugcguuuuuguauauaccaaggaacuagggcucacugggcuaccuuggcacuugacaaggaugcuggggacagagacucugguccucagguuaaccacugaaccaucuaccuaccuagcuacuguuuugucugagauguggucuggcuauaugaccuggaauuuacuguguguguccuaggguggccuugagcucaccauccucucaccucagccuuacaagugcugggucaggguuacuaccagacgcugcucaguacacuucucaccauuaccguaauuaaccaagugguuuguuuacuuccgcacuaagacucugugcagcaggaaacuagaggcaccacccccauggacaaugcugcccccgcccuuaaucacuggcuuuuagaaaaaagaaggugccgggcgugguggcacaggcagguggaucucugaguucaaggccagccuggucuacaaagugaguuccaggacggccagggcuaaacagagaaacccugucucgaaaaaacaaaaaacaacaaaacaaaaccccacaaaaaaacgaaaaaggaaggcuccuuuucuuuucuuuauuucucucucuucuuuuuuuuuuuuucuuuuuuggugaugguaucacacaguccagcuggcccugaauucccuaaucagggaugaagaaugaccuugaacaucagguccuccccuaccccgccaauguuggaaucacagguuuauaccaccacagcugguuugcugcuuaagggacccaacccagggcuuccugcaggacaagcaagcacucugccaacugaguuuuguuuuguuuuuguuuuuuuuaaagauuuauuuauugauuauauauaaguacacgguagcugucuucagacacuccagaagacggagucagaucucguuauggaugguugugagccaccaugugguugcugggauuugaacuccugaccuugggaagagcagucgagugcucuuacccacugagccaucucaccagcccuguuuuuguuuuuuuuugagacaggguuucucuguguagcccuggcuguccuggaacucacucuguagaccaggcugaccucgagcucagaaauccgacugccucugccgaggucugggauuaaaggcgugcaccacgcccggcuccagcugcucuuucaaccucaguguucagugcuccauaucaaacucugaugagcugcuucucuccauugcagccaaucuuugugauuaccacccuccuuccgcucagcaguucucuaagcuccaccugcucuuucuuaacuguuugcuuuuucuaagccuaggcuggcuucaaacucaugacucugccucagcuuuaaccccucagcuccacagcuaggaucccggcuugcaugacacccagauucuccugcucucguuagcagguuccugggugucccagagcuaguaacaugaguggggccagugccugucucaucaauccugaguccagagcacagagcuccugccugcuccacaagaccugaaauggcauacaacacucuagucaggguucaccaggaccagaagggaaguuaacuuacuccgggacauguggacaguggcaagccggcgguacagggccuucugccgggggucuggauggaagccacucuuagugaaguagacauggauauagauggagccauucugcuguacacucugcaagagaaggugccuggugagugagguuuagaaaaggccaaggccacaugucaccugccuacaguagcuugcacuuacuuccaacucuccaacagcuuacugaggacucaaggcacagaggucagcugacugguucugucccaaaugcuggaguaaaacagacugaagagugggugccagaugaaccggacacucaguaaaccaacuguaggauguaggccauccaacacugcagcaaggacuggccagcccuguucuaacaggccacgaagcacauguuuacacuaaugagcccacaggaacagagcacuucagcccugcauugccacaggucaaaauacgacccuguugggccgaugaggcucaaagcuaauucacacccagggcuagagacaggcugcaagggagucagaacucagguuucugaaagccaguuguggcaaugcaugccucuaacuccagcugaagcaggaggauugagagucugaggcaagcuuaggcacaaggaagaccagauuaggauaaaacaaaagaaaacagagaaucaucaguguguggacuuguccaccuccacacccugugacaucccacugccucuccaaagccuuccuuauucccaacugccuaggacggggaaggaaaggagcaucugagcugagccugaugugugacugucacgcagagccuggcccacacagggcccuccaagcccaccagcugcuuuuugggggugaaaccugaguccccaagaccagcucaccggucccccaucuuuuccugaacuuccagaaagggccugaguuugacaguauggccauagcaugacuggaaucacagacugugucuguccauguagauccaaccacucagagauggggcauccuccccccuucccaaagccuacuggguacaaagacaagaguuccacgucacucaggagacuaagguuuacagggcuuggacgcucagugucccugucuaaaaacggggggcugaggucagaugugacagcacauucuuauaaucccagcagccaguucuaaaccaguuccugcugcacagcaagacuagccugcgcuacaugagacuaugagacugucucaaaaaauaaaauccuugggcugcagagacggcucagcaguuaagagcaccaacugcucuuccagagguccugaguucaauucccaguaaccacaugguagcucacaaccaccuguaaugggauuugaugcccucuucugaugugucuaaagacagggacaguguacucauauacauaaaauaaaaauaaaucuuuaaaaaaaauaagggcuggacagauggcucaguggcuaagagcacugacuggggcuggugagauggcucaguggguaagagcacucgaaugcucuucccaagguccagaguucaacucccagcaaccacaugguggcucacaaccaucuguaacgagaucugacgcccucuucuggugugucugaagacagcuacaguguauuuacauguaauaaauaaauaaaucuuuaaaaaaaaaaaaagagcacugacuguucuuccagagauucugaguucaauucccagcaacgauauuguggccuacaaccgucuguaaugggaucagauacccucuauacucauauauacacuaaauaaauaaaucuuuaaauaaauaaauaaauaaauaauccaccaggaggugguggcacacgccauuagucucagcacuugagaggcagaagcacaugaauaucugaguuugaggccaugcuggucuacagcgugaguuccaggacaacaagagcuacacagagacucuaucuagaaacaaacaaaacaaaaagauucaaaaaauaaaauccaaggacaggggcuacaguucguacaguauuuauguagcacacaaaauagaugcuuuauauucaauugccaacaauggaagaaaaaaaagaaaaacaaacaaaaaacaacaaaaccugcugagugcuuguauguguccagucugcugcagagugauggggauagacugcaaagcccagucuuacccuccuaagcucaaggauugugaggaagagcugagcuuaugcagagcacccagcaugccucagaacucacagacuacagaagcccaaguggcugugagcauggaaaacauacuuaaacaagcugaggaggccuuccugggaggcagagcccgagagcaaaagcucucucacuugcuguugaccuggagaacguccccacgcugcugcuaaccccaguuucaucucucacacacacagcacaagcagcaguuacgugagacaguaacaguuacacggggcaguaaagcuuuuuguuuuaagacacauccuccuauaauucacagcuugccuuugaacgcaugguaauccugccucagcugucugagugcuaccacacucagcuguaacacuucucaaguuuaugggguauagacguuuccacauaccaaccuggcuugggcucugaacagaaaaugcacugucacuguuuauucaaauaaccuggaaacuaugccuuuggcaucacugugcugaguggaccccucuuggacagcuacugauggcugaccggcuaaaguugggaaccacaccacacuagaugguuuggaggacacaggccgagaugggcgaauugugggcaggaccuaccugugggaugucaagcucugcaaagugcucguagcagccaucagaguucucuccacugguccagucaccauacaccaggucaugcugcucccagaagagcgccgagguggcguugaagucugugaagugcucgugcucugagauguacacgugcagguucuguggaaugcagaggguguugggaccauggucagaugcuggcauagaaacugcucaacucaacuuuggcuuuugcuguacgccggcucugcccugaacugugacaccaaggagcccagacuaccagugaugaacuuaaggacaaggggaagcaggaccaccacggaugaccucccaguuggaacuggacagaucuggggcaaagaagucaagcaucugugccucagaaggggaggcaagcuuggggagccuccuccuauuggccaaggcuccugccaaccaucccuaucccuaggauccguuacuugacaguggccugcugacaggcaccagagcuaagcagagaacagaaaggacuuggaagagcuuggggggggggggggggagucugguggcugugcuguuagcucaggaaccugaacugaucccagucacccugucacccacauccacgagagccaaacauguuucugaaagaaagcacccggggacccuguugcaauaggugcacaacaaccgggaagucuacuguacaagcuccccagagaccuguuuccucagugucucucggguagcacaagucaccugcccugaucggcuagagcaucugggaccaugcgucuacagagcugaugcagccgggaacugucccauccugccuguccucaccauaucacugcccccagcccucuacuugccuuccacccagcauuaccauuagagugucuuuggggaauagguuucggcuggcgacacguggggccccuccagggccugacugguccugaggggacggcccucggcggaaccagcugcugauggcccagaugaugaagauccugaggaaggaagcaggggcaaguaaguccuccgcccugugcuggagcccuugugucagccuccaucccggacacccuuacgcucugaggucugaggugucugagaaggcgguggggagccagugaagacacagugcccuugcaggacagaggcucaaggagccccguacaagcacagggucaccuuguucccuccaggaucucaugucaugcaugggccacagggcuuagccacucaaacucaagaguugggagaucuaaggcagucaaggugccccaggcuuugguagccuaaugauuauccaaaggaucuagaaucuuccuacuguacuguaagaaaccuuaguauaauuacuuucccguuucaaucgaagacuaaagaagcuggagguaguggguuagccuuucagccacagaaaagccagguuuuggugguggugacuacgguuuuucauguuagccaacuguucuaucuaccacagacccauacccacagcccaucacuggggguggggguggggguggggguucuagacuuuagcacuuaaaaguauccccagauauuuuauuuuuuuccuuugcagcaaggguccccccccaccuuuuuuuuucccgagaaaggguuucucuguguagcccugacuguccuggaacucacucuagaccaggcugaccucgaacucagaaaucugccugccucugccucccgagugcugggauuaaaggcgugcaccaccacgcccagcuuguuuuguuuuuuaagacaggguuuuuccagggcuggcgagauggcuuaguggguaagagcacugauugcucuuccaaagguccugaguucaaaucccagcaaccacauggugguucacaaccauccguaaugagaucugaugcccucuucuggugcaucugaagacagcuacaguguacucacauauaaauaaaucuuaaaaaaaaaauaaagacaggguuuuucuguguaacugcccuggaacuugcuuuguagaccagacuggccucaaacucacagagaucugccugucuuugccucccaagugcugggaaucacuggccaauuuuaauuuuuccaauuaagaugaaacaaagaaaaaacuacagucaauaaagcuuuuuuuuuuuuuuuuuuuuuaacaaaauccauuacuacaguaaaagagccaugggaacagcaugcaguucagucgucacaagcuucccuagcacaugcaaggcucaagguucuacucuaguaacaaacacacacuauaucaauauauucuguauuugcaauacugucauagcaagacuacugucucuaucuccauuagaagagacaaccaacaagaagaaaaucuguaacuggacuugguaacaugccuguaauucaggagacuagaacagaaggcuccuuaagcccagagaggcaagaccagcuuggguaauacuaucacaccaucuucugaaaaagaacggcuuggacauuagguugggcagcaagccccagcaauccuccugacucugccuccuaccaccaggguggagguuucagacuccuucaggcacacaugggugcuagagacugcacuaagggucuuaugcugcgcacugggccaucuaccaagcccuggguuggcuuuuugaggcagucucaguuuguagcagggcuuagccuggaauguaaaauccuuuugcuucaggcucccuacuguggggccugugcguauacugccaacauucacccccagguaagacuguuuccuuuccagacagggcuucuccguguaguccuggcuguagaacucccucuguagaccaggcuggccugaaacucaagaucaccuugcucugccucccugugcugagacuaaaggcgugcaccaccaccacccagcuucaggcaagacugcuaagguuuuguggccucugaaguggggugugaagaacauacagcuggcugcacugaguugugauggcauuaccagcacaggagcagggcgcccaccccaugccugcuuucccugcuccugcuauuucauugggggaaauaggcaugugcagcucucagcucagcguggagcucaaaugcagcacuguccuggcaugcacaaggcccuggguuucaaaccuggcacugcaaaaaaaaaagaaaaaacaaaaacaaaaacacuuaaguggaaaaguacugagagugauagcucaguggguugguaccucccggcugagcccuauuagggcaggacugggcacaaggacuugccucugccuguugaaaccaaggagcccuggggucuggggucucaggggcugcaacccagcugagccaucugcuccccaaugcacauagcugacaaaggucuggaaccagugcucccuggggaccccugcugcuuucaugggaagcucccacuuugguaaauacuccaaggagagugugggagcagcaucaccccgcucagagggggcccauuggauccucagcccucuagccuucuguccccaugcgugaaacaaggcaagcuagaacauauacuuucuaggguuuggguccuagacaucuggagugcaugugaggacagguguacaucaucucagaagcccucucagagggcuggugggacgaagaaaguccuucuucugggcacccacgccuacagggaagagacugucaaaugaugagaguaaagguagcaugucagcucaugccggugauuccaacacucgauagauaagagggcuacucaaguuucaggccagacacaacaaaagaaaaacuuaagaauuaaauucucuaccccauuccaaauagccuuuguugcaggaaugggggguugaguuggagacagguuuuucucuauguagcccugguuguccuggaacuagcucuaguacaccagcucaaacugagaaaucugucugccucugucuccuccugagugcugggauuaaaggugugcaccaccaccacccagacaguccaaauaaauguuuuuacagauagaacaaaguucaaaaagcuuauaaacaaauguagauaaugauagcucagaauuguuaauuccaguaccaggaggcagagacaggaggaucccugaaagcuuaaaacuagcuuagaugacagugaguuuaaugcagucagggauauaaauugguaucucaaaaaacacacaucgggccgugguagcgcacgccuuuuuaaucccagcacuugggaggcagaggcaggcggauuucugaguucgaggccagccuggucuacagaguuccaggacagccacagcuaccuuggcuggguauaguggcacacaccuuuaaacccagcacuagggaggcaaaggcgggcagaucucuaugaguuugaggccagccuggucuacagaacaauuugcaggacagccagggcuacacugagacucuauuuggcacuacuguguuauuucuagcuauccuagaacuuacuauauuauagagcaggcuggcuuccaacucagagauugguuugccccugcuucccaaaugcuggaacuaaaggcgugcacuaccauacccaaccuuggggcugaagagauggaucagugguuagcagcacuuguucuccuccuuaacuacugcggcucaguuccugauacccacacaaggacucacagccaucaguuacuccagcucuaggggaucugacgcccuuucugacuucugaaguccccagguacuuaggaacaaagauacacacacacacaggcaaaauaaauacuuauacacauaaagccauguuagaaugaaauaaaggaagggagggagggagggagggacgcaaacaaacaagcaagcaagcaagcaagcaagcaagcaagcaagcaagcaagcucgcuccaaccaaccagacauacacucugacaaucacagcccuggagagacaagguaggaggaucacagcaaauucauggucagccugaacuacagacugcggacauugccucagaaaagcaaaaaggugccuugaauuccagcacccagcagaggcaaggggauuucugugaguuccagaccagggaguuacaugaugaggcccugucucaauacguaaauaaauaaaaaaauuucaaagcuagcacuugugcuauggauggcucgucauaaagugucucacuaugcgggccuggugaccaugugucuuagaguuuuauuucuguaacagacaccaugaccaagacaaagcuuauaaggacaacauuuaauuggggcuggcuuacagguucagagguucaguccauuaucaucaaggugggagcauggcagcaugcagguaggcauggugcuggaggagcugagaguucuauaucuauaucuucaucugaagguugcuagaagacuggcuuccaggcagcuaggaugcgggucuuauaguccacacccagugacacaccuacuccaacaggaccacaccuucgaaugccacucccugggcugagcacauacaaaccaucauaccagguauaauguaggagaaaacaaaugccacaaagcuguccucuggcaguuguccauagcagcaugugcccgacccccaaucucacauacaaacaauaaauauaauaacuagaaaagaagcucugugccuaguauauuuggggccuuuuguuccacucauuguagcacacacgcagaggacuucagaagagauagucugugagcaggcacccacacccaccugaugucugcugccacuagugcuaaggaaggaagugagccugcagaggcuggaucagagccccugggaaggaagcagcccucagcaccaacaugcagauguccagauaugcaguuaaugaaaagcacugggaggugcugcuggcugugaggaaaugaaggcgaggaccugagagcugacugcccuguccugucgcuuggagcaugaaaacaaaaagugagccagacaugaugguacaagucugugaucuagcauucagggaguguaggcagucccaaguuacaggacaaccuaagcuacaaacggagacacuaucucagcuaaaaggggucagggaugauggacaagaccaccuaaggaacuaggcaugaggcacacacaaaccucuggauuugcuccacagcaaaacuguauaaccaagagaguaguagggccuaaauaggaucaaaauacauuauacccguguaugcaaauguuacagagaaacuacuauuguauauaaauaauauaugcuaauaaaaacuuuaaccccaauaccuaggaagcagaggcagggagaaucucuuggaguugaggucuggaacucacucuguagaccaggcuggccucaaacucaagagaucugccugccucugccucccaagugcugggauuaaaggcgugcgccaccaugccuggcaacauuuuuaaaaccuaaagaauaggcccauggauggcucugccaacugggcccuuaccaccaaggcuaaggaccugagcuccauacccagacgcuacauggcagagagcggaacacacucacacaguuguucuccuaccucuacacgcgugccgugccauuuacaugugcaucaacaacacgcaccccccacccuuccacccccgaaauaaaagaaaacuugaaagcacaggucagggcaggcagacaggguaaggaacagggcuccauggcugagaggccugggcacaaacggcaggacaccuaggucuggggcugaacaguaccugggagccacaggcagggaguucugucccccaccagaaugugccuagagacagaaauggagaucaugaaaucuuuuuucuuuucuuuucagugcugggaagauaccccaaaguucaaacaugcuggaggagugcuuuagugcugagccauacccacugcagacuagacucuucuaaaacagcagucaugacuguaugacucuuuuugucacacacaccuccuucugcugacagguuuucauggaaucccuaggauaagcucagcauaggacuuccacuugaagugggagcugaagcacgagaacuagaacgagaggcugggaauggagugugguuggcagggcaccugcuuuggcacaccugaugcucugaagggcauucccaguacaacacaugacauacugaaugguagcacaugccuauaauugccauguaagaaaacuguaagaaguggaggcagggggauagaaaaugggggccauccucugcuauaaaucugaggcuagcuugaauuaccugagacuauacauuuaaaaaaagaaaaggggcgugguggcgcacgccuuuagucccaggacucaggaggcagaggcagguggauuucugaguucgaggccagccuggucuacaaagugaguuccaggacagccugggcuacacagagaaacccugucucgaaaaacaaacaaacaaacaaacaaacgaaggaaggaaggaaggaagcaagcaagcaagcuagcuagcuagcuagcuaauaaagguggauguaguagcaaaggucuggaacaccagcauucaagaugcucaggcaggaaaacugucccaaguucaagaccagccuggguaacgccugucaaaaacaaaacaaacaaaauaaaacaacaacaacaaaaagggccagcaagauggcucaaugaguaaagacacuugcugccaagccugacccugagucugaucucuaggucuuagauggagaaaacugaguucugaaaacuguccucugaccucugaaugcacauacuuacacacgcuaacacccccaccugcaccaccaccacccaccugcccauauauauacacacucacucacucacacacacacacacacacucacauacacaaaauacguuuuaaaauacaaucaaguggugguggcgcacacguuuaauccuagcacuugagaggcagagguagaaggaucucuugaauuggaagccagccucgucuacagagugaguuucaggacagccaagguuaaacaaaaaaacccugucucaaaccuuccuacaaaaaaaaaaaaaaaaaaaaaaagacaaaaccaaacacagccaggagcgguggugugugcuuuaaugagaugcuagugaauaauguuucuacgucuuagcugcacucccugacucccucaacauugucagucaagccuuuauuuuagacaaaauguugguuguuccuaaugucuguaaauauuaauacaucugcuagaccugguagcucacaccuguaaacccggcacccaagaaguuggaacaugagggcugucauguuuaaaaacugcacuagagagugagaccuuuuuucaaaccaacaauaaauuccugcaucuccacugaauaaauauaaacuuuuauuaugauuagucucguaugagccaagaggaccacugcaagagucacaggccagcaggggcuacacacugagucuguuucuaaucaacaggacacuaaacuuacuuuuaucguuagccuaaggccaccgcuaacagagcacacaaaugugucccacauacuuaggaugucauuuuaucagugacuugagcauuugcucagcagcuacuuaguacacacuaaagggcacagauguaagauuccuaaauuuaaggggaaaaucuacuaaggcagauucucucucucucucucucucucucucucucucucucuuuuuuuuuuuuuuuuuuuuuuugguuuuccgagacaggguuucucuguguagcccaggcuguccuggaacucacucuguagaccaggcuggccucgaacucagaaauccgccugccucugccucccgaggucugggauuaaaggcgugcgccaccaugcccggcaaggcagacucucuuaauugccuguauaaaaaucuucuccccuuccagugccuggugagacuccauuucucaccauacaaacugaguuuucagccagacuccuugggccucuguccuuucaguauuugagaagccgaagcaggaggaucaagguuugaggacuugggccagugaacuggcucagagaguaaaggugugugcuaugaagccugacccucgagcaaaguuucacucccacgaccacauggucgaagaagaacugacuccucaagguauccucugauguccguccacacgugcaccuugucauguacauacuuucucacgcccauaaaguuaacaacucaauguaauguaagagcucaaagccugggcuggagagaugacucagcaguuaggagcacuggcuguucuuccgaagguccugaguucaaaucccagcaacuacauaguggcucacaaccaucuguaaugggaucugaugcccucuucuggugugucugaagacagcuacaguauacuuacauauaauaaauaaacaaaucuuuaaaaagaaaaaaugcucaaggccuccguggacuacacagugaguucaauccagccuggcagcggagugagacccugucuugaaguuagggcuugauguauggcucagaaaggaugucuuucaucccagcacuuaggagacagaggcaaacagagcucugaguucaaggccagccugaucuacagaguaaguuccagaagagccagggcuacauaauagaaaaacacugccucagacaaagcaaaacaaaaauagauaaguaaaacaaaaccauuuuagucugaauguuguccaggagggcucuuagggguucagcaacccccauuaaagaagguggcugcuggggugagaugaugagaggcuauggcuuauccacaagguccuucucuggcacacagguccugaggccccuguguacgcagccccccgccccaauguagagaugugcuaucccuggccacuguccccucuccccagcauugcuuugugcagagugggaacccuaagccuucaugcucaccugaacagaacgccuuugaugaccugccaggcguugggggcuggcugggguggaggguucugaggcugggucucggcuggcgugucccucccaaugcugccauugcuggucaccuguggggggaauagaguaggguaaggggggcugauuaggguacccugaguucagaggccaagacuuugucaaucuucagagaaggcacaacaguaguuuccagcuagaaagggcuccaaaggaaacugcuccccaaggauaccgaugcuggggacaguccugagcuauggggaccugucuaugagcaccaacccaaagggggcagcauuggaaagcaggugcuaauagggagcuguggccaggccugaaacucagguacuaagaauuaaaucacaguugugaacuggagcagggagcaagcacagaugcagccagcagcugagggacagucugacacugugagcugagcacuguucauggagggcuguccuagggcccugcagcuggcuaccacggaaagcuaggacugauccacaagauccuucccuaggcaugagggcucugagccccugcucuccagcucuccagcagcggccgucuaacagugagacagacagacuggcgcagaaccucagcaccgugagcugguauacaagcauccauccuguacacccugccgagcaccaagcucugaauauagcugcacucuccaacugagcaaacaaaggcucagagagauuaagauacuugucuggguuacucaggagcaagacaccaaagagaaagaaucagguggggauaaaauggaaagaaauuaucucucgccaggcagagugacacaugccuagaaucucagcacuucagucuuuguaaaaccaggaggugcaagaguucaaaguaugucucaaaacacaagacagcauaggcagucucaaaauacaacaagaauucucucagaagcagagacucacucugacagccaggaaggagagaguccagagcagggccauuuggaagccucucucuggacacugcuggcuccaguccuguguuagucucucccaauggcuguccaauccugucagucuucaaaagguaggaccugaggacuacagagauggcucaguagcucacagcacaggccgcucuuucugaacacuaaggucugguucccagcacacacauaguggcucacagacaucuguaacuccagcuccaggggauuuaauauccuuuucugaccuccauaggcacugggcgcacacauauacacauauauacaugcauaugaucuuuuuaaaaaggggucgaggggaggcagguuucacaccaccaugggcauagcaaagacucagcaccugauccacacuuguaaagucagcacauacagugccacccauacccacuguccccaggcuccacugcccagccaucucgcccaggacccugaccccaauccugcccaucuuuccuuauugucccacagcaggaaacagaacagccauggagcagggcagguguugauugcuaacucucauccccauucaacaagagcuccuccuuguuaugugcaagacagcacugucgaggugacagggaggggaugacgcuuggguccaguagaucucagcuguaguucuccccacuguucuugccugagacaccuuagcaugacauuaggucggucaccccuucugccugagaacagacuugugaaaaccaugguacagaauaaagagaaaugcucuccucauggguucccaggccuguucugcauaccuacugugugccaagcauaccuacuguacacauacccugaguuaggugguaacuauuaagcucaggagcuugguggcccaggcuaccugcagaacagcagauaguaaaucaugggcuggagagauggcucaguggugaagagcacugacugcucuuccaaacguccggaguucaaaucccagcagccacaugguggcucacaaccaucuguaauaagaucugacgcccucuucuggugugucugaagacagccacaguguauuuacauauaauaauaaauauaucuuuuuuaaaaaagccgccauguacagggcagacgccuaaaaccccagcccuugguaggcagaggugagagaauaaaaagacaaaacaaaacuacugucuguuuaccuaccuaccaaucaacuauuuaccuaucuaguccucuaucaucuaccuauuuacgcaccaaccaucaaccuaucuucuaucugccugauuuugcuuacuuuuuguuuuuacaagacagggucucucuguguagccuuggcuauucuagaacucacuccagacuggccucaaacucagagauccaccugccucugccucccaagugcugguauuaaaggugugugccaccacuggccggcucuauuuguuuuauuguuguugguggugguggcgguggugguuuggggagcgguuguuuuuguuuuuucaggacagguuauuucucuguguaauagccaguaaaagucuagguguccuggacuugcucuguaaaccaagcuggccucaaacucacagagaucuaccugccucuagcugggaugugccaccacgccuggccuuaucuaucugucugccugugugucuaucuguuuuaagguuaauauacaggcaguauuccagugacugcucagccauucauaugguauacucaauguucuuccugaaauauguucuggagaaauaagcagaaggugacagccaccaggacaaaaguaggaacccacaaagacuggaaugacaucucaaugagucucucaggcugaaacagucacauggggaagccaggaaaagguguuuuaacaaugggaaaaguaugagggccagcagacauguccagcuauaagguccuuacccugaggaugcugaguuuggucagguuucuagcaagucuggauagauucagagucaggaagagaaguggggaccaggccaggauuugaagucacaccugacugcuuccaggucucguccccuacagugauggacaaucuagcugggaagacucccacaggcaagcagaccaaauccaugagguacacuccuaguacccaggagcacggccacagucagaaagccccucaaagugcugcuggcaugugaggagacagggguggcucucagcuauugcccaccuagacuuauggcucaguacuccccgaauuccggauacaccagacccugggccccauccccaguacugagaaggcaaggaagaccccugagucaagagacgggaaacucacacaguagcucgugacuaucuguaaucccaguuccagggaucugauacccucuuucuuucggccuccguguguaccagguaugcaugugauacaugugggcaaauacucauauacgagaagugaaguaaauacaagcauuucucuuuuucuucuuaauguuucuuuuauuuuauggggagguggggacacaugccacaguacauguguggaggucagaggacaguuugugagagcuggcucuguacuuuugccauguggguuccaggaaucaaauccaggcugacaggcuuggcaaugcgcaccuuugcccacugcuccaucucaucggucccuaaaccacuuuagagugugaauggacaagaacacgugcccuuuaaaaaauauuuaugggggcuggagagauagcugaacgguuaagagcacuaacugcucuuccgaaggucgugaguucaaaucccagcaaccacaugguggcucacaaccauccauaaagaaaucugaugcccucuucuggugugucugaagacagcuacaguguacuuagauauaauaaucaauaaaucuuuuuaaaaaauauuuuuggauaugaguguugugccuacacguaugucugugcaucauguacauacccagugccugaagaggccagaugaggucaugggauuccauggaacggaguuacagaggguuaugaaccaccauguggguguugggaaucaaaucuugguccucuggaagaacagucaaugcuccuaacuguugagccacccaaagauuuuaucugucuaucuaucuauguaucuaucuauggcuaaaugcuuuguuuuuugaguuagggucuauauagcccuggcuguccuggaacucucuaugcagaccaggcuagucuccaacucaaagaucuuccugccucugccuaccaagugcuagaacuaaaggcguacaucaccauuguccagaauuucuuuugaauugugugcaggcacaugguguauacauuugaaugcaggugccccggauggcagaagagguggcugagcccgagcuggaguuacaggccgugacugugaacuguccaaugugggcagugggauugaacugcaagagcaguccgcccucuuuuaaugucugagccagcucuccaggcucugaaaaaaauguuuagcugguaugauggccuacuccugcaauccaagcauccgggagacaaacuccaaagaucucugugggucugaagccaaccuggacugcauauggaguucugggucaguuaaggcuccauacugaaacucugucucaaauaaguaaauacauaaauacuuacuauuauuguacauguauggugcauaugugugaacgugugugcuccuucaugugugcgaaguucagagacauaaaguucucccucaaccuuuaaguagacuccagggaucaaacacgggcuaccaggcucaucuggucuccguuuuauucuacucaucuaucucaacagccuucgcaaccccaguguuuucaacugcgcacaccuguaaugccaacuuggaaaggaauggcugaaggacugacugccuuaagucuaaggccauccuagcuuacauaugugauccucucucuacgacacaguaaaacugguuggugugcacgccuuuaaucccagcacucgggaggcagaggcagaagguaacagagcucaaggccaaccuggucuacauaguccagaacacugagagcuauaagagagacugucucaaacaaacaaacacacaccaguaaacaggcuggagagauggcucagugguuauaagcacuugcugcucuuacagaggaccagucugguuuauuaacaucuauaaucuauuccaagagaucugaccuuuugcacgcaccagguaaacauguagugcacauacauacauacauguaggcaaaacacuuaaacacauaaaucaaucuuaaaacaaacaaacaaaaggacaaaaccaaacugcuucuguccugcauuuacagacuuuuuacugucacauccuccuaaccaacacaaccuagcagugacuuccacagcauuuccaccccucugggcaugggaaagggggcaugcagguuacauguaaacauauucuacaagagggacuugggcaucugagauuuugauacugacagaagggaacccuggaaccagcccccagagacgacuuuacccauaccaaaccgaugcagucacugcagaguguaucaaaagccaccacacuguacacugucauccgacaaauguaaagguaucuaaguuaaaccuggacagagaggugacccuucuagggcuccccuugccuucaacgucaaagcccacuccucacagagccuggcauacaguugccucccugcuccucuggccacaugcuuagcccaucuagugcccuuccuaacaccaggcaccuucuaccucagggccucugcacagucgacuuccaugacaucaaugaccuuuccuuuacaggguugugauucccccugucccuucuucagaucuuuauagaguaccaccuucucugggaugucuuuccccaagaccuuuuugagacgggcagugguggcacacgucuuuaaucccagcacuugggaggcagaggcaggcagauuucuaaguuugaggccagccuggucuacagagugaguuccaggacagccagggcuacacagagaaacccugucuugaacccccccacccccuaaaaaaagauccuauuugaauggcagcuuucccacauacccacugcucacucccuacacacuccagcuauauaucuaaguuucuaccaucuguggccagguauguuuuuguuauugugucucuaucuaugcuuccccaccucuuacuggagacaugcgguccaagaaagcagagccuguucuauccacugccuguaucagcugagggaaugagugcggggcuagccugaagagaagcaggcugcugggacacaggcuccaugcuaagccagcaggcuggagaggguggcagagaaugcgaaggcaguagggaggaaagcacagcuccugcuugcucuugccucuguaucuugaacucaaagacccuccuccaggaacacccaccagucugguaaauaauuacgaccacuuacaggaccauguccucaaggacugcucagauucaccaugaccaccucagacucuaucucagcacggccucugguucagcaaccauucacugcugcagagaugcgucaggguagagcaccugucagugaugggcuagggcuguagcucagugcgggacuugauaggcaugcaggaauccugggaauucacugccuagaccacuaauaaaacagaacaaaacaaaacuucuuccaacuuaccaucucugcccagccuaagcugggggggggggggggggcgcuagagauacaguacugaccaaaaguccaguggaggagacagacacaacacacagugggcaggcuggcaggcugggccaucagauaggaugugaggaugacccagucugggaggauuucuuucuuaaggaaacuugaggccugagaccuaagaaucaugucaggaagcugaggcaggaggauucucagucugaggcuggauucacuccauggugagacucuugucuucaaacaaaaccaaaaccugcccauccucacgugauccugcacgugcaguguguuuacagcugccccggggugaggacugugugaacgagcagaaaagaagacccgagagagagggaagaagagggaagacaggccaagacuccaaggaagaagacuggaagcacucacucuagugggugagguucacagucgaggccauucuuccagucagcuggcucuccagcgcaggugauucugucuccaucaccccugcccccaccccgagaacauuuagaaacuucuagagacauucuugauugucaggccaggaaaggguacacaugcuacugacauaaguaugcaaauaccauacuuaucacugcacagggcagccccacagugaggaauuugccaacucaaagugucaauaccaagguguuuuuaagcuggacagugguggcucacagcgguauucccagcacuugggaggcaaaagcagguggaucucagaguuccaggccagucugggcuacagagugaguuccagaacuauaaaaacaaacaagccaggguauaaugggcacaccuuuaauuccagcacuugggagacagaggcaggcagaacucucugaguucuagaccagccagggcuacaaaaacgugagauggcuacaaagacagucucaaaaaauuaauaaaaacgaaaaggggggagagaaaaagaaaaagaacaaagaaagccuagucuagucuaaagaaaauaguucaugccagaucuugaucugcuuuaaaaaaagagaaaaaagaaaaagaaaaaaaaaauguguacuuuauccugaaggccaaaguaugagcauuaaaacuuuucaagcauaagcuaggauuagaaguagacugucaucccagcacuugggaggcugaagcagaagggccaccaucggcccuagcuucauaggaagacccugaccaaagucacaaagcaaagauuuagagcagagaugggaaccagagaggcuccacaugugacuggaagcucaacagucucucacgccacugccacccaauaaucaacagaaacuuacaggagccagucccaaggaccagaggcuaggacgucccugcagaccccgcugguguauucaccacagcagggauaaaccagcaauuuccugagcugugugcacccaaggucugguuggaaaugccagaaagacucagucagaaaagguggguucuaccucaucacuugaguguaucugucccccuccuuugagacccuacagccccucaucccgacuucugucacuucccgagucuguuuacgcuaccaucuccucucccacuccccucacugcagggacaugacuggagacaucuuuauagccauaaggcuggcccucucgcccaaguccuccauuaaccacuggggaaauaaagacccaaaggaagaaaacuuguccaaggucacauccagucagcuacaugcaccccucccagucgguacuccucaccccugagcugccuccuacacggcagugacaucccagugggugggucgacagcaccuugcuuccacuccaucaauuccagcagaagccugcacggugccugagugaacugcuaugcucugaggucucaguuuauuugaggugguaauggguugggaggcaaacgcgccuggaucaauuauuucucuauuuauuugaucagcuugggcuaaaacagcgcccaucucagcccagaccacccacagucagcuuuuuccuagaacggacaccaaaacuaaccugggugaccuucuacaagcgccuucgucuugucgucccucggauccuugucugugaaaugggucggucggccuccgcagcccaugcccucuacccaccacaauuaccguauuugcccugagcuugaaaacucucaauuaaccaaccacugcccccgaucucgggcacugcggagcggaccaggaacaccagcccucucuagaaacagugcuggaggcuggaaccacacagucgaggaccgagucugcgccccuccgcgccacccucuccuccgcucgagcaaggaguccgcuggacgcccggcgcgagccugcaggagacccggcgcgcaacagggccggguucccgccaccguccggccuccugggcggccgggcgccgccagggcccaauauucaaggucccucuggggcauggagcccccggugcaccggguuccuccaaaaaggacaagacacucccugcaggggugccccccgcuggggaagagcccccucaggcaccucucggccuccguaccugaccagagcugccucccccggccgccaccacggcgcugccggccccguccgccuccugcgccgccgccaucuuccugcuccggguccccgcccccgccg

SEQ ID NO: 3607 - RNA, 33465 nt, Mus musculus
cggcgggggcggggacccggagcaggaagauggcggcggcgcaggaggcggacggggccggcagcgccgugguggcggccgggggaggcagcucuggucagguacggaggccgagaggugccugagggggcucuuccccagcggggggcaccccugcagggagugucuuguccuuuuuggaggaacccggugcaccgggggcuccaugccccagagggaccuugaauauugggcccuggcggcgcccggccgcccaggaggccggacgguggcgggaacccggcccuguugcgcgccgggucuccugcaggcucgcgccgggcguccagcggacuccuugcucgagcggaggagaggguggcgcggaggggcgcagacucgguccucgacugugugguuccagccuccagcacuguuucuagagagggcugguguuccugguccgcuccgcagugcccgagaucgggggcagugguugguuaauugagaguuuucaagcucagggcaaauacgguaauugugguggguagagggcaugggcugcggaggccgaccgacccauuucacagacaaggauccgagggacgacaagacgaaggcgcuuguagaaggucacccagguuaguuuugguguccguucuaggaaaaagcugacuguggguggucugggcugagaugggcgcuguuuuagcccaagcugaucaaauaaauagagaaauaauugauccaggcgcguuugccucccaacccauuaccaccucaaauaaacugagaccucagagcauagcaguucacucaggcaccgugcaggcuucugcuggaauugauggaguggaagcaaggugcugucgacccacccacugggaugucacugccguguaggaggcagcucaggggugaggaguaccgacugggaggggugcauguagcugacuggaugugaccuuggacaaguuuucuuccuuugggucuuuauuuccccagugguuaauggaggacuugggcgagagggccagccuuauggcuauaaagaugucuccagucaugucccugcagugaggggagugggagaggagaugguagcguaaacagacucgggaagugacagaagucgggaugaggggcuguagggucucaaaggagggggacagauacacucaagugaugagguagaacccaccuuuucugacugagucuuucuggcauuuccaaccagaccuugggugcacacagcucaggaaauugcugguuuaucccugcuguggugaauacaccagcggggucugcagggacguccuagccucugguccuugggacuggcuccuguaaguuucuguugauuauuggguggcaguggcgugagagacuguugagcuuccagucacauguggagccucucugguucccaucucugcucuaaaucuuugcuuugugacuuuggucagggucuuccuaugaagcuagggccgaugguggcccuucugcuucagccucccaagugcugggaugacagucuacuucuaauccuagcuuaugcuugaaaaguuuuaaugcucauacuuuggccuucaggauaaaguacacauuuuuuuuuucuuuuucuuuuuucucuuuuuuuaaagcagaucaagaucuggcaugaacuauuuucuuuagacuagacuaggcuuucuuuguucuuuuucuuuuucucuccccccuuuucguuuuuauuaauuuuuugagacugucuuuguagccaucucacguuuuuguagcccuggcuggucuagaacucagagaguucugccugccucugucucccaagugcuggaauuaaaggugugcccauuauacccuggcuuguuuguuuuuauaguucuggaacucacucuguagcccagacuggccuggaacucugagauccaccugcuuuugccucccaagugcugggaauaccgcugugagccaccacuguccagcuuaaaaacaccuugguauugacacuuugaguuggcaaauuccucacuguggggcugcccugugcagugauaaguaugguauuugcauacuuaugucaguagcauguguacccuuuccuggccugacaaucaagaaugucucuagaaguuucuaaauguucucggggugggggcaggggugauggagacagaaucaccugcgcuggagagccagcugacuggaagaauggccucgacugugaaccucacccacuagagugagugcuuccagucuucuuccuuggagucuuggccugucuucccucuucuucccucucucucgggucuucuuuucugcucguucacacaguccucaccccggggcagcuguaaacacacugcacgugcaggaucacgugaggaugggcagguuuugguuuuguuugaagacaagagucucaccauggagugaauccagccucagacugagaauccuccugccucagcuuccugacaugauucuuaggucucaggccucaaguuuccuuaagaaagaaauccucccagacugggucauccucacauccuaucugauggcccagccugccagccugcccacuguguguugugucugucuccuccacuggacuuuuggucaguacuguaucucuagcgcccccccccccccccccagcuuaggcugggcagagaugguaaguuggaagaaguuuuguuuuguucuguuuuauuaguggucuaggcagugaauucccaggauuccugcaugccuaucaagucccgcacugagcuacagcccuagcccaucacugacaggugcucuacccugacgcaucucugcagcagugaaugguugcugaaccagaggccgugcugagauagagucugagguggucauggugaaucugagcaguccuugaggacaugguccuguaaguggucguaauuauuuaccagacugguggguguuccuggaggagggucuuugaguucaagauacagaggcaagagcaagcaggagcugugcuuuccucccuacugccuucgcauucucugccacccucuccagccugcuggcuuagcauggagccugugucccagcagccugcuucucuucaggcuagccccgcacucauucccucagcugauacaggcaguggauagaacaggcucugcuuucuuggaccgcaugucuccaguaagagguggggaagcauagauagagacacaauaacaaaaacauaccuggccacagaugguagaaacuuagauauauagcuggaguguguagggagugagcaguggguaugugggaaagcugccauucaaauaggaucuuuuuuuaggggguggggggguucaagacaggguuucucuguguagcccuggcuguccuggaacucacucuguagaccaggcuggccucaaacuuagaaaucugccugccucugccucccaagugcugggauuaaagacgugugccaccacugcccgucucaaaaaggucuuggggaaagacaucccagagaaggugguacucuauaaagaucugaagaagggacagggggaaucacaacccuguaaaggaaaggucauugaugucauggaagucgacugugcagaggcccugagguagaaggugccugguguuaggaagggcacuagaugggcuaagcauguggccagaggagcagggaggcaacuguaugccaggcucugugaggagugggcuuugacguugaaggcaaggggagcccuagaagggucaccucucuguccagguuuaacuuagauaccuuuacauuugucggaugacaguguacagugugguggcuuuugauacacucugcagugacugcaucgguuugguauggguaaagucgucucugggggcugguuccaggguucccuucugucaguaucaaaaucucagaugcccaagucccucuuguagaauauguuuacauguaaccugcaugcccccuuucccaugcccagagggguggaaaugcuguggaagucacugcuagguuguguugguuaggaggaugugacaguaaaaagucuguaaaugcaggacagaagcaguuugguuuuguccuuuuguuuguuuguuuuaagauugauuuauguguuuaaguguuuugccuacauguauguauguaugugcacuacauguuuaccuggugcgugcaaaaggucagaucucuuggaauagauuauagauguuaauaaaccagacugguccucuguaagagcagcaagugcuuauaaccacugagccaucucuccagccuguuuacugguguguguuuguuuguuugagacagucucucuuauagcucucaguguucuggacuauguagaccagguuggccuugagcucuguuaccuucugccucugccucccgagugcugggauuaaaggcgugcacaccaaccaguuuuacugugucguagagagaggaucacauauguaagcuaggauggccuuagacuuaaggcagucaguccuucagccauuccuuuccaaguuggcauuacaggugugcgcaguugaaaacacugggguugcgaaggcuguugagauagaugaguagaauaaaacggagaccagaugagccugguagcccguguuugaucccuggagucuacuuaaagguugagggagaacuuuaugucucugaacuucgcacacaugaaggagcacacacguucacacauaugcaccauacauguacaauaauaguaaguauuuauguauuuacuuauuugagacagaguuucaguauggagccuuaacugacccagaacuccauaugcaguccagguuggcuucagacccacagagaucuuuggaguuugucucccggaugcuuggauugcaggaguaggccaucauaccagcuaaacauuuuuuucagagccuggagagcuggcucagacauuaaaagagggcggacugcucuugcaguucaaucccacugcccacauuggacaguucacagucacggccuguaacuccagcucgggcucagccaccucuucugccauccggggcaccugcauucaaauguauacaccaugugccugcacacaauucaaaagaaauucuggacaauggugauguacgccuuuaguucuagcacuugguaggcagaggcaggaagaucuuugaguuggagacuagccuggucugcauagagaguuccaggacagccagggcuauauagacccuaacucaaaaaacaaagcauuuagccauagauagauacauagauagauagacagauaaaaucuuuggguggcucaacaguuaggagcauugacuguucuuccagaggaccaagauuugauucccaacacccacauggugguucauaacccucuguaacuccguuccauggaaucccaugaccucaucuggccucuucaggcacuggguauguacaugaugcacagacauacguguaggcacaacacucauauccaaaaauauuuuuuaaaaagauuuauugauuauuauaucuaaguacacuguagcugucuucagacacaccagaagagggcaucagauuucuuuauggaugguugugagccaccaugugguugcugggauuugaacucacgaccuucggaagagcaguuagugcucuuaaccguucagcuaucucuccagcccccauaaauauuuuuuaaagggcacguguucuuguccauucacacucuaaagugguuuagggaccgaugagauggagcagugggcaaaggugcgcauugccaagccugucagccuggauuugauuccuggaacccacauggcaaaaguacagagccagcucucacaaacuguccucugaccuccacacauguacuguggcauguguccccaccuccccauaaaauaaaagaaacauuaagaagaaaaagagaaaugcuuguauuuacuucacuucucguauaugaguauuugcccacauguaucacaugcauaccugguacacacggaggccgaaagaaagaggguaucagaucccuggaacugggauuacagauagucacgagcuacugugugaguuucccgucucuugacucaggggucuuccuugccuucucaguacuggggauggggcccagggucugguguauccggaauucggggaguacugagccauaagucuaggugggcaauagcugagagccaccccugucuccucacaugccagcagcacuuugaggggcuuucugacuguggccgugcuccuggguacuaggaguguaccucauggauuuggucugcuugccugugggagucuucccagcuagauuguccaucacuguaggggacgagaccuggaagcagucaggugugacuucaaauccuggccugguccccacuucucuuccugacucugaaucuauccagacuugcuagaaaccugaccaaacucagcauccucaggguaaggaccuuauagcuggacaugucugcuggcccucauacuuuucccauuguuaaaacaccuuuuccuggcuuccccaugugacuguuucagccugagagacucauugagaugucauuccagucuuuguggguuccuacuuuuguccugguggcugucaccuucugcuuauuucuccagaacauauuucaggaagaacauugaguauaccauaugaauggcugagcagucacuggaauacugccuguauauuaaccuuaaaacagauagacacacaggcagacagauagauaaggccaggcgugguggcacaucccagcuagaggcagguagaucucugugaguuugaggccagcuugguuuacagagcaaguccaggacaccuagacuuuuacuggcuauuacacagagaaauaaccuguccugaaaaaacaaaaacaaccgcuccccaaaccaccaccgccaccaccaccaacaacaauaaaacaaauagagccggccagugguggcacacaccuuuaauaccagcacuugggaggcagaggcagguggaucucugaguuugaggccagucuggagugaguucuagaauagccaaggcuacacagagagacccugucuuguaaaaacaaaaaguaagcaaaaucaggcagauagaagauagguugaugguuggugcguaaauagguagaugauagaggacuagauagguaaauaguugauugguagguagguaaacagacaguaguuuuguuuugucuuuuuauucucucaccucugccuaccaagggcugggguuuuaggcgucugcccuguacauggcggcuuuuuuaaaaaagauauauuuauuauuauauguaaauacacuguggcugucuucagacacaccagaagagggcgucagaucuuauuacagaugguugugagccaccauguggcugcugggauuugaacuccggacguuuggaagagcagucagugcucuucaccacugagccaucucuccagcccaugauuuacuaucugcuguucugcagguagccugggccaccaagcuccugagcuuaauaguuaccaccuaacucaggguauguguacaguagguaugcuuggcacacaguagguaugcagaacaggccugggaacccaugaggagagcauuucucuuuauucuguaccaugguuuucacaagucuguucucaggcagaaggggugaccgaccuaaugucaugcuaaggugucucaggcaagaacaguggggagaacuacagcugagaucuacuggacccaagcgucauccccucccugucaccucgacagugcugucuugcacauaacaaggaggagcucuuguugaauggggaugagaguuagcaaucaacaccugcccugcuccauggcuguucuguuuccugcugugggacaauaaggaaagaugggcaggauuggggucaggguccugggcgagauggcugggcaguggagccuggggacaguggguauggguggcacuguaugugcugacuuuacaaguguggaucaggugcugagucuuugcuaugcccaugguggugugaaaccugccuccccucgaccccuuuuuaaaaagaucauaugcauguauauauguguauaugugugcgcccagugccuauggaggucagaaaaggauauuaaauccccuggagcuggaguuacagaugucugugagccacuaugugugugcugggaaccagaccuuaguguucagaaagagcggccugugcugugagcuacugagccaucucuguaguccucagguccuaccuuuugaagacugacaggauuggacagccauugggagagacuaacacaggacuggagccagcaguguccagagagaggcuuccaaauggcccugcucuggacucucuccuuccuggcugucagagugagucucugcuucugagagaauucuuguuguauuuugagacugccuaugcugucuuguguuuugagacauacuuugaacucuugcaccuccugguuuuacaaagacugaagugcugagauucuaggcaugugucacucugccuggcgagagauaauuucuuuccauuuuauccccaccugauucuuucucuuuggugucuugcuccugaguaacccagacaaguaucuuaaucucucugagccuuuguuugcucaguuggagagugcagcuauauucagagcuuggugcucggcaggguguacaggauggaugcuuguauaccagcucacggugcugagguucugcgccagucugucugucucacuguuagacggccgcugcuggagagcuggagagcaggggcucagagcccucaugccuagggaaggaucuuguggaucaguccuagcuuuccgugguagccagcugcagggcccuaggacagcccuccaugaacagugcucagcucacagugucagacugucccucagcugcuggcugcaucugugcuugcucccugcuccaguucacaacugugauuuaauucuuaguaccugaguuucaggccuggccacagcucccuauuagcaccugcuuuccaaugcugcccccuuuggguuggugcucauagacagguccccauagcucaggacuguccccagcaucgguauccuuggggagcaguuuccuuuggagcccuuucuagcuggaaacuacuguugugccuucucugaagauugacaaagucuuggccucugaacucaggguacccuaaucagccccccuuacccuacucuauuccccccacaggugaccagcaauggcagcauugggagggacacgccagccgagacccagccucagaacccuccaccccagccagcccccaacgccuggcaggucaucaaaggcguucuguucaggugagcaugaaggcuuaggguucccacucugcacaaagcaaugcuggggagaggggacaguggccagggauagcacaucucuacauuggggcggggggcugcguacacaggggccucaggaccugugugccagagaaggaccuuguggauaagccauagccucucaucaucucaccccagcagccaccuucuuuaauggggguugcugaaccccuaagagcccuccuggacaacauucagacuaaaaugguuuuguuuuacuuaucuauuuuuguuuugcuuugucugaggcaguguuuuucuauuauguagcccuggcucuucuggaacuuacucuguagaucaggcuggccuugaacucagagcucuguuugccucugucuccuaagugcugggaugaaagacauccuuucugagccauacaucaagcccuaacuucaagacagggucucacuccgcugccaggcuggauugaacucacuguguaguccacggaggccuugagcauuuuuucuuuuuaaagauuuguuuauuuauuauauguaaguauacuguagcugucuucagacacaccagaagagggcaucagaucccauuacagaugguugugagccacuauguaguugcugggauuugaacucaggaccuucggaagaacagccagugcuccuaacugcugagucaucucuccagcccaggcuuugagcucuuacauuacauugaguuguuaacuuuaugggcgugagaaaguauguacaugacaaggugcacguguggacggacaucagaggauaccuugaggagucaguucuucuucgaccauguggucgugggagugaaacuuugcucgagggucaggcuucauagcacacaccuuuacucucugagccaguucacuggcccaaguccucaaaccuugauccuccugcuucggcuucucaaauacugaaaggacagaggcccaaggagucuggcugaaaacucaguuuguauggugagaaauggagucucaccaggcacuggaaggggagaagauuuuuauacaggcaauuaagagagucugccuugccgggcaugguggcgcacgccuuuaaucccagaccucgggaggcagaggcaggcggauuucugaguucgaggccagccuggucuacagagugaguuccaggacagccugggcuacacagagaaacccugucucggaaaaccaaaaaaaaaaaaaaaaaaaaaaagagagagagagagagagagagagagagagagagagaaucugccuuaguagauuuuccccuuaaauuuaggaaucuuacaucugugcccuuuaguguguacuaaguagcugcugagcaaaugcucaagucacugauaaaaugacauccuaaguaugugggacacauuugugugcucuguuagcgguggccuuaggcuaacgauaaaaguaaguuuaguguccuguugauuagaaacagacucaguguguagccccugcuggccugugacucuugcagugguccucuuggcucauacgagacuaaucauaauaaaaguuuauauuuauucaguggagaugcaggaauuuauuguugguuugaaaaaaggucucacucucuagugcaguuuuuaaacaugacagcccucauguuccaacuucuugggugccggguuuacaggugugagcuaccaggucuagcagauguauuaauauuuacagacauuaggaacaaccaacauuuugucuaaaauaaaggcuugacugacaauguugagggagucagggagugcagcuaagacguagaaacauuauucacuagcaucucauuaaagcacacaccaccgcuccuggcuguguuugguuuugucuuuuuuuuuuuuuuuuuuuuuuuguaggaagguuugagacaggguuuuuuuguuuaaccuuggcuguccugaaacucacucuguagacgaggcuggcuuccaauucaagagauccuucuaccucugccucucaagugcuaggauuaaacgugugcgccaccaccacuugauuguauuuuaaaacguauuuuguguaugugagugugugugugugugugugagugagugaguguguauauauaugggcagguggguggugguggugcagguggggguguuagcguguguaaguaugugcauucagaggucagaggacaguuuucagaacucaguuuucuccaucuaagaccuagagaucagacucagggucaggcuuggcagcaagugucuuuacucauugagccaucuugcuggcccuuuuuguuguuguuguuuuauuuuguuuguuuuguuuuugacaggcguuacccaggcuggucuugaacuugggacaguuuuccugccugagcaucuugaaugcugguguuccagaccuuugcuacuacauccaccuuuauuagcuagcuagcuagcuagcuugcuugcuugcuuccuuccuuccuuccuucguuuguuuguuuguuuguuuguuuuucgagacaggguuucucuguguagcccaggcuguccuggaacucacuuuguagaccaggcuggccucgaacucagaaauccaccugccucugccuccugaguccugggacuaaaggcgugcgccaccacgccccuuuucuuuuuuuaaauguauagucucagguaauucaagcuagccucagauuuauagcagaggauggcccccauuuucuaucccccugccuccacuucuuacaguuuucuuacauggcaauuauaggcaugugcuaccauucaguaugucauguguuguacugggaaugcccuucagagcaucaggugugccaaagcaggugcccugccaaccacacuccauucccagccucucguucuaguucucgugcuucagcucccacuucaaguggaaguccuaugcugagcuuauccuagggauuccaugaaaaccugucagcagaaggaggugugugugacaaaaagagucauacagucaugacugcuguuuuagaagagucuagucugcaguggguauggcucagcacuaaagcacuccuccagcauguuugaacuuugggguaucuucccagcacugaaaagaaaagaaaaaagauuucaugaucuccauuucugucucuaggcacauucuggugggggacagaacucccugccuguggcucccagguacuguucagccccagaccuagguguccugccguuugugcccaggccucucagccauggagcccuguuccuuacccugucugccugcccugaccugugcuuucaaguuuucuuuuauuucggggguggaaggguggggggugcguguuguugaugcacauguaaauggcacggcacgcguguagagguaggagaacaacugugugaguguguuccgcucucugccauguagcgucuggguauggagcucagguccuuagccuuggugguaagggcccaguuggcagagccauccaugggccuauucuuuagguuuuaaaaauguugccaggcaugguggcgcacgccuuuaaucccagcacuugggaggcagaggcaggcagaucucuugaguuugaggccagccuggucuacagagugaguuccagaccucaacuccaagagauucucccugccucugcuuccuagguauugggguuaaaguuuuuauuagcauauauuauuuauauacaauaguaguuucucuguaacauuugcauacacggguauaauguauuuugauccuauuuaggcccuacuacucucuugguuauacaguuuugcuguggagcaaauccagagguuugugugugccucaugccuaguuccuuagguggucuuguccaucaucccugaccccuuuuagcugagauagugucuccguuuguagcuuagguuguccuguaacuugggacugccuacacucccugaaugcuagaucacagacuuguaccaucaugucuggcucacuuuuuguuuucaugcuccaagcgacaggacagggcagucagcucucagguccucgccuucauuuccucacagccagcagcaccucccagugcuuuucauuaacugcauaucuggacaucugcauguuggugcugagggcugcuuccuucccaggggcucugauccagccucugcaggcucacuuccuuccuuagcacuaguggcagcagacaucaggugggugugggugccugcucacagacuaucucuucugaaguccucugcgugugugcuacaaugaguggaacaaaaggccccaaauauacuaggcacagagcuucuuuucuaguuauuauauuuauuguuuguaugugagauugggggucgggcacaugcugcuauggacaacugccagaggacagcuuuguggcauuuguuuucuccuacauuauaccugguaugaugguuuguaugugcucagcccagggaguggcauucgaaggugugguccuguuggaguaggugugucacuggguguggacuauaagacccgcauccuagcugccuggaagccagucuucuagcaaccuucagaugaagauauagauauagaacucucagcuccuccagcaccaugccuaccugcaugcugccaugcucccaccuugaugauaauggacugaaccucugaaccuguaagccagccccaauuaaauguuguccuuauaagcuuugucuuggucauggugucuguuacagaaauaaaacucuaagacacauggucaccaggcccgcauagugagacacuuuaugacgagccauccauagcacaagugcuagcuuugaaauuuuuuuauuuauuuacguauugagacagggccucaucauguaacucccuggucuggaacucacagaaauccccuugccucugcugggugcuggaauucaaggcaccuuuuugcuuuucugaggcaauguccgcagucuguaguucaggcugaccaugaauuugcugugauccuccuaccuugucucuccagggcugugauugucagaguguaugucugguugguuggagcgagcuugcuugcuugcuugcuugcuugcuugcuugcuugcuugcuuguuuguuugcgucccucccucccucccucccuuccuuuauuucauucuaacauggcuuuauguguauaaguauuuauuuugccuguguguguguguaucuuuguuccuaaguaccuggggacuucagaagucagaaagggcgucagauccccuagagcuggaguaacugauggcugugaguccuuguguggguaucaggaacugagccgcaguaguuaaggaggagaacaagugcugcuaaccacugauccaucucuucagccccaagguuggguaugguagugcacgccuuuaguuccagcauuugggaagcaggggcaaaccaaucucugaguuggaagccagccugcucuauaauauaguaaguucuaggauagcuagaaauaacacaguagugccaaauagagucucaguguagcccuggcuguccugcaaauuguucuguagaccaggcuggccucaaacucauagagaucugcccgccuuugccucccuagugcuggguuuaaaggugugugccacuauacccagccaagguagcuguggcuguccuggaacucuguagaccaggcuggccucgaacucagaaauccgccugccucugccucccaagugcugggauuaaaaaggcgugcgcuaccacggcccgauguguguuuuuugagauaccaauuuauaucccugacugcauuaaacucacugucaucuaagcuaguuuuaagcuuucagggauccuccugucucugccuccugguacuggaauuaacaauucugagcuaucauuaucuacauuuguuuauaagcuuuuugaacuuuguucuaucuguaaaaacauuuauuuggacugucuggguggugguggugcacaccuuuaaucccagcacucaggaggagacagaggcagacagauuucucaguuugagcugguguacuagagcuaguuccaggacaaccagggcuacauagagaaaaaccugucuccaacucaaccccccauuccugcaacaaaggcuauuuggaaugggguagagaauuuaauucuuaaguuuuucuuuuguugugucuggccugaaacuugaguagcccucuuaucuaucgaguguuggaaucaccggcaugagcugacaugcuaccuuuacucucaucauuugacagucucuucccuguaggcgugggugcccagaagaaggacuuucuucgucccaccagcccucugagagggcuucugagaugauguacaccuguccucacaugcacuccagaugucuaggacccaaacccuagaaaguauauguucuagcuugccuuguuucacgcauggggacagaaggcuagagggcugaggauccaaugggcccccucugagcggggugaugcugcucccacacucuccuuggaguauuuaccaaagugggagcuucccaugaaagcagcagggguccccagggagcacugguuccagaccuuugucagcuaugugcauuggggagcagauggcucagcuggguugcagccccugagaccccagaccccagggcuccuugguuucaacaggcagaggcaaguccuugugcccaguccugcccuaauagggcucagccgggagguaccaacccacugagcuaucacucucaguacuuuuccacuuaaguguuuuuguuuuuguuuuuucuuuuuuuuuugcagugccagguuugaaacccagggccuugugcaugccaggacagugcugcauuugagcuccacgcugagcugagagcugcacaugccuauuucccccaaugaaauagcaggagcagggaaagcaggcauggggugggcgcccugcuccugugcugguaaugccaucacaacucagugcagccagcuguauguucuucacaccccacuucagaggccacaaaaccuuagcagucuugccugaagcuggguggugguggugcacgccuuuagucucagcacagggaggcagagcaaggugaucuugaguuucaggccagccuggucuacagagggaguucuacagccaggacuacacggagaagcccugucuggaaaggaaacagucuuaccugggggugaauguuggcaguauacgcacaggccccacaguagggagccugaagcaaaaggauuuuacauuccaggcuaagcccugcuacaaacugagacugccucaaaaagccaacccagggcuugguagauggcccagugcgcagcauaagacccuuagugcagucucuagcacccaugugugccugaaggagucugaaaccuccacccuggugguaggaggcagagucaggaggauugcuggggcuugcugcccaaccuaauguccaagccguucuuuuucagaagauggugugauaguauuacccaagcuggucuugccucucugggcuuaaggagccuucuguucuagucuccugaauuacaggcauguuaccaaguccaguuacagauuuucuucuuguugguugucucuucuaauggagauagagacaguagucuugcuaugacaguauugcaaauacagaauauauugauauaguguguguuuguuacuagaguagaaccuugagccuugcaugugcuagggaagcuugugacgacugaacugcaugcuguucccauggcucuuuuacuguaguaauggauuuuguuaaaaaaaaaaaaaaaaaaaaagcuuuauugacuguaguuuuuucuuuguuucaucuuaauuggaaaaauuaaaauuggccagugauucccagcacuugggaggcaaagacaggcagaucucugugaguuugaggccagucuggucuacaaagcaaguuccagggcaguuacacagaaaaacccugucuuuauuuuuuuuuuaagauuuauuuauaugugaguacacuguagcugucuucagaugcaccagaagagggcaucagaucucauuacggaugguugugaaccaccaugugguugcugggauuugaacucaggaccuuuggaagagcaaucagugcucuuacccacuaagccaucucgccagcccuggaaaaacccugucuuaaaaaacaaaacaagcugggcgugguggugcacgccuuuaaucccagcacucgggaggcagaggcaggcagauuucugaguucgaggucagccuggucuagagugaguuccaggacagucagggcuacacagagaaacccuuucucgggaaaaaaaaagguggggggggacccuugcugcaaaggaaaaaaauaaaauaucuggggauacuuuuaagugcuaaagucuagaacccccacccccacccccacccccagugaugggcuguggguaugggucugugguagauagaacaguuggcuaacaugaaaaaccguagucaccaccaccaaaaccuggcuuuucuguggcugaaaggcuaacccacuaccuccagcuucuuuagucuucgauugaaacgggaaaguaauuauacuaagguuucuuacaguacaguaggaagauucuagauccuuuggauaaucauuaggcuaccaaagccuggggcaccuugacugccuuagaucucccaacucuugaguuugaguggcuaagcccuguggcccaugcaugacaugagauccuggagggaacaaggugacccugugcuuguacggggcuccuugagccucuguccugcaagggcacugugucuucacuggcuccccaccgccuucucagacaccucagaccucagagcguaaggguguccgggauggaggcugacacaagggcuccagcacagggcggaggacuuacuugccccugcuuccuuccucaggaucuucaucaucugggccaucagcagcugguuccgccgagggccguccccucaggaccagucaggcccuggaggggccccacgugucgccagccgaaaccuauuccccaaagacacucuaaugguaaugcuggguggaaggcaaguagagggcugggggcagugauauggugaggacaggcaggaugggacaguucccggcugcaucagcucuguagacgcauggucccagaugcucuagccgaucagggcaggugacuugugcuacccgagagacacugaggaaacaggucucuggggagcuuguacaguagacuucccgguuguugugcaccuauugcaacaggguccccgggugcuuucuuucagaaacauguuuggcucucguggaugugggugacagggugacugggaucaguucagguuccugagcuaacagcacagccaccagacuccccccccccccccccaagcucuuccaaguccuuucuguucucugcuuagcucuggugccugucagcaggccacugucaaguaacggauccuagggauagggaugguuggcaggagccuuggccaauaggaggaggcuccccaagcuugccuccccuucugaggcacagaugcuugacuucuuugccccagaucuguccaguuccaacugggaggucauccguggugguccugcuuccccuuguccuuaaguucaucacugguagucugggcuccuuggugucacaguucagggcagagccggcguacagcaaaagccaaaguugaguugagcaguuucuaugccagcaucugaccauggucccaacacccucugcauuccacagaaccugcacguguacaucucagagcacgagcacuucacagacuucaacgccaccucggcgcucuucugggagcagcaugaccugguguauggugacuggaccaguggagagaacucugauggcugcuacgagcacuuugcagagcuugacaucccacagguagguccugcccacaauucgcccaucucggccuguguccuccaaaccaucuaguguggugugguucccaacuuuagccggucagccaucaguagcuguccaagagggguccacucagcacagugaugccaaaggcauaguuuccagguuauuugaauaaacagugacagugcauuuucuguucagagcccaagccagguugguauguggaaacgucuauaccccauaaacuugagaaguguuacagcugagugugguagcacucagacagcugaggcaggauuaccaugcguucaaaggcaagcugugaauuauaggaggaugugucuuaaaacaaaaagcuuuacugccccguguaacuguuacugucucacguaacugcugcuugugcugugugugugagagaugaaacugggguuagcagcagcguggggacguucuccaggucaacagcaagugagagagcuuuugcucucgggcucugccucccaggaaggccuccucagcuuguuuaaguauguuuuccaugcucacagccacuugggcuucuguagucugugaguucugaggcaugcugggugcucugcauaagcucagcucuuccucacaauccuugagcuuaggaggguaagacugggcuuugcagucuauccccaucacucugcagcagacuggacacauacaagcacucagcagguuuuguuguuuuuuguuuguuuuucuuuuuuuucuuccauuguuggcaauugaauauaaagcaucuauuuugugugcuacauaaauacuguacgaacuguagccccuguccuuggauuuuauuuuuugaaucuuuuuguuuuguuuguuucuagauagagucucuguguagcucuuguuguccuggaacucacgcuguagaccagcauggccucaaacucagauauucaugugcuucugccucucaagugcugagacuaauggcgugugccaccaccuccugguggauuauuuauuuauuuauuuauuuaaagauuuauuuauuuaguguauauaugaguauagaggguaucugaucccauuacagacgguuguaggccacaauaucguugcugggaauugaacucagaaucucuggaagaacagucagugcucuuuuuuuuuuuuuaaagauuuauuuauuuauuacauguaaauacacuguagcugucuucagacacaccagaagagggcgucagaucucguuacagaugguugugagccaccaugugguugcugggaguugaacucuggaccuugggaagagcauucgagugcucuuacccacugagccaucucaccagccccagucagugcucuuagccacugagccaucuguccagcccuuauuuuuuuuaaagauuuauuuuuauuuuauguauaugaguacacugucccugucuuuagacacaucagaagagggcaucaaaucccauuacaggugguugugagcuaccaugugguuacugggaauugaacucaggaccucuggaagagcaguuggugcucuuaacugcugagccgucucugcagcccaaggauuuuauuuuuugagacagucucauagucucauguagcgcaggcuagucuugcugugcagcaggaacugguuuagaacuggcugcugggauuauaagaaugugcugucacaucugaccucagccccccguuuuuagacagggacacugagcguccaagcccuguaaaccuuagucuccugagugacguggaacucuugucuuuguacccaguaggcuuugggaaggggggaggaugccccaucucugagugguuggaucuacauggacagacacagucugugauuccagucaugcuauggccauacugucaaacucaggcccuuucuggaaguucaggaaaagaugggggaccggugagcuggucuuggggacucagguuucacccccaaaaagcagcuggugggcuuggagggcccugugugggccaggcucugcgugacagucacacaucaggcucagcucagaugcuccuuuccuuccccguccuaggcaguugggaauaaggaaggcuuuggagaggcagugggaugucacaggguguggagguggacaaguccacacacugaugauucucuguuuucuuuuguuuuauccuaaucuggucuuccuugugccuaagcuugccucagacucucaauccuccugcuucagcuggaguuagaggcaugcauugccacaacuggcuuucagaaaccugaguucugacucccuugcagccugucucuagcccugggugugaauuagcuuugagccucaucggcccaacagggucguauuuugaccuguggcaaugcagggcugaagugcucuguuccugugggcucauuaguguaaacaugugcuucguggccuguuagaacagggcuggccaguccuugcugcaguguuggauggccuacauccuacaguugguuuacugaguguccgguucaucuggcacccacucuucagucuguuuuacuccagcauuugggacagaaccagucagcugaccucugugccuugaguccucaguaagcuguuggagaguuggaaguaagugcaagcuacuguaggcaggugacauguggccuuggccuuuucuaaaccucacucaccaggcaccuucucuugcagaguguacagcagaauggcuccaucuauauccaugucuacuucacuaagaguggcuuccauccagacccccggcagaaggcccuguaccgccggcuugccacuguccacaugucccggaguaaguuaacuucccuucugguccuggugaacccugacuagaguguuguaugccauuucaggucuuguggagcaggcaggagcucugugcucuggacucaggauugaugagacaggcacuggccccacucauguuacuagcucugggacacccaggaaccugcuaacgagagcaggagaaucugggugucaugcaagccgggauccuagcuguggagcugagggguuaaagcugaggcagagucaugaguuugaagccagccuaggcuuagaaaaagcaaacaguuaagaaagagcagguggagcuuagagaacugcugagcggaaggagggugguaaucacaaagauuggcugcaauggagagaagcagcucaucagaguuugauauggagcacugaacacugagguugaaagagcagcuggagccgggcguggugcacgccuuuaaucccagaccucggcagaggcagucggauuucugagcucgaggucagccuggucuacagagugaguuccaggacagccagggcuacacagagaaacccugucucaaaaaaaaacaaaaacagggcuggugagauggcucaguggguaagagcacucgacugcucuucccaaggucaggaguucaaaucccagcaaccacaugguggcucacaaccauccauaacgagaucugacuccgucuucuggagugucugaagacagcuaccguguacuuauauauaaucaauaaauaaaucuuuaaaaaaaacaaaaacaaaacaaaacucaguuggcagagugcuugcuuguccugcaggaagcccuggguugggucccuuaagcagcaaaccagcuguggugguauaaaccugugauuccaacauuggcgggguaggggaggaccugauguucaaggucauucuucaucccugauuagggaauucagggccagcuggacugugugauaccaucaccaaaaaagaaaaaaaaaaaaagaagagagagaaauaaagaaaagaaaaggagccuuccuuuuucguuuuuuugugggguuuuguuuuguuguuuuuuguuuuuucgagacaggguuucucuguuuagcccuggccguccuggaacucacuuuguagaccaggcuggccuugaacucagagauccaccugccugugccaccacgcccggcaccuucuuuuuucuaaaagccagugauuaagggcgggggcagcauuguccauggggguggugccucuaguuuccugcugcacagagucuuagugcggaaguaaacaaaccacuugguuaauuacgguaauggugagaaguguacugagcagcgucugguaguaacccugacccagcacuuguaaggcugaggugagaggauggugagcucaaggccacccuaggacacacacaguaaauuccaggucauauagccagaccacaucucagacaaaacaguagcuagguagguagaugguucagugguuaaccugaggaccagagucucuguccccagcauccuugucaagugccaagguagcccagugagcccuaguuccuugguauauacaaaaacgcaacugaugucuuucucaggccuccacaugcccacacucaaaugcucccacacaggcagcacgaacuucacagcaagagacaggcaaagcaaaggaauagugcugaauucauuaucucagcauggaguugguggacaaguaugguguuuuacauuguguggggagacaagugucaguggauucuguaucacacccauagcuuaugcccagugguaccagcaucugcaacuccguuagacgggugcagcagcuuuagaagcuuggucuuccagaacagggcuucucugcucccauaggacuagagcaguuucguauuagaaugaaucagucaaucuaucuacuaaauuuuaugugugugauauuauaccugcauauauguauguguacuauguacauuucuggugauggcaggggucaucagauucucugaaacuggagcuaugaaugguuguaagcuacuguguggguggugugaauauguguguccaugucuguaucccguuuucaucagcccugucuguugcuuguugacagccucuucccuucuuggaggaugucccaggaguuuauucucugagauacccaacuucaggugcuuguuacuccagcuggacaagcgggacuaguuuccaaauaguucaucaagaaaaaauggaaugauguuaauguuguaggaacuguaggcuuugacccaugaagaaguguaggcuuuagccucauucuccaugauaguuacugaggugccaggaaguggcauuaauacaccaacaucccuuagcuugugggagacaagagcuaugugauccuagcccagagcucuaugcucccugcucccuuguggggauggaauggggcagcucagcagcacaggccuucugguuuuuguuugccucuugguggaaccuagggcuuuucacacuguagacugugcugucaucuaugcccucaagccucuuacagggacauuccagacagguguccuaccacugagccacacccccagccccucacugggggauucuaggcagggguucuaccacugagccacacccucagcuccucacugagggauucuaggcaggggcucuaccacugagccacgccccuagccccucacugggggauucuaggcaggggcuacaccacugagccacgcccccagccccucacugggggauucuaggcaugggcucuaccacugagccacgcccccagccccucacugggggauucuaggcagggguucuaccacugagccacaucccuagcaccuggggagaugauuauaggccauaccuccaagcuccuuggugggagaauucuaugcaggagcucucucacugacaauccuaaguccauuuuaucauuauuuaaauuuuuuuuuguuuuuuugagacagggucucuguacuuuccuggcuggccuguaacucaccacgcuggccuugaacucaccucuugaguacuaggauuaaaggcuugugccauguugcccagccacauccauuuuguuaagaguauuugauuuuauguauuugaguguuugccuguauauaaguacuugcacccuaaugcuguuguccaaaagccaucucuccaguggcuucugguuuuauuuugagaggcuuucacuagguugcuuaggcuggccuugauccucuugccucagccauuaacuacuugggauuacuggcuugcaccacuagguucagcaagggaggcaguuuuccuucucaacaugaauaagagcuagugacuucuaaguugggaggguguggucaacccuuugcucuugucucaggcaagguggugagaacccuggcuagccugaccuuagcaaggggaaguaaguccacuuguggcuggggauucacaguguuggaguucucauguuggcuucucacguugcuggugccagaccuucucuagaaccguucucuaacucccccauguauggccauguauucagugggcugucccugagcccaggguacagaccauaugggugaacuaggaggcagguggguauguguugugauggaaaugaccuguccaggagagggaccguaucaccuccuuggggaggugaacgccagugaaguggcucaugccuguaguccucaagcugagggccagccuaagauauacagugaggugcaguugcagaaaaacaguggccacagccauguaagaaggaggucuugaggaagggagcaauggcguggugugggcuccaggcagauguguguccuuugcugguuuagggaguggccaagcagguuuuagagaugggaggcucugcuuucugccuggguaaaucuauaaguggugcuucucuauaaagguggaauggugguuccuugaaauuuggggggugguugaggcuucccaagugauauaaucauuagugggaagccggggcacagcagccaugggaucacgggccucacccaccucccucugcccacagugaucaacaaauacaagcguaggcgauuucagaaaaccaagaaccuacugacaggagagacagaagcugacccagaaaugaucaagguaaauagaaguggaguuauuggggaucaugguguuaccuaguugcgcacaaguuuuggucaggccaagugacugccacuucugagcacuucccugggaggaguucagagaucagaauccugcagcaggaagucugcagacaggucagcccaggcagcccuugggguagaucuggcucugagcccuuuucaccugggacccuugcuccaaguuauacaaguagagaggcuggcuugacaccauguagcuggauggcgcagagcaggagccguagcuuggagcaguuguagacuugaucagcucuguggcuccuggugggcugagcaaaccagggcacuucucuaaaggcauagaagcuuaccuuucucucuggcuuugggcaggaggcauggucucagagugaaguagggccacucugagaggggaugccaaggugcuuucucugggcugggcuuuugguccugugcaugaguagccugccucugccuccacaagccucuccuuguuucagaugaggagguggaggaugguugaaucugagucucauguaggugauggguaucagccugcaccuaccagccauagcugcaguggccguucuucugccccaguugucaugggagggcauaagcaguaguauuuagggggccucugccuguccgaggccuacugcuccuuucccaucuccccacagagggcugaggacuauggcccuguagaaguaaucucgcacuggcaccccaacaucaccaucaacaucguggaugaccacacaccaugggugaagggcagugugccacccccacuggaccaauguaagcugagccagaagcucaggccugugaccuugucuucccccagccccaucugugagagacccuuuuaguuccacacucuccuaaccacucuaugccuguccucucucuucccacacucuucuuuagccaaguccuggccagugugggugggaauggcugcuguuucugggugucaggucacaccugguuucucacuguuuucuauagaguuggggguauaugaccaccaguauaagcuguacuggaaacaagcuucauuggccuucauucagggccacucccuuugccacugcauccuuuccuugagguccugggauccuucugcuccucaugguacagucaagaaaugcuguguggugucuuggccaggcugagcagugcccgcuccaugugcccacagaugugaaguuugaugccgugaguggugacuacuaccccaucaucuauuucaaugacuacuggaaccugcagaaggauuacuaccccauuaaugagagucuggccagccuaccacugcgugucucuuucugcccgcugucacuauggcgcuggcaacucuaugcugcacagaguaccaagucacccuggaacuucuuaggugacgagcuguaugagcaaucggaugaggagcaggauucagugaagguguguggggcgccacaggccaggggaaguggggaaucuuacccaaggcugcccagacuguuucacgacugccuagcggcccuaccccccaacccuagcucacccuggggccccggcucccgacucgacucauuuacuuucuccuguuuucuucuugcccgugacacucucucuaauggucacuggagcagcucuagagagguccuacuugggauuccaaggaacauguagggaauggcucuuggaaaugaggugccacagcagggacagagcagugcucacaggcucucuccccagguugcucugcuggaaaccagcccguaucuucuggcacucaccaucaucgucuccauuguccacagugucuuugaguuccuggcuuucaaaaaugguaggcaugggggcccgggacauugaggcaacgggcagaugaaguaaucugcucccugcuucuucugugccuggggucucuguacucuagagggcuggagcccugaagagggacagugaccccacgaggcacagaacuacgcugggccugcugccugggccaaggccagggugguaucaccaggaagcaggguggggaacuccaaagccaaaagaaagggaagcccuggggcugcucccagcacucugccugacagggaggccccaacaugcagcuacccaguucuggaacaacccauuguuauguccagcuccaggugcugaggcagaggcaggccugcaacugcgcagcucugcuacagcacucauuccagcugcucuaggcggguggaccauaguggggguguggggugggggggguccccugaagcuucuggaauugacaggagugauggacacuucugucacacugacauugcagcggaagcuggcaucccagaagaauauagugggcaaacuugagggguauucagugugaccucuccuggaaggccuuacacagggagcuccaccaugcucugaggugcuggcucuguucccagccagagauuagugaggagcaaguuuggccacacuugggaagcagcaagugugagcuagacuuugccccccugugccagguccccacuguuuugagggauggaugaccuuaugagugggaugugcuaagccccagguuuggacaugugggccaggguccaugcuccugagucauggaugccaggaucccugaaugcuugugauccagcuugaugagaccagaaauagcaggguguugucagcuuagguccuccaggugucuacauggagaccaaaauccaggguuugucugugccccaaggauagcucacaguuugagugggaggccagaagagaaggucccuaggcacacacccuggaucuuccugugcagggaagguaggauggcauugugugauuuggaucuggugucugcccagguucugccaugcaaggguguacagccccauguauggucccagcuaaccugcuuccuuuaacaccugaugacccucaggugaccagcuaagggaacauguguuccuaucccauaugaccuugggaaagguccugugugcccucugcuuuugugggagaaagugcagcccaggagaagcugcugaccaccugugcccacauccucugcagacauucaguucuggaacagucgucaguccuuggaggggcugucagugcgcuccgucuucuuuggcguuuuccaguccuuugugguucuccuuuacauccuggacaaugagaccaacuuugugguacaggucagcgucuucauugggguccucaucgaccucuggaagauuaccaaagucauggacguccgggugagucaggcucuauguugcuguggggcuugcagggugggaagggggucgccugcuuagccaggaccugccuuggucucugggggguuucccaaugccugccuagcucucaggaccuaggggauuuucacaguaggggauuuuuuggggucacauuagggcaggggaacugggaagagugaggaagggcagggggcgguucuggcuggggaguggcaggagccaggucccagcugaccuugacuuucccuuuacagcuggaccgggagcauagaguggcaggaaucuucccuugcccaaccuucaaagacaaguccaccuauauugaaucuucaaccaaaguauaugaugaugugagugacucccauggcccugggguggucuccaagcaccuacacucaucaggggcaggcugggcccuuggucuugccugccaguaucacugccaggcccauaucacacccuguguuccccgccugccacagcuacuuccuggccaaguccagaguucccagagccaccuggaaauuccccuggccuagccugcuggaccagguguggguggaugaggacaaggaguggaagcacugagcagggcccgcagagcuggccuguucugugacccccaccccaccaucaccccacagauggcguuccgguaccugucauggauccucuuucccuugcugggcugcuaugccgucuacagccuucuguaccuggagcacaagggcugguacuccugggugcucagcaugcucuacgguuuccugcugaccuuuggugagcaggcccagcucuacccugccuggaaggcauguccacacaguuccaggcccaucauucuuguaggccacagccuuggggcuggcugccaggccuggccuugaccccacaucuaggaccugugccugcagaccaucugaggcucauguucucaugcuucuuucuguaagcacagcagccaagcccuguccuggcacucacuggccuccagacagugcccacccagugugggcagccuugggaauagggagcuauaaggauuccucuggccaggucuacagagaggaauccaugugcugggggaaucccaaagugcagagagaaggcaggcacucacaaugaguacugaguacagacgagggcagagcaguaaauguguacguagguggaguuuaggaaccccacugaggaaagaugcuuaacaguccccagaacugaccaggagagauaauauaaagaucaggaaaugcuugaaauugggaagcugggguuggauaucugaggucaaggccaucccaagcuauagcccaacacccugucuccaaaggaaaaaaaaauguuggaaagagaaugcaacgaucugggguaggcugugcuagaggagcaaagugagccuggguagcuggucaugguuccuuugucuuccugaaggcuucaucacuaugacaccacagcucuucaucaacuauaagcucaagucuguggcccauuugcccuggcggaugcucaccuacaaggcccucaacacuuucauugaugacuuauuugccuuugucaucaagaugccugucauguaccggaucggcugccugcgggaugguaaggcccagcggacacagggauacagugggcggggaggagccucaucuccacugcggugggccaucucccucacacagucccuucccccagaugugguuuucuucaucuaccucuaccaacgguggaucuaccgcgucgaccccacccgugugaacgaguucgguaugaguggagaggaugucucagcagcggcauccagggcccaggcauccacugcagcaggggcucucacaccugcacccagcacagcugucagcggagaggaugccuccacagucccaaaggccacuucuggggccugcacugccagccagccccaggaagccccuccaaagccagcagaggacaagaaaaaggauuagccacugcaguccuccuuaucugcuccuggugacugaccaccaccaccucccgggccccucccuuacccucucugucgcccucuuccuggacagaucaggccggggcggcaggaggcccccagggccagggcccggugugugagauggggccgggcagguuggggcuggcuguguguauguggaggcaccguccaucgucuugucuauccgucuguuccuauguguuugcagacaucucgcccugccagcccaacaccaucgggaaucauggugaagccaauauggcgccgagggugggccaggcggggaaggggccagggcuccucugugggacgccugugguccuccaucaucuugucccucaucccccgaccacccugcucccagaccgccacccuuuaacacagucuggauuuaauaaauucauauggguguuuaacuuaagcucaaccaccgcaccuccucugccuuccuuguccggaccaugcagcuggcucaggucuucaagagaccuggaggugaugacggaguggaaucugggguuguucagcauuuaacacccuggguuaacccugugcugcauaaaacagugguguuguaugccuguaagucagagcuaacuuagauggcagaggcuugcaagguggcucagugggugaagguacuugccaugcaacccugauaaccuggcuuugcacuuccauugugcuacaaggccacacaaccuaaguugaucaccaaaccacacagaggcaggagggaagcaacuauaguguuaucugaccuccacacacacacuguagcacacauacccaaacaggauaacugcccugcaagaggucucccaaaacaguuccaucuuagacuccuacaaggcugcuggcuaaaagcaucugguauuuguggcuagcugugugccaccaggcaggaccugaaacacuaaacaccaccaagucugccugugaaucaagaggcuacccccaagaaggacaagcccuauuuaacacuccucaauggagaaaacagaauggggccuguaugcacuuaucugggccacagcagagugaguccuugggugucauugcagugucccucaagagccuaacuguccauaccaggagcagggccugcuuacccucucuaggagaaugacagccauuggggguacucacuacaccuucccagacuguaggaucagcagugcugcaaggaggcacuggcccaaccccagguugcuucaggcuccaccuacuucucccugcugagucaagcagggauggugccucacagguagguaucauacccacucuccuugcugggcuccccuuccaccugcugacccagugcucucagaagacagcuaaugugauccccagggggcugcugcauguccccagccuuugucucaugcucugccacagccucaccucuagccccagucucucaaguccuuucugggacacaaguaccuucaggauacaauuggugguguucccaggcaccccuuaccgccuaguccugaggcucugcccacugguacaucauggcaaggagacuuccuucacuggaccaagaccugugaaaacaugacuguauccuagccacucuggugccauuugcuuucacggacaucuggacauauccagugcccuuauugggguacugguggaugggucucuauuaacccuucgcaagucugucugggcaaacagcacaaaacaguucuguguacacaguaggaccagcauuccauggcaguucugaggagcucacaacuuagcagaauucuagguaguguugggcacagugguuauuccccauccuugauuuugagaggucaauccagauuuaaaaacuuucagcuagccugggcuacaaaacaagacuuggcauaguggcacacacuuguaauccuggcacuugggagguggaggcagaagggucaggacaucaaagucauccucacugcuuugaguugggucugaggggcuggagagauggcuccucuguuacaggcuaggcucacaaccagaaauagaagcugggucugaggccagccugggcuauuuaacaccuuguuugaaagaauaaaaaauggaaaacaccauggaugcaccaugu

SEQ ID NO: 3608 - RNA, 3082 nt, Mus musculus
ucacuuguucuuuuauguugcuagguccuaggcuucauuucuauugcugcaaaaccaccucccucuacagauagugacagggccauggaaugugugcuagguaaggcaaaaaacaauaaacugaggcugaagcugauuggaaucacucacagagacucagaaugugcucggagaaucuuuauuaagcaagggccaccagagggccagagaggugcuugagacagggccaccuggcuggauauggauguuguugcaggacaggagaaggauacucauugauucuccugggccacuggggugaugaugggguugguagccacagaggccuguaucuucuccaucagguuugcccacuggcgaugcaugucuuccacuauuggcucgaaccagcccuugaggcgggccuggaagaucuccgccugcaggcguauuugcugggucuguuccuccaucuuggagcgcaccuccuccaugugcucacgcaccuccucuaggcggucacgggccugguugcccacuuccuccagccgcccucggaugcggucaccaaaagccugggcgcgaucgcgcagaggcugggcggccccagcgccuagguuggcagugcgcuggcgaccuugcuccaccagaggccccaggcgcucacggauggcacucacaccgcgcucggcgcccucgcgugccccugccuuguacacagcuaggcgcuucugcagauccucggcaucccgcaucaagcgcuugcgcaucuugcgcagguguguggagagccgcgcccguaucuccucugugcucuggcccagcauggugugcaccucguugcgguacugcccgagucgguugcguagauccuccaugucggcuccgagucgggccugugccgccugcaccucuuugcccagccuggcccgugucuccuccgccacuggacccagcuguuccuccagcuccuuuuuguaagccuuuacuuccgucauaguguccuccaucagugcccugcaggcccagaggaaacacaggaaggagaugaaggcaggacagaagggccagaaaccacagagcaagaggugaugguacucgcuuguguucccagaaguugagaagcugcggcauaagaauugcagagccuucgaagccagcuugaguuacagaaugggauccugucucaagaagccaaaagccaaucgaccaagcaaguaauaaaugucuguuccucccagcauccagaaggcuaaagaaggcaggaggauucaaggccaaccugggcuacacacuaauugagaaaggaaacaagaaggggcuggggacccagauaggaggcaacccuggaucagcuggugccugccgagggugaaagagcuggacacucacgucaguucuugugugacuugggagcucugcagcucuuccuggaccuggucagacagcgucugcacccagcgcagguaaucccagaagcgguucagggccugcucccaggguugguugcuuugccacucgagcugaucugucaccuccggcucucccucggcuaggcauccuguguagaguaaguuuaaggcugggucaggaccuacagucuuuuugggucucuuugaagugggucuggaggcuguggagucuguuuagauacuacaagcaugcacugucuuguauccuauguaguucagagccgagacuaggcagguguggaauuagaaaauguauaccccacuuuuaagagcaacuaagaaaucaacuuuuuauuguguguguguguguguguguguguguguguguguguacccuuggaggucagaguucuagagggaauuggcucucuccuuccacuauguuggucucagaguuaagucuucaagcuuuaugauaagcaccuuuacccacuaagccaucaauccucuuauaguuaggggaaaucaaggccuaaagaguauauaaaacagcugcucagggcuauugaaucucagagaggucucagaaccgccucagccucaacccaccagcagaagagaucuagggcuagaauagaguccacagaggagcagaaaaagcggcaccacagcaaguccuugcuccauaccugucagcaaugugaccaacagcacggcccacagagccuucaucuucgcaauugugauuggccagucugcggagggaaaaauugucuuugaacaccagggggcggggguggagggacuccggccacccagagaaccccaucuucccuucucagaucugugagccaucacaaacaucuccaaaacagagcacccgcucuucccaaaggucuguuuaccuccccuugccgaguucgcuaucucggcaccccgggguggauccgcugccaaaaauuccagcucccucuccuaggguucaaauuccacuucacagagggccagcgggugguccagcuuacauuccucuuucuucccggcuaaguccugcuuuccauuuuguguuaauuuaacacgauuuuuaaucguccuccaucccugcgaagugguacccucccacaacuacagaacuuagggagcucagccaugaggagccacaguuugaaaccaguccggguuacuuggggacugugauggaaaucaguagguauuuauauaaaagcagccuaaggcucaucccgaguuuuuucgccauaggaugguuccuaguugagccgguacgccgugcaccgacagucccguacuccuuccuggagguaaccccuccaccugcucugacucuggcaaaggcuaguuaccucgaguccuuaguuugucccccaagacuucuaucgugcugccugcuuuuccaauucuugugccuguuuccuggacuccgggggaucucaagguucccagcccacauccuaccaaggucccugggugaauccccagcccagcuugucuuaccagcuccuuccgaaacaaguccuuagccuccagggucugagcaggggaucggaucccagaccgguccaauuauaggacucccccugucccgcccccuccucagggcuagggcgggcugugccagcccccugucacgaggcggguuguucucucccccuucacagcagggcagaggaaag

SEQ ID NO: 3609 - RNA, 6718 nt, Mus musculus
cggguugggcaggcauccgcagcucccaucuuccgaggccgccgcagcgccgcuggccgcagccccgggaguccguuccgaaccacggccagugcuugacccagugcccaggccgccgccgagcggcggcagagugaagccuggcggcgaaggaggcggcggcgggagccccacgagggacggcguaggaggcggcgguggcccugcgggcggagagcuggcagccaacacguuccccaugguaucugcgaggggaaaggucagagggcagggaucggggcgacacgcacacccccggaugcaaccccaggcccuucccacccaaagcggacucggcucucacuggcggccgcggcggcuccucuucccggccugggcuccgcuccuaccccgugcgcuaagcgcaaccgaacccgcugccgccgccgccaccgcuguuuucccgccccauggauucuauugguucgguguccuccgagauccgcccaccgcccuagaagaaagacauucuauuggagaauuagcaggaaguuccacccuucuguugaagcccuacuccuauugguuccuagucgaaaucagucagugcagcuuccucuaccuuccuauuggcucguguaucccaaguucauugguucgcgacgccgcggggcuggagcuaguucgcuauuugucgauagcacacgcauugacacgccuaccugcucauugccccgcccuccuuuuggaggcgcggagacccgccccagaaaaugccuugacuauugguggaccuuggcucaacucacauucuaauuggcuacaguaugucuaaugggccggccauggugacgugcgugcuaggucucucauuggccaaugcgccagggucaggggacaucaguagaggugcguugcgcugcagacgcugcuaggcagcaaggucaggucucgcgucccgacaggcaccgcgguggagaggcaggguccccgacgguaaagccggaagugcugccccuucccacagugccucgggaagguuucaaaccaguucugggauaaccugccggccucugccuacccacaaugccgcuuucucccuuaacgccgcagcugccuugacccccccacccccuuuuauuuuuuuacccaucaugccgucugcuccuugcgucacuguagcuucuaucuuuggcccauucauuccuuucccauuacccagcauucauucccccauucauugagcuucaaucccuuggcucgguuuagcucgugucugccuguucacguuucccauccuuccggccuuucucuaaugaacuaucuuggaaucuuuuaccuucuggcgacuacccacuacgccuacagcccucguuucuuacuuugcuucuggcucauucguuuagcuccauuacccaucacgccuugggggcuucauugaaaauaguauuugccucaugaucuuagacacuucuugcaugccuaccguuuuuucuuuugguugaugcgguuuugcuuaugacucauuaauuucuggggcauuuuuuuuugacuuuuuggggagggaggggaguccauucucuguugacuuacagaucacggaugccuuucaagcuucaggccucauuguaccccacucacuucacaucucacagaaaacacaagacuuuaucaaaguagaaacucauauuauguaggaaaugcuuacaaaauaaaauucccaacccagaugcccagauucuccaucacacacacauacacacaccauccccuaaagagggauauguaguucucaucucacuggguagggguuaaaagaauucaguaguccucaggauaagagcagagucucccaaacuugggguggcaaggcacacuugcauuagguucuccccucuagcauuggaccuggaauucaugcucuggagacaggaaccugggugcugaggagagggugugagaaaccugagauuccugccugcaggaguagguggagauggggagguccuaccuuacauuggggaauccucuccuuuucaccuuuggggagcaggguggggagggaucaggugagcuucugcugccuggagggcucaggucugagcaacagggagccccugaucccguucuugcauaucuguuggacucuauugccugaggacaagugcaagguccgauuccuuugggacuuuaaggguucuugagauacugaguggcauggucaaagggucguagucuuaggaguccuuggggggggggggggggucacagguggugcagaaggauauggugagcucccugccaagggagauaaaaaucuccagguuuccaguugugcagguuugccugccucagacaucauagauuggacgucaugguggagucacuaagaagucacagguggauugcaaugggugauaguugucccuggucugccuggaagucagaguguccuagauuacugguggaaagcucaugggucaagggugaaaggugagacgucagagccccugugccucccucacacauacauggcccgugacacaaaaaagucuuugcucugguaggagucagaggggcugggguaggacagggcaucauaaauaggguugauuuuauccaggaagucuuccuccucaucaucuuccuccucaucuucgagacucagggaaacccccuccacaacauuggguccuggaggcaccagaagagaaggucccaggccuguagcccccaacagcaggggcccugaccgcucuuccagagugggcagcucgugauaccgaggcaucuccuagaaguggggagggagcaaaagcaagaugucaaagucaccucagucucaggauggcauccuagaucugcccccugccaaucagauccaacuacaccacugccauccuuucucccucgaccaaacuucucuguacagucacuucuaacccaagcccagcacggaccuccuuacccugucucagucuuccucuuugaucucugaaacccaauccuuacccaagaaaauuugaccucuggguucucugucugucugucucucucucucucucucucucucucucucucucucucucucucucugucucucuccucucucuuuucuuuucuuuucuuuuuauguagcucuggcuguucuggugggccagaucugcccgucucagucuccgaguuuucugccucaaccaccugaguguuagaaucaggucugggcugcuguaguuacaaaaugcugagcacugaauccagggcuuugugcauguugggcaagcaaccggaaccaacugccuuauaaccccagccuaacauaaaucuuuuuguguguuuggagaagaggucuuauguaacucaagguguucucuguagccaaggaugaccuugaacuccugacccuccugccuccaucucuguguugggaugagaagcaugcacuguuacgaucugacugacuuuuuuguuuucuuuuacacaaggucucauuagguagcauagguuggauccaaacauagcaauccugccucaguucccaaauacugagauuacagguguguaccccauaccaggcuuggcuuugguuuuguuuuucuagauauuuggaaauguaugcguguguguacuaauauuugugcagaagccagaggaggguaucugaucccuuaaagcuggagucacaggcacuggggggugccugguaugugaaucagacacaacucugguccgcaugacacagcacgcucuaaacugcugagucaacgaucuuguugcuuuucuugguuauuuugaaacaaaaucucacucuugagcucaugcuagccuuguagcucugauugguugaaucuccuguaauucucuucucucaagugcugggaucacaagguagaguuauggugcacagcucugaccucaauauuuauuuuauuuaaccuugagugcuaaucagaucucucagucugcuucggucuccuuaucugacucuugaccaccaagaagauggucucugaugugucucugaugugggggcccccuggggaauggcuccaugguggugucuccgcuguaggcacagcccugagcaacucauaugagugcucucucuacccaacucauaagucacuccacucuacccaaccuugaccuucaacccuuaagccacccccuaagcccacccugguuuccccggaagcucccaccugaucagcacaagagacaccagcaucaaaguauggcgucuucacugggcugugcucugaggcccccaaggugaagaguugagagggcuguggaaggacacaagaguaaaccaggacccucaugucugcugcucccagccagccccgucccaggccaacagcccccucccagcuugaccccagggaggaaggcaggguauggaggcaggggagcucggguucuaggggacagcucaccaucucugguuccuccagcuuggccuucggggugggugguuuauaggagggagguccuuccagucugcaggggucagggguaggaggcagaucagugggagguuagcccccuucccaguuccuccucuuacaggaggugccucugguucucucuaccagaggaacaaaggacuggucacacuggcccugccugccagccuggccacuugaugguagguaggagaugcugguuuuuacaggguuuucagcaccaucccugccccugccccagugccaugugggagucagacugagcaagucacagucccagaacccuccagaaagaauucagaaaauccucuuucaagcaagugagccagguguguggcccacaccugcauuccuaauacuaaggaagguuucugacuucagugccagccccggcuaugugaggagcucuaggccauccagggcugcauggugggguccuguuucaaaaacaaaucaaggcacagggaacuugggcuaaauguuuaaaagggggcuggagagauggcucagagguucagagcacugacugaccuuccgaagggcccagguucaguucccagcacucacauuaggggguuuacaauagccuauaacucaaacucccagauucaagaucuucugcucucagaaggcacacauacagagacagucauacacacaguuguaugugggacgcacacacacacucacacacaaagagaaacaaacacaaauaccaauaauauauuuuccugagacaggguuucucuguguagccuuggcuguccugggacuuccucuguagaccaggcuggccucagacucacagaaauccaccugccucugccucccgagugcuuggauuaaaggugugcaccaccacugccaggaaacauaaaucuuuuaaaaagaaaaacagcaacaaaaaccaaccaaccaaccaacaaaccaggcaagcaaguuggcucagcagguaaaagucuugaaaacuuggggguaggcuuuauccccagaauacacgcaaaaaaaaaaaaaaaaaagaaagaggaaaaggagguacccugugacuucacgaguccccuggccuccacauccaugccaaggccugugugcacacaugcacaaacacauaauaauucuaauuuuacaaaacguaagcaacaagccaggugggggcggugcacaccuuuagucccagcacuugggaggcagaggcaggcggaucucugaauucuaggacagccugguuuagaguggaguccuaucacaaagauuaauaaagggcaggagagaugccuuuaagcacacuuguugcucuuucaaagcacccuaguucaauuccuacaaucuacacggcaacucaugagcucccuggguaccaugcaugcauguaauauacagacauauaugcauguaguauacagacauacauguaagcaaacacaccagaaaauacagagaugaauccccccucccccugcccccaaggacucuagggaugcaagucggguucuuacaaacugacuaaucucccuggcuacuguacaacuuuuuauuuauuuauuuuuucauugcuguuuuuuuugagccucauguaacagagguagcaugaccuugaacuucuaauucuccuaauucuaccucccacauuuaucgguccuuaagaucugaagcucuagggaacaagcccuagggagcaacaagauggugggaaccugggcucugacagugucucagagauagacucuaacacccacgcuucaugcagaagagaaaaaucuuuccucagcacccauuugacaucucaguuacuuauggcagcaucuuugucuuaaacugccuuaaugaucuccuuugguucccacuccaugcucccagcucugcugucccuccucccagcccaucacucacucuucuuccucauccgcagcuugaagccucugcuccuuccgcuguugucggcagaugaggaugccugugccagccacugcgguggcgaugauggcagcgauaauaccuccaaugaugccaccaguggccccugcuccugcugugcugggugacucugucaggacaaagacagcauggggucacuauggaaaacucacagccgcuucugccagcccuguccuucagauacuaccuaugccagacuuuucaaaaugauuguuuuauguauuuguugagacagggucucacauuguaggccaggcuggcugggacucucuguaaaccagaauaaacccaugccucugccuuccaaguguaggcauuaugggcaugugccauca

SEQ ID NO: 3610 - RNA, 6718 nt, Mus musculus
ugauggcacaugcccauaaugccuacacuuggaaggcagaggcauggguuuauucugguuuacagagagucccagccagccuggccuacaaugugagacccugucucaacaaauacauaaaacaaucauuuugaaaagucuggcauagguaguaucugaaggacagggcuggcagaagcggcugugaguuuuccauagugaccccaugcugucuuuguccugacagagucacccagcacagcaggagcaggggccacugguggcaucauuggagguauuaucgcugccaucaucgccaccgcaguggcuggcacaggcauccucaucugccgacaacagcggaaggagcagaggcuucaagcugcggaugaggaagaagagugagugaugggcugggaggagggacagcagagcugggagcauggagugggaaccaaaggagaucauuaaggcaguuuaagacaaagaugcugccauaaguaacugagaugucaaaugggugcugaggaaagauuuuucucuucugcaugaagcguggguguuagagucuaucucugagacacugucagagcccagguucccaccaucuuguugcucccuagggcuuguucccuagagcuucagaucuuaaggaccgauaaaugugggagguagaauuaggagaauuagaaguucaaggucaugcuaccucuguuacaugaggcucaaaaaaaacagcaaugaaaaaauaaauaaauaaaaaguuguacaguagccagggagauuagucaguuuguaagaacccgacuugcaucccuagaguccuugggggcagggggaggggggauucaucucuguauuuucugguguguuugcuuacauguaugucuguauacuacaugcauauaugucuguauauuacaugcaugcaugguacccagggagcucaugaguugccguguagauuguaggaauugaacuagggugcuuugaaagagcaacaagugugcuuaaaggcaucucuccugcccuuuauuaaucuuugugauaggacuccacucuaaaccaggcuguccuagaauucagagauccgccugccucugccucccaagugcugggacuaaaggugugcaccgcccccaccuggcuuguugcuuacguuuuguaaaauuagaauuauuauguguuugugcaugugugcacacaggccuuggcauggauguggaggccaggggacucgugaagucacaggguaccuccuuuuccucuuucuuuuuuuuuuuuuuuuuugcguguauucuggggauaaagccuacccccaaguuuucaagacuuuuaccugcugagccaacuugcuugccugguuuguugguugguugguugguuuuuguugcuguuuuucuuuuuaaaagauuuauguuuccuggcagugguggugcacaccuuuaauccaagcacucgggaggcagaggcagguggauuucugugagucugaggccagccuggucuacagaggaagucccaggacagccaaggcuacacagagaaacccugucucaggaaaauauauuauugguauuuguguuuguuucucuuugugugugagugugugugugcgucccacauacaacuguguguaugacugucucuguaugugugccuucugagagcagaagaucuugaaucugggaguuugaguuauaggcuauuguaaacccccuaaugugagugcugggaacugaaccugggcccuucggaaggucagucagugcucugaaccucugagccaucucuccagcccccuuuuaaacauuuagcccaaguucccugugccuugauuuguuuuugaaacaggaccccaccaugcagcccuggauggccuagagcuccucacauagccggggcuggcacugaagucagaaaccuuccuuaguauuaggaaugcaggugugggccacacaccuggcucacuugcuugaaagaggauuuucugaauucuuucuggaggguucugggacugugacuugcucagucugacucccacauggcacuggggcaggggcagggauggugcugaaaacccuguaaaaaccagcaucuccuaccuaccaucaaguggccaggcuggcaggcagggccagugugaccaguccuuuguuccucugguagagagaaccagaggcaccuccuguaagaggaggaacugggaagggggcuaaccucccacugaucugccuccuaccccugaccccugcagacuggaaggaccucccuccuauaaaccacccaccccgaaggccaagcuggaggaaccagagauggugagcuguccccuagaacccgagcuccccugccuccauacccugccuuccucccuggggucaagcugggagggggcuguuggccugggacggggcuggcugggagcagcagacaugaggguccugguuuacucuuguguccuuccacagcccucucaacucuucaccuugggggccucagagcacagcccagugaagacgccauacuuugaugcuggugucucuugugcugaucaggugggagcuuccggggaaaccagggugggcuuaggggguggcuuaaggguugaaggucaagguuggguagaguggagugacuuaugaguuggguagagagagcacucauaugaguugcucagggcugugccuacagcggagacaccaccauggagccauuccccagggggcccccacaucagagacacaucagagaccaucuucuugguggucaagagucagauaaggagaccgaagcagacugagagaucugauuagcacucaagguuaaauaaaauaaauauugaggucagagcugugcaccauaacucuaccuugugaucccagcacuugagagaagagaauuacaggagauucaaccaaucagagcuacaaggcuagcaugagcucaagagugagauuuuguuucaaaauaaccaagaaaagcaacaagaucguugacucagcaguuuagagcgugcugugucaugcggaccagaguugugucugauucacauaccaggcaccccccagugccugugacuccagcuuuaagggaucagauacccuccucuggcuucugcacaaauauuaguacacacacgcauacauuuccaaauaucuagaaaaacaaaaccaaagccaagccugguaugggguacacaccuguaaucucaguauuugggaacugaggcaggauugcuauguuuggauccaaccuaugcuaccuaaugagaccuuguguaaaagaaaacaaaaaagucagucagaucguaacagugcaugcuucucaucccaacacagagauggaggcaggagggucaggaguucaaggucauccuuggcuacagagaacaccuugaguuacauaagaccucuucuccaaacacacaaaaagauuuauguuaggcugggguuauaaggcaguugguuccgguugcuugcccaacaugcacaaagcccuggauucagugcucagcauuuuguaacuacagcagcccagaccugauucuaacacucaggugguugaggcagaaaacucggagacugagacgggcagaucuggcccaccagaacagccagagcuacauaaaaagaaaagaaaagaaaagagagaggagagagacagagagagagagagagagagagagagagagagagagagagagagagacagacagacagagaacccagaggucaaauuuucuuggguaaggauuggguuucagagaucaaagaggaagacugagacaggguaaggagguccgugcugggcuuggguuagaagugacuguacagagaaguuuggucgagggagaaaggauggcagugguguaguuggaucugauuggcagggggcagaucuaggaugccauccugagacugaggugacuuugacaucuugcuuuugcucccuccccacuucuaggagaugccucgguaucacgagcugcccacucuggaagagcggucagggccccugcuguugggggcuacaggccugggaccuucucuucuggugccuccaggacccaauguuguggaggggguuucccugagucucgaagaugaggaggaagaugaugaggaggaagacuuccuggauaaaaucaacccuauuuaugaugcccuguccuaccccagccccucugacuccuaccagagcaaagacuuuuuugugucacgggccauguaugugugagggaggcacaggggcucugacgucucaccuuucacccuugacccaugagcuuuccaccaguaaucuaggacacucugacuuccaggcagaccagggacaacuaucacccauugcaauccaccugugacuucuuagugacuccaccaugacguccaaucuaugaugucugaggcaggcaaaccugcacaacuggaaaccuggagauuuuuaucucccuuggcagggagcucaccauauccuucugcaccaccugugaccccccccccccccccaaggacuccuaagacuacgacccuuugaccaugccacucaguaucucaagaacccuuaaagucccaaaggaaucggaccuugcacuuguccucaggcaauagaguccaacagauaugcaagaacgggaucaggggcucccuguugcucagaccugagcccuccaggcagcagaagcucaccugaucccuccccacccugcuccccaaaggugaaaaggagaggauuccccaauguaagguaggaccuccccaucuccaccuacuccugcaggcaggaaucucagguuucucacacccucuccucagcacccagguuccugucuccagagcaugaauuccagguccaaugcuagaggggagaaccuaaugcaagugugccuugccaccccaaguuugggagacucugcucuuauccugaggacuacugaauucuuuuaaccccuacccagugagaugagaacuacauaucccucuuuaggggaugguguguguaugugugugugauggagaaucugggcaucuggguugggaauuuuauuuuguaagcauuuccuacauaauaugaguuucuacuuugauaaagucuuguguuuucugugagaugugaagugagugggguacaaugaggccugaagcuugaaaggcauccgugaucuguaagucaacagagaauggacuccccucccuccccaaaaagucaaaaaaaaaugccccagaaauuaaugagucauaagcaaaaccgcaucaaccaaaagaaaaaacgguaggcaugcaagaagugucuaagaucaugaggcaaauacuauuuucaaugaagcccccaaggcgugauggguaauggagcuaaacgaaugagccagaagcaaaguaagaaacgagggcuguaggcguaguggguagucgccagaagguaaaagauuccaagauaguucauuagagaaaggccggaaggaugggaaacgugaacaggcagacacgagcuaaaccgagccaagggauugaagcucaaugaaugggggaaugaaugcuggguaaugggaaaggaaugaaugggccaaagauagaagcuacagugacgcaaggagcagacggcaugauggguaaaaaaauaaaagggggugggggggucaaggcagcugcggcguuaagggagaaagcggcauuguggguaggcagaggccggcagguuaucccagaacugguuugaaaccuucccgaggcacugugggaaggggcagcacuuccggcuuuaccgucggggacccugccucuccaccgcggugccugucgggacgcgagaccugaccuugcugccuagcagcgucugcagcgcaacgcaccucuacugauguccccugacccuggcgcauuggccaaugagagaccuagcacgcacgucaccauggccggcccauuagacauacuguagccaauuagaaugugaguugagccaagguccaccaauagucaaggcauuuucuggggcgggucuccgcgccuccaaaaggagggcggggcaaugagcagguaggcgugucaaugcgugugcuaucgacaaauagcgaacuagcuccagccccgcggcgucgcgaaccaaugaacuugggauacacgagccaauaggaagguagaggaagcugcacugacugauuucgacuaggaaccaauaggaguagggcuucaacagaaggguggaacuuccugcuaauucuccaauagaaugucuuucuucuagggcggugggcggaucucggaggacaccgaaccaauagaauccauggggcgggaaaacagcgguggcggcggcggcagcggguucgguugcgcuuagcgcacgggguaggagcggagcccaggccgggaagaggagccgccgcggccgccagugagagccgaguccgcuuugggugggaagggccugggguugcauccgggggugugcgugucgccccgaucccugcccucugaccuuuccccucgcagauaccauggggaacguguuggcugccagcucuccgcccgcagggccaccgccgccuccuacgccgucccucguggggcucccgccgccgccuccuucgccgccaggcuucacucugccgccgcucggcggcggccugggcacugggucaagcacuggccgugguucggaacggacucccggggcugcggccagcggcgcugcggcggccucggaagaugggagcugcggaugccugcccaacccg

SEQ ID NO: 3611 - RNA, 33842 nt, Mus musculus
aagagacaaaagggccgccucaaaaccagccacaaagaccacaggauucuggugagauagagaaagugggacaaggacaaccggaagggacugguagggccagaggacagacugacugguccagccccacccagcgggguucggccugcuggguugguuuaugcugcccccucgcggaaggcugcgauauaaaaaaaggauacugggugggagggacgcagaggccagaugcagggacaggaauauuaagagugacacagaaaaaaacuaugagacaagaaacagaaagugacagggacgcaaagagagacgcacacagucaaaggaaugcaacgagacacggggacuaagugacauaggcacauggacagacaaagaaacaccagagcagagccacagagaaacauggggaugcggagggagacucagagguagagaaagaggagaaaucuggaaagaaaugaugcggcgacacgagaacccagggcagagaucagaaagaaaugggguccacuaagaagugaccccgaccuaccacagcagcaggacuaggagaaaggcugggacagggguguggccucaccaaggggcggugccucaggaagggaggcccuaugagagcccacauacucaggcuaaccagagggcaguggggcguggucugggcgagaaggcauggcuucuccuggugggaggcgaccggaaguuuagaagggggugugaccgcgucucauuagagugaccaguagggggcgcagugggucuucccggguugugugugggcguggcuccaugucgagugggcguggucaaauaguuaauuccaggagaaggcggagauagaaucguggggccagacaggugugggacgcgggaugggcggggucuuagcccugagaggggcggagccugagcccuaggaucggcuuggcgaagaggggcggggccugugacgucaugaguccggcccgcuggagcuaagcgaggggccggggggcgcggauccugagagccaggcgagggaaagcugggccgaacgaacugauccggggagccgugagcggcggaagccggccuggagccggacacuucagaccccugacugcccucccagccgaucgguacacgaagaguggucccuaggcacccccugcccgggcccagucccuccccgggccccccauggcccgggccgcaguccucccgccguccagauugucaccgacgcugccguuguugccgcugcuacugcuccugcuucaggaaacaggugaaaacgcgcggaugccuucgucaguccucagaagggagggaacggggcaucgucccccaccucacucccagcuccccgaggccccuuucccucgugcccccuucuagguuggcccuacugaucgagauucucgcaacacaccgggcucucucuccgagucuccuaaccucccucucugcaccucgcguaaucacaaguguccauucuaacccggguuucugacccccuccaccucccucggcguggaaaggguuaaauccuccccauccugugcugaucacuuauccggaaucuggauuuccgucucugcucuccccccucaggaauguggagaauguuccccccacucacacuagcuggagggucgugauggugaggagggacgacaccccccccccuuuuuuuucuuuuccuucuuguuggguugggcauccgaggcccggggagaauugggcgcgaggggacccacagucgagguucccaagacgaguguguguugggggggggaugaguucggucuuugggagcccuuggcaaaccaaugaugagaguugggggcacucaggggcaggaagggugugagucuggagugcaagccucagggaguuuacagacacugaccccuggguucugggaaaauuaagagguucugccuccaggaucucagaaggcgagccuaacccgggucuagauagaauuggagaaaagggguucaaacuugugggucuuggguuuaacugugggcaaagagcucugcucgcugggguccaggugcaguuaggguccagaggcacuaucuuggcagguucggauuuagcuguaggcaauggaauuuaaugaucaagggacucugaccuuuaccccucugcccccaaauauaaucaaaggcuuaaagacguagccugaaauugggaacuuagucggcugugucccagguagagucagagcccgggagguuugcaguuuuccuccccuucccccuuuccuugugaguggcaacgucccuggggaaguuuuccgguaucgcuuucaccuaguuugggaggggcggggcggggcuggagcgcuaagagucccaacuccugguuucgggaccuuaucucuccuuuggucacgccuuuguccucgaagcacuuggagagguaaaugggaggagccuccucucuaagacucgcuccccuuuccccaccccccagcccuggaggggacuuggggcucugcgaggccagggggugggggugggggauggggugagguguaaacaggugugcugaccucgccccgccccuagcaggugaccuggcuguuucuuccuaacuacacacucugggauggggagcggggaguuucuggagaguuugcucagaacggggaucagaaggaucguagggagaaugccugucacuuuuggccucguuuuuucuuucgucaccuccuuugaggucauuggccuugaccucccagauagaugagaucuguaccugucccucugagugaauucuuagaauccacccgugugguaccucauagcagauuccacagaaccccagagcaaaccuuguuccccuucccagccugcgaacggggaaaccgaaaaggacacucucccaagguuccacucccgucccuugaaagccuuugaaagccagcaacccaauagccaggcugggcaagcuccccaaagugcuuccuauuuccuagaccuguggugacugucccuucucuguugaaucccuggggggauuuccuggggcugggccuucccuucgaacguuggggagaggaccuuggccuuuccuaacccauccuacuccuaucuccacuuccucauuccuucucucucccucuccuuuuucuuuuuucauuucccuuuccaucucucccuucucucucuuuccgggcucuuucuccuuucuguucuguuuguccuuccuuugcucucuccaucucucccuugcuuucccuacaucucuuuccccuggcucuagcugcucagccucccugcuuccuggccuccucugggaauggggcuuacaccaccuggaccuccugcuggagccugagccucccuccccacucuucccuaucucucucugcucaucuaugucauccaggcagccccacacaguggcgggggaggggagaagaggggauggcaggccuggcugucucuucucguuagggaaggggaacugagcagagaagaaaugggggagggggaggggggggcaagagacaggauggagagcagggauauaggaagaggagccaagagagggaggggacggggaucagaccuaugcaaggauggaguaaugcaaggauggagucaugcacaaagaaugaaggaagauugcaagggagggcagaaagauaccagaaaggggcaggggugcuggggugcugggagggguauaggcagggacacuggaagggcagagagguuuggugacaggaaaggagaucagaagaccccagccagagggcuguggagauccugugacuuggagaggucagagcacaggccagucucaaggccagccagcauguaggggccacagggaguuaaagacacgggaggcacagggagucuugcacaagggccagcuccccugcccccgcugggaugcugauacauuuuuaaugccccagcaaugcugagaaacagagcaggaagggaggaggagauggaccaggagagauggcccggcaguaagaaaguaugucaggagccuuggagaggugugagugcuggaugccuagagacauggagaccccagggucacagaaacagaaaccuaagacagggaugaacaccugugacuccagcacucaaagaaagcugaggagggcgggggggggggggggggggcggggggauugcagggaguucaaggccaggcugaguuacauaggaagaccuugucucaagacagaaugguggagucaggccuguaaucucagugccagcgugggggaggcugaggcagcacacuguccacccccagggccgccuuggcuggagagcggaaagacuggggggaaaaaagaaaugggcugggccaguggauagaguguucaccuagcaugcacgacacccuggguuccaaacucagcaccuccaacggcaggcaugguggcacaggacuggaauccaagcgagaauuccggauugcauggcuauguagugagauugaggccaggcaggguuaucugaguccuucucucggaagaaaacaagaggagcaaagcagucggcagagugcuugccuagcaugcaugaggccuaggguucaaucccucgcacccaaaaaucaccagugguagugugcaccuguaauccugcaaauggaagauagagaccagagcuucagaaguucaaaaucauauuuggcuccauaauuaagaucaggacagccuggacuacuuaagacccugauucacacaaaauguauguuauuguggggaguuagccuuuaaucccagcacucagaaggcagaggcaggcagaucucugaguucaaagccagucugggcuaauuagagaguucaggauaguaagucagugucugucuguccgucugucccucucucucucucucucucucucucucucucucucucucucucucucucucucgcacucuagggaaugagaggcaaggggucagggggagagaaacagacccuagaaguaggaucuguacaccagcagaggccagaaucuccuggaauggggauucacacugagguguccgcucucucggcagaccaagaguggucuaucccaggccccagccaggagagccuuugagagcuucaccccaugagccuguccuuccauaggagagguccucugggagcugagccccagcagcagcaggaggcugcgcauccaaggguccagaggggccucgggaggcucacauagaaauccagacacagcccaagccacguacccuggcagcucuggcugaguucucaccccucagacaggcuccggauguccacuguggggguggaaacuaugauuaauguaauuaauuaauuacccagguggcugaggcagcagcugaugcugguccucaaagcccucuggccuugaaggguuugcuccagcccugccccacccugauauggugggggcuaggacacagcuuguuuuauaggugugcaggggccagcugggacuggaggagccagccaggccggaaaucuaagaaacuaggcuuccagacccuccuccagccuccucccucagacuauuauccccccaggucuaacccucccgugucuuuccucagucugggcuuuaccuacgccagaggcagucucuacucuggccugcaggaagccugcuaguccauuccccaggggaggaggaaguguguuugaagacccagcugacaucucuauagagcugucaccagucagaggcagagaagcaaguguucccacuggccacugucucugggcgugguguuggcuguccgugucugucccugcaaggucaccaccgccacuugcugagaagccugcaggaaauguguuucuugcacaaggccacgcaucuuccccggcuucacgacuccaucuccccugcuuccccauccgacacccagaaccccuggcuccccucaccacauagacuucaaacgccacaagucauuaugcaucugucuuccuccccaagcccaauguccugcucccauucccacuugggagaaaacuuccaacuagaucagcagguucucaaccgcuuuccggugaucuuaggaagccccaaccgcaaguuuauuucauugcuacuucaugaucguaaggccauuagaaauacguguuuuucauugucaugacgcacagggcuggaacaucugaccagauaucucuccaucaguauagcccuuacccugguuuagaggcuuuauuuauuuauuuacuuacuuacuuacuuacuuaucguuuugguuuuucaagauaauguuucucuguguagaccaggcuggccuugaacucaguuucgcccgccucuaccucccaagugcugagauuaaagaccuggcaccagaggacuuuucuuggcucucacugaccuuuccaaacuuuaaccuguuccuuccccuuguuuacaacuccccguggcucccaguacccucacagaaaagccuacacacuccacuucagcugcugcuugugcugugggaagacgguauucauaggcuggcauaggccagacucuuccugcaccagccuccccaugcugggguuacaaagguauguaccccccccaccccauacuuggaagcgcagcacuuuuugguugcccaucauucauucauucauucauucacucacucauucauucaguacauuuacagagcaccuucagaauaccagacacuguucuaggcuccggaauacagcaaugaaugaaucagagcucucuuucccuguggcucugcuggggagauagguggaugguugguugguucugugcuggagggagcaaguuaagaauccuuguuaucauuauggugaccagauccugccaucacuagauaaggaggaagccaggcugaccugcuacaacccaugcaaaggccccggaggccagaagaucagagaagagagguuaggauacugagcagcugggcauggacaugaagggucugagugagaagagagcuacugaaggccccaagcagagaagagggcuaccagcuaccaaaguuucuggcuguguguggagacaaagccggagaaguagguaccuaggaggugacccaagcaggaaaggcuggugacuuaagccagagucgggacccugagggagcacacauagucugacuggagauaaaucuuagcgauagagccuaaaggaugggcuuccugaggcuucuacuccaggaggugggagagaacacaucagacuuccgugcugaccugcuacuaaggguuuagaagggccuuuaaaauggacuaguacucaggaggcagaggcagccugugaguucgaggccagccugguuuacagagugaguuccaggacagucagggcuacacagaaaaacucuugucuugaaaaaccaaaacaaacaaaaaaaagcacuacucagccgggcaugguggcgcacuccuuuaaucccagcacucgggaggcagaggcagguggauuucugaguucgaggccagccuggucuacgaagugaguuccaggacagccagagcuacacagagaaacccugucucaaaaaaccaauaaaaaaaaaaaaaaaaaagcacuacucuugguguuggcggggaggggguguugguacaacuaugugaccccaguaucuugaguaucuuggguuccacgguuagcugagacuauguagucagaccccaucuuagaaaaacaaauaaaacagcagccagggagacggcccagcgggugaaggugcuugcugccaaacuugacagccugaguucugucuccaagacccacacaguggaaagaaaagagccaaccccacaccugugcauuggcacccccaccccugccccacacauauguaaaugcaguaauuaaauaaaacaaacaaacauaagccacaguucaucucacucugaacauccauucuuguauucagaauuagagacuuagucuggaggucuuggggcugugagauucuugucauuuguauguuuucauuuaugaagggcgucccuggauaacgaagguuaaccuggaauucucuggccccaaacauccuuaugccucugucuccuuaguuuuggaauuaugacugaaggcugcugagccugguucacugauaccuccuguguguguguguguguguguguguguguguguguguguguguguuaauacaagaggacaauguucaggagucuguucucccuauccacuacucggaucucagagauuaaaauccgguuaucauucuuggcugcaaucaccuuuacccgcugcgccaucucaccaaccccuccccgacaccuuuucaagcccauuuuucuguccuugauguccuuuugccuagcuccaagaccuguucuaauucacauuugcaaagcuguguaaucccagcucuucuggauggugagacaggaggauugaugugaauucaaggccaacugaagccaaacauugagacccugucuaaauaaacaaaauaaaacccaggcggaagcaaaggcaagcccugccagauguggccuguggggacaggcacugacccugugaccuggccugcaaagagugucagaucuuuuacuugaauuguuccaggggaaccugcagggugacuuaaaugucuccauuuuacacaugaaagaacuugggcuugaaaaggucacccagcccagaagcagcaagcagcaggaagcucucaucucucuguguuucaauuugaaaaaguucuccugcuccucugugguagggcugggacccaaagcucuccacgugguacacaagcgcucugccacugagccacgcccccagccccucccugggggauucuaggcaggggcucugccacugagccacgcccccagccccucccugggggauucuaggaagaggcucuacugcugagcuguccuuuuccuaguccauauggauccgcucugcggcagagaugaagcccuuuuugucuaggugugugguggguuugaguggugaggcauaugguacgacucucuuaacugguggccacuugucccauccucccuagcacugucugaccccaguauuguguucugucagauucccucaccaggaccacccagguucuucuuuuuuaaagauugcuuuaagugaauugguguuuugccuacauacaugucugcacaccauaugugugcuguguccaagaaagagcugaguuugggauguuugugagccaccaucucagggaacccaacccaggcccucugcaagaacaaugggugcucuuaacuucugagucaucucuccagccacuggccugcuugcauuuguuuauuuauuuaucuauuuauuuauuuaggcagaguuuagcuacgucuucuugacuggccuggaacucacuauguagcccaggcuuucuucagacacacaagagaucugcgugccuccaccuccuguguggugggauuaaaagcuuuugcuaccacaccccagcuucccuggguucuugugugugaggaggccaggacgguacacucaccacuguucgcugagugggcagcucugccuagggugcuugcucucacucucucucucucucucucucucuuauucucucucgcucucucacucccuuauucucucucguucucuagaugguuguaagcaguuccucauagagacaagucaugugucccucaccucagggcucacugucaauggccacuuguaauuaucuggccucuguuuguuuacaaaguucaaguuuccuguggaccuaggcugagugcucuucaagcauuccuugguccucauaacaccccuggggugugcgacacugucauuauguccucauuaugcagcugggaaacugaggcacagagauguugagcccuggauuuaaacccacacauuauuguccccugggucaucguggaguacuuccuccaaagcugagacacaggcuuccucguuucuauauuuguucacaguggggagacggugggguugaagagauagcucaggcagaggacuugcucagcguccugcacagcugccugaaguucugauuccaagggcuuuuggcgcccccuucuggccuguacagguaccuguucgccguacauagaugugcgcgcgcgcacauacacauuaaauaaaaaaaaaauuacuauauuuuuaaagauuuauuuaucauauguauguacacuguagcugucuucagacacaccagaagaaggcauuagaucucauuacagaugguugugagccaccaugugguugcugggauuugaacucaggaccuucggaagagcagucaguacucuuaaccacugagccaucucuccagcccauacuauuuuuuuaaagugaggaauugggggcuggagaguuggcuuggugguuaaaagcacagaugcucuugcagagguucugaguucaauucucagcauccacauggcaacauacaaccaucuguaacuccagcuccagagaacccugugcccucuucuggccuccauaggcaccaggcacacaugugguacagagacauacauagacaaaacauccauauacaucaaauaauuuuuuuuaaguaaaaauucagccaggcacaagggugcacaccauuuaucucagcauuucuggaggcagaagcaggaggaucucugaguucaaggccaaccuggucuacauagugaguucuaaaacagcuagggcuauguggagagagccugucuccaaaagaacaaaauaaauaaagugggaaaauagaaggggcucgugagaccccacccuccuggaggggacauuggcaguugguugucaggaaggucgcugaaggagggggaguggcgaagagugggguagcgucaggcuuguugcccauguuccaguagauaaccccacggccaugccaauacaaagcaccaggacagaagacgucaaagucagagacagacuucuugggaagaaaggggcucaacaagagccaugugggggugacggggugggggcagugacagugaccagacuauaucauauacauguaagaacccucagggaaaaacgagggaaaaacucaccuagcuuguguaauuugugaaucaaaucaccaucaguguaagaaucggcaggggacagagauggggagacggaacgauggaccaaaaacuuucuaugucaguaugaggaccgaguucgauccccaacacugaggaggcugaaacagaggaaucccugggauuugcuggccagccuagcugaaacugagcuuccggccacaagcaaccuuucucaaauaauguggggugcugagagauggcucagcaguuaagggcacucugccucccuccuggugugguggcacacaccuuuaaucccagcacuagggagacagagaaaaguggaguuuggggccagccuggucuacaaagcaaguccaggauagccaggggucuguuauacagagaaacccugcccccucacuccccgcaaaaagagcacacugccuauucuuccauaggauccaccuguaacuccugugucugggacucugacaccccuuucuggccuccucugguacugcaugcacacggcacacagacuuacaagcaaaacacccaucucauaaacuaaaaauaaaucuaaaaaaaaaaaagacuaaaaugacaaggugagacuuuugggauagcauuugaaauauaaaauaagaaaauaccuaauuuaaaaaaaaaugacaaggugggucagguguggugacucacgguuuuuuuguuuuuguuuuuuuaagauuuauuuauuuauuauguguaagucacuguagcugucucagacacaccagaagagggagucagaucucauuagggaugguuguaagccaucaugugguugcugggauuugaacucaggaccuucggaagagcagucgggugcucuuaccugcugagccaucucaccagcccgacucacgguuuuaaucacaccacugggagacagaccuugugaguacaaggccacucugggcuacauagugagacccuguauaacguaggucagucgagugaguaggaauaucaucucuuccuugguagagaugccugaccuggagaucucuggcuuguucccuccccgacaggacugaccucuuuucucucuccccaggagcccaagaugugcggguacgagugcuucccgagguccggggccgcuugggaggcaccguggaguuaccgugccaccugcucccacccacgacggagcgcgucucucaggugaccuggcagcgccuggauggcacaguuguggcugcuuuccacccauccuucggaguggauuuccccaacucucaguucagcaaggaccgucuguccuuugucagagcgagaccagaaacaaacgcagaccugcgggaugccacacuggccuuccggggacugaggguagaggacgagggcaauuacaccugcgaguuugccacguuucccaacgguacccgcaggggggugaccuggcucagagucauaggugaguggagggaacccuggcuauuucuccguguccuagcuuucagguugaccaucuuuaauguguuggcaaaugucuuuuguuuuguagaaguuuguauguuuguuuuauugagaugggagggggguccccgugucugugugcgcguguccauccccugcaauguuuagagaucagaagacaacucuugggaaucaguucucuccuuauaucacggaguccugaagaucaaacucagguugucaagugucaggcuuggcagcaauugccuuuaccugcagagccacuuugucauuuccagccucugccucuaccucagagugcugggauuaagagcaugagccaucacacccaguuucuuggguccuggggacagaaacagcacuuggguguguaguagcgcaagcacucugcgccaauugagcuucaucuucagccccaguuuucugaacuucccucgcucccucgcuuccucccuuucuuuuaaauaggcucuccuggagcccaggcuggccuugaacuuacucuguacagagggcugaccuugaauacugcauccuccugccuccaucucaagugcuaggauucgaggagugugccagugcaccuagcuuugacaaaugcuuacacugagugccuaccgagucuaguugcucacucugucugccaaggauaugacagacaacaagguauuuuuuuuuucuuugagucaggggcucaauauauagcuagcuaagacacuggccucaaauucaaaacaacgcagcugccccagagcugggucuguagacaugggccauuacacucuacucugguuucauccugagaacaagagccguggggguucuaggcaagcaggacugugacuuggugagguguccuccugggugucacagagaggccaggcaaacuuguuuuaaaaaaaauaaauaaauaaaaaauaauaauguagcuggguggaggauuggagaggcaggaaaggcucaaggaagcagggggugagcuguaggcauagggucgccguggcugaccgcaggaugaggcaguacaauagaaguuuuaagcaguuuuacaaccgcugucccuggauugaaggaaaccaagaaccacaagggacacacccacccauggggccaagagauaacucaguggaagagacccggccagccaucuacaacuccaguuuucacuacacacacacacacacacacagagagagagagagagagagagagaggcaucuacgcacacacgcaugcacacacacaggcaucuacgcacgcacgcaugcacacacacacacacacacacacauacgcaugcacacacacacacacacacacacacacauacgugcgugcgugugcacagacccaugcaggcacaacacccauacacagacagcaauaaaggacucccagcuugcuucaacaggcguggcccaagggcagagacuucucacuaaugcugaaaaaugcccugcaggacacagcaauccagcccuccagacaccgcaacacccagagucuuucccucuuucuggcuucagagcuggagcuuccuuucugagggaugccaagagggcugugcccagagcccagagcacagcucuugccaguuccuucggagcaggucugucaugccagcaacucaggaggcaagcuucagagugaguugaaggccagccugggcaacuuggacucugugucaaaaucaaauuuuuccaucucuucauuuuuuaugucuuuuugguuuuucgagacaggguuucucuguguaucccuggcuguccuggaacucacucuguagaccaggcuggccucaaacucagagauccaaccugccucugccucccaaaucuugggaucaaaggcgugcaccaccacuaacugccugacuucaaagucaaauuuuaaaaaggacuggcuagggaugaaauucuuccaaguguuugccuagaaucccccagugaggggcuggggguguggcucagugguagagcccuugccuagaaucccccagggaggggcuggggguguggcucagugguagagcccuugccuagaaucccccagggaggggcuggggguguggcucagugguagagccccugccuagaaucccccagugaggggcuggggguguggcucagugguagagccccgccuagaaucccccagggaggggcuggggguguggcucagugguagagccccugccuagaaucccccagugaggggcuggggguguggcucagugguagagcccccugccuagaaucccccagggaggggcuggggguguggcucagugguagagccccgccuagaaucccccagggagggggcugggggcguggcucagugguagagccccugccuagaaucccccagugaggggcuggggguguggcucagugguagagccccugccuagaauccccuacugacaggcuugggauguagcucagcaauagaacacaugcccugaauguauucuacauucaaucucccuugcaaacagaagcagggcuggaaguguggcuuaguuguuaggaugcuuuccuguaaugcacaaagcccugcuuuugaucccuugcaccacaugaaacuagggaugaugacacgugccugcaaucccaacacuugaaagauagaauuaggauaaucagagguugaaggucaucuucagguauauaaagugaguugagaccagccuggacuauaugagauacugucucaaaaucaacacacacacacugcaaagcccuucucccaagccucauaaaacucucuacccuuauguaauagcuugaacaagaguacagucaagacauacuucaagcugggaaugguggcacacgccuuuaagcccagcacuugggaggcagaggcagauagaucuuuaugaguucgaggccagacagagcuacacagaaucucugccucaaaaaagaauccuacuuugauagggaaaaauaaauaaaucaaaggagagcugggguugcugcucaguagcaaguguuuccccggccggugagcacacgguccucgguguacacgccuaagcugugcugugaaagggagaaaacgggagagcaacaggaagccuuggggguggcucaggggcagagccuugccuaucauuuacaaaguccucaguuguaucuguaguauugaaagagagaaguauggaagaggggcaggccuacuuuuagaauaucgauuaggccaucgguacgguggauacagcaacaucugccucaggagagcauggugaugucagagauuccuugaggaauccagccuugaacuggggaugggaucugaagaguggagagcccccaacacccuagccaggcuccacaggcaagaggggcuucccaagggaaggaucuggaauaucccaggggcgcugaugggcagacccaccugacgaaugguggucaggaggaacuggugcggauagcagaaggggacagcagacugacagcccaggggauaccugccccggugggcggauccagcaggacacuggagagccgugaguccuggcuccagagacaauacuggauaagagacaggagggagugggccuugcuaucuccguuggagguuuuuccauguuuuccggaaggaugaggugaaaggguaaaaaugaccaccuggggaauuccugcugcuuuuauucccuucuggaagcacaguacaauggcugucacaggaaagcacaccggacacuuuguuuuuucccuucuugugcugagggacggaaccagugccucagcaucacagacaggagcucuuccacugagcccacacacagacccuuagguuugcuuuuuguuuuguuuuguuuuguuuuuuauuuugauaaaaaccucaaguguuucaggcuggacuggaauguguguggcugaggcugaccuugaacuucugauuuuccucccuccccagcaccuccccagugcuggcaugcaccacccaccacaccccauuuauucuuuugauuacugagacaaaagucugaguauauagagcaagccaaccucaaacucaacauccuccugccucagccucucccaguggucagaucacagguuugugcuaccagccuuggccuguacaucuuucuaacagggcacaguggcuauuguaaaauguccuacccaggccuggcuugguguugcacaccuuuaaucucagcacucaggcaaaggcaguuggaucucugugaguucaaggucagccaagaccacauugugagaccuagucucaaaaaaguuauauauacauagguauauaauuuauauuauauguuauauauuuuaaauuacauauaaauaacaauauagcaauauaauauauugcuauauaacacaauauauuauaaaugcaaaauauauaauacauaaauuauauauuauauaauauacauauaugcauauaguaauuacucagacuaggauaauguaugccaaacagauccuaagcacuggguaugucaauuucuuugauccaugcaucagucccaugugacaucagagaaaauaguuuaacuggcugcccagagcuaugcguaugcuaggcuagugagcuggguucugaacccagggagcagauccgugacugugugguuccauguugucuguccguaguccauccugccugguuccgaaugguccgguuuccgugucucucccaccucuccucaccccaccccccgcccccgccccuguugagacguuuguaaagugacugcaaguugugaaucacaagcuuucuuuggucaucucccuagcccagccugagaaccacgcugaagcccaggaggucacaauuggcccccagucgguggcuguagcccgcugugucuccacugggggccgccccccugcccgaaucaccuggaucucaucucuggguggagaggccaaagauacucaggagccagggauacaggcuggcaccgucacuaucaucagccgauacuccuuggugcccgugggccgagcggauggcgucaaggucacguguagaguggaacacgagagcuucgaagagccgauccugcugccagugacccucucugugcgcugugagugugccgggagguggcuuucccucacaugcuguccgugcuggcucaguucugucugccucaggcuccaccagccaaaccuugccuugccuauggucugucuguacuagagauccacccuagccugagucucccagguacugagagguacgcuggcuucuguggguucccgccucccggaaucagagauaagcugagaggggggugagagcccaaagguucaccuacuuccggguuucuagaaaacagaaaaauaugccgggcagugguagcggcucaggccuuuaagcccagcacucggaaggcagagguaggagaucucuguaaauucgaggccagagugcucagcaaagcaaguccaggacagccagaguugauagacagagaaacccugucuugaagaagagaaaacucuggguuuaccugcaaacagcuguccucuguaucgucuucucuggcuuccagggacaacagguuuccugaaaauccucaacuauccuaggccaugguccacgcugguccccggcucuguugcuacacuauuuagucugauucacuguuggaggcagggucauguagccuggucuagccucaaacaccccagacagcugaggaagauccauucauacgcagacccguaaccuguccuguaaccuguagucucugcacagggcucucugcugccugaauccccuggauuucaucccugggcagccuuccaagggguuccaauucuuuuguuuccgaacaagguaguccggguugcccucauauagcuaaggauagccacugcucugaagcuguugauccaccagaugccacuuuaagaguccaggaauacagcuggagagauggcucagagguuaagagcacuucggaagguccugaguucaaaucccagcaaccacaugguggcucacaaccaucuguaauacuauccaaugcccucuucuggugugucugaagacagcuacaauguauucauauaauuaauaauaaauuauauauauauacauauauaacauaucuauaugcagggauuacaggcauggaccacuacaccagguuuuaugaggagcugauaguggaacugagcaucucgugcaugcuaagcaagcucucuagcccagccgucccuccuggugcuguuuaaacugccuuuaucugagcccuacucucccauguuguugacuuuggcccuuggaggccuugggguuccccaagccuucccaaaguguccuaggcuucugcagaaacugccuacagugacagcccucaguuuugucuagggacaucucccaguacucucugcacacaggcuggaauuccuccuuaccccaacuccugcgcgcucgcccgcgugcacacacucccagcuucaauuuuguguuuuguuuugagucagggucucacuauguagcccuggcuggccuugaacuuucuaugcacgagaguguagggcagaggcaagaugugagucuccugaugugggugcuggaggccaaacucucguaaguacaugcucuuaagcagugagccaucucuccagccuugguuuucugaggaagggucucugguguaccugagcucuccuugagcucucuguagcuaaagaugaucugaauucaucuuccugcuucuucgucuucagggcuaggguuacaagcaugaaccacgccacucagaccugguauuugcaguaccauccugucaacucacugugguagcugccucaggaugccagugccucaggaugcucagugugcccuuggcuguguaauagaguccccccaccucaucugcaguagcucuuuccagccauguucauccugagaccaucaaugugagccuggcuacccugacuuccugccugucuacacuggccaccccaaacuaucuggauauacucuauacauguugcguuuugugugugugugugugugugcgcgcacacacacacacaccauacacacaccauaaacaggguaguugcuuucuuggccuugccugagcuaauauccaagugacuuccuggguugggucuacacuggucagagcauacacaguguggccugcuaaccccaguuuguuuugacugauggaucucucaccaccaaugcugcuaacuuguucccaguucuggauuccaccugucucugagucagucaucuuuuucucccagacccuccagaaguauccaucuccggcuaugaugacaacugguaccuuggccgcagugaggccauacugaccugugauguacgaagcaacccagagcccacagacuaugacuggagcacgugagugaugugaaccuagaauugggucugaggaaggagacuggggccuggacaccuagcucugagggaggaggguuggggucugcaucucuagaucuaaaggaaaagggauuaggugucaucucugggucugagggaggagagcuggggugucaucucugggucugagggaggagagcuggggugugcaucucugggucugaggauggagggcugggguguguaccccugggacugagggaggagagcuagggugugcaucucugggucugaggauggagggcugggguguguaccccugggacugagggaggagagcaccugaccucccaggucugcagagggagggcugacuguuggagucuucaggggagacugcucucccagacgccugcucuguugcucaccucaccccacacccuuaggaccucgggcgucuucccagccucugcaguggcccagggcucucagcugcuuguccacucuguggaucgaauggucaacacuaccuucaucuguacagccaccaacgcuguggggacaggccgugcugagcaggucauccuggugcgagguaaggaagccuugugguguuugaguuuaaagcccagugguuucucccuuuggggcuuggguccacuuuggggugucacugaugcugcccuaggaugagagagaaagagucugaccuaccucugcacaggugagcauauaguucagcuuguccauuuuggcuugcagguguagucugugaccauaggcuguaacugggggugaccagagaggagcauuggugggggacuuucaaacugggggccuauacuuaagucagggcuuaagcugggaaugauguaggucuauagacccaguacuuguucaagaaucugagacaggaagauuaaugugaggcuagccugugcuacauaguaagacuccuguuuuuuaaaaaaaaaaaugccccaaguucauugagaagaaaaucaagaaguuggcuugggucuaugguggaggcaaggacuaauggcagcuguggagcuuugucccugggaggagaugggacucucuugaugcucuuuauucuuauaacuacuaaugaacagacccacacaaagcgagaagcagcuugcucagccaugagaacuaucgccaagauccucagcuggagacccaggguauccagucacccagauguaacccuauauaguuggaacaauugucaccgagacacacccuaagaaagagugacccuggccaggaccuaugucaugccauaggagccaggaaagaaugauucuuagaaauacacuuagccagauuuaaguagaagguauggcagaagaauaacaaguucagagcauacaggguguacagaauucguucugaucuagacugggcuacugaacaaaacuauaaucucacaaaauaaaauauaagaagaggccuagagaaauggcagugguggagccccugccuagaaucccccagugaggggcugagggcauggcucagugguaaagucccugccuagaaucccccaguggggggcuggggguguggcucagugguagagcccugccuagaaucccccagggaggggcugggggcguggcucagugguaaagccccugccuagaaucccccaguggggggcuggggguguggcucagugguagagccccugccuagaaucccccaguggggggcugggggcguggcucagugguagagccccugccuagcauguuggaaaccuuaaguucaauccucaguuucuauacaaaacagaagacuuagcagcacugguguagguaccacacaguuugccuaugcaaauacaugaaucugaaguaguggcccuaccaggcaggaccugagccccucagaaacacaacaaauggcuuagaaggaagguguaagauagagccuggcccugugaugugcuggacacagccuuucuugaaaacacacccuugcugaaacacaacaagucuuguucagacaccaagccagcugacaugccuguaggaacacaaacucacguugcuggucagcucugaacccuugggacauguauucauagcaaagcaauuucaaacggggccauaguucacauacagaaacgugcuuccucacacaucugaggagcguuccagaagauaccucugcauccagaaacuccauuagggagaugcuugggucacuaggucaacugcuaagcgauacguauugagguuuccucuaugaaggaagagaggucacucucagcucagggacccggcgggugcaggccucaccuagucacagccuccucgcuggugccuccagagacagcacaggacauacaaggcagagacagggaacgaguagauacauuuguuccgcucaucuucucagacgggguguuuggguauguagcccaggcuaucucuggcucagccuccaccuccaagggcugaggugaugguauguacugcuauaccaagcuuacuuggucucagcuuuacuuagugauaguccacucuacagucgggugcuccugugugcuacaugcagagagaaaacuuggugggcuggagagauggcucagugguuaaguguguggcuugcucuuccagagacuccucccuccccccuguuuguuucauggcccccauguuggacaguuaacaacugccuauuaaccccaacuacagaagcacuucaucuacaggcacacacacacaugggggagcgggcacuggacucccagaaaggaagccacagaccaccugucgugggacacuauuccuggggagacaaggacaaacgguuacuugucccaaacagggaaucaaggacagaucaauguguagauagcaccaguaaguugugcugagguuccuuacagaagcagaaaugacacagggacagcugcaucaccaacgccugccccagugcgggugcucccugcacagccagugggcagcucccgggguagagacugcgcuucccaagcagcuuggugucucucucugucucgucuacaaggcucagcuuucauugccucucauauaugcuuagagggggaggagccagccucacaccugggacuuccuguaaccuuuuaagccuuuuauuuucuaagcuuaaggugauucccuggggauggaauguuuuaucucccuuuuggcauccuuucccuuaagguuuccucuaagaccaagauggagguuuuaauuucaggggaaauuagugccagcuaacaccagcguacuugaggacaucauugcaaagacaagcccaacauuucacaccagcagaaaagggcacgcugagcaccccagaaaccagcggcugggccaggccugcggcacacaccuaagaccagcauucaggaaggcggacggaggcaggaggccagcacuggcuacuuagugagucuggagguggucugugcagccugaggaccugucucagaaaaccaaacaagcugggcaugguggugccgcccuguaaucauaacacccgugagacagaggcaggggaguuuccuugaguuggagggcaaucuugucuauauagcaggugccaaaccagcuuuuguuuugguuugguguuugggguguuuuuuuuuuuuuugguuuuucgagacaggguuucccuguguagcccuggcugcuggcuguccuggaacucacucuguagaccaggcuggccucgaacucagaaauccaccugccucugccuccagagagagagagagagagagagagagagagagagagagagagagagagagagagagagagagaggauauaaauccaauuggcagaaguuggagucucacaccagggaaacauggguccugccgcucuccaagguacugaccccacacccacucucagacacacagccuuaguucccacgcauucaccaucuugcaugagcauggcuuuaaauuuucaacaaugaaaaacaugagaggacacgcugugcuacaugguaggccucucugcagccaacucacaauccuugacucaacucacugacccaggaauaggcagcucaagauccccagccccucccucacuucaugggugcacccacauuuccaaugaagcagccagcagggacucacugaccagcacucagaccucauuccugccucugugcaguacuuagaaacagacauacugucaaaguguccuuucagagcccacccccacaugcuagauguagguccauauauauagaauaugcuguuugcauagaacuugcacacaacucccccaaacuaugacuuuauuuguauguuuuuauuauuuugucccuuggauuuugguuuuuauguguuguuuugaggcaggaucucacuguguagcuccaguugguggggaacucaugcuguagaccaggcuggccuuaaagucagagaucugccugccuccgccuccuccuauguguugggauuaaaacugagcaauaucugagcccagcacaguacucuacuugaaaacacuacucaaaaccugggugugauagcccagcccugcaauuucagcacuugagaaguagguugcauggggcugaacaaccuguacucccggccaccaacaggcucacuggucaggaccuuucaggcaucuauuccuguuccccuuaugggcugaggacaucaucacagcccaacgagacucucguguuacaaaaaagucaccauaaugggcaaggcuucaaaucccuguacuguugauuuccuuuauauucccaugccaugguggaguagguggggagcgagcugugggggugaggugaacaugaggccugcaggaagcagggaacaguaggaacagcagcgugagguaggggagaugauucaagaccucccaaaccaaggagauacacugauaggacuagugccucccacuacuuccucccauauucacauucuggauccuagugggagagaacagagggccucuacuuacaguggccucccauccugcacuucugaacacacaaggggccagcaccccgugcccuacagcaucuaucacugucucuauugucuuuuguuguguugagggagagauggagaccaccugaccucagacauggaaucuuucuuaacuuccucaauaggugugacuacaggucacaaaaauggcuuuaauucuuaguguuaguuaaugcuggagauggaauacagggccucuaagcaagcaaaugcucuaccacugagccacgccccagccccucacugggggauccugggcaggggcucuaccacugagccacgcccccagccccucacugggggauucuaggcaggaguucuauugcagaucaucugcagcccaccaacacccuuuguugagauuuugagagucuggagucugacuacguggcccaggcuaaucuugauagcaugaucccuuuuccucauucucccgaugcuaggaaggcagucuugugcuaccacaccuugcuauaaucuucauuuuggggggacauuauggguauagauagcuaucugggcagcaucagcuggcagccucuccuuguacagugcccauccugaagggucacagauaccccuuuucucuuccuccucgccuuccuccucccuucucccagcuagucaccuccuaaguucuggucuggucacuaacccauguccugggucucccccaugcccucacgcccagauguguccucuugacucccucuccucuuuuucucucuccuuccuuucuccucagacaccccccaggccucccgagauguggguccgcugguguggggggccguggggggaacauugcuggugcuacuccuggcugggggguuccuggccuugauccugcugagggggaggaggaggcggaagagcccuggaggaggaggaaaugauggcgacagaggauccuacgauccaaagacucagguguuugggaacggggguccugucuucuggaggucagcauccccugagcccaugaggccagauggcagggaggaagaugaggaggaggaggaagaaaugaaggcagaggaaggucucaugcuaccuccacacgagucaccuaaggacgacauggagucccaucuggauggcucccucaucucucggcgggcaguuuacgugugacccuacgauauagacacuggacacauggaaacaccaaguuccacccucacugccaaccacaccaaugccagccagcaacgauggcuagggaccgguuggacugguucuucuggggcacacuggaguuggaagggcaccgccccugcuuucaggauagaggacaaguggaaccacacagacuccuaucuuuagggccucauggaguaggggaccccaggagcgccauggugcacacucaggacuccucagagcuugcuuucggccccagccuagcccuggccccgaaacacucaggagcuaauaaaugccuugucggaaaaccucgggguguuuuguaauccaucagaccccucucuuuauauccuggggaacgacugggugggacagggaccacucaguaugaaggaaaaaaaacagcuggggcccagguugggagcucuuaggccacuuguacucaccccuuccugaagcugcagggacuuagaauguggucucugaccuugaggcucugagccaugaguguggggaaaggggcuugaacucuuagauaagaggccgggugggugaccagacuggcuucagagcugcgcuuccuuaggaagagcaaagcuagcugccuugguccuggguccuaaugguaggggguuggggggugcggggggggggugccacacagaucuccuuucacugguguagaggguccuaagaauggaggguggcuucucuauuugagaaccgcaaggcuauagagguuggcgucagguguggcaauacccagauggccccaccuugauguccucaaagcagccugucuuuggauaccugucuuccacccuccuagcagggcuugguucuguggaaauuaucggcaauucugaugcgucucugagcccccacaccacacacacaaacauauacauaugugucuguguauguguaucuauacauacauacacagacacauauguacucaaacacaguguacauacacagauacaccacauguacagcauaugcagacacaccacacagauguagacacauauacucacaacacacacagagacaacacuacauauacaacaugcacacauacacacaucauauacuuacacaggcauacaccacacacacacaucucucaccuaugcacacugacacacauauacucaaacgcaacaugcauagauaccacagguacaacaugcacauacauguuucuccucaagcuagcagccuuuugacuugggcccccagagcauuugcuccugagagaaguugaacucuuaucuuccccacauaccuguggccucuugggacacuagcuaggaucugaugccaccuucuggguggguggagcugccaggaggccaggucacaggcacuuccucaaccaguagucauagaucucagauuaccaagccugugucugccaugcuggggacaaaaaaguggcccgggucacagagccuugaccugugggaauguagccagccagcaacaauggcaggaaaugcugaguguuugauauggccauggguaaugcacaccaguuaaccaacauacgcacacuggaaccuucuaggggacagccagcuggagagcggaugcugacagucccccuugggcagcuuccgcuccgugugugggaagcacauuaacuucacagaugacaccuguaagguuuugaauccuugucuccucugaggguuccuugugaacccgccauguucucagccauggagggcagggcgagcaguugacuugauuugcacacagauccccgcuuccacgccugcggugugucugacccagggcaaugggucuggugaggaaugagguacuugcugcaggaacucugccauuaggggaggcacagaacaguugggauuaggaugucuggagcucucugcccggucaccugaugggcccgaaaacaucgcauucugaucauaaggggugguccuccucccucggcccccccaucccucucucuucucuucaguccaacccagaaccacugcugcuccuguuuuguucuuuuaacuuuuuuuuuuuuacaacgguccucaaaugcugcagccgagguugaacuugaaccucuuccugcugcuuccgccuaauaugggggcugggggaggucguuuuguuuguuuuggucuuugagacagucuuggcuauguagcuguaacuggccuggaacucacuauguagcccaggcugguuuuauacucugugauucuccugcuccagccucuugaguacuggaauuguaggugccucuaaacucacaacuagcucuucuuccuuaaaaguaccgugugucccugucugcaauacccagaggacucaaaugccccuucacagauucacccuggcuggcuggcuuagugggugcagcauucuaugacuucuugucccccuccuacucuguacauguggccaguuccaucuugacauuggauagcaucaaaucugcuuguuugcuguuggccaaggcaagccugagcuacaggaaacuucagcuccaugaggguggaaaguuccuguuuugaguacaccucuaugcagaucaauguuccugaaaucaggugcacagggugauuugauaaagccaagcuccuggccaugacaggguugacaggcaggggaugucguuagacauacauagagcacuugccuagcaugcuugaggcccuggguugaguucccaaugcagccaaaaggaaacacacagcacugcugguaugauggcacaugcccauaaugccuacacuuggaaggcagaggcauggguuuauucugguuuacagagagucccagccagccuggccuacaaugugagacccugucucaacaaauacauaaaacaaucauuuugaaaagucuggcauagguaguaucugaaggacagggcuggcagaagcggcugugaguuuuccauagugaccccaugcugucuuuguccugacagagucacccagcacagcaggagcaggggccacugguggcaucauuggagguauuaucgcugccaucaucgccaccgcaguggcuggcacaggcauccucaucugccgacaacagcggaaggagcagaggcuucaagcugcggaugaggaagaagagugagugaugggcugggaggagggacagcagagcugggagcauggagugggaaccaaaggagaucauuaaggcaguuuaagacaaagaugcugccauaaguaacugagaugucaaaugggugcugaggaaagauuuuucucuucugcaugaagcguggguguuagagucuaucucugagacacugucagagcccagguucccaccaucuuguugcucccuagggcuuguucccuagagcuucagaucuuaaggaccgauaaaugugggagguagaauuaggagaauuagaaguucaaggucaugcuaccucuguuacaugaggcucaaaaaaaacagcaaugaaaaaauaaauaaauaaaaaguuguacaguagccagggagauuagucaguuuguaagaacccgacuugcaucccuagaguccuugggggcagggggaggggggauucaucucuguauuuucugguguguuugcuuacauguaugucuguauacuacaugcauauaugucuguauauuacaugcaugcaugguacccagggagcucaugaguugccguguagauuguaggaauugaacuagggugcuuugaaagagcaacaagugugcuuaaaggcaucucuccugcccuuuauuaaucuuugugauaggacuccacucuaaaccaggcuguccuagaauucagagauccgccugccucugccucccaagugcugggacuaaaggugugcaccgcccccaccuggcuuguugcuuacguuuuguaaaauuagaauuauuauguguuugugcaugugugcacacaggccuuggcauggauguggaggccaggggacucgugaagucacaggguaccuccuuuuccucuuucuuuuuuuuuuuuuuuuuugcguguauucuggggauaaagccuacccccaaguuuucaagacuuuuaccugcugagccaacuugcuugccugguuuguugguugguugguugguuuuuguugcuguuuuucuuuuuaaaagauuuauguuuccuggcagugguggugcacaccuuuaauccaagcacucgggaggcagaggcagguggauuucugugagucugaggccagccuggucuacagaggaagucccaggacagccaaggcuacacagagaaacccugucucaggaaaauauauuauugguauuuguguuuguuucucuuugugugugagugugugugugcgucccacauacaacuguguguaugacugucucuguaugugugccuucugagagcagaagaucuugaaucugggaguuugaguuauaggcuauuguaaacccccuaaugugagugcugggaacugaaccugggcccuucggaaggucagucagugcucugaaccucugagccaucucuccagcccccuuuuaaacauuuagcccaaguucccugugccuugauuuguuuuugaaacaggaccccaccaugcagcccuggauggccuagagcuccucacauagccggggcuggcacugaagucagaaaccuuccuuaguauuaggaaugcaggugugggccacacaccuggcucacuugcuugaaagaggauuuucugaauucuuucuggaggguucugggacugugacuugcucagucugacucccacauggcacuggggcaggggcagggauggugcugaaaacccuguaaaaaccagcaucuccuaccuaccaucaaguggccaggcuggcaggcagggccagugugaccaguccuuuguuccucugguagagagaaccagaggcaccuccuguaagaggaggaacugggaagggggcuaaccucccacugaucugccuccuaccccugaccccugcagacuggaaggaccucccuccuauaaaccacccaccccgaaggccaagcuggaggaaccagagauggugagcuguccccuagaacccgagcuccccugccuccauacccugccuuccucccuggggucaagcugggagggggcuguuggccugggacggggcuggcugggagcagcagacaugaggguccugguuuacucuuguguccuuccacagcccucucaacucuucaccuugggggccucagagcacagcccagugaagacgccauacuuugaugcuggugucucuugugcugaucaggugggagcuuccggggaaaccagggugggcuuaggggguggcuuaaggguugaaggucaagguuggguagaguggagugacuuaugaguuggguagagagagcacucauaugaguugcucagggcugugccuacagcggagacaccaccauggagccauuccccagggggcccccacaucagagacacaucagagaccaucuucuugguggucaagagucagauaaggagaccgaagcagacugagagaucugauuagcacucaagguuaaauaaaauaaauauugaggucagagcugugcaccauaacucuaccuugugaucccagcacuugagagaagagaauuacaggagauucaaccaaucagagcuacaaggcuagcaugagcucaagagugagauuuuguuucaaaauaaccaagaaaagcaacaagaucguugacucagcaguuuagagcgugcugugucaugcggaccagaguugugucugauucacauaccaggcaccccccagugccugugacuccagcuuuaagggaucagauacccuccucuggcuucugcacaaauauuaguacacacacgcauacauuuccaaauaucuagaaaaacaaaaccaaagccaagccugguaugggguacacaccuguaaucucaguauuugggaacugaggcaggauugcuauguuuggauccaaccuaugcuaccuaaugagaccuuguguaaaagaaaacaaaaaagucagucagaucguaacagugcaugcuucucaucccaacacagagauggaggcaggagggucaggaguucaaggucauccuuggcuacagagaacaccuugaguuacauaagaccucuucuccaaacacacaaaaagauuuauguuaggcugggguuauaaggcaguugguuccgguugcuugcccaacaugcacaaagcccuggauucagugcucagcauuuuguaacuacagcagcccagaccugauucuaacacucaggugguugaggcagaaaacucggagacugagacgggcagaucuggcccaccagaacagccagagcuacauaaaaagaaaagaaaagaaaagagagaggagagagacagagagagagagagagagagagagagagagagagagagagagagagacagacagacagagaacccagaggucaaauuuucuuggguaaggauuggguuucagagaucaaagaggaagacugagacaggguaaggagguccgugcugggcuuggguuagaagugacuguacagagaaguuuggucgagggagaaaggauggcagugguguaguuggaucugauuggcagggggcagaucuaggaugccauccugagacugaggugacuuugacaucuugcuuuugcucccuccccacuucuaggagaugccucgguaucacgagcugcccacucuggaagagcggucagggccccugcuguugggggcuacaggccugggaccuucucuucuggugccuccaggacccaauguuguggaggggguuucccugagucucgaagaugaggaggaagaugaugaggaggaagacuuccuggauaaaaucaacccuauuuaugaugcccuguccuaccccagccccucugacuccuaccagagcaaagacuuuuuugugucacgggccauguaugugugagggaggcacaggggcucugacgucucaccuuucacccuugacccaugagcuuuccaccaguaaucuaggacacucugacuuccaggcagaccagggacaacuaucacccauugcaauccaccugugacuucuuagugacuccaccaugacguccaaucuaugaugucugaggcaggcaaaccugcacaacuggaaaccuggagauuuuuaucucccuuggcagggagcucaccauauccuucugcaccaccugugaccccccccccccccccaaggacuccuaagacuacgacccuuugaccaugccacucaguaucucaagaacccuuaaagucccaaaggaaucggaccuugcacuuguccucaggcaauagaguccaacagauaugcaagaacgggaucaggggcucccuguugcucagaccugagcccuccaggcagcagaagcucaccugaucccuccccacccugcuccccaaaggugaaaaggagaggauuccccaauguaagguaggaccuccccaucuccaccuacuccugcaggcaggaaucucagguuucucacacccucuccucagcacccagguuccugucuccagagcaugaauuccagguccaaugcuagaggggagaaccuaaugcaagugugccuugccaccccaaguuugggagacucugcucuuauccugaggacuacugaauucuuuuaaccccuacccagugagaugagaacuacauaucccucuuuaggggaugguguguguaugugugugugauggagaaucugggcaucuggguugggaauuuuauuuuguaagcauuuccuacauaauaugaguuucuacuuugauaaagucuuguguuuucuguga

SEQ ID NO: 3612 - RNA, 2075 nt, Mus musculus
ggcuuccugcucccgggggagggaagccuggccagucggggaucuacccggucaaccccuggcauccaaacuuccacucuuccaaugggggagaagggaggcagaaccccaaguccucaagccuggggcagcuucauuggguccagccuucagcugguuucuggucccccuauccuggcauccguaccgagggcuuucuuggaaucucagaaaaacauugucguaagucaacuaggaccccaaguggucccucuccuauguuccuuggagggcccaggaauacaacgccccaaucuuuauuucagguccucaggcacaggcggcuucacauuauuacagcgcguccgggcuguuuguaaaguuugcuugcuuucgggagcauagaggcuauuaagugagggccaagaccccugagccaccaccccaccccugguuuagccugcuauucuguuuugaaauucuguacuuuucuuuaaaaugcauggaaccacucccguuuuguuuuaagacugggucgccacccuccagccucaguuucccuagugcugcaauuacagguacacacaccccauuucuuucccuauaucccuugaagauggagggaucccauacuccaguuccggccccgagaccuuaaggcacacaccccgcucgcucccuuugcagagauuugcaguuuccuauuccugaccucuggggguucuggauggccuugcucuggagcccaggcuagccuuccuccugagcuugcuggcaguauuauaagcuggagccacacaaugcuggcucuuucugagucuugcugcccuccacgcagucaaggcucgaccagaaucucugggaucuagacuugagguccccugcccagccucgcugccuuccccuccccuccuccagccugugugaaguggggcucguggcucaggcaagcuggggccaggcccgcugcccauuccgguaagccccagcggaagggguuaagguuggagggagcaccgggaggggcaggcugugaggaguggaggaugcugacgugggggaggcugagcagcugggcugcggucaaguugugcgggaagggauuuccccgaggcggcagcugaggcagaaguguuugcguugggggagagggaggaggggcugggacuggagacagcacucugcuuaccagaccacagacagcucagcccugaggacagauacaaauuaaacccucucagcuuuuagccccuggggugggaggcagauagaguugauugagcccuuuaaggacacuuucuccuucuugagccuacagccuccccagggcggcucuguucaaacaguaccuacucaaguauugagcgcuuacuguuugcccagcccuguucuguguaccuuguguauacaggguugugaaaggucuaugaccaggccugguuuccaaacagaaacugaggcuccacaacaaucaagccagcuauugagccuuucucuacacaaagggccuacugauuucuggcuagggcuuccagaccccucaaaccaauucucacacgaggguucuuuagaagucauuucagccaaaugcuaaucccagcauccaggacacugaggcagaaggauugcuaugaguuauaaguuggccugggcuacauggugaguuccaggccaaucugggcuacagagugagauccugucucaauuuaaaugaagaagcuggacauggugguacagguuugugaucucagcauugggagauauagaagcuggaucaaaguuguccuaggcuagguagugcguuucaggccagccugggcuacaugugaccuuuacacaacaaaacaaagcauuuuuuuuuuuuuaaaaaucucuucccagaaggugcauacuuaugauuccuguuuuuaacagagagggaaacugaggcacagaggaggaagaaacagccagcugagguucacgcccaccuugacugagcagcagcagucaacugcauggaauguucauucuaugcuccgcccaggccuaaacccuccccuggcucagcagauacccaagcaauaaaucagagaauugggaaauccaccaugagc

SEQ ID NO: 3613 - RNA, 12226 nt, Mus musculus
uggcuugcuauauacuuaauaaaugcauauauuuugaaugcauuuauuagggacacuaugacuagugcagcauucuccagacuguccugugagaguggagcaguuagacuuagacgcccuaucuggaaaaugcugcuuggauguggguuaaacguguuuagaaagagccuggaaaauugugacuccccagagaagucacuuaaguuagggaguuuuugcucagaucucucucuaauuagcauggugaaucugucuacagcauccccaggaccccaacucucucacuugcucuguuucuugcagggaagaccucucugugaacuguuuauacaacuuccauuuuugauuauauugaacuuaaccacgagguggccagaucuaguugcaaggacuccugggaaauguaguuuuuauguugagaaggcugggucuccucaccuguggucagauugagcugggcuacggugcaguaauaagaagccccauuuuacucacagcguggcucauuuaggguuuauauuucucacuccugugauacuucggucucagguagacagcuaugaaaagggucaggagaacucagcuuuaggugggcucauucaggaaccugacugacagggcuagucacugugacuggagucuggagggaaagugauggcgcaccuggacuacugggcacugcuugcacccacauuucauuaaucagagcuuuuugcauucuaauuaggggcuguggaaaugcaauuccaccuaaggccagaagagggagaaagagcacagugugaacaucaucuaaccgaacuugaaaacacacacagacacagacacagacacagacacagaugcacgcacgcaugcacgcacgcacgcacgcacacgcacaugcagacacacacucaaauaaauuuuuuuuuuuaaauuauaaauuuggcuggcugcugguagcacacgccuuuaacucagcaaccaagaggcagaggcagguggaucucugugaguuugaggucagccuggucuacaaagcaaauugcaggacagccagggcuacacagagagacuuugucucaaaagaagaacuuuuaaaaagacauaauuaagcccugguuuauucacuccuucugucuccucuggcccucaggucacaugguugaucuggauggccagcuuagucaugcacugguuguaugagaucaaagccuggggaagucccuccgaggggcucauuugcauauugccaaucagcugugguuguaacguccccucccugggauccuucagcauccccauuuccuguuugcuggaacaaccugcuaucaaagaguggcuuaaaacaacuacaguuuaucaucuuacaaucaaacgccgugaguccaaaguggccgucacugauccuugggcccagaggccacaggguggggcaguuucuugagcuuucaagcuuccagagacuuccuccaggcgugucacgugucacgucuucccaguggcugaggacuaacuacuguuuugucccccugcgguugaggauuaaacccaggccucucuccaguuccgcaagcagcccaucugcagagccgcgcccccauguucucagucccucacgggugggcucugggcaggcgcucuacagcugugcuguacagucccaguccucuguguggcugauuuugaagcaggucaggggucgggcaguuaauuugcccaaggcuguuaucuuccugacagguguuuggcucuaugagcaguggcucucaaccuuuguauugcugagacccuuaauacaguuccucaaguugucaccacaaccuccgaccauaaaaauaauuuuguugcuacuucacaacuguaauuuugcuacuguuaugagccauaaucuacauaucuggcauuucugauggucuuaggcaaacccuaugaaacaauuauuugacucucugaagagguuugacccacagguugagaaccuccggugguugugcggccuuccugguagugcuuucuucccaaggaaagggcuucuggguaacugguuaaagcuggauggaauuuuaugguggaguaccaaggccuucuucccaucacucaaauaccuggauggggccgcuggccuuggguggggcaggagccugcuuucuuagaggcagguggcccaagaggcacagacugaagguuguugggacauuggggaucugggguugucagucucucaucccgagaggcacugacuccaugucaugcugagucuauggcagagcccaucuugccaguuucccugcagcguuguccugugggugucccauguguccuuucuauaggugugaagcccugagggguggggucuggaaguugagauucugucuucugugcaggcugggccgaggguccaucaggaaguuggcaccagcuggcaguauggggcugggucaggguuuaguagguccuaggaagagggcaacaggaacuaugaggggcaggagagguggcgguggaagagagacagcggugguggcccagagugggguuggggauaugacagagaauagaaccaggagacugaaagagggugagccccagaguuaggggguacuagggagcaggagagguguacccaaaauaacaggggcaaggccagacaggaaagaggagaggacgagauacuaauaaaccaagagggaaaggaagagggagggggagagggagggggagagggagagggagagggagagggacccaggagaagauuggagagaccugauacccaauccagaaaugggucccuucauguaguggaauugcauaaaggccugaccugcucugcugugugacccuacgcaaucucuuuucccucucuggaccuugcucauccuguauagauuugaagcuuucgaucauuucuacagagaaggagcccaggcccaggaaggcaaggccagguccagugguucagucucaaggaagcugaagcagguuucacuggggagcuuucuugaagggagagaggagaggacaguccaugucccugcccaucugaccuucuagcucauggcuccaugggguucuuguggggugggggguaagcaauccauaccugauagugcuggugcucuggcucuggcuccugagaugcugguggaggugguggaggcugacucugcaggggagagguacaggugagaggguuccucacacccuccagucuuugauccugguguuauguaugacgcacaggcccagauucagaguccccacugacccucugguuaugaggccacuuagcaugugucacacaucuuaggcaaugggcccgaccgugagggcuucuggccuguucagaagccuagcuucuccucaacacgaggguuaagcaaauugccuuuguuguuuuuacauucucucucugucucugucagucuuuuacaaauauuauuauuaccaggggugguggcgcaugccuuuaaucccagcacuugggaggcagaggcaggcagauuucugaguucgaggccagccuguucuacagagugaguucuaggauagccagggcuauacagagaaccccugucuugaaaacacaaaacaaaucaucaucaacgucaauaauuguauguagggugcacacauacagacgucugagggugaguuuggggaucaguucucuuugacuuuuaugugggucccaggaauggagcucagggcccagguuagaggagcaagugccugcucagccauugucuggcuccuuguuuuccugauccguuaaagauuucuucuaauuuuuauugguguguguguguguguguguguguaugugucuaugcugugugugucuaugguauguguaugugugugcuaucuguguguauaggugugugugucuguuugugucugugcugugugugugugauuaugugugugaguguguguguguguaugugugcauguauuuguaugucugugugucuguaugucucuguguguaugguauggugugucugugcugugugagaguaugcauauguguguaugugucuguauuugugucugugauuguguguguaugugugcauguaucuguauggaugccuguaugucuguguguauguuuguguauaugugguguguguguauuuuugaguguguaugucuaugugugugaguguauguuuauguguuugucuguaugugugugucugucugugugugguguauauguguguauguaugucugguguguguguuugugaguauguuuguuuaugugugugaguauguguguaugugucugugcuaugucugucugucugucuguauguuugugcaugguguauggguaugugucugugcuaugugugucugugugugagugugugugucucugcguguauguguguguguguguaugugucugugcuaugucugucugucuguauguauguuugugcaugguguauggguaugugucugugcugugugugucugugugugagugugugugucucugcguguaugugugugaguaugugugugugcaugauaugugagcacgugcacgugacugcccacugaggucugguacagggcaucagguccucugaagcuagaauuauagguaguugugagcugccaaugaggguacugggauccaaauuuggguccuuaaaaguagcaagaacaugcugagccauguuccagccaacucccuccaccuccuuucguuguuguugguuuuuguuuuuguuuugaggcagggucucaaucuaguccaggcuugucaagcacuuggacagcgcuaccagaugggcauaagaacugcugaggugggaaucucagacaucugagcuggcaggaguggcgcugccacacuccagccuccaaugccugcucugcagcauguaaccauggccaccaacugccaggaccauggguauucagucacauagcucagcaccuggaguucuuccuccucuauaccacagaguaucucaauccccguagccuucagccagagccuucccuuccuggguacucuuaugcccuuccccaaaauuauauaaucccugguucaccccgaauaaagcaucuacauccuccccaauaacggaacacgaacaaggggcuggaagcgaugauucagcauugaagagcacuggcugcucuuccagagguccugaguucaaaucccagcuaccacauggugggucucucaggggaucugaugcccucuucugguaugcggguguacaugcagcagaacccucauacaagaaguaagugauuuuaaagaacaaaaugaaacaugaacaagcaaagauggucucacagagaugcaucgucaaagauccccacagggaaggccuucacugaaaugagccaagcugagacgcacuaagauucccgaagaaggccucucucuucucccaccccuucagcacucacugccaacuggaccggaauccugccugucccuggcucugcuauccccuucuggcuuggccucaaacuuggaagcugacuuuaagcuccugacucuccugccuccagugcccacacucugggauaauaguugauggggacguugugauucuuuggugucucugccugcacaucguguagcuuccaugagcccucaccaguacuggguguggcugccacgguccuguaagugacccuacaaaacucacugguucaccacuggacuucgauggaauccuugcuuuaguugucguugggcuaucgcaggugaugagacacacaagaauuggagagaggugcuggcaagauggcucagugggggcaaggugcuugucgcuaacccugaugauaugaguucaaauccaagcacucacaugauggaaggagagaacugacucccacaaguuguccucuacauccgcaugcaugucauggugcguguuccucccuccacccccacauaugcaaaagaaggagaggaagacagaaugaguugacuggagagagaaaugaagagucauggcuuccaggugcccaggcaccauagcuaacuccggguagagguuuuucgagaggcaagaucuaaggggacaggacucaccaugggugggcuuccuugcuccaugucacugaugggagacaccaggaagacuggagauggcaucacuucauagauguugcugucaccugaaguagaggaggaagggggucccaugggcagaugacucaccacuguagaacccguucuaccugccuguccauuucgcucacucaguugcucaacuaacauuugugcaaauuucuccuccugccagauaugugcuggggacacaguggugacccagacaauccaugccacacccuucuuaaacccaaagucccuugggagaaaagagacccauccccagagagugacaauccagagagucuaaggcuggggaugggggauggggaauaggggauguggaaacagaaacaguccuggccaggcuggauaucagggaggacuaccuggaagaggguucaucugagacagugggaagugagaacuggccagaggcaggagggaagccugcaggagcuuggcaagagagcccacugucugcagauaaugagggaccugagagccaugcuagggagacagaagucugucccaaggcacugggggagcuauggaaggcuuauuagcagaagacuuguuaagagaaggaacccuagaggguuaggaggggccuuaaaucucucggagcuccccagugugcccaaagguccccaaggacucugacugcaugugggcauggaggccuuuaacugggggagacacggaagggcugggugcaaaggcacuuucuccuggcuuaccagauucaggacucagguucacuucuggcuucucuguggcuggauuccuagggguacauagaagaacccugagaugcuaggguggaggagagggaccccgacauccuagagacucugucucccugauuccuaccuauuaacuugauuuucacccagccugggaaagacaggagaguuagaggggaaagaggaguuagaggacacagagggaguucugggaacuguaccuggggcuccggcccuuccggcuucgagugaccaggacauaggcaaugccacauacaaguagugacccgauagcaagacucccaaugaugauggcuaccgugaucccggcauggacagggaggagugaggagaccucgcgugcaccuaggagugaugguugucucagggaagacaucugucugcccucaccuaauuccuuacuuugcagugccaugcuaagcaggcuaggcauccauucuaccacugagccacgcccccagccccucacugggggauucuaggcaggggcucuaccacugagccacgcccccagccccucacugggggauucuaggcaggggggcucuaccacugagccacacccacagccccucacugggggauucuaggcaggggcucucccacugagccacgcccacagccccucacucugcccacucauguuaucaguuuuuaaaaaaauauuuuuauuuugagauagggucucuuauagucaaggcaggccucaaauuuacuguguagcuaaggaugaccuugaacuauauagcuaaggaugcucaaauuccugcacaugagugugugugugucuguguguguguguaugcgugugugugcauguagauaaggccagaagugggugucaagugucuucuucaaucagugucuauguugguguuugagacagugucucucacugagucuggaguguccccuuggcuaggcugggucgccagcaaaucucaggggaacuucugccucugagacugacccagacccgggaaugcagguguucaccaugugcaguuuauaaguugcuagggauuuaacccagggcuucguguaugccaggcaugcacucugccaacugagccacauguacagccuaugugaauuuuuaaaaaucuuauuguaugugucugaguguuuugccagcaugugugucugcguaccaugugcaugucauguauuuacagaggcaagaagggcauuggaacucuaggugguugugaguugccgugugggugcuaggaaccaaacccggcucuucuggaagagcagccaguggucuucuuaucugugagcaaucugagagccuuguaaaucauuuuuuaaaaucaaugcuuucccuuuccuuuucccauuuucccuuccuccccuccucuuuucuguaauuuugaggggcgugguggcgcacgccuuuaaucccagcacuugggaggcagaggcagguggauuucugaguucgaggccagccuggucuacagagugaguuccaggacagccagggcuacacagagaaacccugucucgaaaaaccaaaaaaaacaaaaacaaaaacaaaaaaaagcaggauuucaauaaauugcccagacuugcuuuggacuuucuauccuccugccuccgccaucaggcugcgcuagaaucucaacccaggcagggcucauaguccugggccaugguguuuaaaguauuccaagucccucaucacuuccucaucgcuguccaccagacagaagcagucuccucaggugaacugucucccucugguaacauguuacuauuucuuccugagcauaaacagugaauuuaucaguguaggugaaacauuuugauuucuagagcucaaaaggaaacagugucucccacaccccauccugugcugaguuguuacucuaacaagcuugagggucugagcccucuucuuuguuuucuguuuguuuuuauuuuuccagacaggguuucucuguguagcccuggcuguccuggaacucacucuguagacgggcucaaacucacagagaucccccugccucugccuccagagugcugggauuaaaggugugcgccaccaucacuuaccuuagcccucuucuuuuaauguggggcacugacugacuuguaaucaaaaaauggcacaucagugacacugcauggggacaaggacagaguuagcagcagcuaagggagcugggggcguggcucagcgguagagccccugccuagaauccccuagugaggggcuggggguguggcucagugguagagccccugccuagaaucccccagugaggggcugggggcguggcucagugggagagccccugccuagaaucccccagugaggggcugggggcguggcucagugguagagccccugccuagaaucccccagagaggggcugggggcguggcucagugggagagccccugccuagaaucccccagugaggggcuggggcgugugaucuuucuucuuucuuucuuuuuuucuucucuuuguuuuuccuuuccuugguguuuuuagacaggguuucucugaguagcucugguuguucuggaucucacucuguggaacagccuguccuugaacucacagaucugcugccucugcuuccugagugcugggauuaaaagcaagcaccacuaccaccuggcauuugcuuguuugucuguuuuucuuauuaguuuauuuauuuauugacauaugugucugcaccagcaaguggaggucagaggacaaccuuugggaguuggcucucuccaucuaccuugagguccuggggaccaucaggcuugguggcaagcaccuuaccccuugggcuagcuuacugauccuguugacauuuuugaaacaugguccuguucaguagcccaggaucucauuauguggcuuaggcugccugagaauucccaacuacccuuccucagucuacacaguggcggaugacacuuauaucccaccaaaccuaacuacaggucaucuucagcgagaccucucugacuuccucuccugugucauguuagccuguuuaauuuucugagccaggcaaauuauaaccccagugugccucaguuucccuaucuauagaauggagauaacgauggcgaccaccucagcaagcuucuuuaagugcaaaguacuuacuauauuguugugguccuccuucagaggugacccugguucuggggggacacuugucaaaaccuagcaugugauucuugugaguagcaagcacuaguaaugucuuauaagaccagagaggcuguaaagcuucuaugagaugcacagcucucuacucgaagcuauuagccaguccuaaugaucagugugaucuagggaaaguauuuagauucauacuuggccugguaagauucccaagaaauguuagaugucaccuuuguuccccacccuguccccuagcucuucaucugguguggcuacaucaacaaauacuugaauugugaucaagaaaauugaacaauucaucaggaccaggcauauaaaagaugcucagugaauaugggaacaaucagaguauggugagaacuaaugaaaugggguauaucuuagggucugggagauccauggucugguacucagcagaugcucaaucaaugcacacuguauauaaugaaugaggaggcuaaauggcauggucuuugcacuuggucucccugccaucacagcugucccacuuaccagcuacauggacguuaaucuuggccuucauuguccaggcaggguucaugguggcggccaccugauaggugccacuaucugaagguugggcauuucgaagcagcauggaaccauuugggaagccaacaaugucucgcugucccauggcacugccaucccucuggggccgugguaguccggggauauaagagaacagccuugugccuccagaagccuccucccccagguaccagaugaaauccugagcagugcugggaacaccgugaagggacagaagaagguccugguucuuuugaggcugcucugggaucaucucgauguggagggcugccugugagccuuggggcagcucaagggccaggaacaaggcuguggaaaaguauggaggaggccugaggucgaguuuugggcagagguaacaaaaccuuccucuuuacagacucucaaccgcagcaaagaccauaagggcugcacauuggaaaugacaaugagauugauuagugaugucugcccugggaguaggaauauaggcacagaugccacagaucugccacgccaguggcagaaggguuuucuguccugagaugcuauguggucuguuccuaaacacuuggacccucugaauuuacuuauucaaccaauauuuaaaggaugaauaaguaaauacauuucaucauagaccaauuacaucaucuagguuugucuucuccuccucuuccuauucuuccuccucauucuucaagacaggguuucucuguguagcucuggaacucacucuguagaccaggcuggccuuagagauucauuuugccucugucuccugagugcugggaucaaagucaugugccaccaucuccugguuucuucucuuccuucuccuucuccuccuccuccucuucuuucuccucuuccuccuccuccucaugugccaccaucuccugguuucuucuccuucuccucucccuccucuuccucuuccuccuccuucuuccccccccuccccccuccuccucccuccucauuuuccuucuucuuuugagucaggguugccuggaacucauuaugcaguccagcuccaacuugugauccuucugccucagccuccaaagugcugccauuacagauauacaccacuauggcuggcuuguuccuagauuuuugcuuuuuauuugaaacaaggucucauguagaccaggcuagccuugaacugccuauguaguucaggauguccuucuaccuuacaaacucugcgagucuaugugugacucaccaguccuggcucagucucuauagucccuucccucccuccuucgcucacuccccagaacccccugggaaaacaaacacuaauuccuacccucauaguccugacauucuagaagaugccauagaugaaauagggauggagcugugaugucacuacccugccucaucuugucccucagcccucugaggcuguuuccuccuuaccugagaacaggaggcccuuugagaagcagcccggugggguccaggucuccaucuugcuuccuguagagauggcaagggcacugagagccacaggcuggggucuugcucucuuaagagugaaguucaguggggcauccagcgggugccacgggacccagccaggcuuggaggcugccgagcccuaucauccccuuccacugucucccagccuuu

SEQ ID NO: 3614 - RNA, 2151 nt, Mus musculus
uucaacauuugaagagcacagaacaaggaucuuuaggaucucugaagaucaacacuaaagggcagacacuggggaagacugcagccagaaccucacugacaagccuuaugaagagacgagaauguauagaaaaggcaugaaagaugauacaaauacaauuuagaagauaaaagcuaacaaaugugaucaccagcaucaggauaguauggguugcucuggacccagcuuggccucugggguccugauugggagugaggaugugcugcauucgcugaugaugucuauggaggagaaguaccauggagacacugguccagaccaugaugcucaugaauguggcaucaugggaaaacugcaagaagacaaugccuacaaugaauccagaaguggaacagaacaaguugcuuuuagagucaguguuauugucuauuaucuguggaccagugaccuuaauuggaauauggauguuacuuaagacacugaaaaaccaacaacuguagcaagaauaauucgcaaaauuugggacacuuacucugaguaugaguuuaccuuuaccucuauuaacaggaaccagagugacaaacugauggacacucaggacacagguggaacacaaauuugugcuucuugccaccaugugacugaagaauucuaauuuacauuugaguucaguuggaggaguuuugggaccaaaagccaucauguuguuuggaaauaucgugaggaauagagucaaggcauuggccacagccauguggcuuaaaaucaccugucugggucucuguuuagaaccagucaagacuggagagaaauuauggacaaacagaaagacauuggccacggucccaaccacaaacuggcaaagcaagaggaucugaagagccacuuccucagugguuuucacggauuuaccaugaacagacauggagaggccuuuauucaacccuggagugaugauuaggucggacacuacucuccucgggucucuguuuuauuguccacacuuaccaauugauuugugacaauuucuucacuugauaagugagacacuauucuaucacauuacaggcaaauugccugagaaacaaugaauguauaauaacucaaauaaacuuuuauacugauuuuauuacuccugccucaauguaaauuuuguauugcaacuacaucuuuauugguccaguaggucaagagcacaauaacacacauuuuaacacaccaaggucuuugcauauugauacagacaguaaagagucuacuaugagucugugauuccaucaucagaauucaauacaauuaggagggaggaaaggcuucaauugggauguaacuaaaucaauaacaaauaaaagaauauauaaaugcaauguaaaaauaauuaauugaauuucuuauguuauaguaacauauuaaaaauaguauguaugggaacaauauaauauugcacucaauaauaaaguuguauaacugaauucaguuguagaaaauuaaguuguuggcuuuugagaaaauuuuauacuacuuauccucaaaauuaaaaaaaaacaccaaauacuucugauaaagccaccuguguuguaaugacacacaugaacauaggcuaacauauguguccuccauaugaaaaaaaaaaccacuugcuaacaaguuucauuuauucauaauuuuacugaucauaauuuuuguucuaaaaugugaggugccauagccuuaccugcaucaucugcagauucccuccaaaauuauuaacacaaucccuuugcaguaauuuaauauaauauaauauaauauaauauaauauaauauaauaccaauacccuuugcaaccugaugcuuagucugcacuuuacuuguuuauauguuuucuauaggaacacaagggccuccauccacaagguauaauucauuaucucacauacauguuacacugaaugcuguuuucuccugaguacuauucuaggacacagacauuucuuugacaugaaagcaaaauguuaaccuauuuaaguuaaccuucagacuucagaaagaaauaauguuucauguuggcuucagaggacaauuuucacugaagagaaaagaauuuuaagcagaagucuaugauagaugaaucccaccuucugagccucagucaggaugaagaugcucauc

SEQ ID NO: 3615 - RNA, 888 nt, Mus musculus
ugagaccgaccaggaagcccgaacccuuccacugagcgccugaggucguuccgagcacacggggcaccaugggcgccucccuuucguccaaggaggagugggagcgcgagagcaggaccgacuuauggugggcgcacauccaggagguguugaacaagugcgacuucagcugggagcagaucaagcagcugcaccagagguucaggcugcugagcggggaccagcccacccuacagccagagagcuucgacaacauccuggacuuggaguucaauccgauccgcuccaggaucguccgcgccuucuucgacaaccggaaccugggcaaagggaccagcggucuggcggaggagaucaccuuccaggacuuccugaccaucaucuccuacuuccggccgcugcggcccagucucaacaaagaggaggcggagcagaaccgcaaggacaagaugcgguuccucuucaacauguacgaccaggacggcgaugggaucauuacccugcaggaguaccgccgggugguggagagccugcugucggcgcacccgcaaguggagagagacacugugcgcuccgucgccaaugccaucgcccagggcgccuugaaggaggcggccagggcgucggaccagccgcugauggcgggccagcaguaugagggcaucaccuucgaggacuucgucaagaccuggaagagccucgaauuggaggugaagaugcaagucagcuuccugaaucuagaagccacggucuuaugccagugaccggcgggcugccacacccacacuggagaagcugccccuugaauccggcagacucuugcagcagcuacaggguacaugggacuugauggauuucaucucaaagaauaaagaugaucaaaagaga

SEQ ID NO: 3616 - RNA, 8679 nt, Mus musculus
gcgcuaggauuaugcaaaugagcgagccuccagcccgggggauccgggccgaguauuuaggcccccacucuccccccucauuccaaggcauccacuauuuauaaggcgcguucgcucuaccgcgcacgcacgcacgcgcgauucuuaaagcuucuucacccuucgggccgcagacuguaccaagucuagcggggccgugagcggcagagcccgccacccccgccggcgugagcucuacagccuucgccauccucugagccccucuucccaucgaccuccgggaaugguccaucugaccgcgcacgcgccccucgcucgccccucgcucguucgcccguucgcucgcccgcucgccuagccucccgaaacgcaggcgcagugcccgggcgugcagccgccaccgccgagccugauccggggccgccggcgucggugaguguccgagcuuggggggggccgcggggcaugcugggaagcgggcgauacagccccgcugcaugacgggagcccgcggccgcuuggccgagugaccggcccgggagucccuugcuuuccccagcacgcggcucgggacccagcacagcuucgccucgaggcauugugggagcccgugggccaggcguucugggccuggggcauucugggaagggccugggcuccuggaggggacuuuuuuuuuuuuuuuuuuuuuuuuuuucgucgcacacgccuucugugagaagccccggggcaaggagcguuugggugccugguggucguuaaaggcccgaggcaucgugggacgcugucacggggcauugugggagcugaucuuuauuguuugguaccgggguuuguccgagucccaguccuaccuagcguugugcggaaagguaucuauuguguucacucacgcacugugaggcguaugugugggugggguccuggccacucugcuuuugagggaacugaggcauacgguuucauguagcuggguuuuggacccacaauaucgcggaguacaaccuagaauuuauaauuuaccaagugcugaguucgcagaggugcaucaccacgcccagcuggcuuccaccuguccuaaugcuuccacuugauauccggaacguucuggaagaagcuuuauauaauguggguuuggagagggauggcuguccccaaguaaacccccaagaaaaguccuaacaauccuugcugugauggucaaguagaauaauaguuaaagcccaguguggugucacgcgccuauaauuccugcuggggcaggaggauucgcuauucuagaccuguuuuuuuuuuuuuuuuuuuuuuccuuuuggggagggcaucagaucucaaaaaaagaagggggaguggguuuauggaauggcuaauccuagguauuguugcauggaacacauauauuaaauauuuaaaauagaaacaaccaguuguccucaguuuuucuuugcugaauggugcgaguuuuuccaaaaauaauguauuacuacagaauuagaggggcccaacaucugaugauuaaucaugagagcucuuccuugccagucacuauuucucgguccuucaaaggccugauccaguaucuaggugucuuuaguaaauucccuauccaaugaugccaccuccuccucuugcuccagccgcauuccuccaacagcaaauuugacauuugggcuuugaacagugugcuuucuaccauuguuugugcccccaggcccuaaauucaggcuuugccauauuauuaguguccauaucuauuguccccagaaccugggaagcugaaguuggaggauugcaaguucaaggccagccuggacuguauaguaagagucuaaaggagaguggaaaccguauuguuuuuaguccuacacugccuggucuugcaagguccugucacaaugcaguaggaggaagaaacgugugcauugagagaaacaggaauuaugggagccaaggagcaauguggaugguuauaggugagcuuugcaagggugaaaauaaacacucuggauccacaaagaggaaggagaaaauuccagaugggaaauggaggagaaugaacuaggacugcccuucucuggcuauaaaaggccuuuauguggcccugcccccaaccccaccagaagccuggagaguugagcaaaggaguagagucuaugagaucucuuccuuccuuccuuccuuccuuccuuccuuccuuccuuccuuucuuuuuguuuuguuuguuuguuuguuuguuuuguuuguuuguuuguuuuuuaagacaggguuucucuguguagcccuggcugucuuggaacucacucuguagaccaggcuggccucaaacucagaaauccaccugccucugcccccaaagugcugggauuaaaggcgugcaccaccacaccacugcccgacucuuucuuuuuuaagacagugugucauuuaguucauacgagccucaaauucuauguagccagcucugaccuuaaacugcagauuuaccagccugagagcuaagacuguggguguagacugccuacuucuauucagagcauggcuuuggaucuuuguugaaccacagucuggugagguggccagugugaacuuggacuuuggacagugugcaggucuucuuccuuccucuucugcuucgagggagcuguuucugugugccaaccaaagccuggacuugagaaggauacagacaagaaaaguuggguccuguuugaagcacuaggcagaaaaugacagauuugaguucaaaccucaaaagucagcgaggcugacuuuuacaaaauuagguugacgucuaaaacacgccaggcacagugauguuccugugauccugacacugggaggaaaagaggcaggaagaucuggaauucaaggucaucugaggcuccuuaguaaaccugaggccagccugggauauaugacgccuugcuucaaacaagcacaaauggaaggguauggauucagcccgguuggcagaguggguuguuugccuagcgugccugacgccccacaguuugaucucuagcauuugggagguagauccaggagcauugggaauccaaagucagucugggguauuuaaaauccugucucauaaaaagaaaacaguuuaaaacauuuccaggcuagcuaguaucucagcuguaccaaguauucuguguccuuaauagucaacaaucugugacucuucuuccuggugguccucccucccucagccccagaccuuccuacagcuaaaggguuaaugucuggcacuuaguuaugauuggugaccauaccaauaccuuccuuuagauaacuugggaugucuucucucccuacuucacugacuaagaaccacaagacagucuguugcccagauaacuggauucaaggccuccuggggacaaggucugcagaguugagacucuguacacagucaagacaggacagaggccaucuuugccccaccccagcacugagcacgcaguggucuuagaauggggacaaguguuacguaaaaauuuauugagucaccgcaggccuuucuuuucucccuguccagcaccccucucuaccugccaacauccuguauuagaggagcuuguggcuggaggugugaccgcgggagagcuggccggggagggacccugcucagucgcugcucugcuccugucucuuguccccuccccccgccaugacagagacccgugaacccacugagacuggaggcuacgccagcuuggaggaagaugaugaagaccuuuccccaggugagguggccuuagaaguagcagucuuggaaaagcugucauccugggguuggaccuccuugggaagcuguguugaggaguggccgccugccuugcuaccaguucucuucugacuagaagucuucguccuggugggagauggcuucccauggaggcucuuagggguugcaucuugggugggcucucuguccuugcuggaaguucuagauuggcugagggcucuaccccuacuguggguucuagaguggccacgcugguucuccuugcuggagauucgggaucugcuccgugcucucugcuugaugggaguucgagacgggcugugggcugugucuaugcugggacuucuagacuggcugcucccacucucaggacuggauauucuagaccgccugugacccuucuucuuggugguuuuugagcgacagugaucucucuucuugguacuucuggacgggcuguggcuuuuuuccucgcucgagguccuacaccauccuuggcuuccuucccuucuuggagguuuccuugggcugugacuucucuccuugcugugggugcucugcuggcuuuguuccaucuggaugggcgugccccuccggguucgacuucuugcccuacugugguuucucuuccagcugugacuucucuccuggcuccagguccuccuguggcugugacuucuugaccuucuggggguucuagagcggcugugacuucggguccugcuagggguccuagagcggcugaggcuuuggguccugcuguggcuucuggccugcuuguagcucuugauccuaucugaugugugagucggaucagugagggugugagucuguucccugcugggggaagucagcuggcuguagcuccuggcucuccuggauaccacuggagacuugugaaaguucucaaagacgguccuagucgggcuguggcucuuggcccugcugagcauugcagguagccuagagccuacacgcucagugucuaaggcuccgugcagcuuggggcucuuuguccugugccuguuucuaagccaguggucgcuccuuccaugggcacugguucuagauuggcuauaacucuugccucggcuuuguuugcggugggaaguagggguccucuccuucuuggccacuccugguuuggcggaauggguucucuuccuguuaggagugauggcccuguucggggaugucuuagagcucuggcuuccccuuuugccuggaguucguccccggcugugugugucucucugcugauacugucccaugacuccggucuugccucccuuccugccccugcuggccuuccuggccuuaguaucagugcucaccugacuggauguucuugucuugcugcggccuugggucuugcugcuggccugggucuuggcaccuguugcucugguagacuuagaacugcuagggcucauaaacaaguuaggggacuuaggaugcacugaggaacuggugggcacugcugcuuuagugaucuucaaggaggcuggagaugcggcagccacgggagcugcaggagccucagugggcuuugagggcccaguggcugccagagccgugggggcggcgagaaccucgggagccacgggagccgcagugggcuuugagggcccaguggcugccagagccaugcugcgcuuggaggaucucuuugauggagagugcauggcgggugcaaaggggcugagugccuggaagucauagugagcaugcaggauuggguagccagggacaacaaccagacggcucaucacaagcaacuuggugaagucauaguggguaccugaagcacuggugacgucagacuugagaagagguggggggcucuggcucaaggcuggagacucuuagcaaguggaauuaauuagauccacucagacucagcaggacugagaaguggagcugaguucagcaagggccugccuugagucuucaggccuaggugauggguguuacugccugggugggcggaguaggggagcccaaagagacacugacagccuuaagagccagggaggauucauagagaagaugacacugaccugggccucacagaguagcuagaguugccgguagaauggagaagggcucucccaggaaggagcaggagaagccuggaggagagcccagagccuggucaagaucaagucugcccacaaggaguccccaggcugaugagggagacauacuggggcgcccagaaggccacaggcucuagagaguggugggagcagcaguagccaggccaucaaagcaguggcugucauagaggauugccugugcuggguccugaagccaggcuacggagggccaaguggacauaguauaggacagucacagagaguccucuaggccuuagacagugucuggaggaggugagagggucacaaaaugggucagggacagugcagcagucuuuuaggucuaggguggcucaccaaagagggagcuuugcccuggggccuaagggaaaggcagggcugagcauccguagcagaggggacagcauguggggugcacagggccaccacacgaaccauugcuucucuuggggacaagaagaaacacgagugauuguugugcacuugauuggacugcaagagaaacagaccuaaggcagggugagggcagcacuggggaggggcugcugugaaccagggaccaguguuguccugagcagagccagagacaggauuggagcuuggucugcagaaagggaagcaaaggccacggggcagguagauacacaccccugugguacugaggcagcaaggagucuguggugaaggggagggugggcgaggaguggccccugagcaccuguugcccccgugguaauaaugaacagggcagagacacccucacugugagcugcgggaggagaugcuccuggcagagggagauugcuucugcagcccagugggugcucccgcuaugccguuuccaguguggccaaagcaagcaagcucccugggcacuacaggcucccuugaccauggagaccgcagcccugcgugugaccuacagcagccacuaauguccuccucaccucacauuuucuccuuuaaaagcuuuuguuaaguuuaucuauugacuuagugaggguggguacacucucaugguaucaggaggcgaggucacacaacuauugggaguugguucugucccucuacucuguggguccuaggagucaaacucagguugucaggcuuagcagcaagcaccuuuaccacugagccaucuugccaaacccuugaucaugccaaacucaucuauaugcacuuuuauaugcugaaauuacagucguguaccuguacuuaaaauugagcauuuuaguugacuuguuuauugaaaugggaauuaucuguaaucccagcacuuagagacugaggcaggaugaugaugaggcaauggccagcgugggagaugagcauauacauacguguucugucucaaaaaagaaaagccaaguauaguggugcuggucuguaauccagcuuuugagaggcaaaggcaggaagaucaggaguucaaagccaacccuaggcuacaugagaaaccaaacaaaacagauaaacaugcugaggaggaugccacuguggagguuuggauacaggaguuuggcuuccccagcacccaaaugaaggcauaguguguaguguggucucugcaccuggacugccacgcuggaaggcacagacaggccugacccaguggucaaauugcugagcucuggguucagugagagaccccgucuaaaaaaugagauggcaaaugauuaaggaaaucaccaguguugacaccaaaccaaccaaaacagaccugcgugucuacugcuuagcugccuaauucugauguuggucuuucuggaauggucuaggccgggccguugcuuucugugauagacuguguaggggacagccguggccacauugguccggguguugcuguaagcgcugggugggcacacgggcgcugucuuuguuguccaccccauccccacgcccaccugugugauuuauuuugagacaggaucucauucucuguaagccagagcuugcagugauccuccugccucagccuccuugauaccgccauuacaggugacagaugcagcucucgccagguagucauuugguagccgugcagauacauugcaucuguguugugucaagcuguccugcccacacagcgagcuugaauagggcucgggggcagcuggacacagcccugaugccaugucucuccuaccugccccaacaggcccggagcauucuucugacucugaauacacucuuucagagcccgacucugaggaggaggaggaggaagaggaagaggagaccacugaugaccccgaauaugacccuggcuauaaggugaaacagcgaauaggugggggcagggguggcccgucccgccgagccccccgagcaacccagccugcuggcccaccugcacagccuugccagcucugcggccgaucagcgcugggagaggccccgccggguaccccaccuugccgacucugcugcccugcaacagcaacccaagaagccccaggcccugagagcagggcucuuggagaggaagaggaggaaccgucucgcacuggggaaacucggccagcagggcgggauggggacgaagacgaggaggaggggggcaccuaccacuguacggagugugaggacuccuuugacaaccucggggagcugcauggccacuucaugcugcaugcccggggcgagguguaggcggggccaccagagugcugguagaagggugaggggagcagggcugaggaagcuggaaucagcgcugggggucccgcccaucuguguugucuuagcuguagauaaugugaagggcugaauaaaagccagauucuacauguuggcuccgcauau

SEQ ID NO: 3617 - RNA, 8679 nt, Mus musculus
auaugcggagccaacauguagaaucuggcuuuuauucagcccuucacauuaucuacagcuaagacaacacagaugggcgggacccccagcgcugauuccagcuuccucagcccugcuccccucacccuucuaccagcacucugguggccccgccuacaccucgccccgggcaugcagcaugaaguggccaugcagcuccccgagguugucaaaggaguccucacacuccguacagugguaggugccccccuccuccucgucuucguccccaucccgcccugcuggccgaguuuccccagugcgagacgguuccuccucuuccucuccaagagcccugcucucagggccuggggcuucuuggguugcuguugcagggcagcagagucggcaaggugggguacccggcggggccucucccagcgcugaucggccgcagagcuggcaaggcugugcaggugggccagcaggcuggguugcucggggggcucggcgggacgggccaccccugcccccaccuauucgcuguuucaccuuauagccagggucauauucggggucaucaguggucuccucuuccucuuccuccuccuccuccucagagucgggcucugaaagaguguauucagagucagaagaaugcuccgggccuguuggggcagguaggagagacauggcaucagggcuguguccagcugcccccgagcccuauucaagcucgcugugugggcaggacagcuugacacaacacagaugcaauguaucugcacggcuaccaaaugacuaccuggcgagagcugcaucugucaccuguaauggcgguaucaaggaggcugaggcaggaggaucacugcaagcucuggcuuacagagaaugagauccugucucaaaauaaaucacacaggugggcguggggaugggguggacaacaaagacagcgcccgugugcccacccagcgcuuacagcaacacccggaccaauguggccacggcuguccccuacacagucuaucacagaaagcaacggcccggccuagaccauuccagaaagaccaacaucagaauuaggcagcuaagcaguagacacgcaggucuguuuugguugguuuggugucaacacuggugauuuccuuaaucauuugccaucucauuuuuuagacggggucucucacugaacccagagcucagcaauuugaccacugggucaggccugucugugccuuccagcguggcaguccaggugcagagaccacacuacacacuaugccuucauuugggugcuggggaagccaaacuccuguauccaaaccuccacaguggcauccuccucagcauguuuaucuguuuuguuugguuucucauguagccuaggguuggcuuugaacuccugaucuuccugccuuugccucucaaaagcuggauuacagaccagcaccacuauacuuggcuuuucuuuuuugagacagaacacguauguauaugcucaucucccacgcuggccauugccucaucaucauccugccucagucucuaagugcugggauuacagauaauucccauuucaauaaacaagucaacuaaaaugcucaauuuuaaguacagguacacgacuguaauuucagcauauaaaagugcauauagaugaguuuggcaugaucaaggguuuggcaagauggcucagugguaaaggugcuugcugcuaagccugacaaccugaguuugacuccuaggacccacagaguagagggacagaaccaacucccaauaguugugugaccucgccuccugauaccaugagaguguacccacccucacuaagucaauagauaaacuuaacaaaagcuuuuaaaggagaaaaugugaggugaggaggacauuaguggcugcuguaggucacacgcagggcugcggucuccauggucaagggagccuguagugcccagggagcuugcuugcuuuggccacacuggaaacggcauagcgggagcacccacugggcugcagaagcaaucucccucugccaggagcaucuccucccgcagcucacagugagggugucucugcccuguucauuauuaccacgggggcaacaggugcucaggggccacuccucgcccacccuccccuucaccacagacuccuugcugccucaguaccacagggguguguaucuaccugccccguggccuuugcuucccuuucugcagaccaagcuccaauccugucucuggcucugcucaggacaacacuggucccugguucacagcagccccuccccagugcugcccucacccugccuuaggucuguuucucuugcaguccaaucaagugcacaacaaucacucguguuucuucuuguccccaagagaagcaaugguucgugugguggcccugugcaccccacaugcuguccccucugcuacggaugcucagcccugccuuucccuuaggccccagggcaaagcucccucuuuggugagccacccuagaccuaaaagacugcugcacugucccugacccauuuugugacccucucaccuccuccagacacugucuaaggccuagaggacucucugugacuguccuauacuauguccacuuggcccuccguagccuggcuucaggacccagcacaggcaauccucuaugacagccacugcuuugauggccuggcuacugcugcucccaccacucucuagagccuguggccuucugggcgccccaguaugucucccucaucagccuggggacuccuugugggcagacuugaucuugaccaggcucugggcucuccuccaggcuucuccugcuccuuccugggagagcccuucuccauucuaccggcaacucuagcuacucugugaggcccaggucagugucaucuucucuaugaauccucccuggcucuuaaggcugucagugucucuuugggcuccccuacuccgcccacccaggcaguaacacccaucaccuaggccugaagacucaaggcaggcccuugcugaacucagcuccacuucucaguccugcugagucugaguggaucuaauuaauuccacuugcuaagagucuccagccuugagccagagccccccaccucuucucaagucugacgucaccagugcuucagguacccacuaugacuucaccaaguugcuugugaugagccgucugguuguugucccuggcuacccaauccugcaugcucacuaugacuuccaggcacucagccccuuugcacccgccaugcacucuccaucaaagagauccuccaagcgcagcauggcucuggcagccacugggcccucaaagcccacugcggcucccguggcucccgagguucucgccgcccccacggcucuggcagccacugggcccucaaagcccacugaggcuccugcagcucccguggcugccgcaucuccagccuccuugaagaucacuaaagcagcagugcccaccaguuccucagugcauccuaaguccccuaacuuguuuaugagcccuagcaguucuaagucuaccagagcaacaggugccaagacccaggccagcagcaagacccaaggccgcagcaagacaagaacauccagucaggugagcacugauacuaaggccaggaaggccagcaggggcaggaagggaggcaagaccggagucaugggacaguaucagcagagagacacacacagccggggacgaacuccaggcaaaaggggaagccagagcucuaagacauccccgaacagggccaucacuccuaacaggaagagaacccauuccgccaaaccaggaguggccaagaaggagaggaccccuacuucccaccgcaaacaaagccgaggcaagaguuauagccaaucuagaaccagugcccauggaaggagcgaccacuggcuuagaaacaggcacaggacaaagagccccaagcugcacggagccuuagacacugagcguguaggcucuaggcuaccugcaaugcucagcagggccaagagccacagcccgacuaggaccgucuuugagaacuuucacaagucuccagugguauccaggagagccaggagcuacagccagcugacuucccccagcagggaacagacucacacccucacugauccgacucacacaucagauaggaucaagagcuacaagcaggccagaagccacagcaggacccaaagccucagccgcucuaggaccccuagcaggacccgaagucacagccgcucuagaacccccagaaggucaagaagucacagccacaggaggaccuggagccaggagagaagucacagcuggaagagaaaccacaguagggcaagaagucgaacccggaggggcacgcccauccagauggaacaaagccagcagagcacccacagcaaggagagaagucacagcccaaggaaaccuccaagaagggaaggaagccaaggaugguguaggaccucgagcgaggaaaaaagccacagcccguccagaaguaccaagaagagagaucacugucgcucaaaaaccaccaagaagaagggucacaggcggucuagaauauccaguccugagagugggagcagccagucuagaagucccagcauagacacagcccacagcccgucucgaacucccaucaagcagagagcacggagcagaucccgaaucuccagcaaggagaaccagcguggccacucuagaacccacaguagggguagagcccucagccaaucuagaacuuccagcaaggacagagagcccacccaagaugcaaccccuaagagccuccaugggaagccaucucccaccaggacgaagacuucuagucagaagagaacugguagcaaggcaggcggccacuccucaacacagcuucccaaggagguccaaccccaggaugacagcuuuuccaagacugcuacuucuaaggccaccucaccuggggaaaggucuucaucaucuuccuccaagcuggcguagccuccagucucaguggguucacgggucucugucauggcggggggaggggacaagagacaggagcagagcagcgacugagcagggucccuccccggccagcucucccgcggucacaccuccagccacaagcuccucuaauacaggauguuggcagguagagaggggugcuggacagggagaaaagaaaggccugcggugacucaauaaauuuuuacguaacacuuguccccauucuaagaccacugcgugcucagugcugggguggggcaaagauggccucuguccugucuugacuguguacagagucucaacucugcagaccuuguccccaggaggccuugaauccaguuaucugggcaacagacugucuugugguucuuagucagugaaguagggagagaagacaucccaaguuaucuaaaggaagguauugguauggucaccaaucauaacuaagugccagacauuaacccuuuagcuguaggaaggucuggggcugagggagggaggaccaccaggaagaagagucacagauuguugacuauuaaggacacagaauacuugguacagcugagauacuagcuagccuggaaauguuuuaaacuguuuucuuuuuaugagacaggauuuuaaauaccccagacugacuuuggauucccaaugcuccuggaucuaccucccaaaugcuagagaucaaacuguggggcgucaggcacgcuaggcaaacaacccacucugccaaccgggcugaauccauacccuuccauuugugcuuguuugaagcaaggcgucauauaucccaggcuggccucagguuuacuaaggagccucagaugaccuugaauuccagaucuuccugccucuuuuccucccagugucaggaucacaggaacaucacugugccuggcguguuuuagacgucaaccuaauuuuguaaaagucagccucgcugacuuuugagguuugaacucaaaucugucauuuucugccuagugcuucaaacaggacccaacuuuucuugucuguauccuucucaaguccaggcuuugguuggcacacagaaacagcucccucgaagcagaagaggaaggaagaagaccugcacacuguccaaaguccaaguucacacuggccaccucaccagacugugguucaacaaagauccaaagccaugcucugaauagaaguaggcagucuacacccacagucuuagcucucaggcugguaaaucugcaguuuaaggucagagcuggcuacauagaauuugaggcucguaugaacuaaaugacacacugucuuaaaaaagaaagagucgggcaguggugugguggugcacgccuuuaaucccagcacuuugggggcagaggcagguggauuucugaguuugaggccagccuggucuacagagugaguuccaagacagccagggcuacacagagaaacccugucuuaaaaaacaaacaaacaaacaaaacaaacaaacaaacaaacaaaacaaaaagaaaggaaggaaggaaggaaggaaggaaggaaggaaggaaggaagagaucucauagacucuacuccuuugcucaacucuccaggcuucuggugggguugggggcagggccacauaaaggccuuuuauagccagagaagggcaguccuaguucauucuccuccauuucccaucuggaauuuucuccuuccucuuuguggauccagaguguuuauuuucacccuugcaaagcucaccuauaaccauccacauugcuccuuggcucccauaauuccuguuucucucaaugcacacguuucuuccuccuacugcauugugacaggaccuugcaagaccaggcaguguaggacuaaaaacaauacgguuuccacucuccuuuagacucuuacuauacaguccaggcuggccuugaacuugcaauccuccaacuucagcuucccagguucuggggacaauagauauggacacuaauaauauggcaaagccugaauuuagggccugggggcacaaacaaugguagaaagcacacuguucaaagcccaaaugucaaauuugcuguuggaggaaugcggcuggagcaagaggaggagguggcaucauuggauagggaauuuacuaaagacaccuagauacuggaucaggccuuugaaggaccgagaaauagugacuggcaaggaagagcucucaugauuaaucaucagauguugggccccucuaauucuguaguaauacauuauuuuuggaaaaacucgcaccauucagcaaagaaaaacugaggacaacugguuguuucuauuuuaaauauuuaauauauguguuccaugcaacaauaccuaggauuagccauuccauaaacccacucccccuucuuuuuuugagaucugaugcccuccccaaaaggaaaaaaaaaaaaaaaaaaaaaacaggucuagaauagcgaauccuccugccccagcaggaauuauaggcgcgugacaccacacugggcuuuaacuauuauucuacuugaccaucacagcaaggauuguuaggacuuuucuuggggguuuacuuggggacagccaucccucuccaaacccacauuauauaaagcuucuuccagaacguuccggauaucaaguggaagcauuaggacagguggaagccagcugggcguggugaugcaccucugcgaacucagcacuugguaaauuauaaauucuagguuguacuccgcgauauuguggguccaaaacccagcuacaugaaaccguaugccucaguucccucaaaagcagaguggccaggaccccacccacacauacgccucacagugcgugagugaacacaauagauaccuuuccgcacaacgcuagguaggacugggacucggacaaaccccgguaccaaacaauaaagaucagcucccacaaugccccgugacagcgucccacgaugccucgggccuuuaacgaccaccaggcacccaaacgcuccuugccccggggcuucucacagaaggcgugugcgacgaaaaaaaaaaaaaaaaaaaaaaaaaaaguccccuccaggagcccaggcccuucccagaaugccccaggcccagaacgccuggcccacgggcucccacaaugccucgaggcgaagcugugcugggucccgagccgcgugcuggggaaagcaagggacucccgggccggucacucggccaagcggccgcgggcucccgucaugcagcggggcuguaucgcccgcuucccagcaugccccgcggccccccccaagcucggacacucaccgacgccggcggccccggaucaggcucggcgguggcggcugcacgcccgggcacugcgccugcguuucgggaggcuaggcgagcgggcgagcgaacgggcgaacgagcgaggggcgagcgaggggcgcgugcgcggucagauggaccauucccggaggucgaugggaagaggggcucagaggauggcgaaggcuguagagcucacgccggcggggguggcgggcucugccgcucacggccccgcuagacuugguacagucugcggcccgaagggugaagaagcuuuaagaaucgcgcgugcgugcgugcgcgguagagcgaacgcgccuuauaaauaguggaugccuuggaaugaggggggagagugggggccuaaauacucggcccggaucccccgggcuggaggcucgcucauuugcauaauccuagcgc

SEQ ID NO: 3618 - RNA, 27148 nt, Mus musculus
ucugauucccugagggugcagagcaacuuuggagacuggcauccauccucuucuccuuucccaaggaggcgcccagcguagguuggguccuaaccggggagcgcccagcaugucuagacccguccugcgggggccgggcgccuuguggccuuuccuuucucuuucgugugccugccucaccuucaugcuucuguauucgagcuguguccagcuccaaccccacccagggaugugccccugggucuugaggggacugaacaaaagagguccugucagcagacagagacgggcaaaguuggagacaaaugcuuacaaggcauuggggaaccaagguauuuguggacgcacgcaaguauauugugcacaauuuguauuaagaucuuucucccucucuuuugguguuaggucaugagcuaagagaggucugagaucuuugucggccaucugucugucgauguucgucucuguguguccauccguccguccgucuguuugucugcauuuggagagagaaggggaacagagcguguccgcaacaacaggugccagagaucuuauuucaaacaggauucaggcuucaggaaacucucagcuucagcguuucugagcaaggcucugguuugguuggugaccucacgguccaaugaccagggcaaauuacacguaggacccaaucacugaggccgcucuuguugcuagguucccaggaagccgagucuccacguuaucaggcggcuaggccggagagugguggaaccugagagaggcggggccggagggggaaugccuguugcuaagggaacccggcgccucgcucgcggagaggcccaaccgagcaugcgcaguguugacgugugcgccggcgcgccgcgguuugaaaggcccgagccuugcgcgcuugcgcacugagucccgugcagggcgcgcgcgcucccccaaccuucuccgggggccccccggagcugcaacccuucuucuucauucccuggacggucgggcguccacgggcguggacaugccggagaucagccuccgccacgucguguccugcagcagccaggacucggugaggggcugacgugggagcagcggggagacaggggcuuccugagggaugcugaggacuuuggaagcgcaaagggggggggggaucuuggcgggauucugagcggggcuccgggugggguuuccagaggcuggacgugcauuccgagagagacgggcaguuagggaaguuuggggccacuguggagaguaaggaaaaagaggggccugggaaguucuaacugugaagaaaaacucggugaaaggaaaacucgaggcagggguguguguaugcguguguguguguguguguguguguguguggugggacuggcgugaagucaaguguggagagucggcuagcucuugggaguuuaaacauucaaaaauaaucuuauuuuuaaaagucagcuuuauuuaaagaacuuccaccuuuccacccuugccugcagacccauugugccgaaaaucuucucaaggcggacacuuaccggaaguggcgggcagccaaggcaggagagaagaccaucucugugguccuacaggugaugcugccaucucccaccuccucauucccggggcagugagacccccgcucacauuccacugccagcuggcuggagguugagucguuuccuuucuguaguagagagcuugcucggcuaacuugccuggaaaaugggcuuagaaaucccugugccuccaggaauccuuggguaacccugaguagguugacucuacuucugggccucaguuucaucagcugggacagugucagccauuacuguuaacugugucccccggggccagaagguggccaagaagaguaucuccauaaaucaguuucauuguaaagacgaccgacauggaaggguggauggcucaggccuguaauccugguugcuugggaaguugagauaggauaacaaguucaaggccagccugcacaacuuagaaccugucuggaaaugagaaauaacuacccucacgaggacuauuaacauaggauuaggcagauagcucggcuguucagggcuugccuggagcaugucagacccuuccuugguuccaucccuaguaccucagagaguaaaggaaugaaacguguagggaagggaaguuuuguuugauugguuuuauuguuuuguuugugagauagagucucucuacggagcccugguuguccuggaacucacucuauagaccaugcuggccuccaacuuacagagauccuccugccucugcuuucagagugcugggauuaaaagcauguaccaccccacccuauucuccuuuuaaaauuuuucuuaaauugaagcuagucuugaacuccugauccuugucugucuaucuggggcagaggaguuccaaguguauaccaucaugccuagcaucugucaguuugccuuuccuucauuuagcuuacaacacacacacacacacacacucaguacugugcaggcuaggcaagagguuacuaauugagccaugucccuaucuuucugacuuugacuacuuuuaaauuuauuuuaagcugggcaguggucauggcacaccuuuaaucccagcaguugggaggcagaagcagguggaucucugaguuugaggccaaccuggucuacagagugaguuccgggacagccagagcuacauagagaagcucccauggggaguuagggaguuguuucugacagguacagaaacuugaggaaggggcuagagagauggcucaguggguaagagugccaaccggucucccagaggacugaguucaguucuuagcaccugugucugauggcauacagcaacagccuguaagccuagccccagaggcucucauaccucuggucucuggggcuucaucccccuuucauacacauauuaaaaacaauaaaaauguaucucagggcuggagagauggcucagcgguuaagagcacuggcugcucuuccagagguccugaguucaauucccagcaaccacaugguggcucacaaccaucuguaauggaauccgauguccucuucucgugugucugaagacagcuacaguguacuaauauacauaaaauaaaugaauaaauuaaaaaaauguaucuuaaagaaaaaucagugggagaaggaaauuagaugcuuuuaagcaccugcccacugccaguuggguguugaccccgugauucucugaguguccuacuguaaggggcuugguuaccacucacaaacggcagugccaagacucaguccacacuaagagugugggugcuuuggacagcuucgucagccuguuguauucauaugcaccacugagcugcaauccccagccgccaccgccaccauuaucucuuccuccuccccggagugcuucgguccccaguaugggucacugcccagcucacacacugacuuuccuugauguuagccacaucccucaguucugaguggagaaggacuuuaguggggacaaaguugaccugacuauuccuauacuuaacacacucuuggccuuuuucuugcugaguaguuuuggguuacaggauguuuugaggauuauagagauguuuucagaaaagaaccauaacauuuucuggccaaucugagguauuuaugccuuuuuaaaucccuaaucagagacugguaaugaaaacuaacauuguuccccauuguaaccugccagucagcaaccaucaugccucacauggcuugauucauucccuccuuguaaaguccugugacccacagacugucauuauccccauuuuacagauaaggaaaccgaggcccagagaaauuaugaaacccagcaccugucuuuuaaacugugugagaaccagauugcuuagcauuuaguuuggggaucuggauucaaauccuagcucuuacucacucugaccucaggcaaauguuuuuaauuucucuaaacauacccauugaaaauauagacacccaaggcugggguggugguuaaaaccuggugacauaaugucugcagaaguacucugucuacaugugggggcugggauaaagggagggguuggugauuucauuaugggauguugauucuucaggccuucaucaggugaccccccccgcuuccccccucccccgauaccccuacauauacugugggaaauaauguucagcucuauaagaguggugagaacagaaugcagcauccaggguccugaggaggcucagcggggaggguccucguggccaagccugacagcuugaguucccucguuggacuccauuuuaagagaauugccccacagagcuuguccucugcuuccacaugcacgcucauccccaccuguguacaucagaauaaauguccggcuggagagaugcuguggguaagagcacuggcugcuccuucagagaaccuggguuugauucccagcauccacauggugguuuguaaccuuuuguaacuacaaauccaagggaucagguguccuuucuagccucugagaggcaaaauacccauaugcauaagaauaaaaauuuuaagucguuaagaaaacaugggagacaacuagaggucauaugcaagcuacagacagugguguagaaggugguacuuggagggguucacaugucacguuuuagcuuuguggcaaaggucaagagucuuaguagcaucauuuguucccucauucauuuauuccacaagugugcucuaagcucuugcucuacguggacacucugugcucccgggucuguacagcugugugcagucggugaugaacaugcucacaccuggaggauggggguguugcuggacuagaggaggcuugccuagcauaccccaggcccuggguuugaaccccaacacccccaaaauuggaagcaguagugacuucggucugcaauucugguacucaggagcagcaggaucagaaacucaaggucaucugcuacauagcaagcuugaggucagcugggguugcaugagaccccagcauggaaagcugacaggcuuggugaagugacccuguauuggaugaugagccaugagugcuguggaggaaguggggcagggugagugaguggugcauccagccggagaugguguugucagguuuuuauuuaaauaugaggacuaaucucucuuuugaaaacuauucuuaguugaguaugguggugcaugccuuuaauuucagcacgggggaggcagaggcagguggauaucugugaauucaagaccagccuaguccacagaguaaagccuuaacagccaggacuacauagugagacucugucucaaaccaugcccuguccccauuauaaagaagauuuauuuuaugcauguauaucaugacgugcaugccuggugcuuucgaggucagacaagggcauuggauccccugaaaguggaguuaggaauguuggcaugagccauguagaugcugggagccaaaccccaguccucuacaagagcaagcaguaagugcccacuggugacuuuuuaaagcucuguuuguuuguuuguuuggugguggugguuuuugagacagucucucugcagagcccucgguggaacuugcaaugaagaccaggcuggucucgaacucaaagagauccacuugccugcuucugagugcuaggguuaaaguugugaaacuuuuuuuaaacuacauuuagcauuuagagugugugugugugugugugugugugugugugugucuuuagaggucagagggcacucgcaggagucacucugccuccacucugaguuucuaggccagcaucuuugcuccucgagccgucucugcagccuggagucuggugacagaagucuggugacagagucuggugacagaagucuggugacccugaacagaagagaaguucauucccagggaagggacagaggucagcuguguccgucuggcacgugagaggucggucaaggaggccagagagcaagguagggccagggcuucgccagggcuucugcauaggaaagauaggacccuucuuguucccguugagaauaaacagagcccauccugucagaccccugggacaauccgauugcacuugacacuggcuaauuuaugggcaacugaguucgaccaggguuagcuuugguuucuuuucagugacaacaagggagagauuucuggacaccaagacaguagacucuugugugcucaccuauuucccugugugcucucuaaacacuguuacacaacauugguauugccaaacagggcucagcccucugcuugugucagcuccacacaccucuuugucagccguggcuacucugugcccagcuggucaccugcuuccagacagggaguuaaaucuuugccagccccuccuggccuggaggggaugcugggauagguccaacuggaacacugcuguaucaccugagugucagccguacaauggaacacaucauaccugcuuuguuauugcuguuugagacagggucucauuguaugauacagcccaggcuggcuccaacucugauccccugcauaucacauguguugggaugucagguaugagccacuguaguuggugugauuuuuuuuuccauguuuuuucuuauuuuuaaagauuuauguaugcacaucugcacaccaaaagagggcacuggaugccauggagcuacguuuacagacaguugugagcuaccaugugggugcugggaauugaacuugggaccucuggaagaagucugcacuggaagcuaguacucuuaaccauugagccaucucucugcccccccccuccccuccccuguuuugagucacgguccuacuuuguaacuauggccaguuuagaacucacuguguagaccaggcuggucuuggaugcacacagauuuuccugccucuguuuucugaaugcuaggauuaaaggcguacaccaccagaccuggcagauauuuguuuuauguguaugaguguuugucugcauguauguuuguacauaugccuagucgcugaagaggccagaggagggcaucaaauccccuggaacuggaguuacagaugguugugaggugcuaugugggugcugggcaucaagccuggguccucuggaagaccuugugcuuucaccugcugagcuauaucccagcccccucacugggggauucgaggcaggggcucuaccacugagccacgcccccagcccucacugggggauucuaggcaggggcucuaccacugagccacgcccccagcaccucacugagggauucuaggcaggggcucuaucacugagccacgccccccagcccucacugggggauucuaggcagaggcucuaccacugagccauguccccagccccucacugggggauucuaggcaggggcucuaccacugagccacaccccagccccucacugggggauucuaggcaggagcucuuucacugggccacgcccccagaccuucaguguuuugagagagacauucacuguguguguagcucagacuggccuugccuugugauccuccagcuuccucuguagugcugagguugcuggugugugcugcuguucugcucuuuguuacuaguaucauuuugagacagggucuuacucuguaccucagguuggccuggaauuccuugugaccuccugccccugccuccuacauuccaguccaucacucuccuuacggagccuuuuuuccagccccucucucucuuuuuuaagucuugcauacaggacagcuuucaacuagccgacucucagagcuuugccuaguuucugugucugaucaguaucauguaccaugugugcauagaaaaauuaaaaaaauacaaacaaaugugcaaguauagaauaccagguuggggcuguuugugcugcccacuugguauguugccugccuagcguacauaguauuccgaguuugaucccuggcauugcauuaaccugggaagagaaggagacaggauccaaagucgggacauuguuggcuauauagaaaguuugaggcuagccuggguuacaugagaccuaguggugggggagaaauauauauauauauuuauauacaagucgaagccacaggaauggcucaguaguaguggagagagauaaaucaggcuaaggaauagagggaccccuugugggagauggcagaugcuacuuuguuuggucugaggcauugcugucuaaaucuaggucggaaggaaggcuugagcagugccgaggucugaggcauguucccgauucugggguggcagcugcgaaggcccugagcaggaggccucagccuuuacuggauauaagauaggugaugggagcacacaggacguugucugggcucaguauccagaagggucugugcugaagcacuguaagcuauggcuggcucuguucuccugggcuuugccuacacagcugugguguaaccaccuccugccugaggcugcucaucuaaucgcagcaccugcacuuacacccugcuagaagagcagaucuuacaucucuuccacaguuagagaugagagcacucaguuuugcuuuguuuucuuuuguggugcugaauauugaaccaggauccugugcaggccagacaagugcucuaccauugucccacaucccagaccccucucucugagacagucuugcugaguuaacuccugcucuugaacuugcccuguggcucaugcagaccuugaccucugaauucuccugcuuuuaccuaccaagucgcugggguugcaggcucaacuggcugcccuugugacuuugcggcaucuuagcuuccuguggagugaagccacugggacuccccuuggaaacauuaacuguaguuuagaaaugucagggcuggauuugaacacagaccacuuuguucaagucaagguuccuuucugccacggugcuguagugcccugacuggucugagagggcagaagggaacagcagauggucccagagcagaggagggccauggguggaaguacauaggcaguuaaaaauuuguuuuugcagcugggcaguggugccgaacgccuuuaaucccagcacuugagaggcagaggcaggcagauuucugaguucgaggccagccuggucugcagagugaguuccaggacagccagggcuauacagagaaacccuuucugggaaaaaaaaaauuguuuuugcuacaaaaaaaaaaaaaaaaaagauuuauuuuuaaguaucuguaugagggguagguguguguuagugcagaaaccagaagcauugguuuucucaggaccuagaguuacaggauguuaugaaccucuucugaguaugaagagcucuaacaacugagccaucucugcagcucugaccuugaacuucugauccucuugcuguuauagcuaggcuguucucacuuaaggaaaaacuaugauguuuuuauugaaccccccagacugacuacauguguaaagaggugggccucuagcugagaguaagcagggagcuuauaaagggaaccaccacacguuugguaggucccauugguguagcugggauggcuguuaccaagcaugacagguaugaacuuuucguaagaauaaggcacagcugugccaccaugguaucacucaggcagaacaacuggggagcuguggucucugggaagugcugugcauacccgagugucaggcugaccucaguuuuagccagauugagccaggucaggcuugagcgcacguguuuuucucauuucacugcguccacaccaagugcugaaauuacaggugugcuucauucaguaugcugauuaugcgugacugggcaucgaacucaggguuuccugccuccuggcuccagcugagccagccacaucugaagccaggacaucuucgaaggcugugauagcgccucauccgaggacccuguuaaagagccccagacuggacgcuuagcauugccuguccucacugccccacacccacacaccuuucagugucuucagccucaggcuggagccacaggugaguggagucuucauaaauagcucuuucuuucgaugaauaaugagccuguaucagcuaaugguuccuguuccugcauaauagauucaguaagaagccuggagcuuuucuaggccagagacugacaaaacaacuccugucaaagggagacagggacaggcaaagagucuccugccugcaauucuaacccccuggaaggugaagccagcaggauccccuuaaguucaaggugugccugguuauuaagugacaccugacaaaagaaaacuccaacuaggcaugugaaaauggagcugaguguggcggcucaugcuuguaaucccagcuguuagauuguguguagcaguggccuugugggucacaacuguuuacaguggccaagucucaaaaaacgaaauggggugggggaggcuggagaguuggcucagcaguuauaagcacuuguucuuauagaggaccaggguuugauucccagcacccacaccgcagcucacaacuaucuuaacucuaguuccagagguucugacacucuccccuuggccucuguggggccaggaagcagaugggacggacguaggcauacguccaggcaaaauguucauaugcaaggaauaaauaaacuuaagaaagaaaaggaacuacagccucacguuuggacuggauggcaguuucaagcugucucagagaaaugacuccagcccuacccggcccuccugugauguacaggagagucacugcugccgccuccaauuacagcagccucuggguucuauauaguguuuguuucuuauuuaaauggaugcuaaaauugguuucacucuuuuuguucacuuauuuuuaguucuaaaaucuuuagcugaacaacaacaaaaaaauccuuaaaacuuuuuuuuuuucaaauuuuuauuagauauuuucuucauuuacauuucaaaugcuauccggaaaguccccuauacccuucccccuuaaaacuucuuuuuuuuuuuuuaaagauuuauuuauuauuauauguaaguacacuguagcugucuucagacacaccagaagagggagucagaucuuguuacggaugguugugagccaccaugugguugcugggauuugaacucuggaccuucggaagagcagucgggugcucuuacccacuauguguaugaaugugucuucaugcaugccacaugugugccuaugcccagggaggcuagaagagcgugccggauccccgagaaccagaguuacuggugguugugagcagccugacguaggugcuggaacggaauucagucccuguguaagagcagccugugcgcguguaacuucgaggguccgugucucaggucccuuuaguacauuugagugugucuugugaacaaaaauuccugaaaagaaguugugucugcagagacugguagacugauuagaauuucaguguuguggcaagaguggaaucuugucgcuucagaggccgauuacuuucucuugggcugguuuuagcuucaggcagccuuuccuugccuuacuccaucugaacugacuccucguaauaaguaaaacccucucggaagcuuuuaauguagcagaacacuagccuccaccaggagagcuaagaauaucaucagagagcaucuugggccuauaaaaagcccccugguguacccacaucucugguauacccgucaguguauuuuuuaaguugcucuaauuugggggcuuagugguuaagagcacuggcugcucugaguucaauucccagcaaccacaugguggcucacaaccaucuguaaugggauccuuucugucugaugcccucuucuaacaugcaggcauacaugcaaauagagcagucauaugcauaaauaaaucuugggaaaagaagccucaauuuaugucuuucuuuguucugcgaaacuauaauacacuuaaugaaacugcuuccacauuggaacauggaguuugugguaaccuaaaucugcgauccuaggccuuggucacucagaaugguuccugaauaaacuaguuccuuaaacucuuuaagaugagucgggugugguggcacgcuuuuaaucccagcacucgggaggcagaggcagguggauuucugaguucgaggccagccuggucuacagagugaguuccaggacagccagggcuauagagaaacccugucucgaaaaaacaaaaacaaacaaacaaaaaaaaacccucuuuaagaugagagcugugguuuucacaucgacucugugugugggcacaugugggccuccucccaccguauagaucuuggugcuugaauuuagguagucaggcuugguggcagguuccuguaacugcugggucauuguacaggaccaggaauaaaggaaucucaagccuagacaucaacccuugccgcaguuagaaauauggcauuucugaaucucagccuggcucagggggcagcgaaugaguaccagagcugggauccccagcacccacaggaaaguugggugggcaugguagccugccugccugagaucccagugcuccugaggcagagauggaaucccugaaaauaaaguggagagccaucggggaagaugccugacaucaaccucuggccuccacaugcacucagacacagacacgugaauacacaaacaugcgcacuacacauaagcucucucgcuugugcgcacacaccccacuucuguauuguuagcuaucccuuaaagcuaucaccuguuuugauuucuuuuuuauauuugagacaaggucucaugugguccugacuagccuacaauuugcuguguagcuaagggugaccugaaacuugugauucuucugccuucaccucccaaaugcuggguuauacggugucaccaagccccagcuuugccuuucuucaucuuuuucagugagacuaauuuagucacaggagucaccaacauuaaaacaacgcuugcugacagcugcuaaguaccuacugugugcccugaccuucagccauguugauuaugcggugauccuugaucuaaugagggcgcacagcuaguguguggcagagcuggguucaaaugcagggcuccgugguaugcaaaccagacaccccuggcaggcaguaguuaguuaguccaggaacuucuguaguuauguguccucuguaugacaacuugcacauaacugugucugugacuauuggcacccaggagagcuccgugacaagcaguaguagacugaucagugugggaguguggggugugugcuggggaagcagguguguagugagcauccauucagugaauucuuagugccaugucugggcugccugcuagaaacagaucacucuacucacuacuuaguuccgguccccacugacacaccggugacaucucuuucugcccccuguuccaaagcaagcccagggcagaaccaagcacucagcauccuuucucugccccacaguuggagaaggaggagcagauccacaguguggacauuggcaaugauggcucggccuuuguggaggugcuagugggcagcucggcuggaggggccacagcuggugaacaggacuaugagguaagcaggguuggagaggccgacaccccgugucucuaucacuaacacccccccaccucaccacccccaucuccaucacaacacccccccacaccucaccccuaugucuccaucacuagcccccccaacacacacaccagccgccacaugugauuacauuaguguggagagccacccacccugccugucuccuggaggguccuggguaugccgaggagacagagcaggcaugggggaaagcugggcugccuggauuguggucaaauaaggaacaagaggcccucacuuguaaaauucaauugcagcuuagguaguggccugggaacugggguuccacagugucaugacucugguaaccuacaaaauacaggcccuuuaugauugauacuuaauuuuuuccuugagaugggucuuuccuuuugcccaggcuggcauugacuccuagacucaagcaguucugccucagccucccaggaagcugggacuacuauagugugcucugucaagccugccucauaggacuggcagaggccacuguagcucagaguauuagccuacuguuuuuccaguaaagugauggcggugaaaacugcacucaccaugaggcaguugacaagucugagccuaagccagugaagaacgaagggugugugcgcgcgugcgugcgugcgugcgugcgugcgugcgugcgugcgugcgugcauguaugugcguguauguguaugugagagagagggcagagccagguccagccuucugauguuagacuaccccagcguuggucuuuguugcacagcugugccuguugaaaauaaagauguuuugaauguuuugccgccucccccucccuuuuguuuuuuuuaaagauagggucucacugagcccugauugguuuugaacucacauguagccgaagcuggucuuaaauccccgauccucccaccccaucuaaucugacuaagugcugccauuacagcugugagcggccuucuuuccccucuguccugccgacuggcaccucaggguacugucagguucaaggggugaaugcaggccccuugucaucuuccuggccauagagagaacguugugucuuucgcuguuaaauaugacgaugacuguaggguggguucuuagcugguggguugccccaagaccccaagaccaucagaaaacacagauacuuacauuacaauucaagacaauaguaaaauuacaguuaugaaguacaaugaaaauaauuguaugguugaggucaccacaacaugaggggccuugggaaggcugagggccacugcuguagguuuuuguuuuguuuuuuuaagcugaggaacuucuuguuuguuccuaguuaauggaguuguuuguuugcuugcuugcuugcuugcuugcuugcuugcuuuuuaaagauagggucuugcuauauagcucuggcugucugggaauuccccuuguagaacaggcuugucucgcacucacagagaucuugcugagugcugggguugggagcucuuuuccugagugcugucuuggucuguuaggcuggguugcccuccucacucggcccuuccucauccccugcggcccuggauggcagccugugccacaugcccuccucucuggguugagcugcuucuuuccucacacuggaaauggguugcagggccuucuacauguuagagaagacuaccacggaggcccguccccaccugggcuccauaagaucuguuuuugcagaaugagguugcuugcaccaaaaccacuuuuauucucaaaauuauaugccaagucagcagauuuugguauuacuccaaaacaguucuuugcccaguucugcucacucuuaagugaccugagucacuuguuagcccaggggucagacagcucacagucagcugcagccccagcuucaagggaucccacacuucuggguuccacagcccugcaggcaccuacacgcaaaugcacaugucugcacaucgacacacaugcacauaaauacagucaaacuagagacagcuggaagagcaaagaaaggacaaauaagcagaucaggggguuggccaggguugccuccuccuccaggucacugcuucugcgaaucagcaugcuucuuccccuccaugcagaucacgcaaaggaagacuggcuuggagguaauucgagcuacucuggaagagggagaagggguuugcaagucaaggccaguuuagggugcuacauagagcacuugaggccagcaugagcaaguuggccaaaauuuuaaaauuaaaacaggaagaaaaauggggugcaaguugaggcuggagcuccaugguggaguaguguuugcuuagaagucuucauugugagccaagggugugccugagcagcucuuuacauuucugugugcaugagccuaaaacuccuuugcauuccuccuuauauacaugcugccuguuccucauguuccguguaaaggagggcacagauacuggauuggaaauaacuuguagacugggaauguggucucagaggccacuuccuuggaaaagcugguuggcuuuucuccugccacuacugcauucccuucuuccucucucuuagucccccauucucucugaguccuacccagcccauccucagccauuggcuacugccaucuuuacugauagauuaaauuccagcugggagcaaggaccuucagugucaauagacacagauucccgaucagagcaucagaaccacccucuacagcccugccuagaaucccccugggaggggcuggggauguggcucagugguagagcuccugccuagaaucccccugggaggggcugggggcguggcucagugguagagccccugccuagaaucccccugggaggggcugggggcguggcucagugguagagccccugccuagcauuugugaaaaucuagcuuucaucuccaauacaaaaaauuguauaagagagauucacuagaguugaagguagcccagacuagaguaaagguugucuuuggaaggaagcagaaaagcaaugucacaaccagagugguuuuuuucuuuacagugaauaaggcgagacauuugggguucccugccacuuagugacuuaguguugguaacagcucccagcuguugguuguacacacacacacacacacacacacacacacacacgcucaccaugcaaaauccagcccaguaguucacuugagauucuggcccuuuguaacaagugcagaagaagccagcgaguggcuucuguucuguauguuuuuguuguuguuucuuuuucacaaccccagcugagcaccaagaggcauaguguuauauuuuuuaaccauaguaaaaggcuuuuauuuucuaauuuuauaaauuuuucaguaugucaguuggaaaaagaggugaaauaaauagaauaagccuaacugaacauugcuuacagcaucagggaacaccuguucuguccucaggagggaaggcuagccccaggcagacucagcacugcucugacaguuugggcugggggagguagcuugauugguagcuuucuuucggauuuggcccaguggucagaagugacugcgguugcucuaucucaucaguggcuucggaagcagcaaguacagcagguggcuugagaaacaccguggccuugguuugccucccccucccgucauuccuauuuccuccuccauuucccugcauccucugccccacccugggauguuuuuugaggaaaggucuuauguagaccaaacuuaccugaccuugcaugcuuaaccuccugccagcacccccaagugccagugacaggcuugcaggaucgggccucacacuggcuccccaauccccugcuucacugaccuggaaccuaguucuucaguuaaggguggccgugccuucugacccuccgaccuccaccuccuaaggaauuggauuucaaguguuuggcaccauguuccaguuaugcuugcuguacagggauugggcuccagcuuccugugugcuaggcaaacgccaacugagccacauccuuuccccccacucccuuacuguguagcucagacuggccuugaacuagugaucuugccucugccuccugaguauuagaacuauaggcccgccccccacccgaccccucuucuuuguguucugauuggccagagcuguaucuugguccaacugcuggcagagggguggggcuugcuugcacuggucaugauuccauugguuugggcacacagcuuuuucaugguccagaacuauguggucaguucugauugucaucuguuccuucaucugcgucaguaucuccauuuguuuucuugagcugaucuuaagcaggccaauuguguguuugagggugugaguauaugcugccuuccugagucagagugugugguuuguggguucugggaccccuaugggccacccacucguucuuacuucugugaugggccugccaucaccugcagccagagaaugugcacauuauuuuguggacugaauuuuuuuauguaagaauguaguuaccagcugggcaugguggcgcagcccuuuaaucccagcacucgggaggcagaggcaggcgaauuucugaguucgaggccagccuggucuacagagugaguuccagagaaacccugucucgaaaaaccaaaaaaaaaaaaaaaaagaaugaaagaauguaguuaccaacuguuacuguaagccuggguucugaugaagagaagacagagcuguuguccccacuggggugaggaacagaaagcagguuggaaugauagaaacaucugucacagugcggaagggucacgggggcugagcaggugugcccuucccuuucuacugcugguggccccaagagagggguuaguauggggugcugaaaacuggguucauccuugcaucaggaggagcuggggugaugcuccuguagaugggcaagguugcagcgugcagccucucuagcuccuccugcugacggagccugguaaggcacagcuggccaccagagcugucuccacagagcugccccagccugagggugugggccggaagcaucacuuaauucuugaugcugcugugcuccaucuuuggauuugaucuuauuucugacauccuguaacuccuggccuuugagcuaacucaaccacgcauguccauagggcacuugaguacuguaccucucaccaagaugccucugugggacagucccuuagggcaugugguccucuguacugccugauuuuacaugaaaauuugucuggacugcauauggccuggugaccucacuauggagaacugaaaucagcaugucuggggacaaccccacaucaugcaaacagcccuguuaaacucagcaaaccuuaaccaagacacaaaaucaggagagcuuguugggaagaagaagggguccccagggaguuggagagggucaaggaagggugggugaauaugaucaaaacaaauugcauacaugcauggauaguguccaagaacaaugcaaaaauugaaaaaaaaaaaaucugucacggcagcaguuguuaccgaaguuggaggaguaaggcggagagcaguggagaagacacccagcaguccuccccugccuccacaugguacaugugcccacacacccaugcccaugcacccagcuccuagaggugucaucuuacacugucuucuaccuagguccuucuggucaccuccucuuucaugucccccucugagagccgaaguggcucaaaucccaaccguguucgcauuuuuggaccugacaaguuaguccgggcagcagcggagaagcgcugggaccguguuaaaauugugugcagccagccauacagcaagguacaugguguaaaagcugaggcaugcccagggcaaggggaggucugcggaggcccauccugagcucgggacugcucaggucagguccuccugggacaggcagcuugguucucuggagggggugagcugaggcccgucaggcucuguuugguaucacuguuacugucauacuggggcccggaacucaggcuccuccuacuucugcuucugcauccagacagcggaggagcaaagagcccgggguaguuuugcauuccagaaguggcuccagacagagauugggcacacagaaguggacucgcuaccugccauuggcagugagggucaaagagcggugcagguugaggggugagcccugacuuugguccacaguuaggggucagugagguuuaaugucagcaucaccaccauugcucccugggcaccagcuucaacugagccauaaagggcuucccuaagugaaggggcaugagagccuagcuuuguccuauucagacacccucacacccagcccucuguuccaggacucgccauacggccugaguuuugugaaguuucacagcccuccugacaaagaugaggcagaggcuacaucucagguaaguuguaccugguaccccccagagccucucccugccucuccaccccugccugccagcauucuucucacagcacugaccuugugggaccuuagaaggugacagugaccaagcucggccaguuucgugugaaagaggaggaugacagugccaacucccugaagccaggggcucucuucuucagucguaucaacaagacgucaucaggugccugugggacucggggugcuagggauggcguugguggagugcuuacuuagcauagagcccaauccugaaaucuccgcucaggggagacaaggcaggagggccagcuguguaaggucuccucugcuaaguaggaagucuugaguucagccuaggauguaugaugccugagagcugagggcauggccaggucucuaggucuggggaggagggcuggggccuggacuacugagucagggguacaaucuaaacuucugggucaccucuggaugugagagugacuugauaccugauagaugggagcuaaggugacuguggcccugcccucucacccucaguccacuuguccuuccauagccucuacgagugacccagcaggacccagcuaugcagcagcuacacugcaggccucuagugcagccuccucagccucuccaguccccaagguugugggcagcucuuccaaggugaggucaucagacgcuggggcaguggagaaugaggagagccggaagccaacccaucucuaccuccucagccucaggagccucccaaagggaagagaaaacuggacuugagucuagaagacaggaaaccucccagcaaacccucggcagggccauccacccucaagagacccaaauguaagcaaacuggauuccuugauucuguagugacccuggcuugugugucaugagggaagggcuguggucuugaaccugccauccuaagaagggaggcggaaagccugacuuccuguaagagcuggggcucgauggggcaccaaccuaauuucuguucuuuucuccccagugucugucccuagucguacuccagcugcagcuccagccucuaccccagcacagagagccgucccagggaagccccggggagaaggcacagagccuaggggggcucgcacuggaccccaagagcuuggcaagauccugcaagggguggugguggugcucaguggcuuccagaaccccuuccgcucagagcuccgggacaaggcccuggaacugggggccaaguaucggccagacuggaccccagacagcacacaucucauguaggccucugaccugccacacgguucccugcccugcccugcccuacccugcaugcccccgcuagcuucaucugucccuguucugcuauccucccucccugcuucuuugugcccuccagcccccacuucuuuacccccuuaguucucagcuuucugcgucccucccuaagcuccaucucuguucugucucagcuguccaucagaucaugucugacauuccuguuuugcaucucccagcugugccuuugccaacacucccaaauacagccagguccugggccuuggaggccggauugugcguaaagagugggugcuggacugucaccacaugcggcgccggcugcccucccggaggugaggccccacgaccugccucuuaggcagcgcacacaccugccucuuagcccagagcaggcaaugaagagccuggggccugcuggguagcucaggcgaucucaaaccaacauaagccguuuucaaagacgggcugggccugcagaugggaagucacuagccugggugggccacuggauuuuguaaugacggcugcuuugugcacauuguggguuguggcugugcagagguggaagggagccucagggcuguaugccauuccucagaacugauccuuuggcauccuuugggugccaggcagagcugugacugaagugaggacgcugggguugagcccugugcucacuucagcgagugggucagaaguguuagagcccagcuuugaggagcucaggaggggcacagugaucgcgggaugagaagcauggguagcagccaggcagagggcaugcagggcugcagagcaagcagggaugggcagcaugagcauccaucuccugacgcagugggcgggagaagaaccacuggcugccaacagcaggagcuguggagcuggagagaagccgacuccgaucccagugaggucguggcuugagucuguuuaauaagcagggcuaacccuggcacauucaugucggggacugugaggggagguggguggguuggucaguugaucuggaagugguggggacuccacauccugcuuggauuccacagaucccugggagcuaguuaucuagcuucaguauugugaucauccugaacagaugugcggagggugucugugggcgccuuuauucucugagguguguaaggauaguuagcuagugugccacaguagggacuugaaucuaggacacacacacacacaguaccaagaaucaaaaaucuuaggaugguugaaaaugaagagauggcucagugguuaagagcauugguuguucuuuuagaagaccuugacucaguuuccagcacucacauagcaacucucaaccaucuguaacugcagucucagagugauugaugacuucuggcuguuauaggcaccaagcacacacauaugaugcauagacauaugugcaggcaaagcauucauacguguaaaauaaaaaaguuagucuuuaaauauauacaaguugcuuauauaaaaugcuagaguauuuacauaaaaacugcauagaaucuuuucauacauuuaaaaaagauuauuauuuaaauuauguguauguguaucugugcgguggugcacauguguguucagguacgugaggagaccaguugugucaaauccccuauagcuagaguuacaggcaguugugagcaccugauguggguccuggggaaccagauuuggauccuuugaacaguauaagcucuaaacauugagccgucucuccagccucacguacugugaguguggaugucuaagaacugaacccaaggcuucccacaugcuaagccacacccccagccccucacuggggguucuagucagggcucuaccaccgugcuguauaucccuagccuuuuugguuuugauuuggaguguaggagggucuuacuaaguuguucagucuggacuucaauucacucuguucccaggccauccugccucucagccucuugaguaguugagauuagagaccugcucacuaggccagugugcucuuacauguuuuuggguuuuuuguuuuuuguuuuuguuuguuuuguuuuucgagacaggguuucucuguauagcccugguuguccuggaacucacucuguagacuaggcuggccucgaacucagaaauccgccugccucugccucccgagugcugggauuaaaggugugcaccaccgcccggcgcucuuccauguuuugaaucauucugugguuugaauccagcacuauguaaaugccauguaaaucuuuagggaaugacgagcaaacggagucugaauguugagugcagacacagacuuucuggucugugauugguuggguguacagaugcagagaccccagaugugggguuccaccugaauuugcauuugagacuuucccccauugcuuggcauucuccuuugauccucaaagaguagaccccccccccccauugcucuuucuugccuuaaauggaacagaucuuccccaugagggaaagagccugggguggcugaacugccuggcacguaguggagccccucuagggcugggaggggucagagggcagcaggauuccuucucuauccccaccucccucuacuucucaguccucugccugaggcccaguuccuccccuagguaccucauggcaggccuuggauccagcagugaggacgaaggggacucucacagugagagcggcgaagacgaagcucccaagcuuccccaaaaggucugaugccccuauggggccaggagggaauacugggugccaaccaggucugcugaauaccucagcuuccugcuucuccccgcugcuggcuguccagagccucacacugccccaaccucaccuagcccuucuuccucagcggccccagcccaaagccaagacccaggcagcaggacccagcucacccccgaggccaccaaccccaaaagagaccaaagcaccgucaccaggaccccaggacaauagugacacugagggggaagagucagguuagaaucugagggagaggucuacacgcuuuaugucugagggaggaggagggcuagggccuugagcccuggguuugggggcagggcuggugucuagcuuucugggucugagggggagggcuguauggaggugaaggaguagaggaggggccacuguguacccugaaaacuagauugagagggcaacugaagucaaguucauaggcccuggcuguacucucgggugccauucugggagggguguuacuagaugucccaggaaccaagccuguugacuggguugcuacuggcagaaggacgggacaacggggcagaagauucuggggacaccgaggaugaacugaggagguaggauugaaggggguacgucugccuggccuugggugugggugucugcucccuaaguguuuacccuccacuacucuugaucgcccaggguggccaaacagagggaacaaaggcagcccccagccccagaggagaauggcgaggacccguaugcaggcuccacagaugagaacacagacagugagacccccucagaggcugaccugccaaucccagagcucccagguuagacaucccugacucugugacauguccccuagguccccugggucucugcugugucaugcaccacuugcucccuuuccugugacucccacuuuaccccugcugacagcuuccugcucuggcaagcaccugugugacauugcuguagugaccuucccagugugagcaaccucauuuccugacuugugauucaggacuuaccaucucgccccuaaacgcagcucugucugucaucagcucugcugccccuggacaccugagugcugggcacaguguguuugcacucauuacugauaacguuaagccagcucuguuugugcgugugcuauugagcaugauucuucccuguuugguuuuuaugagacagggucucagggagcccaggcuagucugaaaccuguagcuuuccaucugccucagccucccagguucuuagauuacacgugugccaguacacccugccuaccagaaagcugcuaagaagggugucugagcccccugggguggaggagauccugcuguggggguucuugccuauaaucccaguacuugggaugucaaggcagaaggaucacaaguucaaagccagccaggcuacuaagacccuuuuuaaauaaaagaauggagggucaggagagcaggagagaaaagagcagucacucucaagcagugagggucagggucccugcaggagcccuuuccaggcuugugggcaaugucaggagaguauugugaacccccaaugaggggagugaauccuuggacaucguguggaaauaagaagaaaacuagcucagaggccagugugggagccagcugaggugaagugguggccagccugggccaaggccauaagagccccauggccgugugcuuuagcuacugcuuagcaccaggcagaggccugcaggagcuuccuggugacuuggaugaaugccuuagucacggcccucccuccugagcaccuuauccuuggugccucugccucgcccucccucugugcuucugaguacucaggagcuuggucagugccucacuuuucccaucucucccgcagacuucuucgagggcaaacacuucuuccuguauggcgaguucccuggggaugagaggaggaggcucauccgcuacgugaccgcuuucaauggguggguugugggguggguggguacagaggguaugggcugcgggaggauggcgaggauggcgucagggcccaguggcaugaccauagcugcaucguccugcacaguccugcugcccacgaugcuugucacccugcagggcccuucccccaccccuccugagggcaaggcugcugcguggaaggcacaggucucacaggcagcugcagggggcagaggucaagcuaaaagccaggcucacaaacaagaaagaggaagaaaagagcuggagagauggcugcucuuccagagguccuaaguucaguucccagccaccacugguggcucaggaccaucuauaaaggaaucugaugcccucuacuggcauguagguguacaugcagacagaugcuuaaaaagauacguggaaauaaagaagagagggguuagagaggauggcgcaggguuaagagaacugacugcucuuccagagguccugaguucaauuccccgcaaccacgugguggcucacaaccaucuguaaugggcugcagugcucucuucuggcaugcagguauacaggcagaacacugugcauagugaauaaaucagaggcgggggguggggauauuuguccagaaugagagccagaaagcuacugcuguagccagcagcguggcccguccgagugugugggcagcuguagcuggcagcguggccaccugagugugcaagcaggcugcucacagcugccccacccuucccuuucccccaccagcgagcucgaggacuauaugaaugagcggguccaguucgucaucacggcccaggagugggaccccaacuuugaggaggugagcccuggaggggcagacauggagaaccccagcccacuuuggcauucccucugucuuccgauuauauucccaaguggacccuuuucccguaggcccugauggaaaacccuucccuggccuucgugcggccccgguggaucuacaguuguaaugagaagcagaaguuacucccccaucagcucuaugggguggugccccaggccugaguguacaccuguguacgugcagaugugcacauguaugcacaggccugagugcacacguguguacacacaagaguuuaauaaaggagacuuuguuugaagcaac

SEQ ID NO: 3619 - RNA, 3015 nt, Mus musculus
aggaaaguauuggccaaauagcaauuguaacagcuuuauuuccaaagacaaaagccccucccuggguuugaggccucagguggaaggcucggagcugagcagcaaggccagguaggacgagaacagacagagaugggacagccggccggcaggagaggccggcagguccuggaggacacuuuacacagguuccaucugcagcuccucgccaucugcaggcuccaucugguggaaggcagcgugggagccuaugaguaccagcguggcuccuguagggggaugggugguucaggcugugcucuuucgccuggcucccagccucacccuacacagacccuguacucacccaggacccagaagacagcagagccagcaccggccagccagaagaaggggaaagagacgccaccagccagggcauacugaugugcugggcucaccucccggccugggaacagaugguguaagguagccguucccacccgacccuuucccacaaguguccagggucacuuuccacccaucuagugucacagacucuggaaccuuccauguaauaauacagacuccucacaucagugucucccauaccuggccccuacccugccuccccaaagcccccuguccccauaacaaccuuccucugccccaccucugcugucuagcuucaccucucccaggagcccucaggucacuucagacuagggccugauguuccacccuggucaccgggagucucaggcugguggcuccacagucaaaucugaccuaaggauuuuuguccccuuuuuuccuuuguuaagauuuauuucuuugaauuguguguauaugcccugcacgcauacgugcccaagaucaggugcccaugaggagguggccaugggcacccaccugacuugggugcuuggaaccaaaccaagaacaguacucaacugaguacucaacugcugaaccaucucucuaggcacuuauuuugauuuuuuuuuuuuuuugacaggguuucucuguguagcccuggcuguccuggaacucacuuuguagaccaggcuggccucaaacucagaaauccgccugccucugccucccgagugcugggaucaaaggcaugcgccaccaccgcccggcuaggcuuauccugaacuuguagcaauccuccuguuuuagcuucccaagugcugggauuagaggcacaggccagcuucugguuuuaaggauguguucuuugaugcaccuugcgagaauuugguuugugggggcuggagaaggugacucaggaguuaaaagcacguauucuuccagagggcccgcauuacacauuuuuuaaggcuagggcauagcaacacacucuuuaaacccuaguacauauauauuaauuuccuccacccccgccccacgcucuccuaugccugaaaaguguguauguccuagugaccacuaccugcagaagccaaguucugaccugcuucagucuauuucuuugccacagccuaucuuuguuugguccuuaagcuugcugggcuaugaaagacuuauuuuaagucuccucggaaacuuuuggauuccccucauugggucuucccugacaccuuucuuuccagugguccuggugacagucuggggccaccggacuuacagaucucagccuuccccucugagaaucaucagggccaagacuugggaaggaacacggaucuaggccugcaugaggucgccaccuggugugcaguguggguaucugcagcugaugcguuccgugggggggggggggggggguugaguggaauuggauuaagucauuuacaagagacagaggugccagggcuuuggggucucucuggguuugggaagcugagacuggaggggagcaccuggugggucuaagcccuuaaagaccaaguuaagugacucuaguggacagcucggugggggccgucuugggucccaacuauucggaaguuugcauuccgugagaccacgaucagaaaggcccgaggagccauuugggcaggagauuucuuaccaaagaguacaagcuuagacugcaacgugcgcagauagagaauguaacaggcgccaaagaagacagccagagccaccagcagcaugggagaugucacccuggaagagugugggagacaggaguuagguauccgaggcugcgucagccaggccccucuagcuuuggacacagacugagguuacguccuucuaggccagcgaaggccacauccuggucaggugaaugcaggaguacagacugaccggguccuguagugacaaagugggcuaacuggucugggcggggccuggcagccgggggcggggucugacuaucgagggcggggccgcagaggcacucacacgcaguacaggaugaggccgagaaacacgaacacguaguugcuuugauaauacuccacguugcguaccaggcgcuggcaaagcucucccacauugcggggucgcgagaaacguugcugguccacgaaggugccccagggccggauggucgcccggcgccgcuccagccacucucggccugcgccggauggaaucagcuugggcagcaggguccuaaugggcagggcagagcagagcagcugaagggagggagaggguagaaucuggaccccagauucuagcacaccuggucccaagcaugaccuugaaccccuaggaggaaggguccugagagggagccaacaggacugagucccucccaggaccucugaggagaugagggacuccugcaucucggaucuggggguaacacccugcuugcucacguggcgcucagcccuuccccuucggcauccuucugcugguccuucugggccgccaugucugcacugcaguggauagaaccgcuguaaauagcccggagcccagcagcaccuaggcggccccaccccagccgggacucuuuggaaguggcgucguugggagcucuagagggcgguaguuguuccuccaagcauuguggguguuguagucaucguggcgucaagaggcagg

SEQ ID NO: 3620 - RNA, 10928 nt, Mus musculus
cuccccccagagccuuggcccugcccuggaugaggcuagggccgggaguccucaaccccucaguccccacgggaaaaacaugcuugagggccaggagaggccggucaaugaaggggcuagcgaggacagagcaacuggcagcccuggugagaccaagaagggaggcagacgagguggcgagaugaggugggaggagaggauggagagaagcagguggaacgggaaggcggaggaggguggggugucccggggcccgccggcucucggugggagggccuggccgcacacucugguccccugugagcggcagccgcuggcggcuccguguccccagccgggccugccuccuugcugccggccgcuacuaccgcugccgccacugcuccuucuccccuccuaggccgccgccugcccgcccgcccgcgcugaguccuggagcgcggggggguggggugguggugguggugguggugguggugauggugguggugguggugguggaggggagagaugaagggagggaggcagggaggagggcgggcaggagggagggaggcaggcaggcagggagcaaggagggagggaagcagaggagggggagaucguauuggucgggcuggggggcccugcgaggagaaugcugaugagaagagcgagcugcauuggaugaagggccaacccccggggccacccccuccaaccacaccaugccaccgcccugcccaggcagcccaggauucuggagcccauggagcugagaggcauugguggggagaacugagggaagggccuagagauggggagagaggacuacagagauggagaaaaaugcagggaaagagacagccagccaucaagacccaagagaggugggccaaggcccacaaacuccacaaggccaaggaaagccagccauggaaaagcaagccaccugaggacaagagaacagcauauaggacacagagguguuugaagguggcagaggccagagacagaaagacuccucagaauagggagccauacacagaaggagcaaccaggaagcauacacggggcccaguaagcuaggagaggucuccugauggagacagccccauggguacaggagacccacagagacagucacguggcucauagacaugagaggaccacugaggcaggcauggcaagcugggagacauagaacugggaagccucuggaaacgggcucaagauguugaggggaggaagggauucuccauugugcacagagaacuccuggggacccguggagaugagugggaagccagaagaggcccucaucuuuuagucaccugagcagugaggcagugggagggggugacaagauggcagagcugagagaagcacccuuucuuaaggaauacugccgucucccugagaaagcccagaagggcagggggauggaacagaaaauccacacagaucuucaaguggggguggguggugcagggcuggguguguguguuggggggugaaauuuggggggaaggaacaugacaguuggcgcugaaggcugagcccgugacucaccaccacccccaugcucgugauggggaggagacacugacacucucacgugcagcccccagcacaugugaccacaugccucgcacacacaguuggcacguggcaacucagaguauugcaggucuggcuuggugagcucugacuucgugggacaugcccaacaacaugugacauaauauaucugacccuguaggaccaccaaacuuguccaugccucuuuauccuucuaggguuaacauccacagucuccuuaacacccacauuccguucuagccaagccugaggccaguacuucaugccugccucuccguaucuuugcugauccagggaugguauuauccacccucucuaaacauaaucugucccaaaagguccaguccagugcuaccacagcacagugucugacccgaacagguuuccucugcagagaaaggacguaggcagcccaaauuaaguugggaugcccgagcgguuuuagagagaggagccugagaagcuaagcugggaccucaagagggaaaagggggccucagcaggaacaaaacacuaccugcaggcccagagccugccaagagcucagucuggucugcacuugggcuccuacacaggcgauuucaccccaagggcaaauccaaacuacacuagcaaacagcuaggcccaaaccuuagggcucacuaccuccuaccuuaaucuuuuacuuuaaaaaucugcugucuuccccuucccccuuucccuucccccauccuuugcuuugcucuuccugaagucaaccauucacccuuugaucccaaacaauccacccaccggggaacugaguauagaccuagggaaccaucucuugggguggaaugauggcuuucuucucuccccgugggaaccuggacacaugacuucucccggccuguuucuuagcaccucaugguaacugucucugagaggacugguagaauuaaauaaugaaugaaaagcacugggcagaauuuccauugucaccuaacacacuuggaugucaguuaccacuaggcaccucaagauacuaaucagauacuaaaaguaaguccucgagccauguguagugaugcaugccauuaaucccagcaggcagacagaagcagggggaucucuugagaccagccuggacuacauacgaguuucaggguuacauagagaugcugucucaacaauuauuuucuuuuuuggggggggggugucagacaggguuucucuguguagcccuggcuguccuggaacucacucuguagaccaggcuggccuuuaacucagaaauccaccugcuucugccaagugcuggaaaggugugugccaccacugcccaacaaaaauuaauuucuauauagcaguauuuacuuagugucucgaaaacccgggacaaagacuagcaucccuuuucagagauaaaaacaaaaacaaaagccggguaugguggcgcacaccuuuaaucccagcacucgggaggcagaggcagguggauuucugaguucaaggccagccuguuuuacaaagugaauuccaggacagccagagcuauacagagaaacccugucucgaagaacuaaaaaaaaccaaaacaacaacaacaacaacaaaaaaaacuaaaccugagacagaguggaguuguuuugcccaaagucacagcuaagaaguaccagggccaggauaagcagccuaguuagaacauguagguauacuugcuagggaguccaguaagaagacauccagcuagacauccaaaggagggcacacacauggugacaacuggagacucagaccuaccugugguucuguguucaaaccccuccuaguuuuucugagcuucaguuggggaaacgggggacaguuugaccaaccagaugcaccucugauaacucccuuaaccuuggcuucaagagggagcuuccugaaaacugugguguacuuguguggaguccaaauauggauacuggaucucuucagucacucgcuaccauauuacauucagguguguguguguauguucauguaugcacacucugguauaugcagaagucagagaacaacuuacaagagucaguucucuccuuucacccuguggaucccagaaucaaaacuccagaucaggcuuagcauguggcuuuacgcgcugaaccaucucccuggcuggccuggaacuucauguuuucccaggaaauucuucccaugccuagggguccuuaacuguaacuguguggaagggcagucaccuggaaagauaccuuuaaugcucaaaacaggagaggccgagucaggcggaucucugugaggccagccuguucacaaagccagaccaugccucaaacaaaaacaagaacaacugacucgauccacuacaaaucccauaaacuuccuucuucaggucuuccaccccacacccucagcuucuuccaagggaccuuacuaacggggcuuuuccuuucuccuuccauuucucacuuccugucacguaccucuuccucuaaacucccucuccugacaucuuguuuccauucuacucuuccucgauuuccccguucauccucuuaauaggaaaaaaaagucuuaagccuuguuuuguuccuuuugcccugugugacugcugcugcuugguuuccucucccauucacgccgaguggugucucuuuuuuuuuuuuuuuuuuuuuuugccacuggcccucagggauccuugacuguaacccgccggccuccagggcuuugcgugucucuacagccuacacugcccgaauccccuacgccuagcuugucaggcgcccccaagauggcgccuccagcuucgucccgccucccgacgucaucgcgcccucuccgcucagcgcuccccuuucgagcuaucaaaggcggaauccgagaagagguggaagaggaagaaccuccagggaggauuaaagaggcggguaguauccaccuggaggccgaccagcgagggaacauugcuaaaggauuggcugggcgcugcgcgaucccaccccuccgcucuauuggucgaggcuucaggaaaccugagcaucgauuggucuaaugacaggggcagacagccgaugauugggcgaauugugcaguucuucgcagcggcccaggcggaaggugggaggagcguuguugagggcggccuggggugagagcgaggcugcggagcaggcgagacgacgggcgcuagagaggacgcggcgcuagaguggcggugcaaagggaccugaagcccguagcccggccuggggccggcgagacggccgaggcgggugaguccccgccggagcgcagagguccggccccacccggcggcuugccugcgucauucggccugcacgaugaaggccugaaggaucgcgucccgggugcggagagcggagcggccguugggcgcgcgggccgggcgggggcugugccgggacggcgggugggaugggggacuggaguugagugcggggcugagugaggaggggcagggcucgggcugcaggccgggggccgaccuuggcgggaaggggaggucccagagcugccucgccggagggcucucugguugcaugggguaucggggccacgggugggugcgcugggauggggaucagaaucgaaaggggacgguuagaggacucauggaugccgggguggggagcuggcccgagaaaggagguaauuaacgcagggaggaaaaucgauuucugccuggaaagagcugaggcagagaagagguuuuugagguaucuuuagagcgaagggagggaucagguguggaaaacggaguaaugcugacaaggaagaccgauaaacgcaugaaaguggggcuuggaaaguauugacagaggucuuuauuuauucuuacggguuucaauagguugagcuagaggggagggauuguuuuguuuuagauacagguaaguaggccaaagggaauauucgagcaaucuuggguguaguuggagagacagagaugugugcuacagagagcagucuaggaauuuuggggauguaccauauugauaacucugggggauuuggguauccccauaguuguuugcuggugagaagguuuaaguaugaagaggaccucuuuuugcaggguuugaguacagauggaguuucuaagugacagacauuggaaacccugagugagauaggugaaagguuaagcaauugugaaggaugggccagcuauuccuggccaagauuacaaaaaaggagaaauucagucaguaugaaauagggaucugaaaaucccuggagugcguuaggaugaauuugggucuuuucucagaggggaaaaaaaagguuuagguuauacucaguagcgggguucucagcugaguucauuaagguuggccuggacccuuaugcaaaaaaggguaguguugguuggggaggaggcacauaggcauuccucgaugaguuagaguuaagucagugugaauagcugacagugugcuggggcaguagcacagcacacuuggucuugguggagagaaagggugauugaaaacucuaggggugugucagaaaggugagacgcaucuggcugugacggauuagacuuugguggagauggaccuuccggguaaaggguaauccuguggugggccuuuuucccuuuugguuucuccauguagcccagccugucccagaacuaacuauguagaucagccuggcugugaauuccuagcaaucugccugacucugccuuagagggcuggaauuaaaagcaugaacugcccagcugagaagaucuugauaugauuaguuuaaacuuguuuuaaagagucugaguaucaggaagugguuaaggugggaaaguauggagauggguucagccagugagagaaaauuugguagccggguaacuugaugugaggaaccugggcauuggugguuagcagagguuggguggcaagaccaccagugccaccaguuggcuuggacaccagcuugaguggucugagugugaaaagaaguuugugagccugccagaaggcagagucuauguaggagugcagcuuggagggacaggccaugagaguguuugaggauucugcaaguagcuuggcaaaggaauacugucccaugcagugguaaggagucaaaggacagucugcauuggaaggagacagguuccuguuugauggacagggcuuugggaaccaguuuggagguaugggaaauagagaggauugaggucauaggagcugguguucaaugcaagcuaaaugagcugggagcuuugggagaaagucccugggacaagaccauuggagaaauucguguuggcuguuccuauguucaggcaaggaggauuauuagggagggcauuggagcgggaaaauguaaugaagaaguuggauggaauaaaauaccccggaggauugacuugucgcugccuucccuccucucagcccagggccuugcugcugccaugacugaggagagugaagagacgguccuguacauugagcaccgcuaugucugcucugagugcaaccagcucuauggauccuuggaggaggugcuugugcaccagaacucccacgugccccagcagcacuuugagcuggugggcguggcugacccuggagucacaguggccacagaggcugcuucaggcacaggccuauaucagacccucauccaagagagccaguaccagugucuugagugugggcaacugcuccugucccccagccagcuccuggagcaccaggagcuacaccugaagaugauggcaccgcaggaggcagugccagccaagccaccacccaaggugccccccuugggcuccagcgccauccacuaugaguguguggacuguaaggcucuguucgccagccaagagauguggcuuagccaucgccagacgcaucucagagccacgcccaacaaggcuccugcuccugucgucuugggguccccaguuguuuugggcccuccugugggccaggcucgaguggcuguggaacauucauaccgaaaagcagaagaggguggggagggggcggccguuccgucuguggccgccaccaccgagauggugacagaaguggagcugcuccucuacaagugcuccgagugcucccagcucuuccagaugcccgcugacuuccuggagcaccaggccacccacuucccugcuccugucccggaggcugcggagccugccacacagcaggaaacccagguccccucacccacugaggcagcagugucucagcccgaaccccugccagccucugaucacaguuaugagcugcggaaugagcugcgaaauggggaggccauugggcgagaccgcaggggacggaagccaaggaggaacaacaguggagagucagguggggcggccacccaggaacuauuuugcucugccugugaccagcucuuucucucaccccaccagcuacagcagcaccuucggagucaccgggaggguguuuuuaaguguccccugugcagucgugucuucccuagcccuucuagucuggaccagcaccuuggugaccauagcagugagucucacuuccuguguguagacuguggccuagccuuuggcaccgaagcccuccuccuggcccaccggcgagcccauaccccgaauccucugcauucgugucccugugggaagaccuuuguuaaccucaccaaguuccuuuaucaccggcguacccacggagcaggaggugucccuuugcccacaacaccaguuccaccagaggagccugcuauuagcuuuccugagccagccccugcagagaccggagagcuagaggccccagagcuccccguaugugaggagaguucagccgagccugcagcuccaggcucuuaccgcugccuccuguguagccgggaguuugguaaggcguugcagcugacccggcaccagcguuuugugcaccggcuagagcggcgccauaagugcagcauuuguggcaagauguucaagaagaagucucaugugcggaaccaucugcguacacacacuggggagcggcccuuccccugcccugacugcucuaagccuuucaacucaccagccaaccuggcccgccaccggcucacacacacgggggagcggcccuaccgguguggggacugcggcaaggccuucacgcagagcuccacucugaggcagcaucgccuggugcaugcccagcacuuccccuaccgcugccaggagugcggaguccguuuucaccgcccuuaucgccugcucaugcaccgcuaccaccacacaggcgaguaccccuacaagugccgugagugcccccguuccuucuugcuacgccggcugcuagagguccaccagcuugugauccaugcugggcgccagcccuaccgcugcucauccuguggggccgccuuccccucgucacugcggcuccgugagcaucgcugcgcggccgcugcugcccaggccccacggcgcuuugagugugggaccuguggcaagaaagugggcucugcugcucgccugcaggcacaugaagccgcccaugcugcugcggguccuggagaggucuuagccaaggagccuccugcuccccgggccucgagagccacucgcacaccagucgcccccuccccgacagcccucagugguacaaccucugcugccccugcagccccugcccggcgucgggguccggagugcagugagugcaagaagcucuucagcacagagacgucacuacagguccaucggcgcauccacacaggugagcggccauaccccuguccagacuguggcaaggccuuccgccagaguacccaucugaaagaccacagacgccuacacacaggcgagcggcccuuugcgugugaaguguguggcaaggccuuugccaucuccaugcgucuggcagaacaucgccgcauccacacgggugagcgacccuacuccuguccugacuguggcaagagcuaccguuccuucuccaaucucuggaagcaccgcaagacccaccagcagcaacaccaggcggccguccgacagcagcuggcagaggcggaggcugcugugggccuggcugugauggaaacugcaguggaggcucugccccuuguggaggccauugagaucuacccucuagcugaagcugaugggguccagaucaguggcugacuggccccacuggugcugaaggcccuccaccaaccccuuuaaacccguguacauaguguaccccucuccucuccaccaccuuaugaguucuguaacuaauuuuaacuaauuuuuuuuugaggggguugcucuggaguccuugauauguaaagggcacuucccacuuuccaccuguuugguggucuccaaaugaagcagucaauaaagacugaauuggacauuuaugcuuuuugucaggccuagcuauauaacaugauucggaggaucaugaggccaggcugcaauagagcugacuucuggcugcauuccuagcaccccagauagaacuuggcagguaguccaguuugcuggauugagaagaaggcagccugagucuggggcauggaucuuugaaaccagccucuuguggcagaugaagguaaugugucuugccacuagagguccccaaagccugaggaaaaucuugaagcacucuguggcuuuggggcagggguggggcgugcaaacacauagagaaacauuggugcacuucucagccuggccaucccauuuccagccugaugugggucacaucugcgaggccauccaucuguauuucucacacuggaucccugaggacagacuuguaccaggcguaauggggaacaguggcggaggggaacuccuggggacucuaccuaguagcugaauuugaaguucuaaauauugggggcuggaguaggaagugacuugucgugugucccccaugcccccaaccccaagcuguaucucggccaauaggaagaaagugauggauuggcuggucaguaucuucuaguauauuuugaguauuucaucgccaccccaccuauacacacccuaagaacugcauauuugcuuggaucucucacaugcugagcaagcucaggaccacaaagcugugucccgauaucuaauuuugaggucagguuugcugauuguccaggccucagacucacuauauccuaagcaggcuuugagcuuguugguccuccugccacagccccuugaguaguuaggaugacaggccugugcccuugaguuauuuugaguaacauuggaacuuaacccuacagaggaggccucuggcaugugacucggugauggucaguucaacccaaggcagagcuuaaauucaaaucuggucuccuuugauuuaagcauccauauuccaugcugacugucccauggucuuucccaacaagaaaauggaaauga

SEQ ID NO: 3621 - RNA, 10928 nt, Mus musculus
ucauuuccauuuucuuguugggaaagaccaugggacagucagcauggaauauggaugcuuaaaucaaaggagaccagauuugaauuuaagcucugccuuggguugaacugaccaucaccgagucacaugccagaggccuccucuguaggguuaaguuccaauguuacucaaaauaacucaagggcacaggccugucauccuaacuacucaaggggcuguggcaggaggaccaacaagcucaaagccugcuuaggauauagugagucugaggccuggacaaucagcaaaccugaccucaaaauuagauaucgggacacagcuuugugguccugagcuugcucagcaugugagagauccaagcaaauaugcaguucuuaggguguguauaggugggguggcgaugaaauacucaaaauauacuagaagauacugaccagccaauccaucacuuucuuccuauuggccgagauacagcuugggguugggggcaugggggacacacgacaagucacuuccuacuccagcccccaauauuuagaacuucaaauucagcuacuagguagaguccccaggaguuccccuccgccacuguuccccauuacgccugguacaagucuguccucagggauccagugugagaaauacagauggauggccucgcagaugugacccacaucaggcuggaaaugggauggccaggcugagaagugcaccaauguuucucuauguguuugcacgccccaccccugccccaaagccacagagugcuucaagauuuuccucaggcuuuggggaccucuaguggcaagacacauuaccuucaucugccacaagaggcugguuucaaagauccaugccccagacucaggcugccuucuucucaauccagcaaacuggacuaccugccaaguucuaucuggggugcuaggaaugcagccagaagucagcucuauugcagccuggccucaugauccuccgaaucauguuauauagcuaggccugacaaaaagcauaaauguccaauucagucuuuauugacugcuucauuuggagaccaccaaacagguggaaagugggaagugcccuuuacauaucaaggacuccagagcaacccccucaaaaaaaaauuaguuaaaauuaguuacagaacucauaaggugguggagaggagagggguacacuauguacacggguuuaaagggguugguggagggccuucagcaccaguggggccagucagccacugaucuggaccccaucagcuucagcuagaggguagaucucaauggccuccacaaggggcagagccuccacugcaguuuccaucacagccaggcccacagcagccuccgccucugccagcugcugucggacggccgccugguguugcugcuggugggucuugcggugcuuccagagauuggagaaggaacgguagcucuugccacagucaggacaggaguagggucgcucacccguguggaugcggcgauguucugccagacgcauggagauggcaaaggccuugccacacacuucacacgcaaagggccgcucgccuguguguaggcgucuguggucuuucagauggguacucuggcggaaggccuugccacagucuggacagggguauggccgcucaccuguguggaugcgccgauggaccuguagugacgucucugugcugaagagcuucuugcacucacugcacuccggaccccgacgccgggcaggggcugcaggggcagcagagguuguaccacugagggcugucggggagggggcgacuggugugcgaguggcucucgaggcccggggagcaggaggcuccuuggcuaagaccucuccaggacccgcagcagcaugggcggcuucaugugccugcaggcgagcagcagagcccacuuucuugccacaggucccacacucaaagcgccguggggccugggcagcagcggccgcgcagcgaugcucacggagccgcagugacgaggggaaggcggccccacaggaugagcagcgguagggcuggcgcccagcauggaucacaagcugguggaccucuagcagccggcguagcaagaaggaacgggggcacucacggcacuuguagggguacucgccuguguggugguagcggugcaugagcaggcgauaagggcggugaaaacggacuccgcacuccuggcagcgguaggggaagugcugggcaugcaccaggcgaugcugccucagaguggagcucugcgugaaggccuugccgcaguccccacaccgguagggccgcucccccgugugugugagccgguggcgggccagguuggcuggugaguugaaaggcuuagagcagucagggcaggggaagggccgcuccccaguguguguacgcagaugguuccgcacaugagacuucuucuugaacaucuugccacaaaugcugcacuuauggcgccgcucuagccggugcacaaaacgcuggugccgggucagcugcaacgccuuaccaaacucccggcuacacaggaggcagcgguaagagccuggagcugcaggcucggcugaacucuccucacauacggggagcucuggggccucuagcucuccggucucugcaggggcuggcucaggaaagcuaauagcaggcuccucugguggaacugguguugugggcaaagggacaccuccugcuccguggguacgccggugauaaaggaacuuggugagguuaacaaaggucuucccacagggacacgaaugcagaggauucgggguaugggcucgccggugggccaggaggagggcuucggugccaaaggcuaggccacagucuacacacaggaagugagacucacugcuauggucaccaaggugcugguccagacuagaagggcuagggaagacacgacugcacaggggacacuuaaaaacacccucccggugacuccgaaggugcugcuguagcugguggggugagagaaagagcuggucacaggcagagcaaaauaguuccuggguggccgccccaccugacucuccacuguuguuccuccuuggcuuccguccccugcggucucgcccaauggccuccccauuucgcagcucauuccgcagcucauaacugugaucagaggcuggcagggguucgggcugagacacugcugccucagugggugaggggaccuggguuuccugcuguguggcaggcuccgcagccuccgggacaggagcagggaaguggguggccuggugcuccaggaagucagcgggcaucuggaagagcugggagcacucggagcacuuguagaggagcagcuccacuucugucaccaucucggugguggcggccacagacggaacggccgcccccuccccacccucuucugcuuuucgguaugaauguuccacagccacucgagccuggcccacaggagggcccaaaacaacuggggaccccaagacgacaggagcaggagccuuguugggcguggcucugagaugcgucuggcgauggcuaagccacaucucuuggcuggcgaacagagccuuacaguccacacacucauaguggauggcgcuggagcccaaggggggcaccuugggugguggcuuggcuggcacugccuccugcggugccaucaucuucagguguagcuccuggugcuccaggagcuggcugggggacaggagcaguugcccacacucaagacacugguacuggcucucuuggaugagggucugauauaggccugugccugaagcagccucuguggccacugugacuccagggucagccacgcccaccagcucaaagugcugcuggggcacgugggaguucuggugcacaagcaccuccuccaaggauccauagagcugguugcacucagagcagacauagcggugcucaauguacaggaccgucucuucacucuccucagucauggcagcagcaaggcccugggcugagaggagggaaggcagcgacaagucaauccuccgggguauuuuauuccauccaacuucuucauuacauuuucccgcuccaaugcccucccuaauaauccuccuugccugaacauaggaacagccaacacgaauuucuccaauggucuugucccagggacuuucucccaaagcucccagcucauuuagcuugcauugaacaccagcuccuaugaccucaauccucucuauuucccauaccuccaaacugguucccaaagcccuguccaucaaacaggaaccugucuccuuccaaugcagacuguccuuugacuccuuaccacugcaugggacaguauuccuuugccaagcuacuugcagaauccucaaacacucucauggccugucccuccaagcugcacuccuacauagacucugccuucuggcaggcucacaaacuucuuuucacacucagaccacucaagcugguguccaagccaacugguggcacugguggucuugccacccaaccucugcuaaccaccaaugcccagguuccucacaucaaguuacccggcuaccaaauuuucucucacuggcugaacccaucuccauacuuucccaccuuaaccacuuccugauacucagacucuuuaaaacaaguuuaaacuaaucauaucaagaucuucucagcugggcaguucaugcuuuuaauuccagcccucuaaggcagagucaggcagauugcuaggaauucacagccaggcugaucuacauaguuaguucugggacaggcugggcuacauggagaaaccaaaagggaaaaaggcccaccacaggauuacccuuuacccggaagguccaucuccaccaaagucuaauccgucacagccagaugcgucucaccuuucugacacaccccuagaguuuucaaucacccuuucucuccaccaagaccaagugugcugugcuacugccccagcacacugucagcuauucacacugacuuaacucuaacucaucgaggaaugccuaugugccuccuccccaaccaacacuacccuuuuuugcauaaggguccaggccaaccuuaaugaacucagcugagaaccccgcuacugaguauaaccuaaaccuuuuuuuuccccucugagaaaagacccaaauucauccuaacgcacuccagggauuuucagaucccuauuucauacugacugaauuucuccuuuuuuguaaucuuggccaggaauagcuggcccauccuucacaauugcuuaaccuuucaccuaucucacucaggguuuccaaugucugucacuuagaaacuccaucuguacucaaacccugcaaaaagagguccucuucauacuuaaaccuucucaccagcaaacaacuauggggauacccaaaucccccagaguuaucaauaugguacauccccaaaauuccuagacugcucucuguagcacacaucucugucucuccaacuacacccaagauugcucgaauauucccuuuggccuacuuaccuguaucuaaaacaaaacaaucccuccccucuagcucaaccuauugaaacccguaagaauaaauaaagaccucugucaauacuuuccaagccccacuuucaugcguuuaucggucuuccuugucagcauuacuccguuuuccacaccugaucccucccuucgcucuaaagauaccucaaaaaccucuucucugccucagcucuuuccaggcagaaaucgauuuuccucccugcguuaauuaccuccuuucucgggccagcuccccaccccggcauccaugaguccucuaaccguccccuuucgauucugauccccaucccagcgcacccacccguggccccgauaccccaugcaaccagagagcccuccggcgaggcagcucugggaccuccccuucccgccaaggucggcccccggccugcagcccgagcccugccccuccucacucagccccgcacucaacuccagucccccaucccacccgccgucccggcacagcccccgcccggcccgcgcgcccaacggccgcuccgcucuccgcacccgggacgcgauccuucaggccuucaucgugcaggccgaaugacgcaggcaagccgccggguggggccggaccucugcgcuccggcggggacucacccgccucggccgucucgccggccccaggccgggcuacgggcuucaggucccuuugcaccgccacucuagcgccgcguccucucuagcgcccgucgucucgccugcuccgcagccucgcucucaccccaggccgcccucaacaacgcuccucccaccuuccgccugggccgcugcgaagaacugcacaauucgcccaaucaucggcugucugccccugucauuagaccaaucgaugcucagguuuccugaagccucgaccaauagagcggaggggugggaucgcgcagcgcccagccaauccuuuagcaauguucccucgcuggucggccuccagguggauacuacccgccucuuuaauccucccuggagguucuuccucuuccaccucuucucggauuccgccuuugauagcucgaaaggggagcgcugagcggagagggcgcgaugacgucgggaggcgggacgaagcuggaggcgccaucuugggggcgccugacaagcuaggcguaggggauucgggcaguguaggcuguagagacacgcaaagcccuggaggccggcggguuacagucaaggaucccugagggccaguggcaaaaaaaaaaaaaaaaaaaaaaagagacaccacucggcgugaaugggagaggaaaccaagcagcagcagucacacagggcaaaaggaacaaaacaaggcuuaagacuuuuuuuuccuauuaagaggaugaacggggaaaucgaggaagaguagaauggaaacaagaugucaggagagggaguuuagaggaagagguacgugacaggaagugagaaauggaaggagaaaggaaaagccccguuaguaaggucccuuggaagaagcugagggugugggguggaagaccugaagaaggaaguuuaugggauuuguaguggaucgagucaguuguucuuguuuuuguuugaggcauggucuggcuuugugaacaggcuggccucacagagauccgccugacucggccucuccuguuuugagcauuaaagguaucuuuccaggugacugcccuuccacacaguuacaguuaaggaccccuaggcaugggaagaauuuccugggaaaacaugaaguuccaggccagccagggagaugguucagcgcguaaagccacaugcuaagccugaucuggaguuuugauucugggauccacagggugaaaggagagaacugacucuuguaaguuguucucugacuucugcauauaccagagugugcauacaugaacauacacacacacaccugaauguaauaugguagcgagugacugaagagauccaguauccauauuuggacuccacacaaguacaccacaguuuucaggaagcucccucuugaagccaagguuaagggaguuaucagaggugcaucugguuggucaaacugucccccguuuccccaacugaagcucagaaaaacuaggagggguuugaacacagaaccacagguaggucugagucuccaguugucaccaugugugugcccuccuuuggaugucuagcuggaugucuucuuacuggacucccuagcaaguauaccuacauguucuaacuaggcugcuuauccuggcccugguacuucuuagcugugacuuugggcaaaacaacuccacucugucucagguuuaguuuuuuuuguuguuguuguuguuguuuugguuuuuuuuaguucuucgagacaggguuucucuguauagcucuggcuguccuggaauucacuuuguaaaacaggcuggccuugaacucagaaauccaccugccucugccucccgagugcugggauuaaaggugugcgccaccauacccggcuuuuguuuuuguuuuuaucucugaaaagggaugcuagucuuugucccggguuuucgagacacuaaguaaauacugcuauauagaaauuaauuuuuguugggcagugguggcacacaccuuuccagcacuuggcagaagcagguggauuucugaguuaaaggccagccuggucuacagagugaguuccaggacagccagggcuacacagagaaacccugucugacaccccccccccaaaaaagaaaauaauuguugagacagcaucucuauguaacccugaaacucguauguaguccaggcuggucucaagagaucccccugcuucugucugccugcugggauuaauggcaugcaucacuacacauggcucgaggacuuacuuuuaguaucugauuaguaucuugaggugccuagugguaacugacauccaaguguguuaggugacaauggaaauucugcccagugcuuuucauucauuauuuaauucuaccaguccucucagagacaguuaccaugaggugcuaagaaacaggccgggagaagucauguguccagguucccacggggagagaagaaagccaucauuccaccccaagagaugguucccuaggucuauacucaguuccccgguggguggauuguuugggaucaaagggugaaugguugacuucaggaagagcaaagcaaaggaugggggaagggaaagggggaaggggaagacagcagauuuuuaaaguaaaagauuaagguaggagguagugagcccuaagguuugggccuagcuguuugcuaguguaguuuggauuugcccuuggggugaaaucgccuguguaggagcccaagugcagaccagacugagcucuuggcaggcucugggccugcagguaguguuuuguuccugcugaggcccccuuuucccucuugaggucccagcuuagcuucucaggcuccucucucuaaaaccgcucgggcaucccaacuuaauuugggcugccuacguccuuucucugcagaggaaaccuguucgggucagacacugugcugugguagcacuggacuggaccuuuugggacagauuauguuuagagaggguggauaauaccaucccuggaucagcaaagauacggagaggcaggcaugaaguacuggccucaggcuuggcuagaacggaauguggguguuaaggagacuguggauguuaacccuagaaggauaaagaggcauggacaaguuuggugguccuacagggucagauauauuaugucacauguuguugggcaugucccacgaagucagagcucaccaagccagaccugcaauacucugaguugccacgugccaacugugugugcgaggcauguggucacaugugcugggggcugcacgugagagugucagugucuccuccccaucacgagcaugggggugguggugagucacgggcucagccuucagcgccaacugucauguuccuuccccccaaauuucaccccccaacacacacacccagcccugcaccacccacccccacuugaagaucuguguggauuuucuguuccaucccccugcccuucugggcuuucucagggagacggcaguauuccuuaagaaagggugcuucucucagcucugccaucuugucacccccucccacugccucacugcucaggugacuaaaagaugagggccucuucuggcuucccacucaucuccacggguccccaggaguucucugugcacaauggagaaucccuuccuccccucaacaucuugagcccguuuccagaggcuucccaguucuaugucucccagcuugccaugccugccucagugguccucucaugucuaugagccacgugacugucucugugggucuccuguacccauggggcugucuccaucaggagaccucuccuagcuuacugggccccguguaugcuuccugguugcuccuucuguguauggcucccuauucugaggagucuuucugucucuggccucugccaccuucaaacaccucuguguccuauaugcuguucucuuguccucagguggcuugcuuuuccauggcuggcuuuccuuggccuuguggaguuugugggccuuggcccaccucucuugggucuugauggcuggcugucucuuucccugcauuuuucuccaucucuguaguccucucuccccaucucuaggcccuucccucaguucuccccaccaaugccucucagcuccaugggcuccagaauccugggcugccugggcagggcgguggcauggugugguuggaggggguggccccggggguuggcccuucauccaaugcagcucgcucuucucaucagcauucuccucgcagggccccccagcccgaccaauacgaucucccccuccucugcuucccucccuccuugcucccugccugccugccucccucccuccugcccgcccuccucccugccucccucccuucaucucuccccuccaccaccaccaccaccaccaucaccaccaccaccaccaccaccaccaccccacccccccgcgcuccaggacucagcgcgggcgggcgggcaggcggcggccuaggaggggagaaggagcaguggcggcagcgguaguagcggccggcagcaaggaggcaggcccggcuggggacacggagccgccagcggcugccgcucacaggggaccagagugugcggccaggcccucccaccgagagccggcgggccccgggacaccccacccuccuccgccuucccguuccaccugcuucucuccauccucuccucccaccucaucucgccaccucgucugccucccuucuuggucucaccagggcugccaguugcucuguccucgcuagccccuucauugaccggccucuccuggcccucaagcauguuuuucccguggggacugagggguugaggacucccggcccuagccucauccagggcagggccaaggcucuggggggag

SEQ ID NO: 3622 - RNA, 1096 nt, Mus musculus
uuuuaacauuaaaguucuaugagguauuuggugccuuaucucgaguccucgggggagaggggcccgaggugaggggagacguggggcucaccugccccuccagcccacccucccaccccccucccgauauuugguuucacagcuguaguuaaagcuugggauuugguuauuuuuucccccuccuaggaauuuuuuccuuguuuuucauuucccaguguggggguuggaugaggaggguccccaccacccccagcugcauggggguucccuccaccaaugucagggcgucugccccaucccugccccuguuuccuccucucuuugccccacuccuccacacuaggguggggacuugaucaggaagaagcaggauaaauugggugguggugagucccggauuuucuuuucuuaacuauuuuuuuccccuuuucuuuuuuuggucuagaaucaugguuucuguccgagucaucuccaccgugccuuccacgcugccugucuucucagaggguugguuguuguuuguucuucugguugucauuccuucauucugcucuguucaaaugucuuccuauaaaggucaggagccccugggccccucugcacccuuggguugaguccgggcccacucgcuagccgcuuuccaggaaauuaaaauggacaacuucagagguaggaugagggcaggggcugggggagggggcgggaucgguucaguaaagaugcuuacuacauuccagcgaggauggguggacgaggugccccauuggugccugggugggaggggcagccacuccacccaaggcccugcauuggccuagaguuaguuucugcugccucuguaauccagccccgacaguuuuguucugggugagagaagggagaccagaagaaaagagaacgcugaggcuugagggcucuggcugccucuccucggaguguccaggauggaagggggcccaggccauugcccggcucuccccucuccccuucucugccccugcccagccaggggcaagggucacucugauuucaauggcucgcguccuucacagcaacacuuugguuugaagagagaaacagaaaggaggucaagaga

SEQ ID NO: 3623 - RNA, 1096 nt, Mus musculus
ucucuugaccuccuuucuguuucucucuucaaaccaaaguguugcugugaaggacgcgagccauugaaaucagagugacccuugccccuggcugggcaggggcagagaaggggagaggggagagccgggcaauggccugggcccccuuccauccuggacacuccgaggagaggcagccagagcccucaagccucagcguucucuuuucuucuggucucccuucucucacccagaacaaaacugucggggcuggauuacagaggcagcagaaacuaacucuaggccaaugcagggccuuggguggaguggcugccccucccacccaggcaccaauggggcaccucguccacccauccucgcuggaauguaguaagcaucuuuacugaaccgaucccgcccccucccccagccccugcccucauccuaccucugaaguuguccauuuuaauuuccuggaaagcggcuagcgagugggcccggacucaacccaagggugcagaggggcccaggggcuccugaccuuuauaggaagacauuugaacagagcagaaugaaggaaugacaaccagaagaacaaacaacaaccaacccucugagaagacaggcagcguggaaggcacgguggagaugacucggacagaaaccaugauucuagaccaaaaaaagaaaaggggaaaaaaauaguuaagaaaagaaaauccgggacucaccaccacccaauuuauccugcuucuuccugaucaaguccccacccuaguguggaggaguggggcaaagagaggaggaaacaggggcagggauggggcagacgcccugacauugguggagggaacccccaugcagcugggggugguggggacccuccucauccaacccccacacugggaaaugaaaaacaaggaaaaaauuccuaggagggggaaaaaauaaccaaaucccaagcuuuaacuacagcugugaaaccaaauaucgggaggggggugggagggugggcuggaggggcaggugagccccacgucuccccucaccucgggccccucucccccgaggacucgagauaaggcaccaaauaccucauagaacuuuaauguuaaaa

SEQ ID NO: 3624 - RNA, 6453 nt, Mus musculus
caaugggaggcguggauagugaaggguccuacacuacuggaguggagggucugugucaagagcggcaggggcugcuuggagguaagagagaugggugagggcgccgcagggcgggcggggaagagagcgcuggguguaaggagagaguggaggaagagggaaggguacgcucagggucggagagccuuggggccugcgcuuggggcuggagcagcgcgggaugaucgacagcuccuuccugugugcccuagaggcgucguuggauccccugcuugugcuggccucagcuugagcucgcuugcacaccccaccccugcagggggcucucacgcugcagagaagaggaaucugguaggagggaaaaaagcaguguagcgggaaaguugaacuuucaggccccugguguaggugcuuagaucuccuuuccguauacagagguauuagcugaauuccaccuacccccugacacgguguaggacugggagggaaaagaaugcaggcggaaaaguguccauuucgggauaccugugcuacuuucuagaaggacaguguuauuaggauugugugcaaguuaagugaguuuuggaaggauugaguuggaugaaauucagagagcacauaggauuggguccugugcaccauguuuuucuguguaugagcucauccauacuuuguaaaguuugggcauccgcuccuuaccugcuacaagccauguagcaugcucugauccaagccaggggaguucugucuuggcagugaggcuguaacuaaggcagaaugcuaaccucccccacccccagcccauuugauuguuucuaagaaaauccuuuauggacugguucggacuuaaugaggagccaggcagguguaguggcacccgcuuucaaugucagcacuggggagggagaagcugguagauuucugugaguuugaggccagucugcccuacauagugaguuccagauaggccaggguuacaagaugagaugcuucaaaacagagcgcacuuaaugggguauuuggaauugguagauaaggaaaguuugguuccugagcauuuagcaagucauuuaucugcaaaugguuuauuggucaucaacuaauaacagggccuuguacugggcuauguaucauggaaaugcauaaaauggguagacauguagugugcacagagaugguuaaggucccaggacaucgucuauagggagccuuaacucgucacugaaugagucuguguauuuacugugugcugggcaccuuucuuggcacuggaaacaccucgguggugaagaggcuaagaucccugcccucugggagcaguacaugagcagccuguaugccagggcuaccagcuaaagucuccaugcuccuggcaugagcacaaguaaagagguaaggaaaguggccgauggcacuugggaggcagaagaaacaaggcugagaaccagacguccccguguacauacugagugaggucaaggccagccuuuguacauagacugucucuacaaaacagaaccagcaaggcaguggcggcgcacaacucuaaccccagcacuugggaggcagaggcuggugaaucucugugaguucaaggccagcccagucuacagaucugaguuccaggacaguccagggccacacagagaaaaucugucucaaacaacagcaacaacaaaaacgggccaucuugcuggcccaggagguaaaggcgugugccuugcagcccugaugaccccaguucaauucucagaacccauauaccauugggaggaaagaaugggcuccgaaugccaugaaguuguccucuguaugcuacauguaugccaugacguguguucaugcaugcaggcacacaguaacauaaacaaugacaaaaaaugguggcgguagggcuauaagguggcucaguggguaaaagcaauuggcacugagccugaugaccugaguuugacgccagagccccauggugggagaaccagauccugcaaauuguuaucucacuccacacacaugcucccccccagccccccaccccccgcaauuaaaaaaaaaguauaacaguaaauaaaaucuccuuaaauuguaggucuuggagcagaaggcuuaagguggguucauggaauggacuguaggcuccuguugugugaaagggguuggauuagguugagaccagacuaaaagccuaggacuuggacugucagguuggagaguuuuguaucccuggggcuaaguguggaaguacacauacagaaucccacugcuggggaggcugaggcagggucgcucuaaagcuacccucuauugcccagugaguuugaggccagccuagguugcaaacaaacccaagcauugguguuuguuaaccaagugccuggccugccguaggccuuguggucagucugacuuuaguuccauuuuaccggugagaaaauugaucucaagggagaggagguaaagugggagagcucagacucaagcugagggaagucuaguccccgcuguucccuuaaaugcuuugcuguggggcuacaggagcggaggaaagguguuacacagaggaacuugcauggguaaaggcugaggggccagaaagcucagagacggagagggaaugggaauguuugugugugggcuucugagagggcagaguuagaggccaggcugcaggguguccauacugucuuacagauaccugacuauaguggcuacgacagacucagagacgugagaccaugaaaggcugaggcauaaaccuuuagcuacaacuugacugacagacuggugaguaguggaaugagcuagggaacaccugagacauccuacacuccccuuggguuccuggugugccacuggcuucugcccuucuuucuccaggcacugccuuccccauaauggcagagaugguggcagaggcagcugagauaccaacacaaucaucaggagcaguggaaaucucaacggcugugucaggagagcuggcagagauggcgacagcagugacugagaugaccucuggagaggcccuugccucgucccucuucuuccagcaccaccaguucaugugcucggaguguggcagccucuacaacacccuggaggaaguccucucccaccaggaacaacaccugcucaccaugucagaggaggagacucugaccacccaggaugcaggccuggagccugagcuagugccuagcacuggggaaggacccuuccaguguggugaaugcagccagcucauccucucucccagcgagcuccuugcccaccaggaugcccaccugcaggagucugcaagccagauccaguaccaguguggagacugccaagagcucuucccuucaccugagcuguggguagcucaucgcaaaacucagcaccuuuccagugcagcggacgagccaccgucuccuuugccucccccaacacccccaccaccaccaccaccaccaccaccaccaccaccaccagaagucaagauggaacccuacgagugcccugaguguuccacccucugugccaccccugaggaguucuuggagcaucagggcacccacuuugacucccuggagaaagaagagcacaauggguuagaagaggaggaggaagaugaggaagaaggggaggaggaggaagacgacgaugaugaagagacugaugaggaggaagcauccucagaacucacugcugaugacacgggaagcaacaaguccacggcugacucugcucagaguuguggggauuguccacagcacuguaccucuucaggggcacgccacaaacaccgaagggcaucucacggcccagccucagccacccaugccuuccacugcagccagugucagcgcagcuucagcucagcgaaccggcugguggcucacggccgggcccacguggguggcacccaugaguguaccacuugcucuaaggucuucaagaaggcggccucucuggagcagcaccagcggcugcaccguggggaagcccgcuaucucuguguggacuguggccguggcuuuggcacugagcucacacuuguggcccauagacgggcccauacugccaacccacugcaccgcugucgcuguggcaagaccuucagcaacaugaccaaguuccuguaccaccgacgaacucacacugggaaaagcggaacccccaccaggguagcaacugucuccccagcuccagcugagcccacgcccccaccccugcccccaccugcccagcugcccuguccacaaugccccaaguccuucgccucagccuccaggcuguccaggcaccggcgcgcggugcacggccccccugaacgccgacacagguguggggucugcggcaagggcuucaagaagcucguccaugugcgcaaccaucugcggacacacacgggugagaggcccuuccagugucacuccugcggcaagaccuucgcuucuuuagccaaccucagccgccaccagcugacccacacaggagugcgucccuaccaaugccuggacuguggcaagcgcuuuacacagagcuccaaccugcagcagcaucggcggcuacaccuucggccuguggccuuugcacgugccccucgccuucccaucacgggucucuacaacaagagccccuacuacugugggaccugcggccgcugguuccgcgccauggcaggccuucggcugcaucagaggguccaugcccgagcaaggaguuugacccugcagccucccagaucacccucuccggucccacccccacccccugaaccucagcagacuaucaugugcacagagcuuggggagaccaucgccaucauugagacaucccagccgcuggcacucgaggacacacugcagcuaugccaggcagcacugggggccagugaggcgagcggacuguugcaguuggauacggccuuugucugacacggcgcaagagcaaugagaaaagggguuugcuuaccagcuugugucugggcaccucgggaaaaagaggaccccucuuggcaagcuaaccuggcauccacacgucaggguccacccugcuggccucuccuaacugcugacuccucaggguuccuccuguuaccuuucccugccccagaugaaacugaagcucugacaagugaugggaucugucugagucccuaccaacugcauuacagaaugggguuugccaaggcucuuugcacggcaucacccggugcucagcaacaucagguaaccuuuauugagcaccaauuauaugccaggccugugccagacacucccauauaccucuucagaucuucugcuuaaacccccccccaugccccuccccgagaacuugggauguuugggacuuagcucuaccugguauaggaaggcacuuaguuucaugaggcuuacuucauuucaguuuugacaguaugaaaucuguaggugaccccaguacucagcccagccugggugaccuuaaaaaaccaggaaugaaccagucacagcuccacacucgggcaugcucagcccaguaggggcaacugacugaauacagacagcuacacagacaguugcccuauacagacagugcugccuguggcucauugcgccugugugcccaagccugugugcacaugccaugcauggugcggcaggcuaaaggagaauugggucuaaggaguccugggcugagguggggaugugcagggacaguggaacugagaagagacugagaaguagugccaguuccugaaguaaaaguaggaagcugccagcacaagaggaaaauaaccuuucaggcaggccauccaguuacagcugcagcaucaggcaggacauuucgugucccucaggccugagacggaccuguguaccauccuggcugugcaaguaaggacgcagcacagagaauacccagggucgcagaauggguggaggcacugugagaugagaauguaguucuuaggcccaucucuauugugaguaagacuugaccccucggugaccacagagaacacuugguccaucccugacccagagcagugaugcuugcucacccuguuuccuaacugguuggaauaaaaggaggaugagaucaguccugcagagcagaaagguaccccuggggcugaugucagcaucuagcagggccccaaaucucccuccccucaaggauauguuccaaaauuacuuuuucugcaucaguaauccaucaggaggacccucauuugcucccucccagguccccucucuuucuggaacacccuacccacucauugcuuggcaccauguagagauacuaucuccuucugccuaugguucucaccaucuggcuccagcauauuuuaaaagucaagggaaagagccaggcagaguggcacaagucuguaauugcaguguuugggauccuaaggcaagaugaucuugaguuccaggaaagccugagcuaugcuggaagaccagcucaaaaccagagaga

SEQ ID NO: 3625 - RNA, 49102 nt, Mus musculus
cuuccucuucucgccuccuccuagccuguccuccccucagaggcugcgcggcucccgcccccucgcccucucagcgggucuuccucgggccgcucuggcccgggagucuccaggucucucugaucuagcccauucgccucgagugggaggagcggguggguaggcauuagagugagcccuggagauccgggccgggaccccgaaggcaggccccgcccccgucuggaggggucuccccaggagucuccgggccaggcaaguuccaccccgcacgcuccauggaccgcccagcugggcuguagagcacaucgccccuggaagacugucuauacggucuguuuuggccuugcagcagccugaauguaaucacuggauaccguuuauggagucggcgccccuaugggggcucgugucuauaggggacccuuacggucccuaggggucagcccuauccauaacgacuucauauccagggccuuccaugggucuauagggccggccccucgguuucaagagcgcaucaacugcggcccuuuccuuggcccggacugcguggcugguacauccuuggacuacaaggccaugcuacgucuguaaagguugcaucuugcagggccucauucccagagggucuucuccaggucuucacggcccuucccgucccuuagggccagugccuaaggcggcgauggccuuggguggagcucuggccuuggcccuugcacuggccuuggcagugcugggaccgcugucccucaggguccuggcuggugacugcaaggggcagcggcaggugcuacgggaggcgccaggcuucgugacggauggugcgggcaacuacagcgucaacggcaacugcgaguggcuuaucgagggugaguggggccgcgugggucacucacucgguugcuaguucauucauuugugcguucauucacugagcacauuccuagaacccggcuccauuccaggacucuugcuguaaaauguuggacauccaguguugcagccagcuugggcccuaacucugaugggagggaaugugccaagagucacaguaacaaacuaggaguauuugugagggguguuuuucuucacuugauccugaauguagcgcacagaaaauaucaaucuagcacagcuuucuaccacuccuuuauuuuugcuuacuuguaaguccacucaugccuuuaaucccagcacuuggaaggcagaggcaggcagauuucugaguucgaggccagccuggucucagagugaguuccaggacagccaggccuacacacacaaaaaaaccccugucucgagaaaacaaaaaacaaacaacaacaacaaaaaguaaguccacucaccuggcuuaggaucuaggcucuauuucauaugaguuucgugacuuuggauggaugaauuucgaaggcacaguuucuuuuacuccaaauggccgcaacaauaguacuuaguuaaaaggaaaggagucagauauuuaacacauuugauaucugguauaguauauuagucaggguucucuagggaagcauagcauagaaugaaucuuuauagaaaugagauuagaauggcuuauagucacugugcggugguggcgcauuccuuucaucccagcacuccagaggcagaggcagaggcaggcagaucuccgaguuugaggccagccugaucuacauacugaguuccaagacagccagagaaacccuguuuugacacccccccucccccaaguaaaaagaauggcuuauagacugugguccagcaagucugauaaagacuguuuaccaaaaaaaaauccaguaguaguaguucaguccacauggcuuaugucuuaccuggucuucaguauaugccagaaugcuaaagagagucaguucuaaugcagacaggaauuagaagaugcuucugagcaagccuaugugcuaaaaucuaguaugcuaaaacagauaauagaagaagccaggacuagugccagaggcaggagucggggaggcuugugaguuugaggacagccugggcuaccucaaagugaaggacuggacuccuaguuagagugagagcaagcaggccaagagcaagagcaaacuucauucuuucauguccuuuauacaggcugccagcagaagguguggcccagauuaaugguggagccucucacuucaaaagaucuggauuagaagugggccuucccacuuuaagugguuuaguuaagggaaaaaacaaacaaacaaacaaacaaaaacaaacccuuacaauugugccuagcuauuuagcuuuuaguuaguuccagauauagucaaccuaucacauguagcaaauguccauuaagugcccuuaggguuauuguugcauuuaaauacuucaauaaaacuuagucguucaugugccagaaauuauauaugccaccaugacauagcagaagaccagggaccuccuucccagcagugcuugcgggggagaccgacauacuaacagucacauaccaaaguacuccccugggagagcccagaagaaguacaugaucugggagagaggagagcagagaagauucuggaagagaugucagagcugagaccugagggaucuaugucugucagccaggaagcgagaagcagaacauuuuagaaauaaggaacaaccugugccccuuucuuuuuuuuuuuuuuaaagauuuauuuauuuauuauaugugaguacacuuuagcagucuucagacacaccagaagagggcguuggaucccauuacagaugguugugagccaccaugugguugcugggaauugaacuccaggaccuuuggaagagcagccagugcucuuaaccacugagccaucucuccagcucccugugccccuuucuuaugggcuuucagggauccgugaagcucugggaagacacaacgucucaggagucugauuaauccaaggcacgugggaugcuuuugagcaugcauaugugcuaaaauguaguaugcuaaaacaguuaaaaggagaagccagagucaggaggaggagguuugugaguuugaggccggccugggcuacaaguugaaaaucuuuuuuuauuauuuugccuuuuuuuuuuuuuuuuuccagagcugaggacugaacccagggccuugugcuugcuaggcaagcgcucuaccacugagcuaaauccccaaucccgaaaaucuuuuuaaaauagauuuauuuacuuuuauuuucuguguaugaguguuugccugcauauacaugugugcacuaugugugugccuggugcugacggaggccagaagagggcaucagaucacugguacuggaguuauaguugcuuguaagcagcugugcgggugcugggaauugaaccuuauccucugaaagagcugcaacugcucuuaaccucugacucaucucucucgcuugcagguuuuuuguuugguuuuugcuugcuugccugccuuucuuccuuccuuccuuuguuuucuuucuccuuccuuccuuccuuccuuccuuccuuccuuucuuucuuucuuucuuucuuucuuucuuucuuucuuucuuucuuucuuucuuuccuucuuucuuugaggguuucucuguguagcccuggcuguccuggaccucacucuguagaccaggcuggccucgacucagaaauccacuugccucugccucccgagugcugggacuaaagacgugcgccaccacugcccggcuucuucuuucuuaagacagaaucuuauguuucccagguggcuugaacuggauggauaugcauccucuugccucuaucucccuaauucugggauuauagguguuaacuaccgugcgucaugugguacuugggcuugaacccagggcuucaugcaugcuaauaagcucuuuaccaacugagcuacucccccagcccaagacccugucauuacuaccucuucuccuccuuguaggguguguguguguguguguguguguguguguguguguguacguacaaguaacaacauguaggggucagaggacaaccucuuguaucaguccuuacuucccaccuuguuugaggcagaguuucuuuuuuuuguuguuguuguuguugguuuuuuuguuuguuugguugguuuuuuuugagacaggauuuuuuuuuuuuaagauuuacuuauuuauuauauguaaguacacuguagcugucuucagacacuccagaagggggagucagaucucguuauggaugguuguaagccaccaugugguuggugggauuugaacucaggaccuuuggaagagcagucgggugcucuuacccacugagccauaucaccagccccgaggcagaguuucuuguccacuauugccugccuggcccaggaacaucuguguauucucuuguuucugcucccuauuucaauguaagcugggaucgcugccuugcaccacccuauccagcuuauguagauccaggaggaucugaacuugguucuuuguucccugagcuaucuccuuagccuugaagguuuuguuuuguuuuugacaugucccaacuauagcucaggccaauguguaguugggcaugguggacugucagucuccggggugcacaauguucagggcugaaguagaggcuggaaaugggaguuuuguggcugggccuaggggaaagauagaaaucugcuagaagguucagagggacagccauugaagcacaugugggaguguucugggguauaaaaguggccagcuucuaugaagacucgagggaggcuaauaugucuuaggaucugugucuauguuugucuaguaaguccagacaauagacugggaggugaggagccagagaugccccucgaacgucacauuggcaguuuggccguuucccuggggguuccaguaagcuacggaaugguuguucucuugagccuggguggagggugacaggcuagaggcuuggcaugugggaacagugaauucuaaaguggggcagaggugugagcccugcagggagauguuuguggauuuuccccagugggauggaagcaagcugauuaaugugggguguggcaucugucaccccaggaaccagcaucuuagcuuaaaguguugguccaagcuuguagucuugaguaccugagaggccaaggccaggggguccugacuuagaggacacccugggcuauaguggaccccguuucaaaauuacccugacgucuaaguggcccaggcuggccuugaacucaaaauucuccuaccucagccucccuggugcugagauugcaggagugcgcaccaugccucaguacgcacuucuuauacccugauuguguuuugucuggucucaggcuucccaaccuccuccggaguaagagaaucccccgcuuucuccaggggcaggccaggaggcguggcuuggggucagauuccuuucuggaaugguguaggguugaaaccagaaaccuugagcuuuaggagggaggcaaaucuccagccagcuuccagcgagcaggcuuuuaccuuuguuuuaagugcuugaucagaacaggguguuuggugaaggcuggugagauucuggaagaucuggauccugguucugcuggauggcucuuguguaaucuccaaacugaggguuggggucuguaugguauaucccuggguucuggucaguggacucaaaggcaaaguagucagcucuuccucccccuccuccucugccucccucccccuccuccucuuccuuucccuccucccccucccccuccuccucucccucccccuccucccccuccucccccccuucuuccuccucccccucccccucccccuccuccucucccucccucccccuucuucuuccucccccuccucccccuccucccccuccuccuccucuucuuccucccccuccuccuccucuuugguuuuguucuuuuguuuuuugagagaggaucucacauagcccaggcuggucuggaacauaccaaagaugacucuucugauuguuuucuaaauguugggauuauaggggugccucacuaugccuggcuuuguggugucaauuuauuuauuuauuuauuuauuuauuuauuuauagacuuauuuuaugugugugaauguuuugccugagaaugugugugccuggugccugaggucagaaaagggugucagaucucugaagcugauggcuaugagcuccugugugaguccugggaauugaacuugggucaucugcaggagcaacauguuuucuaagcuggugagacaucucucuaggccagaccuuuaaaaaaaaauucuuauauuuuuugagauuauaguauaauuauaucauuucccuguuuccuucccuccuuccauauaccccuucuugcuuucuuccaaauuuaugguccccuuuaaaauuuaauuguugucauauauauauauauauauauauauauauauaaaaaucuaauugcucaauacuacuugcuuagucuguaugauaugugguuucugguuuugcuuaugaggcaagcucuugcuauguugcccaggauggccuugaacagccuuacugguccugccacaccugugacauaauuacaugugucaccaugcuuuugcgugucucuucauucugucauccagccacugcuugguucuugcuuaaccccaggccuugugccaaggcaguguuugagaagacauuaugcccagguccugaguccugugagccuccuccuggcacagagauucaguuaugcugggaugugcgaaucccaaagagaggcucuuaacucaguccugaaccaucaggguaggcuuccuggaggaggccuccaaauauaaagcagcuugugcagaggccuggcuccccacagagccagguuccaggcaugacccacuaguccacugcucuaauggcagaaugagagaugagaucaaguuccaaacaccagggcagggggcuagcuuuucuccuaggcugagagagccaagaaggacuuuuagcgaaggaauaccagugccagguguaggauuggccugaagcacuagagagcauguuagggcaagaccucagguuagguguggagggagucugugucagugguccuggaagaaggacagucacagggacaauggcugggcaaggcuuaguauugagcauccuggcucugggcuagcaaauuauagucacauuguugaccacuuacaccagccucgguggguaaggagaugauucucacuuauagacaaggaagcuaaggcucacgagacucacaaaaccaaggcaggauagguagauaagaaagaaaagaaucgggggcuggagagauggcucagugguuaagaacgcugacuguuccuccagagguccugaguucaauucccagcaaccacauggaggcucacaaccaucuguaaugggaucugacgcccucuucuggugugucugaagauagcaauaauguagucuuauacauaaaauaaauaaauaaauaaauaaauaaaucuuaaaaaaaaagaaggaagaaagaaagaaagagaacuugagaaaagagagcacaccccccgcccugguucuguguuguuuuugagauaucuggucaugcagcucggcaggccuggaccuucgauucucuuaccucagacuccagagugcagggauagacuaaggacaacccuaacggcgagaucccccugccugcaccuccucaguacuggcgcugccggcaugggcagcuaagccuggcuuuguguggcugggagcccagggcuuugugcacacuaggcaacucuagcaacugagucauaucuccagcuccccagccuuagcuccucuaagggcgggugcuugccagccuguugguccuucuucaugcuguuccugguagagugccccugugcaugacaggcaggcguucuaccacgacgcugcauucgaggcccuuuaaaaaucucacagugcuccagaggcagaggcaggaggaucucugagaguucauggccagccuggucuacagagugaguuccaggacagcuagggcuacacagagaaacccugucucuaaaaacaaaaaaaaguaaccaaaaagaauuuuuuuuucugaugucauugacuuccccagggugccuagccuggccuugaacaugcacugauucuccugccuucucuuccucagaacugaauuagaggugugaucaaccaugcuugaccauuauccuacuucugauuucuaccuuuugcugcuugauuccuagaaacuucaauucaaaugaccagaccuacaacacacacacacacacacacacacacacacacacacacagagaaaucaaccuuccacaauaaaaaaugauucaggggggcuggagagauggcucaguggcaauagaugcucuuucagagaccaugaguucaauucccagcaaucauauuguggcuuacaauccucuguaaugggagcccuuuucuggugugcacucauaagugaauaaaaaaaaguuuuauauauauauaaaauuuaguuucaaauuacauacagaucuguuaguucauuucauuauuaaugcccaggugggaaucagucuuucuccucucucucucagaagagaugaaacccaggacuuugggcaugcuagccaaucacuuuacaacugagucaugcccuagcccuucacugggggauucuaggcaggggcucuaccacugagccacgcccccagccccucacugggggauucuaggcaggggcucuaccacugagccacgcccccagccccucacugggggauucuaggcagggcucuaccacugggccacgcccccagccccucacugggagguucuaggcagcggcuccaccacugagccacgcccucagcccuggccuaaagaucuagcucauuuaauaccaguuguucuggaggcagaggcaggcggaucucugaguuugaggccagucuggucuacagagugaguucuaggacagccaggaauacaaagcaagacccugacuugaaaaccaaaagagaaaaaaaaagaaaaaaaagaaaaaaaaaagaaaacgcuuuuggcugaguuccaucacagucuuguuagguagcagucucauuuguagaucagugucuuauagcugggacgauugagccugagagggcagguggcuuacccucuagguaguaguaguucaggagcagagcugagacugaugacguaguuuucuuguguuucuguaguagcaaaguaagugggaacaguagagucugugcgggaacagggacccacagugcuccagucccccccccccccccccagugcuacaggguaacuucuuuguccauagggaggagccaagguucucccugccugguuccugggcugcucucaccuugugcugagugcuguguggguuuugugaguuuuuacaaguugacaguggauguucagcccaauagcagagcagaggcuacgaguugacuccccugaccaggagcucccucacagcacccagaacaagguguggugguuuuuuugggugggcuccggggauccucagagaagaugagaacaugugagaaccuggccccugugcucacuucccagccccgagcccucagcaccggauccugcuggacuuccuuuuccuggacacggagugcacuuaugacuaccucuuuguguaugacggugacucgccccaaggcccucugcuugcuagucugagugggagcacccggcccccacccauugaggcuuccucaggcaagguuaguggugaugggguaugggaccauggucucuugggagugaggggguccuaggagcacaagccuaggaagaaaugaaaaagauuggaagggacggaaaaggccagaaaagccagucagagggugucagagaagacaguggaagguggagaggcagagugcugggucuggcggcuaauaccuguaaucccugcucuuaggauccuguaaggguugauuugaaaccagccugggccccauacugaaacccugucccaagcagcaacaacaaccagauaguuccacaaacacacagaaaacagacaaccgaaggcagggcggggcuggggaaugccccuccguuggcagagugucugccuaguguucacaaaccccuggguucaaucaccagcauccuauaaaacaaggguggugguacacacauaaugccaguacuggggaaguagaggcaggaggaugggcuugaggccagccugggcuaaaugagaucuuuuuuaaaaagauuuaugaguggucuaucugcauguacacccgugugccagaagauggcaucagauccaauuauaaaugguaaggagcuaccaugugggugcugggaauugaauucaauaucucuggaagagcagccagugcucuuaacugcugggccaucucuccagccuccauggcaucuugcuucuucuuuuuuuuuuuuuuuuuuuuugguuuuucaagacaggguuucucugugcagcccugacuguccuggaacucacuuuguagaccaggcuggccuugaacccagaaauccgccugccucuccucacaagugcugggauuaaaggcauaugccaccuaaacaacaaaaggagacagaggaaggcaguggguuguccagggguggugcacuguccagaugcagccagaugcagccucuuguccuguagaugcuccuccaccucuucagcgaugccaacuacaaccugcugggcuuuaacgccuccuuccgcuucucccugugucccggaggcugccagaaccaugggcagugcaaguccccgggagugugcguuugcgagccgggcuggggagguccagacugcggccugcaggagugcucagccuacuguggcagccauggcaccugcgccucggugagcugucucccacugagggucccugggauccugaucugugaccauaccugccacaucugacuuaaacagggccuuguuccauccugacccuccccucccugcagcugugggagccaguccccuccccuuccaggucccccaccccaaugccugugacuucaucccaaccccaccuccaccugcuccugucccuuugggaccucacuuauagcucuguccucaugucuagccaaccuuccccuagggguaauggcuccuguccucuuucaggcugagguccuacuccugccuggcuaucuguuuggccgucccugccacggugguuuuugagacagggucucauuuuguaaccaugguggccuccugagugcugggguuacugacaugugucaccacaccuggcucccugccaugaccucuguccuuccaccccugaccuaauaccucagcucugcaccccuaacuugggaucuguauuauguuuggaauccccuuugccucagucuccccaguuggagcucauccagcccagguggaacaugagccucucuucugucugucuugccuucucugugggucugucugcucugccccaccucuuucucccuuggguuguaccuuugugucuccuguuccucucccuuguccucaugcuugucccuuguuuucucucuguuuccuugaacauucccuuccugucuuucuuuuucuacccugucugucuuggcucuguuucuuucugaauguucuacgacccauaucucugccuuuuucucucucugcacuuuuguccccuuccucccagacccugggaccaugccgcugugaaccuggauucuugggacgagccugugaccugcacuugugggagaaccagggggcugguugguggcacagugugagugccggggacccugccuucucugcccgaauuggggcagcuggugccuuucuguccccaccagggcugcuggcugucuuuggagguaagcagauggggagagggugagcuuggagggucuggaggcgugucagccugcagccaggguuugagcgcucaccucaucugcaggccaggaccuuaacaaggcccugggugaccuuguccuguauaacuucuccacgaacaccugggaguccugggaccugacgccugcuccgguauggacccuccucugcucuggcugcgguccugcccacucacgacccccaacacccugacacccccagacuggauaagugcaucuggacaccugcuucucccugucucugugcucauucugagauucuucuucuugcccacacucccaucuuuccuucucuuguccuucucucuccccacuugucccuucuucuugucccuucuucucuuuccuucccuccccuucuccagacucccucccucccucccucccucccucccucccucccucccucccuuccauuuuuuuuaucagacagggucucaagacagcccaggguggcuuugagcuccugauuucccugcuucuucugugcugucuuguagacauguccuaccauacccaguuuguaugucuccucuuuucuuugacugauagcuuggccuccaucccuccgguuguuucucuuguucccuuccauuucugucuuccugucccucacucucucacuguguuucucugugucacugucucuguuuuuauucucaugucucacgucuguccgucuguccauccuuccuuccuuccuuccuuccuuccuuccuuccuuccuuuuuucuuuuauuuugaguuaggacuuaggcuaauauggaucuuagucuauagccuaggcuggcuugaacucauggcagucuuccugccucccaaguguugagauuagaauggcacauaccaccagaccuggcuuucugucuguuuguucuuuauuuccuccuuuuuuuuuuuuuuuuuugucugcuugaagcagggucucacauagcuuaaucugaucucaaguucacuacauggcccaggcuggccuugaacuccugauccuccugccucugucucuucuucucaaguccuggaacuccagguccacacguccccaggcuugucuucuauucccucucugcauaucugcuuuucugacuuuguaucucucugcucugguccuuuccagugugucacuaucuuucuccuugucucuuccccacaggcugcccgucauucucauguggccguggccugggcuggcuugcuggugcugauggguggugagcuggccaauggcuugcuaaccaaugaugugugggccuuuagcccccuggguggaggccacugggagcuccuggcaccaccugcuuccaguucuucugggcccccggggcuggcaggccaugcagcugcucugguggaugacaucuggcuuuauguguccgguggccgcacucagcaugaccucuuuucuucuggccucuuccgguuccgccuggaccacaccagcaggggcuauugggagcaggugaucccggcaggugggcggcccccugcugccacugggcacucuaugguguuccaugccccaucucguacucugcugguccaugguggacaccggccuuccacugcccggugaguaacacguccuguacuccuguuccuuggccacagcagcccuagaagucuuugcucauugacagacuccugguuucaggugguuaccucugccauggaccauuuguuuaucuaagucuucacuuugucuaauauuuaucuauucccucacccgaggagccuagcgcucucugaucccuuacuggggcucugacuagucacuucccccacacuuccaccguccuccagcucuugccagauuaugcaagaugccagacccugcucagaccugguuccugcccacagugaaugucuagucaggaugggauauagacauggucauggccggucucaauccugggugaagcuaggggagagaaggaaggcccuccucgcccugggccccuggccugucucuucccuguagguuuucugugcgggugaauuccacugagcucuuccacguggaacggcguguguggaccacgcugaagggccgggaugggcuccaggguccacgggagagagccuuccacacugccaguguucuaggaaacuacaugguggucuauggugaggugauuucccuagauccugucugaauuccaggggccugagcccacccugagcugaaacugagccuggacaacccuaccucccccaaggcuugccugagcccacccagagaugagacucagccugggucuccucccucuccugaggcuugccagcggugcccuuuccucuuuucccagggggcaaugugcauacgcauuaccaggaggaaaaguguuacgaagauggcaucuucuucuaccaccuuggcugccaccagugggugucaggggcugagcuugccccgccaggaaccccugagggugagucuccucuguuuuccugagggcuuuugaagaucucugaguuuuagcaggagaugccucagucauuaccuuggugggccaggcauccuguuggaaugaccucuggagacaagccucggugaggacaaggugggggaccagcaagcagauguagggcacugaacauggguuuuacuuuuuauuuuuaaaugcacaugugugugaaugugugugugcgugugugcaugugugcagcgugcacaugugggagccagaggacaaccucagguauuagccucaggaauacuguccacccucucugagucagggccucucaccagcuaggcuagucuggcuggccagugaacccaacgcuuccccuggccccacgucuccagugcugggauugccuggcauuccucugacagugcuagguauggaacuccagcccuaaugcugugagguaagcacuuuaucaacagagccaccuuugcagccccagaaccuugguucuguuggaagcuugccaguuugcagcugcccuaagaagcagugacuucauggcauagugacaagagguagaaccaagggcuggagagauggcucugugguuaagagcacgggcugcucuuccagagguccugaguucaauucccagcaaccaccugguggcucacaaccaucugaaauggagagucuccuccuuuggccucugcaugcguacacguggcuguauacagcauauaccauacaccacacacauacaauaguaaaguaaaugagaaaagacugcaauuuuuuugacaggcaugguauacacacuauguucccaagacuauaagcagaagcaggauauagagucugcaucuagacaggacuauaugcaaugacucugucucaaagcccaacaaaagggcaggagcauggcuuaguggucaagcccuugcuuauaaucuaccagagaggggcugggggcguggcucacugguggcacuugccuggcauguguaaggccuuggacuagaucuuuagcauugcaaaaauacaugcguacauacacauguacaaauuuccaauuucuugggcuaagacccaugugcuuacaaaguauaggggucaguaggaagucagagaagccaugauucacuuuuuauaaccagaaagggggguuucuugguuugcuuuuagugaaaguaccaggcuggguuggaucuaaguacuugguauggacagccuuggcuacuucuuuccccaguucccaucugggccccuccuacuuguuugucacuuucuguuugucuuauuuugugugugccugugcauguaggcccaagccagagugugugugccugugcacaugggcccaagccagagugugugugucugugcacauggguacaagccagaguaugugugucugugcacauggguacaagccagaguaugugugucugugcacauggguacaagccagaguaugugugucugugcacauggguacaagccagagugugugugugccugugcucaugggccaaagccagugugugugcugucugugcacauggguacaagccagaguaugugugccugugcacauggguacaagccagaguaugugugucugugcacauggguacaagccagagugugugugugccugugcacaugggcccaagccagagugugugugugugccugugcacauggguacaagccagagugugugugugccugugcacaugggcccaagccagagugugugugugccugugcacaggggcccaagccagagugugugugccugugcacauggacccaagccagagagugugugucugugcacaugggcccaagccagagugugugugccugugcacauggacccaagccagagagugugugccugugcacaugggcccaagccagagugugugugugccugugcacauggacccaagccagagagugugugucugugcacauggacccaagccagagagugugugucugugcacauggguacaagccagagaguguggagagcccaacaaccugcaggagucaguucucuccuucuaccauguggauuccagggauugaccuugggcugucagacuugguggcaggugcuuuuguaugacggaccagcucgcuggccuauugcuuaccuuuuauagaugucaccaacuacuguugaaucguaucuacucacuucacauucucagagggccugaauuugagaccagccugugguuauagauugagguccucucucucgcuccuuuccccucuccuuagcccccuuccucccuccccucccaccucucucugggaugguucaguuuaaagcaaagaaaccaagacuuggcaaaguugagucuccugcccaaaaccauacagcagcucauaacugauauaugauuugaaucugugucugucacaaagaucauuuugagcaggggcacugggccucugagagaauugagaaaauaacgcaagcgcagagccaggcaggccaguaggauuuccuuggcuagguaggagcuaaagcagcaauaagccggcuagacuggggcaagggcaggagccaggagggcaggagcuggggaaugucugaugcugugacugucuucuaggucgagcggcgccuccuaguggccguuacucacauguggcagcuguucuugguggcaguguccugcugguggcugggggauauaguggccggccucguggggacuugauggccuacaaggugccccccuucguguuucaggcaccugcccuagaugugagcauuggggugauggggagggagugacuguggguggaggcagcagucucugcaaaugaggggugcuuggagagaagugggcagaguacgagguucuccaggccugagggaggaguggggugggguuaacuggagcagucauggggagccagccuuggcagauacuccaggucuugagagcaguguccucuccuguguuccgugucucugcaguaccaccuggacuauuguuccauguacacagaccacagugucugcucccgagacccggaaugcagcuggugucagggcgcuugccaagcugcgcccccuccugggacucccucaggagcugugaguggcuaccccaggccauucauccauccacuagcacagagaccugccuuuaacucccccugccuaaguggucagcuacccaagauccucauuccugccuccugacuguccccaacccagagccuguaccucuccuagcacccgaguuuaggacccugucccugcauccccgaacccuuguucuugaguuccuguagaccaacccugcuguuuccugauggccacuaggcugccucuccccagaccguguagccacagcucuuguuggaucuccugaggcucagaggacaguguauauugucucuuccuuacaguguccagcggccagcugccugggccuaggccgccugcuaagugacugccaagcaugccuggccuucagcagccccacagcuccuccccggggaccuggcgcccuagguuggugugugcacaaugagagcugccuuccucggccuggugagugucgagcagccaugggggaggggcucagaauaccucauacugacccuccagucucccauaccccuguccucucagagcaggcccgcugccgaggggagcagaucucaggcaccgugggcuggugggggccagcacccgucuucgucacuucccuggaggcuugugucacccagagcuuccucccuggccugcaccugcucaccuuccagcagccacccaacgccucucagccugacaaggugggggccagauggaccuggggauggaguggacacuuagagaccuaggguugcuucuuuucaaaugagucuuucuuggggacaguacugggauggaacccggggcuuuugugcauguuuguucucccugccccgaagccgagccgcacccuagcccucacugggagucuucaggcacgcucaacugcugaguuuucuaacaggguucuuuuacuuacuuugagacagaggucuccuaagguugcccaugcuugucuagaacccagucuauucgaaacagaccucacaguuaucuuucucccuggccuccccguguaggcaaaaugguaaucccaugccaugaggcccuacaaaagaauuuuuuuaaaaucuuggugaaauaacacauaaaaucaaaagguuguagaacaagcugggcauaguggcacacaccuuuaaucacaacccuuggcagucagaggcagguggaucucugugaguuugaggccagccuggucuacacaguggguuccaagacacccagagcuauauagacaaaccuuuucucaaaacaaaacaaaguaggacaauauuuuugccauuucuaaaucaagucuagauuuauuuaccaauugcccccaucuuccucuucccugaacuuggccacggauuuugcagcugugggcauuugauggcgucaggacaucugccuacgauguccagcuucuuugacuuaguacagugucuucagggcuucuucgugcugugcauuuggaaauagacuucaagcuggaugugguagaacaccucugugaucccagcgcucgggacgcuagggcaggagaggagacucuugaaauccaaguuacccuguaccagagugagacuccgucucagaaacaaaacaaaaaguccaaagagcuucauugcaccacgguggagaaggcauggcggcuggaguguaaggcagccaggaagcagagaggugaauccuggugcucagcuugcuuuccuggcuuuaugcugguaccacucacauuuccaccucggcucacucagucgagugauucccucacauaccugcucauacguaucuugucagguggacagucaaguucaugggcacaguaaacuuggcaacccuccugccuccuccucccccuggccccuucaguacugguauugacggcauguguaccaugccuagucuacucuuucuccauauauccaagcaugcuucugggugacagaauguaggaagcgcuuuugcugguauuguuuuugagacuggugcugauagccuaggcucaagugauccucucuugucugccuccuggguaacugauacugugccccucuugucucucugaaacaaauuuucucagagucgaggcaggccucgaacuugcuaugcagccgagacuggcccuaaauuccugaugugccucuuuucuuuucuuuucuuuucuuuucuuuucuuuucuuuucuuuucuuuccuuuccuuuccuuuccuuuccuuuccuuuccuuuccuuuccuuuccuuuccuuuccuuuccuuuccuuuuccuuccuuccuuccuuccuuccuuccuuccuuucuuucuuucuuucuuucuuucuuucuuucuuucuuucuuucuuucuuucuuucuuucuuucuuucuuuuucgagacaggguuucucuguguagcccuggcuguccuggaacucacucuguagaccaggcuggccucgaacucagaaauccaccugccucugccucccaagugcugggauuaaaggcgugugccaccacgcccggcugacgugucuuuuucuaucuccugaguuacaagccucugcgccuguaccauccugcccuucuuauuuugaacaguuauauaacacuucauuuacgcuuaaauguuauacugcugcgcauuuauuuagauacuuauuuuuggagauaagguuuggcaguguagcccaggcuggccucaacccuugcauaaacuucccaaguguuagguucuuauuuugaaacagggucucccaagggucagcaaaucucggucccguaaguuacacaaauaguguccagugaggaauccucaggcuggucuguuuguuacuccagagucacacucuggcaagcaagucagucuugugcuguguggucauugggaaucaugguccuagcuuuggaagggcaugcugggaaagaagggagcugcggacaaagaugccaaaggcuccagucuucaagcuugaaagacauuaagacguuguugguugcuuuuuuuuuuuuuuuuuguaguccuaccuguccuggaacuccucuuauagauagaccaggcuggccucgaacucacagcuaacugccuccuucucacaugccaguguuaagggagugugcuaccauaccuggcuaguuuugaagcauuuacauguauuauuacuguguguguacguguaggucagaggacagcacuguggaacugacugacuucuucugguuguggaggcucugggucugcacucaggucuccaggcccacguggcaagcuccuuugccccugaggcaucuugcuggccccucgguccuuugaguuuuaccugaagaugagguuggguugggcccaagguagaaccuguuuauauucucugaauuuggucccuagagggaagaugggcaaguugacuuaauucagucccaucucaacgucucagucggugaaggugguuuggccgucuugucucuugugguucugacgugaccugagggguguguacuuagggacaguccauccacaagcagagagggacuuaacauacaucccaccucugggugguacaggucuccauuguccgaaguacaacuaucaccuugacacccagcccggagacagaugugucccuagucuaccgaggcuucauccacccccugcugccaggaggaccaggcggcccuggggcugaagauguggcugugugggcucgggcccagcgucuccauguccuggcccggauggccagaggcccugacacugagaacauggugagggauucuagaacauucuggggugauuuuugguaaauaugggagugaguguaauucagggcaucuguggugacuucaggguucugggggacaguggggagcauucagacauggggccuauccuuaaaggaagaaggggcugugggguuucagcuaugagcagacgugggaggaauuguggguagggugaaaaagguuugagugacaagugcgauuucccugaggagaggggucauggggaggggaggcagcuucccaaagucuaggaacccuugaggcccucuuccuccugggaggaacugggguucuuggagggauugggagaccaaagaaggaaaguagagaguuccgaggucuucuauguugcucacugcacugcaggaggaggugggacgcuggguggcucagcaggagaaggagacacggcgucugcagcgcccuggcucugaucgccucuucccauugccggggagaggcaacaaguacgcgguggagauccgaggccagcucaacggcucggcaggcccugggcauagugagcucacccuccugugggaucggacuggagugccggguggcagugugagugucuagccuccaacucuguuccuaggcuuuggccucagauccucucagcuucccaaguuccaagcacaacaaaauuuuaagucacuugauucugacuucagccuuggaccucacuuuuaacccaccaaacucuuaacauuugacaccaggcccugauaagauuuccauauucuuuucuggaacaugcuaggaugggccuugcgcguucuagaaagugcucuaucccugagcuaugcccccagccccucaccgguagcuauuaggaaagggcuccaucucugagccaugccccccagccccucacugggggauucuaggcaggggcucuaccacugagccacgcccccagccccucacugggggauucuaggcaggggcucuaccacugagccacgcccccagccccucauugggggauucuaggcaggggcucuaccacugagccacgcccccagccccucacugggggauucuaggcaggggcucuaccacugagccacgcccccagccccucacugggggauucuaggcaggggcucuaccacugagccacgcccccagcuccucacugaaggauucuaagcaggggcuuuacccccaaguuccuuccccuucaaccucucacuuguugauccuagacaagugcuuuaccccugagcuauaccuaaucccuacccauauucugucucuguccauaucugacuucucuucccuuagcucuugucuugcacacuuugaccucuagucucuagaguccuucagacuguggccccuucccucugcugauuuccugaauccccguuguagcugucaugcuaucuccaaaccuuuaacugcaguccucaucuccaauggacucugccccaagaccuaacuccuguccuacgugccugcccuaggagaucuccuucuucuuccuggagcccuaccgcucuucggccugcaccuccuacuccuccugucugggcugccuggcugaucagggcuguggcuggugccucaacagugccaccugucaccugcgucaaggcagggcccacugugaggaugaugggagcggcgagucccugcuggugcuggugccugcccucuguccacucugugaggagcaucgugacugucaugccugcacccaggugccugcuggagggagucggguauuuuguaaaggagacagacugucaggccugcuagcucccgcuggugccaccccucuuccucugcucgaugcuuguuucuggucagaguuuguuccugugaccugcaggggagccacaggccccagaucugccaucauucagcccaaguucuuuccgaugcucagucuugcaacauagccuggacuggccucccaagugcugggacacugcuauguggccugaggucgggcuuccagcuggguuuuguguaggcuccugaucuggugccugaggcugggagaguaaaugccuauuugcacaucucuggauccaaaggauuuuaaaucuacccgccucucacuccugacagaagcuagguagacagacaguggcugugucugaaggugggcugcagagugucaugcccugggaggaggugguggcaagaaggcuggaggcaggagggagaggcagcuggguuugggcugaguucugaccuugcccuucaccccaggaccccuucugugaguggcaucagagcaccaaccgcaaaggagaugcagcgugcagccggcgaggccggggccgaggcgcucugaagaacccagaggaaugccccccacucugcagccagugaguccggcuagguccaggcuggggugggugugcaugggggugggcuggagugaccuggcccugcucucacccccagacggcugaccugugaggacugccuggccaacuccagccagugugccuggugccagucuacucacaccugcuuccuguuugcugccuaccuggcccgguacccacaugggggcugccguggcugggaugacagguauacuccagugcagggugccaauaugggguuccuggcuagggggugcccugggcgcugaccccagcacuuaucacucugcagugugcacucagagccacggugcaggagcugcgguggcuuuuugacuugucaugagugucugcagagccacgagugugguugguguggcaacgaagacaaccccacucugggacggugaggacuugacugguugcaugggccuccuggcucucccucuuucucugccccaaugcccuguccuugaucugugacugccuucugcuccucacugccaucuccugucagcccucuaccuucccugucucuguuuucuucugccgguccccaucucugucacugucccccuggcugucucucguuucucuauugugagauauacuuugaucucuuccuacacaggugccuacaaggggacuucucuggaccccuggguggggggaacugcucccucugggugggagagggccugggccugccuguggcucucccugcccgcugggcuuaugcccgcuguccagauguggaugaaugucgccugggccuggcgaggugucacccacgggcaaccugccugaacacgccucucagcuaugagugucauugccagcguggcuaccagggcgauggcaucacacacuguaaccgcacgugagugacauguggguuuccauggaaacgcugucucagggcuggaacuuaagcucgaggucucuggugaucacgguagugggcucucacuagaaccaguauccccaguuagugugggguucucaccucgaagacaaggaccucaguggaagaacagggugcccaagguaacccuaguaaccauagaaacaggauacgccuggauggugggccauagccuucagaauugcuguggagauagauggaagaggaccuaguuagaaggguguuuucacagugaugcuaugugguuucuauggagacagggaucaccaccugugagaguguugccuuggaaacacguuuacuugcaugcacagggccauugaaagaggcagccaguugugagaguguuguaguggguggagacgcuggggugcucugaagacucuggguccacccagcccucuccuccccugccuccacauggucccucaggugccuggaagacuguggccacgguguguguagcgguccuccggacuucacuugugugugugaccugggcuggaccucagaccugcccccacccacgccugccccaggacccccugccccucguugcucucgggacuguggcugcagcuuucauagccacugccgcaggcggggaccuggcuacugugacgagugccaggguaagcuacgugcucugaggcgcggugccagccuuguggggacccccuuccuuuuccaggacucuagguucuuccucucugagacuccccucagguagugcugugaccccaugcuccagccccugcuccuguccagucucuguaucuugaccucccuccccucuguuggggcuugcucucucuuuccuggccuagggcuuguuugacucuuugaagcagcuugggagggggucugcgaucaacugagucagguggucugggccccuuucuguccuugcuccugacuuuguguccugcccgcugggaccuccacagacuggacguggggggaacacugugaacggugccggccuggcagcuuuggcaaugcaaccggcucugguggcugccgacccugccaguguaacgggcauggggacccacgucguggccacugugacaaccucacugggcucugcuucugccaggaccacacugagggugcccacugucagauuugcucuccaggauacuauggggacccccgguaaguaaagaacauguggggcuugucagagaggugcuaaggacccccugggcuaagacagaggggucugacacugucuuucauuucuuuccguagagcugguggcuccugcuuccgggagugugggggucgugcgcuccucaccaauguguccucgguggcucugggcucccgccgcuuugggggacuucugccuccaggugguggggcagcaagagcugggcccgggcuguccuacugcguguggguugucucugccacagaagcgcugcagcccugugucccuggcacccucugccccccgcucacccucaccuucucuccagacagcagcacgccuugcacagugagcacccgggggccuaggacucaguguauaagccggaacaucuccccuucccaaccuggacccccccaaauagaucccacccccaccccccaugccacugguuuguguguuuguuucuaaaaccauuggucaggucauccagcccuuuguucugggcucucagauccucccauuucucagcuccugccucucauucuucugcuccucuucccugaccaggcacggucgcuucuuagaccucgugugcacacugauucauuaguagugggcuccacuaccaaagugugcauuuagaaagagguuuggugccagagugccuggguuuuguugguuuuuuuuuuguuguuauuguuguuguuuugguuuuuuuucaagauuuauuuauuuauuauauguaaguacacuguagcugucuucagacacuccagaagaagagggugucagaucuuauuacggaugguugugagccaccaugugguugcugggauuugaacucaggaccuccagaagaacaguuagugcucuuacccgcugagccaucucagcagcccugagugccugguuuauuagcuguguuugcuuuggaugcaggcugggaggggaagucuccuccacacugugaacuuaaugauguacacuguguucaaauagcccaccuuagacucaggcugccuucucuccccccgcccccaaucccugggugugucugucugucucugucuuucucuuucggauagucuccuaccuacuguguagccuagacucacagugaauucaugguccugccucaccgucccaugcaguucugagggacauuuccccacacucuguucucucccuuugaagcccugguuucccaggcucccgaacucuuaacucuguauccuuuucagcugagcuacguccuggccuuugauggauucccacgcuuccuggacacugguguuguucagucagaccggagccucauagcugccuucugcggccagcggcgugacagaccucucacugugcaggcuuuaucaggugugggagcuugagggagcgaggcugguuagucuugggcuucucuucauccuucgguguuagggguagaauccaguaccggcucccuuaggugcugggcacauucucuccugcucacccacacugcuagcccucacugguagaucagacaagcaugcucccucaagcuacauuccagaccuugcucugagcuuuuucaaacuuaaaaaaguuauuuugaaaacugggcuuugucucccauucauugaugggaucuaggacccagguucuagcucagggaaugguaggggauucaggugacaccaugcuuuuccugggugacagggcuucucuccaucucuggacuugaguugagagaaacaagauuugggcuguguagguguaggcugguuuuggagaaagggauggguagagcauaucucugaggcacuagagugggggacccugagccauuuccaugucuuuacauuucucaaccacggagcuuuguggggaccuuuggcaaugucuagagacauuuugaaugacaauuagagauuccucugucaucuggcaggugaacacagagauggggcuauccauaguauacacaggaguuuucacaccagaguuguccaccccucagcauacaccuggcuaagagagugggacacuuaggagaugggggcguggcauggaauaccaaggaagagcuggcuacgugcacugcuuuaagcaaguuuuuggaaaugcuucucuacacgugacucagagcaguucugaggccagaggcaaaguguuuugcuguagcuguguaaaagcccagguugugaggcagccacuaaagcugaggggcucacagacucagccauggguacagcaaugagccagggauacaugugcugcccucaugggcugggggagagggacagacugccucuuuuacugaggcaauggaaaggagugggccccaaccuugucucgggagcugcagaugggcaagucuucuuuaaggaggggaaucuuggcuagaaacagaagguaggggacagagagggcagcuccuccaggcacaggaguagcagguaccaggcccugagagcaggcuacaagggccagcacugcgguguacagaugacaaaagugggagaucuugaguucagaggagucuauagugccuauggguaccagauagggacauuguuuuuauuugaaagaaggucucgugaagcccaggauuccccuaaacucaugcaauccuauuuccucagucucccuagugauggaauuauuagaggggugagccacaguguccggucuguccacccucuuucccucuguuccuuccuuuuugagccagguucuccuggcccaggccagccuugaacaguguaguugaagaugaccuugaaaucucgauccuugugcuugcggcuccccaguguugggauaguaaguuugauguaguguuggggaccgaacccauggcuuuguccauacuaggcaagcacucuaccgauugaacuauauauacccuagcaacuggcucugucuuuucuuugccccaaauguccuugaacuccugacccugucuccuucccuccugagggcuagcaucacagguguguuccagccaccacagcacucucccucaggaacacugcucuuacacaggaguguguggagcugcgaaaggucugcaguugcccacagcgggggucagaguggcuacugacaagaucacaagggcugcuggagggcagaauguagggcagccaggagacagugggaggggagggagugcuggugucuaagaugagacuccgcuuugcaugguaguuugaaagcuagggagcggugggcaagcagagcagugagugggcaagcagaggggucuagacuguaauguuuauauccccaaggaugccaggggcugaacccauggccuggccugugguaggcacauagucuaccauagaucuagagcccuagccuaacuaagauuuaauuagaaaauggcuggaauuuuagagccagcuguggcagcacacuccuguaauccuagcacuugggaggaagagggaggauaggaggucaaggucauccucaguuaucuagugaguucaagggcagccugggcuacuuugucuaaaacaaaacaaaacaaccuccccacucaaaacuaaaauguguggaaccugauggguuggucggguaaggggaggguaugcugugaguggcugguuuucguggguuuucuccacaaguguaggagcagcgcccagaguagggcucugcccaccucucuaccuuucuccacaggguuacuuguguugcacugggaagccaacggcuccuccuccuggggauucaaugcuucugugggcucugcccgguguggaucaggagguccuggcaguugcccugucccucaggaaugugugccccaggauggggcugcaggugcuggccucugccgcuguccucagggcugggcuggcccucacugccgcauggcucuguguccugagaauugcaacgcccacaccggggcagggauuuguaaccagguacaggugggacaggagcugccggguaggguagggaugguguucaggcuccucugagcugccuucugauguccucagagccuaggugugugcaucugugcugagggcuuuggcggcccagacugugccacgaagcuggaugguggacaguuggucugggaaacgcucauggacagccgccucucagcugugagugugggaacagcuuugucuguccugugggccaucuuccaccucuauucuuggaacuacuguaaaacuuucuaccuagaccuggcacucggucacgaccuuggccugaccucugacccccucauuuccacucuaggauacugcuagucgcuuccuucaccgccugggacauacuaugguagaggggccugaugccacuuuguggauguuugggggccugggucugccacagggccugcugggaaaccuguacagguaaggacuacuauaaaaaaacaauucauuuuaccucuuugauuugagugauggcucugagacuauuaccagcuuguaacuuauuuaauccuuucaaacuagucugugucuucaugugguuacuuaccucucuuucauucccgaccugcuucucccccagggucucucucagcaucucucccugaaucuccuuucauucuguuucccagaacccucucuucccaccaguguccucccuccuaucuccugccucagcuucuuggccauuggcuuuuucacugacagaugaugcuuauaagagauucucugugcagccgacucuagggagaugagauacuuauguaagggaagcuuguuuuagggacugcugagauaccucuuaugccaggugcugcagaaaaccacucaggugagagacaagaggauugucacaggaaaauaacugagggauucuaggacaacucuauaaagaugcggggaugacugcuuaaugagccugauacuuuguauuuuggcuccagguauucagucagugagcgcagauggacacagauguuggcaggagcugaggaugggggcccaggcccaucaccccguuccuuccaugcagccgccuaugugccugcuggccgaggugccauguaccugcuggggggccucacagcuggaggcgucacccgugacuucuggguccuuaaccucacuacccugcaguggagacaggagaaggugagcaucugucuccauccuaggccuguuucucacaauagauucaacagguguccauuggaguuccuuugaguuucaucacuagagggaucuacccucagggcaccaacagaagcacaggaauaugaccuguugguguauuucagcuauagaaagcuugccuagaaucccccagugaggggcugggaguguggcucagugguagagccccugucuagaaucccccagggaggggcuggggguguggcucagugguagagccccugucuagaaucccccagugaggaguuggguguggggugggguggcucaguguuaguucccuuacuuagcuuauaccagauccuggugucaauacucagcaccacaguaggauagggaauuguaaaguugaauuugaguggucaacguagguuauacauuuguagcuauaagcugaucccuggacaagggccugugacacucucaguggccuggaugggaugcagucccacccagcagcagagcaaacagaggaauaaggacuuuugauguuccugaauaagcaggugugcagugggcagaaccuaacugggcccuggcaggcagggucuaagcagcuauggagcucuugacucuuuagcuggggcugaucgaucuuauguccauaaagugagucuuccucugccaccuuggaugacauuagcucuccaucuuacagcccccucagaacauggaguugccagcggucgcuggucacacccuuacugcccgucgaggccuaucucugcucuugguggguggcuacucccccgaaaauggcuucaaccagcaguuguuggaguaccagcuagcaaccggcaccuggguaucuggagcccagagugggacacccccaacagguaaggcugcagugcaagcugucugcacuuuccucaagcuuccaguccacucucacacgcuagucacugcccacugaacuuuaaaagaucuccuuguugucaccugacagcagcuagcucuccagagaagcuugcugcuucccucccuuagugucacagccauucacuuccccagcuucuaagauccccaccucucagaggcucucuguucucuucuguccucuccucugugucuccccuacaugucuuaagcaccaccugucagccauucugccacccugucucucuuccuggcugcucugucucuccuucccagccauuggcuguccucucugcgguuguuuucuagacccgaaggacaggggaggauggaggggcucgccacaccucuggccacagagccuuuugggcaagggauguggucauuaagaagcggagcccaggaagugaggggauacugcuggccgucagcccuucccugccaucucugugguccuucugccccucuaggucucuauggucauucugcagucuaccacgaggccaccgacucccucuauguguuuggggguuuccgcuuccacguggagcuggcagcaccuucuccggagcucuacucccugcacuguccugaccguaccuggagccugcuggcaccuucucagggggcaaagguuaggacagcuggcuguagccacggcaggggguuccccaaggacuagcuccacucacccagauuccuguccccuguucccugcuuccagucccuguaaaggaacagugaggaaugccaguucuuuuuccaugccugguuuggagaaaagaauucuuggcaaggaagugagaggcaugauuucugcccccacaccacccugacagauccccuccucuuccugagccccugucuaugcaucccuguaacucuggccuuuuaaggccaaggacacaggugugcgagagcagggaucugccucuccugguagggacaguugcaugugauguacaccgcaccaccccagccccucugaggaagaggggugcaaaaaagaccaaguuuccagggaguggcugguucugugggcugcucugcaggacccaagaguuucccucucaaacugggagaagagggggaugagcugggugaggcugggagggaaguucauggguggcaggugaguugggaagaaguguguggaaccgagggugggcuccgacaccuaggcucucccugcauaugugucucccaccagccccgaccccggcuuuuccacgcuucagcucugcucggagacaccauggugguccuuggggggcgcucggacccugaugaauucagcagugauguucugcucuaccaggucaacugcaacaccuggcuccugccugcccucacccgugagucccuaccccaggaggcugacguccaucugcagcccuccuuuccucuccauguaacuagaggccacugaguuccuuucuuuuuucuuuggugaaggagucggucuguccuuccacacguccugggaauugacucaguuucucagucucaguggcaaaugaggacccucugagcugucucacagccccuuuccuuuugucuuagaaugguuuguuuuuuauuuauuuauugcuucguuauuuaguaucauuaugucagcuuggcuugcuuggaacucacucuguagaccaggcuggccuugaacuuacagagauccaccugccuccgaauccugagugcuaggauuaaaggccuguccaccagagaaauauguuuuuauucuagcuuuaaaaguaauaguaaucauuguacauaauuuguaaaauaggaagaaaaacaaaacaucuguagcaaaaaccacuuuugaaagugggaaguguccagguuuucugccagguuagagaugagcuuagagaguuggagagauagcucagcgguuaagaaaacuuucuguauauucacgaagacuagaguucagaucccagcacccauguaacauguguguggaaccccagcucugagguaggcagaaacaggaggucauuggagcuuguuggugucuggccaaaccaagaaaacucacgucccaaguucagggagagaccuugccucaaagcaauggguagagaggguugcucuauggauggaugauacucgauggggguguguacauacaugugugcacgugcacgcccacacacacacacacacacacacacacacacacgcacauauacacauaccuuaaaucuuuuuaaaaguuggaaguucuaguccacuuguauuuuaaauauguagaaauauagaauguacuauagaauaaauuuacuuuuaugaaguucaaaagaaacuccagaacccaaccaacaaaacucagagcuacuuauuucccgaccguuauauccuuaauacuggauaugcagugguuguuauuccuggaaggauguaagagggagucuagguagcucagagcaggagagcuguaguaauaagugaauguugacagagagagaaacagaaaugggcauauggccuuuuuucuuuuucagugcuucuaagacacucaggccuugcacauacaaaacaguugcaguaccacuuagcuauugggagagcaagugcucuuucugccauccucuuccccagaagaccagaggagcauaggacugugcugugugucacuuacaacucuuccuaccaacauaggcacaauacaacccuguucucccacaucuuaucuucuuggccuuguaaaugcuccacuacugagccacaccacagccccucacugggggauccuaggcaggggcuccaccacugagccacgcccccagccccucacugggggauucuaggcaggggcucuaccacugagccacgccuccagccccucacugggggauccuaggcaggggcuccaccaagccacgcccccagccccucacugggggauccuaggcaggggcuccaccaagccacgccuccagccccucgcugggggauccuaggcaggggcuccaccaagccacgcccccagccccucacugggagauuuuaggcaggggcucuaacacugggccauaccccagacccuuacugggggaauccuaagcaggugaucuauuggccccucacugguagauuugcguuagggguucuacugcugagcaagggccccagcccucacuggugaaugucuaugugagcuguacugcuaagucaugaccucaggcccugucuagccuuuucauuuccuugagcacugaguggcugcuuauguguccaggaccuguguucuguguguuuucucuuuucuuuuucccuuuuucucucacccuccccauucccuuuuacuccgacucaaacuuuuuaauauucauucugucuuggauuaaaaauaaacauuaauuuauguaauaugaaauuaauuuuuuaaaaauuaaaagccaaguggugcauagccaagugcacuugcuuggcagguacagugcccuggcuucaguuccuagcacacacucacacacauguaacuaauuuucucaaauccuauuuuuaaugaugcuucuuaaaugccuuaacaucccuuguagcccaccacccaccagagguaguggaaaagaaaggauacaggggaaguggaccuguuuagaaaugauucuuuagaacaacuccugucuguguuauguggaaaucagcaguucaguucacaggucagcagcagcaacagcucgauccacuugcaaacccuucauggauacaccagcgguccaguucgguagagucgggauagcaagcacgaaucaguagugguggcacuaccuagcagagacagccaggccucaguguuggcacaaguuagcuggagggaccuggagggacaccaggagaaguucugggcuaugccucucucaggcaagugaagaucagugaaggugcgagaaccacagauguugcacggcucgcucuaaaagcaagccaagcucagcccccaucgcuauugggcgaguccuauuuauacccaccaaacaucacgcguccuccacgggucuugcuuuaacgcuugagucugucucagcugacaccacucugccaauuagcccaagucuucagaagcggcaagaaacugcagcacaucaccagaaguuuuuugguucguuucucucuguggagucccaacaaacgcagcucaacuaugcaauguaagguggaccaauacacguggucguuagugaagaauccuucaucacguguccuuucacgugcuugcuuuagcagaacauccucucuccugugucuacuucagugaaacgucccuucacaagucuuccuuagccuuucaccuguguccacuucgggaaaacacuccuucacguguuugcuccauccagcaaaacaccauccaacacaauggacucuccaaagaacccuuaaauuuucacuuaacacacauacaaauacauuuuuauucugguggcuuuuagagcuuuuacugucacauagcuucuagugcugugugaccgccaccuccaucugguuccagaaucuuggucucugcucuuuucauuuccuugaggcuuauuuguuauucaggguguuacagguggagcccaaggugcagccugugcauguuaggguggugcuccucuuaggguggugcuccugugaggguggugcuccuguuaggguggugcuccuguuaggguggugcuccuguuaggguggugcuccuguuaggguggugcuccuguuagggucgugcuccuguuaggguggugcuccuguuaggguggugcuccugugaggguggugcuccugugaggguggugcucugucagucagccacaugcucaguccaccucuuccucuccuuccuccucuuccccuccucuuccuccuccuaaccuguuuagauauguuuauucuauuugauauguaugacuguuugucuguaauuauguauguguacacgugcccacagagguauacacauacagaaggaggcaucacauccccuagacuuggaguuacagauaguugugggugcuagaaaccaaaccccgguccucuccaagagcaagaaauguucuuaaucacugagucaucucuccagcccccaccucuuuuccuguucuuuuuucuguugucuguacuucugucccugucuuugcugucugauucuccugugugucucucucucuucucugucuuuaucugcucccuuuuucccuguccuuucugaaugucccucccgaccagucuuucagggggucucuucuuugugcuuccugcuuucuacuucucagaacaccccaucuuucuucagguccagccuuugugggguccccgauggaggagucuguggcccaugcaguggcagcaguugguagccgccuguacaucucuggaggauuugggggaguagccuugggccgccugcuggcauugaccuugccccccgaccccugccgucugcugccuucaccugaagcuuguaaucagucuggggccugcaccuggugccauggugcuugccugucuggggaccaggcccacagguaaccauagugacugacaguccauggcacagugcacacugguguccucugagggcguuagggagugagcuggacuuggggggucuugaaguuggacugucagguucugccucacacauggggaagagaaugauuaucagaagugggggugcugggaggacuccagucugaacccugcuuguaccucagugucuccccuucuggagaaacuggguuggaacuugcuuuuccauguaugguauaguuuagaccagcaaagauugagaguggugcugcacccaggauaucuguaugggaagacacugagaccagaagggcagcucagaaaaggcuucuaguaccuggcugggaccaggcucugaccaaaucugcagccuccucgacugcaggagcacagaugccccugaaaaccaacuagucccuugguuaacucauucgucugcccgggugccaugauggaagccuacuuagggguucuguuugucccaagauaggcagcggagcgagucauuaugcaucuugcagaaugguuaauggaugugauuaugggaugcugaccccaaacacacacacacacacacacacacacacacacacacacacucacacaccugugggccugugugucauagcaggaguacucacuguuuuucuaaaaucuggaaaaugcugaaaacccauucauuuccaaggaauuuuggacccuugcuguguacuggggggcuggggagggauggaaauuguaggcuugagcagagagauuccuggagugcuuguggggggcagaguggcaaggggagguggcacagagagaccuuggccuuuggcugugugagaggaagaauaaaacuguuuugggaaggggucgggaggggaaggagacaguuggugaugccucagggucaguggcaggaggacacguaucacaaagggauggggcuaaccaggauccggagguauaagcguggcacaugguggaggcuucuguaggaccguguacaagagacaaagcguaaguccuagaugagugagugagcuaaccucauguccucuaggcuggguuguggggugcccccuugcuccccaaugccucgcucgccugaggaaugucggaggcugcggaccugcagugagugccuggcccgccauccucggacccugcagccuggagauggagaggugagugguggguagaggggcagggauacuggucuccacugugguuacugcccuacccaucccugcaucucaggaaccauggaacuugucaucugugauugauuggguaggaagaagggauacugagccccacagaacccaccaacuccaucuucccccccacaggcauccauuccccguuguaagugguguaccaacugcccagagggugccugcauugggcgcaauggguccugcaccucagagaaugacugccgaaucaaccagcgagaggucuucugggcuggcaacugcucagaggcugcguguggggcugcugacugugagcagugcacgcgggagggcaagugcauguggacgcggcaguucaagaggaccgguaagccuccucgcgguuugcuuucuggggggugaggggguuagaggccugggugccugcggaucagggaggccagggacuagacacugaggcugaggcagugcuagggcuuaaacugguggggcuggagaagggcuggcaucuagacuccugaaggaggagaguccgggaagcagacugguuacugacccugucccuccccuccaaccccccaccaggggagacucgccgaauccugucagugcagcccaccuaugacuggacuugcuucagccauucccuguugaaugugucuccuaugccaguggaguccucgccuccacugcccugccccacgcccugucaccuccugcccaacugcacaucgugccuggccuccaagggugcagaugggggcuggcagcacuguguguggagcagcagccuccagcagguaaugcccgaguccugcugcccagcccggcauccucucuccucccucuucuccuuuccuucccucgucuuccaugccuccugcuguuaggaucacaacucuguacuccuuccaggacaucagggccauauucagggcccagugagacacugccaggaagggcugggagggcccaguucacacagggugggucaggaccucgccuguggguuggagaugugacugguggcaguggauguacuugacagacagguggcuaggaccuaacugccuaccacauuguccucuucuaggagcuccaaaaaaugugucuacguagcauaauuuaguugucccagugguagacaaaagcauuugccuuggcuugccccuguggaaggccagucagaccugcccaccauugucauaucuagcaaggaaugucugauucccacugauaccucuuccucgugcauaggcggauagccaggacccaguggcaacauuccagcuccccaagccacugguucagcucucccucacccuucacccaguggaccacaguguguguguguguggggggggggggcaugccauugggacuuccauucuaaaggugaccuuagagaaaccagcagugcuuccugcacgacccagcagcgagggcugccagcuucuacagcuagaagcuuuaccuaggaguggcggaguggcguauuggcuuaggcaccuuguaaucaaucucucaggcccugggccuggggagagagcucacucaguaacgcagcugccugucuacugcugacuagucuagucuacucagugacuuccaggccaaugcgagacuggcucaaagacaaggugacagugccugaggccgcucacugaccuccacauguacgcgugcgcacacucaaaacucagcuggguuuggcucucgaacaggugcugggauccuuacuugagucccaugcaagagcaguguguugcucaccucuaagcccacucucuagccccgcagucauuccaacgcaggaaaaugcugucacaugccuuguaagucuaggguucaggcggcuggucacugccuucuuucaauacaggaauuggguagggaaaggagacuuugcaucgauauaauaggcuuaugggacaugagaguuucuuuuaaucuuuaaaauguauuuauuuauuauauauacauauauacaugcauacauacauauauauauguauauguguguguguauauauguauaaguauguauguauuuuuucaagaaguuucucuggcuguauauguauauguauuuguauaugcauauguauauauguauuauuuuuuucaagacaguaguccuggcuguccuggaacucacucuguagaccaggcuggagagguccaccugccucugccucccgagugcugggauuaaaggcaugugccgccacugcacagcacuuuuuaaaauacggucuuccucuguagcacaggcuagccugcaacucaucuaaccuaggcugaucuugacuacuuuucuucuucuuccuccuccuuccuccuucuccuucauuacauauacuuauuuauucauuuugggaggggaugcauguguuuagaggucagaagacagccuguagggguuaguuuaauuuuuccccuguauggguuccagggaucaaacucaagucaucaaguuuagcaacaugugcauucacccuucaagcugucauaccugcccuugucuggaaccucucguuucuccuguuucugccuccaaaguacugggauugcccaggucccuuugggucacaaguagaaaguucaauagggcuuccuaggggcugaacucugaggccuggaagcuuccaugucugcgucucaccauccuuggggccugacugauggcugaugccugccucuucucuuccugcucccccuguaucuucuucaucugcucaucaucucauuccaguguccucucagcccagggcuccacagaacccugacccuaguccauuguucuuuaacaccagggcucauguagcccaggcugcccuauguagcuaaggguaacccgaacucuugaucauccacccccugucuucugggauuccaagcaugggcuacugugcuggguucauccaauucuagccuugaugucugguugcaaaggcuuaugauagccccgcuuguacccugagcuagaaccauggaggguggggccuggaagaaagggaugcagucugagaaguguaguuaacuuucuuccccugucucuucucccccccacccccgccccguuucucuggacagugucugagccccuccuaucugcccuugcgauguauggcuggaggcugugggcggcugcuuagagggccagagagcugcucgcugggcugugcucaggcgacacagugugcccugugccugcgacgaccccacuguggcuggugugccuggggaggccaggauggggguggccauugcauggaaggaggucucagugguccccgagacggugagagagguuccaggggcugggcagggugguuggccaggggcacagagaacaagaugggggcgguucugaggugggacucagagguggugggaagggcccaggugucugggauagucaugaagagaucuccuggguaaaggccuguguccucuggggucagggcuaacguguggacgucccggggccuccugggccuuccugucuugccccccugaggacgagugugcaaaugggcaccaugacugcaaugagacccagaacugccaugaccagccccacggcuacgagugcagcugcaagacaggcuacaccauggacaagugaggcucagucggggugacacaagucauguggaaggaaacagcccaggcucaugggcgggggcgccuaucugugagacgggagggcaguuggcagacccaguguguaggggaggggggugagggacaaaauagcuagaggagccaggaaagaaugagucucuggaggagcauagugggggcggggccagcggccuccaggccagcagccuacugaaagagagugggacaguguuggaaggcugggccccugcccucaucacugcucgucccugcagugugacuggcgucugccgcccugugugcgcccagggcugugugaacggauccuguguggagccugaucacugccgcugucacuuuggcuuuguuggccgcaacugcuccacagagugucgcugcaaccgccacagugagugugccggcguuggagcacaggaccacugccugcugugccggaaccacaccaagguaugggacccgccacccagccccucaggcccuggccgaacccgagccccugagucugcuuagaagaggccuuuuauuguuuuuuugaagucuauuuuggugguccugggauggaacccagggcauuugacaugcuaggcaagugcuguaccacugagucacaccccagcccucgugcugaggcaucaucuuaagguuaauucccagucccaagaagccauggcagggaaggggugggagaacccuauucuggggagaugugaaaagacuuugggggcuguguaguaguggacagaauagcuggggagccuggguguguggacaccuuugcuacuugggacuuaagggcuagggcaagugagugaagggagggccuaagccgcagcccagcccugugcccccagcccagccggcaggggcagaccaggugcccagcccugugcccccagccccauguuuccccagcccuuuggauggaacuuuccuuuguuacuaggguagccacugugagcagugucucccacuguucguggguucggcuuugggcggugggaccugccgacccugccaugccuucugucgcgggaacagccaugugugcgucuccaggaaagagcuagaaauggccagaaaggagccagagaaguacucacuggauccagaggaggugagggaaugaagucugcacucaugagucugaggaggagacugggccugagggaggaagacugggucuggacccuugugucugggggaggauauagggccuggaccccuguaucugaaggaagagguggggccuggacccuugugucugggggagaaggguuggcccaugucucucugugcccuuguuggccagauugaaaccuggguggcagaaggucccagugaagaugaagcugugugugugaacugucagaacaacagcuacggggacagaugugagagcugccuccacggcuacuuucuccuggacgggaaaugcaccaaguaagaggaaggagccuggcccucgcccuucucaccgggaguaacccugggaacuagaccucccuugccuagcccucucuugucagaagcgaaugaaguuuaagaaagcuggagggugagcaguggguggggaacauggguggaacccagcugagagguccccacaucagaggucugcaaaaagggcugcagacagaccuggagggagccuggucucccgaauccacagaaggcugcugaggaaggaggccucaaggucaccccguuuugugccugcccuucugaaacuucagaaaacuggagacaguccgagcagauuguuacucaaggaccccguggcugggguaguggacuugaguucugagagucuggaagucagagcauagcauucaccccccucucucccauucucaggugccaguguaauggccacgcugacaccuguaacgagcaggacgggacaggaugcccaugucagaacaacacagagacaggcaccugccagggcagcucucccagugaccgccgagacugcuacaaguaccaggugugucugggaagccagcuccuggacucggugccacaggagcaaagggcggagcugggaugaggggauccggguccaggaucagggcuguggaccugguuuggaauggaggucaucuuguacauugcugagccccgggcuguggcucagaguccaaaugcaggaccucaggggcucugacugugacagucacagacuauagguugcaagugccagaaacccaccucagaguagcuuaggggaaaagcaaauguuuugacucugaaaacaggucugacugggugcaguggcacaugccaauuguuccaggggcugaggaggacccugaguucaaggccagccugggcaauagagggauacgguuucaaaaacaguagucuuacgguguggcucagcugcuggagugcuugccuggugugcacgcgcagcccuggcuuucucuccuacacugcagaagccuagggcgguggcauuuaugugaccccggcacuugggaggcagaggcaggaggaucagcagcuacagagauaugugaugccagccugugcuaagugagauccuaucucaauagagcagcaacagggccaccaaggaccugugugcucugggaccuguauguaggaauggcugcauccaagaagucacagugaugucagaaaugucacugugacuuuacucugcccucccugugccagcuuugcuacuuggggagguuuuugucccacgugccuuuccccaccaugugaaauucuggcugaugaggguucucauuaauucuaaacuuagauuuaaaucccccuugugagccaggucugugacuucagccugugauccuaguucuuaggaggcugaggcaggaggauucugucaguacugggccugcauggugcaagacuuaaucuagugaaaccuaacccaaaucccaaucccccuuaugcccauuucucauuucugaaacagggaggcuggcugacugcucugccccacucccccacgcagccgcucuccaggcccaggggaacaucuuccugucuuacugagguguagccccacccagaccagccucaccgaccuccauccuucucauccuagaccagaaaguuggcuuuacugcuguaugauugaaaggccuggcugggaugccggggagauagcucagucaguaaauugucugcuacccaagcucuaagaccuaaguuuauugcugggcaugguggcacacaccuuuagucccagcauuugggaaaaagaggcagguggaucucuuugaauuuguggccagccagagacacacagucucaagaagacccaaguuuggaucuucaaauucacuugcauauacaugugcacacacacaaaauaugcucauauauaaauuacacaugggcacacauacacauauacauacauacauacauacauacauacauacauacauacauacauacauagcucacugagggccugaaagcaugccucuaugauauagaguaccugcccuaaaucuuccaguaaggggcuaaggguaaagcucagugguagagccccugccugaaaucccccagugagaggcucaggugugacucagugguagagcuccugccuagaaucccccagugaggggcugggggcauggcucagugguagagccccugccugaaaucccccagugagaggcucagguguggcucagugguagagcuccugccuagaaucccccagugaggggcugggggcguggcucagugguagagccccugccuagaaucccccagugaggggcugggggcauggcucagugguagagccccugccuagaaucccccagugagaggcucagguguggcucagugauagagcuccugccuagaaucccccagugaggggcugggggcauggcucagugguagagcuguaaauccuccuauauuaggauuacugauaugugucacuaugcccagcaaaaaaugaaacaaaacaaaacacucucaacacugucagacacagccauuggccuuugcuagagugggcuggcggucaguacagaccuccuccaaccccucuguuggcugccccaaguaguguuuauuugguucuaauaauuauagcaguaauaacgagccauguaauaaccaccaugacuaagugguagacauggugaccaugacugaggaaggugacuguaaaaaggugacacuuugggcugaagugacagugacaggcaaguggaccuguggagccuccuaggcagggaggaggugggcaggagaugcugaccaaacucaaaugcugagccacaggcugugaaucauuucaguuccucucaguacggagguucagugaggucuggucaauggcagagggccacacguagcuagugaggauguacggucagaaccucauagaagucucauggcugagagcgccacgcuggggugcagguagggugugcugggcacagugccauggcuggcauugaggguugcagcacugagcucagcccugauggccgacuccacuccugcccugucacagugugcuaagugccgcgagucauuccacgggagcccgcuagguggccagcaguguuaccgacucaucucuguggaacaagagugcugccuggaccccacuucccagaccaacugcuuccaugagccaaagcgccgggcccuggguccuggccgcaccgugcuguuuggcguccaacccaaguucaccaauguggacauucgccugacacuagacgugaccuucggcgcuguggaccucuaugucuccaccuccuaugacacuuuugugguccgaguggccccugacacaggcguccacacugugcacauccagccaccuccaccucccccaccucccccgccuccugcugaugguguaccucggguggcugcggaccuaggaggauuggggacuggaagugggucaggaucuccgguggagccacggguccgggagguguggccacggggccugauuaccuacgucacagugacggaacccucggcagugcuggugguccgcagugugagggacaggcuggugaucaccuauccccaugagcaccacgcccucaaauccagccgcuucuaccugcugcugcuggguguaggagaccccaacgggccuggugccaacgguucagcagacucacagggccugcucuucuuccggcaagaccaggcccacauugaccuguucgucuucuucucugucuucuuuuccugcuucuuccucuuccucucacucugugugcuccucuggaaggccaagcaggcucuggaccagcgacaagagcagcgccgccaccugcaggagaugaccaagauggccagccgccccuuugccaaggucacugucugcuucccuccagacccugcaggcccagcaccugcauggaagccagcugggcucccuccuccugccuuccgccgcucugagccuuuccuagcaccccuguugcugacaggagccgggggucccuggggacccaugggaggcgggugcugcccaccagcccucccugccaccacagcuggccuacgagcuggacccaucacccuugagcccacagaagauggcauggcugguguggccacucugcugcuccagcugccuggggguccucaugcucccaauggggccugccuugggucagcccucgucacucugcgucauaggcuccaugaguacugugggggcagcgggggugcuggaggcaguggacacgggggugguggaggccggaagggacuguugagucaggacaaucucacuagcaugucccuuugaccugucaagggcccucuuccacagcuaccauguugccugauggggccacucugaacuagggauccccuggacagucuucagaaaccacuggcucccuuuucccagggucccccccuuuguucugcauuuagcaacuauuuauuacuuugugcccaguacaguuguggguacaaagcaaagcaggaggugagaggagguucccucaucugguggggauugaguucuuguggaaggagacaugugcccacaugcacacacacauacacacaguguggcacugagguaaaguugaugaagcauuuggagaaacugggcugagaaaggugacagacggagggaagaccuuugggaaacaaauucaagagucgagggaacuguaaggcugaagggcccgaggcuggaagcgguuugucuuaucacgagaaccagagaccuggccacugcaacccagaucaagugucggcugagcuggguucuuagucucagggcagugggcagcgguuggacacuucuguggugguaaaugaggggcuucagcucuggggagaagagugggcuggugggcacagaagacgcugcaggugguuaacugggcaggaggaaggugaguggcaggaugugacaguggugcagauguuagaguagggaagaggacauauccagaacggccacuuuauguccugggccauggguggacagugagguuguuacuaaucuggggcaggcuggggcaggcuggggcuugugggcuuccaggugugacugcgggcucauacaggagggaaucuagugcccuguggugaguuuagcacuggcaaaagcaggcagcuacugagaggacaggacagugcagcugcccgcuguaggagcagugagcugcugccgggcuagaccagggccaccagcggaaccuggagauguaggcuuauuuaaaggcagccucagaggcaaauucuuugccugagaugccucacaucucauccuggcaggugugggcugggagacccuggaggggccaucauuuggcuuuuucuugagucucugggacucugcacagaggccaccuacaccuggaucuccuuuuuggacuuaagagcucucuccucccccaguccuaggcagcugccugagcuugggacucuugcuuucccaagacuccaacuucuagccgcuguuuugguccuggcguggggguuggacccagccucuuucccuugcugcaguuacccugucugaugugauccugcuaaugugugcaugucagcaugggucacaucucuaugauaggagggcaacugaggcaaagaauaaaguguggagaagacuugug

SEQ ID NO: 3626 - RNA, 2111 nt, Mus musculus
ugggguugguuuucagguuuuuauuguggguguauuuuuuuggcggugggacaggggcagugggacaggcuuuccaaggaguggccucccagggaggccaggcaagaccaaggaccaaggaccaagaauguccuuacucucggauuuucaguucccgcgccaucugacagagggcgcagggcaggcaaaaggugagggcagcccagucgugcccgacggagcccuggagggugggaaagagagaaaucgagaaaggucaggagcuuuguucuggggugccagguggcgguccccagucucaauccccgcaguccccagucucaaucccuguggucugggauuggcgcgcaccuggaugugguagcgcucccucaugccggugcgcagagagugcagaccuccgggcagguagggcgcacagcagcacuccccaaagucaucggagaugcggcaggccaggcacagcggggcgaaagugccgcacagaccuggacagggcagaacggucaggucccgggccugcuguguuugcccccgaggagggcacgcacgguggcacggaggggaugcgggcuucaggagaacaguuauagagaaggaaaccaagacccaaagcgaucgggcucuggguggggugggugggggucaccgugaggaggcugaggguuggauaaugggaucccaggcagagugaagacugcaggaguguggcgugaguuucccucccuccccaucuuccucggacacucacagacgggcaugucguugcaacagucggugaggcccgugugccaaucgcugagcugugucugguagcagguguuggcgcacugaggcugacuagucacuggauaugacauggcuguggagguaagagaagggggaucaacaggcauccuggcaggaccuucugagccgcgccaccccugccgcccuuccuucugccgggcagucugggcaggccaccuggccgcccacuagaggaaacaucacuguaccuccuccccauuccuaucugucacauuuggucaucaacaccccuagucugucucugcugcuguugccaacuacacaucugguugagccaaagucaggagggaaagugggcaccacagcugggcagagccucgacuuggcuacacauaccaccaccuccuccuccaugacugggcuccaacauuuccuggggccucugggguagaagcaagugccauuuguuuucgaagccagggugcccaggguagggaggcagccagguuccuggcaccuagaggguugcuggugcauucagugaccccaccuuugccuuucacguggucgugcaucucaaacugcaucuugcuggcccugaggagguggcugcugugugaacggcugcaggggacggcuacggcaacagcaauguagucuguccaagggaugcuggauacuaggcaggggagggcaagggacuagggcacugggggagacgaacucucagggggggaagggagcugaagagaaagaggccaaguuaaccuguuggcugggauggcuaggugggcgaacuacucgcccaucguuuuaacagcugcccgacagaccccagaggacccuucuuggagcagaggcagaguuggagagagacaaauccuugucuagggagagcaaaggcagccaggaauggcagagacagaugggaaagaacucugagccaggugcucgcagagacacugugagacagccacaagcguggaacaugguaccucuacaagcugauuuuacagagggcuauaggcucagagacagaagagaaaugccugaugauggacccauccaaacaggcucugagacugggugcugggccccagaauuucuaaauccaacucuguaccagucagguuggaaaggugagacuggggaagugaagcguugagaaagaguaagaugaucccagucagcggcagucagucagaggcagucagggagacagagcugugagccagauaggcagagaaccgagcggaggugccugccagagagcagggacuuagggaggagaugguccuaccugcagauccacgugaggggauggagauagagguucuuggugacagcagacacuaaguucu

SEQ ID NO: 3627 - RNA, 16908 nt, Mus musculus
uguagaucaacccugaggccggcgguguugcugucuuccccuuuccuuugauucuggggaauaaggcagggcagagggagagacaccucaugaagcagagcaguaagaacuaggagggagcgcggaugugagacuggaagguaguuugcugagaggccaaggccacccucaacuacagccuaggacccugucugggggggaaaaaaaaaaaaaaaaaaaaaaaaaaaacagggacgaccacgugagggggcggaggaaaaggcggggcuucuccaaacggcuaccaagcgcggcuacgcccccaagucgguccccgcccacgccuuggguugcccgcccccugcccgcccgcccguucuuccggcucccggggcaagugggcgggccagguucaaggaaaggugaaugagauggcgagggucagcaccugcacaagaugacugagaauucuuuguuggggugacucuaacgcgacuccucacuauuccugcugugagggcacuucucgcugcuuccaggacugcggguuuuuuuuugguuuuugguuuuugguuuuuuguuugucguuacggugcacugcgcgguuccuuuaaucugagcagaugggcgggccaagaccuucagccccacccauuaaaggcggagcuccgcgaggagccugcccaggauuggaugguuugggggccuggcagugguguguaacuaggauugacucuaagagaggaacuugaucgcuggaauugggccccgcgccaggacuggaaagaauugauggagccggccguggaaucggcgcccgugggggcccaggccuccaagcagggcaaagaaggaucgaagaaccgcagucgcaggcgguggcgaaaaggcaagaucaaaggugagucgguaacagcuuaaaagaaaucccgcacauccugcgggggacuggggacugggggaacugacccacuuccacgagggggaagagacccguggacugauccacugccguccugcgcgugggggggggggugaugugagaguagaaugccccaccgagacguaaggacuacgucugucccagugcggucuuuggggaaguguccgaaaugcucgucugucggaauaagguucucucucagguuccuuuuucuguguggccaagagcugugccuuuaguguuuucuguuucgguucaagcgguuuucaugucuucugcccucuuaaaagaauaacguagaaggguuuuuaaccgcuuuuucuaaauaaauagaaugcaaaagguaggcagaaggggcauccgguaauuggaagagcuccuugcagccccuucuuacucucucagugaauccauccaucugcucuuugacaaucgaccuucaucaacccagcaacccuggggcgacuugcaaaacaugagaacuuuuacguuguccuuagagaaaggagggaguuaccauuuagcuucccuggauccaaaaggcuggagaaacaguggcagaacaaccaaagauuuugcauggcucaaucagagcaggcauuaaguccugguuugguuaugaguuuugucugucuuguggcgcugcuuacagccaaaccuagggccuggugaacacuaagcaagcccuccgcuaugcagcuccaccggcaguccauggaucuuuaucagacuccagggacagguuccugugcaggcaaaaccagaaaaaaccuggcauggcuuaccagacccaaaacccccaaauucaucauuccucauccuccuuugguagacaaguguuggagcucaagcaggacccugaagccuccuaucccccaacaaagacacauagcagaacacuaugcuuugaagcgauauggaaccucaaucgcaaagacccauuguaccaaauugcuaugaaugugaaguaaugaacagggaccuuuucucaauuuuuuuucugagcucccaacaggcaucuguagggcuguugucagauucaaauguguguguuuuggagagguguauguaagucuacugucuggcugagugugcugaguagagugucugacucuacuagacacuggucucccuaagaguaggguugugucugccuuguuuacagggaaugccagacacauggacauucaaguauuuauuagauugauaagcaaaggaaugugugaagugugacguggagcuguuaauagccaagcugcccuuagugucaugaggagucagaaagaaucugcuugaguaaggcuccucccuugcacgggguucagguaagcacacucacaaaggcucgcagcucugagaagugacugucauuuccugaggcccuuccuagugccaggccucagaccugugaaucagaucccaccucugccccaaggguauccugacuggcuggagccgucauuuauccuugugaucuugccacaaguaacuggaugagacagcugucauuaugaucagcccauuucccaaaugacgacagagacacagaggcacugagcugguuggguuuccuguaccuguccagugagggcagggagauggauaccuucagccuucucagagcagggaguguggagcugacagcuguuguaugccucaaccuuaauucugaaucuaaaaggcucuagucacaaagauuucaucccgagacagacauucaauaccuagaggugccaggcuucggcuuucuguaacuagcagggcagucucaguagagcugaggacacagaugguaauaagacuguuguugccaggcaugugccgcacaccucugaucccaguccuugggaagcugagucaguucaaggcaagcccgggcuacauagugaguugcaggucagucagggcuacagaguggaacucugucucaaccucucucauucacccauuuacaaaacauuguaaacaagccaguaugauaaaaggaaaaauccuggagcuggggauguagcuuauuacuggaguaccugacuagcauggacaaagcccaagggucugucuccaggaccacacacaguaggcaucauagcacuugcuuauaauucagaaguagggaggccgaggcaagaggaucagaaagaagcuuaaagucuuguagucucugacuauauagucagucugaagccagcuugggcuacaugagaaaauguguccugcuuucaagaaagaaaauucugagaaaaugagcguggguagcuuuuccaacaaggugacaucagacucauggacgggcaggcaucagcuaccgagcaagggagguggggagagcagagcagcaggaacaccgcuggaagagcagcgccugacaaugcagagagaggucugggggcggaggcuggggucaggaagcuggggcaggcaaggugggcucuaggucagcuuaaaaggccaugcccaagucugaagcuuuaucugggaggaaggcagggaagcauuggugggcuggaagggcaaggucagccuuaugcuuucaaaagauccucuggaugcucugcaggaaacaggcuuaagucagaggaggcucacggagugaggaccagguaguggagguggguggcuugcuucuggauguccaguagauggggauaggugagggaaauggacaggacaaccccugagcucucugccugaaccaacagugaguccuauccucagcacacacgaacacacguggagaccgugacacacccaaacauguacaucgauucuuguuguuuuuauuguuguugcugcuauuugagagguagagcaucauauauacaucccaggcuggcuucaaacucaccauuuacuucaagaugacuuugaacaucagauccucuugucuccacuaucauagugcugggauuacaaauauucacccccacauucagucugcacagaauuggggaccagauccagguggagugaggcaagugcugcacuaacugaucuacauccccagucccaggguguggagucauaaaaacaugagcacauccccauacaagcugaaagacuaagacaaaacuuagacucacaggcuaacaaacacacacauaccuucagacaugucaagaaacaagguacauugaccugguauauccccaggaaccaaaguccaggccugauucagcugacaaguggcuucucagggcaaagggcuggaggagguaggagcaugggucaggggcagaacauuugucuagcauuugucuacaaguuugauucccagcaccaaagcagggcaaaggacugggucauaguuggcuagggcccccucccccacugccagcccccccucgacccuaccuuugucccacuccugccauacuuacccauguccccacuggguaugcccuuaucccagugcccucugccugggauucuggcaaucuccguaucccucccuccugccucuagccagcccagucuucagggaaucuugaauggggcaaagagcagggcccagaagucacaagggcuugggggauccaacccuucccacugcuucaucccaaucacuuguccuuccacaaguguuccucaucuucaaaaaaugucccaacaccguacuccccacauauuacauuggcguggaaggcagucaguccuagcagagugaugugccagauauaagguauacagugugacaagugagugaggcuaggcuuagaaaguggaaaauuguaccagcuaagagcagaacacaacagagaaggcccugaacucaggguguacagacaauuucauggggagacagaacaaauaaugauuaugaagucauauaguguauuaggguagugacgaacugcauggaaaaagaacccaacccccccaacccccccucccccgccuccaucagugaggccaagcugagugaggccagggagcaaaccacgcaugcauugccucccugggcuagggguagcacucacaggagcgcaugcuuagcacauggguuccacucccaggaggaaagcccaugagggacugcucaugaagcaguccacccacccugggugggcagaauggcucagcagcuuccagauggagaauuuagagcuaaccuaggaucacccaacaagugaccuggaccaguaucccacuguaacagcugcuuagcuuaaccaccccugagggucugguccagcugucugucugcaaguccugggaaggugcaacccucuccccgguucccagccacugccucuggccuucagucuacuucgugcccucugcccuucauguauuugcuagugugcugggccauggggccacccucucccuucaucaauaugacaggccagggccacaggcagacaugugcugccugucagccucccauguacagcaggcucuuuggaaggccccacagcugauugccauuuguaauguugugcucuaagcagucauacugcacuuuaugagcccugugccuccacagaaacccaucuguguccguccuagaggacacagacagaaaagcaaagguacgagugugcugggguugagauaagcuuuaguggguaagugagaguggacguuagagguggggagacguaagggagcgaccaccacgagcugaggccugccugagggugagaaagagcuggcuaggugaggaguuugcggaagacccugcaaaaguaucugagccuuggucucccauggacugucggcagggugggcugcggaaguuacggguaagccaaggaugcacauguaagaauagcacccaggagggccugugacucaggccccuagcugaguuugguaaugcccuuaaucggcuuuuggacucccagaggggacagcagggcuggccacuucuuuucccuaacagcuggagacaucugugccagggccaaugucgggagggggggaauuggcauaacugagccuuuggcucccugaauccacuugggggagaggagaggacagcuuucugggggagaggggacaguguguucaggacuaaagcuugggacuccuggguccuaagggagaagacuggaacuggauccccgagucugagcaaggagagccugggccugggcucccugguguaagcaaggaggggcugagagggcagggauccagggcucugaggaagaaccuagcaggaggacucuguugagcugccuguccagcaggcaggaggggcaaggaguugaacucugggcucuguuuacagcaugugguucucacuauccuuucuggauaggaggugaagcaguggccacacccuaccccacuagucccucccccaguuuaucgccccaggcugcuacuggcacuagccacagaccugcugugccagcuuggggagcuccagucggaagaggccagggaggggugagugcaggcccaaccaagagacagaacccagggccuggaggggagaggagacacugucuucuagggaaacaagggguugcaaauccaggagccaggcagggcccuagacuuccagagggggguggggggaaucacucaggaagguuguaaugucccuaccaaagugucaagggcaacuuauccaagaugugguauucaagucuaaauagcaggaauacccaaggagacgcuggaagaagaucacaaaggacccugaaugugggaagucaagccaagcauggagccagacuuugaaggacaaguagaagcugagcuuccagaguccuaggaggagugcucuguauguaggaacucuggacuuagaaaucggugauuaagugggcucuguaauuaugcauacaaccuuuggcucuuugaugauccuuaguuuccccuccuguaaucuaugucugaaccagugcauccagggucuuugugggcaaucuaaaccguagcauggguuuggcuagagagaugaauauuuauuagcuauuugaacuguuguuucaggcaggagaauggaacaguguagucuaaggcaggugggcaaggcugaaagcuaggagaccauccaaagaagggaugcuggguuuagggaauccuacaggaaaacaaggagggaaggcuuaaguaaccaggagugagucccuggugcagagaggcugguauuguggauagggcucagaaggagggcuagguauagagggcaguccuaggcgauaguaauggcuggucuuagggaguaacguucccaaccauuguuagaagggaagggcuuauaggcaacccaggagacugagaaggaaacuuggagugggacuugaaugcgugggucuucagaaggagaaccgcuaagcaucccgauuucccagaacaagaaggacaaguccaaagacaguaaacaaagauaggaguucacccuugaauaccuggaaggaagaaggaagagggugggcccgccucuggaauagagggcucaggagauuggacuccuagauccaggaagaaggccaaaagaccuggucaguggguuucuaauucugaagaggagcuagucagggucugcucagucugagggcuucgacucccagcugcuagaaagaggaugaggaugcagccgcaggcuucuagaagacaaggagauaaauuccuaggugugagagagaagauaauggaaggccccugcgucuccaggaggauugggacagaccugaggaaggagagggcucggcuuuggacuccugcaucucagcaaggacgguccuagguuugaauacuugguuggccuagggaaagagaggaagggcauggacuccugggccugacagagcaaaggguaaccacagaccuucccaucuucucacagccucagcguucucacacagcauggauuuacgcacgaugacacagucgcuggugacacucgcagaagacaauauggccuucuucucaagccagggcccaggagagacagcacggcggcugucuaaugucuuugcagguguucgggaacaggcacuggggcuggaaccaacccuaggccaacuguuggguguggcacaccauuuugaccuggacacagagacaccagccaacggauaccguaguuuggugcacacagcccgaugcugccuggcacaccuacuacacaaaucccgcuauguggcuucuaaccgcaaaaguaucuucuuccgugccagccacaaccuagcagagcuggaggccuaccuggccgcccucacccagcuccgugcuauggccuacuaugcccagcgccugcugaccaucaaccgaccaggagugcucuucuucgagggugaugaaggacucaccgcugacuuccugcaagaguaugucacgcuacacaaaggcugcuucuacggccgcugccugggcuuccaggugagucccuugccccauguccuucugggcucacagugaaggcacugguggccuggaaccuguccuugagguaguguccacaguaaucacaauuacuagauucaugacucagcccacagacugguaaggagaguuggcaggaacucagaacugggcucuguggugcacagacucauggcucguaacuagaucuaccaugucucagaagccucuucaccagcugggccuggguaacucggcaggcacauaucaucagcuacuugggaagcugaggcuggaggauagcaaguccgaggccugacucugagcuugucucaaaaguaacaagaaagcuggagcuguaauucaauggaaaaagagcucucaaacaugcaagaggccagagcuucaaccccugagggcaggagagguucauuuguucuuuuucuuuuucaaguauuauggauugaacuuagagccucaggaauauugggcaagcacucuguuguuaagccgccuccccauucacucuuuuguaguccccuaaguuccuuugaguuugagccccuaggagggugaucaguucuugaucucaaaggucucuugugugggcgugcacucccugucgucuucacugagacucugggacugaaggaagaaggugccaucccacagauaucagauuggcaccugggcuuaguuacuauaaaaaucacaugauuucuaggcagcccucaggacagggucaacacaccacacccaucauaguuggugacaguggggaagacuugguuguggcugaucucuucccuggguucugaccuaagcuguggaccuuaugucuuuugcccauccuagaccaccucagaaagaugcaaccugucaccacacagaaagugaggcagcccaauacccucaagagguuaaaggcagaaggauuauuuaaagauagaagcuagccuaagcugcaucauauauauaccaggcaagccaagacuauauagaaagacccugcuucauaaacaaacacacgcaaaugaguaaauaaauaaguugggggauagagaauuguagaacauagagaacuaaagucagagcagaggccggagcugccccgucuggggucagugcuuguuccagggagccccaaggaacuauaucaagcuguaucaaggagcccuauuaagaauuccaggggcaccgggcgugguggcgcacgccuuuaaucccagcacuugggaggcagagagaggggaauuucugaguuugaggccagccuggucuacagagugaauuccaggacagccaggggaacgaagagaaacccugucucgaaaaauuuaaaaaaaaagaauuccagggccuuccucucucugccuucacugagagaugagcccaccauucucucagcuucucugucccuuccaccacucugauccugaacaacccaacacaguucuuucugggacuuuccccucacacacacacacgaacccuacgaauugugaugggcccggcagagccagccaucuuccuacuuugcuguccuggcaucaacacuggaaaaaaaaaauuccaggcugccuaaaucgguauuguagccacaauggccaggagcuccugugcucuuuggccuacugggucccuggccaagagcacagacugggccagcugccagcuccugaggacccagaucugcuagaauguaagacagcaucacccucuaaaaugucaacuuccaggaaggcagagggaggccuccagaucucagauauuacucaguccccgcccccucccaaagccuagcacgcagcggaacuuccccaauguuuacugagugaacaagaacucuacugauucuuuuccuuggccuccugaggcugaguccccugucugccaccugacauguaucucccagucuuccgugagagccaucuaccccuugucuaggccucagcagaucugcucaaguucuuuguaccugucauuuccccauuucugacuuuuaguucccuguaccuagcccgaacugucugcuucaccccuguuucuccugacuucaggaagacccuguaugcucugccuccccaguucacagcccuccagaugcaaggaauggaauccgucccucagccuagacccuucuuugccucucgggccucccuuggucucacucagcuguaagcacacuauguucuccauuccaugcucgcuucaguacugcugcuuccccuuucugcccgugcguagcaucgcagcuucugcuucugcacuggcucuggccucuccuggaaauaccacuguccuccuucagauccugacucccuggccuggccagguagcccagcccaugggcaucacugcagcccaugcaccuagugccauccuucauaucacuaguugauucagacaugucuuuauuuuguucaucgucuccuuccuuuugaggacacuagguccaugaaaggacccagggugaugcccacagcacaccacagcagcucaguaaaagcuuaccaaauguauguaccuacuccuaucucugucccaacucgugccccauccucaucccuguccuggguaguugggugacacaugcaucccuucacaguucacaccugccauccggccguuccugcagacucucuccaucgggcugguguccuucggggagcacuacaaacgcaacgagacaggccucagugaguggcagcuggacccugccuacacccucuccugucccccuuuucccaacccaacugagcaaucuggcugucaccagggcuccuugacaccccuucccugacucccaggugugaccgccaguucccucuuuaccgguggccgauucgccauagacccagaguugcguggggcugaauuugaacgcaucauacagaaccuggaugugcacuucuggaaagccuucuggaacaucacugagauugaggugcugucgguaagcucagagccaggagaaagcccgggcaugcuuacagauagacacugacucccagguggccagcgaagccacaaccgcucacuacagggccccaagcccaaggcgagcacauaggaagaacugggcugcaaggaggaagaaugugguuuguggugugugcccccaccgccuccauagcccuaccccagcguccuuucuguucccuccccagucucuggccaacauggcaucaaccacugugaggguaagccgccugcucagcuugccaccugaggccuuugagaugccacucaccucugaucccaggcucacaguuaccaucucaccucccuuggcacacacgggaccagcuccugugcuagccaggcucaucuccuaugaccuacgggaaggacagguaagccgcuagcuagccccagacaguagcagccccaccccagcacccugaagcccugagcuuacccugugggaggaagaaagcccugacagaucacaucccuccucaccaccaggacagcaagguacucaacagccuggcaaaaucugagggcccacgccuggagcugcgcccacggccucaccaagcaccccguucacgggcccugguuguucacauccacggaggcggcuuuguggcacagaccucuaaaucccacgagcccuaccucaagaacugggcccaggagcuaggagucccuaucuucuccaucgacuacucccuggcccccgaggcucccuuuccccgagcgcuggaggaguguuuuuuugccuacugcugggcugucaagcacugugaccugcuuggugagacccaggucccugcguucacacagauucuaaccccucccuugcccuagccauccuucuucaaccccuguccugucccggagaggcacuaagucccgaaggccucagccucugccucaucucuucuugccccucaccccagccaccucccuucugcugccucugcgacccuacugagggcuagccccacugcugcucaucuugcaucuugaccacuucaucucugcuuccugcucucuuaucccagccccucuccuccccucccccagcugcccaccuucugcucuccugcacugccagucugcuggcucacaugcccaccuauuugccagguccucacaugucccucuuggaaugccaacaucucaggaggacaucaaggcacagagcagaacguggccauucccagccuuaacucugaccuuugguuucccaacauccgaugccccugucuugggaaaacugcucuuagcuccucuuucccaccaccugcucuugcugcugccugccagacuccccagguccccaguacuuugucucuguccucugaccacuaccuaccacaaagguccaaaccaugccucuugccaguaacuaaaauggcauucugcuuggucuuaggaauuucguaccucaccugagagccugcucgugccaggcuaugacugggcucuucuccccacaacuagguucaacuggagagcggauaugccuugcaggggacagugcaggugggaaucucugcaucacugugucccuucgggcagcagccuauggagugagggugccagauggcaucauggcagccuacccaguuaccacccugcaguccucugcuucucccucucgucugcugagccucauggacccucuucuaccacugagcguacucucuaagugugucagugccuauucagguaagguccaugcccucagaguauggcagcgguaaugccugcaugccucagauacuccaagucuguggguuagaacugggccuaaaaaagagagaccaacucagccucccacaugcguucugcagggacagaggcagaggaccauuuugacucagaccagaaggcacuaggcgugauggggcuggugcagagagacacuucgcuguuccucagagaccuccgacugggugccuccucauggcucaacuccuuccuggaacuaaguggacgcaagccccaaaagaccacaucgcccacagcaggugaguuagagcuuucuccaaagcaccuagccaagacagcacagacagacaccuugacagccaccgagaggcugguucuguccuugguccuacaacaagcccuuaguuuuccacagcagaccacauccuggaaauucugcugcuuccccaggcaaugucacaauuccaggaauugccuaaaaaaaaaaaaaaaaaaagaaaggaaggaaggaaggaaagaaagaaagaaagaaagaaagaaagaaagaaagaaagaaagaaagaaagaaagaaagaaagaaauuuaaaaagaaccucucagggcccucacuaccaggaagcagaagaaagagcucugagaguucagggccagccugaucuacaaagcaaauuccuguucaagguaggugaaagccacacauugucucaauaacaauaaaaccauuccuucaggggccuggggagggauugcuuaggaaacaaagagcuugcugugaaaguaugagaaccuguuuggaucccaaaacccaaauaaaagccagguguaguggugcacaccauaaucucagcucugggugggcagaggcaggcaagucccugggacuggcuggagugccagccuagacaaaagcagugagcucugaggucagugaaagacaagacucaaaagcuaacauggggacuaggaagauggcucgguaccugcugccaagccugcccuggauucaguccucaggaucuacauggcagaaggcaagaacguacucuuuccuucaaauuguccuccacccaccagaugugcacacccacauacaaaagaauaaaagugaaagaaaaaaagguggacaguggcgugaagaauaaugccucaggguuaucucuggccacaugcucacacauauauacaaaaagacagcucacauuuguuuaauuuuagaaucuucagguggacagacauauaaacacaaguuaaaaggaaauugaaucugaggcaagggaccccugaguccuggggguaggggucuguguagaaaagaugacccuagaggcacacacuccagcccagcuucucacucagucagugccucaaugaguuaucugacaaauauuagcaucuauaacccuuaguuuguuccucuguaaagugggaacaaguguauuuaccuugcugggucauagugaagacuacuauacccauuuguguuaaaugccaacacagucccuggccgucaggugccuuagaagauacuagaaucucaugucuaugucugcaguucuguuccagugacucugggucauguagcacuuaagugauuauucuuauauuggucugcacuuugcccucauagauugauaaaggcaaguuguagcuaggaguauguguagugccgcacaccugaggcaggaggauuccaauuugggcaauagaaauaaaacaguauaaucccuaaaauggcaagcaguaggaauccaauuaaauuaacagacaugcacaucaccccugcacuugcuugccugguuacucaguggaaagagcuaaggccauuuuggagagcagacccaugaaaguagcauacccuggagccuuguuagcugccuggaaacagaagcuccuuucaguuguaugagcucauucauaccuuuuggucaaguagucuuaagaggcuggcugagcuuucugcuguguggagcccagaggcagcucgagccagagugcugccugacagucaagccuugcucccagccuggggauguagcuccgcaguagagcgccugccuggaauccaccagugagggagggaggggcaagagccuaggaacuagccugugcaaggacuaugugcaccacagagacaaaaauuaauacagaugcaucuugauuccucuggaggaaagguugguaauccuggguucuuguauucuuguaacuuaaaagcuaaguacuauaaaacauuuauacagagggaaaaaauggaagcuuucagaagucaguugauuugcacuucccagucuuaauacaugcacacccuccacuauaacacagccccaccuccaagacuaccagccuuaggauugcaacccuggauacagaaaugucccauucuggagggggugguuggucccggacugcccccugucuggcauccacacacccuacucacggccaggcuuaucuucuggccucaggcagccucugucuuugcuuuuccuauagagucugugcgccccacggagucuaugcgcaggagugugucugaggcagcccuggcccagccugagggcuuacugggcacagauaccuugaagaagcugacaauaaaggacuugagcaacucagagccuucagacagccccgagaugucacagucaauggagacacuuggccccuccacacccucugaugucaacuuuuuucugcggccugggaauucccaggaagaggcugaagccaaagaugaagugagacccauggacggagucccccgcgugcgcgcugcuuucccugagggguuucacccccggcgcucaagccaagguguccuccacaugccccucuacacgucacccauagucaagaaccccuucaugucuccucugcuggccccugacagcaugcugaagaccuugccgccugugcaccuuguggugagaacaaggccgcuggagggcagugggaugugacuugggcgaccuggggaaaagagcuagccaaguaccacuuagccagccaggccagggagucuugucauuugcagauagauguguugggcaggaggcuugagcagguggaaaauaugggugggacuggguaaagguggaggauuaaguuaaccaccgccuccaccguguucucugcccacucccuccccaaguccucuuaccccacccuuaccccaccccacccccacccccacccccgucccugccucggucaaccuucacaucugugugcacgugcuuuucccucccuccuacccugaccaccacucucuucuaggcuugcgcucuggaccccaugcuagaugacucggucauguucgcgcggcgacugcgcgaccugggccagccggugacgcugaaagugguagaagaucugccgcauggcuuccugagccuggcggcacugugucgcgagacccggcaggccacggaguucugcgugcagcgcauccggcugauccucaccccgccugcugcaccacugaacugagcuggggacggcggggggcggcacuaaaagaccucuugcucccaucugcgcgggcuuccguuaugagugcgcuccgagaugggcuccaggcccccucagucgggcugggcgggcgggagugggcugugccuuaacuugagacaguaaguggggcgggacaggggccaaaagcugaaccugggggagggacacacacacaccugucacugagacagcuggaucugcacucuaccacugccuucugcugcugugaccgacccggcuagucgguuuugccuuuuguaaauaaaaguuauuuaacuaggccuuuuaaaaauagggaguguguuuucccagcagauggcagcacugaacuaaaguugcugcgaaagggaaaauuagaauauguggaccccgacucuagcuuugcucacaaacaaaaccaccuaauaugcaagcucugccugccugugauugucauuaaagucccaucagccuggcccccaaua

SEQ ID NO: 3628 - RNA, 1275 nt, Mus musculus
ggggacugggucacuuggaccuugcuacuuccugcucuucaguccaugguucggacuauggagccgugggugcagcugaagcaggcuggacuggagcccaguggauuggguccacuccccaaggcccuaagggugcccccgccagaagggaaccccggucaggcccuuaugucuucaggggcagaacuugggggugccagggagcugauucuauggaucugggaggagcuggugagugagggccuuagagagauaggagagaacgaggaacaugagugaauauugauaaagguagacguagccgaggaucagcggggccugggccaggguggggacagagcaugagagacaggauuggagucagucucggagaacagagauagaaaucagagacccagagcaggaucagacaggaccucagauggaaugggggcugggagagcccaaaggcaaggaugagaaaacggagccggagaugagacagaggugagggcccuggccaggcaggacaggacuugagcugaaacuugcccccauggagcucuggcaggcuccccguggagccuccccaugguguuccuuuauuccuacaggggaaccugcgacgaguggauguccagcuguugggacagcugugugaccugggacuggagauggggaccuuucgggaagagcuggucacuauccuggaagaggaggaagaggaagaggagcaggaggagaagagcuguguugaagagaacaaagggcccgaggagaagcaggacgaagaacguucccggagcuccuauccagcccagcgccucccugacuucgagaugaccaucugaggucauuuagcuugacacgcaaaugagaugcaaauucaugcaaaggaaaaaaacggagauugagaaucaagggugcuccuucggcagacccacaaaacaguuggagauccuggcagggaccugggugcugugggcaggugugauugcagauuugggaggggcacaaaagccacccgugugucuguagagauguugcagugugaccuggagaccaggugcuuggcugaagugacagaaucuuggcagacagguuugaagaccaauucugcguagugugguaggccccauggccgguaagcaauugaaacgugguggguucggacugagaugagagguggacaaaggucaaacaccucugugguaaaaccgaucaacaguuuaaacagcucgacaacuacagguugaaaugauauucugaauaugugaaauaaaauauugauuuuau

SEQ ID NO: 3629 - RNA, 6141 nt, Mus musculus
gguaaugugaacagcagacguuuaauauaaagaaucacacauuuccacaguguauuggguucaugacagagccaccggaaacaugggcgccaggaucaaucacaguugauaggagugccaggggaagcugcuggccacccaacagccugggugcugggcaagugcugcccucccugcuacacucuaaaguccccgcacaggucucuuuacuuuggauucucuccggcggucgugccagaaagagaauauuuucucaaauacucaucuccaucuggggguggggugggcggacacacugggacucccacauuugaaggugcucaucaguaaaucaauggguaaugccauggggcucggggggcugcuggucucuaguccguguaggccagcagugucucaugucagccacaguuccugcugauguguaugggcagaguuugggggaaacgguggagccgcaugcagcugucacagcauggagggcugucugcccaggcaacagauguuugccaguugcaggcugcagucagccaguccugacucagucuucuuaucuucccaugcugcuccgugcugaaugagcuacaccagaagccagacugugagaagacuucagacucuccacagagcccacaagacccuucaagagcugggccacaggcuaggaagagagggggguagaugugucuggaggcugcuugucugguuccagcuugagauucugggcccagucagcuccaaggaccucacaguggggcaacaucucuuccaccaggaucugagugagaccugggugggacacggcagggaggucugagauguccagccugcggagguuccugaagggcaagaaggacagacgugaguggcuccugugugcaugugaagggugggguccggcccuaacuacaacuucucuuuuuuauucugugugucugagugugcacuugcuaaggaagggauccaggaucuacugcugacccacagcccuaaccccuuacugguacauucuaauccaacaccguagcucggccgaguucgcagccccucacugggagauucuagguaacuucuauaccacugagccacgcuccuggcucuccaggaaaacucuauagcuagcuguagaguuaugagaaauucacugcuaacuguaaauaccguucuuuggcuucuccucucccacaacagugugacacacaaagucucaucuauauauaaaggcagccaugccaggagucaccgaguccuucucagcugugcucaccaaccccgggcacuagaucaggguucaggcagauggcuaguaguaccaaggauccccucccgccucugcccugugccagccugagcagggaucuuacuggaggugguggaggcaggcaaggccccguucugagauucuggggcagccagccagcgagagcuccugcagugagccagccaauagguagaggcggcugaggcaccagucguccagguuggggcagcgcugcagggacagggaccgcagcuccuucaggggcacuggugaguaagaaggcagguggcaucaggggccuuucuggagggagcccaaugccgaagggaaacccacccauuccggcccacucacagagguuacucaggcccugguaguugauggcacagccacuggcauccacagccuccacaggcacauucuggaacuucugaaucucggcgaggaaauggcuacgguuauuuggccggauccauuccuccuuguccugaaaccuagaaggaggaguggcugagggucacugcccagcuucccauggguggccacguggcaacagugacaagauggcauucuucauacucuuucacacaggaugccagaagccccagauauugcucagcaucaggggcugaggugcacacaacugcaugccugaaagcccaauguuugggaggcugaggcaggagcauugggaauucagggccagcuuggccuucagaguaagaccccaacacacuccccacaacaacacacacuaaaggaaagagcuacacgcacgaguucuuucaggcacauuucauccuaaggauguuggcacaggcauucaaaccagguagaaagaguaaacagaaacuuuguauuuucccagagagaagaaaacaaaauaaccaaggggcugaccgauggcugaguggaugaagcugccugaugccaaggcucacagccaguuaaugccuggggccccaagagcggacagagagaagggguccccugaccuccaauacagcagcacacccccauacacugaauaaaugugugugugugacaagaaaggaaggagaaggugcauaaagacuuucucuuuugagacagggucuuggaucuuguuauguagcuccgaguuuauaauucugcuucugccucccaagcagcuaggagcacaggcacgcacacgucaucauguccaguuaggagacacugacgccccugagcugucucccauccugggaucacaggcacacaccaccacccagcagaaaaacacuucuuuuugcuuuugccagacaggguuucucuguguagcccuggcuguccuggagcucgcucuguagaccaggcuggccucaaacucacagauaucugauugccucugcauccugagugcugggauuaaagguguguggcaccacgucuagcuguauauaacuuuuuaauuauguauuuaaagacgggauuuuaaggcuggccuagaacucacagggagccagcugccucugcccccagagcauugggacuaaagggcugguuguuaauuuaaaauguauuuguguggauguauuuacaugucuuugugcauguguucaagugcaugcauguaagccagugguuagucaggcaucuccaucaguugcuuucccaccacacuuugaaacagcaucccucacugaacucagagcuugccagucuggccaggcuagccagagagccucaggaauuguccaguuuuuaccuccucaacucagagcuccuucuaaaugaugaacugaggucuaggagcaaggcccccacugcacagccaucagacagcagaggcacucugccccauccccacaccccaaccccacaccucacccccacugcucccauacuucacugcgccucccugcuucaggaugaagacagcaccugcaacauacgggccauauuucuccuggauguuagugaaggaucugcagagaaaugagagcagagaugaagccugggaccucucacuguguaccacugugucucgggguagaccacagggcaccaagcaaauagagacuaggcuggcugcaaaucugugugccauuaagugccauguauugggaucacagugaagaccaaagcugacaauagucucugccuguguucaacuacaaagcgggaaguagcagaagcaaaucccagaguuccaguucugagaugaggguaaaucaggcagccugacuuuggacacucauuuagaggagauguuaaaacucacuucuuggccagguguugcacucacaggaggaaaaggagccugaggccagcuggcccgagcuaugugacagccucucuugaaaacaaaacaaacaauguugaggcuagagauggcuccacuccgcaguaaagcccuccucccugcccccugcacacguugcuucccagcugacaccauaaaugacugcaguggcaggaaucggagcagcucccaugggcucaucuuugagugcuugguuccccccuugguagaacuguuuggaaagauuaacagguguggcuuuguuggaggaagugugucacugggguaggggcuucgagauuuuaaaggaccaugccaggcccagucucacacuuuccucucugggaucucagcuacugcucuagugccaugccagcuuaaggccaucucccaccacgaugcucauguaaccuucugaaacuguaggcaggccgccauuuaaaugauuucuuuucaaagcugccuuggccauguugucuucucacagcaauagaacaguggcuaagacacuaaccuuaaaaugaaaggaaugagcaggcaggccacacagugaaguguuggaaaccugggggcugacccugggaauccucuagcauugacaaacuagaugugaaggcagagaaaagacaaagaaaacaccuuaaaauucacccuuagcaacuggguggccaggggcaccuacucuguggauggggacagcuugagaguaagguuucuuuuaaaugggagacaugagagaucugaguuguagcugagugugucugagaggccagcuugacccccaagcacagcuggugguggaagugccuauauaaugagucuuagaggagggaugggccagcgaugaaggcgugagcuugucaugcuggcaguggaagccacagcccggcggaacuggggcucuggcugggaggucuggccagcagggucucaccgauucucccuguugacuuuugagaucuguuucuggagcaaguacucucucagagucuggauguccuggaaaugaucugagaggaacugcaacagcguucuuuucuucucccgacugcuguccggggucaccaacucacucaugccauggaugcgccuggcucugccauuccauucucgggcgcccaggugcaggaccuggagaaggggagagggaaaggacugagguugaacguggagcuggguuccaccccuaacucuuacagcauggccuaccuugaaucucagccugugcuuccugagucuuuuaaauccuucugauaccacucccgcccuaauauggggguguagcucaggacuagagucucuguuuaauauucauaaggcaccguggucaguccccagcauguccacguccucaauccuuaaccuuugggauucaaaacauuucuccaaagucuuccauuuaaccaaccauaaauucauucuugaaugcagccagucuugguuuucucagguucuucuaauuucccaccaaguccuuauuuuuuuuucccaaacuaccauuauacuuucauuucucaccaguucacuccuggggguuggggugguggugguggaauacguacgugcauagugugcauucaaauguguagguguccuugcacgaaugugcccauguauggaggccagcugucuuccucaauugccccuggcuuuauagaucaaggcagggucucucacuuguaccugcagcaccccaacucagguagcccagccaguggguuugcuugaggaaucaacugucuuuaccuccagagugcugggauuccaggugagcagacaugccccgcuucuaccaacucuggccuucaugccucaagcacaugugcuucaauaaugaaccauuuccccagcccaaauuuuacccaguucucccuaggauuuugccaaauggcugauuucuuugccauccuguccacguaaccuucaccuuuacagguagcgcuggaaauggaacccacggcaaugaguaccaacaaaauacucuacuacuaaauacauucuccagguuaacgaagcucuaggaaucccccucagguucuuccucggaccuccaaauuaacuuccuggcucccgccugcacacccuguucuuugauuuuuguuuguuuccuauuaagguuuaguuauuuauuuacaggcaggauuuuacguugcccugccugcccuccaacuugauacacaaaaggauaaccuugaacuccugauccugcugccuccaccucccaaauacugggauuacaagauccuuaaauuccccccaggaauuucgcgcaaaagcaucauuaguucuacaucaccuccaaacccuuaucccguccuuuccccccaggaagagcuguccuacuccgcugauuggcuaagccacccucaucccauugguuucucuaucaagcgacucgagacucucuguggcccucggcagccccagacggcgucucccgagcgagguccggcaggagacgcucuguuuccgcagacuuuuguuucccaggaggcugagagaggucucgagaaccgagcuacaaagugaaccauaguuccgggacgcggacgcugcggucaccuaccgcucugggcgccgccaucuugccagguaacguaaacagaagaggcag

SEQ ID NO: 3630 - RNA, 29039 nt, Mus musculus
gaacccugaagguucaaguuaaguuguccuuuuaguugccugaauuaggagcaacuagaagcagacgaccggagcaauuuuagagacuaaaaauugccaccuuacucauuuaugcgucuuugucgcaaggugguuagaagcagauagcguguuggccuagcggugcugcuauuugaauaaggcaucuggugggacagccguaugucuauccugugagaaaggaggagugguuauuagccaagauggcgauagugaugucugcggccaagaucuggaggccgagccguggccugcgccaggcugcucuucuccuguugggacgaucugggguucggggcuuggcuagaucugugaguaucugagccccacggggucuuucuuagggagaaauagagacguaaaaguuauucuuacauugugugagacaccgcgggcugugaaggaaagaaagaaaagguccgagaaacuucuugaagagaaauucaagggaagaaucccuuuagaggaaaagcaaggcagcuacuugugggccucgauagaaggagacgagacggggguugaaaggacagaucagguuuucauaggguccuacauugcuuaaauuccaacuguaaagggaguugagcaagaaacugguuugauuccuaugccaccugaucaaaaggcaaggcaagggacuuugccaugacuguccuuuacacaagaugauuaugaagggagacaaagagagcuacaaguucaaacaggacccuuugcccacguuauuuuuuugagacaggaucucacccacgaguccggaauggccuuuagcucacccagaugcuuagacaggcaucgaacuggagauaguccugucccagccucccaaguacuggcauuacagauguaagcuacggugcuuggcugcccacuuuucuugaaaacacuggagaaaacucggaauucccuuuugauccauuguugauaagggcaggauaacacuuccaaaaucuguugcggucuggcaauguaccaccacaguguagaaugcuugccuagcacgcgccacguccagaguuuggcuccuagcccuguguguuuguuuaucuggauauggcgacacaugucuguaauuucagcgcuugggaaguaggagaggaggcauuugaggccagguugaguuacgugagacccuaucucaaaaaaaaaaaaaaaagauuuuuaaaaaugguuuacuuauuuuuauuucacgugcauuguuguuuggucugcaugaagauguuggauucuguagaacuugaguugcguacauacagacaguuuuggacugccauauggguccugggaauugaacccaauuccucuggaagagcagccagugcucuuagucacugagccaucucccugcaccccccaaaagauucuuuuuaaaaagaauaggaccugguguggugauguaugcuuuugauuccagcacuuaggcaaacagaucucugugaguaccaggccagggcuacauugugaaacugugucuuuuucucuuuuucauuuauuuauuuauucacuccacaucccgauaucagcucccccucuccucccagccccucccccccccuuacagcuacucuuccuguuccuuucccccuucuccuuuggaaagggggagcuucuaucaccuccccagcacaucaaaucauugaaguaccauacaccaacgcuagacaaggugguccagccaggggaaaagaauccacaggcaggcaacagguucagagacagcccccauuccaguuauugggggacccacauaagaacaagccacacaaguguguguguguguguguguccagguccagccagugcucauucuuuaguuggugguucagucacugagagcccccccccccccagaauccacguuaguugacucuguggucuuccugugaagccaccauccuccccugggcccccaguccuucccccaacuccuccacaagacuccccaggcucccuccauguacugcuuggcgggggugggggugggggggggugggggggggugucucugaaucuguuuccaucugcugcugaguguagcuauuccaggcuccugccuggaaguauaacaaaacaucauuaacagccucagggaucggcuccugcccgugggaugggucccagucauuggucagucauucccucuaucucugcuccauccaugucccugcacaucucgcaggcaagacacauccugggucaaggguuuugugggugggucccuccacugggaguccugccuggccacaggcaguggccacuucaggugccauauucucagagucguccccauagacucccuggggccucucccaccccacccccaggacucuggcacauuguaaagacaacucaacccccacccuaccucugcugccaauuuccaucgacuucccugcucucccugcaccugaucccccuguccuguuccucucugugaauuacaggccagucuggucuacguagaguuucaggagcuauagagugagacagucucuuacaaaagaaaaauuuuguugguaauaccugguuagagggcuuugaaguaaauuuccaguggaaacaggucugguuaaguggauggggucuagagcuggaccacgugauuuuugccucucugcucugccacuuuccaauuguguggcuugggccaggaacuguaccuugugccucuccauacacugccaguauugggcacuuccuaggguugcuguggaaauaccagcuugucagcaguacagauuggacccgguacaaaagggcaguaggacugucugacuuauauuaguggugaggaccaagaccacagagauugggagagggaaagaaugaccuggagagugggaacuggauuggcaaugcccuggcgaagcaucuccaucuuccaugaggcugcggucgcuccucuguguguuucauagggcagagaagacagggucgggaagagaaggggacgagcagaggugagcaggugagcaggaugaggaagauuggcagcggaagcaagcaaauauagaaagguugcuggagccaguggggguggggcaggcuccugcuugugugcuguucucuuuuuuuuuuuuuuuuuuuuuuuuuggcaaucaaauccuucacagcugauuucagucccugaacucauuggcugagcagguaggcugagcuuugagcugaagugagguacccuagggaaaggucacuguggcugauuaaaucuguuuuccugcuggcucagucuccgguuuuuguccccauauuucuuuacuuauuugagaggacauuuggaagaacggcaggagggcgcagucuguagcuuucauuagucuguauauuuacauuuucccauuccccacccucccacuuuggcaguggcuuauguagcccaggcuggcuuuccagcucccuguaaaccugagcgugaccuugaacuccugcucuccuugccuccgugucagagcuagaauuaaaauugugcaccaccauggcugcuuuuuuuuccuauuaauuuauuuauguauucacuuuacaucccaauaucugcccccuccucccagugcccccucccacagcucccccuccaacucccccaccaugccugcuucuauguggugcggggauugaacucaggacuuacacaugccaggcaagcgcucuacuuaccgagcuacauccucagccuucucccuccuccucucacccucccucucuucuuccucccuuccuuuuugcugggggugagucuagaacugauucuccggccucugcaucucagaugcugggguuucaggcauuugcuaucaugccugacuuuauuauauucucucuuuugauuucauucuuuuuguuuuugaucuuuuugagacaggguuucucuagguaacccugacuguccuguccuggaacuugcuuuguagaccacacuagccucagacacacagagaucugcuugccucugucucccaaggcugggacuaaaggcuuaugccaacacaccuaguucuggcuuuaaaacuccccccccuccccccccacacacacuuuggcuuuuucgaaacaggguuucucuguguaguccuggcuguccuggaacucacucuauagaucaggcuggccucgaacucagaaauccgccugccucugccucccaagugcugggauuaaggcaugcgccacaucugcccagcuaaaacuuuuuaaaaucuucuuuucauacaggauacuuugaucgccuuucacugugcucccuguauuuguuuuucuuucacuaggucuguuaauaaaagcuguuuuguuaaagaccagcucuugaggugcagucuggcucccggagaauuuucuagcccaggcucauacucaggauccuccugccucagcuuuuccugccucagcuuuuccuaccucagccuucagaguacucagcucacaggcaugugcugcugugcccaccccuuuaccuuugaguggcagcagcaggcuuggggaguagcagaaggagauuuuuuuggacccacgauuauccagcagagcuuucccagacaguguagaugacuuguauuugugcugcccggcauaguagcaccagccauguguggcuacccagccgugaauguggcugguacagcuuuagaacuguggguuuguucuuuuugagacaagguuguccuaucuguaauauaaucaggcugaccucggacuagugguccuccuggcugagcucuuaaaugcuggaauuucaggugugugcaccugugcucaauucgaagguuuacuguuguuguuuuaauuuuuauuuaguccuugaaaauguuauucaugucuaccauauauuuugaugaaacccucuccaccuuccccacuucaguucugccuaggguccucacaugccuugagacucugcacccucuuaggcuuguuuguuuguuucuugaggcagggucuaacuacauaaccauagcugucccagaacucacuaagugggccacacaggccuggcacucacagagauccaccugccucugcuuucugggugcuggcgaguccaguuaauguugcccauacaugaauuggguauagacucauccacuggggcuuggggaaccuaccaguggccuaaaagaaaaaugccuggcucuuccuucucuugcagcuggcaacugcuaacagaccuuuagccaggaaugggggucuugagcaucuccccaaaccuugcuggaacuuuuaaccggcuucaucuuggugcagaucgugaccacgaucacacgugaccacggcugcuauaaauuauguuugcaauagcugugucacgaggauacggauucugcagcagcuccucccauccugcaugucuuauguccuauggucuaaacauuaauauuuagaagacagcuugacagcauggccauuuaggaaaauagcaucagcagguucuccucugguuccugcggcuucccuagugaagguuuugaccugcguuccuguaccagguauggguuccuuccuguggagcaggacuucucuucacucaggagagcaguugguugccuuguaaaccgucuugccgcagaugugugccagugagcacaucucacccagcagguugugacuguagcguguggagguccaagacuggauaagucgaugucuucuccccagcugccugcacagcaucuggcauagugaaagaacccucagccucuguugguggggauguaaacuggugcagccacucuaaccuugagucgggaggguucuuaaaacuaagcagaucuaccacaugaccuggcuguaugguuucugagcauauauccagcagaucugucucuuacuauggagacacuuguacauccuuguucaucgcugcuccauucacaguaacuaggaaauaggaucaacuuagauguucauuaacugacaaauggauacugaaaaugugauauauauauauauauauguguguguguguguguguguguguguguaugcauauauauaugcacauacacauguacauauauacacauauguguauauauacacauacauauauauacauauauauguacauauauauauauacauauacauauauauauauauauauauauauauauauauauauaugcacacacacacacacacacacuggaauauaacuuaagcgugcagagaacuggaaccgugaagcuugcaggcaaauggagcugggaaaguaaggucacucaggccacaaaagauaaacgucguacauuuccauggagguucuaagcugcaaaucuuuuauguucuuaacaugaaguagauauggaagcuaggaagguaaaagagaccauuaucagggagugaggaacagaugcauuuagaaaaggggaacccugggggccaaagggcucaagcaaauagugccgcguccaggauggggaacugaggggccgggcaaagguaaacaagugaagugugcacggagaagcuacuucagaaccugugaguuuugcgaucuacuugaaaaaaaaaauacaguaaggggggggggcgguagaacaugcgugcuugaaagaacagggaggauacuggaagcgaaagucuuaaguucaaauggggacagggagguggggggagaggagagguaggggugggcuagccaaaacuaagaaugaaugaagaagccuuacgaaacccuauuaggaggcuguagagguggcucggugguuaagagcacugucuguucaccugaaggucccagguucaguucucagcacucacagggcagcucacaacuccaguuucaggggaucugacacccucacacuaauguagauaaaauuaaauaaagaaagcccauuaguuuaacaagcuaauuaaaaaaaauuuuuuuaaaagaaaguucaaacagaaguacuccacauuaguacccuuuuauuaacacucuuguucccaggagacagguacugaaugacagugucagugccaggcacggcuguuacuggucaggcaggacucggagggacgcagaauggcacagguucccgcauugcucuuggcugucuacugugacuguauaguaagaccgcaguuugguuugggaacacagagaaaacuuuuuuuuucccucuagugcaggcugaucucagacucgcugcauagccugugaugacuuuaaaacugguggcauuucuccugccucggcuucccaaguggcgggauggcaggcaugagccgccauccauggcuggaaggugcaguuuuauccgguuggggaugaagagcugaggccuugggagaaggguggggagguuauucagcuguggcuuggguagaguggaugacaagggcuagugggucaggaagagggacgaggcacacuguggcccugugggguuugcuggaucugcgcuugucuuccccugcugcuacagcagaugucucugcuguucaaggcuaagaagaggaaggaaacucagacugugagagccuggccugagguggugacuguaaaucuuguaggcacgcaggcauucccccaucccauccacccuccccccaaaaaagaaagaaaaaagagaacaaacgaacaaaacaaaacuaaccaccgucucgggcucuguugguagaacguaccagcacugccuuagcugagcagcgcagacccauaauucuaaugcucaggaagcagaggcaggaggauugcagggaacucccagccagccagggcuauguggcaagacucugcaggaagcaaaaaagaaaacaaaaaacaaacaaacaaaaaaagauucacccuuaaggccauugaaacggcucagagaguagaagcagcugccaucaagccuagugacuugagcuguuuccaggaccugcaugaaggcgagagagaaucaacucccacaaguuaccucacucuccaucgcacgugcacacccaguaaauaaaaguguaguuuaaaaaauuaaaauggagccgggcgugguggcgcaugccuuuaaucccagcacucgggaggcagagacagguggauuucugaguuugaggccagccuggucuacauagugaguuccaggacagccagggcuacacagagaaacccugucucaaaaaaaccaaaaaaaaaaaaaaaaaaaaaaaaaaaaaauuaaaauggucaggugugguggcgcaugccuuuaaucccagcacucgggaggcagaggcaggaggauuucugaguuugaggccagccuggucuacaaagugaguuccaggacagccagggcuacauggagaaacccugucucgaaaaaccaaaaaaaaacaaacaaacaaacaaaaaaauuaaaaauggcucagugguuaggagcauggucuguucuucuaggggacccagcacccacacaggcggcucagaacucucuggaacgccagcuccaggagaaucagcacucucacgaagacaugcaugcagacagaacaccagcacuuaaaauaaaaauaaaucaggaaaaaaauuaaaaacuuaaaagccagguccacugucuguagcauuucgacccucaucugggagugcagaggugcuagggcgcugagcaaggguggucagagccaggcuucugcucauugucaccgauggccugcuucagcgcucugaaggcucuccaagugacuugccaagaggagguaguucuuacugaggucucuccuguuuaggauaaccuuuggccuggaggcuaaauguagccaaagacagguauaaauguagcccaacauggaauuauaaacuucacuaaaacacgaugacauuauuuuuuucuguuuguguguguguguguguuuugcuaacuguggugaaguucuaguuaaguguaguuuguagauaacaguguuguguugcaauguuaagccguuggaugccccugaggguguuggcugaugucuuaaggaaucugguguggguuuugcacauuaugaaacacuuugugauugauaguuucaacacacaaagugcuggugcacugcuauuaaaaauggggaaacaaagguuuagcgauaggaagucugaggcugggacuccaaagccugaguccuuccuggcugccagggagagggggaagcucaggcgcguuggucucacaagacacugagccucacccugaccucuccacagcuucuguccaggacacuugcuucuggugggcugugcuagcuucagaagagcuaggcucaggccgacagcacuccucccccacacgucauccacgcuggccacuuuuguuuguuuguuuguuuuugagacugcaucccauggugcaguccuugcuuggccucugauccuccucucugcgucccgagagcugauauuaaaggugugcaccacaacacucaugaauuuuguuuuggaauacaguauuguugaccuaagaagaaacgucuuuuuugaggaggagauggcacgugcaugccacugugaauguucacaggucagaggucagcuuuggggucccagaggucaaaugaucaaacuucaggccaucagaauugguggccuuugccagaugaaacuucucucuggcuuuuguuuucuuuuucuuuuaaggcagggucucuaguagccuagguuagccuugaacugagacuggcuuugaacuugucaucuuccugucuucacuucccuuguguaccagcaugccuugguuuuguuucagguugccuucagugcuggggagagagccauggaccucgcgggugcuaggcaggugcgcuccgccccucacuaacucaguguaagggucuuaccugggaggcguuuugauucuaggagagagaagacugucucauggagcagaaguguuccagucacccgagcagcuuuguuugacagacagugcaaggaacaaagggucuauucacacuaguuuuucuuguaggagauggaggggugaaaucaguggaggagcuggcuggugggcaccaccaggccccacgccugcagcuuguuuuggcuggcugaccugcugguuccucaguuugggauuguacacuuuagauuuccuugggcaaaaccagaaauacuucccuuacauagugcuggcaaggguuaaagagagauuauuuuguuuguuuguuuuuguuuuuagagacaggguuucucuauagcccuggcuguccuggaacucacucuguagaccaggcuggccucaaacucagaaaucucccugccucucugccucccaaguacugggaucaaaggugugcgccaccacugcccggcuuuuguuuggguuuugagacaagaucucauccugggcaacccugaaaacucugauccucguaccuuccccuccaagugcuggguuuccuuccgagugugggccaucacguccaccuagagugcauauggcguuguuucccuggagucgugcuauguaguccaggcuggccuggaacuggaugcaguucugccccugcuuccugagugugggcuaaaguguguguguguguguguaugugugugugugugugugugugugugugugugagagagagagagagagacagagagagagagacagagagagaggugugugugugugugugagagagagagagagagagagagacagagagagagacagagagagagagagagagagagagagagagagagagagagcacgagcgcuuaacugcagaugugugcuugcuauggccaaagauaucagaucccccuggagcuagaguuccaagcuagagcugagcuugcagggaacugaacucggguccucuguuagagcucgcaagagcucucacgucugggcucucucucuagccccaagagagcgguucuuaggggcacucagucuguguuccgagcauugacuaagucaggauuuuagagauggcaguuacagcuuuucuccagagacacuggcugguuucauguugacugauucagggaaagagugaaaugcucucuuggguuucacaccugcagcacccagagcuguggcguuaaaaaccacugggucucugaggcccagggagcccgauugcuuuccuagcugagcggcaaccucuagggggcuguagcucccugcugccugugcaggccuagugccucagggcucaaggcucaguagguguggauguuuuuggcucuccuccacagagagacacagagaagauguagaguuggcuggcccaccccaugauagaugaguucugaacccuaccuucuuuguucaggcagccccugcacaugccagccucaucaccugugagcuguguggcuuugggcaaguugcuuagcccuucugagccucaaauaccagcuguguuugauggagguacuguggggggcagggcucagugaacacagagauacagcuucguguggcaccuguguucuuaguuguuuuuguuuuugucucuuaagguucauuuuauuugcauguguguaugugcacguuuuugugggugucugugaagacuagagagagugugggauccccugaaguuggagcuacagacaauugugagucagcugauaugggugccaggaaucaacaucugagccauugcuccagccccgugguuggcucuuacggaccugccucagucaucuugguugccaguguuccccagugccaggccuagagccuguuucuguuuguuugguuuguuuugguuuuuguuuuguucuauuuugagagggucaugucuuauagcccaggcuagccuugcacuugcgauccuccugccucagcuuccugaugcuggccuaacaugccuguguaacuccacugagcucuggagucuuuguucuuccuuacacccaaaguacuuugucacccuugccucucuuggccugucuagcaauuucucucaacuccccucuuugagggaacuuuucuaucacuccgcguggaguggcuggugacacuugcuacaaggcaucagugguguauuaucccucagcccacaggcagcugucuugucuuuauggggcguggguucagggcaggagguuccuguccaguguccugugguuggacagaggcagaccugggauucgaaccaggcagguuagguguagcugugaggacacccuguuuuucucggcaucuauuacacgugcucccgggcaagcucucauccaagcccacgguaaaacugcuuuuuaucugccugauugacgggaacagucauccagcauaccuguuaguggugcaggcuugccauacgucccuuccgugucagccccugggcugaaucacguguacaugucagcucaugccaugcucaugguagcccaugagaauguacaccagaagaagaaacugaggcucagggagucaucguccuacagcuuuugccugugcuguuaauuaaggcccccaugggaaaggcugugcggauaccucugcaggcugcccaggcugcucagcuccuguuggaguuccucuggcuucagggcuuugucccaggcugaacaguuuugccacccuaugucacuggccgccaggcaacucccugccuccaagaagaggcagaagagaacuaugaugaucauuggauguggucauauaccuucucuguaggauugggugggggaggguuucucugucacccuggcugaccuggaacucacuuugcauaccaggcuggccucaaacccacagagauccgccugccucugccucccaagcgcugggauuaaaguuguacacuaccacugcccagccucuguagguauuuuauugcccauucuauaauccagcauccagugucauuauugaccaguuuuggaacucacugaauuagcacagugacuucauggggguaaaggcagcccuuuggaaagaggggacuggagaacauggucugugccugcuccaguaugugaaguccaccuggguaucugaaugguugcaucagguccccugacaguguguccugcuuggacaccauagcucauucuuagccuacaggcucugccugggacuccucacucccaggcuaucccuuuagcucuccucugucuccucaugauucucucugagguuuguuaggggaaagucuggaguccguuuuuaauuuagggaguacugguucuucucugccugucuucccaaggcgccuaucguuucugauuuuccugcuuucuuaccucugucuuuuggugggguugaucagguuuugaaaacaggucucaguaugugggucaggcuggccuugaacucauuauucucuugcuucagccuccugagcaggugccucagggauucuguugccgugaagagacaccaugaaggugacauuggagguaccaccaugcccuucucucuuaccacuucucaaggacauacucugccaggcccacaugaacccugugcagucacacuggggacuuggugcacagcccucugcagcuuuucagacaggagaaaauuugaaguguuugcagagagccacacugugagcucagaaaguggagcccaaguccauuugacuccagagucacugaacucaacucaccgcucauucucccguguacgagguuaaucaccuauagagagcuucuuguauaagccagcucaacaccuccccugccguguggccugugugggagucagacaaaggccccuuccaggucgguauccagguccugcugugcccggagcucaggucgaggagagguugcuugcuuccuucuugcucaaacaggaugagucugcccgaggggugccagccugaaccugcccugcuguggggagcaaucauuuccucacagccacaaaugccaguaaucaugcacugggaacgugcugcccgcuggaaccucggcgccuuguccggugcaauuaaaagaagggaggggacacacgugagaugaaauuuguagggaauccacuguuucuguagcuucccuagaagugaggccacaguugcugaccugagaggaagcccagcugcggugggagaaaagacgaagaugugugggaguggacaugcuguggcaguugggguuuggggcccaggggucugaaucauagccugucagguuggaaguccauuugugacuaguguuuuuagauuuguggcuggcgaaagcuggcuuaccucccuaagccucuuagcucaucugcuucauagcagugcaaguagucgucacugaugcccaaggaagcccagcccagccuggcacccagccacucaguccccuccugagcauguaggcuucucuggcuuugccaccuaugucuucucugaugcuagccuuacaagguccucuuaccuccugucugauaacaucaaggaguggaguggcagaaugacccagaaagguuuaauuagcaacaagccaggguuguuggaagauggcaaccugucugucucucccuucagccauccuuccccuugcccagaggucaaguugucucuauagguuuucauuaagggaagacagugugggaaguccugugggucuggaacaggugggcagcucuguuucucagaguagcccuucccccaccccgguagccaccucuggaugggagccgcucacacccucgccuuuaugaaugaagaugggcgguguggggggaggcccuccaggaagucugaagacacauccaaagcugcuguguugaugagagaagucugagucugguuucuguuguggucggcuuuuucuggcaaguggccuuuccuggaacguggcacuagguacagcaggcgugggaaaggcugcaagauuuguucgugccuagauaacuucagugugcaguccaacuauuugauuuauuuuuugcguuuuguuuuucauuuucagacagucguccauagcccaggcugucucagucuggugauaucccugaccccuaccuuccaggcagggaccaccgcucuaaaucaaacccagggcuucaugcaugccaggcaagcgcuuuuucuucuccuucuccuucuccuucuccuucuccuucuccuucuccuucuccuucuuucccuuccccuuccccuuccucuuccucuuccucuuccucuucaucuucuucuuauauuuucuuuauuuacauuucaaaugccaucccgaaaguucccuauaccuuccugcguuuuaucuucuuagccacauuccuacccuuuuuuuuuuuuaaaguagggucucauguugcccaggcuagccuugaacuugcuauguagccaaagguaguuuugaacucuugcuucuccuuuucccaggugcuuggauuagaaguugagcuaccaagucccacuucauuauuauuauuauuuaaaaugaucucacauugaagcuuaagcuggccuugaacuuguggcaucuucuucccccaggcucccgaccccuuccaauauagggaauguauugacccucauaccuagcuuuuuguuuuguguucauggugagguuuucuaugucucaggguugucccagaauuuuuuuuuuaauuuuuuuuuauuagguauuuuccucguuuacauuuucaaugcuaucccaaaggucccccauacccacccccccgucccagaauuugacaucuuucugccuccacuuucugcaugcugugugcuguugugcauagcucuguguuuaguuuauguauaaaagauagagcaugcaggagcaaagagaaacuucuggaaaccaugucugcaguuuuugaucugagagguucaaugucccuccagaacugcuggcuacucggagcccacugcagggcgugguucagcagcacccacuguagggcgugguccagcagcacccacugcagggcgugggccagcagcacccacugcagggcgugggccagcagcacccacugcagggcgugggccagcagcacccacugcagggcgugggccagcagcacccacugcagggcgugggccagcagcacccacugcagggcgugggccagcagcacccacugcagggcgugggccagcagcacccacugcagggcgugggccagcagcacucacugcagggcgugugccagcccugcuuucugagcuuggcauguucugucugaugccugcaguacucuuccuuggcugcuuauuacucgaugggacucaguucuuaugucaccuccucagaggagcccugaucuuguccucagggcuucgagaggacaggaauugcccuccuuccuguuugguauaucaugucccuccuggcgacaaggaaggaugccugcaguuccuagaucccugcucagagcugggaguuaagugggugcucagggauuuguugaaugggucauagcuuuagcauaggagcugcccuggcagggagagggcagugauguauguaauacacuuggccaggugcgagaagggaagggcgagguguguagaauuuaucacaaguagcaccuauaaucccagucccccagaugcuaaggcagguagaucaugagugagcagccagccugggcuauguaggagaggcuugucccaaaagacuuauauaaaugaaaggcaugcaauaccucacagggcaucuguaagucuuuugggacaagccucuccuacauagcccaggcuauguauuauuuauuuauuuauuauuuuauuuauucacuucaaauggauuuuuuagguaggcucccugugugucacugaggaugaccuugcacuccugauguccugccugccucugccucccacaggguaggauuguaggcuugcacuguugugcccagccaaccuucacauuuccaugaacuauuuuuuuguucuuagggcaggggauacauaaagggaaaaaucccuuugccaugcauccauuaaaagauugguccccauagucagguggugauggcucaugccuuuaaucccagcacuugggaggcagaggcaggcagauuucugauucaaggccagccuggucuacagagugaguuccaggacagccagagcuacacagagaaacccugucuacaaacaaacaaaacugcauguggagaggucuaggacuucaaagcuagccucagacaugaagcaaguuugagaccgaguagcucacggugcaugagcucuuacccaccauaacgucagccaccaagguugagccagcugaagccgcagcugcuccugauaaagcgcucuuugccucuccuccccagcaccccagcaggcagcagcaacagcaguucccaucccuggacgacaagccccaguucccaggggccucugcagaguuuguagacaagcuugaguucauccagcccaaugucaucuccggcauccccaucuaccgugucauggaccgccagggccagaucaucaaccccagugaagauccccacgugagugaggcugcuuccccugccaggccccccaggcccucgucccuugccuggcugcucugguucccaccuuuccccaucugucugccuccaccugcagcugccccaggaggaggugcugaaguucuaccggagcaugacgcugcucaacaccauggaccgcauucucuaugagucccagcggcagguaugugggagcagggugggaucaccccaggucccuaccuguagcuguauacaaggaaugcaccaaggaggggggccguaugggggauccuuuggguggugucuugagaguuugugggguucuggugggucacugggaggauguggggaggguuucauacuugccaugcucccagcaaagaaaaguuccagaagugccagucgcagccaugacuuuggguaggacauuugucuuguguuugucuugguguccacaguauuugacaacugucuacacaacucagugguagagaucuuucuuuguccuggcuuccgucacuagcuguguaaauacguuccuucaaaagccagccauaaugauagaugccuguaauucccgugcuugggaggcugaggcaguaggauagccuugaguuccaggccagccuacacuacaaagugagacacugucugaaagcugccccuucaccccaaccccauacaucaguagugagagcuggcguuccgaccagcuuguaggguuggcaugggaaccgugcucuccugagcaggacucugccuaacaugcagaacaugagcgagcguaaggacuguguuucaguguuagugacaggcuaccagugccaaagucaaaagcuguacucggcaggugacuaguuuguccucuuagaugaaagaagcuaggggaauagggagccuagaauucauccacugguagcugagugucucccgcugccauucacuguguggcaguagauuaauccacucuaaacuccccaguggcggcugcggaggcagugguacgcuuccucgcuaccuaccccaaugcucuggauucucaaaugaaagacauaagcacgugcacacacacacacacacacacacacacacacacacacacacacagccuuacauuuuaauaugccuuaaacagcucaguggggccauccccaaacuuccauguugcuagcacacucuccccgcugacauuccugaauuauuacuaacaccuauauuccauccuggccacccugcacccaagccugcagcccuccuggccaugauccccggcucuuauauguccuacacuucucaggccuggaucuucucuuuccccaguauggcaccguuuucuccuuuauccuugcccagggauccuagaaguccugccucugucuccuugcccagccauuggccgccagcaacuuuauuuaccagucaaagcuagcuggggacagggacccucagcguuuuacaugcagacguguggauuccccugugauuuuggaaacccaaacagcauaauucaagcauuaaacaaaauccacaacacuguugcugugcggugcggugcaggccuuucuuucuuuaugaucugcuugugagucucauaauccagguggcugcuggagucucauuccaggcagcgagcagaaggcaggugggaggugggaggccaaacacugcccaucucaguucuuccgugacuugugccucccuagagcuagcucucuugggcagucccccugaaugccaucugucaguguucaucagcccuuccuaguugccagagagacuggcacuuguccuuucuucuagauagcucuugcauauggcagaaugggugcucugguaacaggacucagggaggacacuagaccaggggugcucucaggcucauccacauacuaacugaacuugacagcccugaaggcccuccauaccuaguacccgcccacccacuuggcaccagaaaguuaauuaaauuuuaauuggcuccucacuuaaagaaaagcccuuccucaucacuuucccaggccgcuggaaaagcagguuccaggcgcguuguugcgcuccacagaggcgggcaguccugaggggcagcuaggagagcucuuccauaugaucuugggugauguggauuucaucauacaccagggguuccccagcucucaacuucaucuuggcgucuuaggcuaguuggcauggucucuguccauaccccacagcagacagccuguccagacucgaccuacgugcccuccuccucuaaccaucucucuguguuggguacuggcagccgcccuucucaccuguccuagcaccccaagucuccccugcugucugcugucugccgucucccugccugccuccucucuguuccuugauguucccugaggaaugaguugguagcugcagcacuguuggacacccacccagucggccccucugugccauccuuuauggcacauuggcccuuguucugugccuguugccucgugcuugcaggauggcugccgcagguccaggcguccuggcucuugagugaggcaggaaggagaugggguagggguggugaaagcaagagucucccuuaucuagaaaagcaaauuccauuaaagccugggcuaaaacugucccugacaaccaccucuggcuggcaagggaggcugggaagcccaaugauucuccaggcccagggauagagaggcuaagcaggccuggguggucacucuccgagcauugacuccgcuuuugaggacuuauccauccuccgucccucucucugugucccuagcucccagaccaggccaucggucccucucuccuggcaguuugcaucccuucccugcacagccaccugcgggaucccaagacccaggcauggcugcagcaugccugcagagugaucuggagcacaguccaggcacaccucucucccuucaccucgcuugaccuuguggcccuuuggccucgugucuuuccuuguccuucugucuaggccuucuacccacccugccuuugcccagugcagccgguuaucuccacaccuggcugugcccgggacacuucaggcucuugacccucagcucucacuguccacuucccuuuggaggcaggagcuccuugaucccagccccgcccacacagugauggccacaguggugacugaucauuacaagacaggcaggagcuggugcggcggcaccccccuuuaacucuagcacccaggcucuagcagaggcaggcucugggaaucugaggccaggugggucuacuuugugaguucaugauaucuggggcuacagagaggcccugucucuaaaaaucaaauggagaaguaaggcaggguucucugucaaggauugccuuaacaagccuaggccucuggccccuucacccguagggccggaucuccuucuacaugaccaacuauggcgaggaggggacacaugugggcagugccgcugccuuggagcgcacagaccugguguuuggccaguaccgggaggcagguaugucuguugguaguuuucucuggggucuccauugagcuccacagcauggugcugugaaggccucugggggugcccaagaaccagcauggaaagcgggcaggugaggcugugacgaggcaggccucucccagagccaccacgcagugugagguggcaccucagcccucucugagacgcugucugcucagcuccaagguggcaaugaggaggcgccugaagugagcugcugguaguaggaccuggggccaggccuggcggaaggcauggcuuucucuguggacaccugucuacccagggcagggcacuucuggacucucccagggugcuguguuccccaggaagcagaagcuguguugagcucaguguggaucucuuuuuuuuuucuuucuucuuuuggcaagggagauggauacagaggaaagccgggagcagagaguaaggcgaaaagcucuuuuccagcuggggacaggguguggcagcaucgccccugacuagagccaaucagugagggccaggagagaggccuacugagccaagggauguguuuguuugggguccagaaaggaaggcgccccugguaguaucagcccggcaaauccugagccuuauuaggcccgccacaucuuaagcaaguugcuuggucaugcuguagcccuacuggcugcugaaaggucacgggcagcuggcauaaagccagcacagggaugaacacuuggaguuagaggcccuugucaucagagccuuucccaggaaccucuuuucagaagugggguggccaggaugacuguccagaggccgccuuggauaagcugggcauccagucuagagccagaccagcccugaccugucuuggacuggguugggacauacagucugugacggugacacuuggcauuaccagcaaggaaagccagguuuccauggcacuggggucccaucagcucucgccuguguggaggugacaggacaggggaggacccaucuccuacuucacacugggagguggagaggccuggcacaauagcauaugcuuguaaccccaguucucagggagcggaggcaggaagacugcaagucugagacuagccugggcuacauggcaagagggugucauaaaacaagccacugugacgugacgagaggagaggucuucauagcagcagguggccccuacugguuucuggaaggccaagucuccaacugcagcagaggacucugucuuguccucuuucuugcugcagagugugggcacuuuggagccagggcuggccugguguggguggcguguggaggucccuuucccagccuucucgugaggcaguuguccuugucaacugugagagccaggcaaucagcagggagaaugagguccugcgguccaggccaucugccucccagggagcagggcuccucuucccuggagucugaccaguaucagcccccucugucacucuggcugcccucccagcugugguggugacagggagugguguuuguucacggcugugaagcagcagcaggugcugaggcaaagcacugauucccgugagacuggcagcuuccuggugcagguuagaucugccugggugcugugcauagccacggcugggcugucagauuuguuuauguuugguggugguggagauggagcccagggccucacacauaccaggcaggcacuuuaccaaggagccccaccccagccugggacugugugugagcaccuucuuccugccccuuuguggugacugucauguagaagccccagugccugggccuuuugaguuugugggaagucucaaggcaagcgcaccccuccucugccagaguuccuccuccagcauugucuuaugcagcauagcaagggcuuuuggaauuuuuuugugcccauccaaagacaucugacagaugacugugaaggccaaggcuugguggcaugugcggaagcagaggcaggaggauugccacaaauucaaggccagccuugccuacauucauagaaaauccaggcuugcuggguguggugguguacaccuuuaaucccagcaguugggagguagaggcagccugaucuacauagugaguuccaggacagccagggcuaccaagugggaccugccuuaagaaacaaucauguaagcagggcagugguggcgcaggccuuuaaucccagcacucaggaggcagaagcaggcggaccucugaauucgaggccagccugguguacagagugaguuccaggacagccagggcgacacaaagaaacccugucuggaaaaaaacaaacaccaaaaaccaaaaaaaaaaaaaaaagaagaagaaagaaagaaagaaagaaagaaagaaagaaagaaagaaagaaaaagaaagaaacaauuauguaacuccauugccuuguuuuuguuuuuuuguuguuauuguuuugagacguggucucacuguguagccauggcuggucuggaacuaccuuuguagaccaggcuggccuugaacucacagagaucuaucuggcugccucccaaggaggugagccaccccagacucauuaacuuuucauaugaagaacaacucugcaguaaaagguugggaacggccagugccagacagcugcuucagagugagcucauacucugggagaccacaggggccauaaaaugcuucuuugcgagucaggcucugcgggacuauaggacaucaugacccacaguguucucccaaggcugugcauugugaccccuuucagugauguuaagagaggcccagcgugccuugaaacaaccacagacccauccaguccucugacuugcacauagaugcaauucgccuuugguggugaucuaacauccauccagcagggcuuuuuccuccauucauucauucauucauucauuuuauaucccaauaucaggcucccccucuccucccauuuccccccucacaaucuucucccccuccccuucaucucugaaaagggggaggucacuccaggguaucaucccacauccucucccacugcggccagacaaggggaacaggauccacagacaggcaacagauucagggucagccccgacuccaguuguuugggucccugcaagaagaccaagcugcacaucugcaacauguguccagauuaguugucucuguuggucuuccuguggagucccuguccucuucggaucccucaggcguucccccagcucuuccacaagacucccugagcuccgucuaauguuuggcugugggcgucuucaucuguuucagucugcugcuagguagagccuuucagaugacagccagacuaugcuccugucugaaaacauagcagagcaccauuaauaauuucagggauugguucuugcccaagggaugcaucucaauuuggggcagucauugguuggccauauccucugucucugcuccaucuuugucccugaacaucuugcaggcauggcacauuuugggucagguuuuguggguggguuugugcccuuaucccuccacugagaguccacuucagcauccauauccucuacugcuaugagacgcagcuagagucacccucauagacuccuuggggccuccuucccucuggcacaggucucaggccuguccuagaggccucccccagggcuuuuauuugaagaaaagguuuuauuucugugaauagauauggacuuugcuguugguacugguggagguggauuaguucaagacacaaaucucacaguuucucauugggaagaaagccuugggcuggagcuguaucagugguagaauauuugcuggcaugccugccugaggcccuugguuccauaucuagcacuauaaaaaaaagaagggaaaggaggguguugacagccccaagggaaggagagccacauucccucaguguuguggcccuugggccauuggauggcucccuguaucugugagcacaggggcagccacauaggggcuuaguggcucacagugcagaccaggcuggccuuaaacucucugagaucugucucugacucccaggugcugggauuaaaggccagugaguuauuaauuaaaaaaugaagaaaaagaaaacaacaugaagucuggaggagaacagaggguguucccaaaagauuggagguggggaugaggggugggcgugacuuaaacaucucguguucauggaugaaauuaccaaagaacccugacuaauacaccaaguaauuucugaaaaggcacguguagagugauggucuagugcgucuucucgcacugaccauguacccugaaggcugaaaucagauauuuauaaagcccucgccugcuacuuucugugcaggacagcccugucauacacaaaguucaguuauacccuucaaagacgagugucagggauggugcuaacguaaaccauucuccccuugcugagaguuaccaagaaggauuaucuggucaaacaagucucuccugagauaggucguaucuaugggaccgccuggccuuaugacccccuaaguucgccaccuucuacagucuggcucuuaguuaucuuugaauugaaaacaaaggcuuacuucuggcuugcaauccuccugccuuagccuccaaagugcugggcucaaaggccugcucuaccacacugaccuggcuacugccuucucgguaggaagcccuggggaggacggggcugguuccaggugguccacagcauuggccugaugcgccuccccacugcacugcucaucacgcucacagcugccuccuccugccaggugugcucauguaccgggacuacccgcuggagcuguucaugucccagugcuacggcaacgugaaugacccaggcaagggacgccagaugccuguucacuacggcugcaaggaacgccacuucgucaccauuuccucuccacuggccacgcagaucccucagggugaggaccugugcucugagccuuacgcaugcaauaccuguggcccagcucucugugggcccaggccucccgccugcuaguugaguagaaccguuagagccuggccuguguacagggaccucucagaggagggcucuguggugucucaccucaucaagcagccuugggucaucaugacccugcugaacuucccagacuccuccugcccaagcuagcauggccaggcauugugucguugccacacucaagacugucuaaugacacugucgguggcugggggguaaaccuagcauguacaauugucccuguugcaaagaccagaacauugaagcugaagaaggaagugacuuacuagggacuugugguagggaggagggcaggaacuuacucauggguacucgugacugcagagaccacggucuacccugcccuggcuagccuggaccucaaguggacuucccagagcuggggugcccugaggcuccuguaugcuaccgagacugccagggugcugggccugugcccacacagcacacagaccaaggauuggcucucuuauggccuccugggcccagaaucugauaggaggcgugugucucgguguagcccugcuguugaaccagucuggguguguggcuuguguggcuugugugucugcagaccuccugggagaaugugggaagcagagcuguuuauuauggugcaccagagucccuuauucagcaaauguaugccaggugucacccuaggcuuucugaauaagacaaaugucaacccuguucauacugaugcugucuugagggagagggggcaucagggaagagugugaagagaugguaccuggagugcuucgugcaggugacaggaaaggcagcacagagccaugucgagggggcaguagcaggggcaucacaagugauugaaaggcagacuggaagucguguggaagggagcugugugggcaccuugaggcaaucguguguuuaguugugacuagaccaggggacuaaggguggggaguacugagcacucggggcuuaguggccuuuccuauugcaaggacuuggcccacaguggccugagagcccagaguuaggaaggagucugccagacucacacuuaagaguccccuggcugcggcuuggccuugguguggaagguccagaucuggcuauccucugaagguggcuggcauacauguaagcgugacagacaggagucaggggucacacccuagguaccuggagacaacuuuccgagccugagucugcgugcguguguggugugugugugugugugugagagagagagacagagacagagacagagagggagggaaggagggaggggcaggcuuauuccuacucacacgcucucaucugugucccugugcagcgguaggggcagccuaugcugccaagcgggccaaugccaaccggauugugaucuguuacuuuggcgagggggcagccagugaaggggaugcccacgccgguuucaauuucgcugccacccuggagugucccaucaucuucuucugccggaacaauggcuaugccaucuccacaccaaccucugagcaguaccguggggauggcauagguaagggccuuucucuugcugcccuccuuccuguucucucccugauggugucugacaguaagggcacagggggcaaugagcagagcacacccuucacucuccucuuccccuuucuucucccugaggccugacuggcauccucucuguccugcagcggcucggggcccuggguacggcaucaugucaauccguguggacggcaacgauguguuugcuguguacaaugccacuaaggaggcccgacggcgggcuguggcugagaaccagcccuuccucauugaggccaugaccuacaggugccugucucccuuccaccccugcagcucacaggucugacaagcucugucagcacccccccacguguggccuggucaccccaugugcacucccuuccuugugccacaucacuccuguguccuuuucugacaccccgcccccggcugauccacaauccuccccugagcaggauuggccaccacagcaccagugacgacagcucagcguaccguucgguggacgaggucaauuacugggacaagcaggaccacccaaucucgaggcugaggcaguaccugcugaaccaggguuggugggaugaggaacaggagaaggccuggcggaagcagucacgaaagaaggugagggcccauuggagccccagggugugcucccgauggcucugcacagcgagaacucugggagaacaggaauagaggaccuggguauauucacacugacccaggcaagccuuguccucaugcguggcucauagagccaagccaccuggaccauauggccucagugacucuucacaguggaacccagggcuagucauguuccugggguaucuacuucauaacucaguccauguaaagugguauguccuaccugggcuagagcuaaugucacccucugugcacuuagaacaggccuguucuggccucauacugcaccguggucacuagcucagcucugacuccgucgcccugaggaauccuuuccuuucucugcaucuugcccuccacuccuguucccuccauugcagagcugagcugacagugcagggccaggacccugcaggcuaggcucuggaauguucauuaacaccagucugaggccucagaggggugaggcuggaccguggcuugugguugggagagggcaggaugaaggggacagccacuuacucccucaugucucccaggucauggaagccuuugagcaggcugagcggaagcuaaagccgaacccaagccuccucuucuccgauguguaccaggagaugcccgcccagcuccgcaggcagcaggagucgcuggcacggcaccugcagacuuacggggagcacuacccccuggaccacuuugacaagugaggcccuagccagcacaaggggguccugcucugaguggaugcugcccccugugcuagucagcugugcgaacaugcugagcagccaggguggcauuccagggugacuuuugcuccuguuccugcucccccaggcuacuucacuggggcaccauguuugcagccauugcugcggcuacuucacucccuucaccuguuacagugccuuuuaggggugggaagggaccagggccagggaagacccucugggcaggguggcccugggcuugcccagagagauagcugauuggcagaguaaguaaaccacaggucugccuuugacu

SEQ ID NO: 3631 - RNA, 13917 nt, Mus musculus
cgcaauagguacgcggccgguagaacugcgcgcgccgcuaagcggaagcuacggugggagccgcagcgcgcguggucagcggcuauggagggcgcaaagcgugcagacgccaauuuacucacugacaccggaacagaguccagcccccgaaguccagucugcagucuccggcacuuugcuugugagcaaaaccugcugucccggccggauggaucugcuucuuuucuucaagguacgagccucaccaaguuuaacucagcgcgcgccauccucaccgaagaaggguuuuugaagagcgguuacuguguaguauguaaccaaguacgcccgccuccuugaacuuauuucuagauguugaguauacccaccucccgucucgagaagaaaugaguuggccagccugguaaaucccucucagaggagaucgagagcaagaccacucucauaagagugacuaucccagaauagguauuucaccaaggcagauauuacccuucucuagauuucuuucuuucuuuuaucuuucuuucaagacuuauuuuauuuauauaagagcacuguagcugucuucagacacaccagaagagggcaucagaucccguuacagauggcugugagccaccaugugguugcugggaauucaacucaggaccuuuggaagagcagucagugcucauaaccacugagccaucucuccagcuccccuugacuagauuucuuggguuuuuguuguuguuguuguuguuguuguuuucacuuuguuguugaacucacuuuguagaccaggcuggccuugaacucagaaauccgccugcuucugccucccgagugcugggauuaaaggcgugcgccaccacgccuggcuuugacuagauuucuuaaaaaacacuucuagauccauacaucaccgguugaggcuaagguguuuauuugcauaaauacccuuugagacagacacaucaccaccacugguuuaaauauaauuacuguggcagaugauacaucuaaguaagugcucuucaaauuaaaugugaucuucccauccugggcugagaagcaucuccccuuccccggucccaucauuuaagaaaacgugccuuuccuugguauacacauuucaucagacuaaaugaauagggagaaaagagaagucuuguggcugagacccacacaacccuauaucccagucgggccagccaacuuugagaggucaugagagggugagaaacuaccagaguagacagaugagagggcagagacagaguugacaauggugaguuuguuugagauguuaaaggcugaucaccuuauggcuaauaagcuagaggucauugcuuauaguggugggucagaaagagcgagaaaaaaaacaguugagacaagucuccaggcauuuuccugcgaaggaaucagauagauggggcaagagcugacgacugauagagcuuaagaaaggagaaaacuggcaggucagugguggcacacaccguuagucccagcacuugagacacagaugcagggucucuaugaguuugaggccagccuggucuauagagggaguuccaggacagccaggaaacccugucuuggggaaaaaaaaaaaggggagacagcucggggcuggagaaaugguuucucuuacagagaacaaaguugaguucccagcacccauucaggcagcuuucaagcacuuguaacuuguggggagccaggauauuggaagcccuguuauggccucugcagggaacuauacacacacacacacacacacacacacacacacacacacauaacuuaaaaaguaaaauaaauacuagggggaaaagaagagaauuucugcagccacaucaucgagauggugggaagaaagagacucccuugcucgcugagagcacagucuaucuagcaguacaggaauguagcucuaguaagcaccugagucuauuggguuaccucugguuucauuggagaagcacccacagauguuuaguguucucaucccaggcuggcucucagcuuagcucauugcugaaaucagccuccccuaucucuugggauauaagaaauagagagggaaccuucccauguucuaaaacccuaaacucacagggcccuagugcaagcuggagacuuggcagacuuucaaaaagaauguugcagacacuucugaccucaaaggcuccuguaagaacacccgauggagggggcuguggcugcggcaggcaagcagugcaaaugauguguauguaugauaaugacacaauaucccuauuacuugacauuuguccucacuaggagucucuugcugugacaaggacauaaccagaaucaacguggcagaaccuggcuuuucauggcuuguucagccugcuuucauagauaaccuaggaccaccugcccagugguggcgcugcccacagugagugggggcccuucuauaucaguuguugaucacuaaaaugcccuacaggaucaugcagcaagacccugucucaagaaaaagaaaaugcccccacagaccugccugcaggccagucugauggaggcaauuccucauuugaguuuccucuuuccagguauggcuaaguugacaaaaugcaaagcaaaagaagcaacuagccggcacaguagcuuaccuuaaaggcaaaaacaaacaaacaaaccaaaaacaccugaugguacaaaaccccuaaucccaguacggggggagggagggcugguagaggccagaggaacaacaguucgugcccugcucccuuagcuacauagauagcauggucagggccagcuuugaccauauagaaccugauuucagaaaguacaucgaugaaaaccuacagagccggggaagcugccuguguaggcuugccaucuugguuuugccaucuuguuuuuuuuuuuguuuuguuuuguuuuugcuuuggacuuugcauaaaugucccaccucagagugacauuccuaagcccuuguuuuuuaaauaacuguuuuuuuuaaauggaugucccuagugccugaggacagaagaguacgaucuucccaagaacugugguuacauacaguugugagccaucucuccagccccaaccucugaccgacuuauacacauacauuuuaucgauuuggagcugugcuguaaaguguagugggcauugggaguuacagucagaaacauggaaacugcuguugaaugcagugccuucacaucguagguggccucucugacgccuguggacguuagcaaagucacacgaggucuccagacccauucauaaccauuugggggaaauaaguagaaauuaagacccccuacacauucacaaucuuuauuguuuguccuuuuaaaauguauuuuacuaauauauuuuaauugcaucuaauaacuguuuucugcuuggcuggcuuaugagauguucucccguagcucaggguagccccagacuuaccauuggagccaaggaugauuuugauuuccugaucuuccugugugucucccaaacacugggauauguauaugcgugugugggcgagagcugugugugcgagugcccaugaaggcagaagagggugucagucccuuagagcuggguuucguggugguugugagcagccugauaaugggugcugagaacugaauucuaguccucuggaagagcagugugcaugcugacacacaccaccagccaucucugcaaaccccagcuaccucuaaaaauuaaccaguggcugaagucugugguaagcucugcaccuucuggccagugucuuauauguuucaagugaacugugucucuuuaaaguuggcauuuauuucaucuucuugugugauguugggagacugagggccuccugcuucugugagccacagucaccugaucuucacaaacuuaccaugaggaagguacuuagcugcuuaaaguuaagagagcagaggaaagaagugcuaagugcagcacagagcggccaaggccucccucuuucccccaggugauaccucuguccuggcuggagucuaugggccggccgaggugaaggucagcaaagaaaucuucaacaaggccacccuugaagugauccugaggccgaagaucgggcugccugguaacuggacuccacugagccccccaaaagauccagucuguugggaccucaucugaccccucgaugcuugcuguguccagucucugcugcccugcucuccucccucuuugcccagcuuuugauucugcugcacuggaauggaaucuagagcaucaggccugcugggcagaugcacuuccaggaagccacagucccaggcucuccaggguggaguccggucaagcccucugcugcugagauuaggccucccagauccucacugguggucuccagacaggaauuccagcucugagccacaccauuagcuuuucccuagugaauuuaaggcuauguggcuaggccauguagccagcccuguuaacucuuuuuuuuuuuuuaagauuuauuuauuuauuauauguaaguacacuguaguugucuucagacacaccagaagagggagucagaucucaugguugugagccaccaugugguugcugggauuugaacucgggaccuuugggagagcagucagugcucuuaaccgcugcugagccaucucaccagccccccuguuaacuuuuugagacggggucucaaguccucugagcuggcagugagcucucuuuauaaccuaggcugcccucaaauucaugaucccacugccuaaccuaaagucucgagauuacagaccuguaccaccagacccacccucucuugagccuuuucuuucuucccuuuuuugccuuccucgcucuuccuucccauuaacuuguuuuucugcccuuuuaccacuucuccccaugugucaugggaugggccugcucugaugagaguagauauggccaguagcacaggacaugggcaccucuggguauuccuccuuggguggcuggcugguagaccccuggccaagguuggccauagcaggaguuacucagaaacuugcagacucgcccgcuuucuccugggaguguguacuccgacccggacugaggcugacagccccuuccugaagucucccuccagaggcuggaccaagcagagcaagacgacgggguggaagggaagagccugaccgcuucccgucuccccaggcguggccgagaagagccgcgagcggcuggucaggaauaccugugaagcugugguucuaggggcccugcacccccggaccucaaucaccguggugcugcagguggugagcgacgcuggcucuguauccuuucccagcccucuccuccaggaaguggccagaaccuccccuccggcuuccguacccucagccacccaggaccugugccaggcagcagcuccugcagagcauacaacaaggccauggucaacaagaugguucaguggagaaaggugcucgcugccaagccugacggccugaguucagucuccaaggcucauaugguagaaggagaaaaccaacucccauaaguuguccucuuaacuaccacgugagcacaauggcacacaccugccccugaacacacacaaguagaugaauguaauuuuuaaaaauuagcaagcagggcuuacugugugcugcugggccuggcacugagcaccucaugauguuaagucauuuaguucucacugggcuuguauuggguagcacuguaauuccuauguaaaucccaagacagugggcucaggcucucugguucgagagcccugccauguguguuucucauguugccuuguuucaggugaggggcaguguuuggucuaagggaccaagauggaaacaagggugggacucaagcuccaggcacgucccaccucagagcuccauuaucuagcaugguagcugccuacuagacuccccgggggugggccuggcuuugccaguaaugucuuucuuguguggcuuugggauaucucucuauuugacccuguuucacucaugacacuugguauaucccuuaguguacauaccuguucccuagcauugucccaucuaacacaaagauaugagacauggagaaaaccauuugaucucauagcugggagagaguugguaagaccugguguggagcagcggcagccacuuggcgccagaaccgcguaaccauccugccacgccgcugcucugugaugagucagcgaugucuguaaagggaagggugaauguucaaugccagccugaagacacucuccuuaaccagucugugaugcccagcucuuggccuguugcuugaacgcugcuugcauggcauugguggaugcaggugugcccaugcgagcccucuucuguggggucaccugugcccuggacucugauggaaaucucgugcuggaccccacaaccaagcaagaaaagguaggguugccgcuuggcgugccuccaggcccaacccuaacccuaacaagacaaguggcuugugcacugacacauuuggaagguucugcucuauucgucaaggcucauucagcuuuaagugcuagaaacccaauucagacuugcacaagccagaaaggaaacuugcuagcauuuacuaccaaaccauagagcagagcucugguucuuaugcccugcgcuggcaugguagugagcauaggaagcccguucuccgcaccucacgugaaggguuugacacuggggguuagaggagccacaggagugggggauggggagaagagacaggagccauuagaaaccguggcugggccccagcagggucacagacuguuacagaaaagagcgcagugugcugcucuggcuguuaccuggcuuuugcugcaacugcugcugucagagugggaaccgggaugcucgucuggaggcuucccagguucccaucagauaaccagcaaaauguaauggcaagagagccaugguauugccuugcccguguaggacagagcaggaugguggggaggcagccgggaagugaccagcacugugguuccccugugggacagaauaaacacauaaggagcagagaaguaaacagccaccuaggaaugggugguccccggacacuuaacagccuugucccucuugucccuaggaggcccgggccauccugaccuuugcucuggauagcgccgagcagaagcugcucauguccaccaccaaggggcucuauucugacgcugagguaccagugugggggcggggcauagcccagaaccuuuauaacaucuugucccagcucagaacaagccccucuguacgucccugcuggggaguaagaggaaggguacaucuucagggcucaggucaugaaggucuugcaugacacgcacaggguucugagccacaaguuuuaaucucggcacuugggagucagggaggcaugguucugaauucaaggccagcgagggcaacauuuugagagagggcgcuucuuuguagcauuuugaaagaaagccagagagaugaacucagaaaacaguguucaucuugaaugaagcaguccccggugcccagcacagaacagugcccucuggaauucugggcucccgcggggcaguuuggaaacuugggucagauggucugugccuccauuucuucugauuuagagcucucauuuuaugguucuuaagguuauuugaguugggcuugggagcucacggcugugaucagagcacuucagaagcugggcagaaggacugcugugaguuccaggcuagccuggacaguauaguaaaaacuugucucagaaagggagcagaggcucuagguagucugucuagucccucucagcaggccguaagguagggagcugcuaagcuugagaucaucuugagcuauagacguaguuccaggccagccugggcuacauagcaagauccugucucaaacaacagcaacaaaagaucugugugugugcaggagugcccagaggcccgaagaguuaagguuaaagguuauuuauuccucuaguucucaggaucuccaacucucugaguccuuccaagguguggggauuccgaucucaggcauuugaggucuuguugcuuucagaguguggucccuuauugucuuuucauuaagaaaaagcuuaggggcuaggaagaugguucuaaauuaaagacucuuguugccaagccuaaccaccugacuucagugcccagggccaacauggcagaaggagagacccaacuccuucugcugguucuuuaaccuccacagggcgugucccugcacugagaguuacaucuuagcuacgcaggcuucugggcuuggggauguggcuauguugguagaggguuuaucucccaugcaggagacccugagcucuguucccagcgccauauaaagcgagguguagugacacucuuaggaggcugggcaggaugauuguuguggccgugacauugucucauuguggggugggaguuaggagguagugaagaagggcaugguccucgugauggugaggaggaguagaaggggagggaaggagggaggcuuagggauuccuuuggggcuaacccucuccugguucccagcuccaacagugucuggccgccgcccaagccgccucacagcacaucuuccgauucuaccgggaaucacugcagaggcgcuacucgaagagcugaggcacgccaggguagggcgccccucccaccaugcccaccgccuaccaccgccacgagccagcacuccacugugccucugucugugcccauguagccucugguccugucgcagcggaggcuccugugccaggcuggggugggggcuuagggacauucuaggccuggguauaacccucccuucaucaggauaccauuaaaaagggcucccccguguugggugagugagucaguacccacugauuccggugucuggagaguacucguccaucgagcuugcuuggugccaagaagcugcagugaacaagaggcacagguuccgugguccaggauaagaaauggguguggugguggugugugccaguagucccuggcacuuggcaguuagaggucauuucccacuauauagugagccugaggccauccugagcuacauaagaccaucuuacuucuuaaaaggugaucuggagagagcucagcuguuaagagcacuuucugugcacagaggaccugaguucaguuccagcacccacaucaggugacucacaaccaccauuaagucagcugccaugggaucagaccgagucuucgggccucugggcacuccugcacacacggagacaaagcuagagcaggggugggcacauucugcaucaggaugcaauaaguaugccccuggcccucuucaccaccacagccaccccagacuagauuucucuguaucccuggcuauccuggaauucccuuuguagaccaggcuagccucaaacucagagaugcaccugccucugccccccaaguacucggagugcuggcuucacauuguuagguugggucagucuccuuaaauuguuaaggcugacccucuacccacaguacuagggaugaaagcaaggaccuagguccuaccuguucuaccacuaaguucacccccagccccagggccagcuugaacuugaauccuuuucucaacuuguauccucuucucucagccgccugagccagaauaugcauggcucccaguccuucucucccaccgguuuuccuuucuguugaugauggacuacugaauaguuagucccuccaucugcugugggaugagcucagaggcaggcuacgaggcacgcaagcuccgcccgagguaaaccuugucccauuuugcagaugagacaaguccaugaagucauuuggucuagggucacaaagcuaccagaucaagucucuauuucuacugugaugacaucccaccucaagcucugaggucuaaggccagccacagccagcuaaccuagcucucagauauuccuaccugugugcccuugacacacccaaacacagacagacuccgguuuggcuucaggguaucuuuaauuucucacauugcuuccuucuggguagggguggccaggaaaaagagggggccuccagcugacucguuucugggcgaugugguccucuccgucaccacuguguacaccaagaucauccauucugcucagggguuugaugguccucuggccucugcauucacagugggggcugaagggcaacuagggcgggucucgggaggcaagguaggcagccaaggucaccagggcagcugcauaugugcacaggcccagccccacggcaaggacccccagcaggaaagcucggcgggaggcagccccugccccuuggacgucccccuuggcccaagccuuguuggucuguagaggcagugggcagugguaaccaaagugcccaccucacccuccguccugcuuccuguggcucucccccucccugcccccaccuaguaugacuaauccauuuguauucccaaaccaggguuagggcaacguaguugcuggguauuuaaugaaagaauguauuacauaggugguagagugcaccuuuaaucccagcacugggaggcagaggcaagcagaacucuucugugcuuaaggccagccuggucuacagggugaguuccaggacagccaaggcuacacaaagaaacccuggccggggggaggggggcgguguuccaggugccacuauggaaugccgcguuuuaacucaguugauuuacacaauaaacccaagagagggaucgcucccauuuacugaggagggaaaccuguggggaauucacuagcuuccauaggaaggagaacgcgaggaugauucuaaguccuucaccgccacucuggaaucuugaaaugucuugguuuucccccauuuuccuucuuuuguuuuuauuuuuguguuugguuguuuugacacaaagucucagguaacccaggcuguccugagguccccuuuguagccaaagauaaccuugaguucagaucacccugccuucgucucuuacauguugaucaucaaaaccagcacuucaugagugccggguugagugcucugccaacugagcugcauccucggcccuguucuuuugugguuuugguucuuuggagacaagauccuaguuuguagccggguugaccuugaaacuucucagcccuccaaauacugggauuacaggcagucaccaccacaucuggucacaccuguguguaucuguguggaguucucucuagcccacccccacugccuuaagcauagcauggcuccucacaugccuuuuuuuuuuuuuuuuuuuuuuuuuuuuuugucuuaagccagcacccucccagucccaaacacagacuaaccuugugggccagacagaaggcagcgaugcccacaggccaaaaacaacacagcacagagaauaccgccaggccgagguggucauggggaagaaguggagagagccggucgcccccaucaucaucugagucacugucacuggauaauguguccugcagauaggagagagcacagguggugguccucacccaccuccccaucgcccccguagaccagugcuucccuggggccuucccagagacuuuucuguccccuagaucccuugaaggggcgacaguggccugacugagggucuccagagagacccacccccaggugaguucauucucaaggguccaacuaugggaagauugcucauaaucccugagugaagacaucugcagugggggcaggcuuugccuugggaugagaaccuguaaagaguuaaaagugcucccguggucugaauuguuaggacaaaccugccugccaaaaaugguuuuaaaggcaaguguguuucuaaucccagcauucgggauguagaggcaggaagaugaggaggcuugccuggguuacaugagaccugucuggagaaaaaaaauaaucuaucacugaugucuccaggcagcucugucaggagcaaaagcucugucaggagcaaaccagauccucucuggauccucuagaccuucaugcuaggucuccaaagaacugaucuuuuaaaguauuuuuuucaaacaaaaugaccagauacacagucaaauacacuagacacaagugucaaacaggacucagaggugcaauacagagcagucagaggcaguaacacgaugcuuacuacccgaagcaggcuguucucaaccccgcggauggacucguuuugauuguaaacauggucuuucuuuguagcccccggcuguucuuuaaggcucugugcagcguaguccagcugucugaaaccauuccccugcuucagcuuccugggugucaggauuaugggcacauacuaagccugguuccuaaagacaaaaucucuacuauguaguccuggcuguucuagaacucauuauguagacugggcuggccuuaaacucaacagagaucugccuaccucucuuggaguucugggauuagagguaugcgccaaaaccuuugcuucaaauacucuuuugauguaacucagauguuucuccccuugaaucugggcagguuuccaaaucacuugacagaauaugauaaagucacuuuacaagguuuuuaaagaaaaggugacaaaaagucugguccagaggacugaaauuacaaguccugccaggacuauagugaguuccaagucagccugggcaauucaacaagacccugccuaaaguaaaacgggaaaaccagggugcuggcaccugccucuuagcccaacucucgggagguggaagcaggagggacagaaguucauggucaucuucaauuacaugaugaguuugaggcuagccugggcuacaugaaaccaucucacaaaagagacaaaccagguggaguggcauaggccuguauuuccagcuacuuggggcuugggaaaaaagaugagugugagcugagaaguucaggcuggcaugaauaucagacaccgugucaaaagaagauaaaugucaaaauguaaaaaugauguuucacaauaugaggaaggaauaugacauaaaaaugacuuuacuacaggcagugguggcacacacuuuuaaucacagcacucaggaggcagaggcaagugggucucuugagucccaggacagccugaucuacacagaaaaaucccaucucaaaaaagaaaagaaaaaaaaaagaaaacaacuaaaaacuaauuuuaugaugguuguguuggcacaaaccuguaacucuaacauucuuggaugcugggauacaaggaugaagaauuuaaggccagccugagagauacacagacucugucucagaaagggaggagcggggauugaagagagggcugagugcuuacugcucuguaacuccagcuccaggggaucugaauaguggguaauguguuacacacacacauucauauucucucucguuggcuccaaagaacugauaacagguuaagggagcuggcaguggauccagguuggauucccagcacauggugccucacaccucccuguuaauaccaaccccaaggcauccagcgcccccuucuggccuccacagauaaccacaugaguauaaugcacagauaacgcaagcaaaacacccauacacauaaaauaaaacguuuuaaacuaacaaaaaucugaaaagaauauucaaaagcagugugaggggaagcagagagacaggucagcagguaaagccauuggccacugagccuaaugacggcuccagaaugcuguccucugaccugcaugugugcgcuggucucacuccaaacggagcaugcacacacaaauaaauguuaggguuugggguuuuuuuuuuuuuuguuuuguuuuguuuuuuaagauuuuuaacuugaaaaacugggucaacagaagccagguguuuauggguucuggaaaaaggaaaacagcaaacaaagauuuaaggaacaaauuaaagucuga

SEQ ID NO: 3632 - RNA, 5836 nt, Mus musculus
cuuacccaugagaaauacacgcuuuuauuaagugcccccgacaguccaaacagugggcccugcucaugucccuccaacccacagcccuuucuaccccguaguucaguggagcaugggccacaggggaguuccuggccuugcaguccauggcauaggggccaugacuugggggugaucaggacugacagucuccagaguccacgugccugcuucacugcugugccauuaugugcucaguggaugauggcgauuaguagcaaugaagucccucaacacuccacuccauagcgaucgaaguggcgcagcagcaggccgauaccaaggugcacugugccacccgcggccgugugcaggcgguagcggucagccccgcuguagaugguaucugcgugcagcagcuguggcccaccacccacgaaagcccgugcuagcugcucccuccaacugcccaggggccuccauguagggcaguccagcugaugagugccugggcugcuaggcacauggcaaaagccauagccagcaagcuggcagcggccaaagcuguccugggaccacaccuggagauggagucgaggccaaccugcgggaggagaggcguuagagaaaaggacaaaggggcagaacccugcucccggguucccagcauugaaaccacuggagaccucgcacaguacuuuuaccuuggauuauugccugaauuuccucucuggguucucaucucccacucacuccacauaguagucacaggaaucuagagcaauccacauuacccucuugcucaaaacccucccaugacuccccugggccacagaacaaaguccaaccucucaagucaagucuggccucgucugaccucccuuuguggucucuucacucucccaggcccccaggucagcaccucagcuuagaccccuuccgcccuccuccucauggacuugcuuugcucucacgcaccugacucagauuuccuuucuuccccaguggagccaucucuccccuucguuagguuucuaguggccucaaugcacagcugagugucccagccugacaguccaaugcuuggagaugcagcccagccccccccccccccaacccuaagcccuccccuggcaggcccuguucuccaggcuggggacacagcaaugaacacagcagacaaaaauuccugccccgugaagcugacauccuagacaaccaacauaguaaauaaguaaauuauaggguaugucauauggugauaaccgcucuggggaaaaacaacagccagaaagggagggguggagauguaguuuggaaaauuggggagcagcugaaggaagcuuuccuaaagaaggugacauuuggggcugaacacugcaguguacagcuggaaugccagcacuugggagguagaggcaagaggauccccagaaguucaaggcuagccugggcuacacaaugaguucuaggacaaccagggcuacauaucugaagggugacauuuuggcacacacuugggcugcugaggccccaggcuaggcuggacuauguucugagacucuaucucaaaaagcaaacaagccaaccaggaugcaacauaaaugcuuaaagaagugggcucucuaggcaccuaggggaaugacagauccagucagugcaaaaguuccgaaguaggagcuagccugguggggccaaugaggcuagaacggggagucguggggaacaaaggacagaggugacagccagauuccauaggccugugacgccagagaaggcuccggcuuuucucuugagcgauaggaggccugcaggcagguuccauacagaggaagaacaugcuguauuuagguccucccaggguccaguccaguauccaacccugagagcacagugaagacagaaagaaagaauggucccagaaggcugggcgugguggcacacgccuuuuaucccagcacuugggaggcagaggcaggcagauuucugaguuugaggccagccuggucuauagagugaguuccaggacagccagggcuauacagagaaacccugucuugaaaaacaaaacaaaacaaaacaaaacaaaaaacaaaaaauggucccggaaagagaagauggacagagaaggcugggugggauggggugagaaacaaaaguggguuucagagccgccaggguuuguuggugagcugagagacuaagaaggaagcaaacagggaggaagacagcuaaggccaggacugaggaaaacuuccaacguaucacccucacaaacuaguacaauuguucagaaggagaaucugauccauccauuucuucuugggcuccccagagccuucgagaaucagucuuagugccuuugcaggcgaggccuuacauucugucccugccgccucaucccccacuguccuucucacccacagacagcgaauacccaggacacaccuccccauuucuaccuggcuccagcucucugacuccacccucugucuuuguccuugggccuaguuagcuucucuuggcccuuuacagcagaacucuaacugcucugcccuauaaggccaugggaccaaucagagaugacuucuguguuuccagggccucugugcuggccacauuuggaaacaggucuaucuucuaccuauaauggaacccuugaugacagggcuuggaggguccuucuuaguuggggaugucccugcucaagcuggacagacguaggcucagucaacaguccucauucccagaaucugcuguguuuuaaccagaaaagcugcacugacaugauacccuccuccucccucgaagacucacuuccccuuugagcagaaccucugccugugugagcaacggcaacuggcccauuuccugucccucuccucccuaucuaucucucuuuacccuaugcagccuccucaguggccguuagucaaaggccccucccacuugacccccacuuccugauaucuucucuaccccaaccuccggcacauuccacaggccuaggguucugaauagcucgggugaggccucaaaugcacugcucuaggggaggcuguaccagaaaagggacccacaaaguacagggagcagacagccaugguguuccaagcccagcuccucuuaguuugacugccccuccccauccugucauccuguacccaccuuggagaccuuuaguagcgaagugcaggucaauggggugggaccaguaagccauguccccuaucuggggugugucuaccugugucuggccuucucguacaccugagaggagcuuccaugcggccccuguaaugagaaccaggacaucaggguuugggggauagcaaccuucaagaaggggaccugccguggcaaugaguuuguucccucugguaucugggagugggaguuacacaguguagacucuagagccaagugucuggauccagaucuuggcacuggcaguguacaucugaaaucucagcacuugggaguuuguuuggggcuuucuugggcugccugaugagugucaggucagcaugggcuacaaugugggucucagucucuaaagaaaaauuggagggguugaagagcacgugagagagaauaaagccaggcagugguggugcacacaguuggucuuagcccuggggaggcagaggcaggcugaucucugugacuucaaagccagccuggucuacagaaggaguucccagggcugccagggcuacacagagaaucccguguagaaauccuggcacgauucauauauguguucuguauuuugcaguguuagggauggaaccuagagcaguacauaugcaagagcucucuagcaacagucuacacuccccagcccaaguugaugcaacccuggcagaguagcuucucucuguuucccugucuauaaaacaagcgacaaaaaacacaaucucacaaguuaugagaggacucacauagcaaggaugaacuaugaauuuuuaaaauauuauucacuuguuaauccucaugacugcagcuggcgaugugauccagaggcacacgcucuaugcucugcugaugagcugcacucucagcaccaacagagagccuccuuucuuaagacaaggucucauauagccaaggcuagccucaaaccucugucguagcuaaggaugaccuacgcuccccgggugacgagauccccagcauuuuccuuccucuaugcaccccacauucagaagccuccgucaaagaccaagaagagacugggcaccaucugcgagcacaucacaaccccagugaggagcaaggagaagcagugcccacauacugagcacuacaccccagaugcucugcuaaacgcucugggcaaugccuucaccuuaucugcucucugggauucuaacugcccccucccaacacacacacacacacacacacacacacacacacacacacacacacacacgaagcuuucagacuccucacuguugccacgaaggcccaugugugaccuggauccugucacucaucugccacugccgcuccccacccucaagccucacuggucccauccuguucccuugccucaaggccuuggcagcggcuguuccuuuugcccugaaacgucugcuacugggugcccauuuccggcuguuuuccuccugccccccaauucaagugccacuugcacagaaaggcuuucucugaucucagaccuccacaucccaaaucagcccccagcacaucacuuucuuuuuuucccuagaacuuacaauaaucuuguauauauuuugugcucuuuucuuugagacagggccccaaacuuguaauagaaggcuuccuaggugcuggaauuacagauaugcauaagcacaccuaguuugucuacuggccugaggacaggaagugugugugugugugugugugugugugugugugugugcgcgcguguuuucuaugucacagccccauaugcuuaggggcuauguuuuccgauggugagauaacaugaaagacaaggauaaagagaagcaaacaguaugaguucauuggagaaucgaggaaggaacauggagacuuaggcuaggggagggagcuggguauuguuugggagaugaacaaggugugaggaggauaccuguguggaugccccacuugcaaaagaggcugcuuuccgagaaaccgguggccccuaugaucugcccgaucacgugcacuucagccauggcucuaggaaaggaaaaauucaaucacaacccugugagguaacuguauuauuuccaucugacagcugggaaaacugaagccuaucacauaaagaacagcacugugauucuaagcuaguuccaccaacccacugacaauguggccuucaucacagauacaagccacguccccagaaaagcccaagaaaaauggggaagucucccagaggugugggaaccugcaccaauaaauaaaccaaggcucagacgcuuagaaagccccgccccaggguuguggccccgcccacaugugcaaggccccgccccuucgcggcagaucagccaagcuucaaaaggcgcaugcgucucgucucggguguagggccgcuuuacccuugcccguaggcguagcgcaugcgucauuccuaccuccgcguacuugaccguuagaagugaaagcugccucggggaugguaguucacgggcuucuuugcgggcgccgucgagacuagucucgcuccccucccgggcccuuccaggcggagggagaucugagguagauagauccgcagccucgcucuccuggggugccccgacuguugcuggggcaacagcagguuccuccccugagcccgcccugcgugcugaugauuggugcuauagcugcccucuggggggcg

SEQ ID NO: 3633 - RNA, 18078 nt, Mus musculus
ccgccgccgccgccgcccuucgcgccccaggccgucccccuccuccucccgccgcggauccuccagacagccaggcccccggccggggcaggggggacgccccuucggggcacccccggcucugagccgcacucggagucggccuccgcugggagccggcaaaggagcagccgaggagccguccgaggccccagagucugagaccagccgccgccgcagggaggagggggaggaggagugggaggagggacgagcugguugagagaagaggaaaaaaguuuugagacuuuuccgcugcuacugcaagucagagacguggggacuucuuggcacugcgcugucucgcaaggaggcaggaccugaggacuccagacagcccugcucaccgucguggacacucgaucgcuacccggcguuccucagacgccccuauuccggaccagcccucgggagccacaaaccccgccucccgcgaagacuucaccccaaagcuggggcgcaccccuugcacgccgcccuccccccagccugccucuugagucccucgcaucccaggacccucucucccccgagaggcagaucucccucggaccugcuggcaguagcuccccuauuuaagaacacccacuuuuggaucucagagagcgcucaucucgauuuuuacccuggugguauacugagacaccuuggugucagagccucaccgcgacuccugcugcuuucucccucaaccucaaauuauucaggacuaucaccuaccuuuccuugggagaccccaccccacaagcccugcaggggcggggccuccgcaucccaccuuugccgaggguucccgcucuccgaagugccguggggcgccgccucccccaugccgcccucggggcugcggcuacugccgcuucugcucccacucccguggcuucuagugcugacgcccgggaggccagccgcgggacucuccaccugcaagaccaucgacauggagcuggugaaacggaagcgcaucgaagccauccguggccagauccuguccaaacuaaggcucgccagucccccaagccagggggagguaccgcccggcccgcugcccgaggcggugcucgcuuuguacaacagcacccgcgaccggguggcaggcgagagcgccgacccagagccggagcccgaagcggacuacuaugcuaaagaggucacccgcgugcuaaugguggaccgcaacaacggugagcuccgaggggccggggagccaggagggagcccccagggggcgccggagugcaggggucaccgggaggaaauuacccucagaggaaacuggcuggaggaaggggagcccugggggcaccgggacaacugugugggugucccaaagaggcuggcacuuucccguaccccaggugucuuugagaggaauagacagccugccaaagugauccucuccuagaaaagcaaggucguggggagaguccccucuagaagaggagcauuuggcagguuuuguuuuaaguuccccuaauggugccuaaaaaugcagggcucgcuggguggucucuuuccagaaagguagaacccagcucaagagaauggaagguguccaacauuucggaauggagaugcaauguggaaagccgaccccagaccgggucgugagauggagagaaaaccuaggggauggguacccuagaacugccaaauaaaaucucuagugggcuuacucucagaaagcgacaggcgcacgcuagagagugugaucuguggagucacuacgggguuacaagugaaaaaggaaagcgacguuguugggagaaggacucuagagaggagcagagagggugcggaaaaugagcccggaggugucacgaguguuuugcuugggggcguaaaagagcgcgcgagccggcaggcggagcccagugaaggaagcgagcgaguccucaagaaaucuagaauacugggucauugggaaggagucauaaaaaggggagacuggcuuaggaagguggccccccgcggcagccaggcagacggagcagggauaccaugccauccaggagugaguggcgagcgccccucuccugggcguggaagggaguggcugagccucuggagucgagcccuagaggagcagcuagaaguaggggagaggcagucuucaaaacucaaaugaaaaaaccgaaucgguaaggaugaggaagcccccacgugggugccacgcgcguggggaggagcuugcgcuucuuggggggguaagaggaccccacggaacugaacgcugacaggcuguaaccccaaggucccaguuccuccuaccggaggcuggggaaaacccagcguccggucgccacgcccuccucccuucccuuuccuucccgugcccgggaggaggggagacagagaucgcgcgcggagccuggggcgagacgaggcagguccggaucccgcccucccuaggcuguuagucucccgcccuccucaccccaguagugggcggggaaacucacggccccgcccuguaggcgcccacgcgggacccaagcgucgugugugaccggggaacuuuaggugucaguagcuucuccagguuucaccuuccuaaccccagagguggacuuaaggauuauuugcacauugcuggacccaauuguggcucaggccuaaugacaccccucccuagccacgacuuaaugugaccucuucguuggagaaguccuuuacucuccugagacuguauuucuuacgcauauaucucuuccggcaugugccucucauuuccgucuccucucccacauaccuauucaucucuaugucaccccauuucccucugcgacacccacaauccuuccugcccuccuaucucuccccuaucggcuacccccagcugagaucccaucccuccauugugguuugcugaguaacaaccgaaccaagaauagaggcccucuguccuucaucgacgucugggaucaccaucucauccccacuacaagaagccagaagccccagcagacgcagaauuucgggauuuugccccuucguuccccagugcagacauccuuuaggcuaggaagcccuuuagugaauggggcucccaaaccugcagucacucuuaccuagaaauccucuuugcugcuaacacgaccaggaaaugggcuaaagaggggaguaacuaaugacacugaugacaggcaaaugauaauaaacccccacuggccaggaaauggcagaguuuugggauuaggaccacugucugguugucuccaucugaucccccccuccccugcuuauccucauucccacucaguucucccccuccauccaccucccaugacuuacugacucgcugugcagggguggauugguacggggugcgggcuuccccuucucaggagaggagggggugagggaaggggaugugaggggggacuggaaggagggaaagcugaagucggguuauaaagugaaugaaugaaugaaugaaugaaugaacgaacgaacaaacaaauaaaugggggggggcaacccaaucccaggcugccaagucugucuaugacuguagucccaguacuggggagacaaaggcaaaaggacugcuucaagaccauccuuggauacacagugaaugugagacuagccuaagcuaugaaauccugucuccagaacaaaagaaaauaaacaaaaaaauuagucccuggggcgggagagauggcucagagguuaagagcacuggcugcucuuccagagguccugaguucaagucccagcaaccacaugguggcucacaaccaucugaaauaagauccgauuccuucuucuggugugucugaaaacagcgacaguguacucauauauauaaaauaaauaaauuaauuuuuaaaagcuuuuaaaaaauuagucccuguaauaagguggcuugaaucuuaccauguugugaagucucaaugccuuuaucuuuuguaaaguguuuaaaaugauaucuuuaccaugcacuguauuccccucaccuuuauuagcacacacacaugugcacacacacgcacgugcgugcacacacacacauauguaggcuaacucccagugaacagcuuccugacucaggcucaggcuccucagcuuuggcugcagacucacacuagcuaaaauacacuuuauuauguuuagcuuuuccccagugucucaucagcucuguuaauccuggauuugauuggugucuuacaguuaaagagagaaguuuggccgcuacugguggcacaggccuguaggauuugcugaaggaggcagaggugggaggaucuggaguucaaggccagccugggauacacauuuuucugccagccagugguggcgcacgccuuuaaucccagaauuugggaggcagaggcaggcggauuucugaauuugaagccaguuuggucuacagauugagcuccaggacagccagggcuacacagagaaauccugucucaaaaaaaaaagaaaagaaagaaagggagggagggagggagggagggagagaggggggagaggggaagggaaggaaggaagaaaagaaagaaagaaagaaagagagaaagagagagagaggaaggaagaaagaaaggaaggaagggagggagggagggagggaagaaggaaggaaggaaggaaggaaggaaggaaggaagggaggaagggaggaaggaaggaaggaagaagccacagguaacauaguguuucaguugcagccgccuaggcugggaaucagaacuuaaugguacuuauuucauccaagguuagaaggcaguuggcccaguaguagagcacuuccuuagaauccaccuccaaggggcuguguguagcucagcgaccaagcgagcgagcgcucccaccuagaaccugcugugggagucacucagugcacgagcacccaaccugaguagcagcagggaagcuuucugaucccccaaauuaugccgugcaauuuacucuacaacuucuguuugguuuuguuugaggcguggucuccugcagcccaggugaggucagccaguuaagaacauuagagaggggccucuaagagcagucaagauaaccagcuguucuuccagcggguugggguuuccaggaccuacauggcagcucacagccaucuguaacuccgguucuagaggaucugacacccucuucuggcuuccacgggcacuaggcaugcacucugcacacagacacacggaugcagccaaaacaucccuacacauaaguaaacugaauguuagaaugugaaguggaaugccaaccugaguuagagcccaugggcucagaagcagggugucucuguuucuuccauccuugucacagaccugaccugaugucuuccuccuucugcuccuccccacccagccaucuaugagaaaaccaaagacaucucacacaguauauauauguucuucaauacgucagacauucgggaagcagugcccgaacccccauugcugucccgugcagagcugcgcuugcagagauuaaaaucaaguguggagcaacauguggaacucuaccagguaaggcuuugagccugagagguggcacacaggucagcccugcugagguguggccagguggcucaguuugaaggcuccuggguacagagccaggccugaggguagagcacagugucgaagccuaagguuuuuauuuuuauuuuugucuuguuuucaauugguugguugguugguuggguuuuucgugacagggucucucuguguagcccuggcuguccuggaacucacucuguagaucaggccggccucaaguucacagagauucgcuugccuuugccucuccagugcugggauuaaaggugugugccaccaucacccagagaauccuaagguuuuuuuaaaaaccgcucagauugcauccuauuaguugaauuugggaguuugaacuguaaaaaugcagaaagagccagggauggauaucuggcuauguaugcaugacuagaaucccccagugaggggcagggggcguggcucagugggagagccccugccuagaaucccccagugaggggcugggggcguggcucagugguagagccccugccuagaaucccccagugaggggcugggggcguggcucagugauagacugccuagcuaccacuaaaaaugcauuagguucuguccucagcacagaggugaaaaaaguaacagugaggaagaaaaagaaguuggagucuuuaggagcagacacuugcaaauccuagcacgugggacgggggaggcaggagaucaggagucugaggccagccuggacuacaugagaccuugucuggaggcugaggcaauaagaucucuuaaacccaagcauucaaguccagcacaggcagacuagugagaucuugucucagacagagaaauuaagcauuucuuguagucucuuaaaucagcagucaaaugcauuuuuuuuuuuuuuuugacaagaguucccuguguaguucuggcugucuuggaacucagagcuccacucaccucugucuucugaguauugggauuaaagaugugucagccaaaaauuuuucaacccgggaggcagaggcaggaggaucucuugaguucaaggcaagccgagucugcagaguuagugccagaacagcuauggcuacauagagagacccugucucaaaaaaauaacaaaaguaacaaaaauuuaaaaaaaaaaaauugggaagacuguucuguguguguacucauaauaauaauuauaaguaaaauaacaaacuauaaauaaauaagaaaauuacucccaaacucaggguaauaaaacugcugaacugugcacaauaguaugagcaaugaccacuugcauugugaguccucccugcugccauguugcagcagcauuauugagacccggcaaggccagcaagugcccauagcuugcacaguaccucaugcacagcugaggagccucaugggaccugaccacagccuggguuguccuccuugucccauguccuauuccagucugucuccaccccuccuccccugccccuggcugcuuucuguucuugggggcuguaugugagaguguggccugcagggcucauaugugucagaagccagugucuggggcuggucuggaagccaguuugugagacaggcagcaugggguuacagccagauuaucugggggcaagauggcagcgaccauacuccucuuugcucucuuuguuuccauuuagaaauauagcaacaauuccuggcguuaccuugguaaccggcugcugacccccacugauacgccugaguggcugucuuuugacgucacuggaguuguacggcaguggcugaaccaaggaggugagauugcuugucuuugugccauccuccaguggggccacuccuccaguggggccacuccugcuuguccuggcgucaaccugccuagcacuguguuccccaccccccaccucaccccugccacacacaugcacucgauagugaugucaagaaguaguacuccagccaggcagugguggcacacgccuuuaaucccagcacuugggaggcagaggcaggcagauuucugaguucaaggccagcuuggucuacagagugaguuccaggacaaccagggguaaacccugccucgaaacaaacaaacaaacaaaacccaaaacaaaaaaagggucaaucuguagagggaugcuugggauagguggugacccaaacagucccuguccuugcccucaguagaccucauaguccuuugguaguugaaggaggaguugacuucuagcuaggugcuuuaugaauagugaggaaugggguugaguacucaagaggugccugacuacugucuggauucaaggagggcuuccuggaggagagggcaucugagguaaugucucugagaugaauaaaggcaagaaggaaaaggagaugcaggagcacccuguaucaaguacccuguaucugcagccagggagauccugacauguccaucugucuaggagugaacaauuuuccuugucucuuaugggucccacaguaucuuuccagauacugguaaggucuugucggagcucuagcaggcaguaauggccgauaacgaugaaggggagaccuauacagagggggcaggauuuagaugagggaagccaaaggugcuguggaaacccaggcaagguuaggaucuuggagggcuuccuggaugagaaugugaagagacucaugggaaguguaguuuagccacauggagggugagucuugagugggcuggcaccaggaggaauguggaaggccacuggacggagguggagaaggguuuugucugguauacagucggcgcuuagacaguauuauuauguguccacucaaggaacaucucccuugagccagugagauggcucagcagguaaaggcaccugcugcugugcuuaacgaccugaguucaagcccaggacccauaugguagaaggagggagccauucugaccuccuugcccaccuuggcccaugugcacccccguaaauaaugaggagaagaugccagcuuagguuuuccuggugccuuuggcuauggcuucuucuguggcccuggccaagccgcuuucucuuggggugacuuggaguuaaaggaguuugaagaucaauggcguuaacacaguuuagaucagugacgggcaucuguguuagcguugaacauccugcgacaccaacacugcucguggcccuugacaccugggucacaauagauguuuauuguuaugaucgaggcccaggcucuacagagcacagagauaacaagaacccagggcagcaugcacgaugguacacaaaccagcggagcccugcgcuugugaggcagaggcaaggggaccacgaguucaaggucauucuuagcuccauagugaguugaaaauuugaggccagcuugggcuaccugagaccuugucucaaaagcaaaagagggcuguggcgagggcucaggggcaggagcaucugucucgaaggcgcgagcgaggaccugaguucuugucccuggcacucagguaacaagucaggcauugucauagugugugcccguaaucccagccuuguugggaguuccacguguguauggagacaggcugacacacggcucuaugaccugcuagccuggccaaaggacugggcucaaguucagagcccaggcaauaagggagaaaggaauagaggaagacacuuguuacccagcuauaagccuccucauguaccauacacagaacacaucacccauacauauucucugauauacauaaaauaugcauuauauauacacacauaaauauauauauauacauauacauacacacacauauauauacauauauauguacauauauacaauuuuaaaaauuacaaaaugaaaggaaauaaggcaggauacuccccugugcauguuuuccuuuuuuggguuuauuuguuuguuuguuuguuuuuguuuuuguuuuguuuuguuuuguuuuugagacaggguuucucuguagcccuggcuguccuggaacucacucuguagaccaggcuggccucaaacucagaaauccgccugccuuugccucccaagugcugggauuaaaggcgugcgccaccaccgcccagcuauguuuuucuacugagaccaaagaaguaaauauucaugcagaggugucagagccccugcuugccguggagaaagggaacagaugccacauuuggagaaggacgugucucuuucagagccuuucccgagggguugauguuugagcugagcccugaauaaggggagaaggguccagcaauucaaagaauaggagcaagaaugaaguguggggugacuagccgggagcccccaaggcuggcaguuuccuguccccucuucccccucauauccucagacucccuuccucucccgcagacggaauacagggcuuucgauucagcgcucacugcucuugugacagcaaagauaacaaacuccacguggaaaucaacggugagcuaacuucccggguccauccugacacaggccccucauggucugugugcacgugcaugugugugaaaucucacccaucccucuaaguguguguauguccuucaccacaacauccaaacccaacagggaucagccccaaacgucggggcgaccugggcaccauccaugacaugaaccggcccuuccugcuccucauggccaccccccuggaaagggcccagcaccugcacagcucacggcaccggagagcccuggauaccaacuauugcuucagguaaacacugucucucuccgaggcugugcaggcugcgggcugacugcagccuguggacuggugugccaccauguaugccugcagggcuuggggacaaguuccugguucugugggcagcugagaguccuagaaugagggguguuuucuuccuggagugcugggaucagggaauucaacaagaguuggaagucuguuggaagguugucugguuggguuuuaaaauucuugccaggcuucugccacuuugggaugcuaaugaaagaauuuacugugagccauggagcguguugaccccaggaaagcuggagugcugggauccaaacauuuggguuccgaaucagaagguggucugcacuggguucccacacucuuggcagaugguggucuccagugcugguggaugagagcggcaaauccugggucucagaauggcagggcuggcagggagauguuagcaucuagaguggagguggagaaagccagaaagugaguuuccugagggccagcgcuuuaucuggcaguggugcacccugaggaggugagaagauagaacuucugagauguauguaggcuuggaagugugaaguguuggaauauaguacugagauagggaacucugaggagacaagaucucucagagucagagagugggcguccuaguguauccagaaugcccguaccaagggccaaagcuuuuuggucauuguuuuuaaguuauaucucuguguguguguagggccauugugugugugugucuguguguauguaggggcauccaugccacaaaacugugugacggucagaggacaacuguugggaguccguucuccuuccaccaugugagucccagauauaagacucaggucauugggccuggcugcgagcaccuuugccugcugagccaucuuguuaguucuccuuuguuugguuuuguucgagacagggcuuugcuguguaauccaggcuggccucagauucacuccuuuagcccagacugucuugaauucucuguccugggauuacagaugucacacaaccacccaguuccagaaugguagacucauauuaagccucgguacuguggaugagagaaagaaauuggaacguuagauccuagaaggcaugaaauucagggguguugagagaugagagcagugagcugaccuaucccuuaccugcuucagacuuuauagaguucuguguuacauaucgguccuuggcuggccggccuccuccuccuccuccuccuccuccuccuccuccuucuccuccuccuccuugucuucaccuuugguugucagccuucacauaggaucagauguccggucuucauacugcagguuacuaagagaugcaggaagcuauguaaacucuguuccucacauacugggaaacaaacucagggaaucaugaaaaucucuuugucugucugucugacugacugacugugucugucugccugucucucucuuauauuuguuuugccuaugccugauguauaugugggcucugggaauccgaaaccaggucuucaugcuugcacagcgagcacuuaauucccugagccaaguccccggcugugacaagcaaaauuuugcauggaagaacaccaugccaucgagcaaggccuaucagacacaucaaccaugaucugaugggaacuguagcuccaacucccauguugcagggaacugcaacagagggacagacuaacaacauuagccagcaccacagggacgcacccagcaaagugcagauggugggaaaccuagucauuucuucaacagauacagugcaaagaagggaggggaggauauauaguccacacuacuagaagagagaggaagagagggcugagagguuggaggaggaggaaagaaaaggaaagggaaaaagauguuuaugggacacagugggaaacaugaaccuugaguaguauuugauuuuagugauuuaauguuaaauuuuugccuggggaagggggcuggagagauggcucagugguuaaaagcacuggcugcuuuuccagaggacuugcguucaguucccaccacccauaauaaggaucacaccugucuauaauucuagcucuagaggauuugaugcccucacacaugcauaagugcagguaaaacaccaauauacauuaaaaaaaaaaacaaaacaaaacaaaacaaaaaaaccaacccucccuaggauuuuguuguugcugcugcugcauuugugauacugagaaaacccaguaccuuguacauaguaaagaagcacucuaccacugagccacgcccccagccccucacugggggauucuaggcaggggcucuaccaccaagccacgcccccagccccucacugggggauucuaggcaggggcucuaccaccaagccacgcccccagccccucacugggggauucuaggcaggggcucuaccacugauuuauauuuuauauugauuuauacuuuugauucauguuuaaauuguaaaauauuccucacuuucuaagagaaagugaacuuuucuacaaaaguucauuaaacaaaugaaaaaacuacaguggcggaaagaaaguagguggaaugaaauuggccacgagucagcaacuguugucauuuacaguuguggagaugcgaauuaguuaagaauccauaauucagaaguccaaaaucucgcuggccauggugagcaaggcuguaauccuagcgcuggaguaggaacgggaaccgcaggaggucaaagucauugauagguacgucguguguuuguggcaaccaaucagacccugccucgagaaaggggguggggcaucuggaaggaugaggagcacagcugcucuuucagagcacgcagauucauuucccagcaaccuacauggcugcucccagcaauccauagucccguuccagggaaucuaacgccuccuccuggcccccaugggcucugcacguaugugguguguguacacacauguucagagaaauacuccuacacauaaaacuuuuuuuuuuuuuuuuuccgagacaggguuucuuuguauagcccuggcuguccuggaacucacucuguagaccaggcuggccucgaacucagaaauucaccugccucugccgaccgagugcugggauuaaaggcgugugccaccacgcccggcucgcucucucucucucucucucucucucucccuuucuuucuuucuuucuuucuuucuuucuuucucucuuucuuucuuucuuucaaguugacagguguggugcaugucucugaucccagcauucaggaagcagaggcaggcagaucucugaguuugaggccagugacaaacaaauuucaggcaaauacauagauccugucucaagaaauaugaauaguaauaaaaauaaaauaaauauguaaagucuauguaaauauccccuuaccccaaaaagcuauacagucuagaauguuucuggucccuaacguuucugaaaagggguauuccguuuauauuguaacgcacugcuucugugucucuucacaauuuuccauggcaaagcuguuuuuaugccaucuuaaaaaccaccucccccgggguccucagggcuccucacagauuaggcccugcugggucucagacuggcaagggaggcuugaaaaagcagugacucugaaaacccugagaccgcgucccaguagggcgcccccaugugccaggcggugguggugcacgucuucaauuccagcacucaggaggcagaggcagguggaucucuaugagugcgaguccaaccaggcuuaaaacguccugccuggacuaggcuggcuucaaacuugcagcgauccucccauuucggcuucuugacuacaguugugcacagaggugcaugccugccugguucacaugugucaaguuuuauuuuuuauuauuuucuuuuacaugcauguuuugucuuuguggauguauacguggugcauauguggugcccaccgaggacaaaagaggauguuggauccccuagaucugggguuacaaguugguuuugagccuccauguuggugcuaggaauugaaucuggguccucugcaagagcauccagugcacuugaccucuaagccauuucccaguuccuugaccacauuuuagaguuauuuuuggugucaugaggaggaaccugcauuuuccuuccuugaauuacuuuguccugauucuaaaaauaaccccagccacugcuaagaauguggaaaauccagaaagucaucacacuggugaacguaaaacgccacugucagcauuuaguauacauccugccagccucuuuguuuguaauggaauuugaauuauacuauaccuguaucuuuacaucaugauucugauacaugucaggaacacagaggcucaaguguccuugcuggucagccugggcuacaaacugaauucugggucaaccuaggcuacguggugagaccuugucuuaacgcuccucucuuuugaggggaucauggagggugagguggcaauugcugguaaucccagcacuugggaggcuaaggcaggaguuaucagaaguucaagguuagccugggcuacauaacaaaacccagucuuaaaguaaaggacuggccagagacaggagggucuggggaguuugagggcagccugaucuucguagugaauacuaggacagccagggcuccauaaagagauuaucucuaguagaaauguuuaucaguuaauucauguacucaacauuugcugaacauguauacauuaagagacacuuucccauggagagaugaggacagauaauauuuaguacaaacaagcugaaucauuccgagacggaaaauaaaacuggugaaauggccagguuagaagccaggccaggaaaaaugaauauuagagcuugguguggugcacgcucgugaucccagcccuggagaggcagaggcaggaggaucaggaguuuuggguuggccuuggcuacaugaaagccugucucaaaaaagacaaauaaacacaagaaauccuggggaugaauuaauuuuucuguucugguuaaaauuguuuuaggguagaaauuccaaauguagacagaaaaagcaaagguauauaacccucuuccagcuuccagcauucucaggauuuugaugacucacuucagacacucuggagcuggagacuuggcccaacaguuaaaagcacuggcuguuuguucuuccuuaggaccuggguucaguucccagcacccauaugguuacuuagaaggacaaccaucacuaacuccaguuccuagggacuucaugcccucuucuggccuccuuggguacugcacaaacauggugcacaucaaaacuuacguaggcacacauaugcacacaaauaauaaaaugaauacauaaaccuuuaaaaccuagagcaaggggcuggagagauggcccagugguuaagagcaccgacugcucuucugaagguccugaguucaaaucccagcaaccacaugguggcucacaaccauccguaaugagaucugaugcccucuuauggugcaucugaagacagcuacaguguacuuagauauaauaacaaauaaaucuaaaaaaaaauccuuaaaaaacaacaacaacaacaaaaaaccuagagcaagccaggugguagugaucccaccuuuagugccagcacucagaaggcagagagacagguguauucuuaaguucgaggccagccuggucuacauacagagugaguucugggacagccugucucaaggaagcaaacaaacaacaccaaaagcuuuauagaaauucaguuucgccgggcaugccuuuaaucccagcacucgggaggcagaggcaggcgaauuucugaguucgaggccagccuggucuacaaagugagcuccaggaaaaccagggcuauacagagaaacccugucucgaaaaaaccaaaccaaaccaaaccaaccaaacaacaacaacaaacaaacaaacaaacaaaaaaaccaaaaaaaaaaaaaaagggaaaagaaauacaguuucuuguaguaauuguaguacugaauucccaggguggaauuuaacaauuguuuggagggagaguuuggaaggcaaguggaaagggcuggucagaggaggcacuguucauuuauguaacugauacuggacaccugcuucaagcaagauggcauuuuuaggaguuaaagcucccugggugguagaaaguaucucacauagcccaggcuagccucaaacucacuaugucuccaaggaggaccuggaacuucuaaucacccuugccugugccucccagguguugggaucgaaagugugagcccucuugccuggcuaugacugggucugaggacuagagaggaagcccauguggcugucagggugggcgagggaggacacugaggaaagccagauagacucauggugauaacaggcauuugacguaaacaggaggaaggagugaguagcuauggccuccaaaggcuuccaucuguccuguuugugccauucaggagcaccggcccuagccccauauucaguagagguuugguaaauauguguccuacaaauaggacgugcaggcacauguuggacugugaauuacuccuguguguucuguggggaugugacaggacuuauuacguccuccccgagagugcucaugggacuguugcuagcccugcacuggcucucaagugccugcccagugggaggugcuucacuggcagccuggaugguuguagugucacuauugucaucacaggcguccuggagagccugagcuggacaggaggcugagggcagccgagggcuggagcgggcugcaggguugucccugcuucugaccuuuguuccuccugccugcagcuccacagagaagaacugcugugugcggcagcuguacauugacuuuaggaaggaccuggguuggaaguggauccacgagcccaagggcuaccaugccaacuucugucugggacccugccccuauauuuggagccuggacacacaguacagcaaggugggucuggcucaugggacaggcuggagcagaggcuggggugguagggagagaaugggaagcuuagagcaguggggagucagcgggauagggugacagagaaacggagaagagcagggggggggugcagagcagagcuggagagauggaaagaaacagauugggugagaaaggcaagagagcuagugauguggagagauacagaaaaggagguggggagaauuggagaugggagaguaagugacugaggcagacaggaagaggagauaggaugaagagagagagagagagaggaagagagagagagagagaggccgagauggggacagaugagggacagagaacaauagggagagacauauauagaaauagacugggagagauagggaaacagagauggaaguugaggaggcucagagauaagagacagaaauguagagauccugguggggagagagauagggggagccccuguacucuggcagugaccccggcccacccgcagguccuugcccucuacaaccaacacaacccgggcgcuucggcgucaccgugcugcgugccgcaggcuuuggagccacugcccaucgucuacuacgugggucgcaagcccaagguggagcaguuguccaacaugauugugcgcuccugcaagugcagcugaagccccgccccgccccgccccucccggcaggcccggccccgcccccgccccgcccgcagcgcccggggcuguauuuaaggacaccugcacccccccucaagcccaccuggggggcccauuaaaggugacagaggac

SEQ ID NO: 3634 - RNA, 7985 nt, Mus musculus
ggaacuuugaugcuugggugccgcauaaagacgcuugcguaaccggaaguaccugcggguaccuaggguccagccuggcuuccggagcccgcuguggcgguuacuguguugaagagaccuguuauggaggcgguggcagcugcagaggugacggagaggaagccggauaauggugagacguuugccaggcucaggugaccggagggugcucuugcggugugaccaggaaaugguuccggcaagcgcugaggacucuaggaagucugaccgccgcuuacuggcacuuucaacacuugguccaccuugugggucugguuauucggccuuguagcagguugacguuucccuucuucuuugaaaugaaccccuuuccauguccuaggcuaacccacuuuuuuuuuuaccaugccaacgcuucaagcaaauaacaacucuccugcagauucuuccagucucagaccaaccuuucucaaguuaacaucauuucugugccaaccugaguuucuccguaucccaagcuagcucuccucuugucccaugaaagcucacaucaaaccaacagcccccauugcauucuaacccuuccugaccccaacgucugccucuuuagguccuaaaguucucauuccgccccuuuagguccuuucucccucgcaccuucaaugccuuuuacuuugcuacugacuuccuacaaguauuggcuugggggggcgggggcgggggcuuuuguuuuguuuuguuuugggguuuuguucacagccuuuuauuauugccaaggucagccuccaaauugcuguccuccaaucccaggucccaagguacugaguuuacagcccugugccaccacgccugucuuuaauguuucauaguagucugaugugcgaugacaacuuggaacugggaguuacugaagcugaauagcagauuaugaauguagaggcagagguguguucuaguguguguuucaaucuuugauaaucuccaauuguggugauuuauaucuguaaccccagcacuugggagacugaggcaggagauuacccuuaaguuugaagacauccuaaacuacauagugaguuccagacuacaaagucaaacccuguacuaugaggcccugcuucaaaguauauauauuaacauuuucuguaacaaaauuguauguaucuuuuaaacuuucuggugcugggccucaagccuuacaaaugccaaucacauuugcuaccaugaagccauaaaagagaaucuggggcaagauguggugaaaugggccuauagucaggagccuagaagguucaaagccagggauuaaggccguagcuuauuagugggauguuugcauagcaugccugaggcccuggguucaauccccagcaccaucuaaacugugugugguagagcaggccuguccuccuagcacugccaagacacugcucauaauuuucuuacccaucaccuacuacagcgugcucuccacccugaacuuguuccagucagguaggauccccagggacguccauucauggcuauucaaucuacuugauuagaguuuuguuguuuuguuacauucucauuguuauucauucauuuguuugauuguauauuuauuuauuugaggugggguuucacccuguagccuaggcugaccuagaacucacuauguagucuagccuggucuaaaacucaugaaucauucuaccccagccuccugaaugcuggggcuauuuguguguguguguguguguguguguguguguguguguguguguaugcauacauacauaccugcccagcauccagacuguuuucuuacuauacugcuuccagcagccagugccagccaccuggcacaguugccuuaugagagaaacaauaugcacugcuucccuucuguuucucaggcugcucuuucuuagcucuuccaacugcuauaccaaagaccagaaacuggguguuugguuuuuuguuguuguuguuuccuuuucgguuucucgagacaggguuucucuguguagcccugacuguccuagacuugauuuauagaccaggcaguacucgaacucacagguguuccccugccucugccucccaagugcuagaauuugugagcugccauguggaugcugggaauugaaucuggacucuggaagagcagcagccuaugcucuuaaacgcugagccaucucuccagcuacaagaugucacuuuccuggcaagccugcuacccugcaguuuaaaagugagccauccuaacauuugcugcuucugucuuuuuuaggcuuuucauuggauacuuuauuuaucaucaucaucauuuuguuaucauugguguuuuggauuuuguuguuuguuuuuugagauuuuuauuuugaaauucaauaucacuguguaggccuggcuggccuugaacucagagagauccacuugccucugcuuccuccacgcugaaacugaagguguguaccaccauaccaggcuuguccgacugucuuucuaccuagccagggaagcacguaauauauuccaugguuguuuguuuguuuguuuguuguuuuuucgagacaggguuucucuguauaggccuggcuguccuggaacucacucuguagaccaggcuggccucgaacucagaaauccaccugccucugccucccgagugcugggauuaaaggcaugagccaccaugccuggcauauuccaugguuuuguuaauuaguuagacuauugacugugcagcaucacggccuguucaccauggucucucugucuaaggccuagaacauuacccagaauguagcagguacucaguaaacgugagcuguuugaaugugucaguucccagccuccuccugccuaagcccccuuccccugaugcccuuaacuaaagacuccucuugacucucagacggcguggagcccagaguugugcacuggggggagcugagccagacucccauuccaucuggaccgcaggagaaggagacagcagagaggacaccagacauccccaacaguggcagcucccaggcagagagcccggcugugagugccauguugcaugccaucgcugccagccaccugccugugugcagccagcagcagggugagccugaucugacagagccugagaagguggccauccugggccagcuguaucacaagaagccgcugguguucuuggagcgcuuccgcacaggccuccgggaagagcaccuggcaugcuucggccaucugcguggagaccaccgugcugauuucuacugugccgagguggcccggcaaggcacugcccggccucgaacccugcgcacccgccugcguaaccggcguuaugcugcccugcgugagcucauccaagguguggggggauggugggugagggggacagaggugggaggacaggaggacugaagcagagcaggagcccagagaaauccuuggagguagguuuugagacaaagagaccagaggcaccgacccuggagaaguaagggagagaaagauaagcagacagggucagaaugcagaugacggaguggcaucugugugacacagucucacuaucuagugcccaggcuguccuugaacccaaauuccccagccucagccuuucacaugcagaaguggcacuguagauggucacuguccucugauggacaagagcauacacagcaucgggguagucagcugccaccugaggaacagcgucccaucugcacaccaugaacacaucgagggaaaccaagggggcaugcgugucccccaaggccacccucaacaaaacaccaagaagagccugguguggcgguuuauaccccaacacuugaaaggcagaggcaggaggaucucugaguuugacgcuagcccugucuacaucguggcucaggccuggguauaugaacaggcucagcccaggcuauagacucaaugccccacuggccuuuaggcaccugugggugguguuaucauguuccugaauugcauacaaauguaugcaucuuacaagcagggcauuuacgcacaugccuagacaugugugcucacacacauguaccuugccucuuaugcacaggaggcgaguacuuuagcgacgagcagaugcgguuccgugccccacuauuguaugagcaguacauaggacaauaccucacccaggaagagcucaaugcccgcacagcagccccgcaagcccccagguccggcucuccuggcacgccugccuauccacucuccgaccugcuguuucaguccuaccaggaacgggagcugcagcaaaagcugcuccagcagcaggaggaggaggaggccugcuuugaggaggaagaggacagugaugaggaagguaagggcaggaccugacaccccacuccuacccccguguugugucacccggcugggccccagccuguaaaaacagacaugaugucugcccucacccccuucccugccaucuccuccugauugcugugguacaggcuccagggcacaauaucaccauuguguccagugugugugccaggagggcagagacugggcugucucagcagcacgggcugggcauggggugguaaccugucuccuucaggcugcccaccuggguaucuccgcagaccagaggucggauaaagacucggaagccugggugccugacucggaagagaggcugauccuucgcgaggaguucaccagccgcaugcaccagcgauuccuggacggcaaagaugggggcuuugacuacaggugccucccacccccagcccagcaccuauggucccaggcaggucccugccuuuccucagacagccuuccuucgcagugcuagagugcucgggaauaguuccccacugagggaccuggugucagucacucuggaaguuucagaucauugaggggagguggcugucccucucagagccuuagccccuucaucuguaaacgaagggguaaacugagccaacauuuaacgcaguguugacgaagcauuaaaugaagccuaauggggcacaccucaucccagcacuugggggacagaggugguuggaucucugauccagccagggagacaugaugagacccccaucucaagaaaaaacaagagaggggcuaggggagggagggagagagagaaagauaacauaccgucauccuagucuggcaguucaggacccugccugcucacauccagguccaaugacaugggaacuguguccacaaauagcuucauuaucgcugccauagcgaccaugcugggaucccacagcucugacaucagugauguucauccacugcucgcuggggccaccaaggcuaugcaguguuggcucuggcacacuaugagccagccccgcuacuacacuaagugaccccgaggacaccagaagagggggcccaagccuguuccuucaggagggcagcagauacccaaaugugucccacaaucaguuuacacuuuuguacaucugcuguguccagacccuaggguuaaagcagggauggauguagccaaggauuaccuuccugaaagaaggaaaucuccccuacagcaggaacugcccgacuuccacuggugagggagcucugaagaccgugcgggggagcagagcaguggucagagccucagugggguguuuucugagcagcucugcagagagcaagggugaggacaggugcaggcacccugaggcacaaaggaacuccagugcugaggcaggacugagacggcucaucccacaggaguggagccuuggugauucaggucacacaguggaacuggggugggugccacauaaaagccaaagccuuagaagcccgagggcuguggugucgucacaccuuccgaucugucaaagaagcaggcauuuuuuuauguaggcugauugggaaaacaccucuuuaggauucccaaaggcacaagcacacucagguggucaguucccgagcugggucugcuaugacgccugacagcuuucuucuccgcagcacgguggaugacaacccugacuuugacaaccuggacauuguggcccgugaugaggaggaccgguacuuugaugaagaggagccugaggaugugucuagugcagagcuggguggggacugauggcucucacccuuguagccaccccgcaggccgcuggcuaaaaccggcuuagugacucaggccccucuagacuuggcccaccucagacaaugccuccacuuguguuuagggguucccacuccucucugggaacauuacugcuccucuggcucuggccccaccugucuuuucucuuugagacaggaucuuauuauauaacuugccuguguuacuugcuuuguagccaaggcuggccugaaacucaguccuccugccucggcugcccccagguugcguguacaggcgagucccuaugcccugucuaccugucuuguucuuacucacuuucucccuucaugccacugccccaccucucgcuuccuaagucuaaccucugcgcauccaccuuguacccaucugugucacgggugcugugcccacagcagggcccuaacaacugucugguggcugcagcugccccauggaugcuaguguccagcuccaccagaaugccagcgcagcucuugaguuucuccaccucucucugccaguguccuacgcagggcccucuugcuucccccaagcucccaccuuacccuccaugccuccccacccuuguucacgcccauggauccccuggccuugaugucugccccucuuucucagccuuuacugcucuggcucucugggucccccuccccaggccuggcagccaagggcaucagaagccuucccuguggguggagguuaggggaacccagguggcaccagccucugcugcuccuuuuuggacacuagcugggagugccggcagaggcagggcuggguaccacagggccagcuugagugugggaggaacuugaagagggggacucuccccuaccaacccccccuuuccagccacaguuuuccuuuuccucacuuccuccaccuccaccucccuucccucucccucucccucucccucucccucgccuguuuacacuccccaaauacgcacaggcuguuaucaugggucuugagucaucacacacagacacacagccugccccagugucccugcccccagcuggccacagggcccgccccacagagcccccugcugcccugggcuaaugaaagccagauggcugccugugacucagccauggccugugggaacccagacgcccuaccuucccaugccccacacccggccccugcguccccagcagacagaagcaaccugcuccuguggggauggaggccagcgugucugggccugagaauccaaacugcuguggcacugaauggcaaauggcugcauucugcucuggccauaccugaaggaaccuaaaacugcuuuguaaagccaagguccugacccugggucuuggcucugcccucuguaucaaguaaacucacccagugggguagaagguguucucuuaaacuguugaaagauccucaacagcucagccugggccaggccugacugacaccuccuaacagaccuggaaacaagacuguuggucgccacuugucucaaaggauggaaagaacccagaaguagccauuugcaucuugagaccaccuggucucccaugcagaaccaagacuggaacacacuuggccagugugccuccauguguccucauuggacagcgguggagauccgaagacagacuuccucccaucucgggggacuguagaaggugcagguguugugguacacaguaugguggcaggugguggacuguuauaccccuacccuuaccuccccagaggacgcagugaguccccagcugggaucccaccacacuggacaggagccaggagugcucuuuugggaaguuguggcuuagguauuuuucacaguugaccaguguucuguccgaucauuaaacuuauuuaagauagaaacugccau

SEQ ID NO: 3635 - RNA, 32272 nt, Mus musculus
uauuuucuucuuuauuaagacagucucauguagcccaggcuggccugcaucucucugugaaaucaaggucaaccuugaagucuugaucuuucugcuuauaccucucaagcgccgggauuaugugcaccauguuggauucuugaguguguguaaugcuuguucugugucuguuacuaaagguucuuccuauugcuggugaguaccugccugcugauguuugcagauuuacaaguguggguuuauauguuucuguuacugugagugcauaacugggccuuugcauuuguggcuagguuugccugagcaugugcacuaauucacaugucuguuacuuuggaauguuuguguaagacccugucggggaucgcucucucccuccaucccucucucucucucucugucuggcucgcucucucugucuggcucucucucucugucucucucucucucucucucucucucucucugacagagagggaguauuccucagggcuuucugagagucugacuuuccuugguuguauauauuugucuaugugcaugguucaugucuacucucacuaaugaaaacauucccaugugucccucaaacucuucuuauucuuuuuauugaggucagggucccucuagguaagccacgauggccugcaacuaacuuuccauccucuugccgcucagguguugggauuacaggagccuuucuucucacaguggggaaaccgaaucucuagggagaggggacguagcacaguugaauggacacaagagacagaauagugacugacaaaaguuuuaugugaucugagccucucuggaggcaccagaguccacacuucagaacaggcauaggggacuggcucaaggggcaacauggccccaaaugaggggagaugacccaucccuuggaggaaagcaggcauucccagugcaucgcacaggcuuaaggugggguguaccccacacaaggagaggaggagcauaggugcuuaaggagggaaaggacuuaggauggcuacaagcgcccacccuuggagucguaccuaauacucuagacuguggaccuuuagaaucucagacacucaaaacauuggcuccauagugcuuagagauuuaagaucuuuagacauauguauucuugggcauuuaauuaugugcuagaaaggcaaaaagcagcauagaaccuagagguguccagcauuagaagugguuagaacuuuggugucucauuaguccucguuaacuggagccucuugugacuuagaugcugaggacccacagcauccuacagggccugagacgaagaucaggccaacauuagaguuuuagaguuuaauaaucuggaauccugggagcagaugacguggaagcuuaggaaucuagaaccuuggacuaaacuuuagauuaucaccacaucauagcuuagaaacuccaucuggagacucuuaaagcuuuggaauuucagagucuagaaucauauuuccuugagauacaggauuuuuauauaaaagaaucuauggucauaaggcuucagaaucuguaguugaccaucacuggggucuuagaaauuaaaaaaaauaaaaguuugaaacauuaugaucuggaguauuccaacaugagcccuaaacuguuaaacuggagaagcaguaugccuuagaaccuucaugccuagaaucuuuagaauuuaaaaaucuacaaucuuccacugacaggaccccuggcuccagaaaaauaaagucuagaagccuuagguccuggaaucucagagucgugcaaccuaaaaccaugggagcauugccacgaauuauagagccagaaaaaucuagagccauagaaucucagagccuucgagcagugggccugucuauagcaacagcgcugcagaccuagaaacaagcaucucgguccaaagacucaucaucuuugagaacuuugaacucuaaacucaaaccuuaaaaucuagaacgcugggauggaagaugugagacgaucccuugaaacuguuauggauagggugcauaaggcauggacugcaucugagaagggagggaaggccauucugcaucuggggagaaggccuggagugacggagugggggggugagcuuucccccaguggcagugccuagcuuggguccugagaggaugucccagguggaagauugucucaggcuccguccuccugcccuggaggugcugggcagccucugucagcagacagaguggguccuggggcuguagaaggacaaaggacauagcguccagcugaguggacgucagcugcagugagacagcuacaggaauccuuaggaucagguuggguuggggggucagcuccuccagcagccccacgggguucaagguggcuuccgcccucauccauguugacauagaggauuucaucuggcuccugagcagggggcagagccuucaguguguucuccaagucuucccggagcuccgcaaaacuuggccggucucgaggguucaguucccagcaccgagacaucagggcauaccuaaugagggagagcaaagggggcagacugagcaggggcucagaggguagcaugcuagaaguuaaggggaggauuuagggcauucgggugagaaugagaaccugggagcuagagagagccucagcaacuuagggaugccuacagagauuugagaauugcaaaguuucugaggugggccagaagcucaggaacuaggaaggaucauagaaaaccucucugaguccugggugguuuuuaaugggaguuugcuagggcagagcuucccaguguggccacacagaacagacucuuguaccaaggccuggccuugaugcuguuuaccaagcacauuggggagggggcgaggcacaccuauggaaugaacuagaagucauaugauuuuccuauguccuugcguucuuugacacgccaccguucaaaagcugaggcuaaguccccuccugaguguagggauuugcuucuagcuuagcagaagacauggcgcacgugugacgucuaagacuaggucauaaaaggcagcgcagcuaccucuugcacauucucucggaucaucuuguaaggaagcucaagucgccccaugaagaggucucaucuguuuauuuguuuaugucaucauauagcccuggcuguccuggaacucgcucuguagaugagcuugaucucaaacucaagagaucugccugccucugccucugccucugccucugccucugccucugccucugccucugccucugccucugccucugccucugccucccggaugcugggaauaaaggugggugccaucauccccagaaugagcuugccacuuugaagucagcuuuccagccucagcguucacaugcauccccagcugcugccuugauaaccuugugacagaccugcagcagaaccacccuacugggcuacucucaggcugaucuucaggcaccaugaaacaaagguuggguuuaaaugauuagauuuuuggaguguagcagcucauacagcagcaaauaauaugcccuccccgaagacuucaauuuucucauuggcaagaauggggcuaaccacggugccugucuacuaacggugacugugggaucaaaugagucaauacaaguggaacacuguaucacugccuuccaggaaguucaguaaaagauuagcuauuaaucucauccucuucggcccgaggagcgcccaaaggaagcgugggggaucugaauccccccaccugacccaagcaacacccucuucuuaaccuuaaaguaugggcuaaaaaccacgccuuucucuacacucugugaugccgcaaagguuuccugcuagcgacucagggaucuaagucuggagaaggucaaugaagcagaguggggguuucugcacaggacccuggguguugaggcacaugggagguaagggaccaugggagguaggggucccaaggccagggcuacccaggaagguuguaugcaguugaucaucgcuuaagaauaccuggcugaggugggacgggguugacccagcuugccuuccacacagccaacagagaggaaaaagguuccuuuagcaaucucccaccccacuggcauucucagagcacuggugaggggcaaauggguuucuuaauauucugagggguuccaugcacauugagucagaacuugagauguuguugggggcucaguguguguaauugaggguuggauuaaauucugaggugggguuaaggagaguuuuaaagguccucacaggccguccagacaguccacaggcuguuucagccgauuuccuugacgcagguagucguaaaucucacuguucuccaccccuggauagggaguuuggccucggguggcgaucucccacauugucacaccgaaggaccacugucggaguagaggaagcggggugagaggaucucuccuacacaaggacaccuccaacaugaguuaagacaagcacucaacacuuacguggacauuugucgacagcggcaucuauggguguaucacaguaugcacagggagauuuugacacagguacacguacacacacacccacacacacacacccaguaacugacuuuguaggaugcagagguaugcacaccuguguacacauuugcaugaugucacaugucacccuucaugcccacauuguuguacacauccuauggcauacuuggucaccacugcuuccugaguacccaugcuguuaccacgcaaccauaagccuauuuauguccuagcccugcucacauauuauucauauauucuccaaacauguccuggccucacagacaacuuugcaaggaugcccacaggucccugugagcccuucagcuucuuaggccuugucgcccaugcugucaugauuacuugcuccuggccagggcacacauaccacaucgcucuugcugguguagacccgaucugccagacucucaauagcaauccacuugacuggcaucuuggcaaugcgcccuuggcgguaguaauccccguuguagaucuucuuggagagcccgaagucugccacacacacggacauguucucauucagccugccccgguugggaaaagcaguaaggucaggacauggcucaucuccaccaggaagccugcuggguccaccuccugccugaccccagaguccugcugaggguggagcucugacuccgaaacccuuaccccagucccagagggaaaugcuuugcuucuaguuccugcuacagugagucuggacaaaagggcuuccaaaagcuuucucagcuuuggcuuuuuaucaaucuugagaucuuuucgaaacuccagagucccuguucuguuuucuuggauuuaaaaaauguuuauuguuucaauuauguuuaggugugugccugccuguggguaugugcaugcgaguguggguacccauggagguccgaaguguagacucuccuuggggcuggaguuacaggaggccgaugcgaaccgaugugaaccgaugcuguggguucugggacaugaacuuggaaacaaacaaacaaacagccaggaaugaugguguguaccuauaauaucagcccuugggagacagagaaaaaagagucggaguugaaguucaucuuucacuauauaguaaguucagugccauccugggcuaggugagacccugucucaaaaaaaaaaaaaaaaaaaaaaucaaacuuuggaggcugcagagauggcucaguagcuaauugcacucguucuugcagagaacccgggcuugauucccagcacccacacagcagcucacaagugucuuuaacccuggugcccucuuuuggccuccuuggcacugcucacgcauaaugcagacauguagucaaaacauccaugcauauaaaauuaaaauaaaucuuuaaaaaaaaaaucaagccaaaccagacaaaacaaacaaaggacgaaaaaaaaaaaaaaaacuaacaaagaaaucaaacaaaaccuuacacaauguguguguguagaucagggagggcagagacaauaacuacacaagugcauccauauagacaguaucuauaucuuuuaaaaaguccaagaaaggccagguguggcugcacacaucuuuuacccuagcacuugggaggcaggggcaggaguaacucugugaguacaaggccagcuuggucuacaucgcaaguuucaggacagcccaggcuacacccaaauaaacaacaauaaagaccccaguguagggcuucucuagaaagccuuuccaaccaucuccuugcuggccuucucuggugcuuuggauauaaagugucaccccacaaaggggaacaguccccugaaggcuuaauccccagcgggugaugcucucccuugaugagcucacagcagagcggucaguacaaggagaugggggucuagcugcaggaagugggcacugggaagguuccucugauggcuauaugucucucucugcuuuccugcucccacgagguaagcagugauacaccgcuccgcucuaucucagucacgacgccacaccuucccaggaguccaccgcgauggugccaggugaccguggucuggaaucucugaaacccugagcccaaaucaaucuuuccucuucacuuguuucccucagguauuuugucacagucacaaaaaggugacuaccacaccuuucuaaccuugucuggagguccaacccucccaaaggcuccaguuucccuuucauccuggggguggggugggggguggggaagaagcuccuugcggaaggaggggcuuccagagggcuugccacucacaugcaguuccuggcagccaggucccgauguaugaaucucuugguacucagguacuccauaccacuggcaaugucggccaugaacuucacuagcaucugagugggcaggaacuggagggacaaggccaggagaaguggucagagucaaacaagggccuccuucccucccugugugugucuggaucuacucugguuuucauggcuuugagaacaucaacccuuuucuauagcuacaggguccuagaaaaccuacuccucucugauuugggcuauuucucuagccuuugauacccaucugagccaggaccccuuccuggguuucagacccugguccaugcuaagccuugguuaggaauuuguuuccugcuugcaucucgaaguaucuccccagucuccuucaaggucacccuuucagucaggccuucccuccaccccaauuaauuccaaggccaccuuaucguucuucucuccuucugcauuuucuucauagcacucacugcucuugcuuauuccuguuaacuuauuuauugccuuguccaccccugcaauacaggccccucgagagccagcuagaggucagccguagccuuccuucggcgccugcgcagcugcuaauuguucagugaauacucauggaccggaagaguagaugccucucaccacuggcugguccccgagccgggaguacaggaggaaacuguguaggucuccguguuucaugaaaggcaagaugaccacagguucugggaaacccucucugucagagcccugaaaacagacgccugagccccccaccccaggaagaucaguuauucuggcuaggcagaagaggggaacccaacuccgcucccagacagacucagccucccccuuucccacccccucaaaucuaaucuccacauuguuugggagguagaugguaaggaugaaacuucggagaggccauuucccagggauguuuccggagcccuccuggggacccucagcuauuucugggaacaggucaggggucgcauuccaaguugagggagcaaaagaaggggagcuugcugauccugaaggagaagcggguagggagccaggaagucugaucuuucugggcucugcgcugggccugggagaacaugcuccucccucaccaaugagccucaugacguugggguggucaaauuccuucaugcagacagcuucacucaggaaauccuccagcucugaucuugugcagauggcaacuuaggggagaaagggaggugagugacaaggguggaagggggagggaggaaggaggagggagaggauuucuucuucccuccuccuccagucuacugccauucuucacuaccaccaccaccaccaccaucaucaucaucaucauccaaauucaucaaauguuauuacuggaucuuaagauguccuacgcacuguuuuacuugcauaguuauuuuauccucaguaaguauaguacacauggugcuagcuugucugcuuguuuaugaaggccagaaagggaugcuugggaagacuuucuagagaagcccuacacuggucuugcaaaugcaaugcaguccccucgcugggagaguuuagacaagagcucuauuggugagcuguguucucaguuccuccauggcaaauucuaaccaagcauuuuacuacugagccaugcccccacccccucacugggggauucuaggcaggggcucuaccacugagccacacccccagccccucacuggaggauucuaggcaggggcucuaccacugagccacacccccagccccucacuggggggauucuaggcagggcucuaccacugagccacaccccagccccucacugggggauucuaggcaggggcucuaccacuaagccacacccccagccccucacugggggauucuaggcaggggcucuaccacugaggcacuugguuuuuuuuuuuuuuugaaacaaggaaguuuaugaguuggaagccaguuuuacacacauuaugcaaugucuuauaaugaaaaaaaaaagcaguagaaaguagcucagagggaggguauuugucugacauguacaagguucuggagucuccagaaucaacuuucgacaccccacccccacucacaggcacaaauacacacgugcgcaugcccacacacacauacacaugugugcacacacacaugcacaaacacacacacacacagcagcuuaaucuaguacacagaagaugcuuaguaaugaacacgcaaaugcauugacggcuccguagcucaggccccaaaacucaaaauucacacaacaucauugcucucugcccuccagcccuagccuaaccccgauaggcuuuccuuccuguaggaaaaggucuucuccuugauuccuuaugcuguuuaacuacugacuggccuuuacccucucugaugagauaguugcaauacauuaucaguaugcauuacaugccaccacuggcacuuggugcuuuguuuuauaauaguccuaagaaauagugacaucaugaauguuuuuuuccaaggaagaaaggaaggcuuggagagguaaagucagagcugauaaugcgaguggcuggcugugccucauucuguccugcccuccucaaaaagucauuuccaaguucccuuuccugcuagcgucuaucaguggcagacauuggugaaagagaagccaggauaucucacccucuuuccacuuccauugccuuggaacuguuacauguucaccagguuuuuuuuucuuuuucuuuuuuguuuuuguuucuuugagacaggguuuuucuguauagcccuggcuguccuggaacucacucuguagaccaggcuggucucgaacucagaaaucugccugccuuugcuucccaagugcugggauuaaaggugugugccaccaccgcccagcuguuugccagguuucuaacucuccccugggaagcccuugauucuguguucucagcuccuugcuggcuaugggcucugccuacagcuuccucccuuugcccuucagccuagagguggaagugacuuccuguuguugcuaaucuguuugucuugauguuucaguuauuauuaugcuaccccaaccuucauucaaugugacagcaaugucccuaaauucaacuccuauucgagugucuggcacaggcuccauuuucucgcugggaacacugguacuuuccggagcauagagaagaggcuuggguuagggaccggggcugcugcacauacucacuuuucauggucuucacagcgaccuugaggauggagucauccugauugagcugaccuuccaucacagcgccaaauucuccuggggcaggaagaagaaagacaucucagaggggucaguguugccugcaguuggcugagaacuagggagagaggaaucuuggcauuuugguggguuaugcgccuguauguguacaugugccuguguguguaugugugugugugugugugugugugugugccugugcacauucguggaggugugcuggaguaacucaccuucucccagggucuuccccaaggccaccuuaugccgaucuaccaugacgucucguaguuucuccuucagcucuucacugaugcccagacuguucacugagaugaggcagacggagccguguggcaggguugaugaucagguaaugugaaccaagaagggcagacccacugaugagucauugaacugugucuagagcacucaacccaucccaguuccuguagccucccaaugggcuccauagaagcaacuagccccagucucauuguaguggguacucuaacuggucagugcccucuacugcuuguuaaacauaguucuucagagucuggaguuuacccgcacaaagaaauggucuuucaagagauagaaagucuaauuagcuaaucacccagacuugauaacugcacacuauauacaaguaucuaauuaucccccuguauuucagaaucuguaccccauaaauauuauaauuaugugauuacaaaauaagaaagguaggcauaguaucacauuccucuaaucaucccuuagggaggaaaagcaggcagauugcugggagcuugaggccagugugggcuacauaagggggcuggucucaaaauauguaucuuuagcauuugguaagcagaggcaggcauauauaucucugugaguuuaagacaaggcuggucuacuuaauggauuugagguggaugugagggcuacauacugaaauccugucucaccaaaagcuacuaccaccuccaaaacaaauccauaaucuuccuauaagaaaauuauuagguacuguagaagucacuauauucaauuuaguuuaaaaaaaaaaccagucuuaauaugcagccuaacagccauauuaccagccccucauugagggauucuacacagggcucuaccacugagccacgccccacccccucacuggaggauuccagacaaguguucuaucacugagcauugggcuauauccccagaccucuuuugagacagucucacuaaguuacacaggcuggccugaacucaaucuagcccaggccagucucaaacuuucaauuuuccugcuuuagccugccaggaucugccacccccguccaguuuaagauggcaguuuguuuuauuuuuaaaccuguguuuauauguauguauggguuuuugccugcauguauagcuguguaccguguauaugcaguacccauggaggccagaagaugacaucagauaccacggcacaggcguuaguuauugaaggcugugagucaccaugugggugcuaggaauugaacacagguccucugagaaaacagcaaaugcuuuuaaccacugagccaucuaucucucuagcuccugacaaugguuuuuaaaaacccagugacauauaggcauauguucucucaaccacagaguguuaaugucgucacagaucagggagccugagggaaagucccuugaaaguuuauaaagaaugggggugcaaaagagcaagcagcaucuugguaccacugugaaaaucauuuugaccucauggauguccggcucagcucuccagaaccucuugggaccaggcucaugcugcgagaauuguggcuuuguaucacuucaacaaaucaccauggccauccaacuacuguuuccuucucuucuuaaguaaaugucuuucccagcccuucccagcaucccgugggacacuggcagucugggcugugugcuagaucuagacuuagauuuguccuuuugcucucuggauuucaguuuccucggcuggaaaacugaggggcuuuuaugggugguggccuuggaggaugaccucagcuggggccuucugugacucuaucgucuuauggaucuacaguucuacgacccuaugacuuucaaaacugagagccuagagcccugaguauauuguuuuccagaccaagauugaaucuagauuucaauuguuucuaauguucuauaauuucaagaggccacuucugaguguggccacuaggaauaucgacuucagguuguauaugguggcacacucaaguaaucccaggacgugggaauaugaagcaagaggagagagaguucaagggcagucugagcugccuagugaggcaaugccuuaaggaaccaaggguugacuguaugacucagugguagccugcuugucuugcauaugcaaggcccuguguuguagccccaagaagggagagggagggagggaaagauggagugagggagagacaguuucagacagacaggaggggagagagagguucagagcaaguugcuggagguaggaucacaacuucaagagaaccucgguuacaaagaaaguuuaacgguagccugaaacucuaucgcauaaagaaaauaaaaccagauaaacaugaacucauaggaaaacuggcugggcuuaaaucucccauauccauaaucuugcaagcuguguggcauuaagcagguuacuuaguugcucucugcuacagcucccuuuucuuugaaggcagggugauaacacagcucaugccuuuggguugugaggaucgaaugaguagauguguauagaaugcuuagaacagugcucgucguguguguguguguguguguguguguguguguguguguguguguagggacugucacaccauugucauugucggugucaucauaauugccuaacaauaucauccaucaucaucuucuucaucgguaucaucauuaaacauuaucccaagauguucuggcucuuagauuuguuguucugaagauuuagugugucugggauucaaacuguccuggccagcacccaggaaguggagacagaaagguugcaaguuuguagcuagcuucgucuauaguuccugcuaguggaagauggaggcaagagacggcaguccagccugggcuugaucucaaaacaaacaaacaaaaccccaaauccuuauugguugugguuaauuucaaccugacaauaucuagaauugcauaggcaacaggccucugcgcacgucuuggagggaguuucugaauuagacacuaaggugggaaggcccaccuuaacuguggucugcagcauuucguggccucggguucuggacugaacagaaaggagaaagcaagcugagccaggcauuugucucgcugggcuuccugacugcacacaggaauugaccagccaccuaacacagccuuucuucgucaggcuggacuaguccugcccucaaacacugagccaaaauuaacccuuucuucuugaagcuguuuuuuguccucagugcugagaaugcacaacacccuaucgucuacuguucuaaggcuguguguggugcaagccucacagugccuagagccugaggcucucagaaacuguuggcuuaugcaucugcagaagcucagacucggcuacuggggcccacuucucuguuuggaguucacuuacagguggcuucagugguccgccggcuguaggacuuucggacacgguaccugacuaccaguucaccucuuuccacgguuggcucaaacaccucccuagggguugaagggagaaggugagggaugaacagaaccacguggaacccuguccuucuagugggcacugaagcaagcaccagugcauuccccagcugugcagcuugcucuccucuucagugcaugcugagcacaucuggugcugagcacaucuggaauuagcacucccugccuuccaucaucucuucaggucuccucauccucagacugcccacauacacacacacacacacacacacacacacacacacacacacacacacacgcacaaccuccucauuggucuuccaugacuucagcuuccccgaugaguucucacucacccauaucgagucuccuucuuccuccgauggacaaggaacagggccaagaugaggacgcaggcggcagccacaagugcucccagcaguacauaccaccaaggccacgagaaggcgcgagguggggguucacucacugucagaggguaugggggacagaucacacagcuaagcccccuggauccaguucccuggggcccaagugggagugacaugggagggagacaggagugugaccuggguggaaagggaaggugagguguguguauauagggggcaugaacauacagggaggggauagacgagugugggagagagcuaguaauggugcaggggagacaguggcaggauaacugugcagagaagugaccuagguguggaaugaccagugagugagggagagaauucacauagugcagaaggugcauggagcacaugcauggagcacaaggcugaggaacaauaaacuaaggaauaucuuuuaggagugcucaaggaggcgaggacaaacacacgugcauaagggaagugugugugcacgcgggcacuagcaagcaugagcacaaagaaugggguggccauuggaggaacuugggcacaacacaaaggagaaauguccaguuuguuuuguuuuguuuuguuuuguuuuguuuuagggagggucaaauaaaccccaggcuagucucggacuuaguaugcagccaaagaugucuugaacuucugauccuacugcuuccaccuccugagugcucggauuacagugaugcaucauugugacuggcuuauggagugcuggaccagggccuccugcaugccaggcaagcacucucuaccagcugagcuacaucuccagccucccuccccgcuccucuuucuuuuuagagucaagguuuuuugcagcucaggguggcuugaacgaauucuucugccuccauagccuucccaugugcugggguugcaagugugcaccaaccaugcaggcugucagcagugaucuuuagggaugugauugagcaugcaacaagugugcaaugaacaugcaacauacgugaacuaagcaugagcuggcaagugaggcgcacaggaagggcacgggggaguauaggaaaggacagguguagagaaaggagggaccgacuaugguuggucaugugagugugcuaagaguacaaggagguaggugugugcgugugucuaucuguguguguuugugugugucuguauguguuugugugugucucuguaugugucugucuaggcaugugucugugugucucuguguaugugucuaggcauguguacgugucugugugugucugugugugugucuaucuaggcaugugucuguguguguaucuguguaugugucuguauaggcaugugucugugucucucuguguauguguaucuuugugugucugucugucagugucugugugugucuguuuaggcaugugucuguguguguaucugugugugugugucugugugugugucugucuaggcaugugucugugugucuguguauucgugagaguggagcaugugcugggcaugugugaggaaggaagggcugucuuggggcaugagaggagggcugaggacauagaaggaggaggcauguaaagagcacugaaagcagugagcuggguucuaagugguggcucugcagcguuaggagggugccauggaaguggaagaagguuugagaauugcugaagaaauauuugaaaaagagaaucucucuccuuccuucucuucccuuuucuuccuuucuugcauccuucccuccucuucccucucccuuccucccauugaucugucuauucaucucuuauacauuccaucuauccauuggccuaucucuauaugaacucaucuauauguauaaccauucacucuccauaugccugcccaugcauccauccauuuauacaucuaccuauccuucaaaaaauuuuuuuugagacagggucuuacuauguggcuguccuggaacucacuacauagcccaagcuggccucaaacuuagagagauccaccugacccuaucuccuaagugcugggauccgaugcacauaccacuaugccuggcuaucuauccuucaguauucuuuucccacacaugcggcuauccauccaggugucugucaacccagucuccauauacuuauccauucaugcauccauccuuuaaucuuuccauccauucguucacccacccacacaguguauguuaauucacuccuuacacacccaugugucuguacaucuacccacucucccauaccacacucacugggccauucuaggcaccucccucaaggaccucacaaacugaagaagugaagggucagagagauguguuugggaugcaugacagcggcguguaaaagguacauguguggugaugaggcccucgcuguguguugagggaaggcagagaaagggggcgcaaaaagcccuuacccagaugguggaguggcuguccuugcccugugaggagaaaggacagaggagagacaugcucagagagggcgagacugacaugacgccaagugagcgggcugagggaggcucugugucaggcucaggguagcaacagagucuaagcugagggagcacucagaggcauggggaacaagucaagggugccaggaagagaccauccuaagggaagcuugaagggggcuggguauggcuuuagaguuaccugggcgccagggcucuaggggcacaggaaggcuccagggcccauccccagccgagguauaggcugucacagacacagucagguuagccacaggccuguccccccgcaguuccaaggucaccucucgaguuagcccuauauccauaaguaccuaggaaguccagaggcgacaucaggagggacaccuacaucuagaacuccuaagacucaacucuuguucauccuuuccccuugucucuacauuugucuccacaucucuagcuccaugcacucuggaacgucagcugcacagggaagaaacuccgccucaucucuggccauauccuuagcuucucagaacagugcuuggcaccaggcacagcucagcauuuguugaagaacugaauucucaucuuuuuguccucaucuaaccccuucuaacuucccaccccucucuccaccuugggguacagcuagcccagauaaaacaucuguauaaauuaggaaguuccucaccucuaagaugcuguaaaaguuacaacacccaagcccacugaggugcuguuacaacgcucacagacagacauuccucagccccuucuucuuggauccauuuaggauuuccggaaugcgccacaguggacaugguacaacaguauaguagugcccgguuuucauaauugccugcaucuauuuugucaucucuuccccaucucccgcuucccacaaccauuccacccuaacccagccagcagcacccaccucggggguguccuggccucgauaugccagccgguacccuaacagggugccuugcaggggcacccuuggcuccugccaacgcacgaggaccuggcucccauuccgcauggcgcuaacguucucagggggacccaagggcacuggaggacauggaagagggaagcugguacccccaccuuuuccugauccccuccccuguucccaggaaguggagcagguugcaaagaacacacgcgugggcaacucgugcaggccuuccaugagcggaagcacagggagagauuuggagagaagccaaugggcagagcucggggguuaggggcuggacaaagagacuaaggccauugugggauaaaggggugagaggagaauucagggugggaccaaugaaagcaaagcccaaugguaucuuccuccuaugacuuucuuaccucccucuguggucuccacaggaagccaguggguccaaggugaggggcccuggcugcugcugcaggauauccggaugugauacggggugugaggaaggagcuuuuccagccgaagcuggugggggggcacugauacuugcaaggugagggggucuucaggaggaucugacuuucccagccagauacccaccccaucgucugacagcacggccugaggaaagauaggaggaucagacgacaguuaacaguuacacuagugugugugugugugugugugugugcgugugugugagagagagagagagagagagagagagagagagagggagggagggagggagagagagagagagagagagagagagagagagagagagagagagagagagagagagaguuuguacaacucuauguguuguagcgccacaacaggacaaugggcauucagauuugcaaagcaaagaaauuguauggccacacccugucuucacccuugcaaaagacaccucuggcaagacuucccccaccucugccggcuuucugagccucaguuuccucauuuagaggaccagagaugccuugaaagguuauuuaaagauuaaauguacagggcuggagagacugcucagugguuaagagcacugacugcucuuccagagguccugaguucauuucccagaaaccacaugguggcucacaaccaucuguaaugggauccaaugcccucuucuggugugugugaagacagcaaccauguacuccaugaaauaaauaaacaaaauuuaaaaaacagacaaaaaaaaaaagauuaaauguacaaacugcaggagugguucagugguacagaguauacucuggauccgugauaucacacaaaacacauaagcaaaaccucaaagcaacaacucaaggacaaaaccaaccaaccaaccaaccaaccaaccaaccaaccaaccagccagccagccagccagccagccagccagccagccaaccaaccaaccaaccaaccaaccaaccagccagccagccaaccaaccaaccagccagccagccagccagccaaccaaccaaccaaccagccagccagccaaccaaccaaccaaccaaauaaaaacauuaaaugcaguugugcagcugauguggugacauacaacuauaauccagcucucagugaagcaggaggaucaccaguucaaggacagacugggcaacauaguaagauccugucuuggaaaaaaaauuaaaaagagaaaaagccaguaucuugcccaccauugagugacaagggaagacuccuuguuaugugacaaaguuuaaugauauguagguuaguuuguuuacaauauuaucaacuugucccccucccugacuucuuucuuucugagacagugcuauuauguaucccuggcugacuuggacuugcuacauugaccaaucuggccuucaacucuaaagacacaccugccccugccuccccagugcugagauuaaaggcaaguucuauuaugucugguuauugcuauuguuauuauuguuguuauugugauuuuugugugugugaguguguguaugcucuaggacaacuuauaugagucaguuuucuucuucuauuaauuguguccugggaauugaauucagauuguccaguuuggcagcaagcaccuuuaccuggugagccauccagcuggcccccaccuuguguuuugagacagcgucacucaguaggaccugggacucacugauuugcuagacuggccagccagugaauuccagggauccaucaucucccucugccccagcacugggguuccauguguguucuacuaugcucagcucuuuuuuuguggcuucugggguucaaacuuggguccucaagcuugcaugguaaacacuauacugacugagacauauaccuaagcccccuuucuggcacgacuggggaugaacccaaaggucucaucaauguugagcaaacagucugccauuaaacuauaccucaguccuaaaagucaauacauuuugagagccuacucuaugcuaagucccuugcuaagccugcacccagacaaacacauaaaucccuccugcccacuuagggguucaauuauuuuucucuuuccaguuuuacagauggggaggccaaggcccagacguucaguaucuuuccgaaaauaacaugguccccagagagggugacccuggcccuauaagacccgaggaggaggcagguuagugauggauagcaagagggggcaagucuacucucugacccacagugacauacaggaagaggaaccucugccaggacaaaggggagaugggugcagacagugggcucaaauucacucccacuucucuuuucccugggacagccaugacccucccucaggaacuguccagccggagccugugggcagcaggaagugagaccuggagaaggaagaacccacacuucugcuuuucuucgacacugcauggauguggguaggagggcagcuguggcuugacccgacauuugagauuguucaaguugguggaaugccaggauugaaccucaguuuuguucuucuggcuaaggggguugggcuggaggugcaggcuauuuuccuuucaggaucucucaguuucauaccuugaaagggaaaugccccgcccuggucaauucuaugaaugggcucuaccucaagucacacccccagccccucacugggagauucuaggcagggcucugccacugagccacacccccugccccucacugggggauucuaggcaggggcucuaccacugagccacgcccccugccccucacugggggauucuaggcaggggcucuaccucaagucacacccccagccccucacugggagauucuaggcagggcucuaccacugagccacacccccagccccucacugggggaauucuaggcaggggcucuaccacugagccacgcccccugccccucacugggggaauucuaggcaggggcucuaccacugagccacgcccccagccccucacugggggaauucuaggcaggggcucuaccacugagccacgcccccugccccucacugggggauucuaggcaggggcucuaccacugaaccacgcccccugccccucacugggggauucuaggcaggggcucuaccacugagccauacuuucagcuuucuaagucuuuuuuugagacagucuugcuauuuugcccaggguagcuuugaacucuccauccucuugcuuccaaaugcugacauuacaggccuguacuauuguaacucuccuguuauauguuccaucaaacagccuuaucugccugaccuaugcuacauaacauugaggugacgaugugacuaaaaauuaguguccuuagagagcccaaaugccauagugggaaauaccuacucuagaaagugacaauccagaguggucagggugaagacagugagcauaggguugugacagggacagcuauaaguccugacaacuuaaagaguuccgaauccagcuacacucaauauuacuaauacuaaaaacaauaaaaccagcuaacaguccauaauacauccccagacaauguuuuaaguuggcugcuugccuucauuuacugaauccuuauuucuaucuuguaaauauuagcauuaugaccaucuuauagaugggagaacugaggcccagaauggucuuugggcuuuacucaaauucacacagccaacaggugaaauaggugagucuuggauuaacugguucggaagggcugguuuuccauugagaagaugauauaggcuugugguuguggauagaaggaagguugaggccgaagugaucaaagucagagggucucaccugcagguugcagugggugagcggguagaugccacucaggccagggguccaagcuaccucuagcuccguagguugucuggaaaccacguggagauggugaggccucugggggagcacugugggcacacaagggaaggcugacucuuaggaaacucuccccagagcccuccaucuucccucugcuuucuccucucaccucugguccagccucccacaccccugucaccaagaucugugaacccucuuguuguuaccugugaugguggcugugcgggagguggugacucccuuggcauugugggcuucacaugagaaagaagaugucuuguucaggccuggggaggaauaugagaaagccuagugucacgguggggaggacucccacaccuugucacacagucacagacacacacguauagaugcagacagaaacacguaugcuuacauacauauguacacagacauacgcacccagacucauuuagacucaugaaguguucacauguacagagccagaugguacacaccugucacaccagauaaugggcaggcugaggcaggaggaucucaaguucaaaccugccuggcagagugaguucaaaauucucaucucaaacuuaaaugguuaaaaagugaaugagaaaaagaaacaaagucgggcgugguggcacacgccuuuaaucccagcacucaggaggcagaggcagguggauuucugaguuugaggccagccuggucuacaaagugagcuccaggacagccaggguuauacagagaaacccugucucgaaaccccccccccccaaaaaaaagaaaagaaacaaaagggaagagaaaggaaagauaacugcuccuagguaugggggaggggaaguuuaucacagacacguggaagagcauagccagagauggggcaucuaggagaguccaggguggacauaaucagacugagcugggucaugugguuggagggggaggggcagggagaggagagaggggaaaugaggcacagcagccaggaggcccaaagguaaacaaaagaccagguaaacaaaaugguugugcucuaugaggaaaagcagcccagucccuuggguuggagaaguuuaagguaggguguggauuauaauggcuagggggacccuguauacggagugagggaugcugggagaaccuggaggugggcugguauguuaaguaggcuccucagucguuugucccaggcuugaaaucuaacaaaaaggauccuggaaggggcuggggagauggcucagcaguuaagaacacuuacugcucuuguagaggaccaggguuugguucacauaaccuacauggcagcucacagcugugaaucuagcuucaggggauccaaugcccucccugaucuucacuauuauagcaugcauauaucagguccacacacauauagucaggcauacacauauaaaacagacaagacuguggaagagucaucccuaucccugcagagaaaggggucaggggggcucuuauaucaacaugccaacauuaccaacauacacucacacaggccuacacagacuuacacggagacacaaacaaugaacgcacacuuaaggacagaguauauaauaauguacauagguuugcucauugauaaguuugucuccuacaacugcucucuuggucugcuucuggucucucucucucucucucucucucucucucucucucacacacacacacacacacacaaggucuucucacaggaugucuauaugucuaugugaccucagccuccuuucuucaugcacgucuucuuggauggcacaccuaagucacccugccccugacuaaucucuguagaacuggaaccuggcuugguuuccucuccucgcugccagcuugcucacacguugcccaagaaucauguuucuuagggcucucucucagaaucuccauuuuaggagcgcaggaaaugucuguuuuuguaacccugagguggcagcauggccgggcacacaguagguacucuacaaaugucuguugaaugagugggagaauuuuuuuuuuucccaagacaggguuucuccguguagcucuggcuguccuggaacucauucuguagaccaggcuggccucaaauucagaacucugcccgccucugccuccugagugcugggaucaaagguaugugccaccaccaucuggcugugagugaauuuuuaaaaagauugugugugugugugccacauuuauucaggugcccucagaggccagaagagggcaugggguucccaggagcuagacacauacaggaggaugugaguuggcccauggagguucugggaauugaacucagguccucuguaaguggagcaaguguucuuaucugcuaaacacucucuccuuccccagugaaaauuucugaucaagcccagggcugcacacaugccaguccgaugcucuacagaugaaccacacccccagcuccucccugguggauucuaggcagaugucucauugcuaagcugcauuccuagccuucuuuuuaacuuuuccuuggagauaggaucucacuagguugcccagaccggccuuaaacagacccuguagcucagaagaguuuugaacauguaauccucuugucucagccucuggaguagcuggaauggcaggccgacaaaaccaagccuuacaagccaaugaacacgugugugcaucuguguuuggguguguaaggaagaaaagggagccugauuauguaacaggccaaacaagccaguuaauguguuuuugaauaaaugucuuugugugucugggaaagguucgugggccaagguguuugucuugagucucuuguuuugucuuguuugugugugcaacugugucaucacugugcacacagacacacacacaaguguguacaaauacaaauacucaagacacaggccggcaaacacacagauaugcaauacccaugugugcagaguccucuaguaccggggcugcaauucugagccugguggauguggaugugcuugcguucucccaucuguguuucauggcuuguguaagucugagaacagcauguacuugugucacuguggcaucugcguuugugcgagcgcggcguucccuccaccugguauguuggagggcagccucucucucggcagacacaaaguuuccuuuucucagucagcaaagggaguggaacaggggaaaauccgucuugaaggccggaaggggguggguagggaagcgcccuagccuuggcugccccggcuggcugcgguucccagccaaggucaggugcccgcggcgcagcccccucggcccaggaagggaugcgcagcccugggagggcacccugaggggggcaagcgcuggaucacguccagccaccuggcacgugggggccaccacgcggggagcuggcgccaagggccagccguagcagccccggggcaaggagggggguugguucuggagcucgguucuguuccgaccgcagcauuccugcccccgccugagucaccggggcgccccccacccuccacuuccggccuguccuggugggcauagucugggauuucccauucucaugccccaggggcugcaucucaaaugaggacacugggaugagcugaggggucuaggaccccucucuccuccugcacucacccuacaggaaagccuguggacuccagauguguuuuccagauguacugccccgcccccaccccauccgcucacucccacccauggcuuuucugagggaaagagagagauggagggagaagaggacacgcccugacucagauagagagggacagagaggcacucacacgcacaaacugacaaaauucuuuuacaaagcacccuccccucccccgacagugaaucacucuuaaauacacagggaccguuauuagcacaaauguaaacacacagaaaugcagcacuggcuaagcuauacacuauucacagggcggaugcuguaccaaacacagugacauaaaugcacugggacuuacugguaaacacauggagacuaacaaugaggcauagccccauaaacagacagacagacagacagacagacagacacacgcacucacgcgcacacacacacacacacacacacacacacgagucagugugggaaggaacauauaaacacacagucuaacccucacacaugcacugcaaacaccuggccaaauaguauacauaguauaaauacugagaaacuacagaacuucguacagaacagcguacuucugucuccagacaacacauguugaaagggacagacaaaauggauacaaacuaggaagcaauaaaaguuaauguugacuccccccccacaccacacaaacacacgcagagagagaaagagagagggagagagagagagagagagagagagagagagagggagagagagagagagagagagagagagagagagagagaaugcuagcuuuaucugugccaaaacagaaacacagacggaugggaaaacaggcggauggggaaaacaguuauugcgcagccacaaaggcccucugcagagaccacaagauggggacacugccacauaugccacauaugcauggguuggcacagauucauggcuaacaggugagcgcuuaggguucagucaccaagaaucagaggagucaguaacagacccagagagagcagguguguacuaauauucugcugcgaaucucuuugguacaugauaagacacagaacuucauggugacgaucauacuuuucuuuccuuuuuugggggaggaggauugagacagggcuuuucuaugcaauagcccuggcuauccuggaacucacucuguagaugaggcuggccuugaacuaacagagcuuugccugccucugccuucugaguaagugcugggauuaaaggcauacagcacacugccuggcucaugcuuuuccuuugauggucaauaagaaacauaccaaccuagugacacaggcaucuucccucucucuuuggagacagggucuugugaagcccaggcuggucuccuugacuguugggauuacaggcacaagcugccacaucuauaugauaucuugauucugcaagggacugggaccucgcaacaguacacacaaccccccccccccccggccuugcacccugugaacugauguuguuaccuuaauauacagagguuuucaagcuagccacauggugucagcagcucuggucucaugaacggccaugaacacagagcacagaaggaaaacagauacaagacaaaguugaccuuuagugacagcuacagagacacacucugagagccacagagacuggcccccacuaagacauucuuuccuacuuuaagcaguugaugcugguggaucugccgacccgagaggacagggcuacacauucggaaauccucaccucuuugcagguguuuuugucaguaacacacugagagacacagacgacccucucacaccugcgggccccaucucuucccuccucccuucuugccagccaggcugacucaagccccauucuuaucccuaucagaccacucgagccacaggccugacucacccucugggggccagcaugcucaucacacuuccuugcacacucagggcucccagaaugcugggaaugugagcugucccccuccauacugaaagacccauccucaccucccccgagaggcagcagguaggauuuuaggaagccguuacucauccagauauugcuauguguuccuccaucucuucuucuuuaacaagguccccuagcccugucucugacuaccaugggacccuaagcaaagugaccaaucuguauaguacauaaagggagggucacgcugaaauaggggugccguuauucaggccacauuaucacgugucucuccaugcugagucacuucaguaaccuguucucuuuuaauuuuucuuccucaacauguccaacguuaaccucuaacuuacuauauagucagggcuagcuuugagcuugauaauugaggaugaucuugaccucugguaguccuaccuccaccagugccgugauugcaggcauguaccacggagccagguuuccauggugcuuugaguggacagggcugugagcgugcuaaggcaagaguuuuaccaacugauuaacagccccagcccuuugguuuucuuggguuuuuuuuuuuuuuuuuuuuuuuugguuuuuugguuuuuugagacaggguuucucuguauagcccuagcuguccuggaacucacuuuguagaccaggcuggccucgaacucagaaauccaccugccucugccucccaagugcugggauuaaaggugugcaccaccacacccggcuccuuugguuuucuuuauugacagggucucacacuguaacccugggauggccuagaacucacuaugucagccagacacaucucaaacuggugacaauccuucugucucagcuuccaaauucuaggauuauagguaugagccuccacccuugucuucccuaauugacuuucucuuuuacucauuuucccucccucauucuacucugggcucugcuuuuccaggaaagcucagccgagcauggacugaggucuagggaacacuucagaucagggggugggcaggucaaaggaggaaguggacagaggaggguauugguucauucugaugccuugcuugggucagggcugacaaaggagcaccaggccuacacauuugggccacugaacagcauuagagauuugggacaaagaaugcuauugaacagagaggggcuguggugagcacagagagagagagagagagagagagagagagagagagagagagagagagagaaagaaagagagagagagagagagggaggagagagagagaggcuggggugaacagagagaggcuggggugaacagagagaagcuggggugaggagagagagggggggcuggggugaacagagagaggcuggggugagcagagagagagagagagagaggcuggggugaacagagagaggcuggggugaacagagagaggcuggggugaacagagagaggcuggggugaacagagaggcugggguaaacagagagaggcuggggugaacagagagaggcugggguaagcagagagaggcuggggugaacagagagaggcugggguaagcagagagagagagagagagagagagagagagagaagaagaagaaggaggaggaggagaggaggaggaagaggaagaagaagaggaggaggaggcggcggcuggggugaacagaggcacacacacagaaguagugaaacagugauggagagacagagggauggagaacagacagacagaugaaaaaucacaggaagggaaauaagacagaagacagagacaaguagacagacacaucgaaugaagggcccuggcugcucugcuuuggcccacucucagacucaccuggaguuugcagacugugcugggagcuguguccugugacuggggccagggggacagcaucuugaagccagaguagggucacggguuccgggggucccugggccuggcagcuuagguugaaagggguguuggcaggcacagcuuuguccucaggcuccuccaggaaguacgggagaccugggcagucaaggacagaaacuugguucccucugacccucucagggcccccagauuaucauuaggauguuggaggugcuaaacacuacauccacccugcaggguuuuugacuugucccuuauaucuggucaccuaggaaacgugcgucaccuucagauaucugauccuuuaugcuuuuaugccuaggaccaugcuuccaacaucugguuuagccuaugccugaccaccuugaacauuuuccagggcauguaaaagucucgccuugucuguuuuucuuuuucucuuccucuuccucccccucuuccccucccccccccccaucucucugagauacaaucucucuacagagccuugacuguccugaaacucacuauguagaccaggcuggccuugaacucacagagauccuccugucucugucuccuuggugcugggauuaaagguguguguuagcaugccggggucuucuccuuuugagggucuuucuauguaucccagacuagccucaaacuacagaucaucugccucagucucuugaaaguggcaauuauaugugugcaucacuaugccuggcuuuccucguaucccuuuccuaaugaaggagugagguacuuggaaauaugggagaauuaacuugugugcagcugauucccagacuagaagguccuacuccaagcauaucugauuccccaggacauccaaaagcuccccaaaucucucuccucugggacauagaccugucccccauaauguauggccucccaugccuccccaacuaccaagauucccuaagucucuggacuuuaugucccaaugggaaaagcucugaguucuucaccugucauccccgcauaagcucugacccgagaacucaccuuccagcccuacaaagcccggcugagacacaaagguccguccuucuagaugcaccauacacugguacuccccugcaucugaaaguugcagggcugagauucuagaagggaagagggggauuuagaggcugggggucagagcuggacacugggauguggucagcagaacugaaagagggagggggucuggacaggaaacuuauaggaggcugaaguagguccuauuuuuaacucauuuuuacagaagaggaaaacgaaacccagaggucauaucacaagcucagagccacgugcccaguaaguggucagguggagauucccaacccagguggaggggcugcccaguggcuuggugcggaagggcuguguguauggagcucccuggucagugacaggugccacaccugagcugacugacaacuuuccauucaucuugccagucuucgcccagaggcaccugggucuggguguuaucagccaguucuaggaucuguccaucucgaagccacaccaccucaggggguucccccugaaccuggagcucacaccgaaguguccccgugaguccucuggcaccugugauauucccuggguuccccacaaacgggcugccagccucggucugugugucugucagggagaugguaaggagcaugguuaggaaacccgcagcucgcugcuccucugguccaccuucccuaucugcccaugguugccaggaccccacauaguuguagagugaccucagaggggggugggguggaggcaugggagaggauaggagucuucccaggggauugagguccggcuuccaucucauguccagucuguuaggaagaaggccugggaucuggcagccucccacgcccuggacugccuggcagggccgguccuugccauucuggucucuagagacuucacagucuggacugggagauagaggaaaagaaaacggagcagagaaggaaaggaaaggggaggggaggggaggggaggggaggggagagagagagagagagagagagagagagagagagagagcacuccagcagggcaagaacaaguggagggggacagcagugacaaagggggcccaggacucccaaacccuccuucucuagucuuccucuguguuuguuggggaaagagcccuuucuguaaucuggacccucuagcucugucccucuccucaggacacagauuccucaaccccccagcccucccucaacuccuccugucugucuuucugcccaguccaucuuuugguccucccgguuacuguuucuuguccuucuauuccucucugaguugcuuucccuaacuccaggcucuuugagucugugucuuucugccgccccccccgcccccccccccgcgcgcgcccaggccagcacucugucgucccaaggaaacucccuaagccagcccaguacccauaacaccugccagccagcccccaccuccucacugccccugcccuggaucgcaucagccggcgucucugccucagugagaccccaucacucacccuuaugggcugcacacccccagcagcacagcgccaaccaccaggccagcgggacccugcccauccuccagacaccaacagcucagauugaugccaaacuuucuuccgaaguugaugggcaccucgcuaggaaagggggcagggccggguuguccccggcccuccccccaccccugggcuccugggauuuggcacugcccgccuggcacagcgggagccccucggcuggcucaacuccuccgcagcuagccgccuucccggcuacccugccucauucucucacucccagacuucuuuccccgccccuggcucccccucugccuccgcccacuagggccccagccuuggggccacug

SEQ ID NO: 3636 - RNA, 391 nt, Mus musculus
cucucuuucucucuuucuuucuauuuuuuuuuacguaaauaacccguuuauugcaggcuaggcaagucucagacagcagggcuucugcugaucuuucaguuccuucagucuucugacggcagacuucacugugauugcagaggugguguuguagguccaggccccgccggccacuguuuuuaugcaggaaccacagugccagaugccgacggcucgucucuucaucuuggucuugccacagaaggagcaaguguacuuggcgugcuggcugauuucaauuuucuucaccauuuuccggagggaggcaccauagcgggucccguacuugccgacgaugccgaccuucuuggugcguucagccaugucgccggaacccaagcccaagucugaa

SEQ ID NO: 3637 - RNA, 582 nt, Mus musculus
uggcuuuucuugacauuuuggcuuuucuguguggaccuggcuauccuggaacucacuccguagaccaggcuagccucgaacucacagaaauccaccuaccccugucucccgaguacucggauuaaaggcaugugccaccagcgccuggucaguuucuugaaucaaucagccaguuucaccacacuguacuguaucggagcuucgcauugauuuaagcagcugcaucgacugccugagccuccgucuaucuugaaagggagaaucuaaagcacauucuccucgggacuucuuuuaaaagaucuguuuucuuuuuaauuauuuguaugcacggggaacugugcaaaugagugugggugcccauagagccaggaaggcauggagccuggagggguuguuacaggcaguugugaguacccuugugugggugcucggcacuaaacucaguccucugcaaaagcaguaugcauucuuaacacccgaaccaccucuccaccccuccucgggacuuuugagaauugagugagagguguaguucucuccccuuagucguccucucacagacgcgaauuuuacucucuccca

SEQ ID NO: 3638 - RNA, 2868 nt, Mus musculus
agacagacaucaaaaccaggacgcugaggaaggccacugcagccaccaggaggaguccugaggucagcaugguggcaguggggugauagacagacagugauggcugaauuagcuugcuuuuauacauccagagacagaaggccggacuuuggucuugauuaugcaacuauuucaccuccagacuacccacuauugugcaccaaguuugggacauuaccaacacuggaggaggaggagggccccaugacagauuaacagggaguagacugaaucugugguagcuaaggaggaagugcuccagagcuaugcauuacagaggacaguagagagaagccagaacuggauucuucauaacauggauacuagagacacuuccucugagaaggggcccaaaugauagggauaguagggccuuaggagagaagaacacuauaauccauuaguuugaaauagaaugaauaccuaugaaguugaaagaccauuuuucuuucuuguuugagauaggcuuucacuauguaguccugccuagccuagagcuccauacauagaccacagagauccaccugugucugcccugagugcugggauuauaggccuauacuaccacacccgacccuugggagucuuucaaugaagaggauccugaauuuaaggaugcgagaaguggagacuccagggcuaccgguuauggaucuugaggcaagaauggcuguggauggggagugccugggaggaacacacugaaaccgcaggaggaucuuggagucagcaccugugcccagguauggauguacuuugauuuuggcuccacgauaucucuuaaugcucagaacccacggggaagccucugagucuaggauggauggcuggaacauaggaucugagaaagcuggggaagaccagagucauauuuuacuggaacucggcccaguacuagagacaacaucugagggucugucuaggucuugagaaaucauaacuccaauaugguagaaaaguucuaauuuacaaaagcccuacuggauuccuaugcagaucuguuggaaaggccaccagggucacuggcucauugcuccuguuauuuacaaagguuuccuauuuuacguauguaugcacugacaacaaaacacaggggugguaugguggggguggagggguggggcacauacguugaaagccugaaagccagagguauuaacaacgucuacucuugcccacauuuuuagccuuccugucuagacaucuuuuccaccaguggaaaagagcauugggagaaauaaaggucauaugugugugugugggugugguaaguguggugaugccugguuguuaucaguaggcugagauggagagaguuaggugagccuccaucauggggaacagaaaaaaaaaaaacccuggaaugcuaaggguggcaugaagaagggaagagugacccuacuguugcccccauauugaaauucuucuuuaauaaaccagacauuuuugaugaaccuguagcccaggaagacuauuguaucccaucuguggaaucuuagucauuacggaguuggcacaucaccagccucauugaaaugacuaaggucauaaaggagcugggauuuaauucucucuucucuucauuucuuagcucagaucauccugggagacaccugggaacuaagcucagcugcaggaugggcucccaggagggaggaggaugggguuagcauugcgauagcuccuaggcaagcacuaaagugagaaagaaguuaucaugagcuugacaucaaaaggauauuaguagacuugcuucuuacacuaagagggacuuugagaggggaggcagguggucacuggaauugccugaaugaaggccuaaauguggcaacacaugggucuggauuugguuccagcagguucugacauaaacacuagguacuugcugagacuggccuccuugagacccuaggaggggccucagguggacacuggcaagcuuugauggaugaguccaucccaugguggugccccagcuuuagacagguggagaugggugaggcuggagcucaugacuggcucaucucguuuuaggcuguuggacucugagacugguugggguagaaaccaagaacagagaagaaagcagagagaaagguuguuuguugauuuuggaggaggaagaggcagaggggggaauaggauuagccuaggcuuggcugguaucaaucucuccuuaguaccagccugcaccugcacuaaagcugggcauggaccucuccucuccacuuguuuccacuugaauaggagggagggaguaauuuagagaaucuguuucauggugaaggggugaagggggcacccagaaagacccugaguggucagguagguucucauaaucugcacaggggccagaaugggaaccgagcugggagagcucagaagagaucaaguuuauuuguucuuguugacuucuuuucagacgcauggaugacagagcagaaacugaagucacgugggggagacacagacacaugaacagucagugccuguagucaccuggcagagacaugugagaacagcagcaagcaucucaggcaggcuuccagagugcgugagugagcaggggcuuugggaagucucucuuugauggcuccagucucccuuucuuagugauuaagagcagggccacagcauagaacagaacccgaacggggcaggggugggggcagauaccaaccccugggcaguucaaucagucucccugagaucuugucuguuguguguccuugaagagccaacuucauugacaaacugaacuuuaugggcccaaggacugagcacaacuuccuccugauaguaaugguugaauaaaugcauaaagucaau

SEQ ID NO: 3639 - RNA, 2875 nt, Mus musculus
agacagacaucaagaccaggacgcugaggaaggccacugcagccaccaggaggaguccugaggucagcaugguggcgguggggugauagacagacagugauggcugaauuagcuugcuuuuauacauccagagacagaaggacggacuuuggucuugauuaugcaacuauuucaccuccagacuauccacuauugugcaccaaguuugggacauugccaacacuggaggaggaggagggccccaugacagauuaacagggaguagacugaaucugugguagcuaaggaggaagugcuccagagcuaugcauuacagaggacaguagaaagaagccagaacuggauccuucauaacauggauacuagagacacuuccucugagaaggggcccaaaugauagggauaguagggccuuaggagagaagaacacuauaauccauuaguuugaaauagaaugaauaccuaugaaguugaaagaccauuuuucuuucuuguuugagauaggcuuucacuauguaguccugccuagccuagagcuccauacauagaccacagagauccaccugugucugcucugagugcugggauuauaggccuauacuaccacacccgacccuugggagucuuucaaugaagaggauccugaauuuaaggaugcgagaaguggagacuccagggcuaccgguuauggaucuugaggcaagaauggcuguggauggggagugccugggaggaacacaccgaaaccgcaggaggaucuuggagucagcaccugugcccagguguggauguacuuugauuuuggcuccaugauaucucuuaaugcucagaacccacggggaagccucugagucuaggauggauggcuggaacauaggaucugagaaagcuggggaagaccagagucauauuuuacuggaacucggcccaguacuagagacaacaucugagggucugucuaggucuugagaaaucauaacuccaauaugguagaaaaguucuaauuuacaaaagcccuacuggauuccuaugcagaucuguuggaaaggccaccagggucacuggcucauugcuccuguuauuuacaaagguuuccuauuuuaccuauggaugcacugacaacaaaacacaggguugguaugguggggguugagggguggggcacauacguugaaagccugaaagccagagguauuaacaacgucuacucuugcccacauuuuuagccuucccugucuagacaucuuuuccaccaguggaaaagagcauugggagaaauaaaggucauaugugugugugugggugugguaaguguggugaugccugguuguuaucaguaggcugagauggagagaguuaggugagccuccaucauggggaacagaaaaaaaaaaaaaacccuggaaugcuaaggguggcaugaagaagggaagagugacccuacuguugcccccauauugaaauucuucuuuaauaaaccagacauuuuugaugaaccuguagcccaggaagacuauuguaucccaucuguggaaucuuagucauuauggaguuggcacaucaccagccucauugaaaugacugaggucauaaaggagcugggauuuaauucucucuucucuucauuucuuagcucaaaucauccugggagacaccugggaacuaagcucagcugcaggaugggcucccaggagggaggaggaugggguuagcauugcgauagcuccuaggcaagcacuaaagugagaaagaaguuaucaugagcuugacaucaaaaggauauuaguagacuugcuucuuacacuaagagggacuuugagaggggaagcagguggucacuggaauugccugaaugaaggccuaaauguggcaacacaugggucuggauuugguuccagcagguucugacauaaacacuagguacuugcugagacuggccuccuugagacccuaggaggggccucagguggacacuggcaagcuuugauggaugaguccaucccaugguggugccccagcuuuagacagguggagaugggugagguuggagcucaugacuggcugaucucguuuuaggcuguuggacucugagacugguugggguagaaaccaagagcagagaagaaagcagagagaaagguuguuuguugauuuuggaggaggaagaggcggaggggggaauaggauuagccuaggcuuggcugguaucaaucucuccuuaguaccagcuugcaccugcacuaaugcugggcauggaccucuccucuccccuuguuuccacuugaauaggagggagggaguaauuuagugaaucuguuucauggugaaggggugaagggggcacccagaaagacccugaguggucaggcagguucucauaaucugcacaggggccagaaugggaaccgagcugggagagcucggaagagaucaaguuuauuuguucuuguugacuucuuuucagacgcauggaugacagagcagaaacugaagucacgugggggagacacagacacaugaaccaggagucagugccugcagucaccuggcagagacaugugagaacagcagcaagcaucucaggcaggcuuccagagugcgugagugagcaggggcuuugggaagucucucuuugauggcuccagucucccuuucuuagugauuaagagcagggccacagcauagaacggaacccuaacggggcaggggugggggcagauaccaaccccugggcaguucaaucagucucccugagauuuugucuguugugugucuuugaagagccaacuucauugacaaacugaacuuuaugggcccaaggacugagcacaucuuccuccugauaguaaugguugaauaaaugcauaaagucaau

SEQ ID NO: 3640 - RNA, 7773 nt, Mus musculus
guuguuacugcugcucacuguguguuucuuucuuuuuauuauuacuguuacaauuuuaucaaggugaguaguguuuucuauuucuuccaugcacguggucccuucuuaauccccaggucuuuaucuucucucuucacuccaccuuccuucuagcaccacuucaggcucucccucccucuugacccaucuuggcucaacccagaaucagaugggcacgaagcucaugguguacuuugguaugauccugguaaaccccucugguguaggggacucauugauaucuucuaguuuccuugggaacuugaaacggaaguucugcaagaugguggugaagaacaggaacagcuccaucuuagccaggcugucucccaagcagaaucgcuucccugaagaggagagagggaagagcacaggcgugggggcagcucucacugaugccuugcuucaguacccagugugcagcuguguucucuuagggagaagggguuucuacacuggagugugagggaucauuaggaaaggcuccuaagucucucagaaccccaauguuccuacacacaaagugguguaagccaugguagguggagcaaugagaagucaauauguuuccucuaccaauuaccaauuauauuucuaaugugaaugcucugcuguggccucauucauuuauucaucuaauuaucuaucaucgauguaucuaaguacacaugaauguacauaugcaucuaucuaucuaucuaucuaucuaucaucuaucuaucuaucuaucuaucuaucuaucuauguaucuaucaaucaucuaucuauuauuuauuuauuuuuaguuuuuuuuuaagucaggguuuucucuguguagucuuggcuguccuguaacuuacacagacccagguugguguugaacucagagaucuaucuccuucugcuuuuccggugcugggauuaaaggcauguaccacuaccacuuggcugucauccucuuuuaaagagucugaauauaugguuggagauggcucagugguuaagagcacugucugcucuuccaaaggacccagguucaauucccagcacccauauggcagcucaugagugucuguaacucuaguuccaagguauccaacaacuuuacaccaaugcaaauuaaauaaauuauuuuuuaaaauaaaggaaacaaaaaaaucauuuaaaacugcauuaaaaacugcacccccuccccccgcucucugaaagagaucacugaucccacugacccuuugauaggcauccaggaugucugaugcuugggagguccaggggcugcaacugguuggcuuaauguuagguugcaucacaaagaggggagcugacaugagcuaccccuguuagugugagcaguggucugguaacccaguauuuucuuaccaguggaaaagggcagaaaagcagggaucuucuucaacugucccuugucauccaggaagugcuguggguugaagucuuuggggcuagagaagaacuuugggucugucaucagagaacccaguauaggaaacacuucagugcccuggaagagagaagauggaguuuaagaauauggauaaauggagaaaggaucacaaaagguguuagggucuaaaugaagagaucugaaaggcacagaguugguggucuccugaguaagggauauuagggaguaugaguuuugaggugaugugaugugugccaccaggaguaggagauuugagcuccauggguucauguucugagacaggcugcuagagugacaccaggccuuugucuccagcccaggaguugagauauuggaaggcaucaaggcagaggagcagauagaacuuggaguucaaagcaaugagacaagaaguuggagacauguggauaaaucuccagagacacuaagucuaggaaaggugacaauaaucuaucuaaucagaggacccuggugaggcugacauaguaguugggggaauagaguggaguuagauagcuguagauggaaaggggcccugaggcaucaggaagugggcugaaggccccuccugauguccauggcuguaccuuggggaggaagaagccacggaaggaaguauccuugguaauccuucgaggaaugcccaagggagcaaaguuagaaaaucucuggaucucauugaucacagccuggguguagggcaucuucauaugguccucauauuggggcugucgguuccugccaaucacucggucaaucuccucauggaccuuggcuggaagacaaggggugauggaguguuuuuaaaaguccaggagccucaaagcaggugcaauaguucacauguguaacacuguauguaguacaugucucuguaagugacaugcauauaggccauugagaacauguuuucauaccaaauguugggcagggucauuuuauccuuuucaugacagaaucaugguggggagaagaaggaggagucaggccagggaccagagagcagggaucuggcagccagugggaaaucaauuuggggaugucuaauauuuuaacaguuauugagaacucuguuuaugcauuuaauaugcucuugucucugcauagcagggcaugucugagcauccagggaccugggaaaggugagggucauugucaaguuggaaaaaguuggagcaucugggguucccaauuucuucccugccacacagccagccucacccucuacaucuggaugcuucauuaguagcaggaagccauaucguaguguggagcugacugucucagacccagcaaagaagagguucaaugaugucaucacuagguucuucaugugaaacucugaauuaacauauuucuccuggagagagagagagagagagagagagagagagagagcccaaaaucuaucaguuugucauccucuuggagaauauuaaacuuucuagucauucuuuuauaaauauuuuuaauuaauucuuugagaauuucauuuauuuuacugugaauauauucacaccuuuccccuucccagaugaauccccuuccacacccacuggaccuugaguccucauuuuuuagacauauaugugaaaugcacuuuaaacauauuccccucuauuaucuucuauuuuccacuuuguggaacucuuucuuaucccuaauaagccucuuucuuuuuuuuuuuuuuuguugggcaacugcuuauaaccaggcuuggcugcaugaguaugggugaaggguucuuuacuugagaaaggauaauuuacuaguagccacaccacuaaggaguaugauuuccucuuuucucaacagccaucaacuguggauuaaguuccucauggaggagagugacccaacaggcaccauuucuggacuuuucuuuggaucuuauucucaaaggguccagacaacuaugggaaagguaaucucaagguuguguggagccuuggguuuggaugagaagcuuugcucacuucucugucuacugacugucugccacucaugucacgguugggauauuuagacagugagggguaaggacugugagaaagaacccagaugccaugauggaguguguuauuagagauagaucugagacacagaucagaguuuaaacuucauucucuccccccucaaacaacucauagaagagccccuaaacagacccuugaccuucaugugcaauagaauucuauguccuuucuucucaguugugaaagaaguccuuugauaucacauaaaacacuuaaguugccuaggccacugauauguauugauguguauuuccuaauggagauaugaaaugcuggaaagcacauggccaagaguaaaagccugagagccacagagaggcaagagugcaugguuuucuggcugcaugaagucagcaugcaacucugggcacacuuucccucuuugugaaauuuaagcuccacaggaucuucaacaguagcuucagugcaugcuaacuaggcaaauagcaggaugcacugauaacagugucucaaaggggaacacugggauauugguuagcauguuaauuugcuugcccauacccuggcuugcauaaggaaggcucaauagaugggagagugauguuuaacuaugaucgggucugugaggaacaucauggggacuuaaugggccucuguuccuccucuucuagggugauuuccagcugcccugguuuagaugucccauccccagauguugggaucaccuuuugcauguggaugagaaaggagucaaugaagucucguggggaauugggguccaggguacucugguucugcuucacuuucuguaucaugaagucuuccaguuuaugagaauccuugaugaucuguugcugugguccgggcagguacuucauaacugaauggaacaugucauagagcugggggugggaggagaaaagaugggaaugagacgugucaguagcaacacccagugggagugggacuugucucaagacauccauucauguacuaauguauguaugugaggcuggauugcaauaaacagcaacucuauucuuuaaagaacucuuuauacucauuuuguuauuguuguuguuauuauuauuauuuuacuuuuaauuaugugugugugcaugaauacaggugucugaagucagauuuccuagagcugugagauguaauaggugcugggaacugaacucaggaccucgggaugagaagugcaugcucuuaaaccacugaccugucgcugaagcgauuuaaagaaugaaggucauugucuuacaauccaggcgagguggcucaaaaggggacacuaggagacauucaacuauuuaacugauuuuuggaucagaccaugacaccaggcuucuagcauucaggacagagugucacagugacucaugaaucuagagguuuaggcaucccagagggcugaguuuaguugucuugauacuuguuugggauuagaaccuguuuucuacauagucaggacuucagugugggaugguucaggguauaagguguggacacaccugucagacauuguguugaugaaggcuguguguggcugggagacacucauaucguuguuugggaaaacagucuguccugaggucugcuuucaguuuccuugguugaggugccugucuacucauuccugaauucacaugggacaagcagaugacuuuugugccauugugccaaugggauauuuugggagagcagcauguaugggcugaauaacuuuacuggccuugacuuugcagaaccagguagguguucaggaauggaggaggggaccugagguggucacuuauuucccuugggcaggugucucaacuuucaggaggaccauacagaagauuuguuagagacuaagcuggggaaaccugcacagggaagagagccaaguagagggcuuuguucucaggcuauuugagguauccagaugucauuagguucugaguacucgauagcucccauggguucugauauaaagguuaauugucugaggguaaagacugguuuugaggggaucuuauguuuguggguauaagaguugaggugguccuugccuuugcuggguauggccaaugugggacacugcaagugcaauuggcagagcuggagucucuuaccugcccugugggugaagcagcaaauuuguucacuugacccaucaucugcagcagugacaggaacucuuuguccucauaguugaagcggucgccgaagacaauggagcuaaugacauuggaggcuguuuugcucagguagaugguggggucaaugggggcuccugagaugagugacauuguugggaagacauuggaauuaugagggagaagaguuagaagaugguaugggcauuggagugaggcaccaaacucucagcaccagauuucagggaugguuugguagguggucuuccccauccucuuuuccacagcccauaggcucuuggugcaggggauguuccuuuuuuugcucaaacacuuaugggucucuugcuuaccacaagugcccugcaacaucuugaucaaacagccugccuccuccuggaugcgcuccuccacaccucgcuugcccaugccgaaaucucucaguguggcuauagagaagcgucugaguuguuuggcucguuccccauugcugaaugccacaccuguaaagauaagaacaugaggaauggagagaagcagacugaggcugaggaaggaccagguccacacuggaaaaggcuucuaagagaaaagaauaaauacaaagauggauagagaugggaagaacacagaauauauaaacacagacccugcauuagacacacucagaauaagaaaguuggaacaaaucagccaggcaaggaaacagaaaguuacaaacaggcagaagcagggauacucagaaggcagggagacuaguccucaauauuuuagcuggaccaauuccaucacgccucuugaugcugguuagcugcucugggucccugaaauggcuaaaucaaccaauauuuagcauuuucugaaaacagcaaauccccacuaaagcaaggacugccuacauaaaaacauacccgguuguugagguuuugucuuuuacuguuuauuguauugugcuagucucuaagauuugaagucugcacuuagccugagggacucugcccuagucaauuuugauugauaaauaaagaugccagcagccaauaguuaggggaagcgacauaggcaggguuuagguuuacugggcuagagaccuugaaaggagaaugggacugaggagccuugguggaagccauggaagaagaagaagcagaaaggaggaagcacuuagaauucuugggacuccucagagguuauauaaaugcuagggccccaagaggaggguuuugguuguugguugguugcuguugguugugguuuguuaaauagucugugcgaagaaacaacagcaagaagaaauuagauauccugacugugaagauuaaacuugcccuaaggaacucaucacuccuaaucagcaggaaguagucuaacaauuuuguucccauuugccucucuuuuugucuccuaucuaguguuaggagguuaaaaggcaaagagggugaaggguggacgaaagaagaacccacaaaguagcaaaagucugucuacaaucccagauuucagauccuccuuaccauagccuuugaagaguguauuaaagguggccuguucgccucguccacugaacuccucagcgugguccaccaaagccucuuugacugcaucguauccauaaagcaccacaacccggcgaggcccaagguggauggugaacacagggccauagugcucuuggagcugaugugggggaaaugggggcuguuagaggacuuauucacuuaacuggaccaguacacagaagucagauuaugugauauuuuacaaacaaauucuugaaaaacaaacaaauaagcaagcaaacaacaaaccaaagacuugaaauagcuccacagccuucuaaaccccacuaauaagagacuuuggauuauuuugugaauuuucugacacaaaacgucugaaaucacacagacucuugucugugucccaugucccauccaucccuucauccaaugauaccugugugauggagcuguauacaucuuuucuauucaguugcagguaauuuccaaugaaaggcaaaggaauggguccugggggcaacuucccccugauuuucugcugccagacagacaccaagaccaucacacucaggaaggccagaauggcuaggaggagcagcccugagcccagcaugguggccaaugaggauugacagacugau

SEQ ID NO: 3641 - RNA, 789 nt, Mus musculus
cccugcaaaaggcccugaagucagagcgugcacagaauauuugccagccagcacagcucaguguugcugcugcagcaugagcaaggggccugaagcccaggagcagggauagagagagggugggugccuccauggaggggaaagaggcucucggacugggaagacuugagcuauguuuccagcuaaggaaggagggaagacucugggagggcguucagcaaaggcgaugagaucugacucaccuuuuucuuggaagucuuuuuacuucccuaaagcaagugagagaagcugggcaugguggcaccaaccuuguccaucccagcacuugggagaccggcaggaggauggccaguaagucuggguuacaaauacagaacauguucagaaaauaaauaaauaaauaaauaacaaaacaaacaaacaaacaaacaccagagaaccaaaaaccaacaaacuccuccaggaggaggugggaaagaaggaagaugaggaggggagccugauaguagcaaccagccaaucgaagaaacacccccaauuuccaggugaacauacagaggcucagagcugcccggcuccuucccuaauuaagaacuggccccagaaguggaaaggcuggcccugcagagggacaaaccccagaggccagaguccaccuuuccccaacccgcccuccccaacgggacuacagugggggaugggccgcggaggcccugggcguggcccuaaggcugagucccacccaccugcccacccucggaacgugcuggccagcgggcaggagaccug

SEQ ID NO: 3642 - RNA, 3407 nt, Mus musculus
gggaacuagggauagucgagugucuggagucgugcgccggagucagaacugcgccuaccgucccaggugucgguugcuggagcagaacaagcuagcgaugcuacggcagccgcuuccugauuggcugcguguggcucccucuucguucugauuggccgcgagugaucuguguauguaaaugaaggggccugguggggaaagacggggguacggggggccggguucuuuaggguguucgauaccucagcuagguagaugguggccggggcugaccgggaucgagcgcccagggccuguaugugucgcccgcccgggccgggcugggugaaucacgucggagcccgagaagggggcggaggcgccggcucccuggcuccggcugcgugacucacccgcccccgccgccgccgcuccgggaggagccgccuccgcugccuuccggaagcgagggaaggccgggcucacugagcggcccgcgggggucgcggcucgcuguggcccgggagggacaggcgguacccuggggaaucuaaaggaucccggggucacuggggccggaguccccgggggagcccagguuggaguaccgcuagggggcgccgggacucgggggggcggagucggggugggggcugaauuccugcgguucccggcucccgggucuucagcgaaaagggcaaagacuggauuuuuagugucuugcuaggucuaggcagcguccccgggacugagacccugcggccuuuaugcccccguuagauuaggcuaggggcuucaaacucuaguccucuuggaagaaaguaccgauuuucaaacuucugucaaugacuuacucccgcggcccuucaggguuucccuugucucucucuuuccucaauaaguucgggacccuuacuuccuugagugacuacuaacagcuuaggcuuuaaacccaagcggccagcaucccagugaguacagcagucggaaggcaggcaguucaggcccacuucuaucuccaaaccuacacacacacacacacacacacacacacacacacacacacacacacaugaugcugccccgccaccgaucuuuccccaggcagcagcuaccggggauccucuagagaccuugccaacuaacgucaccauucaucuuccugccuagacccuacccuccaugacucuguccugacacucugaaaauccaagccuccuauuccugcccgcgccuccuccugcuugcuccccacccccaccgggacuccuacugugucacacucucugcgccugcuccuagugugugguggccuucuuuuuuuuuuuuuuuuuaaacuccccaguucagguuuaccucucucugucuuccuuuggcucuuucaggaaagccuggcccugcuucuccauagccuacagugcaaacagcaggacucagcuucaauguacuuaucuuucuuagaaaaaccugccuugacuaccucccaggauggcaucuuccuaccacuuucuguacauuugaccauagaguuccaugcauagcagauacucuguauugaacuguguaagauggcuguauuuguaaucaaggaauggaacacaccuguaauccuaaccccuugggagacugagacaggaggauugccuggaauggcuggucagcccggacuacaguguggggcccugucucaaaagagcaaaaccaaagagugcuuauaaauaagaacuagugaugugguuuuagagcuugcuguuccuacaaaggaccugauuucaguucccaguacucacaucugauggcguacaguuacuuuaaaaucagcuccagggauuccagcagcuggcuucuuuggacaucugcacgcucaugcgcgcacacacacaaacacaaaaauguaaaauaaaaguaaaauuucaaguacuaaugaccauguugcaagggcuuuuuguuccuuuaaucuaaucuguaguagcaacuuauaacagaaugcugucuguaucucagaagcucacugaggacgcugagaauauaacucaguugguagaauguuugccuuacaugcaggaggcccaggaaguuccauccccagcaucaaauacaccaaguaugguggcacacaccuguaaucccagcgcugggaaggggaagaagggaagagcagaagcugccuacauagcacguuugggggcaggucagccugaguuacacgggacccugucccguuagaaacaaauaagaauuugcuuagaaaaccuagaccuggagguuaaucgacuggucaggaucccacagacagcaguugucagagcugggugugaacugaguauuggcuucccauaacugaauggcuccuuccucccugcagaggaugcugagcaaaggucugaagcgcaagcgggaggaggaggagacgauggaagcccucuccguggacucgugcugguuggauccgagccacccggcaguggcgcagaccccgccgacgguggcuucuagcucccucuuugaccucucaguggucaagcuccaccacagccugcggcagagcgagccggaccuccggcaccuggugcuuguggugaacacacugaggcgcauccaggcguccauggaacccgcaccuguccugccgccugagcccauccagcccccagccccuucuguggcagacagccuucuggcuagcucagaugcuggccucucagccuccauggccagccuccuggaagaucucaaccacauugaggaccugaaccaggccccccaaccccaagcagaugaggggccuccaggccgcuccaucggggggaucucacccaaccugggugccuuggacuugcuaggcccagccacuggcugucugcuggacgauggacuggagggccuguuugaggacaucgauaccuccauguacgacagugaacuuugguuaccagccucugagggucucaagcccggcccugagaauggcccagccaaggaggagccuccagaguuggaugaggcggaguuggacuaccucauggauguacuaguaggcacacaggcacuggaaaggccaccagggccugggcgcugacccuuaggacccagggagaauugacuuggaucugaguugagccugguggugacaccaacccacuuugacacgacacagguggcguccccucacagaggagagccagggucacuuuggagagacuguacugaguccugggaacuucacauccauccaccugucuugaccagugaaggaguuggaaaugagccccgaguggugaaaugacagggcccagugacaguaaugguguuugggccaggcugggguugaacugggauaauaguuugggcuaucccaucccauuauccccagugugggaagagaccucauaauuuuuugaaauuaaaaccagcuuugggaaauacca

SEQ ID NO: 3643 - RNA, 5407 nt, Mus musculus
cauaugcagaccacgccuaccuucuugcaagcugaggcucuuagcugccggugaguccucucgcagcucacggacaaagauuccuucuuugccgccgccugcuacguugaagccgcugaccccggucugugccucggucuccacgauaaucuccaccaacuccgcccgucucagcuccugcgaggggcagcaaggggucgccauggagcuccaagacggcaacucgcccagagcucgccauggcguuccuucucuaggacccgcguugugguuaaacagcucuccuuucccgcucgcucucugggagggucgcgguccgaaaagcaaggggcggggcggggcuggaagaagaggggaugaguaggcggggcaagaucauggggcgggacuagaagugccaaauuaggugauuuugagaagcuuauuaauuuuccauucuuucuuccuuuucuuccuuuuuuuucauuuuauuuuugagacagggacuccuguagcccagaacguccuagaaauccuccuucagagauccuccuuaaaguacugggacuaaagucauaagacaaaaugccaauuccaauauccauauuuuaaagaccaaauggggcuuuaauaacuacacaacaagccuagggauuuaacccagugguagaagucuugcauagcacgcacgagguucugaguucuguucccaacaugaaacuaaacaaaccaaaauauaaaauauucagcuugauaauaguuauuccuacaggacaaaggcaugccucuaauaaagggagacacccuuaagccaugcgggauggaagaauggggucuugcccucugugggcuugaauauguguaagaaugcuguugugaacucuuaacuccaagacaugcauaacucccccgggaaaaggaauccaaugaagggggggggggugcguggguaaugaauggugaccgcagcagaacuggcauucaugguauuugcuggcccuggcucugaaacacgcuagaggguucacaucugcuucccagaaggggaagcgagaggucugauucugucuaggaaaccacaagauuuugcggagcaccuugcacuucugggccuguugcuguacugcaaaguuggguggugugaaaggaaagucugguugugaacugaaaccugaccaagcauggauggaccugggagaaugcaaggcacugcgaccagccaggagagggaaaaucaggccuagacuagaugcccuacugcagugggacuagagcaggagaauaugaaacauuaguugggggggggggagcuucuuggaacaguaggguccuuccacuccccuuuggacagcaucuugugucuccccguguuuuuuugggaagucacaggaaggcaguaacuccuaggaauuuaaagugacuuacuuaaugccucaaagcacauuaacagccaagucuugucuuagguauuccaccccaggacucuauaggccgugaccccauugccugucacccucagccuuaaugaggcuccuuuguaaguagagccacccagccugguacucaguagaagagguuaaaacugcuaacaucgaaucugaaagcaguggcagugacugaaggugaucucuugguaccagacuaugcaguaguccaaaaaaugaaccaucggaguucccagagauggggaccaucaccccaccucaccaguggggaagcuggggcuccaagaaguuaggucaccugcuuagggcuguacauaaagcaggaaaggacuggauuugccuugugggucccuacguccucuacagugacuuuguacuuugucagcucuuaucuguagugggguguuuugacucagggucuuacucuguauuucagguuggccucuaacucacaguagucccccugccucagccuccugaguacaagugcuaggaucauaagcauguauccaugcuugguuauaacuagucucuucugauaaaauauuucuguugaauuuuuugguuuuguuuuuguuuuucaagacagggucucaaggcacuggcugucuguccugaagcucacugugaagacccugaacucacugauccaccugccucugcuucccaagagcuaggauuaaaagccugugcuaucacacccagguauguuuaaauuuauuuuaaaaugacuugggagcugggcagugguggugcacuuuaauucuggcacucaggaggcagaggcaggcagaucucugaguuucaggccagccuguucuguuuacagacuacagagacaguuccaggacagccaagacuacaaagagaaaccguauuauuaaaaaaaaaaaaaaaaaaagguaggggcgaggcagcaaaacaacaagauaaacaaaggauuuugugugcaucggcguuuugccugcguguaacgcugugcaccacauacgugcuuagugucaguggaggucagaggagugagugugucagaucucuaagggguuugaacccccaugugguugcuggaaauugaaaggaauccucuggaaaagcagccaguacucuuaaccacuuugccaucuguccagccaaggguuucccuuuuuuguuuguuuuguuuguuuacauuuauuuauguguguguauaaugcaugaaggucaaaggaaucaauuuuaggauccggguccucuccucuaccauguagcuuccagaagauugcacucaggucaucagacuuggcagcaagcaccuguacccacugagcccaucugcuggccccucugcuggguuucgucaucgucaucaucgucaucgucgucaucaucaccaucaccaucaucauccucauaaucgagggcugacuccaagaucuugugcauauuaggguacuuuaccccugagugacacuuuuuuuuuuuaaucuuugugggauaggaccuuacuaaauugcccaaguugaccuugaacuugaaagccaaaaugauaggcauaagccaccacacccaucuguaggccccgagcgcguuguauugagcauuugacauguuaauuucucccucacauuuccuauuuccagcuuccagguggggauaccaaggcccagagaagccgggacaugccuucuuggcacccuaaccuguggacacccaccucagcgcugcggcuccuggccuccauagcucugcagagagucaccugggggcucgagcucccguguccucuccuccuucugcugcaggaccaccuucagcuccucauggagcagcugccgcugagccuggggguauaagauggaggccugaggcaaggagggauugucggguagagauggggcuugccagagaggucgagugcagggauggcaucaggcgggcggagaguagggccccucaccgcuucuugagugauggccuuuucuccugacaggagccccacucggggugaugcacagcuguaagcaggaaucucacucuuccuuugaggucuugcugccugccaaggagagagagacaaggggcgugggacaucagacagacccagggaagauagagaggggcaugcggaaccagccagcucucaccugagggucacuuccagcuuccugggccuccugggucuggggcucuaggaagaacaacacacacaguaguauuaucucauauccccugugcucguucugacgauucuuugugcucaagugccuuacgguuauuucccaggccagccuggauagccuccguagugagacacugccucaaaagccugaaugccgagccaggaacgcuugcccgguaguacacacuggcagucccaucaugucugguuuguucugugcuagugagucaaucccaggguuuugcgcaugcgaagcuaccauuuuaccaccugagcuacauuccuaggccucgcuuugaguuugagacagggucuuugaacacauuagccucaaauucucuagguagcugaagaugacuuugagcuauugcccuccucccaccccauuucagccucccaaauaccggggucacaggcaaaugucaccgucuuuaguuuaccagacagcuacuuuacugaaaauaugccgucucagagaagccaagcaaauuuguaccgguguggcacacaacccaagaagaaggcacagagaaggcagccuccagccgggcccuccuggugacauggaggaggugacugucucugagcuuggcccccaccuggcaugccagcccgccaaccccugccacacaggaaaaggucaggcucaugcggcacauucccucacacaauggccagucugcugugccagucacauucugccccugcccacccgcccacccacccacugccauacaauggcccuucauagcucggcccuggagcaaaggagaucagucaguagagugcuugccuagcaugcacaaaggcccuggggucaguucuccagaauuuccuaaaccaggcaugguggcacacaacgauaaucccaguauuuuuuuuuuuuuuuuaaagauuuauuuauuuauuauauguaaguacacuguagcugucuucagacacuccagaagagggcgucagaucuuguuacagaugguuaugagccaccaugugguugcugggauuugaacuccugaccuucgggagagcagucgggugcucuuacccacugagccaucucaccagcccgauaaucccaguauuuggcagguagagacaggaagaugaaacaauucaaggucauucuuagcucccuaggccaaccacaugaaaugggucuaugcaacacaacaaacuuaggucacaauuggcugaacuagacaacccucuggacgcauccacacaugcuguaaucacacccccucaagcccaccacuggcccccaguaucugaaagcuccugucagcaacuccuaggaaucccagauucugucucuaagcccagccucccuugugaacccuuucggcuccugcacacaagcugaacaccucuccuaagauggcuucccugugaaccaggcccuggcacagggacagagaucaaggcuuggugagaaguuuccuguccagagucacaaagccaggaugaggcagaguaaagaccuaugcccuuggccucuacucuacaccuaacuaauuugcggagcugcuggggagaguugaggugagcaagaggagucaagcugaauaaauuccagaggaccuugucggugccaggccuggccgcgggacacuauuuugcugacaaguaaaggaaaguuaaagacagacugucguaaacuggguguggccggagacuccuguaaucaaauaggauuaugaguuaaaauguagccugagcuacaugagacccugucucaaaaauacugaaaaaauacuggaaggcaggaagauuuaugguuuauguccagcaacauguucuggcuucauccugaacaugaccaucu

SEQ ID NO: 3644 - RNA, 3061 nt, Mus musculus
aguguaaaacguuuaauugaaaaacgcucacuggguguggugugcuucacuuucauuaaauauacagagaagauuguagaacucccccggacaaacuggucaaaucuuuaaagguacacccuccacacaccuuagagaccaauaccaugggaccagaguacccaggcccacugagcaggguucggcucauguccaccuugcagguaguucuuucucuccaugaggugggguuaggguaaggaaauccucuaguccaggcuuuuaagauguuuaauuuuuagagcguuuuaaauuuuucuuugugucagccuccacagcaguccaugugagcacuagccauguaagcacgggugugcuugggagccgagagugagcgucagacacccuggaccuggaauuuaacgugguacaugguguguaaguugcuuggcauaggucuugggaguugagcuuggguccuccucaggucugcuggaggaucagcugcugagccaccucuccugcccugguagugucauuauuaaagaguugcagguuugcuguuuaaggcaaugcugaagcggauugucuuuuuaaaacuaagauuauuaugcagaaggguggugguguaggccuucaaucccagcacuugggaggcagaggcagguuggucuaugugacuauacagagaaacucuaaaaacaaccaaagaguugauuagaacgguuauuaaauccauggauagaccacaguguggcagaggcuguaggagaaucaggcccacuaggcagauggaaggaagcauauuuguuuuguuucuuugauugauuuuuuuucaagacaggguuucucuguguagcccuggcuguugaaacucacucuguagaccagacuggucuugaacucagagaucagccugaugcugccucccaagugcagggauuaaggcauggacaacaccguccagcacugugagggccccuucuuauacuuauuacagggagauaccccauggcaugugauugucagguaaccuacagugugugcuuguaguuggguuucugauuccuggacaccaggugguaaggagggagucuguuaaccuggggcccacauggagagggugcuaagaguuucagggaagaagucuaggaaaacaaacuccuggaggggagauauaagguggcuuugucacauggaaugagggacuccacucuggucugucgggccucauguccucgauuauuauaaaaugaacuauuuuuaaaauauaaauguauuuauaucacagugugaaguaaucuggugguugcauuucuuuuaacuuuuguuaguccccaguaaccacacagagaaacaaagcugcacccagauacugggcaauuauugaucuauuaauccuaaucugggcaauuauugaucuauuacauccuaaucugggcaauuauugaucuauuaauccuaaucugggcaauuauugaucuauuaauccuaaucugggcaauuauugaucuauuaauccuaaucugggcaauuauugaucuauuaauccuaaucugggcaauuauugaucuauuaauccuaaucugggcaauuauugaucuauuaauucuaaucugggcaauuauugaucuauuaauccuaaucugggcaauuauugaucuauuaauccuaaucuggcuaccugcuccaucccacguugcuugcauauuaucacagaucugguucuuugggauucagauguuuuuuucucauggcaucuuuucagacccucuccuccuccuggugaucugaaacucccucucucauuccucccccuggcugggagacgugcugcccuguuuucucucugcccagccuuugggcaaucugcauuuauugucagggcagagaacaaaugguaagauuuuguuuauagaacuugaaacacgagaguuuuuuuuaaaaaaucuaaguauuacaaugucauuuucagauagaaacaagaggugagggcagagaaaugaccauuugaaaaccccaaggauaaccuuuccacggggcacaaaaccauucugaccacaguucaucucaaacucaggugcucccgugggcuuagugggauggagacuuccgugagcucccgacugcagcagccggugccuuuguggccacagcacugucuguauaguggguuucagaugcacgguuuccccauagaucuggcucuguagauggccuauugguccaaccgaggaugugaaaucugagcgcuaaagaggguucuucaucggguguccugagcagacuaagggacagccacaaugccgcuguguaacgggacauguucaacaacuuccucagcaggacaggcgcauacugaagauuugauaugccaucuuaggcaaaugggggcugggaacaagguguuugaagcugguguauacuguggcuucugguugcugugaagaaaaguucagacucccauaagcugucuucccggcaaaccuggaauucuucuucuuuuuuuuuuaacuuggaauuuuuaugauucuguuuacuuaccuuaugguucguugagaucugauaugagauuuggguaugcgggaauugacuugcuaaaagguccuuuguguaacaaucacaaaagcccuccugcgaagcuguuagccguuuaguucagcucaccagaauggaucccucugcuucugggaagccuaaauucauucugcagugucccucuuucuuugaucguucagaaaaacccagaacacugacaaagucccaccagagcacagcgagguggaacccugcagugggucucaggcaaagcguauucaauuacaucucgauccaauuuuacuuccuagccugcguuuaaaacuuaggcucaccugucuucuccacaggggugaaacccaguuacucacagaacccggaaguacacacacacacagagagagagagagagagagagagagagagagagagagagagagagagagagagagagagagagagagagagagagagagagagaagggcaccaucccugggaacucccacaaagcacagggcgcagcugccagaugggcuggcccag

SEQ ID NO: 3645 - RNA, 3061 nt, Mus musculus
cugggccagcccaucuggcagcugcgcccugugcuuugugggaguucccagggauggugcccuucucucucucucucucucucucucucucucucucucucucucucucucucucucucucucucucucucucucucucucucucucuguguguguguguacuuccggguucugugaguaacuggguuucaccccuguggagaagacaggugagccuaaguuuuaaacgcaggcuaggaaguaaaauuggaucgagauguaauugaauacgcuuugccugagacccacugcaggguuccaccucgcugugcucuggugggacuuugucaguguucuggguuuuucugaacgaucaaagaaagagggacacugcagaaugaauuuaggcuucccagaagcagagggauccauucuggugagcugaacuaaacggcuaacagcuucgcaggagggcuuuugugauuguuacacaaaggaccuuuuagcaagucaauucccgcauacccaaaucucauaucagaucucaacgaaccauaagguaaguaaacagaaucauaaaaauuccaaguuaaaaaaaaaagaagaagaauuccagguuugccgggaagacagcuuaugggagucugaacuuuucuucacagcaaccagaagccacaguauacaccagcuucaaacaccuuguucccagcccccauuugccuaagauggcauaucaaaucuucaguaugcgccuguccugcugaggaaguuguugaacaugucccguuacacagcggcauuguggcugucccuuagucugcucaggacacccgaugaagaacccucuuuagcgcucagauuucacauccucgguuggaccaauaggccaucuacagagccagaucuauggggaaaccgugcaucugaaacccacuauacagacagugcuguggccacaaaggcaccggcugcugcagucgggagcucacggaagucuccaucccacuaagcccacgggagcaccugaguuugagaugaacuguggucagaaugguuuugugccccguggaaagguuauccuugggguuuucaaauggucauuucucugcccucaccucuuguuucuaucugaaaaugacauuguaauacuuagauuuuuuaaaaaaaacucucguguuucaaguucuauaaacaaaaucuuaccauuuguucucugcccugacaauaaaugcagauugcccaaaggcugggcagagagaaaacagggcagcacgucucccagccagggggaggaaugagagagggaguuucagaucaccaggaggaggagagggucugaaaagaugccaugagaaaaaaacaucugaaucccaaagaaccagaucugugauaauaugcaagcaacgugggauggagcagguagccagauuaggauuaauagaucaauaauugcccagauuaggauuaauagaucaauaauugcccagauuagaauuaauagaucaauaauugcccagauuaggauuaauagaucaauaauugcccagauuaggauuaauagaucaauaauugcccagauuaggauuaauagaucaauaauugcccagauuaggauuaauagaucaauaauugcccagauuaggauuaauagaucaauaauugcccagauuaggauguaauagaucaauaauugcccagauuaggauuaauagaucaauaauugcccaguaucugggugcagcuuuguuucucugugugguuacuggggacuaacaaaaguuaaaagaaaugcaaccaccagauuacuucacacugugauauaaauacauuuauauuuuaaaaauaguucauuuuauaauaaucgaggacaugaggcccgacagaccagaguggagucccucauuccaugugacaaagccaccuuauaucuccccuccaggaguuuguuuuccuagacuucuucccugaaacucuuagcacccucuccaugugggccccagguuaacagacucccuccuuaccaccugguguccaggaaucagaaacccaacuacaagcacacacuguagguuaccugacaaucacaugccaugggguaucucccuguaauaaguauaagaaggggcccucacagugcuggacgguguuguccaugccuuaaucccugcacuugggaggcagcaucaggcugaucucugaguucaagaccagucuggucuacagagugaguuucaacagccagggcuacacagagaaacccugucuugaaaaaaaaucaaucaaagaaacaaaacaaauaugcuuccuuccaucugccuagugggccugauucuccuacagccucugccacacuguggucuauccauggauuuaauaaccguucuaaucaacucuuugguuguuuuuagaguuucucuguauagucacauagaccaaccugccucugccucccaagugcugggauugaaggccuacaccaccacccuucugcauaauaaucuuaguuuuaaaaagacaauccgcuucagcauugccuuaaacagcaaaccugcaacucuuuaauaaugacacuaccagggcaggagagguggcucagcagcugauccuccagcagaccugaggaggacccaagcucaacucccaagaccuaugccaagcaacuuacacaccauguaccacguuaaauuccagguccagggugucugacgcucacucucggcucccaagcacacccgugcuuacauggcuagugcucacauggacugcuguggaggcugacacaaagaaaaauuuaaaacgcucuaaaaauuaaacaucuuaaaagccuggacuagaggauuuccuuacccuaaccccaccucauggagagaaagaacuaccugcaagguggacaugagccgaacccugcucagugggccuggguacucuggucccaugguauuggucucuaagguguguggaggguguaccuuuaaagauuugaccaguuuguccgggggaguucuacaaucuucucuguauauuuaaugaaagugaagcacaccacacccagugagcguuuuucaauuaaacguuuuacacu

SEQ ID NO: 3646 - RNA, 854 nt, Mus musculus
gugagguuguguaauucagagcuuauauuugccaacaaacuuuaagcacuguagcugggcagauucucaucuauauggcugccuaccacccagccaugugcccugcuacuugucaccuugguccugucucugcuccaccaguguucucauggugacuccccuggugacuugcucauagaucccguccuugcccuaucugucucucuguaccucugcuuggaacauccugacugcuuccucucuccugcccaucuguugggcagauuagcucuuuauuaaccaauuagaguugaaggaaaacaguuuuacacaacauuaaggucgggccaauuaaugauggcagugcuaauguccagacuguaaccaaucucugggcacagaaaucaccaucagaguacacaguguacagaaccauuccccaacauagaugagggaagguucucaggagagugguccauggugcacagucccauucacuaacagugggcacagaaugcuggacgcugccugagcacugcagccccuccagccuugcugugcuucagcccugaguuuacacaggaggggccaccuggaugcugugagccccugugagccuugauaggugggguuccagugugaagaucugagaucugcucacaguaggaggagcggcccaggugcagggcgagcuggaucucagaguggaagauggcucccuucugcuggccucuucuggaggaguucaaggcagacauguuugugcccugcacucccacacugcccccuuggcaguggguugucuggguuagggggggaucggcuuuguguagacuccuaugugcuuccaauuugugugugggaggcugugagug

SEQ ID NO: 3647 - RNA, 2732 nt, Mus musculus
ucgacaucaucgguacacuuuauuccucagggcauuacacgcuaacuuuuccuggagcgggucagugcaucgaguucuguuucuguggaagaugugcaccuuuccaaacggcguggcuggcugucucacccuccgguagggccucugugcacaggaagcgguuccuccagcacaaagccagccucuggggccuggacacaagagauugcucugucuagaagugccuguuggacgccccucuucggucuugguggccagcaucccucccuggcugcuuggagccucggugcccggccuggcaugcuuaugcuguaguuaaggguaaagugacagggucauucacaggcguguccacaacagaagcggguugauguacucaaagccuucaaacucggacuggucgauccucuuuaugacguccucaucaucuggggucagcugcacaggcucgcuggugaacugcgugucaaaguuguccaggccauagucaucugugaucuggggcuggaagggaggcagggucugcuucuuuuccagcaggucccagucuaugcugcggaagaaagcaugagacuugaugucggaaaacccagucuguggcccgcagccaagccucucuuugggauccuuauuuuaaaauccuuuuaagacgugugaggccuugacagacaggaaacggggaauccgaauuggcuuuuccaggauaacuuggaaaagguagucuucaguguucaugucaggguuguccgugaugaugucaaagggggagcgcccagccaucaucucaaacauaaggacacccagugcccaccaguccacgcugaacccguacucuucuccucgcaggauuucgggggcgauauaguucgggguuccacaaaaagugcuuguuguaucaccggggccuagaccuuccuugcacaugccguaguccgucagcuuaauguguccgucggcaucaaggaggacguuguccaguuuuaggucccguagaugaucccccucucaugcaagaaguugagagcgauacagaucucagcagcauagaaccuggcauguuccucuggaaguuuucucugccucugcauguggaacaugaggucccccccauugacauacucgaugaccaggaacaaccggcucguugucuggaagcaggaguguaagccaaccaggaagggguugcuggacgccugcucaaauacaugcuucucugucugcacccagucgauauccucgucgucauggacaagcuccuucuuuaccaccuucauggcguaaaucuggucguuuuucuucaaccgcaccaggaggaccuuggcauaccuuccacgcccgaugacucuaaugaggucgaagucuugcagccccagccccugagagauuuugaucccauccaccccaucgaugacaggcuuaagguccucagaaucaucuuugauauuaucauguuuccgagaugaagaaauauaagcaauuccaucaguuucuucugaaggaaggucuacaccaucguucuugucaucuacuggaggcucuugggaaggcgugacagaauccauaugccuccugcaggucagcgggacgaggacguggcagcguuuauggaccagcagcuugcaguugaugcaccuguagcccugccucgagagaccccauauccuuccgcugcacuggccgcaguacgcuccccuguuaaagcgcuuggcuuggaagagguggccauuggcucgguacggcuuucuccaucuucuggcuccauggcgguagauggacuugucuucugcaggacaaggcaugccuggcuguucugggaugcuugggaaaacaugaaugaagagcacuucgucccuacccugacagaccaggcggaaggccuccuccagcuccaucugugaggacacaguacaagggucaccuucacuguccacccacuugagggugagugggugcugcuggugcaggccacacaugucucgcacuuccucacagagguccuugaauguugucauggcauccacgcugguaaucaggauguccccgccguagugcgccuucagacggacgcggccgccgcuccgguccaucuugggguccguccugcugggcauggcgcacucagccagccgccgucagcgcugcuuccagggcgcuccggcaauggcuagcggccccggagaagggccggguugccaggcagggcagacggcggaacguggaagccacauucuugauauauguucuauaaacauaauucgccaaacacuacuuagccaugacagucaacuuagagcaauuauuagaauuagguuuaccuaaagugccuuccuugucucccaauuaacaacccauagcucccguuuguuuccuuucuuuuagaauaauuuguugauagccaguacaauaccaaccaaagguguggaauaggguuacauuagauaauaaaacauuucagagaguauuugguugaugccugugcucuuuaaaguaucuuuuacauugauuucacguuuacuagcauuacuguaacucaucugaguggcaaauuguauugcagauugcagauauuuuggaaaagcuucaugcacucacccacuauuaaauuuuacauaacuucauucuguauacaaucaaugaaugagauaaacaugaguggauuuucauugacaauccauuuuuaaguuuguggguagaaauauuaaaaaugcagccauagaugaauaagugcuuuu

SEQ ID NO: 3648 - RNA, 2732 nt, Mus musculus
aaaagcacuuauucaucuauggcugcauuuuuaauauuucuacccacaaacuuaaaaauggauugucaaugaaaauccacucauguuuaucucauucauugauuguauacagaaugaaguuauguaaaauuuaauagugggugagugcaugaagcuuuuccaaaauaucugcaaucugcaauacaauuugccacucagaugaguuacaguaaugcuaguaaacgugaaaucaauguaaaagauacuuuaaagagcacaggcaucaaccaaauacucucugaaauguuuuauuaucuaauguaacccuauuccacaccuuugguugguauuguacuggcuaucaacaaauuauucuaaaagaaaggaaacaaacgggagcuauggguuguuaauugggagacaaggaaggcacuuuagguaaaccuaauucuaauaauugcucuaaguugacugucauggcuaaguaguguuuggcgaauuauguuuauagaacauauaucaagaauguggcuuccacguuccgccgucugcccugccuggcaacccggcccuucuccggggccgcuagccauugccggagcgcccuggaagcagcgcugacggcggcuggcugagugcgccaugcccagcaggacggaccccaagauggaccggagcggcggccgcguccgucugaaggcgcacuacggcggggacauccugauuaccagcguggaugccaugacaacauucaaggaccucugugaggaagugcgagacauguguggccugcaccagcagcacccacucacccucaaguggguggacagugaaggugacccuuguacuguguccucacagauggagcuggaggaggccuuccgccuggucugucaggguagggacgaagugcucuucauucauguuuucccaagcaucccagaacagccaggcaugccuuguccugcagaagacaaguccaucuaccgccauggagccagaagauggagaaagccguaccgagccaauggccaccucuuccaagccaagcgcuuuaacaggggagcguacugcggccagugcagcggaaggauauggggucucucgaggcagggcuacaggugcaucaacugcaagcugcugguccauaaacgcugccacguccucgucccgcugaccugcaggaggcauauggauucugucacgccuucccaagagccuccaguagaugacaagaacgaugguguagaccuuccuucagaagaaacugauggaauugcuuauauuucuucaucucggaaacaugauaauaucaaagaugauucugaggaccuuaagccugucaucgaugggguggaugggaucaaaaucucucaggggcuggggcugcaagacuucgaccucauuagagucaucgggcguggaagguaugccaagguccuccuggugcgguugaagaaaaacgaccagauuuacgccaugaaggugguaaagaaggagcuuguccaugacgacgaggauaucgacugggugcagacagagaagcauguauuugagcaggcguccagcaaccccuuccugguuggcuuacacuccugcuuccagacaacgagccgguuguuccuggucaucgaguaugucaaugggggggaccucauguuccacaugcagaggcagagaaaacuuccagaggaacaugccagguucuaugcugcugagaucuguaucgcucucaacuucuugcaugagagggggaucaucuacgggaccuaaaacuggacaacguccuccuugaugccgacggacacauuaagcugacggacuacggcaugugcaaggaaggucuaggccccggugauacaacaagcacuuuuuguggaaccccgaacuauaucgcccccgaaauccugcgaggagaagaguacggguucagcguggacuggugggcacuggguguccuuauguuugagaugauggcugggcgcucccccuuugacaucaucacggacaacccugacaugaacacugaagacuaccuuuuccaaguuauccuggaaaagccaauucggauuccccguuuccugucugucaaggccucacacgucuuaaaaggauuuuaaaauaaggaucccaaagagaggcuuggcugcgggccacagacuggguuuuccgacaucaagucucaugcuuucuuccgcagcauagacugggaccugcuggaaaagaagcagacccugccucccuuccagccccagaucacagaugacuauggccuggacaacuuugacacgcaguucaccagcgagccugugcagcugaccccagaugaugaggacgucauaaagaggaucgaccaguccgaguuugaaggcuuugaguacaucaacccgcuucuguuguggacacgccugugaaugacccugucacuuuacccuuaacuacagcauaagcaugccaggccgggcaccgaggcuccaagcagccagggagggaugcuggccaccaagaccgaagaggggcguccaacaggcacuucuagacagagcaaucucuuguguccaggccccagaggcuggcuuugugcuggaggaaccgcuuccugugcacagaggcccuaccggagggugagacagccagccacgccguuuggaaaggugcacaucuuccacagaaacagaacucgaugcacugacccgcuccaggaaaaguuagcguguaaugcccugaggaauaaaguguaccgaugaugucga

SEQ ID NO: 3649 - RNA, 24049 nt, Mus musculus
cgcagaucuggcauccccgcccccaagagccgggcuucacgggggcuuugcuggugauaacugcauuuuuuagggucaccacgccgaaacuagcgcauaggcuuuugguguucuggugccgcuaaugcggaagguccgaucuuuguggucggcggaagaaauuucagguuggcuucggucuccauggaguaaggccugaggcagccggcugggagugggcgugugcggacggucguauagggucgcuguuuguugaugugauaguguguguguguguguguguccacaccuugaucucucugcauuaucuggggcucugugcgcgucgcuuucugcuccaacuuucccucgcgaccacaggaaccaaagcagaggacuaaguuucaguaaggagaggucaggcuagguacagacuugagcuugggaggagcauuuggggcugaaagugccaccgagggugaccuaggagggugguuacuuguugaauuccaugacuuucucagagcccuagcugugugaguguugagggaacugaaggaaagugcucagugcggaugcugccagagcaugauggggaucucauccuugcgcaggcuccccgcgaaggccaucagucaaaaggagggcuugagaaggaugggaucauuauugcugcccaucuaagagucaaggaugaguguacucuucuuuucuguuugagaaaugaguuuucaauuuuauaauauggaauugucaguaaaugcagguaggugaacguacacauucauaccuccaccgcuguggcccuuacguugucccugcccuuagguccugguguucacaugaccauuucaauuacccuugacuuuuucucccuaaaucacuuccuuuccccacauuauagacagugcucaucuuggguucauugucugcaggguauggcaggacaagggaguguuagaaagaaugcaaauacugguuguauauuuaaggaaaugacucauaagcucuagucuguacaguguacauuuuaaucucagcauuuugggaggcagaagcaggaggaucauuguaaauuaaggaucaguuugauccacauagcaaguuccaggaggggugugcuacaaaaugagaaccuguuucaaaacaaggagaaaacgaaaugaagguaauaaugaagagcagaauuuuaaaauuuguauuguguucagugugauaauuuuacagagcacaaggugguccucacagagcccaaggcaggacaguugugucagcccugcggagguugagaaacucaguucuaggaucaaaagaccuaggacacccagaacaaacuuagcauuauuuuguucaaaaucucccauaauauggaaagagggaaacauauacucaccuccugugacaggauguuuuacagcuaauuaucuucauaaaggaucauggcuugagacaacauaaguguuaucauagaugagggaagguucucaggagagugguccauggugcacagucccauucacuaacagugggcacagaaugcuggacgcugccugagcaucacagcugcagccccuccagccucgcugugcuucagcccugaguuuacacaggaggggccaccuggaugcugugagccccugugagccuugauaggugggguuccaguaggaagaucugagaucugcgcacaguaggaggagcggcccaggugcagggcgagcuggagcucaggguggaagauggaucccuucugcuggccucuucuggaggaguucaaggcagauauguuugugcccugcacucccacacugcccccuuggccguggguugucuggguuaggaggugaucagcuuuguguagacuccugugugcuuccaauuugugugugggaggcugugagcggugggaggggagagagugaguggggaggcuugagaaauaaguguagucgaugacaucacagugacagaagucagccugggaacaucaagucacaaugcagugaauggcuuucuuuuugucccccaggggaggaagccugaagaagaauggccagcucuaguucccaagacauggucuguguaaguuguuuuucucucuuggacauagagugacuucagguuaggugacuccugcccucuuucccucuugaagcuucccaaggauccggauucccccagcccagucugccccuuuccagugagggcuggcaggucugagcacuuccugucugugcuucuucccagcgugcacugcgguugucuuugaaugcauuucuccacgugugcucucugcuuggucugugcucagggaggacugucccugcaguggaggugucagucccacagggaaacaggggccuugggggcuucagagcuuugaggggauggucucauugagugcccugggaaaccugauugacaucugugguguugucagccuggugaugaauuguuggagaguuuccccuaugcaugggugugaggagaugacuuccccgaggaagccuuaggggagaguccaggugucagagggaaaggucauccaggcugugauagggaggugacugcagucuccagagucaagaaggaccugagacacauuguuucuuggaagguuuuguuuucauucauggaaagaaagaaagaaagaaagaaagaaagaaagaaagaaagaaagagguuaagccuaacauguacauaauauguacuuauacuuaguaaguuuauggccucuugcauaguguauaaaaucauucuuaugacaacaaauguuaaugacaucaugugauaguaugauaaacucaaggacucacagcauuccuuauguguuuuacccugaccccaggugacauuucccuucuguggguauagccugagggauguggguggaguggagaggcacagguauuggcuauguaggugggcacagucgucguuuauggggggcucaugcagucaggugccuugagcauuuccuuauggcucccuucccacgcuugaguccuuucccuccugguuuccaucuugaaagcuuccccaguuucacucuccuuguguuugcucuuucaggggucagugacauuuagggauguggcuguugacuucucucaggaggagugggccugccuggaugcuacucagaaggucuuauacagggacaugauguuggagaccuacagcaaccuggucucaguggguaagccugugccccauggaugggggauguguccucuacacugugggcuuuccucacucugaauuaaaggacagugccaucuuuccagugguagcugaagcugggauggaggccgauuccugucauugcuucucugagaaggcugaggcaggaagauugcugugagugcaacaucacccucagauacauccugaguuccaggcuagccuagucuacagggugaggccuuguuucaaacaaaauaaaacaaaacaaaaucaacauauaaaugaaauaagcagaugaauccauaaauagaauuaggggcuagagaaauagcuugguuguuaagagaaccagcuguacuuggggaggauccaggcucaauucccagcagcacaagguggcucacaacccuguguacuuccaguuccaggggauaggauguccucuucuggcuuucacuaugcacauuugugguguucaguuauacaugcagaaauauccucacaaacacauaaaauaauuuuuaucaauaaaauuuuaaaagagggagcugaguuccuucguuuuaaccauaggaagaaugugagauuuaauggauugaaaauaggaccucauagagccugcuugcccaccccuuguugguccucucagugagcucuagguucagugagagacccugucucagauacagacguagagaaaaaugaacgaaaagacacccaacacacuguucucuacuguauacgugcaugcaugcauaccuacacacacccucauggacacauacacacccuggacaugcagaacuaaauacgagagccauuaugguuuacuuaguaaugaaucaguagaguugacucagagcagaaguggacacauucuguuuccuucaguaccaccuccuuuaccugcuuuguaguggauuuuuagagugugaaguuugucucucucagugagcaaaucuguaaggaugaggcgugaaugugaaggaaggcagcauaaguaauaaugaaagcaauuuccauggcugaggaaguaacucagucauguuaacccuuucccagcaugcuuaaaacccugguuccaucccuagcauuacugaauaaguaaauaaaugcaaguucaaaaauaaugauuuuguuuuaguauaagucaaucuuuaaaguauuugaauauagcauuuaaucuuaguaaagcccuauccaguuaauagcauuaccucaaucuauguuauuuucuauuauuauuauuauuauuauuauuauuauuguuauuauuauuauuauuauuauuacuauuacuacaucuuuuuucaagacacaucuucuauagugcaugcuagcuauggacuagcuaugcaacuaaauccagccuugaacuucacaucuccuugccuacguccuucaagagugugacuaugugugugugugccaccaugcccaguuauuauugggaaaauuaagcauagaacauuauggcuguugccuaaauaaguacuaucauuagugaggugcagaguagaguuuuacauuagacagcauagcugugauggguugaauaugcuugguccauagugaguuauacuguuaggaggugugaccuuauugggggaaguaugucacuggggggggggggggcggguggcgacccucuuccuagccacaugugagccagucuuuuccugucugccuucggaucaagauauagaacucucagcuccuucagagccaugccuaccuggauccugccaugcuuccugccaugaugauaauggacugaaccuuugaaccuguaagccagccccaauuaaauauuguuaaaagaguugccuuggucauggugucucuucacaacaauggaagccuuaacuaagaagacagauguugguaccagagacugggguauugcugagauagaccuggucauguuuuuguuuggagaaauguggguuugagaacuuuggacuagggaagcagcggaaugcuucaaguggggcuuaauggaccauccuaguaggaguauggaagacauuggugcuguggugauuugaacugugcagacuuggucgaagagguuuagguggagaaaaauguuagcauauggccuagagacuguuuuugugauauuucgguaaagaauguggcugcuuuuugccagcggcggaagaauuggccugaggcuaagcugaagagauuuagauuaauugcuuugacaaaggaagucucaaaaacagucuguuuuguuuaaauaaauucuguuguguuuacuaaaguucucucuuaugaagagcuuuuuaaugaaaaggaucaaacugagaaaggaaaaauacaaaaucuguguucagggaguaaaggagcaccagcaaguggaggggagcaccagcaaguggaggggagcaccagcaaguggaggggagcaccagcaaguggaggggagcaccagcaaguggaggggagcaccagcaaguggaggggagcaccagcaaguggaggggagcaccagcaaguggaggggagcaccagcaaguggaggggagcaccagcaaguggaggggagcaccagcaaguggaggggagcuuaaucccaugggcaagaauguuucauggaaagaagcuaauaccucucuaucauuugcuuuaaaaaaaaauagaauauugccaggcagugguggcacaagucuuuaaucccagcacucaggagucagaggcagguggauuucugaguucgaggccagucuggucuacagagcgaauuccaggacaaccagggcuacacaaagaaccuugucuggaaaaaccaaagagaagagaggagaggagaggagaggagaggagaggagaggagaggagaggagaggagggaaagggaggggggaggggaggguauuaaauggaauuaagggagugcugaccucaggguaagcaagaucccacccagcuaagcuuauauguuuaauauaaguuuauauguuugcaguugaacaaagaauaguuauaccauguuagguguucuuagcugguuauuguuuuuauuuggacuuuuuaucuaaaaugaauuauaccauuaaaaggagggcauaccugugauccagaccuugaagcuggaagacagaagaucuugaggcauaguggccaugagaaacuuuggcccaagcauggugauaauacaccuuuaaucccaggagacagaggcaagcagaucucugagcacaaggccagcuuaggacagagcgaguucuaggugaagaaaagccugaguugagucgaguuaguacaugccuuagaucccagcauucaggaauugugaucucuugaguucaaggucaaucuacagagcaaguuccaggacagccaagcuuagacagugaaggaguuggaaaacagaaagcuggugauaauguaauagaagaagagggucaugauccaguucuaguaagcagcuucagccauguggcuccgguuugagucaaaaauagaagggacuacugggauaauugaugcuggcuaguuguagcuaagaaauuaguggugauuaagaagagaccagcaucaaugaggugaagucuucuggaaaguguuuucugagcucacaaagaagcuguguuucagagauagccaagguugucucuugcgcugcagcuggacuugguaauguauaagagucaccuaggugguacugguuuugaaggcauaaagggaucguggagagcagcugaggcuuggcacuguaagaggcuccaguguggagccuaugagaggcuauuggugaagccuaguugcagcagaagacccuaguauauugaagaugccaguaccuugggaugaccaccaggaacagcagcagcaguggaguugagucaaccagucccuggagugauacagaggacagaguuggagaaguaacacaagcccuuuggaggaacccagacgauaauguguggaucccauacaugugugccucggagaccccaagauguucaagaugccagagcugugggauaucugcugagaaaagcugcuaacagggaguggaaccaguccuaggagaaaaaaguuuguuuugcagucaacaaagaugaaaagaaguugaagaucuguagagugcuuugucguccgcuauggagaugcaguuuggaguuagcucagcugguuuuucaucuuguuugguccaguauuuccucacuaugauauuuuggaaugguaauguauauccugugauguuuaagguaugugaucugcuuuuuuuuuuuuuuuuugacuuaauaggggauuacaguuuuaaguguuugaaugaaucuuagaaaagacuuugaacuuuggacucuuaacauuguugaggcuacuauagacuauggggacuuuugaaguuggacuaaauguuuugcauucugcuauguuuagguauggccccauagacccauguguuugaacaagccuacagaggccagggaguggaauguggugguuugaauaugcuuggcauauauggagugguacuguugguguggccuuauuggaggaagugugucacuguugggaugggcuuugagacccuccucguagucauaugggagccagucuucugucuaccuuuggaucaagauguagaucugggcuugagagauggcucagcaguuaagagacugcucuucuagaacuucugaguuugauucccaccaaucacaugguggcucacaaguaucuguaaugggauacgaugcccucuucuggugugaagacagcuacaguguccucauauaaagaaaaaaaaaaguagaacucuuagcuccuccagcgccaugccuaucuggaugcugcaaugcuuccugcuaugaugauaauggacugaaccucagaaccugaaagccagucccaauucgauguugucuguuacaagaguugccuugguccuggugucucuucacagcaagggaaacccuagcuaagucaauaguuuaggggucauguucucacucauucaauuauaccguccucuuggaugacaagccccuuucugcuauuaaaggagauuaaaaucccuuucagaagcagcugguuucuugccuagguugcuuuuuucuucucuaaagucuuuccucagcauuauauugguuuuuaggauauuuaucuguuuuuaugagacaagggucuugccuugccgccccuugccugacucauucccccagcugauggccuaguagguccacugugccaagcuuugaaggaaguuugccagauccaguggcaaaggaauauauaucguuauaguaaauaaaucuguauuuuuaagaucugcacaggcagggcauaguggcacacaccuuuaaucccagcauuugggagacagacacaggcaggucaaguaaaaguucaaguaccacauuccaggcugcuccuggauuauuagagaaaccaaguucccccaauaaaauaaauaaacaaacaaacaaauaaauaaauguaugucaauauuaugauucauuucuuccucucuuucuuuuaagugggaaguugcauuuccaagccagaucugaucgucuuacuagagcaggagaaagagcccuggauggcugugaaggaagaaacagacaggccgagcccaggugaguaagagugaagugauucauuauugguugugugcgcacacacgugugcagguauccuacgaggcccuagagagggucagcucccugggcuggaguuauaggggcugcugggucucuaacccagggccucgggcggagcucucagaguucucgaccacugaaccaaagccaagacgguuucagcagaagugacagcuguaacccagggaggggcaccaaaugucugaauucuguguccucauggucacuguagucacggugugaugguggcgccucccugcagcacuggggagguggcaaaggcagaucccuugggcuugcuggcaagucagcuccaggcaaaugagagacccugaaucaaaaggaacagauggacaagccaggggacaucugagugcacacacagcacagcuucuaccuagcuuggcagggagcugugaugacuccucuuuuugucaacuugaccacaucgggaauuaacuacaacccaauggcuggguacaccugugugagauuuuuguuaauuaaauaauuugaggcacugcuucugguucccacuggaacugaggccaugagacuuucuggucucagggcaagccauugucagguacgggacuucuaguuugucaaaggcagagaagaagugaacccugaauagaccugcugggcccagacagucggaaccaguguccccgggauccugaguaaugaaaauguccucagaccccgugucgagagaaggaaaggcuaaggguccuaaccccaggggaagagcucggcugagggagggccucgaguaguaaucacccugcaugcuuccuggcuuuuguuuuauauuuucuguaacugaugggaaacgcagaggagccuaaguacuuaccucuaggcagcguggacaggcuguaauaaaccuguuucucuuugccggucccuguuccuauuuucuucuaaaauaccuaagugccccauucuuggcuguuaggauaagccagcaugggccugggacaguauaaagaaugaauggcaggaggagugccccggcauucucucuaggaaacaguuuaauuguuuuccucucuacucuaguuauuucucuguugcugggaaagaagggaauugguaaauauauauauauuuuuuugguuguuguuuugguuuguuuuuuguuuuuuguuuugcuuuugaagacaagguuucucugugugucccuggcuguccuggaacucacuuuguagaccaugcuggccuugaacucggagauaugccugccucugcccucugacuaaaggcaugcagccacaagaaggggcauauaccgucuuaugcuuuacacaucuuucaaaucuccauguauucugaugccaucucugguuccaucagauggccuguaggcaagacugugggguuauuugcucaauuaaugauugaugugggauggcccagcccacuguagguggugccauaccuacuuaauugguccugggugcuguaagagcacagggagcaagccaauaagcagcauuccuccguggcuucugcuucaguucuuuuuaaaaugccugccuuagaccgcaaucucuaaagcaaagaaauccuccccccauaaauaaauaaaaaauaauugaaaguaggaagacucaccuuuaacccacaucuucucuucccacguuaagucugggccacaccuucuggugcagccuggggaaaggaugugggagaagcaagagguucucuuugucugcuuccaucccucugcuggcaaggccagucccucauggcaugagagccugcuccuucaggacuucagcauguacugaagagcagcugagagauccagccgcagggacugagccagccgcagggacugagccagccgcagggacugagccagccgcagggacugagccagccgcagggacugggcagcuacuggauuuugggacuguuccauccuuuuaccugugaauuucaucauuucauuguuuuguuuuuuaacagccaaguaauacucuguaguauaacaucccccuguugaaggacaucuagguuuuuuccauuucuugcuauuaugaauacaacagcaguaaacgugguugagcaagugucucugugaaaguaugaagcauccuuuggguaugugcccaagaguggucuaucugcaucuuguaaaucgauucucacuugauucucaccucacuguggaaucagcacgcauauuuccaugggagugcaugcuuucaucccacgaucaauggauacguauccccuuguuccacauggucgccagccugaguggucacuuguucaucuuagccauucugacaggugcaagauggaagcucaaaauaguuugauuuacauuucugugacagcuaaagauguugaacauuucuuuaagugugucccagccauuugaguuuccucuuuugugaauucucuauuuagaucuguaccccauuuucuaauuggguuauuuguuuucuugauauguaguuuuuaguucuuuauauauuuaggguauuaucccucuauuagauguauaguugauaaauguuuuuuccauuuucuaagcugcugcuuuguccaaauaacaguguccuuugcugugcaaaaaagguuuucaauuccagaggucuuuauguauuauuuguuauucuccaugccugugccuaugguauucuguucagaaagucuuuuccugugcugauaaauccaagucuauuucacacguuuucuucuaguacguucaguguaucuggcuucauguugagaucuuugauccauuuggaguagaguuuuaugcaaagugauaagcauggauaagcauucuuguacaugcagcuguacuuguugugccaggaaacguucaugaacccccaaaagaccaccaagaaaccaauuccaaugcaaucacauuagggucucuuuauucaagcuccagcuugggcucccuaucaacccugacacaacaggaagguggaacccugagcccaguuucaggcaaacauuuauagaggcaagaagggaguaucuagccuggugcacaucugauuggggggcaguuauggccuuuaacauaacuggcuggugcugggagccaaacgauaaacuucuguguuucuccugaugguggugguuaggaagugaagugccaguggcaggcuuguaaccugguggugcugauuuguuggggaauaaccuagaaccuggugcuagguaccggccuguuaguuaacuugaguucagccuuaggucggguucucuaaagcucuguaguacaaauggagauucagaauggugauacuuucuguaguuuucuuauuauuuaggguuuuuguuuauuuguuuggcuugguuugguuuuuuucugcuauccuagauuuuuuuuguuugcaugugaagaugaaaguuugucuuucaugauaugugaagaguuguacuguaguuuugauggagauugcauugacucuguagaugcucuugguagaaugaccaaguugacuauagaaauuauuaugcuucaugagcauggaagauuuuucagcuuccaguaucuucuucaguugucuuacugugugauauuguauauuaguugaggcuauuaugaaagguguuguuucccugauuucuuucuauuucucggugcauuugucauuuguacauaggaggguuacugaugguagugaguucauuuguaucccgcuucuuugcugaauguguuuaucagcuguaggaauuccucauuggaaucuucagggucacuuauguaugcugucauagcaucugcagaccaagauacuuugaccuuuccaauuugcauuucuuucaucuucuuccguugucugauuguucuagguaaaacuucaagugcuuugaagauauggaguagguauggagaguuuggacagccuugucuuuuucuggauuuuaguguaauugcuuugaguucucuccauuuaaggugaugcugucuuugggcuugcuguauccugccuuuauuauguugcagugugucugucccuuguaucccuaaucucuccaggacucuuauucugaaggaguguugaauguugucaaaggucuuuucuggaucuggugagaugauccuguugcuuuugucuuucauuuuguucacauggugguuuacauuuauugauuuauguaugugaaaccaucccuggaacucugagaugaagcuuacuugaucaugauggaucauauuuuuaaguguucuugaauucaguuuucaaguauuuuacugagaauuuuuguaucuacguucauugaggaaaucggucuguaguucucuuuguuggaucuuuaugugguuuggguaucaaggugccuguggccugucucauaaaaagaaucgaaaagguguuccuuguguuucuauuucagcauugauuugagcaugagcuguucuuugaaauuuuggcugaauuuugagcuaaagcaucugccuuuuuguuauaguuguuguuguuguuguuguuguuugggagacuuuuaauuacugauucuauuucacuauagacugcuuaaauuuuuuuuuuuaucgagucuuccauuaacuuuguuaagugguauguauuggaaacaucacucauuucuuuuggauuuuccaauuugguggaguuuagguuuuuaauugcauguccuaaaugaaccucuagauuuccuauguaucuguuguuauguauagugaaaacuuuugagaauuuugaacuuuguuuucccuaaaaaauaaagaaauauuauaaggaugugcuuucacuuuaaucccaguuguagugaaguggagcugcuucagacuguccacagcagcuggccaugauuugcuucauacaaugcucguuuugccagcugcauuuaauuucuuugacugugugaugguuggaauauugggaccuuucagaggguacauaaaugcaaugcacuccgagaugcaggauuauuggcccuuuagggaccgguuucaguuugcauuuagcaguugucaaagaagaaacaaaagaaaagaaacucgauucgggaaguuuucuaacuccucucuccccucuaugcuuguuuuucugcaaucuaguguuaguggggaaaauuggcagggcugugguggugguggugguggugguggugugaaaagaacaaaguagcaaagaccagcuacaauuauguucucuuuucaucucuucauuuuguuaauuuuuuuucugccuuuuauuuaauuuggcuaagaauuaagaaauuuauuuaauuugucaagaauuuucucaaugagucaacucuuuguuucauugauucuuuuuuccucuguuucuauuuuauugauuucagccuugaguuuaauuaccccuuaaugggcuauuccuuuugaguguaauuucaucuuuuuugcucuagagcuuuuuguucugguuaaguugucagaaugagagcugaaagucccagaaaacaucuccaacaaaaucauaauuaaaauuucccuaacuuaaaaaaaaagaugccucuaaauguacaagaagcuuacaaaaaacauaaagaaaaauuggacuagaaauaaaauccuccugccacauaauaaugaaaacacuaaauaugcagagcaaagaaagaauauuaaaagguguaaggggaaaggacaaguaauauauaaaggcagaccuaucagaacuauaccugauuucuccacugagacucuaaaagcuagaagggccuggacagaugucucgcagacccuaaagugaccacaaaugucaacucagacuacuauacccagcaaaacuuucaaucacuauagauugauaaaccaagauauuccaugacaaaaccaaauuuaaacaacaucauuacgcuaacccagcccuacagaggauacuagaagaaaaacuccaacccagugaggcuaacuacacucaagaaaacacaaauacuuucaccccauuacagccaauagaagagaaauacacacacagacacacacacaaccacuaccaacaucaaaauuacaggaaguagcaaucauugaucaauaucucucaacaucaauggacucaauuccccaauaaaaaggcacaggcuaacagaauggaugcuuaaacagaacccaucauucugcuguauaacagaaacauaucucagcaacaaagauagacauuaucuuagaguaaaauacugggaaaaaguuucgcaagcaaaugaaccuaagaaacaaacugaaguaaccauuucuaauaucuaauaaaauagacuuucaaccaaaaguaaucaaaagagauugggaaggacacuucauacucaucaaaggaaaaauacaccaagcugauauuugaauucugaacaucugugccccaaaugcaaggggcaccaacauuuguaaaagaaacauuacuaaaagcuuaaaucauacauugaagaucccauagugggagacuucaacaccccacuuucaccaauggagagauccuugagacagaaacuaaacauuagaaaaauaaugaaacuaacagagguuaugauucaaauggaccuaacagaagucuauagaacauuucacucaaacacagaaaaauauaccuucucagcaccucggggaaccuccuauaaaauugaacuauauaacugaacacaaagcaagccuuaacaaaacuauacaaaauugaaauaaccccuugcaucuuaucagaucaccauggauuaaagcuggaauucaacaacagaaacaacagaaagccuauaaacucauggaaacugaacaacucucuacuaaaugauugcuggcuaagggaagaaauaaagagagaaauuaaaaacuuucuagaauuuaaugaaaaugagggcacaacauacucaaacuuaagggacacuauaaaaaagcaaacacacccaagaggaguagacagcaggaaauaaucaaacucagguguagcuuagaguuuucaaaaccuacuuuuaauaaggguucucaaacgcauugacccucccuucuagcccaccuucuaaagguaugggaaaaaagaugguaaauaggacaaggggauguggaucuguuuagaaguaguucuuuccgaugguuugucaggauaccagcaguccaguucaguagggucaggauaccaaacaugaauuggcaguaaugacaugauccaacagaaacagccaggccuccgcugaauugcuguaaaucagugggagugaccagaacuagcugggacaccaggaaaaguucacuguugugcuucucucaaugaagugaagaugcacuaccaacaaagcauugcaaggcuagcuauucaagggugacuacauugucuguugaguccuauuuauacucucuccaaacaucaccuguccucccacaggucuugccucagcaaaacacaaugugagucugccacaguaagacaccaccugcaucuguaucacaugacccaaccagaaacuugcacuucacucagggcugaaaucaauuagaaacagagaacaauauaaagaacaaacaaaaccaagagcuuguguuauuagagugagaucucucaauuuuucuuaaauguagguacauaccauuaugaauuuaccucuuagaaucaccuucauaguuucucuaaguuuagauauuuugugccuucauuuucauucauccuaggaagucuuuaauaucucucaaucucugucuugacccaauuuucauugaguaguaugguucaauuuguaagcuuucauuuuuuucuguuguuacuaauauccauggugguuaguuagcauucaagguguuauuugaauuuucuuguauuuguugagaauuguuuugugcccauguaugugcucaauuuuggagaaaguuugaugaugugcugagaagaagguauaguuuuuuguguaaauaccuauauggucaauuugguuuauaauaucaguuagugccagcauuucccuguuuaauuuuugucuggaugaccugucuauuggugggaguuggguauugcagucucuugcuacaauaugugauuuuaaguaugugauuuaagcuguaauuuuuuuuuuuuuuuuuuuuuuuuuuuuuuuuacuaaauuggauguuggauguuuggugcauagauuuugcuggauuguuccuuugauaagauccuuuccuaucucuuggguaguguuaguuugaacucuauuuuguuagauauugaaaugacuauaccagcuugguccuuagauccauuuguuuggauuggacaugucuucccauuuccaaccugcucuacuguaaaguguauugucuuacauaaacuuuccuuacugcugcucuccuuacucuuguucagcuucucagauauuacuuuagagucuagccauguauuuaauggauuuuauguuacaagaaaauuguguguguguuuuacuggaaaauaaaguauucuugauuuuuccuuuucuuucagauuuggagacagauuaugaugcuggaaguauaucuccagaaaauucuauuaguaauggaaauuuucccaaacagagcauaaagcaauuaaguagaauucuugaucucgagggcucuacuuuuaguaauggccacaaccauaguauauucaguggacuacaggguuauaaaggaggagaugcuggucaaaagguuacuaaaaaggaagaaaugccuccuuauaccugccagacucuugcucacaauacagaaaaaccauaugaguguaaagagugugggaagugcuuugguuguaggucaacuuuuacucagcaucaaaguauucauacuggagagaagcccuaugaaugugaggagugugggaaggccuucagacucccccaacagcucacaaggcaucagaaguuucacaguggugagaaaccuuucgaguguaaugaauguggaaaggcuuuucaucuuccugaccugcucaaguaccauaaaaccauucauacaggugaaaaaccauuugaaugcagggaauguggguuguauaggauuauccaugcugaugugaaaccauacaaauguagugagugugggaaagccuuuaagcgucgcucaaaccucgugcaacaucagaaaacucauucugaugagagacccuuucaguguaaggacugugggaagggcuucauuguucuggcucagcucacaaggcaccagaacauucacacuggagagaagucauuugaaugucaugaaugugggaaggccuucagacucccccaacagcucacaagacaucagaagucucacaguggugagaaaccuuucaaauguaaugaauguggaaaggcuuuucaucuuccugaccugcucaaguaccauaaaaccauucauacaaguacaaaaccauuugaaugcagggaaugugggaaguccuuccaucgcaucucuaaccuuguugaacauaggcuuauucaugcugaugugaaaccacacaaguguaaugagugugggaaagccuuuaaaagaaacaaaagccucaugcaacaucagaaaauccauucuggugagagacccuuucagugccaggagugugggaaggccuucauuguucuggcucaucucacucggcaucagaccauucauacuggagagaagucauucgagugcaaggaauguggcaagaaauucagaacugccacacaccuuguucagcaccagaguauucauacuggugagaaacccuuugaaugcaauguaugugggaaggcuuuucggcuucagauauaccuuucugagcaucagaaaacucacauggaagcaaaacacuuugaaugcaauauaugugggaaggucuuuaggcuucagguauaccuuucugagcaucagaaaacucacacugaagagaaaccuuucaaguguaagcucuguggaucagccuucagaaguaaguaccaacuuaguaaacaucacacaguucacacugaugaaaaacccuaucagugcaaggaauguggcaaaugcuuucgucaaaggucaaauuuuaccgaucaccagaguauucacacuggaaaaaaacccuuccaauguaaagagugugggaaauuuuacagacucaauacacuucucauucgucaucagaagucucacaguagugagagaccuuaugaguguaaagaauguggaaaggcuuuccaucuucccagugaacuuaauaaccaucaaauuguucauacaaguaacagacccuuugagugcaagguaugugggaaguccuucaagcgugaauccacucucauucaacauauggccauucauucuggugugaaaucauaugaauguaaagaaugugggaaagguuuuauucaccgcucaagccuauugcaccaucggaaaauucauucugaugagaaaccguuuaagugucaggaguguggaaaggccuuuguuguucuggcauaccucacucggcaccagagcauccacacuggagagaaaucauuugaaugucagcacugugggucagccuucagauacaagucccaacucaguaaacaucagagaauucauacugaugugagacucuuucagugcauggaagguaggaaugacuuuguucauggacuagaccuuagaauucaucagggaauccauaccagugagacucccuuucaauguaaugaauauggggaacccuuucauaaucauaaccaauuuucuuggacauauuagaauucauacugguaggaaacccuaucacuguaaggaauguggaaagaacuucaauuugagcucaggccuucuuuaacauaaaagaacccaugcuggugucaaacacuaugaaugcgaggaaugugggaacauuuauagaauuagcucaagcucuucagagaguccauugagguuugaaaccaugugaaugagaagaaucaggaaaagucuuuauuguaaacgaugaguuuagacaucaucagaaaaucuguaauagccaggaguccuauucguguaagggagguggacaagcuauuguaugaaaauguuacugaacaucaggguccucauauugggaauacugugacuuaaaauaaugugggaacuuuaaucugcccuggauauggugaccauuggugugucauauccugucaaugccagaagcucuuuggaaugagaaugugggaagugguuguuaagaguaaauacuugguugagauuuucaugucaaaaauucaggguagcaauuauguucuugauuuacucuccucuuguuaguuguauaaauuuuauucaucaaucaauagucauccaggauaaucaauuuagggguaacaguuauuggaacugaguauuugguuaguucccauggucuguagaagaguuuuuaaaguuuucuccuuuuaucagcguuaguauaacugacaugaaagguuaauuguguguuagauaguuuaggaaagucucaugcuuuuacucacuguuacacuuuaaccuuauucuggauaaaucucauggaugaacaugaaaggauuugaauuguuccccauuccuuaaguauuuguguggacauuuaaaagaaaaaaccagucauuuaugaguaaguacuuucuaaaagggugaaacccauaaaaauuucaggauguaaaacccuauaauucaaugccuuccacccacaugugaagauaaaguauacacuuuugauaggacaagaaaguccacaggcuuuuccaucucuuuuucuugcuaagaucauuucagguuugacuaaaauuugaguagaauuuccuugauggagaauauuguggaaaauuguccaacucuacuuagagacuggaguuuaaauugccucugcuaauuuagccuaucuucuguuaagagcccuguguguuuaaaccucucccuccagcuaucugcuuauuuuuggcuaauuuuaaacuaccugcuuguccaaaagcucccccuguagcuccugaacaacguaguaauaagaugugggauuuccucuaaaugccagggcuauucuuggguuccaaauacaugaauguacucagagcuagcuggaauaaagacuuucauuuugaaguaaacugcauuugaauggucuucucuugugggcucccuauagugcauuaacaaaaauagccagauugaaagcacuuauaaaaauguuggaaaauuuuuguccauaugaaaaacuuggaacagucaacaacauacaucuguauccucaccuagauugaaaauugucaacaguuuacaagguugauccuguuuuucuguauauauagauauuugaggcuguaccauuaagacuauguuuuagaguuuggaguggaaaugcaugcucaaauccuaaggaaguguaaagcuaagacaggaggaucaagaguuggaugcaagucuagcuauauacugacguuaaguccaacugugguaguauugagacuccuuaucaaaucaauaaguaaaaguuguagacgugacauuuuaucccuuacuacaucacccaagaugaaaugucaucuauacuacagaaccauaaauauuccgaaggaaaugauucagaauuuaugacauuuagaaguuugucauuggccuccaaacuccuuuuuuuuuuucaaguguauauauccugaggagaaucuuguauagagauuuggccuugcccuauuuuauauugaguuuucaguguugauuuaacccaggguguugugcacaguauuauuguaucuucuauacaaggacaauuagauucagaugaaauauuuuggaugaauacacacuguagguuguauguucuguccaaccuaucuagaaacauuuaugugucagcuauaauauuacuggugaaauuaugguugguaauuuggguaaaauggugggugccagagcucuauuaaaaggucuaguuuguuguguauaaguagucuauguaguuccaaacagauauuuauaauuuaaucuugguuaaauauaaguaaagaucgaaaucaacuuuaaauugauaguauaauaaaguuguaugguguaacuugaauaccaugauuuaaguuguaugguguaacuaaugcuguacucaguucuugaguuguagacauaacauuuuaucuuuucuugauuuaugucaucuuuucgucaagugaccuguguaauuggaaaacucaaaacucaucauucuguggaaagaguagagaaacugccuccaagcugagcugguuggggguucuguuguggggaacacugauggaaugcagccaggauagaauggauuuuucccuuuuguccaguauugaccaaggagggaauuuucucuaagacuucuuuagaugaauuagacagcugcuuagaagguugccuuuuucacccaguuuacacuaucuauuaggaaaagaaaguuauaaaacuuagauggauuuaaaggcagaaauaggcccaguuccuggauguggccuaaaaggaaacaacaacaaacugaaagacaagauccuuuggauaaacugaaagccaucauccucuucucuauugaugagacucgguuaggguacagauacccagcaaaauguuggugucuugcccuccuucagaagaauaucucuuagcugaaaguugugcucccaaucaaagauacaucuuuuagauugccaaccaaaaauccugaaggcgagggcaaaaucaccucccaccccaggauuaguucaacaccaacgucagcuaaacaguuaagccacuccugaccagaaugaacaauaccaaguagcccuggaaagaugauugggaaauugcagucugucuugccuggcuuaucaagacagacacacaacacaauucuccugucugugaugaaaccugggacuucuggucaucgacuccagaaucugaaauaaaaagaaaaaaaaauuauuaagagaguccugccucuacccuguggucucaaccccauacauucucaugagucugauuugccuagagaaguaggcagauauugccuuggaccugaaagauguguucuccagccucucauuguuagagcuaagucaauucaucuuugcuuuggaguggacggaccaagaaggagguuauagaggguaacuuagauggaccagguugccucagggauuugacaauuuuuccaacccucuuugaugagaguguuggaaacuuguguuuccaaucuuaggucaacuaaguauuaaccccuugcucuuccaccagggguuugcagggcccauacucuuauaauauauaaagaccuccuagccucuaaaacuaacagaaauuaaaagggccacggagggacuccugcaacaguuauagaacuugggguacaccaugucagcucaaaaagcccuacuuuguacaccucaugcgacuugaagaggugaggcaaaaggagccugucucaaaguaggauugcugccaguucuucagaucccaacaccaaagaccaagagacauguuugagaauucucagguucaucuauguauuucugacccaagauaccagaguuuguggaaauagcaacacuuuuauauacuggagcaaaucaggcccugcgugccuaaucuggauagacuaaacaaaaggcauuugaggcuuuaaaugacuuaggcuccagccuuagcaauuccagauaccucaaaaccuuuucaucugauuauggaacaaaauacaaaaggguuuuaucccaagcuuuggggccauugaaaagccuugugacauagcuguccaaacauuuggauccuuuagccacaggaugacccacuugucuaagagcaaugccaggaaagagagagagagagugagagagagagagagaucaguaucuuauacucacagcaccacaacugguugugaccuuccucugaggaaccccaggauucgaugccuguguaccaggcucuacucgugaaccacccucgugugcaauuugagaaacccaugucuaucaauccugcuccccucuuuucuauaugaguauguacagguccucaucuguggcugacuggagaugacaucccccuaaaagaguuugaugcagugcucuacucagguaggaacagcuucauuaaugaugaaaccaguauaugggguguaaccuucagaccauauaccacugaggcggggccaccugcagugcugcuucuccgacucaacuaauuuccuuugaugugacacugccugccaccugccaugaggccuaaccgguucuccaagauuuuccggaguuaacuacaaccugugaaucuggcgaauuacugcuaaaaggcugugcugacaacaucaagaaacuuggugugauaggggauggguuuccuucuuuaugagcacagacuuuuuuauuaaacauuugauccuugagcagac

SEQ ID NO: 3650 - RNA, 30106 nt, Mus musculus
cgccgccaagggucuuuggcaucccggugccaccaacacggaaggucugaucuuucugguccaaagaaauugcugguuggcuucggucuccacagaguaaggugggcuggguaucggugugggcgcugguguagggugaauggagauguugacgcguacgggcgugugugagcgugugugagcguguguuugugugggugggugggcgcgcgcucgcgcgcgucucucuguguauacacaccuugagcucucugcucaucugugucacugugcuuaucauuuucuuucaaggccacagggguuggagcagagggcuaagcaucacuaaggagaagucaggugcggagucugaagggaagcuuucccugagguacacacgagcuugggaggugcuuuuaaggccggaagugccuccgagggucgcuuaggagggcugcucuggguugaauacccgaaguuucucagagcuguagccaugagaguguugagggacgugaaggaaaaugcucggugaggaugcucucggauauagucugagaucucguggaauuaucaguaaaugaaggaggaacgugaaaauugauaccuucaccucuggggcccauaacguugucccuucccuuuccacuucaccuuaucauuucaaugaaccccgccuuuucuucucuacaaucacccuuuuccuaagauguucuagguagaaaccuccagagguuaucguuaggucucucaaacucugauuuuauaaaucgauuucuauuuggauggcaucgcauaucagaugcgauccuuugauccuuacaggccuuguuuucaaagcaggccaggaaugucggggauagaugauguguucacugugaggauuauggcagugggaaagugauagcacugaauuuggcaucuuugaaagcuagugauuuucugaguguguguguguguguguguguguguguguguguguguguguaauggguaacguuggccagauccagaugagcaaugccaugauugaucguggaguguggaucugugguaucggguuggaaucuugguucuguccccucaggcucuccaggccugucaggaaccguaggaugccuguggugaagccuguuagugcagugccgccauauccuaagggccuggugugcuuuaguuguucucugugaggccaucuuggguucauuccacucaguguucagcaggacaagggagugugagaaacaaugcgauugcugguggauguuuaagaaagugacuuaaaaagaaaagcuaggcuucgugguauacauuuaaucucagaggcagaagcaggaggaucacugugaguucagggucagcuugguccacauagcaaggucuaggcuagcugggccacacagugagaugcuguuuuaaaaacaaggacaggaaaaugaaugugcuaaugcagaacauauuuuuuuaaaacuuuucagauaaaaauguucauauugugcauagcauaauauuuugaaguuuuucuauacuuugggaugacuaaaucggucacacuuuuguagagaauaugcuagcgucuacucaaacccauuaauugucaccguuuuuacaugauauaucaggugaacuuuuguuauguaggugagauuuugugauguuuaaucaacaucuucugaacucacuuaaggaccuacgccucccacugucaaccaugaugcugcacauccggccucagccacucaaaccccaguacccagcauccuacuugguucuaugagaaaacagcuucagauucuacacaaguaagauuguggguguuuugucucaagauuaauuauuucaauuuuaaauuaugugugugcgguuauguguacaugagcacagcucagagaccagagguauaggaucuacuggugcgcauacagauggaaaauacucagaaauauaaaauaaauaauuuuuuuuaaaaaaaguuuucauucauguagagaaagaacgcauuguggagggaguguaaauuaaugcugucauuguagaaaacaauauggcggauucucaauuacaacuagaacugguaugugauacagcaaucccacuacagaguagucacacaacagaaauaaaaccgguacccuccggagacauuuacacuccugcuuucaauucagcaucauuuaugcagcugugauaugcagccccaccaagaaaugagcagacacaucuggauugagguucauggacacaguggagugauacccagccauuuguuccuuuccuugugauuucaguggcuaucaccgagaugcuaauuuuucauguccuauuuucuuaaaaagauuuacuuauguauuuuauguauauaaguacacuguaguugaacugaugguugugagcuaucaugugguugcugggaauuugaauucaggaucucugcucgcucuggccuaaagauuuauuuauuauuauaucaaguacacuggagcugucuuaaguugcaccagaagaggcugucagaucucauuauagaugguugugagccaccacaugguugcugguauuugaacucaggaccuucgaagagcagucagugcuuuuaaccacugagccaucucuccaucccucauguccuauuaauaggccauauugauguuccauuuggggaaauagcuuuuucugguuuuccuuuuuuugaauaggaaguuuccuugccacugacuugucugcauuccuuauaaaguugcugugcaguuuagauguuaacaccuugucggauguacaguuugcaauuauucucucuuauagucuagucuauuccucuacucuguugauuguuuccuuugcugugugugguauuuugaauguaauuggccuccaaaacccacagggaauggcacuauuaugaguugugugaccuuguuggaauaggugucaccuuucuggaggaaauaugucacuguggggguggacuuugaggucuccuaugcucaaguuaugccuucuccagcaccaggucuuccugcauguugccaugcuuuuuacaugaugauaauggacugaaccucugaaacuguaagccagcucugauuaaauguuuuccuuuauaagaguugcuguagucauggugucucuucccagcacuagaaacccuaacuaacacaguguaaagguuuuuaguuugguguaaaccccauuugcccauuugguuuuguuacuuauguuuuuagaguaauaccaaaaauauccagugucauggagacuauauuuuucuaguagcuucaguuugcaaauuguaaucuguuuugaguggacuuacaccuguggugccucugaagguccaaugucauuguacugaauguuaaaacugagucugaccagaacaacugauugcagcuccacauaggccaggcuggcccgagucucugagcaagccuccuacaucaacuucccagggcuggaauuauagacccaugcugccacauccagcagacccuccugggcuuuuaucucuggccaacuuugucagucaccaacuuuaugaagcauaaacaguuauaagugucaugagguuacacuaaaacuaucacagaaauauaaagauaggggcuguggcgauggcucagugggugcagugcaugcaagaauggaacugugcagugccagauggcaagauggggguggaaacaagagaaucccuggcaggcuggcuagcuugguauaugcagagggaaggaaggauaaggaaagaaguuuguuuaugaaucuuguggggagacaaaaguaugauuucauaagauuaucagauguuggggcuggugagauggcucaguggguaagagcacccgacugcucuuccgaaggucuggaguucaaaucccagcaaccacaugguggcugacaaccaucuguaacaagaucugaugcccucuucuggagugucugaagacagcuacaguguacuuacauauaauaaauaaauaaaucuuaaaaaaaaaagauuaucagauguugucuuaggguuuuacugcugugaacagacaccaugaccaaggcaacucuuauaaagaacaacauuuaguuggggcuggcuuacagguucagagauucagaguaugauuaagaugggaguaugaccgugcccaggcaggcagggugcaggaggagcugagaguucuacaucuucaucugaaggcugcuaggagaacacugacuuccagacagcuaggaggagggucuuaaagcccacacccacagugauauaccuucuccuacggcuacacuuccuaauugugccacucccugggcugagcauauacuaaccaucacagauguguacuugaaaguuggguguggagauccauggcuguaaucucagcauaggagauggaggaaggagcuuuaggaguucagggccagccugagauauagaagaggccgucucaaaaacaaacgauaacaaaguguacuaagguuuagaccuguuggccagagcacuagguccccauuuggugauggcugcucccuggggcaaagauagggagaucugaggguugugugugaugaguuauuucucugccagugaaaugagccaauucaagccagauuuuuaucuauaucuacaucuacaccugugucuguauauguauguguauauguacacacacacacacacacacacacacaugcagguuuauugggaagcuguccuccagugaauucacuggccccaaggaccaaggcuagagaaauugccacacugagggagaggggauggagaagagaggaagggagaaagaguggaguagaaaggggagagagcgagaaggaaagggaaccggagagacccaaaauaccuggauuacauaagggaagacccugugggggcagggcaggacaugccagcuagagacugagggaugcugggagaaccuggagaccuaaucuguuuugguaaaauacgcaccucggccccuugucccugaucugaaaacugacugugcugcucagagcuugagaguagagggucagugcugcugagugcaguacagagcccaagaugguccucacacagcccaagacagcacaguugugucagccgggcggagguugagaaacccaguucuaggaucaaaagaccuaggacaccugaacaaauuuaguaauguuuuguucaaaaucucccauaauauggaaagagagaaacagaucauacucgccuccuguggcaggauguuuuacagcuaauugucuucauuaagacuuauagcuuaguugauacaaucuacgcuguaaucauagaucaaagaagauacuacaguauagcagcaaauuaguuaaacuuuuuuggcucucagugggucccaugugaugcaccugcccaagagcucucugcauuugagaaugaagcaugcaugcacacgcacgcacaugugcacacaaguucucuuggucccuuucccacgcaauuuaaaaguccugcuccaucucccugcccaguggugggcuguacagcaauucuuuauuaucaguugaagccagcugggggcagggacccucaggucuggaagcacugugaacgguaggaggggagagagugaguggggaggcuugagaaauaaauguagucgaugacaacacagugacagaagucggucugggagcaucaagucacaaugcagugaauggcuuucuuuuugucccccaggggaggaaaccugaagaagaauggccagcucuaauucucaagacauggucuguguaaguuguuuuucucucuuugacauagggugaccuucagguuaggugacuccugcccucuuucccucuugaagcuucccaaggauccggauucccccagcccagucugccccuuuccagugagggcuggcaggucugagcacuuccugucugugccucuucccagcuggcacugcgguugacuuugaaugcguuccuccacgugugcucucugcuuggucugugcucagggaggacugucccugcaguggaggugucagucccacggggaaacaggggccuugggggcuucagagcuuugaggggauggucucauugagugcccugggaaaccugauuggcaucugcuguguugucagacugaugacccaguauguguggaugaauguccccugugggugugugaugaggugaccugcuugaggaggcuuuaggagggagagaguugagguaucagagggaagggucauccaggcugugaaagggaggggauugcagucucuagaguuagggaagaccugagacacauugucaccuggaaaguuuuuugauuuuucuuuuuuaaugguacaauagguuaaacauaauaugcacauaauguggacucuuacauaguguauaaaaucauucucaugacaaaaagucuuaaugacaucaugugauaguaugauaaacucaaggacucacagcauuccuuauguaauuuacccugaccccaggugacauuucccuucuguggguauagccugagggauguggguggaguggagaggcacaguuguugacuauguaggugggcacagucgucguuuauggggggcucgugcagucaggugccuugagcauuuccuuauggcucccuucccacgcuugaguccuuucccuucugguuuccaucuugaaagcuuccccaguuucacucuccuuguguuugcucuuucaggggucagugacauuuagggauguggcuguugacuucucucaggaagagugggccugccuggaugcuacucagaaggucuuauacagggacauaauguuggagaccuacagcaaccucauugcaguggguaagccugugccccaugaaugggggauguguccucuacacugugggcuuuccucacucugaauuaaaggacagugccaucuuuccagugguagcugaagcugggauggaggccgacuccugucauugcuucucugagaaggcugaggcaggaagauugcugugagugcaacaucacucucagauccuuccugaguuccaggcuagccuagucuacagggugaggccuuguuucaaacaaaacaaggcacacaaauaaaauaaauaaagagauaaauucauaaauagaaucuugggcucgagagguagcuuagugguuaagagaacuagaaguucuugcagaugauccagguucaauucaauucucagcaccgcagaugggcucacaacuauguguaacuccaguuccuggggaucuaauuaaugcccucuucugaccuccauggucauacacacauuuggugcucauacauacauacauacauacauacauacacucauauacacauaaaauaaaauuuaguuaauagaacccaaaagcgauagcugaguuccuccuucuucccaaagcaauaguuugagauuucuuuggucccgaauaggagcuucauuaagccccugcuuucccaccccuuguugguccucucagugagcucuagguucagggagagacccugccucagauacuaaaguggacaacaaucaacaaagacaccugacauucaucucugcacuauccagacaugcaugcacgcauacuuacaugcacaccuggacaugcacaacuaaauacaagagccauuaugguuuacuuaguaaugaaucaguagaguugacucagagcagaaguggacacauucuguuuccucucuagcucaagauucugcuuaugaauuuaucucuuuauuuaucucuuuaccugcuuuguaguggacguuuuagggugugagguuugucucucucagugagcaagucuguaaggaugaggcgugaaugugaaggaaggcagcaucauaacgaugaugagagcaguucccauggcuggggaugcaggucagcagagacaauuuccccaggaugcucaccgcaucacuaaguaaauaaauggaaauugaaaaaaacagugacuuuguuuucauagagaucagacacuauucaaauauuugaaguaguauuuaaucuuaauauuggcccuacucauaaacgacuccuaaauacuacuacuacuuauuauuguuaauuguuauuauuaauugcuuuuguugagaccaugucucacauaguacaggcuugcuuuggacaugcuaagaaaguaaacccagccuugaacuucuccucugccugcuuucacuuuucaaguguugugacucugugugcgcgccaccaugcccaguuuuuagauggaaaauugagcauagaacccuaugggacucgccuaaaugaaugucauuaguagugagcugcagagauggggucuacacuagacaauauagccuguggguucauguucucaccacucaguucugcuuuccucuuaagugacaagccucugcuguaguuaaaggagauuaaaaccuuaauugaaauaggugguuucuugcucaguuuguuucuucucugaagucuuuccucagcauuauuuuggcuuuuagaauuuuuuauuuuuuuuuuuuuuuuuuuuuuuuuagagacaaggaucuugcauugcagcccagagggccuggcucauucccccaccuacuguauagacuuuuauaauaagucuguauuuuaaaaaucuggacaggcagagcaugguggcacacagcuuuugucucagcauuugggaggcagaugcaggcagaucaaguaaguucaggccagccuuguuuucguaucagguuccaggacauccugggauaauuagacugaaucuccaaauaaaauauaauaauaauaauaauaauaauaauaauaauaaugucuauacuaugugucauuucugucuuucuuuuaagugggaaguugcauuuccaagccagaucugaucgucuuacuagagcaggagaaagagcucuggauggcugugaaggaagaaacagacagguugagcccaggugaguaagagugaggugagccugcagcccugccaggcacagauguggucagagaggcucuaugugaguauagcaggaugggagcaacgguuuaguguuuaagaguacuuccugcucuuacagaguacccaggcuuggcucccaauacccacucaguuuccaacacccacaugcaguuuugcaagcugcuacaauccaauuccaaagggucugaugcugcuuccuuggagaccaggccuagaaaugguauguuuacauacauauacucacagaaacauauaaaaugaagauaacuggaucauuaacaaacaaaaccugaugaaauaacagcaacaauaagcauuguucccacauuaaacagacgaaaaacaaaauguuguucucuaaaugaacauugacagcauuuguccuaugugcuguguuuaugucuacaacuccauguuuagacacuuaaacuuugaugguaaguuagugauguacacuugauacgaaguauucagugcaucccuuuguaggcuauuauuuugucuuccaucagucguaguuaauguaaacaagcuuguuacucucauacuaauaaaaugaccaucucaaaugaucgucagaaguucucucucuuuuuuaauuuuuauuuauuuauuuauuuuggguuuuuuuuuuuugagacaggguuucucuguguagcccuggcuguccuggaacucacucuguagaccaggcuggccucaaacucagaaauuggccugccucugccucccaagugcugggauuaaaggcucacuguagaacucccaguuccuucucaugucuccuccccucugcauccacucccuuucuaccucuccuucgaaaacagacuucuaagggauaauaauaauguaauaaaauaaaauaagcuaaaacaaaacuaacacauuggaauuggacaaaacaaacaaaaaggaaauagcccaggaaaaagcaaaagauacugacccacuugucuguguccucacaaaucccauaaaaaacgcuaacuuggaagccauaauaaauucacaggcaaaggucguggcgcagacuggggagcgcaggcccugcgauaccaguaucucagugucugugacgucacgugggcuuugaucacgcuuauuuagaggaccuuguuuucuuggugucccugagugcuauggggaggggguugaaggauacaucccuuuuauggcugagugucccaaggucucuaauugucuacauagugucuggcuggggaccucuguauccauucccaguaccuguagaaggaagugucucugauaauggcugaacaugaaaauggcugaucuauaaguacagcagaaugucuuuaggacucauuuuauugcugcauuuuuguuuuugguuuuguguuagaacaguuuuagagcagaaucuuugguuuaacccuaggagccugucuacuuucagguucuuggugacugagcuuuuaucuaucaggaauggguagcaucuuagggaguggaccuuaaauaaaaucuuacauuaaccagcuacucccgccagcuuugccaucagcuguggcagcagccugaguuguuugucguuuugcauggagccccuuuggcccacaacucaauuagauguauguaacccagcccugggacuguaagcucuauuaggggacaagagauaaucaguugggacucuugucuccuccaguauuuggccauuucauuuagauagcccucauauauguguauacuuuuggaaguuucuaccguguuagauauccauacuacuucucaaaugauccauaccuuuaucuacuucuccucauguuucucucccucuccaacucauccucccauucuagccccacccccaucuauccauaacuauauauucuauuugccuuuucaaauaaaagcucuguucccccaguuuuuuacucuauaucuaaccucuguaguucuauggacuauagcuugguuaucauuaauuuaacugcuauuuuaucauauaagugaauacauaccauuuuugucuuuucugaaucuaugauaccucacuuagaaugauuuuuuuaguuccauccaguacuuaccugaacauuucauaauuucaucuuuuucaacaguugaggaauacuccauuuuguauuuucauuuuccauacuucuauugauagacaccuagguuguuuccaauuucugaguguugugcauaaagcagcagcaaacaugacugagcaagugucaguguguuaggaugccacaucuguuggacauaugcccaagagugauagagcuggaucuugagauagagcaauucucaccucucugaggaaucaccacauagauuuucauaguagcuguacaaguucacacacacagcaucaguggacgagcguucccuuuauuccacaagcuugucagcaugaguggucggucacuuguuuaaugaucuuagccuuucugaugggaacaggauaaaagcucaaaguaguuuugauuugcaguuuucccuguuggcuaaagauguugaacauuuccuuaagugugccucagccauuugaguuuccucuuuugagaauucucuguuuaggucaguaucccacuuuuuaguugguuugcuuucuugauaccuaguuuucuaagaucuuuauacaauuuggauauaagcccuauaugggauguguaguuggugaaaucuuuuccuaaucuguagguugccaucgugucugaaugacaguguccuuuacuguacagaaguucuucaguuuuauaaagccaugcuuauuaauuauugaucucuguagcugugcuaaugguauuuauucuguucagucuuuuccugugcugaugaguucaagucuacuuuacauuuuucuucuacguguaucugguuucauguugagaucuuugguccauuuggagucaaguucugugcagggugauaagcguggaucuuuuugcauucuuguacacgcuccuguacuuuuugacuggccccauuuuuugaagaugcuuuuugaagggcuuaugucugggucuucaauuaacuucccuugaccaacaagucugguuuugugacaauuccaugcuugugauucuuugucagacauaauugucgccuaggagccuuacugcugaauauacuuacccuuucuaacucuuucugaacucuggcuggcugguucaacucagcuguuguggcucaaacuccucccuaagcugacugaaucuaucaucucuuggcuucucacugaauugcucugcuuggccacauacuaacuuuugcaaucuguucuaaucuucuggcuccuucucauucucugccucauucugucuucaccuguaucuacuuguuuucucucuggacgcugucucuguacaaaugucugaguaaaaacuacccuuugaacuccaugaauggaacugccaccaaaugaacugcuacuacuacuguacuacauagauguucuauuuuuaucaggaaauuggucuauaguucucuuuguugagucuuuaugugguuuguuuaucagggugccuauggccucaucaaaggaauugggcaguaugguguuuugaauagguuuggcccccauagauucaaguguuucaaugcuuggccauagagagugaccuaucuuaggagguauggccuuauuggaugagguuccagccuuguuggaagaaguguaucacaguguaaguggguuuugaguucuccuguagugaagcuccacccaguguagaaucagagacucuuucuggcugccuuccaaacaaauugagaacucuugacuccuccagcaccacgucugccugcaugcugccauguuuccugccuugaugauaauuagcuaaaccuuggaaacuguaagucagccccaauuaaaugcuugccuauauaacuauugccuuguucaugguaucucuucacagcaauaaaacccuaagacagguaauguuccuucuguuucaguuuugaacaguaauuugaguagaauugucaugaacucugcuuugaaagucuagucuaauucugugcuaaaaccauuugaccuuggacuuuuuauuguuggaagauuuuaaauuccggauucuauuucacuaguaggaguuauagguuugguuacauggcuuauuuggucuuguuuuaacuucgguaaguaguuuguauuugaaaaaucacccacuucuuuuagauuuucuaauuugguggcgugcauguuuuuccuuacguccuaaugauucuguggauuuccuuggugucugugguuauguccuccuuuuaccuuuuauuuugcuuauuuggaucuuuucucucugccuuugagguaauuugguuaauggcuuggcagucuuacugauuuucucaaugaaccaacucuuuguuuauugauucuuugaguuguuuuacuguuguuucuguuuuacugauuucguucccgaguuuaguuauuuuauuuuuguuccaucuacuccuuuuggguguaacuuugucuuuuuuuguucuagaacuuucagguguaguguugacuagcuaguauaagauccuuuccaacuuuuuuaaguugguacauaauuauaugaccuuuccucuuaaaaccauugucaucuuguccucuaaguuuggguuugcugugucuucauuuucauuuaauucuagaaagacuuuuaauuuuuuuuuuuuuuuuuuuuggauuuccgagacaggguuucuuguuucucuguguagcccuggcuguccuggaacucacucuguagaccaggcuggccucgaacucagaaauccgccugccucugccuccccagugcugggauuaaaggugugcgccaccacgcccggcuagacuuuuaguuucucuuuuuuucuuuuuuuuuuuucagaauaaaccaauuuauuuuuuuaacuccacaaucacaauacaguuaguucaaggaggccaaacacuugcccaguaaucaacacuacaagccucaguaaacaucuauauuuagaucucuuucacagccauuccaaagcaaugcagcuguuagaaauauagggguccacauuucuacuaucaauuauacagaaccaauuuuacaucucuucagcuugaauuucuuuuuuuuuugaauuggguauuuauuucauuuacauuuccaaugcuaucccaaaagucccccacaagcucccacacccacucccccacccacccacucccauuucuuggcccuggcguuccccugugcugaggcauauaaaguuugcacgaccaauggaccucucuuuccacugauggccgacuaggccaucuucugauucauaugcagcuagagacacaagcuccggggggguacugguuaguucauauuguuguuccaccuauaggauugcagaacccuuuagcuccuuggauacauucucuagcuccuccauugggggaccugugauccauucaauaacugacugugagcauccacuucuguguuugcuaggccccggcauagucucacaagagacagcuauaucaggguccuuucagcaaaauuuugcuaguguaugcaauggugucagcguuuggaaggugauuaugggauggauccccggauauggcagucucuagaugguccauccuuucaucucagcuccaaacuuugucucuguaacuccuuccauggguguuuuguucccaauucuaagaugggguaaaguguccacacuuuggucuucguuauucuucaguuucaugcguuuagcaaauuguaucuuauaucuuggguauucuaaguuucugggcuaauauccacuuaucacugagugcauauuaugugaguucuuuugugauuggguuaucucacucaggaugaugcccuccagguccauccauuugccuagggauuucauaaauucauucuuuuuaauagcugaguaguacuccauuguguaaauguaccauuuucuguauccauuccucuguugaggggcaucuggauucuuuccagcuucuggcuauuauaaauaaggcugcuaugaacauaguggagcauguguccuucuuacugguuggaacaucuucuggauauaugcccaggagagguauugcaggauccucugguaguacuauguccaauuuucugaggaaccgccagacugauuuccaccaacaauggaggaguguuccucuuucuccacauccucaccagcaucugcugucaccugaauuuuugaucuuagccauucugacuggugugagguggaaucucaggguuguuuugauuugcauuucccugaugauuaaggaugcugaacauuuuuuucaggugcuucucggccauucgguauuccucaggugagaauucuuuauuuagcucugagccccauuuuuuaaugggguuauuugauuuucuggaguccaccuucuugaguucuuuauauauguuagauauuaguccccuaucugauuuaggauagguaaagauccuuucccaaucuguugguggccuuuuugucuuauugaaggugucuuuugccuugcagaagcuuugcaauuuuaugagguuccauuuguugauugucuuucuuacagcauaagccauuacuguuuuauucagaaauuuuuccccuguacccaucucuucgaggcuuuucccuacuuucuccucuauaagguucagugucucuggcuauauguggaguuccuuaauccacuuagauuuguccuuaguacaaggagauaagaauggaucaauucgcauucuucuauaugauaaccaccaguugugccagcaccauuuguugaaaaugcugucuuuuuuccacuggaugguuuuugcucccuugucaaagaucaagugaccauagguguguggguucauuucugggucuucaauuguauuccauugguuuacuugucugucgcuauaccaguaccaugcaguuuuuaucacaauugcucuguaguacagcuuuaggucaggcauggugauuccaccagagguuccuuuauucuugagaagaguuuuugcuauucuagguuuuuuguuauuccagaugaauuuggagauugcccuuuccaauucguugaagaauugaguuggaauuuugauggggauugcauugaaucuguagauugcuuuuggcaagauagccauuuuuacuauauuaauccuggcaauccaugagcaggggagaucuuuccaucuucugagaucuucuuuuauuucuuucuuuagaguuuugaaguucuuaucauacagaucuuucacuuccuuaguuagagccacgccaagguauuuuauauuauuugugacuugagaaggguguuguuucccuaauuucuuccucagccuguuuauccuuuguguagagaaaggucauugacuuguuugaguuaauuuuauauccagcuacuucauugaagcuguuuaucaggcuuaggaguucucugguggaauuuuuagggucacuuacauauacuaucauaucaucugcaaaaagugauauuuugacuucugccuuuccaauuuguauccccuugaucuccuuuuguugucgaauugcucuggcuaggacuucaaguacaauguugaauagguagggagaaagugggcagccuuguccagucccugauuuuagugggauugcuuccagcuucccaccauuuacuuugguguugguuacugguuugcuguagauuguuuuuaucauguucagguaugggccuugaauuccugaucuuuccaagacuuuuaucaugaauggguguuggcuuuugucaaaugcuuucucagcaucuaacgagaugaucaugugguuuuugucuuugaguuuguuuauauacuggauuacguugauggauuucuguauauugaaccaucccugcaucccuggaaugaauccuacuuggucaggagggaugauuguuuugauguguucuuggauucgguuaucgagaauuuuauugaguauuuuugcaucgauauucauaagggaaauugguaugaauuucucuaucuuuguugggucuuucugugguuuagguaucagaguaauuguagcuucauagaaugcuuuggguagaguacauucugcuucuguuuuguggaauaguuagaucuucuuugaaggucugauagaacucugcccuaaacccaucugguccugggcuuuuuuuuuuugguugggagacuauuaaugacugcuucuauuucuuuaggggauagaagaccguuuagaucauuaaccugauccugauuuaacuuugguaccugguaucugucuagaaacauguccauuucauccagguucuccaguuuuguugauuauaggcuuuuguagaaggaucugauggaguuuuggauuucuucaggaucuguuguuaugucucccuuuucauuucugauucuguuaauuaggaugcugucccugugcccucuagugagucuggcuaaggguuuaucuaucuuguugauuuucucaaauaaccagcuccucauuugguugauucuuugaauaguucuucuuguuuccacuugguugauuucgccccugaguuugauuauuuccugccgucuacuccucuugggugaauuugcuuccuuuuguucuagagcuuuuagguguguugucaagcugcuaaugugugcucucucuaguuucuuuuuggaggcacucagagcuaugaguuuuccucuuagaaaugcuuuccuugugucccauaaguuuggguauguugugacuucauuuucauuaaacucuuaaaaagucuuuaauuuccuucuuuauuccuuccuugaccaagguaucauugagaagaguguuguucaguuuccacaugaauguuggcuuucuauuauuuauguuguuauugaagaucagccuuaguccauggugaucugguaggaugcaugggaccauuucaauauuuuuuuaucucuugaggcuuguuuuaugaccaauuauguggucaguuuuggagaagguaccaugagguguugagaagaaggcauauccuuuuguuuuaggauaaaauauucuguagauaucuguuagauccauuuguuucauaacuucuguuaguuucacugugucccuguuuaguuucuguuuccaugaucuguccauuggugaaagugguguguugaagucucccacuauuauugugugagaugcaaugugugcuuugagcuuuacuaaaguuucuuuaaugaaugugacugcccuuguauucggagcauaauauucagaauugacaguuucucuuggaagauuuuaccuuugaugaguaugaagugccgcuccuugucuuuuuugaugacuuuggguuggaagucgauuuuauuagauacuagaauggccacuccagcuuguuucuucagaccauuugcuuggaaaauuguuuuccagccuuucauucugaguuagugucuaucuuuuucucugagaugaguuuccuguaggcacaaaauguuggguccuguuuguguagccaguuuguuagucuauaucuuuuuauuggggaauugaguccauugauauuaagagauauuaaggaaaaguaauugugcuucccguuauuuuuguuguuaaaguuggcauucuguucuuguggcugucuucuuuuagguuuguugagggauuaucuucuugcuuuuucuagggcgugguuucuguccuuguauugguuuuuaucuguuauuauccuuugaagggcuggauucguggaaagauaaugugugaauuugguuuugucaugaaauacuuugguuucuccaucuaugguaauugaaaguuuggcuggguauaguagccugggcuggaauuuguguucucuuagugucuguauaacaucuguccaggcucuuuuggcuuucauagucucuggugaaaauucugguguaauucugauaggccugccuuuauauguuacuugaccuuuuucccuuacugcuuuuaauauucuaucuuuauuuagugcauuuguuguucugaugauuauguguugggaggaauuucuuuucugguccagucuauuuggaguucuguaggcuucuuguauguucaugggcaucucuuucuuuagauuugggaacuuuucuucaauaauuuuguugaauauauuuguuggcccuuugaguugaaaaucuucauucuuaucuacuccuauuauccauaggcuuggucuucucauuguguccuggauauccuggauguuuugaguuaggaucuuuuugcauuuuccauuuucuuugauuguugugccgauguucucuauggaaucuucugcaccugagauucucucuucccaucuccuguauucuguugcugaugcuggcaucuaugguuccagauuccuuuccuaggguuucuaucuccagcauugccucacuuuggguuuucuuuauugugucuacuucccuuuuuaggucuuggaugguuuuauucaauuucaucaccuguuuggucguguuuuccugcaauucuuuaagggauuuuugugcuuccucuuuaaggucuucuaccuguuuagcaguguucuguauuucuuuaagugaguuauuaaauuccuucuugauguccucuaccaucaucaugagauaugcuuuuaaaucugggucuaucuuuucggguguguuggggugcccuggacugggcgaggugggagugcuggguucugaugaugguggguggucuuuguuucuguuaguaagauucuuauguuuaccuuucgccaucugguaaucucuggaguuaguuguuauaguugucucugguuagagauuguuccucuagugauucuguuagccucuaucagcagaccugggagacuagcucucuccucugaguuucaguggucagagcacucucugcaggcaagcuuuccucuuacagggaagaugcacagauaucuggcguucguaccucccgccuggcugaagaugaaggcccaaaacaggaccugucccagaagcuguguugcuucagccugucacagaugcuguuagcuucuguaguccacacacucucaccugcacagacuagugucggagggauccgggaaccaagauggcuccccaaggugcuccugcaaagcccucucggguagggcggacaucucuccucuggccgggaaugugcucagaugucuggagcccaaaaggggggcugcuucagaagcucuguggcuccugccugucccagaagcuguuagcuucuguaguccacacucucaccuugcagacuacucucggcagaguccuggaacccgacuuuuaauuucuuaauuucuuuccugacccauguuuucuucaguaauaaguuguucauuuuccaugaguuuguaagcuuucuguuauuguuuaaucaauagugguagauagaauucaagguguuauuugaauuuucuguguuuuuugagacuugcuuuuugucgaaguaugugguuaauuuugcagaaagguugauggggugcugagaagaucuagucucuuguguuugggugauagcuucuauaaauaucuguugggucauuugguuuauaauuucaguuaaugacagcauuucucuguuuaguuugucuggcugaccugucuauuggugagagugcgguauuauaguaucccauuauuauuaaugcuagacuacauuaacauaugugauuuaaacagaaauauuguuucuuuuacaaacuugagugcuuucuguucagugcauguauguugguguuuugauuguuguuuuuuuguuuuguuuuguuuuguuuuguuuuugauaaucauguguugaccuucuuuaucauuucuaauuaguuuugguuuaaacucuauauuuugucagauauuuaaauggcuauacaagcuugcucaagcaauuccauuuguuuagaaauggaauauuuuuucuauccuuuugcccggagaugauguuauucuugguguaaauguuuguuucuuggaugcagcagguuuucugaauccauucuguuggucuguguccuuuuacugggcaauagagaccauugauguugagagauaucagugagcaguguuuuuugauuucucuuacuuuguugugcugguguaucuuucucaucuuuucauuugcuaaucuaggauuauuuauuacuuguguuuucuuggguaugguuaaccuuuuuuaaucuguaguuuucauucuaguucagugguucucaacuugugacccuuucauaggggguugccuaagacaauuagaaauaucagauguuuacauuaugauucauaacaguaacaaaauuauuguuaugaaguaauaaaauuuuguggugggagucaucacaacaugggaaacuguaugaaagggucacagcauuaggaaggaugagaaucacuguucuaguaacguuuauaggguagauuuguauauagauauagcuuaaauuugauuuuaucaugaaaugucucuuuuccgucuaugguguuagaaauuuuucuuggauauacuagucuaggcuggauccguggucucagagucugugguacaucuguccagucuauucuaguuccuaaagucucgauugagaagccacauguuauucuaguaagucuaccuuuuuauguuucuuggucuuuuucucuuaacaccuuuuaauauucuuucuuuguccuguauguuuaauguuuugauuauuaugugcugagggaacuuucucuuuuaguccaguguaauugguguucugauugcuuccuguaccuuguuaggcaucucauucuuuagauuggggaaacuuuuuuuuuuuuuuuuuuugguuuuucgagacaggguuucucuguguagcccuggcuguccuggaucucacucuguagaccaggcuggccucgaacucagaaauccgccugccucugccucccgagugcugggauuaaaggcaugcgccaccaggcccgguuuggggaaacuuucuuuuaucauuuuguugaaaauauuuccuugccuuugacuuagguuucuucuccuuccucuguucuuguuccuagauauggucuuuucuuggugucccugauuuccaagaugauucauauaggaacauuuuuagcuuugccauuuucuuugacagagguaucuguuuuuacaaucauaucuucaaugucugcuguucugucuucccucucuuguauucuguuugugaaacucuccuccaaguuuucuuuucuagucccuaaucuuuuaacuuacagaugucccucaguuuggguuuucuuuauugagucuauuuguacucugaggucuugaauuguuuaauuauuugauuuccauuuaugaauuguguuuucauagauuuauuuaaaaggauuucuucauuuccucaauaauggcuucuaucauaguaauaaaggcuauuguaauggccuuuucuugugcuucaccuguguugcaugacucagguucugcuauaguggguuucuaggcuuuagugcacacauacuguccugacugguaugguguuuuuguauaauauggcagauagacauugaguuugggaaaauuacaauucuaggugcugauaucuagucuugucuuuguugggcgugcuuugcuuuuucuugcuuucuuugguacuuaggaaaguguggugguuguguguugccugguaggaaguucuucagggguccugauagauguugccacucagaguucuagguuaaauguguuucuagguaucaggaccugacacuuaggaguguugaaggaucccacaagaaggaggaaagcagguguuccacuagaucugcuuaguccccugggaauggggucuaagagugaggagaggcuauagcaggugaucugcugcagagcuagggaugagccuagggauuggaguuggaggaaucaaggagagguaaagagcugcuuguuagucuaccuguuucacuggcuagagugaccuucaaacuuccagggcauaccugauggaauugugcauugggaucaagcagugaauggauaaaaguaaguuuggagauacacagcugcaugguggagacagggaggcuacagcagguggucugguacagaucuagggaugagauuaggugauuggauuuggaggagaggaaagguagguaagguucugaaguuagccuaccuguuucacuggccagagagccuuacuuacucuuuuaaaaaauuacaaugaauucucuccugcuugcuuucuguuuucuuuuuagcuuguuccuuuuuuaucagaguuucaguauauaguucaagcuggccuggaacucaugacccugguaacucugguuccuuguugcugguauuauuaccauuugaauuaccaccaccacagaugauguuuacacacacacacacacacacacacuuuaugagguuuucaguuuccugacaguuuucuuaauguaugacauauauuuuguauuagugugauguguuauuuucucauuaguugcuucaaaaaaacuucaccccaaaguguguauuaugcaaaaaaaaaaaaaaaaaaaaaccaaucacauuagauaauuucaguauaauuaguuauagucucgaugagcagacacacuuccauuuccaagugaucuacuguaaggaguauuuucuuaaggaaaagaucauuauuguuucucuccuugcuacaguuuagcuucucggaaaaugcuuuagagucaggcuauuuuguauacagaaaaauaaaaugcucuuguuuucuucuuuuuuuuucagauuuggaaucagauuaugaagcucaacaaauaucuccagacaaccacauauauacuauaaauuuacccaaacagaccauaaagcauauaagugaaacuuuugaacucaagggcuccaguuuuaguaauggccacagcuauaguacauucacgggacuacaggguugucaaggagauguugaucaaaagauuaguaacaaggaaaaaaugcucacuuauaccugccacacucuaacucacaauacagacaaugaauaugaauguaaagaguaugggaaguacuuugguuguaggucaacucuuauacagcaucauaguguucacacuggagagaagcccuaugaauguaaggauugugggaaggccuucagauuacaacagcaucuuacaagacaucagaaagcucacaguggugagagaccuuuugaauguaaugaaugugguaaauuuuucaagcauggcuccagccuuguucaacauaagauuauucaugcuggugugaaaccauaugaauguaaugaaugugggaaagccuuuaaucggcgcucaaacuucaugcgacaucagaaaguucauuaugacaagaaacccuuucaguguaaagaauguggcagugccuucacuguucuagcacagcucaucacucagccucagaacauucauaauggaaagaaaucauuugaguguaaacaguguggaaagauauucaguaaugguuccuaccauauccaacaccagaguauucauuccagugagaaagccuuugggugucauguaugugggaaggcuuuuaggcuucagguauaccuuucugagcaucagaaaacucacacugaugagaagccuuucaaguguaaucugugugggucagucuucagacguaaguaccaccuuacugaacaucagagaauccauacugaugugaaacuauaucagugcaaggaaugcgggaaauuauuucgucgacgcucaaauuuuauggaacaucagaguauucacacuaaugugaaaccuuuuaagugugagcugugugggucagccuucagacuucaaucacuacuuagucaacaucagagaauucauacugaugagaaaccauaccagugcaaggaaugugggaaauucuuucgucgaaggucaaauuuuacugagcaucugaguauucacacuaacgugaaaccuuucaagugugagcugugugggucagccuucagacuucagucccuacuuaaucaacaucagagaauucauacuggugaaaaaccauaccagugcaaggaaugugggaaauucuuucguagaaguucaaauuuuacugaacaucggaguauucacacuaaugugaaaccuuucaagugugagcugugugggucagccuucagacuucaguccuuacuuagucaacaucagagaauucauacuggugaaaaaccauaccaaugcaaggaaugugggaaauucuuucgucgaagaucaaauuuuacugagcaucugaguauucauacuaauguaaaaccuuucaagugugagcugugugggucagacuucagacuucagucccuacuuaaucaacaucagagaauucauacuggugaaaaaccguaucagugcaaggaaugugggaaauucuuucguagaaguucaaauuuuacugagcaccugaguauucacacuggaaagaaacccuucgauuguaauaaauguggaaaagucuuuagacuuaauauacaucuuauucgccaccagagauuucauaauggugagaagguaaagaguguggagaggccuuucaucuuaagagccauaaaauaauuuauucaggucagaaauguuugaaugcaaggaaugugggaaguccuucaagcuuguuuucacucuuguuuggcauaggguuauucaugcugcugugaaacaauaugaauguaaugagugugggaaaaccuuuaauuguucaaaucucaugcaacaucagaaaauugacucugaugagagacucauuuaguguaaggacugugaaaaggccuucacuguucuggcucagcuuacuaggcaccagaacauucaugcuggaaagaaguccuuugaaugugaguagugcuggucagccuucagacuuagugccaacuuauucaaucucagagaauucauacugaugugcaucccuaucauugcaaggaauguggaaaagcuuuguuagugguccaagucuuagaauucaugagagaacucacaguugugauucacacucaugagagaccuuaucaguguuaagaauguauaaaggccuuuagucaaaaaugaagcugguugggcucuagaguucauauuaguagaagccuuaugaauauaaagaaugugaaaaggccuuuagcaauaauucuaagcuaccuguauauuagaaaacuuauacuggugagaaacccuaugaauauaagaaguaugggaaaacauuuagaauuaguucauccucccaugcacauuggagaauucauaccaguguaaaaccuugucacuguaaagaauguggaaauaacuucaauuggagaucaagucuucuucaacauaaaagaauccaugcuggugugaaaccuuuugaauacaaggaauguagaaacauaacagaaauagcaaagcucuuaaagcucuucagagaggacagguagaucugaaacccuauaaaugcaaaggcugugaaagcccuuauugucaaugaugagcuuacacaauaucagaaaauccaugaucaucaggaguccugugcauguaaggaauguggacaagccuuuguaugaaaauuucacugaagaucagagcacucauauucuuaagucuaugacugaaaagauugugggaagaacuuuaggaugccuuuugguuuggucaacgucauaguauucauauauuccuagugggacaaacccuuugaaaaugugaaugugggaagucuauucagaggaaguacucuguugagaaugucuuuaaaugucauaaauacaggggagccagcauuauuuugauuuacucucuuguuaguuguauaaucuuaauuuaucaaucauuagucagccaggacagucaacuuagggagggcaguuauuggaacuagguuuaccugcgaugacuucauugucaccauucacaucccacugcucuugugauauuagacuggauguuuacuuuguuuuuguauaauuuguuaauggcuagcacagcaccagccaaagcuguaacaacagaguuauaauagauaauaaaauccuugcgaguauuuggucaguacucauguucuguaaaguggccucuacaguguucuugcuuucaucaacauuacugcaacucuuaugaaaagauaauuguacuuuagaugguuuaggaaagccacgugcauucauucauuguuaaauuuuaaauaacuucauucuggguacaucuaauaaaugaaggaacauuaaaggauuugaauugugaguccauuaaauauuuguguagagauuuuaaaaauacagucauugaugaauaaguacuuucuaagggguuaaaccauuuuuaaaaauuaaaacugauuauuuuugcccucugcccacaucugaagauaaacuacacauuugugauaagacaaggaagucuacaggauccuccaucucuuagucuugcugaggucauuucagguuuggcuagaauuuccuugauggagaaucucauggaauauuacccaacucuguucuaggauauggaggucaaaaugucucugauaauuuauccuggcauauguuaaauggccuguguccagcuaccugcuuaucuuggcuucuuuuaaacuuccugcuuggacaaaagcucccccugcagcuguugagcaagguaauagaauguggguuuugcucuaaaugcuuggagguauacuugggucccaaauaacugaauguacucagagcuggcuggaguuauuuuucaguuggccauauacugucugagugguguucucauaacaaccaaaauagccaaauugaaacuacuuagaaaaauacauguaugaaguuuucuaugcuuaugggaaacuugaaauagucaagaacucaccucuguaucauuacuuagauuuaaaguuguuaacaauuucuaugcugauuguauuucucuuuauauauaggguauuugggguuugucuuaggguuucauugcugugaagaaaugccaugacugaggcaacucuuaaacagaaaaauuggagcuggcuuauaguuucagagauucagucuauuaucaucauagugcaaacauggcagucuccagacaaauaugguacugaaaggagguuucuacaucauaaucugaaggcagccaggaggaggaucuccuuugcccugggcagagcuuaagcauaggaccucauagaccacagucacuugcuuuguccaacaaggccacaccuaauagugccaauucccaugggccaagcauauucuaaccacaggacuguacauucagaaaguuuuaagaguuuguauaguagugcaugccuugauuacaguaauuggaaauuugaggcaggagaaucaagaguuguauguaguauagguauacagugacuucauguccagcuuuuguuuacuagagacccuuucuuaaaaaaaaauagacauagcauuuugcccuuuccuacaucagccaagauggaauguccucuauaucacagagucauaauuuuccuugaggaaaugaugcaaauuuuuacaacguucaaaaauuuguuauuggucuccaaacuguccuguguucaaauguauauauccuaagaagaauccaauauagauaaauggccuuuauccgaccauuauuuaaugguguuuuaucugagagacuugugcauuguaggagugcucugucacccagcuacauucccagucccuggccauuguauccucuauccaaaggaaauuagguucagaugaaacauuuuuaauaagacauuguagguuguaugucuuguucacuccagagacccaagagccaaagcuuagcagaagacagcacaaucuuucacaggaagaggcuuuuccuugcgagguguaccacuuacacuuugggcagcaggacacuugguuucaagucaacuccccaauggagccagaauccauagaaauuuguccuuauaauccucaucacugaaucccacccagcagauucuaguaccaccuggcgucaugcaggaagaagaaccccagaaagccaaaaagauggccagcuguaaauacaacaccugccacguggcucccaucagaaagcuggcugaacaugaagcuaccugugucaacaggagcuccguggaggaagaggacacauuagguccucugcaagucagccucccacugccgcagaacgaggacacgcuacaggucuguuggcuuuccaaccuugacauuuggaauguugacggcaccaacugccacccaaaguucuucagaguuuuguucuccaaaaacuuguuugugaaagugacacccaagagucacggggaggagaccaaugcccagaagauacucagacuaggaccaggaaggcaaacuucuagcaggaggaagagggcucucgaaugcauggauggauugugcaucucaucugaauaaaaaccugcaaaguuaaaaaaauaaaaguaugguuucauaggaaccaauugcaaacucuuaaugauuuucaaaaauuaauggaagauauuaacuggcugaggucuacaauuggguuaaguacuuaugaguuaaguaauuuguuucaaaugauacaaggaaaauuuaaacaguccaaaaugucugucagcuaaaguauaaagaguugacucuucuagaacaaagacuacaagaggcauauguggaucauguugauucuaaaugugauuguauucuguucauuuuaccuucaacucguuccccuacuguauucauugugcaaagggaagauaguauuauggaauggauuuucuuagaucaugaacaaagugaaaaauugaugucauauauugaaaagauuuuuuaauuaauugaacuuacaaaggaauuucauagcagaguugucuuguucuuagaaaaacaaaaaucacuaaaacugugaucaucuccuugcuggggguaaggggacccuugaucaccuccuccucuuccuccuccagcugccuucauuuuguuucuucuguuccacuccuccauucuuucuccuugcugauacugguacaguaauggagaugagucuguggacaacugaggggcaaugaagcccuuuguguuugcuuuuauccuuacacuccuguugccgccuggugaucauuauaugcaacagaagauuuccagguuucuaguagaaaaaucucauguguugaucuguuacccugagguccauauggagagugaacuaggaguuucuggggaaggagucugggaaaauaaacuaguggaggagcuuugcaaaauggcuuggucacguggaacuucagcaugagggauuccaauucggcuugaucug

SEQ ID NO: 3651 - RNA, 8728 nt, Mus musculus
ccaagaugcucuaugugaaggacuuccguuggcgucagcggaagccgugacuggccgggcugcacugaggccggcuuggucacuauggaggagauaggcauuuugguggaaaagauucaggugcaguggggaucuggguuucuuagcgggagcuggacaugaguggggugcugagggguucucaggaucccagcucugggcugggugguuucagaggccucggugucgagcuuuggguggucccggggccuggcgggguagucauguugucaggagggcggcaaagcucagaaaagcagagcgggaggaaaguggcguugaacuuaaagacuuuucagacagaacgguugcgaggccuggagagcugugcuuacuagcuuuucgguuuggggucuggaccagguggaggaugauguaugggggccccguggccuagguauguucguggccaagggaccaguggacucacugugcuugggacgugaacggugaggcguuaaguauugguugugguuuggcugagugaccuuuggcuuuaacgugaguugggaaucugacaugaaagcuuuugggggggggaggggaagaacuggguaaugagacucugaaugugacucugacuuuaaaauccaugggacuuuuagaaccucuugaggggacugggaugcuaagguucgguauggagcugcugcaaaacuuucaugaugaguuuuguuuaaggggccuacuauuagcaaucuacauaggggacugagcagcuccuguaucuauugagagauagugaaugaugucagguacuggagacauaggugacuugguggcgaaauaggaagaacgcuuucgcugauuucacgagaugauucucugcuuccaacaccaaguugucuuuaccgucuacaggaugagauuccagcacuguccgugucucggccgcagaccggccuguccuuucugggacccgaaccugaagaccuggaggaccuguacagccgcuacaagguguguucaacccuaagcuggcuccugcauaccucccaucccccaucacauacgcccccccccccaccucccacugugguacggcaaggcugcagccaacccuuugcccucccugugcgugcagaagcugcagcaggagcuggaguuccuggaagugcaggaggaguauaucaaggacgagcagaagaaccugaagaaggaauuccuccacgcccaggaggaggugaagcggauccagagcauccccuuggucaucggucaguucuuggaagcuguggaucagaacacagccaucgugggcuccaccacaggugaguggugaggcaggcugggagcaaggcagggugauagaauggccagaguacugaccgauccagaaguggauacauacuuuauuuucugaaugucucuuucugccucucaauucacgugugugcguguaguuucaccauccaagugugaugguguacgccuuuaaccucagcacuugaggaggcggagggacaagaggaucuuuguguguuugaggucagccuggucuaccuaguauguuucccggaguacauacagaaacccugucuccaaacaagaagaaauuuaccauguggguuggaguaccuuugauguuugugguucuagucuguuugaguugaacaaacugguggucacuucccucgccugaguuaacgccacaacugcugcuggauauggagcugcugucuggaagcaucgguuguguguaaagacguuuggcucuguugaggacucagcauacaacagaugcuagugacauaaauccauacccugcucuuacaguagcugacgauucuggugucuuaccugucuuuuccugcugcucgacugagccguguguuuauaaaggcucuagauaaagucguguaaccaugugggauuggacaggugggcuuugaggaagugaagggagaguaauauccaagaugaaggcugugucuuugaaagugagacuuaagacgguggggcucccugagauaguggugugauuggagggguggauuuggaggcagacaguggggagcugaggcuguggaagaugucuggguggccgcugcacucacaagucuugcuguagagaguagauuggagaaaggagauggaggcugcugaccaggaauuuauauggagacuuaggcaggggauaguuccaaaugagggcaggguuugguggugggcuaggugagagcagagggaggugggguagagagagugagugacugagggggccagaacgaggcuuaguccucuggcuggcaacucggggacagcacaguugaguggagaacaccaggacugugcugggaacacauugaaagauucccagggccauccaggagaccacaugugagaugcacagagcuggaccucaagaaggaagcagggcugaagaccagcagggaagucauuaggaugagcaugggggcuaagaggggaugaccuagggccagacgugggaaacguggaaagugccagcuguguguagagggaaacggggaaggagugacgucaagucucuggcauuucacuucgucuuccuuccugucugcucccaaaggcucuaacuauuaugugcgcauccugaguaccaucgaccgggagcugcucaagcccaacgccucgguggcccugcacaagcacagcaaugcccugguggacgugcugccucccgaggccgacagcagcaucaugaugcucaccucaggugaggggggcacccggggcccugggagucccacggggacccugggggcugagccgcaagcccuagcuccacucucccaccagaccagaagccagaugugauguaugccgauaucggaggcauggacauccagaagcaggaggugagggaggcuguggaacucccgcuuacacacuucgagcuguacaagcaggugaggaggacgaggcggcagggcagggagaggucucugggccuaggguuggugacauaaucccuuggcucauccuuuucccgucucuuuuagauuggcaucgauccuccccgagguguccucauguauggcccuccuggcuguggaaagacaauguuagcaaaggcuguggcacaucacacgacaggugagccucucacggccucccccaugcucuuccugccuuguuuccugcuuccuuggguuccguaaggaaugacauaaggguagugucuguaaauagaggcucugggaccauagcccagguggcaguccuuuacaggauaugcaguccccggcaggugauuacgccucacugugcccuggguuucucaaaaguggaaacuaaggagccagguguggucucauauaccuagaaucccagugcccaggagauagaaguaggugaguugcugugaguucaaggccagccuggucuguaugggcaguucuuggcuggccaaugcuagauagugagacccugucuuaggugaaauaaaauuuaaaaagcccaucuggacauucuggcaaauauucuuuuugggggauucgggggugggguucgagacaggguuucucuguuuagcucuggcuguccuggaacucacucuguagaccagguuggccuuaaacucagaaauccgccugccucugccucccaagugcugggauuaaaggugugcgccaccacugcccggcuucuggcaaauauucuuaaucuuaacucaggagacuguggcauuaagauaaacauuuaagguuauucuggguuaccuagugagacccuucuccagacaagcaaaaaccaagccaauaaacaaacaucccacccugauuccauaggaugaugacgaguuagaaaagcgaugcaguguuucuaugguggguucagacuuggugacuaucaccuggcuugcugggcagaagccacaggggcgagugguuagagguaaggucagggcgagagugguccauagagagaguacucuagggagucgggguggacggugagcaagcauguccuggcugugcugucaauccugcauagacuucucaggaagggguuuccagaagcuggggguaaggagcugucaggcacagagauugggagugggaauuuaggucaggaaauacacuugugcagaggcccagcggcugagaggaacucaugugcagacucauggguaggcugcagaugccgcuagagcaaacucauacuugugguuuuguccuggugaguggcugugcaagcuacguuuggcagcacaaagggaugagucuggaaagaugguaaggugcccgauuagaaauagacuaaaauaguuuuagucuaaaagaaaccugaaagccaaucagaaaacgugguuuggggacccccccgauauuugccucaugcugugugcuuagggauggaugacuaagggucuggugucgcugagauuugccagugaacugggugugguuggcaggaggugggcauugaagagcaguugucaguuccugguuugggcccuggcguccuuguuggcuucaugggguagagggaugaacugaggaacgugaacaguggcugcacucugggacacacugagaucucacgaccagggaacacucagccagaaacaugaaacaccgaggcacuguccuuugaugugagcucugagugagauucagaagucaacaguguguguccucuucaguucaucuuuauguauaagccaggguuuuaaaaagugaaauaagaaugguaauagcagugguaaaugugggucacagugcuagcuagacaucuguaacguucugcucuucuugggaagucgcacccgccuuucagaaguuggcauuggaccacauuugcugagugucugcccugugccaugugucaccggcucuaguucugagacacugcaacaagcaaauguccauuccuggggccugcguccucgaggacaaauagggguggggagauaucugcaaagggaagauuuuacuguuacagcugccuuagggagggagcuaguugccuggaaaaguuggugauccaagcaggaagagaggcgguagaugggagauguggagaggugggagauggagcuuagacgggagggugagggacgguaccgcccugacaaggaggacggagccgagcagucaccugagggcucagaggucucugugguggcaacuuaggcuuaggugacguugaaaaggcagauggagggggcagcguccauggaugauuuaaacaccgccuguggaaaugcaagacuguuguaugggagacugcaggcugguuccugggcuguguuaaagaccuagggcagcugaggagaauuuggcaucaucucuucuguccucuggccuuucuccauaacggcuagcccugggguggcauuccuguggugaugcacugaaucccgucuaugcuguuuaauaggaguagcuuugguauugcugccugcugcagcccugugaaaaagaaaugugucacauaagaaagcaggcuuacaacuuguucaaggucaccagcugaccagcuguagugcuaggauuugaugccaagaccucugacccccaaacugcuggcccuugaugcuccacugauuuccuugagcucagugagacgcggggauguguaagccauacacuugguacagaggguacauuucuugcugacuauugaaaaaaguaauaauaaagucauaaagcucuguguuacaucugggauucaggaaaucugccauguuacuucauguccucuagagucacagagcaguuagaaaggcaggacguugacauugcuaaggugcucugagcuggagaauagacaguuuugaaauucacuagcgguucauuagcguccuuguucugcccagguuucaguccagcaggugaguguggccaagagcagacagaaagugaggggcucuucuauucugcgugaaucuggaaaaggcuuuuucaguggaagaggggccagggguagagcaaugggaaagucccugaguugucuccuugaagaaggaaaguccugguggagacgggauucugucuccuugacucgauggccacugagagugagugacuaagcaggggaguguucaugguggaggaauggcagacacugaccagucuaaaagagagacaggaggcugggagggugaggaaggacaggaaugaggugagugagugaaggccacucuagagauggguuuccugugggcagggggaauguggugagaugugucuaggacagagucagcagucgugagcuuacggugugugggagcccugaggugaugcagggaagugggugggugaguacgucuucauaccuucagccaguugcgaaguggccugagggguuguugggccacagccugcagccuugcucagauccuacuuggccuguguguacgaguuaugucuccuugcucugguggcaggaaggagucccaggaguauauuacacauggcaugcagcuggucaccuauuagggaacaagugcagucagggcccagagcaaaccugguucagccuggcugccagcucucaguuaugugagaagagagccuuagagccuuugguucuuccaaggcuggggaagugguucagagcugggcaaauguguuuaaucccagcccugcagagcuugcaacaggagaauuacaaauucaaggccagccuggcuacauacauaaccccaggcaaggcugagcuguguaucaagguccuuucucaaacaaacaaacaaacaaacaaacaaacaagcaaguauggcucaaagagcaaacaugaauuuaagauuaucuguuggucagguaaucuuagucucuggacauuucuguuuuguuaacugauucugcauguguucuagaaaugugugcuuuuaauuuuuguuuuguauuuaauauucugauucuuuuaaaaagcccaccccccacauguaccuguaggguuugauuggggcuuaucugucauugugaggcaugagcgguggcuggauguggggacccagcccugugccuuaggcagcuucuacggggaguuagccaagaaagggacauuuucaggaauucccagaggcagguaaagcacaaaggaccccagaggaggacaaccccccauucuaaaauccuugucauucugcccucagcugcauuuauccguguggugggcucggaguuuguucagaaguaccugggugagggcccccggaugguccgggauguguuccgccuagcuaaggagaaugcaccugccaucaucuucauagaugaaauugaugccauugccaccaagagauucgaugcccagacaggaggugaguagugcccaaauggccuggaucuugugcaggcuuguccaaggauguguucugaacugaccauguuucuuacucuuagcugacagggagguucagaggauccugcuggaacuacugaaucaaauggauggauuugaccagaacgucaaugugaagguuuagggcucaggauuggcaaggggugguauggccuaaggacuggagaaagacaggggauggcucauggaggccagaugucacgacaggaaaagaagauguaggaauggcagaagccuaagcugguuccucccugugccagguaaucauggccacaaacagagcagacaccuuggauccagcucuacugcggccaggacgccuggaccgaaaaauugaauucccacucccugaccgucgccagaagagguugauuuucuccaccaucaccagcaaaaugaaccucucugaggaggucgaccuggaagacuguauccuucuuuggaagugagaggggaacccagcaggaaaugaagguugggucuucaugaccaccaccauuuggggaggacagggaaagguccagggaaagggggugaugaccaggacagcguccauuucaagaauugaccccaucauaugaggacagguuucuuuaacucagcugcuauagauguggcccguccagauaagauuucaggagccgauaucaacuccaucugucaggaggugagugauagucucuuugaccugaguggggguguuugaagguauguccucuuuuccagucuccccuuguugccucccuagauucuugagucucauauuucucuuccuucacugucaugggguuuaggggguugggaggacgguacuuaacauacaguuuucauucccaucccuuccuagaguggaauguuggcuguccgugagaaccgcuacauuguccuggccaaggacuucgagaaagcauacaagaccgugaucaagaaagaugaacaggaacaugaauuuuacaagugaccuccuccccacacuuccccaggcaccugucccaaaggcuaguuuucucuuuacccaggauugguuuagucaauaaauggacgugauuggaucuauuuaauuucuucuuagguguuuaacuccuuuagggaauauggaccuugaauaggauccucugggucccuccuugucuccugacaagggauugcagccugggagaagagcaaagaauaugaaccaaauggcuucgaagauuuuagaaaaugaaccucagccaaagccguggccacugacugaagccccucugucauuucuacaagaagaucauuuggguuuucaguagcuucugcuccugauaugcacaagggccaggggcagagguaaccccucaggcucuuguacacagcagugucagaaagcacagguguauuugguugccaaggaaacaguuaa

SEQ ID NO: 3652 - RNA, 6595 nt, Mus musculus
auaaccaaaaagacucuucauuuuucuuaugaugcauuuccugggaauccauggggacuugauuuuguacuucuugggggggggaaggggggcggcagcggcaagaugaugugaaggggaacagagacuuuaggagaugaagucaagagaaguuagguuuauuaacagcaaagauugagggguagugacaaaagcucacaaaacagacaacuagaaaagugcuucccugcccuaaaaauggugucugugcugaucucauuagaaagccuugaggcucaaucacugucacugucagccucacuggaaucagaggcugcugcuucacugccaucuuccugagcugagugcucacugccacuggggaaggggcuggcacuccggcuacgacuccugcucuggcugcggcuccucuggccaccaccaucacugccgcuguccgagucauugucacugccccugugggccugcccucuguccucaucaucagagucagcaucaucuucugaaucagcaucacuaccaaaaaucuccucuuugucccgggcagcacgugcuucauccucacugcuuucauccucaccgcugccacucuugucacuugccucaucucugucacccucuucucggucacucucacuuccagaguguucauccucgcugccuucuuucucacugcugcuacccuucuccuguuccucaucugugaggaaguaggggacuggugagaucccaaugcccacccucccagggcucccaggaugugacuaauccuuuaccugagcccccagcuucuuucucuucagccuccaucucuuccuccuccucuuccucugguucgugguuuuccaacugggccuuucgugccuccugaaaccagcaaauugggaagaagaugaaagaaaucuaucagaccucugaugccauccuuacccacuagacucccuuugggcauccugggccaguacagcuuaccugggcuucuaauuccuucucauucaugucacgguguuugacgacaagcaaggcauugguaccugacugaaccccagccuuggcccggcgcuuacuuagacggacccugcaguggacaauugcagaaggggaguugggcuccacuaggaccagucuaacaucugguucccuaucaauauuugacccagaacauaacagaggacaaaguauacauacaguggaugugaaagaugguauuucggguuugacuuacccaacuuuuaaguuuucaggguuuuuuuuguuucaagauuuuaauugaaugggugguuugccuguauguguguuguguuguaguaccccaagaagccgcaagagagcaucagaaucucuugggaacugggauauaagcugaggucuucugaagagcagccaguguucaucacugcuaagucauuuuccaaggccucuuauccaaagcauaaaaccaagaaaauggcaaacguguguuucuggauuuuaaauagaagagcaguggacuugcagcuguauuguaguacucacuaaaggugaugccacugccuguuuucacaucuccagccagacaacaggaucagagccauauugaaccacuggcacuaggacaaguuagcuuucagcccucagagaaagguucugaggucacacaacaagggcacacuuuugaaguugugucaaguauuuaaaaccugcugaaggguauaggagaugguucuguugguaaagugucaugguggaacaggaaagaauaacucuugccccaaguuauccucuaacauccaagugcaugccaggucaugcauaugacuauauacauaugcauacaugcacacaaaauaaaagcaacaaaggaaaacugauugcaaccucuggcuccaguaugugcacgcaugaacauaaacaugucacauacaaaaagcuuauuaaaacuguugagacgggcugguaagauggcucaguggguaagagcacccgacugcucuuccgaagguccagaguucaaaucccagcaaccacaugguggcucacaaccauccgcaacaagaucugacucccucuucuggagugucugaggacagcuacaguguacuuacauauauuaauaaaauaaaucuuuuaaaaaaaaaaaaaaacuguugagacuaggaauguaucauacaggagggcacuugccuaucaugugugagaaaaaugacuagauuuauauccugcauuaugugaaaauuuucuuucugguuuauggcauuaagaccacagccagguccagccuacauuuauaagcaggcuccugcugcucucuuuuuuuuuuuuuuuuuuuuuuuuuagauuuauuuauuuauuuauuauauguaaguacgcuguagcuguccuagcauggucuuuaaaggggggagaggggggcgugguagugcauaccuuuaaucccagcacuugggaggcagaggcaggcggaucucugaguucgaagccagccuggucuacaaagugaguuccaggacagccagggcuacacaaagaaacccugucucaaaaaaaagggggggggggaccacaaagggccaaagucaugaaacagugccgaguaccuggucuccagcucauuguaguaaacuccgucacccucucugaagaugaagaaauaguucuccucauagcccuuacuggccuuguucuucacauuccaguuguauucccgagcaaucuuauagucauaccugggaagaagauacacagcccauugauucaugaggaggagacauacuucugaauucuaaaaccugacccugacccuaacccuaacccacuuacacaucaucuggugcauaguccaucucuuccucuuggucccgcuuucguuucuuuaguguuucuuccacaggcagaaaauaagccacaaacugguucccuuccucauccaucaugccccugguuugggggagaagaggguacaaaggucaaaagcaaagaaguaacaaagcuagguguggugacacaugccuauacauucaacauuccagagauugaggcaggaggaaugcaaggagccuagaggucagccaggacaacaggaucauaacccaucucaaaaauacucaaacaugggagaggcagcaaggagcacacaagguagaaagcaagaccacagaccugaucauggccugagacaucaucucuaaugcagcugcaccacuuguguccuugggggcugggucugagucaaaaaugaccugagcacauggguuuauccacaucugggaaauagaaagauacuaaaguuaguaaggacuggacaggcacaaguagcaacccccgccucuuucccugagucugaccuuaaaaucugggaagacaggcaugaccuccacuggugucacucggggcuugcuguaaugcugggagaucugauagaacaaaaagggugagaaagaggaagacccugagccacacucuugccucuauucuauuccccccaauuaccgauuucugggcaucuucaaaagucuuuucaauggcugugauuuggcugucccugucuuuguauauuucuuccucugugaacugcuguuucacagaaaccccaauccuagcagugaagaaaaugucauuaagggccucuggacauugcuaaagucuugcccccuucccaccuguuuguuacuuacuugacuucaggcuucucauuggagaugccauaucuguugaacucaguggagauauacucugucuuacgcauccacgguaccaccuuugcaugcugcugggaucugaagaggaaaaccaggcaccucagggucccaugcuugacaaaguccacccaguaccugugggacccaccucaccucuuagagcuggugggagccugaaucuccucuucuagaagcuucucaucagccggauccagaagaacuaggggguaaggggcaggaggaccaugagggauacccaggccuggccuuugcuggccuggaacagacccucccugucuccccacacaccauugggaucaaugcgguaggugucaggguugaugagaucaauggugacccccagaucuggcucagucaggaggucauguuugugcuguuucuccaaggagguugcuuuguacugaacaaaccuagaagggaaaacaugacuguuacaguuuuaugauccacccucacgccccaacaugcucccuuccuagaagcuaagcuucuauggagaggaacucugaaugcaagcguccagcauuggcaacuucugaguaagaaggguauugcauacugcuuucucuauuaguaguuacugagcaccuccuaugugccaguccgaggaagguugaggcaaugaaauaagcaguccuugccaucaaugaacuauuuuuuaguaguuuuuccauucuugaauucaguccuaccuguucuggucgaagggguaggugaugaacuuggggucaaaugggaugucaggaaggcuauugcaguacuugacucggcagacuacuccagaccuaagaaaacagaggcccagaacuaggucuugcagaccuauagaaauaacuucagcaguuaagagggaguauuuauucugcagaggacccaaguuugguuccuagcacccacaucaggcugcugacaaccaccuguaacaaggggaaccugacaccugugaccucuguaggcagcuacacaaacauguacauacuuacacaucuaauuaaaaauauaaauggcuuaaguugguggcacaggccuuuaaucccugcacuugggagacaggcaaaucacuugagaguuuaagcuagugaugguuuacauagugaguuccagaccagucagugauacaaagugaaacucuugucucaaaagaauuaauaguacccacacuuuaauaccagccuuggggaggcagaggcaguggaucucugaguuugaagccagucugcucuacagagugagcgagugaguuccaggacagccagagcuacacagagaaacucggucuugaaaaaagaaagaguaguaguaacaauuuuaaaaaacaggcucgaagagcuggugagauggcucagcgguuaagagcacugacugcucuucugaagguccugaguucaaaucccaacaaccaccugguggcucacaaccacccguaaugagaucugacgcccuuuucuguugugucugaagacagcuacaguguacuuauauauaauaauaaauaaaucuuuaaaaaaaaaaaaagcgcacugauugcggcuuccaaagguccugaguucaaaucccagcaaccacaucguugcucacaaccauccauaacaagaugugacccccucuucuggggugucugaaaacagcuacaguguacucacauauaauaaaucuuuaaaaaacaaacgggcuggagagauggcucagcaguuaagguccugaguucaaaucccagcaaccacaugguggcucacaaccaucugcaaugaaaucugaugcccucuucuggggugucugaagacugcuacaguguacuuacauacaaacaaacccugccucaagcugacaagauaccucagcaggugaaagugccugcuguccagccuaaggaaaugucuuuagacugccacucagagcuaagguguguacaauuuaaacacacacacacacacacacacacacacacacacacaacccuaggccugugcugcugggcacauaaggcugcaaucccggcacccaugagacuggggcacaaagaccagucugggccacuuuaugagauucuccaaagcacaaaaaaggcccccuaaccgccuccccuguucguguuccaccccuccuggaaaacggagcugggagcuuaccucucaggcaagguccggugggaauugggccugguuucggggagaagagagagagagagagagagagagagagagagagaugucaagaguuggccaugugaguggaaaggccggcccccgaauuucugaaggagugauggugaugauggugauaaagcaugaagccagaugcucaauccccugaggagagcaauccagaagcuucacugaaggagacugaggucugacucccucccgcaaggugcaauuccgaaauugaauagcaggggaccaggaagcgaccgcagagcccaggggggaccgccccuucaucgggggugagcgcugcgcgaccucgggggccgaccugagggaaucagugaugucgcaagcagccccccucggccuaguccccagcuugcagcucacaaaacaaaaugaagcggcaggugacaggagaccuaccuguggccaucuucccucugggccugggucuggauggugggcgccaucgcgaccaggcgacggcggcgcgguaggcguccucgcuggccgcaggcggacgcugaguggcguaccgacuuugagagacgccggauccaaggacaggcucccguagacgccgggcuccgcggggaaaggggaugaagugggccgacgagaagggcucgggugugacugaaguaagagcacagacagcgucggacacagacuugcagcucccgcuccgacugcuaccaagacgcagaagacuagacaggucgcuccuggccgcaaggccuucaggga

SEQ ID NO: 3653 - RNA, 2552 nt, Mus musculus
gaugucagagaagaaaauugaggguggguuuccagaaagugcuauagauuaccgacacggggcuugggagaaaaaucucuaaagaaugucuuaggaaguggucuucugagaaagguccugacagagggauuuuuaaauacaggguaggguaggcauuggggggcuuuaugagaaaucucaaguuuaaaaacaaacaaccccccccaaaaaaaaaccccaagcauauagggcugagggaagaagacuccuaaugaagaccugaaagcauuggaguagguuuuccacaaagaauucuggguguucagcuauacugaagaaagauuagguagguaugcaaggcuuucuaaagaugguucuagagaauugggggugggggagauucugaggaagagauagcuagaaaagucuuuuaauaagaaagucugagaaaaagaaagaacuaaaggccaucucaggguuacuaaguucugugaugcauggggguccugaaagcuguagcuuagagggguguuucaguauuguaaggaagagugucagaaaguuuaccaaaggcuagaaagggaguuucaaauuuucagguuauccaagaaaaguuugagaagaauagaggcuaugaggaaacuuuuuuggaguccguacacuauucuuaaaacaugugguguguguuacuggaaaggauuugggauacagaagacaggcuuuggaagagguuuugggaauaugagaggaacucuggagauuuucaagauuagaagguguagaggcugaggagaaaagggcugggguacaugagauuaccucuagagcauuccaagcuggggaauauuuguguaacaugaguuuggaaaucuauagaagggucuaagaaauaugagaagaggacagggcguauauaggagguggaagcaaagagaggagaggagaggguccucuaggugaguuuuggcaucuaagagcacuuccugaguaucugaggacgacuguucugggauaugcaagcucuuuaaggaugauguaguguucaccagggacauccugaagaauuuggggauaagagugaaaaucucuaagacuuuuggaauggggagagguagaaggguaaauucuuggggguauuugaagaagucugaaggagagaugacuugaauaugugaugcagaugggggggggguuagaugcagagaguaucugggggcgguuuaggggcuuuaagguucuuccugggggagaugccuggaauaucugugcugugaagacagaugacgaguagccaccaaggaauguguugcgauucaggaggaagaugugaggagagaaccaaggaccaaagggcggggauccacagggagcguccccagaggaggcaguugaaagcugaggguggucuccggggaggccgcuggagucgugcgggaggaccaggcagaugugugccgagucaggacagaaguccccgggcccggccccucggcuagccccagggcgugacgguuugggagggaaacugaggaaggggcccggguagggagaaacgggcugagugcggaacccuaagggguccuccaggauccuccggccucccgaggcccgagucagccgcccgccgcagcccgcggcgcggggucccugagggggcggggccggccgcgcggccugggucgcccugaggggagcgccgcgcgccucgaccgccgccgccccgcgcccgccggcccggccuugcccgagacucaccgccucggccuccgccgccgccgccgccacccgcaccuccucgggcagccgccgccacccgcgccgcugccgccgccgccgccgccgccgucgcccccucucuggcccgagagcuccccucccuccucccgcaccgaccaccgccgccgccgccgccgccgccgucgcgcugcgucaccgcgccgugcgucaccgccccuggccccgccccggagggccacugugcgccagcauuagcucacacccuauugacagacggugagcccagccaacuggcggcgagggcagaccgaagggugggaggugugcggcaagaaaggcggggucuuggccuggaggggagcgacagggcuggaaggaggccugagaggcccgcccccuccucacuacgauuggucugacgagaaggugacggacagacggacaggccccgggcggagagcagagggccgggaagaggaggggcgcgcgccgcguugccccgggcaacggucuggcgaagcccgcgauuggaccuacggacccgcagggggcagucucgcgccggucuaacucaguagcggcgaacccagucacaauuccucauucuggcguucaaggacccccuccucuccgccccucggucacaccccgcccaggguuuguguccgguaguaccaucgcccuuugggaugacaaugcugccuccuggcuccugguaucgaucggccgcgccucaagugacaccucaagaugagcgaggucgacccuuuaaggguggaaagagauaagaccccacacauaagaggcugucaauaaauggagauugcuuccaucac

SEQ ID NO: 3654 - RNA, 10802 nt, Mus musculus
aaguccaggacaaagcccucugggagauugggucccagaggagaagcucaaugugggacagccaacacugaggucaagaccauugccccaccucgggcacaaauugaggcuggagaccaggauuuaaggaucauuagagaugguaauugagguugugggaguuugugaccaaucccaaggaggguaugaggggugaauggagacaaggcucagacggaauucugagaaaugagggcacaugaguugagaaaagaaaugaguacuagaccaacauugugaagauggcacaggaaagaguugacgggaacugggcuuagcggcgcguccuaucccagcagagcauuucuguaggcuugaagcuagccuggucuacauauugagacccugaacucgggaggcagaggcagguggcucucugaguucaaggcuaguuuugucuacagagcgaguuccaggacagccagggcugcgcagagaaacacagauauuuuaagucuuuuuuuuuuuuaagauuuauuaauuaugagcacacuguaggugucuuuagacagaccagaagaggguaucagauuccauugcagaugguugugagccaccaugugguugcugggaauugaacucaggaccucuggaagagcagcagucagugcucuuaaccacugagcuaucuucccagcccacuccaccuuuuuuuuuuuuuuuuuuuuuuuggucuuuggagacaaugucuuuuuagauauucauggcuggccaagacuccugccucagacuccugagugcugggguuagagaucuguaccaccacacaagcuagagagggaguucuuuguuuuuaaaauagaagaacuaaaauuguauggaggcuuaggagaagauucaucaggggucagggagagaucauaggaagaguugggaagacugaagagguaccuggcaggugggauggagaccagugaugggaccugcccauuauuaaaaaggggagccagcacagaaagucaaguggagcaagaacuuagaaauauuuuuuuuauuucuucacuaaaauacauaugguuuucucauaaguuacuuugccuuuauuucuucuuuauagaacagguggcuuuaugaauugauuuuuuuuccaaaauuugggcauauaaauaggucacauuacccaggaauuguuucaagggaaggggaacuuguguaucugugugggacacucaugagaucaaaaggccaggcccuguguaugauaaugccugcucucacugagcuacacauaaccccucaaugcccauuuguuuauuuuaucagauuuucuagaguuuguguuuguuugguuuugggguuuugguuuuuuugagaagggcuuuucuguguagccauggcuauucugaacucacuguauagaccaggcugaccucaaacucaaagaucugccugucucugccuccagggugcugggaugaaagauguucacagcuacuucuccgcugccagugcucuuaacugguucuagauggcgagcuaucucuggaacaccuguuuuuugauguugcuuuuuuuuuuuuuuuuuuuuuuuuuuuuuugagacaggaccuuguguaugcccaggcuggcuucacuguaauccagguuggccucaaauuugcuauguagccaagguuguccuuagcucuugaucuccugucuuucuuugccuaucaaauucuaaaauuaaagaacuggcucuguuuuguuguuuuugacaaaaagcugagcuauguagcucagaauggccugcagguccccauccuccugcuucuggcuccccagugcuggaauugcaggcacacaucaucgugcucagcuagaaucuccuguguccuuuuacauuucucauuagaguuuauuuguuuauguuugugcaugcaugaacacgccacgucccacuugcggaggucagaggacaauuugugggaaucaguucucuccuuccauguggguucaaggaaugaauucaauuuuucaggcuugguagcaaguaccuuuaccuucugagccaccucaccggcccuauuuuggucuuuugguaugcagugucucuguguaacacuggcucuucuggaguucacuguugucaccuagguuggccucagacuuggcaauccugacugcuggaagauaucuauaucuaucaauguauauuauguauuauguuauauaauuaauaaacauugcaauuauauuuaaauugggggcuggagagauggcucagcaguuaagagcacugacugcucuuucagagguccugaguucaauucccagcaaccacaugguggcucacagccaccuauaauaagaucugaugcccucuucugguguguuugaagacagcuacaguauacucacauaaauaaaauaaauuuuaaaaauuuaaaaauuaaaaaaaaauuauauuugaauuguauagauuuaauuaaauauauuuaguuauauauuuauaauuauauuauauacacauauauaauaguauauagauguauauauaaacauacauauuacauauauauacuuauuacauauacauacuuauuacacacacauguauuacacacacauauauauauacauauaauaagcuguaacuguuugggccuuuucuaugccuacccuugcucccaaauaacacagagaccauuauauuuauuuaauagcuuuggccuuaagcuaggcguguucccaaauagcuuguaacucaauuauuccauuuauacuaaucuaaguucugcuaugugacuuguuaccucuccucgguuucauacaguccauuuccuccaugucuaccacgauugauucuuuuccagaguugcuuucucuguccagaagucccaccuugcucuucugccuuuugcuauaggccauaggcuuuuuauuuuaaccuaucagaggacaccugagguaggcaaggaaggacagagacacaucuugacacaguauacaaaaacaucacuccaacaauaggccaccauuuucaugguagcauuuauuaauuuuugagacaggguuucucuauguagccugucacugcucuagaggcagugggaccugggagaauggaguuaguagaaugguugaauuuagcagugggugacagcaaacuuuaaucccagcacuugggagacagagacgggcugaucuuugaguucaacgccagccuggucuauaagagaggaccuauacagagagacccugucuugaaaaaacaagaaaauaaagaauaaacguguuuuccacaguaccagacuuauuuccucuuuuuaggcaucucuaucugggagauaggugaaguuuuuuucucuucacagcaaucccagaccagaguugcaaauuuaacuagggccacagugaggcaguauucgaacccccaucuuagugacugaaaagccucacagguucugacagaugcagggaaggaaggaaggggaggagcccuuugugacaguuguccuaggcuaggcauaaacaggaugugguguuagaggaaagcuucccccuuucauagcccaucccucucagccugggguccccaccccuagaagacagaggaacugagaagaggccuaaggacagaaaaacauggucagagggccugggugacaaggaagggugagggggccgaguucagggugaccuggauggaggucagaugggggaugaaggucacaggcaggaagggaagggacccagucuugacaaagcuuggucguagagguagaggccucaggcaagcagaugcuuaggucuuuuggaguaauccaagggaauccuccaggaaggugguaccuggccccugugugucccucggagcugaacugugugucuuaguaacugccucccuauccagguguuugccaaaggccacucaucuaggcuaguuucagcgucuucauugacuuacgaagauacuugggucaggaaaggggccagguuagaagcuaagccggcucagcucuucccugucccauuggcagucggacucccugguggugugugaaguggacccggagcuaaaggaaacauugaggaaauuucguuuccgaaaagagaccaacaaugccgccaucauaagucagugaccucugcccucucaaggguggcacgggggggggggcugucgggggggggggaacagcaaggcagggaagucugggcugguguccccuggaauggcgaggggucuguaaucuguguucuaucccuccccagugaaaguggacaaagaccggcagaugguggugcuggaggaugaacuccaggugaggggcugggauucuggacauuccaaauacaggaagaugucuggggacaaaguugggagggugcgccaggguuggaucagcuaccucauaaacagggcaccgugacacaugcuuuucuaaugcuggcacucuaagggugcagagagagggaccaggauucaaggucauucuuggcuacaguguuaaguuggaggcuagccuggacuacacaagacccuguaucaaaaagccaaauaaggcugggugugguggcacugacuuuuaauaccccaaugcaagagauagaagcaggcagauuucucugugugcuugaggccagccuggucuacagagugaguucgagggcaaaaaaaagccaggugcuucaguuagggucacuauugcugugaugaaccacuacgaccaaaagcaaguuaggaagagaaggguuuauuuggcuuacauagccugaaucacaauccacugaggaaagucagggcaggaacucaaacgugacuggcaccuggaggcaggagcugaugcagaggccauggaagagugcugcucacaggccucucguggcguggucaaacuauuuucuuauaguacccggggccaccagcccaggagugguauacccacaauggagcuauguuccuauaucacuaaagaaagugcccuauaagccgggcgugguggcgcaugccuuuaaucccagcacucgggaggcagaggcaggcggauuucugaguucgaggccagccuggucuacagagugaguuccaggacagccagggcuauacagagaaacccugucucaaaaaaaccaaaaaaaaaaaaaaaaaaaaaaaaaaagugcccuauagacuugaccuaaaucugaucuaauggaggcaauuucucaauagcgguucucuccccuugaaugacuauagcuugugucaaguugacacaaacuagccagcacaggaguuaaauaaaaagaaaagguugggaggacaacuguacagagcucuugccuguagagccagguccuagagcuuaaaaaaaaaaaaaaaaguuuucauuuuagauaagguagcccaaagccacuagcaacccuauauaacuggauaaaccucccacuguggcuuugccgucugcaacagccuuccuuccuuccugcuggagcuaagucuguuuggcagagaaggguauugaccaggaagagcuaagcucccuuaggcccccuaaaaggaaguauacuaaagcgguuaccaugggaaugcagauucaaaucggaacucuggcauuuacuaucuugugcaauguggggcaagucccuugacacugccggaccucaguuucuguagcugucaaagugggcauaauaagaccuucccauaaggguucugagaaaucucaaugaguccacaugcacuucuucuuagcaaaaugucucugcauguuuuuaagugaucauuuaauaaaccaaaugacagucauuuguuuguucccugucucuuucucucugccucagaacaucuccccagaagaacuuaaguuggaauugccagagagacagcccagguauauggggggaagggguagagugggggaauauggguagggggugacagaccuauaaacugggggacuguugggcucuaguucucuuuaugggcucaagaucucuguguuugaagccaagaagucauagucuagaaacuuuuguugauauaauauuauuuuauugcagaauuuucacuaguauguuaaagagccauuuauuuguuuuauguccgugaguauuuugccugcagcuaugacuauguaccacauacgugccuggugccugcauaggucagaagacaucauagaucuccugugacuggaguacuaagcuaccacauacgugccuggugccugcauaggucagaagacaucauagaucuccugugacuggaguacuaagcuaccacguggggcuugggaauggauccuagguccucugcaagagcagcaagggcuucuaaaaacugagacaucuuuucaccucuuauaccaauaauuuuuuaagggguagacaaaucaggagagcauuuuaaaaaauuuaaggacagguggugguagcaugcaccuuuaaucccagcacuugggaggcagaggcaguuggaucucugugaguucgaggccagccuagucuacaaagacaguuccagggcaaccaagauagugagcuccugucucaaaaaagguuuuuuuuuuuuuuuuuaauuuaugaguaugcauguuuucaugcaugucuaugcacuucauguccauagaaaccagaagaggguuuuggauccccuagaaucggagugacagagcauugugagcaacuuugugaaccugaacccaguccucuguaagagcaacaaugguucuuaacugcugaaauaucucuuccagcacuuccccuuuuaaaagaggacuuaauuuauuauuuaugugcgugugucuaugggagccaccugacacuggguccugggaaacugaccugcagccccuaccuaagaacaaaaaguacccaaccccagagacaucucucuagacccucuuguuucuuugaaacgcagucuccuguauaccagguuggcucugaacucaauauacacccaagaacagcccuggauucccaaucguuucaccucugccucgcaagcacuugggauuacagcucuaugcucuaaugucugauuuccauccuccugcucuagccuucugaguacuggcaucagaggccugugccacucugccugacucaaauuggucuguucacaucuuucauccugacucagaccccaaaagaaagggacuuuugacaacugcaaagagccagggcccagaaggggaccuccccucccagaagggguucgaugcugauuuuguuuagaguuuuaucuuacaguuugucuuuucugugaaguccaaucgaucagauuguggcacuuagcaccuuggcucacaugcaguuccagcuccugggucaggcacccagcaugcaacugcugagccagcccucagggcccauugcugggauagggaagucccgggccuagccccagauuuaaggaugugaacucagagcaucgaucgcgcagcuucucaggucucguucucuuccguagguuuguggucuacagcuacaaguacgugcaugaugacggcaggguguccuauccuuugugcuucaucuucuccagccccgugggugaggacagugucuuagauucucuggagcagugugugugagagagagaguguuugugagugugugucuguguguguuggguguguguuugugaaugugaauguagaguguguugagugugcauggcuguguuaugagugugcguuugugagugugugagugagugugaaugugugugugugucacuguggaggugucaauaguaaccagguaugguggcacacaccuucuaaaaccagcacacaggaggcagaggcaugcagaucucugugaauuugagaucagccuggugugaauagcaagucccaggacagccagagcuacauagagacucugucucaaacaacucucccuaaacacacacacacacacgcacacacacacacacacacacacacgcacacgcacacacaccauagccaggcauggucaugcucuaacugugaucucagcacagaacuugggaagcugaugccaggcccgacuaaacgacaacuaaucugaacaagucgggcaggcaggcaugguggcucaagcuguuaauuccagcacucaggaggcaggggcaagcagaucuuugugaaaucaaggccagucuugucuacacagugaguucaagaucaaucuuggcuacauagcgagacccugucuaaggaaaagaaaaaaaaaaagaguaaucaugugaaugugugugugggugggugcguuguacgugggagcugagaagugaaggcaggcauuuagauucgucaagaacucauggaauccuguucauguuaccuggaaaucccugacaggcuucugacucuucucccagagacccucacuaucacuugaagcucccaaacaaauguagaaacucuugaggacggaugacuuucaagguccuccuccaaggaccuucugugccuacuggacauuccuagagcuuuaccaguuaugucgcguuccccaccacauccaucucccuuucucacacaggcugcaagccugaacaacagaugauguacgcaggaaguaaaaacaggcuggugcagacggcggagcuuaccaagguccggaggggcucuggaggggcugggcaaccugagggucugagggagggagccaggggcuggaccccugggguuggugggcuggggguaaauucuagaccccagagagaaaggcugggccuagauccucaggucugagggaagugggaugggccuggacuccaaggucugagaaaggagggauauggaggcugggauuucuggauuugaagcaggagggcuucuugacaaacaaaguaggagggugacuccuggguuucuaguaggaggacugggguacggacuccuggguuuggaggaggauggcuggaaucuggacuccugauuccuaggggguuaggaauccucauuggaucauaaugccgauugcucuuuauccagguguuugaaauccgcaccacagacgaccucaccgagaccuggcuuaaggaaaaguuagcuuucuuucguugaccuuugagccagggauuuggaauccuuacuucugaaggcucagauugauaggauaugaacauccaagagcgaaauaaagguuaaaauuucaggaacuuaauaacgacaugguaucugcaaaaucugagccucuuuguuggugccgccggacagucccuacaguuccaacuuuggccgggagggggcggacguuuccagcgaaaccaagcuggucccaggagaacagacaccuguuucucagaaaccaagggaggggggacuaugggguuuccuuggauggaagguggccuggguccccuuaaggaauuuggagaaauguuugaaucaaugaagggucacgccuaaggggauaaagacccucgagaggagagcgcgggcacccuuuuucuccaccuguuucccccgcucugggacaagaaggcaucuuuggcgccaaaugcuacuuuucucagcccucagauaggaagaauuuaaaggccaaaagaugucaaaagaucaaaauguaauugcuucaggcacucaggaggaugcugagggauggauguuuugagguuuugcuaagcuugaaggcccaggacuguggggagagagaauucagaacucucagugagccccagagggcuugaagagucagggaaaggauacucccuauacgcuagccuuuuuucuuuuucuuucuuuuuucuuggcacaucagggcauugaauuuucucaaaccucuguuucucuuugaaggacauguguugagcacccaagccauacagggcucugagaugggcagucaccacaaagaugaaucauacuuucucugcuucucccagugucucccauggcuccucaauccucacacccaaggccccuggaacucccucccuccaccucuuuccagguuccccguugagagguggccguugccaugguaacaaugacacagugaccuugggccugggcugucccucccccaacccuggugcucuuagacgagccuaaaagggaauucuaacccugccucucccucucagccuucagauucuuccccccuucaauccguguucuuuuauccccagucaagacaaacccuugucgagaaguucugcauagaauaucucuaaacugggcuauggagaaaugcccuuagcuuuccauguucugggacauguggaucaagcugucuccgcccugcuagaggcuccaccccaccuauguuucuucugaucacagccucaguucccaauggcuggaggugggaaagagaggucuggggauaagaagaggcaucgaggccaagcaaccgccgcuggcuugccgagaucauggaacuugucacaacagucacaaccucaaaugcauaacagcuaacucucccacugagcgcuuccuacgagucaaggaucugugggcaccauacgggcauaguuuaauuaaccucacucugaagacaaagaaaccgaggcacagaaggugaagccauagacuaucccaggcccaaagaccacacuaugguuuuuuuaugcaagaacucaacagccauuucuuuucccccuccauccucacuauccuucagaguugaacuggcuuuucggguagaacugcaaauaacccaaucagaaaggaccauguaggugacucgcccaaucaagagcaaaucuggaaagcaaagacuaaccaaaggggcggaggggugguucgauggguucagucuuuuaagaaguaccagcacccugauguuaacuuauuuauuuacuuuuuaaaauuuugauguauuuuauuacauuguauuugugugugugu

SEQ ID NO: 3655 - RNA, 5166 nt, Mus musculus
cauugugggagagagcuuccuuuuagcugccuaagggugccagucucuccugguugccuucggucaagaugcagaacucucagcuccuucuccagcaccgcaucugccgagacacagccaugcucccuacugugauaauaauagacugaaccucugaaccuguaagccagccccaguuaaauguugucccuuuaagaguugccuucagggcuggagagauggcucagugguuaagaacacugacugcucuucugaaagguccugacuucaauucccagcaaccacaugguggcucacaaccaucuguaaugggaucugaugcccucuucuggggugucugaaaacagcuacaguauacucguauaaauaauaaauacauaauaaauaaauaaauaaauaaauaauauuuuuuuaaaaaaggguugccuuggucauggugucucuucucagcaaugggaacccuaacuaagacauccuccacuuccuuauuuauguauuuacuuuggagucagggucucacugcauagcucugauugacuuggaauuaacuaugugugucaggcugguuucaagcucagagauucaccuacgucaaccucuguagugcuaggacaaaacucaugugccauugaaccugauaaucccccacuuaaaaaaauaauuuauuuuuauucuauauccauugguguuuugccugcauguauaucuguguaagagugucauaagcccuggaauuggaguuacagacaguuguaagaguugucaugugggugcugggaauugaacccagguucucuggaagagcagccagugcucuuaacugguaagccaucucuccaacauccccacuccccccuccccuuuuuuuugagacaggguuuuucugugucauucuggcuguccuaaaacucacucuguagaccaggcuggccuuuggacucagaaaucugccugccuuugccuccugagugcugggauuaaagacuugcgccaccacuacccaguuagcuccacccauucaaacuuauaaagcuguauggguuggugugacgugucagcagcaaagccacuugccucuaacaugauggccugacuuucauccuuagaacacacaguggagggaaagaauugaugccauagguuauuuucugaccuccaucugugugcauuuuggcaugcacauaggcacacaggcacacaggcacacacacacacacacacacacacacacacacuuuacagguuggcuuuuauguauguguugguaggggcauaugcuacuugugugugugugcccauggaggcuggaagagggcaucagaucuccuggagcuggaguuacagguggcugugagcaccugaccugggugcugggcacuggauucugggucccagguugaggaccaagugcuguuaaugccgaggcaucucucuagccccuuccuuguuuugggagauagggucuugcuuuguagcccagauuggccuugugaacuugagaucuuucucaucuaacugucaaguguggaugauuauaggugugugccaucacaccggguggcuuuucagcuuucauuuggauucugaaaaacaaauuuauuaaguauauuagucaguauuauaucaggcaaaaaagagcagguuuuuuuuuuuuaagauuucuuuuauuauuguaucuaaauacacuguagcuguccucagacacuccagaagagggugucagaucucauuaggaugguugugagccaccaugugguugcugggauuugaacucaugaccucuggaagagcagucagugcuccuaacugcugagucaucucuccaggcccaaaagagcaguuuuuaaaaaaugaauuaagaggggcuuacaguguacuuacauauaaauaauaaauaaauauuuuuuaaaaaucauuaaaaaaugaauuaagagccuucccucccuccuucuccuccuucuucccucucuucuuuccuuccauuuguuuuuuaucuaacaacauacauauauaucaucuaucuaguuaucaaucuagcuaucuauauuuguguuuugauaucuuuauuauguaauccuggcugucuuguuaagaagaccaggcuggccuccaucucaccaaguggagaaaaccacacuggucucaagugcugggauuaaggguuugagccaccaugccgggcucuauuaucuggaacaaaggaaggugcuggaggcuguggcugagagaugugaacauuagaagcuggggcucucagacugccuggggagucaggagggcggccagauucaaagugagaaccagaagaaggguucuccuugauaaguccuaggacuauacaccagccaugugcacugacugcccuuccuuccaagacaggaaucacguauauaagaaaagaaaccucaccaucccagcauaggagccaaguccucuugacucacagcuaauacuccacuauggcccaaccuauuuacccuucuuccacugaacacucaauaaaauaaaguaaauaaaugaaaaauaaaaagaauugagagaggaugggggcaugugggaagcagagugggcaguucaggagguugaagggacaagucccacuugggacacagagugaguuccagucccacuggggcaacuuagagaggcucuaacccaaacagaaaguacagccgggugugcugguguacaccuguaacucuaacacuuggugaguggagagagaagguacaggaauuuaaagcuacccucagcuacauaacaagucaaaggccagccuggacuacaugagaccugucaugaagaagcaaauaauaaaugaaagaaaugacaaauaaagagagagcauaucuguagcucagugguuaguguuuguuuagcacgugcaaggccguggggaugaccccaggagagggaaagcaagggggaucucaaggcucuuggcuuauacaggcuccaugcuggaggccacaagacaggauuuuccuacucugaggacaccucagcuuugcuuuaaggccucucaguugauuggaugaaguccacccagaugauggaggcuaaucuuuccuugagucaccagauuguggauuuaauggccucuacaaagccucucacggaagcgcuggcugcgugguuaaugggauaacugggccccguagccuaucugagcugacacagaauaggcgccgcagcagcgaggugugauuuacauuaauggacugcacacauuuaacacggaucauugacgagucuugacaucuuuaucugccugggucucuuccccuggaagcgacgaucuacuuccugucuuuauagaucaguuugcauuuucuaggauuuuauaauaggcacuggauccugaaugaauaaugcauagggaagaaaagaaaagaaacaccgcaaaccuuauuaacccaacuggcaaaagcuaauccugaaauugaaucccacuuuugcaggcuccagaggcguuguucagucuccacggcuguucaucauuuuugucuucucuaugaucacaugcuugacagaaacaaaccaaaaaggaaggguuucauagaugucagccccauagaucuuugcucugucgacucugacggagccagguuguuuacuucacacucuagagcagugguucucaaccuuccuauuugcugugaccuguaaauacaguucuucaugcugugaugaucuccggaccauaaaaauuaucucauuggcugggcgugguggcacacaccuuuaauucuagcagaggcaggcggauuucugaguucgaggccagccuggucuacagagugaguuccaggauagccagggcuacacagagaaacccuaucucgaaaaaaaaauuuuuuuuucucauugcuacuuuguaaauguaauuuugcuacuguuaugaauuuauguaaagaucugauauauaacccaccccugcauaggucgcgacccacagguugagaaacacugacguagcagaagggggggggggaagaggagccauucaacucaagauggauaggcagcaaggugcugggaaggguggggaccggauauaacccucacaguuccauccuagccacugcuuccuccaaggaggcucagcugaagcuaauuucccccuaaacagccccacugacugaggaucuaagcugaagacgugacccagugggggacauuuuguauuuaagccaguaacauuguucaugagauggcaucgucucagaguagagaaugucaggaccuugaucgcucagcacuuggauauucugauuuuguucucccccccgccccuugggcuucuucuggguccuacaguacacuagguuucuuauguuuucuucaauuucagcugcugccggugugaugagcugagaacuuuaagagaaucuggcggccgccugggcugcggcccugagagucagguggcugcaaaggacaacccgcgguguggugccacuggaggcaccgagagccuuccacaugaccaaggccauguugccagggacauauccuaggaccccagaagaacgggccgcagccaccaagaaguguaauaugcguguggaagacuccgagccauucccagaugauggcaucggguaauggugacuacccgaugcuuccccaacagaucgcagcaugagagggauccgugguaugaugggaccacccagaccucaggcugaccuagggugaaccgauacacugggaccuagacauuuacgucaggaucaggagucguguggacacgucgccuacaccugcuuccugagaugaugucauguguaaacacugcuucggcuucguggcuuucaugguuuucauguucuggguaagggacauguucccuucuuaaagcaguacccuuacaauaauccgcccguggagugagguggugauccuacgaaagagcccgagcccgugguucacuaugauaucugaggaggcuugaugggcuuuugugcccucuaaauaggacucccucgagacaagguuucucuguguagcccuggcuguccuugaacucacucuguagaccaggcuggccucgaacucagaaauccaccugccucugccucccaagugcuggaauuaaaggagugcgccaccaccgcccggcgagagguuuaaccucaaugaaaucccuaauaaagcucagug

SEQ ID NO: 3656 - RNA, 2186 nt, Mus musculus
cugaguaacaucacaaccugaagauauauuuauuacaaaccccaucccagcacaugaggucaaccugcaaacacugaacauggacgcacagggguacugccuuccaauucaccuucaguacucuugcagguuaacaacagucuugcugaaucacaguaagauuugagcccaagacccgggaguaggaagaacccguuuccaaggaucgagugccagaccacugugaauuacugucauuucuucuuuugcacguggccgcagucauacuugccccucacaacuuugaguuugaccccaggcagguccugggugcgaccacccuccacgaggaccacgugaugcuccugcaggguguggcccuccccggggaugaagcagacagccucuuugccugugcugaggcggacucggcagcacuugcgguuggcggaguugggcuucuucggcuuucggaugaaugugcgcaacaccacacccuucagcuggggccggcccucuguggggcccagacgcuuaggggguuccuuccgggggccuaagcggugcaucugguucaggguggccauggaacgggcggcccagagcuggggagcgagggcuaggccuggagagacacaagagggccuacuagguuuccguauucuagauaggaauccaagucuaagacuauucaguggggacagauggcucgugguuagaagcacuuguugcuccugcaaaggacgaccauuugauucgcagcacccacagugguggcucacacaccucuaguuccagaggaucugacacacccauggguugcacuuacauacacacauucauacaggggcuggaaagauaccucagugguuaagagcacugguugcgggcuggcgagauggcucagaggguaagagcacugacugcucuuuaaucccagcacuccggaggcagaggcaggcggauuucuaaguucgaggccagccuggucuacagagugaguuccaggacagccagggcuacacagagaaacccugucucgaaauaccaugugaauggaauacccaaugccugccucccucagaacacuguguacaaaccugaugucugggcaaugucuaggaacauaaaaguuguccuccaauggguggcccgucuuagaauuagaaaaauagcacgugaaugaauaacuaaacuucuucuucuucuuuuuuuuuuuuuuuuuuugguuuuuugagacaggguuucucuguguagcccuggcuguccuggaacucacuuuguagaccagccuggccucgaacucagaaaucugccugccucccgagugcugggauuaaaggugugcgccaccacuaaacuucuuagcuuggccuucucaccuguagggggugaucaauaaacacugaaggaauaaacacuacugagagacaccuaagcagggagacaugccaagaaaggagcauuuguugguaugauuguuacacggacaucgagagugcacuuacacaaacuaagacagaauaucaccaggcaaugcaaucucagggauucaccgcuaucgaugcaggggagccaugacuaagacugacuuaaacucuaagaacacaggaccuucccaccuccugcccccugagccgggagcgugguagaaaacgccuguaacuccagaacuugggagauugaagcgguagucaggaggucaaggccauccugucuacaaagugauuuggaaguugaccuggacuacagugaaacccugucuccaaaauagaaaaggcaccgugcuuaaagaugauaccauccgaaaucuggcaaaaacacgcaaaugccagggagcuguccucgucccuguggcccaugcucacuuaccacgacugagggacguggugaggccauaaagaaggccgggccaggacaucucgccgccugcagcgucccuguauuaggagagaagacauucagaaaggagguugggaccagaaacccacucucagagccuucuagaaucuccucuaaaacagaaaguccccucgcaaauucagucuccuucugaguaggcccccaaggacccaaccgcccuugcccggauacuggaaggggaaacugaggagagaggagagaucuggaucacagauaacugcacccaccucaccaaccuagcggggucgcacacacgccaaccccuaccuccagccccuuccggg

SEQ ID NO: 3657 - RNA, 11914 nt, Mus musculus
cgucugauuggcucguccaugaugagugacuucuuguuuccacuccaagauggcugcguccauggcgcggcuuugguggccuuuccuggcucgccaggggcuccggucccgaggacgcugcgugugcagccagaacccaaggaggaguuucgcuacggagaaacgaguccggaaccuccuguacgaacacgcacgagagggcuacagcgagcuucccuacuuggacauggagucggugugcgcaugcccagaaaaagccgcgcgcucccuggagcuccgcaagggggagcugcggccggccgaccugccugcgauugugagugcgcuugcgcccugagggagcaggaugcuuuacagaacuggguuuaccagaugcauuccaguugugggaaaaacuacucaacaggaauuuggguuccuucccaaguuaggcaaugucuugugcaugacacccacuuaggugccaaugaucuagggagaacugaggcccuauugaacgucguggaugccuucugugaccuacaugcccuuuugcaugcauuucauaauucgacaguugguaucuacuguacucccagaaccuaaauaccauugucuucuguacucaaacuucgugccgggcucacccuuaggccacaaagaaaaaugaggagggaggugugaaucagagggaauuuuggagacagagcuuugcauccugcuauaaacauccugauggaguugaauggauaaauaccugcuaaacagauauuuaagguauaucuguucauguauuuaugauccagagguuaagacuaugcgccauaauucuaccuuauagggaacuaaaauugggggucuccaugccgguagugaauuccgaauguaauagaugaaucuucccaacucuguugccuugauaaaacaccaugaacaaagcaacuuacagaaggauuuauuuugggcuugguagggaauggcagaauagcagcaggucacagagcaguaagcugacagcacacaucuuuaaccacaaucaugaagcacagaccucaaacuagaugcaggacgaggcuuuaagcucucaaagcccaccuccaggaacauauuuccuccagcaaggccacgccuccuaagccuccccaaacaucaccagccacugaucauuugaccauguucaaaugucaggauaugggggacauuucucauucaggucacuacagacucucacaccaccagucauugucaaucacuuuagccauauuucaaguuuuugucauguuuaguuuuucaccaguaagcacugguggcuaagccaaauagggcacuuccugccaaaccugauaaccggaguucaauuuccuggugguaggagaaaaccaauucuugagagaauugucuucugaccccucauuuaagcgcaaacacaagaaagucacguacaugcuuaauaauagaagaaaggagccgggcggugguggugcacgccuuuaaucccagcacucgggaggcagaggcagacagauuucugaguucgaggccagccuggucuacagagugaguuccaggaagccagggcuauacagagaaacccugucuuguaaaaaaauaaauaaauaaauaaaaaauaauaauaauaauagaagaaaggucugucuggguguggugaugaaguacucuggaggaggaagaggcaggcagaucuuuggucuccuuagcaaguuccaggguacccaggacuacauaaggagaccuuauauuuacagaagagccuuauauuuacaggggagauggcuuagcagguaaagguccuuacugccaagcugacgaccugaguucaaucccugggagagaacugacuucguauacugucuucugacauccaugcugcagccacacaaaguaaauaaacaagaaagaaaaaguuuagucaccuuuaaagaggugacuuagccaggcguguguuagugcacucagagaaugacagguugauuacaaguucaaggccacccugggcuguacauaaauacacugucuuacaaaacuaaaaauaaauaaauaaauaaaagagucacacuuccaugauuuuccguugguuggucgugaucauaccaacagaaguggcuucaaaguaaacugggaaaugcauugauucagggcaacugugugcccaccccagcuucugggugucauagugcuaaugggagaagagagugccccucccccacugccauccaggugccuggcagaggagacuucagagcaguggccauuucacugugguguucucccacagaucuccacguggcaggaguugaggcagcuucgagagcagauccggagccuggaggcagagaaggaggcuguggcagaggcagugcgggcccugcuggugagugagcauggggaacagggguccugcguucaccggguuaggccagaggcagcuaggaugccucucugucugggaauaacaggaaacccaaugaaaagggcuugaaucauguagacaguuguuaccuaauaaagcaagccacccaggccugauguuccuaggcugauaaauuagcucucuucagcaucuccaaccagauucucugugugcccaacuucagugcauagaucggaccccaucccagucccaagauggcugccagcaggucagagacaaggucuaccuccaggucuuuuccaagagcaaggagaccauucccuaaguagaagccccucuuguugccagagcucagacacccaugacagucaucagcaggaugguaagucacuguugcuagcuuagggccagugucccugcuccugaacugaaagcugucuagagagggacaaccugaaugaggucugugaggaggagagaggagagcaccuggcuucuuaaccuucccccacccaccagcccccuuuuuaccagaaacaccucacauuucuuacauguuugauugguaacuaguuuacaucauugugcauacagaaaccuguacuguugcugauuuuuuuuguaacccuaauauucaguuaaagugccccauauagaguccacaguucaacauuuacaaagcuugauaaccaguagcacucacacagauggcuuaguaggguccuaaagguguugguggcacacagcuguaaucccagcaucuggcagguagaggucagaggaucaggaguuccguauccuuagcuucggucuuaggcacuguuguguugccgugaggagauccagcagguacuuaacuggggacuggcguaggguuuuggaagguuagucuguugucaucauggcgggaagcagacaggcauggauggccggugcaguggcugagagcuuuagauugugauccucaucccgcuggcagggagcagacacuaggccugcugugugcucuugauacuucggagcccacgcccaguggcauaucuucccccaagucugugccuacucuaacaaagccaaacuuccuaauccuuucaaacagugcaucaccuggggacuaagcaugaaaacaggagagcuauugggucuguucuccuuaaaauaaccacagcuacauaucagguuccaggccaggcuguccuaugugauucccccaaaggucguuuaaaauaaugacagacagggaccggagagauggcucagugguuaagagcacuggcuacugugaacucagagguccugaguucaauucccagcaaccgcaugguggcucacaaccaucuguacuaagaucuaaugcccccuucuucuggccuaugcagauagagcacucauguacaugaaauacauaaauuaaucuuuaaaaaaaaaaaaaaaacaaggaaaaauccuagcugggaggugguggcgcacaccuuuaaucccagagcucgggaggcagagacaggcagaccucugaguuccaggccagccugaucuacagagcaaucuccaggacauccagggcuacacagagaaacccugucucaaacaaaaaacaaaaacaaaaaagcucaagaaagagagaugguccagcagcucuuguagacuugaguuugguucucagugccuaugccugguguucauacccuaagucuagcuccaguucugacaccuccucuggccuccaagggcauacacacacgcauacgcacacgcacauacacacacacacacacaaguagagccaggaaugucucugggugguuuaauguuaccuaccuugcacaaggcccaaaguuuaaacccaaaugcacaaagaaaguagccauguaaaauaaagaggugugcuccacacagccccccucuuccccucacagagggaacaguucauucacagcgcuggguaucauuccuguuacaucacguugccaccuuguggcuucaccagcagagagccugcggcagggugggagguucagaugucaugcuccucuuugaacucugaccucugcugccucuacucuggacccccacgugcauuaccuaaucaccuucuccccuuucuucuccaccaggcaaaccaagacagugaccaagugcagaagguacucagggccccgacgucugcaccgucaguggggcgggcagggagggugccauguuggccacaauucuaauccaggcaggguuaggggaagcaagagaaaguuccaguuagcuagaccugagcauuguuugccugaucuugccaaacugagaggaaagaaaugguggguguuuccaugggguccugccagcaaagauaagucaugcugguagagguaugcccgacucucccccaggguaacccucugcccugucuaggacccccaauaucagggccugcgggcccgaggccgggagauccggaagcagcucacacccuuguacccccaagagacccagcuagaggagcagcuguaccagcaggcacugaggcugcccaaccagacccacccagacacgguaaaggccguucagcugccagggacacugggcauccaggcugucuccuucccucugacacacuccucuucccacagccugugggggacgagagccaggcuagagugguccguguggugggugaaaagccggguaagucacaccccagggcucagggugccugggagcucaggcugggaguggggcauggcaggucuuugggucaggguagggcuuggggguguagcuggaacagcccuucagacuugagcggaggcugcgacuccuugcccuuccuucacugggcagcccacccugucacggugaccgccugccuggcugccucucucuuuucuuacuugcuuugcuuugguccccauucucgggggcuuuucuuccuagcccccauguguguguccacucucugucugaucuccuucccuucucucaucucucucauccauuuccuucucuuuuuccuuccuuccucucaccucccucucuucccucccuucucucugcuucucuuauucccuucccuucccccaugagccucucucucuccucccggcucuccgauucaucuuucuuucucucuuaccccaucgcauuccaucuacaaccagcuuucuccuuccaaccccgaggccaccuggaaauuggcgagaaacuggacaucauccggcagaagugagcucccaacacccccauucuccccagaccucuccccuccccccccuuagcccaucauccccacacuaacagcuggcagcccuaacagcuggcagcuagcuucucuccugcagccuuagggcacaagguggaaugccagggcugggcccacccagcaugaauauuuaaugcccggcccgccugucaucugggccucucuguccccuggguacacgagcccuuuccccacgcacccuggcccguaggcacugcugguuugucugccugucugucucuaggcgccugucucacgugucuggccaccgguccuauuaccugcguggggcaggagcccucuuacagcacggccuggucaacuucacccucagcaagcuugucagcaggguauggucuaccugaggaccugcuuggacaggguggcaccgguaccaagcuuagacagguuaaggaugcuccagggggcuaggagcauagcucaguuaacugggaaagcacuugccuggcaaguauaaggcccuggcucccauucccuggaacauauccauacccagagagauaguagcacauacuuauccagcacuggagaaucaaaacuucaaggcugacacgggcaacaugggaaaacucugucucaaaauaauugauuaauuaauuaauuaauuaauuaaaaagccaaagaggccggugugcugcagucucagcaucggcguauguuaucaacacguugauuccuaugcccucugcacuagggggacgcuauuauuaugcccucuuuugagaugggaaaauugaggcuugaauggagcuaggagcuuggccgagagccugcacuuguaaucaguacccccacuuccugcugcaggguugggggcaccugaggaacacaguguccacugaggccaggagucugugccaucaaaguugaugacuugcuagucacgguggggacgucacagucuuucagguuuucuuuucuguuguucuuuuugguuuuuugauuuuuguuuuuguuuguuugagacagagucugacuuuguaaccuuagcugguagccuggagcacccuauguagaccaggcuggccucaaacucagagaucugccuaccucuaaccucugacauucugggguuaaaggcauucgccaaaacagauuuucugauggcgcugggaaggcuucgagcggggaagggacauguuagggcugaacuucucuuaguggcgcccccagcugcccucugcgggugaacugcggggaaagcagggugcucgcagcaggagaaccccaauaacagggacccaggacucaggcuucuguaguuucuuccgcagagggauggacuguggacuggcagggcagccacugucucccucccuggguugauucccgucuccucucugcagggcuucacccccaugacggucccagaccuucugagaggagcuguguuugugagugagacccgagugacggggccccuucuccuugaggagaccacccugggcuaggucauggaagucagucacagugugggagagcaaagcaguuccagaugcuucuagaggaacaucugggauggcagccucagaauuagggaggcccagggccuagcaaacacagaaguggaugaucacagucagcuauuggaugggucacacggccccuaauggaggagcuagagaaauuacccaaggagcuauagggaacugcaacccuauagguggaacaacaauaugaacuaaccaguacccgggagcucuugucuuuagcugcauauguaucaaaagauggccuagucggccaucacugcaaagagaggcccauuggacuugcaaacuuuauaugccccaguacaggggaacgccagggccaaaaagggggagugggugaguaggggauuggggggggguggguaugggggaccuuugggauagcauugaaaauguaaaugaggaaaauaccuaaaaaaaaaaagagggaggccaagguuaccccaucaccugaccccugcaaaccuucccccaggaaggcuguggaaugacaccaaaugccaacccaucccagauuuacaauauugaccccucucgcuucgaagaccuuaaccuggccgggacggcagagguggggcuggcaggugagcaguugccugggggaugcagggaggacagcucccugcaggggacagacaacaacccuggggacuaacauauccagugguguaggcugccagaaaccgguacucugacugggguucuacuugaaaucucacugacuuccuguggguaauggcagcccuggcugaccccauccugccucuuucuccucccaggauacuucauggaccacucuguagcuuucagggaccuuccagucaggugaugcccauuuccuuuaaugcuagacccccauugguagguagcaucuacccugccugacccaaucucccaucuuccuacuaggauggucugugccagcaccugcuaccgggcagagacagacacugggaaggagccuuggggacuguaccgaguccaucacuucacuaaggugaguaguguaggccuggcuggcgugcacagguccccuccaccacccaggaccuccugacccaguauccuguccuguuccagguggagauguuuggggugacaggcccugggcuggagcagagcucgcagcuguuggaugaguuccugucucugcagguggagaucuugacggagcugggcuugcacuuccggugcggagaugaaacugggugggacugguagggguugggggcugggagagugggguugacugggcuggccuaccaccugcuccuauccccuaggugaggccucugggcuguauaguuucugucugugcauuauuuuguuuuauauacgagugucaagccaggcaaugguggcgcacgcuuuuaaucccagcacuugggaggcagaggcaggcggauuucugaguucaaggccaaccuggucuacaaagugaguucuaggacagccagggcuacacagagaaacccugucuggaaaaaaaacaaaaacaaaaacaaaaaaagagugucaaaagcaugggaauuaaagcugccacacacacacacacacacacacacacaaccaagcucccagucuuuagaguuugguccaagagaccucauuguccucccggguaaagcaggggugcagaagggaggcaucaguuaucacaaggcccacuuguucuacaggacagacagacagacagcuuuacugagggcugaggaaggccaccuuuuacccaggugucucacugcaaaacacaaacaaacaaaacaaaacaaaacucugagaguaugcaaccagguggcaugucucacaccgguaaucucaacacuuuagaguccauggcaggauuuccaugaguucaaaaccaaccugagcuauagaguggaagccugucucaaaaugaaacagaaauaaaacagaaaaggcuuagugucauggcgcacacuuagaauccaagcacgagggaggcugaggcagaaggauugcuaugaguuugaggccagccuggaguacaugagaccuuguuucaaaggaagcagaaaacuagcucagaaaagugccugccguggaagcaggaggaccucaguucugauccccagcacccacauagcagcugggggaaggugagcaucagggcccagugcugcagaggcaggaacagcgcccuggagcucgcugcccagccuguccacagcgcccuggagcucgcugcccagccuguccacagcgcccuggagcucgcugcccagccuguccacagcgcccuggagcucgcugcccagccuguccacagcgcccuggagcucgcugcccagccuguccacagcgcccuggagcucgcugcccagccuguccacagcgcccuggagcuugcugcccagccugucuaguggaaucagugggcacacacacacagcauccagagaugcacaccuacaauuugugaucuacaacuccagcacuugggauccagauccuauucaaagccauccucagcuaaagucuaagccagccugggcugcaugagacccuaucucaaaaaaagaaaaagacagacagacagacagacaaagggaaaaggccaguuagaacuccaaaacuggagguacugcucuagaccauaagaaugguagggugagugcccacagacgucugcauggcugucuuuccuuuucaccuuggccuucucuucugucuccuguggguaccaccuccccagcugcugguucuccucuuccacuguguucuuaucccuuucccuccuuuuugguugcugccgccaccaccucccccuccuccuucccccuccuccuuccuuuccuucccccuccuccuccuucucccuccuccuccucucuacuuccuccuccuccccccuuccuccuccuucccccuccuccuuccucucuacuuccuccuccucccccuuccuucuccuccuccucccccuuuccuccuccucccccuuccuccucuucccccuuccuccuccuucccccuccuccuccuccccuuccuccucccuccuucuccucccccuccuccccccuccuccuccuccuuccccuccuccccccuccuuuacauccuucuccuuuauccaaugacuuuuacccugucuuuuuuuuuuaccuuggccucaggguacuggacaugcccacccaggaacugggccuuccugcuuaucgcaaguucgacauugaggccuggaugccuggccgaggccgcuauggagagguaagaggccuggccuagugggcacauuugauaagacacuggaggaugggccugucccccaagacagacccucaaucacuccuguuccaggucaccagugccuccaacugcacagacuuccagagccgccgccuguacaucauguuugagacagagaccggggagcugcaguucgcacacacgguaaggaccacgcugaaucuucaccuucccaucccagggccaggauggaaucagagccuggcccugagcaugcgcuucuuccaggugaaugccaccgcuugugcuguuccccgaguccucauugcccuccuggaaagcaaucagcaaaaggugagagagcccccaagucuggaaucuuagguuuggugggaggacugcagguucaaggccugccugggcaacuuaauaaaaaccuaucucaaguuaaaaaguaaaagaggccgggcgugguggcgcacgccuuuaaucccagcacucgggaggcagagacaggcguauuucugaguucgaggcuagccuggucuacagagugaguuccaggacagccagggcuacacagagaaacccugucucgaaaaaccaaaaaaaaaaaaaaaaguaaaagaggaccagggguguggcucggugguaaaacaccugucaggaaucucacucacugaggagcugggggcguggcucagugguagagccccugccuagaaucccccaguggggggcugggggcguggcucagugguagagccccugccuagaaucccccaguggggggcugggggcguggcucaguuguagauccccugccuagaaucucccagugaggagcugggggcggggcucagugguagagccccagccuagaauccccuagugaggggcugggggcguggcucaguggcagggccccugcuuagaauaccccagggaggggcuggggugcagcccaguaguuaagaguuuguauggcauggagaacacucugggcucaguugguaccaaaaagaggagggaaacagugagggucugagacuuccaccagcagcuggugggggagcuggaggaaggguagcauccuaacaaccgcucugucgccaggaugguucaguccucgugcccgccgcucuccagcccuaccuaggcacggaccggaucacagccccuacccaugugccucuccaguacaucggccccaaucagccucagaagcccaggcuccccggccagucugccaccagaugacagcugucugcuccagaggcuggcguucuagagaccccugauacuuagagacuuuccccuguagcugguccugaugucucuguaggugucaccuccccuccuggacuccugagucuacugucccuucccugccagugaauuauugucagugaucccucuaccauugaggcugucagccagaggcacggcucagccugugggccggaagaaggccgucccagcuucuucuucccaccucagugcggagcagaauggccacaauaaauggucgugagaacagagucuucuggauccaugagcacagga

SEQ ID NO: 3658 - RNA, 2870 nt, Mus musculus
uggggggggcacuacaccuggguuauaaggcgcuagcacuggcuggcugcccggcagaaaggucccggguccggacuccccaccaugcugcuucguguaaccaccucugcagcgcugcugcugcugccucugcccccgcugcuggcauugcugcucggggcuggugaguccagggcccacagagggaucggguggcagggaaguacaccugaggucgggcuauagguggacagcugagggguacaagggaacagcacaccuggcaggugccgguccccgggcgggcuguggaccgaggugccgguggugggggagggugggagaguugggaucaguaccaugaacagcacccguuuucucccaucauagccucuucagcuccauugaugcccagacccuccaaggaggaggugagcagacuccuuucuugcccuccccuucccguugggucccuucugcccaacuucucgcuggauucccaccucuuuugaucccguagccacucuuuucccaaauccccugcccuugcccucucucugaccguucauccuugcccccagcuaacccgcugucuagcagagguggucauggaggugcugacacugggccaggcccagcggggccccugcacagcucugcuccacaaagguagggaugcuccaguugcccucagaaccccaagaucccuuuccuaccucccuacuagcccgcagugcaugguggaaggguucccuggccuggguuagugugugugguacuacucacagccccaacugugguucaagaaccugguucccuugaagcucgcugcaggacagggacugagcagagaacauuugcagcccauggcucccccucagugcuaagcaguucccuucauaaugucaggaaggacucaacucuccaggacaguuucccgaagagcauccuaucuuuucccugccagagauauuugagacagagccccauagcuguguguccccugaggagaagaaguugcugggugaggacuucaaccagcaggagucuggaaagaugagguccagccaggagauaagggaugaggaagaggaggacgaagcagagaggacccacaagucuggggugcaggaacaggcaguccacacgaagcuccacagccagcuucaccaggaggaagaagaggaggaaaaggaagaagaggagaagagcaugccggggaagaccucugagcauguguggaagcaacauccagagggaggccuccagaagcggguggcugagaaggcuagcgaugaggagacggcccaguuucaggaggagggaaagggcaugcagcuccugggcggaggccgaaaucuguggcagggggccgggagggucggaggagagaggcgugaagaguccucgaagcauagccaccaccuggagcagccuggcaccaaggcuaagcaagaggaagaggcagaggaggaagaggcuuuggagcaggaggugaguggagagggcacuccaaggcuccaagggagucuccuggugcugaacugcacaaugugaaaucugccaugaugugggucagagcagccaagugugcaccaggacuagggagcaaugcccgagcagggacggugaccaggaagacacgcuaaguacacaaaagcacuagaguuagccaccauuaucuguaccaagcgagucagcucccacugaagcuagcagcugcucucugguucacaacgcuagugucagaggccacugacuaggcucugccaaggugaaugucccagcaagauggcucaguggguacagacgccugcugccaagucuugcugccuuggguucaauuccuagaucccaggugguggauggagaggacugacccccacagguagucuucugaccucuccacacaugcuggggugcgcgugggcgggcacgcgcgcgcacacacacacacacacacacacacacccuaaguaaauguguaaacauuuuuuguuuuuguaauuaugggcugagagaugguuuaacaguuuaacagucccuuccagaggaccccgcuucaaucccaggauccacauggugacucuguaacucccauuuccaggggaucauaugcccucuucuggccucccugggcagacaugugauauaaaggcaggcaaacaccaauuuuuaaaaguuaauuaucaccucaguugggagcagcaaucaaaauagccaucgcuucacaaaugguccgcuuagggcuaggcacacagguucaugguagaacguaugacuagcaugcgcaggcuguggauucacuucuaguguugcuacauaaaccagcugugacgacacacaucucuggucccagcacucacaaagauccagagaacaacguggcaggcaggcugugugaaccgccaugccgcucaggugggcaagcagagcuuugggccuuguagaagcaaggauggugguccucacugacuaugacacacagcuaggacaggaugucaggccaagcauaugaaguggcagagcugcuauucacaguggccaucgaggugguaaccauacuucugaucucccccaggaacacgauguggagcggcuggagcgcaugcaggagcaguuaaagaaggcuaccgccaugcuaggggaggcucucgggagggaaggcugaccccacgccacuccuuccccacacucccugaggcucaggacuguugaccucagagccuccuuucaccgggcauucugcuccacuuccaacugguagggacuggaagcaaggaugugccugagaaccaagccugagagaagccuaugggcaggggcugggcuccggcugacucaggaccccgcccaccccuccaucccugagugaauaaagcacaaagcaa

SEQ ID NO: 3659 - RNA, 9265 nt, Mus musculus
uuaaaaguuaauuaucaccucaguugggagcagcaaucaaaauagccaucgcuucacaaaugguccgcuuagggcuaggcacacagguucaugguagaacguaugacuagcaugcgcaggcuguggauucacuucuaguguugcuacauaaaccagcugugacgacacacaucucuggucccagcacucacaaagauccagagaacaacguggcaggcaggcugugugaaccgccaugccgcucaggugggcaagcagagcuuugggccuuguagaagcaaggauggugguccucacugacuaugacacacagcuaggacaggaugucaggccaagcauaugaaguggcagagcugcuauucacaguggccaucgaggugguaaccauacuucugaucucccccaggaacacgauguggagcggcuggagcgcaugcaggagcaguuaaagaaggcuaccgccaugcuaggggaggcucucgggagggaaggcugaccccacgccacuccuuccccacacucccugaggcucaggacuguugaccucagagccuccuuucaccgggcauucugcuccacuuccaacugguagggacuggaagcaaggaugugccugagaaccaagccugagagaagccuaugggcaggggcugggcuccggcugacucaggaccccgcccaccccuccaucccugagugaauaaagcacaaagcaaagcacccgggcucgcaucacacuucggcucuggagggucgggaccugaaauaagcaggaaggcagggucagucugggcucugguugucaggucugcaauuuuauuaaguuggaaauuauauuaauauuagcacuuaagucaggcaggguuggggucaucaggaagagguuuggaugccggggaaggcgguugucgguuuuggcuccugccacugugaaccacgaugucaucauauucauccugggaacagagagggguagcacagggucaggcagcugccaccuugcccacuacccgggucacagcacccaaagaaugggugucaccgugaagccaguguucucacucucagcacaccauacugguggccacggcuccgcgcugcuuucucccaccacugcauggcucuucuccccgagcucccaucucacccaccccugccugggugggcuguccccuggguucuucaguaaugcucccccucaccacuggcugaggucuuucccuaccaucaagugaucuagacacucuaaccgaggucaccaaccuacaccgcucuccaucugcugcucccaacgucacuccccacauagggucucaccaugcaccccuugcuggccucaaacucacauccacugccucugccuccugaauccugggauccuaggcuaaaggugugugucacaugacagauggccuuagcuguccagcugccacugccacccuugcccaagucuaugacuguuccccacaucuccucgugugucccuccucuggauuccccgacaguauccauccgguuagguuuucucguugcugguuuaccccgacccuccagcugggguacccacucccaacucacgcccucaucucuguugucacugucacugucgcugccgcugcugcugcaagggcuaagcuuaucguccucguccucagguucaggggccccaugugcacggaggaggcgggcaaggaugggguugggccggagcagggcacugccaagcggggugcggcccccauacaugcgggcgguggggucagcaccggcuuucaggagaaguuccagcacgcuggcugccugggcuucuacugccaggugcagagggguccggccacacguaggcuccugcaggaugugccagagaggucagugagacugaagagaggacagugccuuccccacacuggcccaccacagugucuuaccgguuuauugaggucggcuccggcaucccugagcagccggaccaucucugcaucuuuguggaugacagcuacauggagugggguauggccugggaacagagcaauuggugucagaugaugagguaagaagccuuggcucaggcuagagagauggcucagcgguuuagagcacugacugcucuucugaagguccuaaguucaaaucccagaaacacaugguggcucacaaccaccgguaaugagcucugacguccucuucuggugcaucugaaaacagcuacaguguacuuaacauauaauauaauaaauaaaccuuuaaaaaaaaaaaaaaaagagaagccuuggcucuguguucauccuaggaaagggccaugugagcuaaggaugccaauaugucaggucccagggcuggcuucucaaguccuuccuagguaugcauacaggcuccugaauuccaggugcaagccuaagucugcugugucugggaucuacagggcaugagaccggggacucuaaaugaaagcacacgcacaugaucuguggaucaagccgccaaaucuuugaucuuccuccacaaagagcagaggccugaccagcaugcacagcccuugaguuccagccccagcaccauaaauaaaacaaaagauacagugacaauaacaguaaaaguccccaaaagggccuggggcucaggacucuggcuaucagaugaccucagucuauucaugaggcggggcugagaggguaacccgcauccucugccccuggcuggggacaugggauggauccucucaucauggucaggcugggcugguggcucauacucgggaacaauucuggagggaagucaccuugcagauggguagcccugguuuaaccacuguauccuggcaucucuggaccuguggcugacaggucuggguuauaaguggucugacgucuagaccugugggagaggggccuuguacguccaauucuuaguacuccugagacuguguggagggccuuaguccagaugcuaggauuuacggagccuagggaugacuucccaaggagcuaguuuugcuuugaggguuuuuugagacagggccugaauuugaccucaugauguuucugccacccaagugcugggacuggguguuuguuugagauggggucuccuguaaccuagacuggccucaaacuagcuagcaccaaggaugaccuugaacuccugauccucuggcuuccagagacugguauuauaggcauacaccaagcuguuuaugccggggauugaaccuagggcuuuacguaugccagaugagcacuccaccaaccaggguaugucugaggccauuggcuacaacucagguugggugagaggagcugggagccugggacuggccaggagcucacaucuuccccaaggccuggggcucucaccaucauaguuuucagcuucuaguuguagccuccagucuucaucacgcggcuccucuucguucucuggguuggguugggaauccacggcagcaggggcauggcuggugucugggguacaguccuggcucugagugagguagguaucugaggcaucucuuggguggcugggacggggcuggagcaguacgcacgcgcacgugugugcccugacccggcaggccaagugcaaugccguguggcccccucucucagccaccaacacuccugcaccggcugcauacaacuucucuacuguagaugccuccccaaggauggcugcuagaugcagggcugucuacagggauagagagaagggguuaguuagggccacgcugacaauccuggacccacccggcucccuacagcacacauccccauggcucacuuggccuaggucauucugcaggucaagguacucggugccggcggagaagcccaggaggaaauccaggaagggcucaugcugaugaaucacagccaagugcagggcucugaggacaaaaggcagaggucagugucacagagugucuacugugugcuacaaacuguggccacgguggaaaccugucaguguuccggagagucgagggcagaagcuaaucuagcacuuugucuggcugcuccguguucugagcuaagauagggucuucauaaguggcccacacugaccuugaguucaagcccucccaccucagccuccugaguagcucggcugacaagccaggggaauccauagacuuagugauuucaauagcucucgucaccaauaggcccagcuaccaaauuuguuucaccuguguuaacuaaguaacauaaucaguguaguagcucuaauuccagcauccgggaaaccugaggcaggaggauuguuaguucaaggccagacugggcuacauggugaguuccagagcagcaggguuaaaaacuaaauaaugagauucgaucacacacacauacagaaaugcugggcauggcggcccaugugagagaggcaaaagcgguggaucucugagaaucccaggcuagccugaucugcauggugagcuccuggucagcuagggcuacacugugagaccugucucaaauaauaauacgguaauaaagugagguacaaucgagguagacagccaguauggaucucuguccuccacacauaaacauacacauacacacagacaagcuggauacgauggcucucaccacacacauacacagacacacacacacacacacacacacacacacacacacacucaguguagcucuaagaacagaccuucaaauuacauaaagcaaaagcuaacaaggagaagaagcaacagacgaauccauaggugugguaacuucacuaggucucugucaccaacuguuccaacaaguaggaaagcaggagcaaaugaacggcagggcucugugguggcugcugcccugucuuugcagucaugaggacugaaccuaagguagcuugcaugcagggacgcuggcugccacugagcuaccugcuauugguuccccucauuuugaaguagggccucgcugugaauguccccagccuggacuugaauucacucuauuccucggcagguccugaccuugagcuccuccugccucaaucuucuuuguagcuggaaucacacgcccagcuuugaacaacacugcuaaccaacauucccucuaagucacacguugucaaaaugaauuccaccggcacacaguucccgagagcacucgcccagcacucagaaggcccugggucugauggccagcgcugcaagagaaaaacuagagaccgcaaaucagacaaaacauguucucugcccgcaguaaaaugaaauuuaaagcugguaacagagagaucuggaaacuccuccaagcgugaaaaaugaacauacuucuucauaaccuacuggccaaaggagaaaccaagagaaauuagaaaauauacucauuuaugcaaaaauaaaaacacaauauaucagaaguucuccagagggaauauuuacagcauuccaagcacauuagaaaagaagagagaugagcugggcaguggcuugcuugguagacugcuagcuuagcgugcauaagaaccugggaucaaucccaacucugcauaaaccaggcacgcaccaccuugcccggaauuccaggcaggaagaccaagaguaggguaggguaggagcaauggcuuagcaguuaagaacacuuguugcugccgggcagugguggcgcacgccuuuaaucccagcacuugggaggcagaggcaggcggauuucugaguucgaggccagccuggucuacaaagugaguuccaggacagccagggccauacagaaaaacccugucucaaaaaaacaaaaaacacuuguugcucuugcagaagaccccgguuugauuuucagcaccuacauuguggcucauagccaucccuaacuccaguuccaggggauccaacauuuauacacauaaaguaaaauuauuugggaagcaggggcagacauaucucugaguucaacgucagucugcucuacauagagaauuccaggacagccaaggcuacacagagaaacccaaucucaaaaaaccaaaaauaaauaaaauaaaccaaagaaaaauuucauaauguguagacagaaucucuuauaggcaacaccugucaauaaaaaagcaaacggccaaugagcugaagcaggaaauaggaggugggacacuggcaggaaaagaaaggauucugggaaauagugagagaauaaaaggagacacagggagagacacuggaggagucacugagagagacaccgagaaagacgaugcuaaggaagaagcaggcccgagacugaaggaaaacauagaaugauuuaaauggguuaaauaaguuauguguuagcuauggaaugggccaaagcuuguagccaaggcauuuauuaauaaauaguuaaugccagaguccuuauuguugggaauuaaguggccggaagaaaaaaaaaaaaggauucauuuuuuuuuacaguaguguucaaggcuagccugggcuacauagugagacacugacuuaaaaggggggugggguuggaggcugggaaauguuuugcuaaguaaagcacagugaccuuaguuuagaacccacauaagaaaaagcugggugugauuguaaguauuuauagucccaacacuagggaggagaacccuggaauggagcacaguggugcgcgccuuugaucccagcacuccggaggcagaggcagguggaugaguuugaggccagcuugguuuacauagugaguuccaggccagccacccugucucaaagaggaagaggaggguagagagcaagagaugaccgcugaggcucucaggccagcuagucuagccuacgugcucagugcagcccaagguugcccucuaguccacacacacacacacacacacacacuccccaggcgggauguagugauacccacuugggagcugaaagcaggagaaugaaauguucaaagcuauccucagcuacaaaguaaccucaaggcuagccugggcuacaugagaccgucaaacacaaacaaucgagaaaggaagggggaggauaaagaaagcacaaaaaccagacccaaaguaaccagagggaaauaauaaaggaacaggaaccaacaaaguagaaagugaaaacuaaggcaacuacuccuggcucuuuaagaugaguguuuguuggguuccccucaugggucaggcacugagucacugggcauacgcaauaagcacaaaggacaagaaaaucccggguacaaucccuuaaugcacgccgucaccacaaccaucccuucuccccagcuuaucuacuaaucaacauuuccuacucuuuaaccuuuuuucagucacccucuccuccuuuuccucuucccuccuuuuugauacuggguccuuccaggcuguccucggacuagugauccuccugccucagccccucgagugccagaaugacaaguguguaccaucacacucagcuaaacuaaaaccagggauuggaaggugguaguuugggagaagcauuuggcuaacagaugaaucuagccucauagaauagaguuucuacaucuuauguagcucuggcuggcagggaacucaaucagguggccucaaauucacagagauccaccugccuuugccuuccaagugcugugagagccaugacacccaccagcucaauuucuuaacugcagggucaauacuggacgugucagcuucagagacucagggccaagaacuaguuuugaaaucaaaaucuggcuuauacaagaauagccaaagaccaaagacuacaucuggaaguaagagguaagaagaugugggaacuagaguggucggaaagguucagauccgauuuggggaucaggagcucaaauuuauagaguucaaaaaaggugagacacuugacugugugaaagcguaccagucucacaauuuaguguuuggggguuaagggccaggaaguccagcaucggaaaucaagaguuaggaacgagacgauacgaagucacaggaaucguaggcuaaaggggacucagguaagaucccagggcucagucuaguaauuuaagguuuacucacguguccccauccucagugacguagccaaagacuaagggcgcccacgacagcucugggccaagcucugcgcccagaccugguccuccgggagccgcugcgucgggaccuagagagcccaggccgcugucgcaccauucaucggcauccgcaguuuuccccaagcacgcgaccccggccauggccccagccaccucggguggcccccuguggucgccugccugucgcugggcucugcgaugagcuccagugcuuccgcccuaucgggaauuccccaacacgcccccucauauacccaaucaaaauguuuuaaauagcuacaccccgccccuguacugcaccacagccaaucagaaaaaugagguggacauucgcucgcugaguuuccccacauuuuccagacgcccuuuaucaauauggccgccggcgccaggcuuuuugggauuuguaguuugauaacaugagaggcacauuguacgaaagcgguuauggggaucgcauugccugccgggaguuguaguucucuauccuaucucggccucuucuuguuuccgcugccgucacgggacagagcagucggugacagucccgagggcccccaccccguucccauggccgagccggaccgugaguuaggggcccuguugggagggugggagggucgggccgcgccggggccuggcuuugggcugcaggccccggggcccgaggguaggcucgguggggcgggagacaggaucuaccugaagggagugggauucggagggguguugcuaagugguccguauuacuagguugguugguuucuggauugugaaauguaaggguccgauugucaaguucuuaaugaucgcauuucucguacuuuggcugcugaggacccucguugcuaaggaccaaaguuaccacuaucccgguugcuaagguugucuguuguuaagggcaacuguaggauggguuccggggaccccuguggccccuuacuaucucauuccuucaguucuugugccucuccuaaaccuccuaccuucacugcaucuccucucccacacucaacucucagcagaaguaucccuacuuacgucucuugaaaaacuuagcccucccucauucucucgacucgcacaugcuaccauauccugcuuaacucugaaaccuuccuucaguccagucucgccugcuuucuccuccuaaagauuccccuccucagccuuuucacgucacacauaccuccacucuaaaauaugccuuuucccaucuccgauaguuuuac

SEQ ID NO: 3660 - RNA, 9265 nt, Mus musculus
guaaaacuaucggagaugggaaaaggcauauuuuagaguggagguaugugugacgugaaaaggcugaggaggggaaucuuuaggaggagaaagcaggcgagacuggacugaaggaagguuucagaguuaagcaggauaugguagcaugugcgagucgagagaaugagggagggcuaaguuuuucaagagacguaaguagggauacuucugcugagaguugagugugggagaggagaugcagugaagguaggagguuuaggagaggcacaagaacugaaggaaugagauaguaaggggccacagggguccccggaacccauccuacaguugcccuuaacaacagacaaccuuagcaaccgggauagugguaacuuugguccuuagcaacgaggguccucagcagccaaaguacgagaaaugcgaucauuaagaacuugacaaucggacccuuacauuucacaauccagaaaccaaccaaccuaguaauacggaccacuuagcaacaccccuccgaaucccacucccuucagguagauccugucucccgccccaccgagccuacccucgggccccggggccugcagcccaaagccaggccccggcgcggcccgacccucccacccucccaacagggccccuaacucacgguccggcucggccaugggaacggggugggggcccucgggacugucaccgacugcucugucccgugacggcagcggaaacaagaagaggccgagauaggauagagaacuacaacucccggcaggcaaugcgauccccauaaccgcuuucguacaaugugccucucauguuaucaaacuacaaaucccaaaaagccuggcgccggcggccauauugauaaagggcgucuggaaaauguggggaaacucagcgagcgaauguccaccucauuuuucugauuggcuguggugcaguacaggggcgggguguagcuauuuaaaacauuuugauuggguauaugagggggcguguuggggaauucccgauagggcggaagcacuggagcucaucgcagagcccagcgacaggcaggcgaccacagggggccacccgagguggcuggggccauggccggggucgcgugcuuggggaaaacugcggaugccgaugaauggugcgacagcggccugggcucucuaggucccgacgcagcggcucccggaggaccaggucugggcgcagagcuuggcccagagcugucgugggcgcccuuagucuuuggcuacgucacugaggauggggacacgugaguaaaccuuaaauuacuagacugagcccugggaucuuaccugaguccccuuuagccuacgauuccugugacuucguaucgucucguuccuaacucuugauuuccgaugcuggacuuccuggcccuuaacccccaaacacuaaauugugagacugguacgcuuucacacagucaagugucucaccuuuuuugaacucuauaaauuugagcuccugauccccaaaucggaucugaaccuuuccgaccacucuaguucccacaucuucuuaccucuuacuuccagauguagucuuuggucuuuggcuauucuuguauaagccagauuuugauuucaaaacuaguucuuggcccugagucucugaagcugacacguccaguauugacccugcaguuaagaaauugagcuggugggugucauggcucucacagcacuuggaaggcaaaggcagguggaucucugugaauuugaggccaccugauugaguucccugccagccagagcuacauaagauguagaaacucuauucuaugaggcuagauucaucuguuagccaaaugcuucucccaaacuaccaccuuccaaucccugguuuuaguuuagcugagugugaugguacacacuugucauucuggcacucgaggggcugaggcaggaggaucacuaguccgaggacagccuggaaggacccaguaucaaaaaggagggaagaggaaaaggaggagagggugacugaaaaaagguuaaagaguaggaaauguugauuaguagauaagcuggggagaagggaugguuguggugacggcgugcauuaagggauuguacccgggauuuucuuguccuuugugcuuauugcguaugcccagugacucagugccugacccaugaggggaacccaacaaacacucaucuuaaagagccaggaguaguugccuuaguuuucacuuucuacuuuguugguuccuguuccuuuauuauuucccucugguuacuuugggucugguuuuugugcuuucuuuauccucccccuuccuuucucgauuguuuguguuugacggucucauguagcccaggcuagccuugagguuacuuuguagcugaggauagcuuugaacauuucauucuccugcuuucagcucccaaguggguaucacuacaucccgccuggggaguguguguguguguguguguguguggacuagagggcaaccuugggcugcacugagcacguaggcuagacuagcuggccugagagccucagcggucaucucuugcucucuacccuccucuuccucuuugagacaggguggcuggccuggaacucacuauguaaaccaagcuggccucaaacucauccaccugccucugccuccggagugcugggaucaaaggcgcgcaccacugugcuccauuccaggguucuccucccuaguguugggacuauaaauacuuacaaucacacccagcuuuuucuuauguggguucuaaacuaaggucacugugcuuuacuuagcaaaacauuucccagccuccaaccccaccccccuuuuaagucagugucucacuauguagcccaggcuagccuugaacacuacuguaaaaaaaaaugaauccuuuuuuuuuuuucuuccggccacuuaauucccaacaauaaggacucuggcauuaacuauuuauuaauaaaugccuuggcuacaagcuuuggcccauuccauagcuaacacauaacuuauuuaacccauuuaaaucauucuauguuuuccuucagucucgggccugcuucuuccuuagcaucgucuuucucggugucucucucagugacuccuccagugucucucccugugucuccuuuuauucucucacuauuucccagaauccuuucuuuuccugccagugucccaccuccuauuuccugcuucagcucauuggccguuugcuuuuuuauugacagguguugccuauaagagauucugucuacacauuaugaaauuuuucuuugguuuauuuuauuuauuuuugguuuuuugagauuggguuucucuguguagccuuggcuguccuggaauucucuauguagagcagacugacguugaacucagagauaugucugccccugcuucccaaauaauuuuacuuuauguguauaaauguuggauccccuggaacuggaguuagggauggcuaugagccacaauguaggugcugaaaaucaaaccggggucuucugcaagagcaacaaguguuuuuuguuuuuuugagacaggguuuuucuguauggcccuggcuguccuggaacucacuuuguagaccaggcuggccucgaacucagaaauccgccugccucugccucccaagugcugggauuaaaggcgugcgccaccacugcccggcagcaacaaguguucuuaacugcuaagccauugcuccuacccuacccuacucuuggucuuccugccuggaauuccgggcaagguggugcgugccugguuuaugcagaguugggauugaucccagguucuuaugcacgcuaagcuagcagucuaccaagcaagccacugcccagcucaucucucuucuuuucuaaugugcuuggaaugcuguaaauauucccucuggagaacuucugauauauuguguuuuuauuuuugcauaaaugaguauauuuucuaauuucucuugguuucuccuuuggccaguagguuaugaagaaguauguucauuuuucacgcuuggaggaguuuccagaucucucuguuaccagcuuuaaauuucauuuuacugcgggcagagaacauguuuugucugauuugcggucucuaguuuuucucuugcagcgcuggccaucagacccagggccuucugagugcugggcgagugcucucgggaacugugugccgguggaauucauuuugacaacgugugacuuagagggaauguugguuagcaguguuguucaaagcugggcgugugauuccagcuacaaagaagauugaggcaggaggagcucaaggucaggaccugccgaggaauagagugaauucaaguccaggcuggggacauucacagcgaggcccuacuucaaaaugaggggaaccaauagcagguagcucaguggcagccagcgucccugcaugcaagcuaccuuagguucaguccucaugacugcaaagacagggcagcagccaccacagagcccugccguucauuugcuccugcuuuccuacuuguuggaacaguuggugacagagaccuagugaaguuaccacaccuauggauucgucuguugcuucuucuccuuguuagcuuuugcuuuauguaauuugaaggucuguucuuagagcuacacugagugugugugugugugugugugugugugugugugugugucuguguauguguguggugagagccaucguauccagcuugucuguguguauguguauguuuauguguggaggacagagauccauacuggcugucuaccucgauuguaccucacuuuauuaccguauuauuauuugagacaggucucacaguguagcccuagcugaccaggagcucaccaugcagaucaggcuagccugggauucucagagauccaccgcuuuugccucucucacaugggccgccaugcccagcauuucuguaugugugugugaucgaaucucauuauuuaguuuuuaacccugcugcucuggaacucaccauguagcccagucuggccuugaacuaacaauccuccugccucagguuucccggaugcuggaauuagagcuacuacacugauuauguuacuuaguuaacacaggugaaacaaauuugguagcugggccuauuggugacgagagcuauugaaaucacuaagucuauggauuccccuggcuugucagccgagcuacucaggaggcugaggugggagggcuugaacucaaggucagugugggccacuuaugaagacccuaucuuagcucagaacacggagcagccagacaaagugcuagauuagcuucugcccucgacucuccggaacacugacagguuuccaccguggccacaguuuguagcacacaguagacacucugugacacugaccucugccuuuuguccucagagcccugcacuuggcugugauucaucagcaugagcccuuccuggauuuccuccugggcuucuccgccggcaccgaguaccuugaccugcagaaugaccuaggccaagugagccauggggaugugugcuguagggagccggguggguccaggauugucagcguggcccuaacuaaccccuucucucuaucccuguagacagcccugcaucuagcagccauccuuggggaggcaucuacaguagagaaguuguaugcagccggugcaggaguguugguggcugagagagggggccacacggcauugcacuuggccugccgggucagggcacacacgugcgcgugcguacugcuccagccccgucccagccacccaagagaugccucagauaccuaccucacucagagccaggacuguaccccagacaccagccaugccccugcugccguggauucccaacccaacccagagaacgaagaggagccgcgugaugaagacuggaggcuacaacuagaagcugaaaacuaugauggugagagccccaggccuuggggaagaugugagcuccuggccagucccaggcucccagcuccucucacccaaccugaguuguagccaauggccucagacauacccugguugguggagugcucaucuggcauacguaaagcccuagguucaauccccggcauaaacagcuugguguaugccuauaauaccagucucuggaagccagaggaucaggaguucaaggucauccuuggugcuagcuaguuugaggccagucuagguuacaggagaccccaucucaaacaaacacccagucccagcacuuggguggcagaaacaucaugaggucaaauucaggcccugucucaaaaaacccucaaagcaaaacuagcuccuugggaagucaucccuaggcuccguaaauccuagcaucuggacuaaggcccuccacacagucucaggaguacuaagaauuggacguacaaggccccucucccacaggucuagacgucagaccacuuauaacccagaccugucagccacagguccagagaugccaggauacagugguuaaaccagggcuacccaucugcaaggugacuucccuccagaauuguucccgaguaugagccaccagcccagccugaccaugaugagaggauccaucccauguccccagccaggggcagaggaugcggguuacccucucagccccgccucaugaauagacugaggucaucugauagccagaguccugagccccaggcccuuuuggggacuuuuacuguuauugucacuguaucuuuuguuuuauuuauggugcuggggcuggaacucaagggcugugcaugcuggucaggccucugcucuuuguggaggaagaucaaagauuuggcggcuugauccacagaucaugugcgugugcuuucauuuagaguccccggucucaugcccuguagaucccagacacagcagacuuaggcuugcaccuggaauucaggagccuguaugcauaccuaggaaggacuugagaagccagcccugggaccugacauauuggcauccuuagcucacauggcccuuuccuaggaugaacacagagccaaggcuucucuuuuuuuuuuuuuuuuaaagguuuauuuauuauauuauauguuaaguacacuguagcuguuuucagaugcaccagaagaggacgucagagcucauuaccggugguugugagccaccauguguuucugggauuugaacuuaggaccuucagaagagcagucagugcucuaaaccgcugagccaucucucuagccugagccaaggcuucuuaccucaucaucugacaccaauugcucuguucccaggccauaccccacuccauguagcugucauccacaaagaugcagagaugguccggcugcucagggaugccggagccgaccucaauaaaccgguaagacacuguggugggccaguguggggaaggcacuguccucucuucagucucacugaccucucuggcacauccugcaggagccuacguguggccggaccccucugcaccuggcaguagaagcccaggcagccagcgugcuggaacuucuccugaaagccggugcugaccccaccgcccgcauguaugggggccgcaccccgcuuggcagugcccugcuccggcccaaccccauccuugcccgccuccuccgugcacauggggccccugaaccugaggacgaggacgauaagcuuagcccuugcagcagcagcggcagcgacagugacagugacaacagagaugagggcgugaguugggaguggguaccccagcuggagggucgggguaaaccagcaacgagaaaaccuaaccggauggauacugucggggaauccagaggagggacacacgaggagauguggggaacagucauagacuugggcaaggguggcaguggcagcuggacagcuaaggccaucugucaugugacacacaccuuuagccuaggaucccaggauucaggaggcagaggcaguggaugugaguuugaggccagcaaggggugcauggugagacccuauguggggagugacguugggagcagcagauggagagcgguguagguuggugaccucgguuagagugucuagaucacuugaugguagggaaagaccucagccaguggugagggggagcauuacugaagaacccaggggacagcccacccaggcaggggugggugagaugggagcucggggagaagagccaugcaguggugggagaaagcagcgcggagccguggccaccaguauggugugcugagagugagaacacuggcuucacggugacacccauucuuugggugcugugacccggguagugggcaagguggcagcugccugacccugugcuaccccucucuguucccaggaugaauaugaugacaucgugguucacaguggcaggagccaaaaccgacaaccgccuuccccggcauccaaaccucuuccugaugaccccaacccugccugacuuaagugcuaauauuaauauaauuuccaacuuaauaaaauugcagaccugacaaccagagcccagacugacccugccuuccugcuuauuucaggucccgacccuccagagccgaagugugaugcgagcccgggugcuuugcuuugugcuuuauucacucagggauggaggggugggcgggguccugagucagccggagcccagccccugcccauaggcuucucucaggcuugguucucaggcacauccuugcuuccagucccuaccaguuggaaguggagcagaaugcccggugaaaggaggcucugaggucaacaguccugagccucagggaguguggggaaggaguggcguggggucagccuucccucccgagagccuccccuagcauggcgguagccuucuuuaacugcuccugcaugcgcuccagccgcuccacaucguguuccugggggagaucagaaguaugguuaccaccucgauggccacugugaauagcagcucugccacuucauaugcuuggccugacauccuguccuagcugugugucauagucagugaggaccaccauccuugcuucuacaaggcccaaagcucugcuugcccaccugagcggcauggcgguucacacagccugccugccacguuguucucuggaucuuugugagugcugggaccagagaugugugucgucacagcugguuuauguagcaacacuagaagugaauccacagccugcgcaugcuagucauacguucuaccaugaaccugugugccuagcccuaagcggaccauuugugaagcgauggcuauuuugauugcugcucccaacugaggugauaauuaacuuuuaa

SEQ ID NO: 3661 - RNA, 21935 nt, Mus musculus
gaucgcauugccugccgggaguuguaguucucuauccuaucucggccucuucuuguuuccgcugccgucacgggacagagcagucggugacagucccgagggcccccaccccguucccauggccgagccggaccgugaguuaggggcccuguugggagggugggagggucgggccgcgccggggccuggcuuugggcugcaggccccggggcccgaggguaggcucgguggggcgggagacaggaucuaccugaagggagugggauucggagggguguugcuaagugguccguauuacuagguugguugguuucuggauugugaaauguaaggguccgauugucaaguucuuaaugaucgcauuucucguacuuuggcugcugaggacccucguugcuaaggaccaaaguuaccacuaucccgguugcuaagguugucuguuguuaagggcaacuguaggauggguuccggggaccccuguggccccuuacuaucucauuccuucaguucuugugccucuccuaaaccuccuaccuucacugcaucuccucucccacacucaacucucagcagaaguaucccuacuuacgucucuugaaaaacuuagcccucccucauucucucgacucgcacaugcuaccauauccugcuuaacucugaaaccuuccuucaguccagucucgccugcuuucuccuccuaaagauuccccuccucagccuuuucacgucacacauaccuccacucuaaaauaugccuuuucccaucuccgauaguuuuacuaccaucccugacucugaaauaauuagguugguggguccucuuguccuccaccauugugagcccuucugcuuaacucuuuccccgcacuguaaccacgucugcuccccuccuccccagccucugacccucuggagacccaggcagggaaggugcaggaggcucaggugagauggggaagggguggagggaaggagagacuugguuccacgugccgcacuggggggagguggcaagggaaggcuuuuacccaagggcccuuggcuuauggcccugauccccaagcccaucuggggauuaguacaaucuccugggagaaugguggcuucuugggacugucaaggaaaauguauagccucaaccccugguucccuuccauaucguccucguuuccuacuguugcccaucccauccucagccccuucugaaccucauuugugcuggaccugaaagagacgguuuuccaguucaauccgcaaacucagauccuaugaggugggggaaaggacccuauagggcacguuauaaaaguaucgaagcuggguguggugccagcccccuguaaugccagcacaugggggggggcaggggaggggggaagugagguaggaggauggagaaaggagaggcagcuugggccauauggugagacccagucucaaaaaaggagggaggaagggagagagcauaccccuggaguaccgggcaaacucugugggucagagauuauagaagauucuagccaaacucuccccugguggaacccacaagcugaucuaggaacaagaccaagauauagucacagugucguauaagugaagugauaagggauuuucuuaaaugagaucggaggugguguuccaugcaggguacaggccugagagcacgaagggauaguagauguuucaguaguuggguugcuggcguggucauuuauugauacucugccugaauuuuaauguacaugacuucauuuaaucuuugcagcaucccagugaagggaaggccucucauggcuguguuacagaugagcagcuuacuuggugaaaacuguuaaccccuguguucuuuggguagaaaggaaagggcuugaaacuuauggggaaaugggcuccgaaagaugcugcagcuucaguggaguguagaugagccaucucaaagauguuugaagacacgugccaaggccuccgguucccccagaggccagguuguccucauauacucgaggagugguucucaaucuuccuaaugcugcaaccuuuuaauguagcuccaacgguguggugucccuccaaccauaaaauuauuuuguuacuacuucauaacuguccuuuugcuacuguuaugaacuauaauguaaauaucagauauguaggauaucugauaugggaccccccccccaagagagggucgcuugaucccuaaagggauugugucccacagguugggaaacaguguacuggaccaugccuacaaccacugaaugccagcaugcucauccuaugagaccacacuucgaagggaggcaggugcagaagcuguggucaacaauacccccauaagagcugugacagccugcugugggucucuagucucuuacuugucuggcucccaaaugaaggcuuaaugccagacuaaaaaaggguuucacagucaaaagggguucucaguggccaagaagauguggggugucaauugcagcauuauccagauggggcaacgcuagcagcagccucaguggcugucaggagagggagucaaugaaccacgguucaucauacaauguguuacuauggagccacaauaaagaaugaggugggggcuggagagauggcucagugguuaagaauucuauuccagagaaccugaguuccauguaccaggcgcucacaagugacuauaacuccagucccaggggaucugacucuauggagacuugcacacacaugcacauauucacauaacuaaaauaaacuaaagagaaugauguaggucugugaaacauugugcaguaucuuacucuggcaagacccaguucuauaauaaugagcaaaugcgcaaaaccucacgccgagaaaccacguagaguuaucucuguuuaacuguugcuugguuuugcuuugguguuuguucguuauccaggcucaggaggccgaagggggaggauuaggaguuggaagccaucuuagguaaaacaguaagacuuggacaggcucuuuuuaaagcuuuuaucuuuuuuuuuuuuuuuuuuuuuuuuuuuuuuuaguuucaugugcauuggcauuuugccugcgugugugucugugugagcgugucacauccccuagaacugggguuacaggcagcucugaucugccaugugggugcugggaauugaagcagucagugcucguaaccacugagccaucucuccagacccucuuuuuaaaauuuuacaccuaguuuguuuuguguguguguguguguguguguguguguguguguguguguuuaggauacacacgccacaguauauguauggugaucugaggacagcuaucgucuccucccaccauguggggccugggaaucaaacgcagauugucaggcuuagcaggcagccccuuccccuggugacccaucaugccaacuuaugucauuuuuuaauaucagugaagaaucauucuagagucaggcaugauggugaugcaauccuguaauccuagcaccuaaaacaauaaaaauagaugggucaggaauucaaguucacccucacguacauacaaguuagagccagccugggcuaugucggacccugucuuaaaacaauaacaacagaagaaucuuuaaaaauaauuuagaaaggagauuuggaagcagaguguggaagggaaggucugggggccuuugagcagggaguugacuguacuggucagacuguguggcaucugcugcaaggccagcccugggcuggccccagucggcauguguugagugguagaugguucuggaaguccuguuaucuaggcugggcaguaagcaguaaacguaaugucccugcccuuguguggcugauauuguggcacucaguagauguuugugauuuggggacgggggaaggauuaaagaagagagagguggacuguccucaacaggccaucauaugaucuaagacagaaacugagucaaggaggccagggcaggaccccaggagagaacacguugaaccagguggagcucuaggguugggagagggagucaguggaaggaugucaggaggcuggcaucccaguggguacacugggaauuggcaugaggguggugagguagggaagccaaugaagggacagggaggccacuuaguauggggacugggagcaggagcugguuuggggagauucugaggccacuuuggaacaugguuggagcaagguggggucgcccugagaggcucauguccggugucagagaaguggcaucaccaaugacuaggcugugguauagccagccgaggcaccuaggggcucgcugcucggcuucacagcaaccucugagcuauauggacaaguugcggcccaugggcuuggaggucuaucucgaggucaccuagcaugcaugaagccauggcuucaggcccuagcaucuugucaggcugugauggccaacuggguagaguguuggaugugcucccaacaucaugcccguaaucccagcuuuagagggguggagacaggaagaucagaaguucaaguuacaaagacuucauagcaaguuugaagccagccugggcuacauaaaacccuaacucaaaaagcaagcuaggcaugguggcauaugccuuuaauccuagcagucagagagaggcaagugguaaucuagucuacauagugaguucuaggccagcuagggauauauaaagugagacucugucagaagaaaaaagaugggacaagcaugcaggugcaugccuuuaaacccaggccacagauccaggcagaucuucaggaauuccaggucagccuggucuguguaguaaguuuuaggccagccagagagaccccaucuugaaagaaagauaaggccuagaggagagccagguccucucucuaaagcaaccuuucccagaguccuuacacuggcccuguacuucuucagggcaccucccagucagagcccuacuguauuugaaccagguugucacccuucccaucccuucccuucccuucccuucccuucccuucccuucccuucccuucccuucccuucccuuccccgcuaaccccacuucuugggcuuggccaucccacccaccccuuccaggauucagacucggacacugagggaggagccacugguggagaggcagagaguaagugucguccuggaggagggcagggaggugaucuggggucugggauuagaggaugggauucuggggagacccccuccaagcuaccggagugauaggcaaagcauguaacaaugguuugggacuggaugcugcugucugugggagacauugggaguugagaugugggaggagagugugugcuugggcccuggcucgaugcccaccuggcgcugucucucuuguuguuggccaguggacuuccugaggaauuuauucacccagacccugggccuggguucccaaaaggagcgucuucuagacgagcugacccucgaaggagugacacgcuacaugcagagcgagcgcugugaguccccaauugcuuggccgcuucucccauuccuggccccaguugacuccauauuuugggggguaggaguaguaagaaagccugcuguauacaccuguaaucccaaacucugagcagauugggaaaggaccagcauuucaaguuagccucugcuagacugugugugugaggcuacccugagcuacaugggaaguuuuccuaaaauucagaaagaaaaaagauggaggaaacccaacucuugggauggagagaugguuuaguaguuaagagcacuagcuguuuucccaaaagaccuagguuggguucccaggacucacaugauggcuuacaaccaucuguaacuccaguuucaggggauccuacuuauggccaccaugggcaucaggcaugcauguagcacacaacauucacgaaggaaaacacccauguaguuaagaaaaaaaacaaaaaacucagcuugcuggggggggggguggugaacgccuuuuaccccagcacucgggaggcagaggcaggcagauuucuauaguuugaggccagccuggucugcagagugaguuccaggaggugacugaagccagaagaucaugaguuugaggguaacaugugcuacauaagauuguuaacucaaagaaagaaaagagaaagacaagaaaccagaacucuagccaaaaacaauaaaaaggagcaugcagacucuuaagcauuaaaugugauggagccaggcucgaggacauuguuaggacauuguucucaggccucacaagucugucugcguagggugaaggaaaguccagcaggcggcuccugcuugggaggguaccuuugcacuuaagaacaaggccacauuggcccagaagccccccccccccccccccggauggaacucagccccuacacucacacaccacgcuaggcaggcacucugucauugagcuacagccccagcccuuccuuuccuacuguuuuauuuugaacgcccugaauuuacccucuagucccugaaggucgauccucuuaccucagccucccacauagcugggaguacagaguagcaccacuaggccugccuuugggucacuucccuagugaaucuauuacugucuucugaugggccaggccuaugcccuagacuggaagugaucaaagcucuggggugacucaggugaggcuaaggaaauugccacaugcugagcauacauaugcucagcaugccgagcucaucugcaggcccagccacucuggaagcugaggcuagagcaugugaauucagaggcagccuggacuacagaaaaaagagggaaauggaaugaugaugguggcccacaccuuuaaucccagcagaggcagggggauuucugaguuugagaucugccuggucuacagagugaguuccgggaaagccaggguuacacagagaaacccugucucaaaacacgagagagagacagagagagacagagagagagagacaaagagagacagagagagagagacagagagagagacagagagagacagagagagacagagagacuuaggagauuaucucaguccauuaagugcuggcagcucccacacaagcagcucacaagugcuuguaauucccgggcuggggaggcagaggcaggagccaagcucagguccccaugagacucgugagacccugccuuaaaauccgugauggcaccaguuguccucucacuuccuuccacauguuugcugugaaauacacgcacaaagagaugugugcacaccaccaaacaaacaaauaacagcccauauacacacuagguggauggcccuggagaaauacacacacacacacacacacacacacacacacacacacacucgagagauaagugauuagaacaggacccgaucucuugagagauacagaaguguuugccaugguauuauuacaggaagcuugucucagacgugcuguuuagaagccagcuagcugggucaccgugaaauugauauuucuugcugaggucgagucaccgaagucugagaacccaggcccucgcaguccccguugggaacaaugcagcuuugaggguccugaacagcccuuuguugaggccaucuucuccaguuuccccuuggcccagcugcucagcgcccuccuuggcagccgggauggcagcugaaccucccucuccugccacaggcugggcagccggccgccuacagagcauacccacacaguggccaggcgacacugguccucccucuuacacucagaucugagagucccuggcccauagggugcuggugugggacgugacauaaauaucaacuaagcagacccuugcuguucgccaggcucugggcuaaguagcucaccaagcauccuugaaccuaauuaucacgcaauagcugugaggucuuucuagaagugagcugaacagaagaggaaacugaggcacggagagguugugacuuggugugaacauaugcaaggggcacagucagggcccuugaagcucggucuuguucuguagcuguggcaagcuuugaauuuaagauuuucuugccucagucucuggaguuuugguauuacaguguuaccacacccagucucaaugccuacgaucuccagccagacuugggccaguaacauccuaaagaagcugagugcauagacuguagcaggcucucugcugucauuuguuuuugguuugguuugguuuuuuuuuuuuuuuuuucuauguaacagaccuugcuggucugcaauucacuuuauagaccacacuggccucaaacucacagagauccuccugccucugcuucccaaguucugggaauaaacacauacgccaccaugccugguuuaaacauuaucuuugagugugugugcugggggugggugggugaugugggcauuacuguaggugcaugcaugcuacuguguuugccaggggacaucuuugaggaguuauuuuucucguucuaccguguaguuuccgggaaucaggcuuagcagcaagugccuuuacccacugagccaucucgccagccccgauggcagacugacuucuguucacacgugucccuuaaacagaacaccccaggggugcccaauucaugggauaccacacuugugucugcccaucagcugacagacagaugucggggcucuguguggcugggcuguaggccagccagcagcuggggcagcaauagggccauuucuucucagcucugugccugugaauggauucaauccuaucacccccuaauaguucuuuaaaaaccaagaacaaagcccccauaagaguaugaaccauggaucugaagaagcauaauacaccggaggggcugggggcucggcuuggcucgguugguggagugcuugcuuagugcacaggccccuagagucagucuccugcaccacacacaacaacgggcauagcaaggcuugguggcacccacuccucccaacgcuugcaaggucacugcgaguucucaugcugagacccugucucaaagaaagaaaagaaaagcugggcaugauggcaaugcugggcacuuaaagauggaagcagggugauuggaaguucaaggugauccuuggcuggcugcacagugaauuuaaugcuugccugacguccaugagauccuguccaaaacaaacaaacaaaaaaaccguuauuuagugcaauugacucaaaggagcagacuuuaggcuuuugugugaacaaagcaggauggugaagggauguguacagcuagaaacagguccuagccagucauuggagcuccugggaggcugaggagggagguacaggauuccaggccagcccaggguacauagggaggcacugacucaaaaccagagaaaccagcagacaugcuggugcacaccacaacaccagcacccaagagguggagccaggaggcuccgaaguucaaggucagccuuagcuacauagaaggcucaaggucagccuuggcuauaugaaaccuugucucaaauuuucuuuuuuaaguguguguguguguguguguguguguguguauaagcaugaguguagauguacagaugcccucaaaggucagaggcacaggauccauggagcuggaguuaacagguggcugugagcucugccugacaggggugcuggaaauugaacucaggaccucuggaaaaggaggagguguucuacccacugagccaucuauguagcccucaucuguguguguguguguguguguuuugaacaagguuucucugugugucuuuggcugucuugaaacucacucuguagaccaggcuggccucaaacccacagaaaucugucugccucugccucccgagugcuuggauuaaagguguacacaacuaccuucugacccaaaaguaauuuuuuugaagucuuacaguauuguaccuagaagauuagucauugucagaauuugguuuggauugauugucaaggacucaaacuagccgucucuguacugccgaacuuugcaaggcguccccaccucaccccaccccccaucccucucccuucuccuggguggcugugucuccucaccugaaaugugagguugccaaugccauccugcccggcaccagcaguacgucuaggagggaaaccuuagcaugugccaucaauccucuguuccaggccgcaaggucaucuguuuggugggagccggaaucuccacguguaaguuccccguccuucagccacuccuggggcugggggaggcuggagggguucgugcacacgugggcagagccucugacugcguugccuuccuagccgcggguaucccugacuuccgcuccccguccacuggccucuaugcaaaccuggagaaguaccaccuuccuuacccagaggccaucuuugagaucagcuacuucaagguagacggcuaagaugaggggagguggcucccaacuccaguccuugucuuaccugggacauguggcccucugcuccucucucccacagaaacauccggaacccuucuuugcccuugccaaggagcucuaucccgggcaguucaaggugaggucaucuucugcagggagccugggaagaguaggcauggaagcaggcucuuuauaggcccuccaggcaagcauaacaugauuaagaaccuagcuucuggggccagcaggaugguuccauggguaaaggugcuugcuaccaaaccuaaugaccugaguucaaucccuggaauccucaugacugaaggagagaacugacuccaucauauucucugaccuccacaugugcacuguggcaagugcauauccccagguagaugguuggauggagggagagacagauggguggguagguagauagauggauggauggauagauggauggaugguggguagauagauggauggaugauagauagauagauagauagauagauagauagauagauagauagacagauagguagauggguagauggguagauagagauauuguuaaagaaaaaagaaaagaauuacauaaguucuggccagauuugauaguucauccccauaacuguagcauuugggaggcagagacaggaaacuuucaaaugcaaggucagccaaaacuaccuaucucaaaaguaaaaaaaaaaauaaaaauuaaagaugaaagaggugaaagugggagagauggcucaggguaaaagagcagauaguacucuuccagaggaccuggguucaauucccaggacccacaucaggauguucauagcccccuguaacuacagcuccggggagccugacaccucuggccucugugggcacuagaacucaccuccauauaccaacagagacccacacacauaucuguaacuaaaaauaauuggaaugguagcuuagcaguucagugcacuggcuccucuuccagaggaccuggguucaauucccagacccacauggcagccuacagcuaucuguaacuccaguuccaggggaucugacacacacacacacacaugcagacaaaacaccagucaaugcacauaaaauaaaaauaaauaaaucauuuaaaaaauuccagcucgggggccgggcggugguggugcaggccuuuaaucucagcacuuggaaggcagaggcaggcagguuuccgagaucgaggccagccuggucuacagagugaguuccaggacagccagggcuauacagagaaacccugacucgaaaacaaacaagcaaacaaacaaacaaacaaacaaaaacaagaaacaaaacaaaaaagaaaacaaacaaaaaaauccagcucuuggugagaggcaggaagauuucugugaguuugaggcuagccaauuccaggcuuaccuagagagacccuaucucaaaaaccaaaaaaauaaauaaauaguaaaauaaacaauuuuaagaaauuaaaagaaaggaggaguggguugccuggccccucgucucuuuauccuguggcucugggccucaguuuacccaacucuaagaaagcugcugagacuaucaggaagggcugagacugaagccuggcugugagccugacucugcaguuuaccuauuggugaugccaaaaagccgccaccaugcccuugccugggucuccucauuugugguacgggagaaggcaggcucacccucacugggccacugagauggggccauggggcagaaugggcccacagcauggccugggacauucacaucagcacuguuacucuucucucagccaaccaucugccacuacuucauccgccugcugaaggagaaggggcugcugcugcgcugcuacacgcagguaggcggggccacgggcaggugugaccauggguaggcaggaccuugggcaagcgugaccuuggguggcagggcucgagggcaguaggccagaugggucuuggaacacucggucagagcugggcuaacacaggcaggcacaggaccagggcucagcuaauuauagugaaugaccuacaaugggccacuuccucuuggccucaguuuccccuuuguaaaauaggggacggaaacaggauagauugguacucauuggaaucaggagaaaggucagaaauucaagguugcuggaugguaguggcauaugccuuuaauuccaguacucaaaaggcagaugcaugcagaucucugugaguuugaggucagccuggucuacauagaaaguucuagaagagccagggcuacacagagaaacccugucuugaaagaccaaaaaaaaaaaaacccaaacaacaacaaaaaccaaagaaagguuaucauuggcuacaaaaugaguuuaaggccaaccuucaggaugugagacuguaucucuaaauuaauugauuagucgauuaauuacaauauaaacuaauagaagaauguuuaaauauaaagaagucagaacagcuucaagcccucucaagucugcugugaggugacaggugacaggacaucccagacuuacugcaaaaggccucuguaucugaggggacaccguccauaccacagccacuccaaaucaggaaagugacacuguaucguaaggaaggugggcuucuuauucauacacuucugagccuggccuuggauacgguggcuaaugggacacuguggccacacugagguucagacggauguucaggcugcuggcuucuaugugucucugugcguuuuguggauguguugaaguucagacugcucuguguauacaugugugcuaaaaaauugucucagaauacaaaguggccauuacauuacacacuuguuaucccagugcuugggaagccgaggaaggagcuggucaugaguucaaggccagccugggcuaauaguggauuuaaggucagacuggcuccauagcaaacaaucucccccgccccccgcccccucccccgcccugcccaagaagaaaaaguuagaaaggaaaaagagagaacuccaaauuguacagaagaguuaaugcuugaauacaaauagguuugaagcucuugcaaugucagaaauggccaccagggggaggauggguucaaacuuuuggguccagauggcuggaggccccagcuggggaagagacagcuuaguccuuccaggcaccgcccaagcucagagucagccucauucacagaaagaggcucaggccugauacuaacagcuuccuugaagccccauacuuccugcuuguuguugcaugucccuccugcacccuuguuugcuggccucuaugacaacagguguccacccaaguaccaggcccuaccagugagccaagcagacaccgcugcccuccuggugccaauucaugugugugacaagaacaagagggacgaugagucauagaccuagggugucagauggggcugagaccagccugaaguuuggaagucagaggacaaggugcaggagucaguccuuccuuuccaucgugugggucucagggauggagcucaggucaucaggcuugguggccuuuaccugagcaucucacuggcuccacacauaaacuuuaaagggagauuuauuuuuauuucauguuuauggauguucuuccugcuuguauguccaugaccuauguguaugcagugcccacaguagccaagagaggcuuuaacagaugugugcugccaugugggcgcugggucccaacccggggucuucugggagagcauccaacacucuuaacugcugagccaucccuccagcccccacacguacauuuuuguaaaauaucugaagguggaaaaaaauguuccacuugcccccuuuguggucagcuuuuuuuccuucguggccucuucuccucagucaccguuugaaucacugacccacuuucuggaacacagugacuccgccucugaguugugccgacacagcaucuuugaagcuguggugcuguuuuuagcucugcacaggaacccaucgcucaagccacugugguccccacagaagaguggcuauagaccuucaaguugcauacaugaaauucacccuccaggaaguucucuguaugccccaaacccagccucuugucuggggaccccucgauacucacaccauagagcagcaccaugcuuuuuaaaaucgaagaguagucuuuuucuuuuuuucuuuuuccuuuuauuuugggugugugucugcugcguuaguuauauaggccgcagggcuuccggcaugcuggggaagugcucuaccacugagccacacccccagcccaggcaagaccugaguuuguaaucuucugucucacccuccuguagcugagguuacaggcuugcucugcuagcccagcucuacugugcaggcauuggguacaggcggcagccuaccacgucaucaugaggggaaacugcaaacuuacaucagugaugugcaguaggguaggugucagaggccugcuccacucaggguagacccaacucacggugggcuuaugaggacagagccccauugcaagggaaggagcgugucuguggauauaauccaacaugaucagagaucucaggcaucucccuccacccuagacuauguuuccuuugaucacagaggcugccggagguaauucugugaucccuuaguuagcuguuugugugugugugugcugcucacucuccaaugaagggcuugguagacugagccagcgacaaagcagaugcagagugcgggguguggcagugcuccccugucauccuggcacucuggagggagguucuccaguuugaggcagucucaaaaaaucauauccccccccaaagaaacaaauaagucauucucuuguuuuauuuauucauauuacauuauuuaguguguguaaaguucagcugacaacugaaggaaggcguuugcuucuaccaugugaugucuggggcccaaagccacguugcuauguugguagcaaggaccauugucagcugagccaucuugucagcccuuacuguggcuuuuccagacaggugcuagucuugucccagcuugccugaaucucacccuguuccucaggcuagccucaccuuuacagcagucuagaauuauaggcauggccuaccaugccuggcuuuauuuacuuauugcuuauuuauuucacuuuuuugaggcaggucuucccauguagcccuggcuggccugacauuagcuauguagccucagcugacuuuaaacuuaaagcaguccuccuaccucagccucuaauugcagggcuuauaggcagucaccaccacugcugaccugauucaguuuauuuauguuaaugcuuggccagagcugucacauacaagcuacucaggugggauccccacaaggaugccacaucugagggagacgcugaagauagguacauuuauugcaauaaauguguggcaaauggagggacugugcguggcucucuaacaaaagaacuucucugaaaauuagaggcagugacccaaguuuguagaagaauaucccaugggcauccuuuagcaaccuucuguggccccacuggggaagcgggcacuuuccauauauccucacccuuccucaucccccgcaaugccacuucucagagccaccagggcuggcugucuuccugaccuccccucccccuccagaacauagacacgcuggaacgaguggcggggcuggagccccaggaccugguggaggcccacggcaccuucuacacaucacacugugucaacaccuccugcagaaaagaauacacgaugggcuggaugaaaggugaggcuggacucugcgggcaggcaggccucgggcaggccagggggagguaggggguggggggcucucacugcuugccugccauagccagccuccaagggcugggccccagugcagucugcuccauucuuuggcucuugcuagucagugaguugguugguuuccacugaggcuaggcuucccuauguagcccaggcuggccuggagcuugcacuucugccucagccucucuaguacugagguugcuugcaggcgugcacuacgguacccagcugucuugcuuuuuaugguagcuguagaagccucaaggauucaaggugacagcaggucuuugcucccaugccaccccucugcugggcugucauccauaugaaccgcagagcacggccagccacguguggacuccguguagacucacguccucaacggucacacagccugugucucugagguguuuacuaucuaucuuacauggcaaacacggcuaccuucugaggaaggcauugcacaguggaaccuuccgagacgaggaggccugugucuacguccaacauggcuccacuugccccaugugccuacugaagcaaagugucuaaccucugcugccaccaugugggucccaggaacuggacucaggcgcucaggcuugaggauggaccaccucgcuggcccagaacaguuuaauuuuuauuauauuuuuuaaagauagggucucuaauuucauuaaguucuuguugguuuaaguuguagaagucgcaggaggaaccaugguacaugccuauuagccuauugcuugggagaggcaagaggaucaggaguucaggguuagccuuggcuacauacuaaguuccaggucagccugggcuacaugacaacaugaaaauaaaaacuaauaaauuuuauauaagucuuauguagcucagccuuccauguuggacagugcagcaggagccuguggagagggaagcugggugcugugcuggguaagacaagugcuggagacacacaugguagcucacggcugucacugcugucacuguccucauucaugugaggacacagcaacugagaggacagcuaguccccgcgccugggugccagcaccagucuguucuggcagccauugugcugagccugaagcugcugugucaacugugggaauccauuucuguauucuuuaugcugacuucacaaagccucugguguccccuugagaucaggacagcuguggccuuuauagcaggacccuggaagguagcucuucugacagaaugccagccagcugcccccagacugaggguuccugagcagcccaugugugcacagcugggggugacggacaauggacaucacccccuuuaugucccuguggaaucgcaucuuccacccacagaauagcauauuugugcagaaauaccucagcagcagccguuaaagcuucgcccugugacuggcuguaugaguggcuggcggagugagcuccaguccugugggcugcauguggcagaugugcuuucagacuccgugauccauaaguaagaaggagugugacuuucauaaggguggucugucccauaaggagucugucacagaauccgagagugggaaacaguugggcuugagguuugauccaacccaaggcuaucuguauguccuuuccugacccagggcagauaggacuguccccaggacccauuggaugacucccauuccccagaugggggucugguggaguccaggggcaccugucuggggcagauggguuugccccuguauaugcccuuucacucacuagcuguggugcugccagccaccccuggaugccuggaggugaaggggacggcucucuaagaagggagcuccucucugugaagcaggaaagaccacucaggaaaugccugaguagugagcugugcuguuuguuuuguggcgcugcggaucagacuaggggacucgggcauucgaggucagaggcucuuccacugggccacacccacagcccccauacugggagacucaaagcaggcaucuccugcugagucgugcccaagcccucuugguuccaccgcugagcuagccuagcucuugggguuugugugcgcauguguguaggugugcacauggcauagcaugcgugugcaugucagggccaucugcaggagcugcuucucuccuuuuagcaugugggaucuggggacggaacucaggccaccaggcuuggcagcaggucccuuuacacacugagccaccuugaagccucagcucuuauuuuuuugagaugugguuuuguuguguagccaaggcuggccucaaacucacaauucuccuguuuaauucucccccaagcaggcuugcggcaugcaccacugccaccugccugggaugcauuucuguugacaggagggaggggcagaagagggcuucuccagcagcccuugggggagccucacaacucacccccccuuccucuuucccacucagagaagaucuucucagaagcaacucccaggugugagcagugucagagugugguaaagccuggugaguccugggcccggggcuggagcugggaccccuuccuccacggccucaccccccaaucuggccacucugccaccuggcccguccccuacuguucagcagagggugccccgccccccaagccucaguugggccccugacuccugacuguucuagcucugucucccauaucuccuguccucugucccucugucccucugucccucugucugugucuaccgcagauaucguguuuuucggugagaaccuuccaucgcgcuucuucuccugcaugcagucaguaaguguccacucugggcugggcccaugugagggggacaaagccagaguagugggguccaaggccuuccugguuacuccccgcaggacuucuccaagguggaccuccucaucaucaugggcaccucccugcaggugcagcccuucgccucccucaucagcaaguagguugaggaggaugggacugggugucagcucgggacagggcacuagggcagauccugaaucucagcucccccuucccagggcaccacuagccaccccacggcugcucauuaacaaggaaaagacaggccagguaagucugccucagcuucccucccccucuccucccccccuccuucccugucccccucccccucccuccacuuucuuugcccccuuccucauuuggccacuuccucaggggacagggcaggucucugucccaccuggaaagcaccagauccuuagacuugccaguucagucaggagaacaugggagcuggccugugcacugggccucugucauucuagacuccacugagcacagaacagaaccgugccuugaaccugcugaagcccaagugcuuccccggacccaggagacaguccagacacuaccauucuagugcccucucacauaucaaaaucuggggacccucaagucccuccuaugaaguggcagaguguuuauauagagcaaucucugaagaugcuaagcugugucuccgugacgugugcgauaccaugugaacucaggagacaggcucccaugccccccugcccucucagacacgccacggaauuuaagaugaccuugaacuccuaguccuccugccucugccuuccaaguucuggcaugacaagccugugccaccacuccuggcuguguuguuguuuguuuagcagaaggauaaguugcuugccacgcaugcacuaggucccgaguuuaacugcuugcacccacauaaaaauccaggcaugguguuuguagucccacacuggagaggcaaagauuagugggucccuggggcucaccggguagccagucucacauaauccugaauuccaggccaguugagcaaugucucagaaagaaugugucugggccgaggcuguaacucagcggcagugcuugccuggcguaugcgcggcccugaguucaauccucagcaccaccaaagacgaagacgguuauuaguuuuggacuagagagaugguuuacugauuaagaccuucuguccccagcacccaugucagguggcucacaacugccuuuaaccccggcuccugggcaucugacgccucucaguccucugagcacucacacauagagagcacacaugcagucagauaaaaagaagccaaguggugguggugcacacuuuaauuccagcacuugggagacagaggcaggugaaucugaguuugagaccagccuggucuccuuaguaaauuccauauuagucaggacuauauacauauagacaccaucuaaucaaucaaucaauaacaaguuggcuaacuucuaagaaacaguaauuaugguuggccucuugguugaccucuagccugaccuccagguccacauguguacaaauauagacacauagcccacuaccauacacacacacacacacacacacacacacacacacuaauuaguaaauaggaaaauaaggcuagguaugguggugcacaucuuuuaucccagcacugaggaggcagaggaaagguggaucuuugugaguucaaggccagccuggucuacagagcaagccccaggacagccagggcuccacagagagacccuguuuuagaaauaagcauaaggcaggucugcuggcucagggcugugcccuuagcugucuucuccccacagacggaccccuuccugggcaugaugaugggccugggagguggcauggauuuugacuccaagaaggcuuacaggugaggcugggccugggugagcagcucgagaagggugggugaggagggagagaagacagaaggccggcugguccucagccuguucucuuacuccugcucacccugcagggacguggccuggcugggugacugugaucaaggcugccuggcucucgcugaccuccucggauggaaggugaggagcugggccaccccagcccacccugagcccaggcccaugggguuuacgguaaccugacuugcgucaacuuugcccccuacagaaggaacuggaagaccuuguccggagggagcaugccaacauagaugcccagucagggucacaggcccccaaccccagcacuaccaucuccccuggaaaguccccaccgccugccaaggaggcggccaggaccaaagagaaagaggaacagcaguaacaguaaccaugaccucccgcaggacagcggagcccggccagcacugggcccucuuaacaugcagcuugugugagcucaaagacccuucguucuuuaaccacguucuugaaaucaggguccccaacucaaucccagaaaagccuaauauaccuaggggcugaggccugugcagucuguagcuggggccucuaaccaccauagccucuaaccaccauagccucuaaccaccauagccucuaaccacccaggcaagaagcagccuucccuaacuucuaauuauucccagacaacaggcuaccccaaaaccccuaacagugccagaauaaggcauuucucuauuguuuucagggggccuauggcuaaaucaaauuaaccuaccccgcauaggggcuggacucuacaaauagaacuucacccaaggggguggggccuugugggaucucugagccugaaggccugccaacucucugccuccaacaaaguggguacuaggcucccuuuccuggggacccacuugccagcuguugguggaugagcaagagaccuugcuuauuagaaacaaauuaaaaaacaaaacaaagcaacuaaccaugacu

SEQ ID NO: 3662 - RNA, 6618 nt, Mus musculus
ugguuugguuugguuuuuuuuuuuuuuuuuucuauguaacagaccuugcuggucugcaauucacuuuauagaccacacuggccucaaacucacagagauccuccugccucugcuucccaaguucugggaauaaacacauacgccaccaugccugguuuaaacauuaucuuugagugugugugcugggggugggugggugaugugggcauuacuguaggugcaugcaugcuacuguguuugccaggggacaucuuugaggaguuauuuuucucguucuaccguguaguuuccgggaaucaggcuuagcagcaagugccuuuacccacugagccaucucgccagccccgauggcagacugacuucuguucacacgugucccuuaaacagaacaccccaggggugcccaauucaugggauaccacacuugugucugcccaucagcugacagacagaugucggggcucuguguggcugggcuguaggccagccagcagcuggggcagcaauagggccauuucuucucagcucugugccugugaauggauucaauccuaucacccccuaauaguucuuuaaaaaccaagaacaaagcccccauaagaguaugaaccauggaucugaagaagcauaauacaccggaggggcugggggcucggcuuggcucgguugguggagugcuugcuuagugcacaggccccuagagucagucuccugcaccacacacaacaacgggcauagcaaggcuugguggcacccacuccucccaacgcuugcaaggucacugcgaguucucaugcugagacccugucucaaagaaagaaaagaaaagcugggcaugauggcaaugcugggcacuuaaagauggaagcagggugauuggaaguucaaggugauccuuggcuggcugcacagugaauuuaaugcuugccugacguccaugagauccuguccaaaacaaacaaacaaaaaaaccguuauuuagugcaauugacucaaaggagcagacuuuaggcuuuugugugaacaaagcaggauggugaagggauguguacagcuagaaacagguccuagccagucauuggagcuccugggaggcugaggagggagguacaggauuccaggccagcccaggguacauagggaggcacugacucaaaaccagagaaaccagcagacaugcuggugcacaccacaacaccagcacccaagagguggagccaggaggcuccgaaguucaaggucagccuuagcuacauagaaggcucaaggucagccuuggcuauaugaaaccuugucucaaauuuucuuuuuuaaguguguguguguguguguguguguguguguauaagcaugaguguagauguacagaugcccucaaaggucagaggcacaggauccauggagcuggaguuaacagguggcugugagcucugccugacaggggugcuggaaauugaacucaggaccucuggaaaaggaggagguguucuacccacugagccaucuauguagcccucaucuguguguguguguguguguguuuugaacaagguuucucugugugucuuuggcugucuugaaacucacucuguagaccaggcuggccucaaacccacagaaaucugucugccucugccucccgagugcuuggauuaaagguguacacaacuaccuucugacccaaaaguaauuuuuuugaagucuuacaguauuguaccuagaagauuagucauugucagaauuugguuuggauugauugucaaggacucaaacuagccgucucuguacugccgaacuuugcaaggcguccccaccucaccccaccccccaucccucucccuucuccuggguggcugugucuccucaccugaaaugugagguugccaaugccauccugcccggcaccagcaguacgucuaggagggaaaccuuagcaugugccaucaauccucuguuccaggccgcaaggucaucuguuuggugggagccggaaucuccacguguaaguuccccguccuucagccacuccuggggcugggggaggcuggagggguucgugcacacgugggcagagccucugacugcguugccuuccuagccgcggguaucccugacuuccgcuccccguccacuggccucuaugcaaaccuggagaaguaccaccuuccuuacccagaggccaucuuugagaucagcuacuucaagguagacggcuaagaugaggggagguggcucccaacuccaguccuugucuuaccugggacauguggcccucugcuccucucucccacagaaacauccggaacccuucuuugcccuugccaaggagcucuaucccgggcaguucaaggugaggucaucuucugcagggagccugggaagaguaggcauggaagcaggcucuuuauaggcccuccaggcaagcauaacaugauuaagaaccuagcuucuggggccagcaggaugguuccauggguaaaggugcuugcuaccaaaccuaaugaccugaguucaaucccuggaauccucaugacugaaggagagaacugacuccaucauauucucugaccuccacaugugcacuguggcaagugcauauccccagguagaugguuggauggagggagagacagauggguggguagguagauagauggauggauggauagauggauggaugguggguagauagauggauggaugauagauagauagauagauagauagauagauagauagauagauagacagauagguagauggguagauggguagauagagauauuguuaaagaaaaaagaaaagaauuacauaaguucuggccagauuugauaguucauccccauaacuguagcauuugggaggcagagacaggaaacuuucaaaugcaaggucagccaaaacuaccuaucucaaaaguaaaaaaaaaaauaaaaauuaaagaugaaagaggugaaagugggagagauggcucaggguaaaagagcagauaguacucuuccagaggaccuggguucaauucccaggacccacaucaggauguucauagcccccuguaacuacagcuccggggagccugacaccucuggccucugugggcacuagaacucaccuccauauaccaacagagacccacacacauaucuguaacuaaaaauaauuggaaugguagcuuagcaguucagugcacuggcuccucuuccagaggaccuggguucaauucccagacccacauggcagccuacagcuaucuguaacuccaguuccaggggaucugacacacacacacacacaugcagacaaaacaccagucaaugcacauaaaauaaaaauaaauaaaucauuuaaaaaauuccagcucgggggccgggcggugguggugcaggccuuuaaucucagcacuuggaaggcagaggcaggcagguuuccgagaucgaggccagccuggucuacagagugaguuccaggacagccagggcuauacagagaaacccugacucgaaaacaaacaagcaaacaaacaaacaaacaaacaaaaacaagaaacaaaacaaaaaagaaaacaaacaaaaaaauccagcucuuggugagaggcaggaagauuucugugaguuugaggcuagccaauuccaggcuuaccuagagagacccuaucucaaaaaccaaaaaaauaaauaaauaguaaaauaaacaauuuuaagaaauuaaaagaaaggaggaguggguugccuggccccucgucucuuuauccuguggcucugggccucaguuuacccaacucuaagaaagcugcugagacuaucaggaagggcugagacugaagccuggcugugagccugacucugcaguuuaccuauuggugaugccaaaaagccgccaccaugcccuugccugggucuccucauuugugguacgggagaaggcaggcucacccucacugggccacugagauggggccauggggcagaaugggcccacagcauggccugggacauucacaucagcacuguuacucuucucucagccaaccaucugccacuacuucauccgccugcugaaggagaaggggcugcugcugcgcugcuacacgcagguaggcggggccacgggcaggugugaccauggguaggcaggaccuugggcaagcgugaccuuggguggcagggcucgagggcaguaggccagaugggucuuggaacacucggucagagcugggcuaacacaggcaggcacaggaccagggcucagcuaauuauagugaaugaccuacaaugggccacuuccucuuggccucaguuuccccuuuguaaaauaggggacggaaacaggauagauugguacucauuggaaucaggagaaaggucagaaauucaagguugcuggaugguaguggcauaugccuuuaauuccaguacucaaaaggcagaugcaugcagaucucugugaguuugaggucagccuggucuacauagaaaguucuagaagagccagggcuacacagagaaacccugucuugaaagaccaaaaaaaaaaaaacccaaacaacaacaaaaaccaaagaaagguuaucauuggcuacaaaaugaguuuaaggccaaccuucaggaugugagacuguaucucuaaauuaauugauuagucgauuaauuacaauauaaacuaauagaagaauguuuaaauauaaagaagucagaacagcuucaagcccucucaagucugcugugaggugacaggugacaggacaucccagacuuacugcaaaaggccucuguaucugaggggacaccguccauaccacagccacuccaaaucaggaaagugacacuguaucguaaggaaggugggcuucuuauucauacacuucugagccuggccuuggauacgguggcuaaugggacacuguggccacacugagguucagacggauguucaggcugcuggcuucuaugugucucugugcguuuuguggauguguugaaguucagacugcucuguguauacaugugugcuaaaaaauugucucagaauacaaaguggccauuacauuacacacuuguuaucccagugcuugggaagccgaggaaggagcuggucaugaguucaaggccagccugggcuaauaguggauuuaaggucagacuggcuccauagcaaacaaucucccccgccccccgcccccucccccgcccugcccaagaagaaaaaguuagaaaggaaaaagagagaacuccaaauuguacagaagaguuaaugcuugaauacaaauagguuugaagcucuugcaaugucagaaauggccaccagggggaggauggguucaaacuuuuggguccagauggcuggaggccccagcuggggaagagacagcuuaguccuuccaggcaccgcccaagcucagagucagccucauucacagaaagaggcucaggccugauacuaacagcuuccuugaagccccauacuuccugcuuguuguugcaugucccuccugcacccuuguuugcuggccucuaugacaacagguguccacccaaguaccaggcccuaccagugagccaagcagacaccgcugcccuccuggugccaauucaugugugugacaagaacaagagggacgaugagucauagaccuagggugucagauggggcugagaccagccugaaguuuggaagucagaggacaaggugcaggagucaguccuuccuuuccaucgugugggucucagggauggagcucaggucaucaggcuugguggccuuuaccugagcaucucacuggcuccacacauaaacuuuaaagggagauuuauuuuuauuucauguuuauggauguucuuccugcuuguauguccaugaccuauguguaugcagugcccacaguagccaagagaggcuuuaacagaugugugcugccaugugggcgcugggucccaacccggggucuucugggagagcauccaacacucuuaacugcugagccaucccuccagcccccacacguacauuuuuguaaaauaucugaagguggaaaaaaauguuccacuugcccccuuuguggucagcuuuuuuuccuucguggccucuucuccucagucaccguuugaaucacugacccacuuucuggaacacagugacuccgccucugaguugugccgacacagcaucuuugaagcuguggugcuguuuuuagcucugcacaggaacccaucgcucaagccacugugguccccacagaagaguggcuauagaccuucaaguugcauacaugaaauucacccuccaggaaguucucuguaugccccaaacccagccucuugucuggggaccccucgauacucacaccauagagcagcaccaugcuuuuuaaaaucgaagaguagucuuuuucuuuuuuucuuuuuccuuuuauuuugggugugugucugcugcguuaguuauauaggccgcagggcuuccggcaugcuggggaagugcucuaccacugagccacacccccagcccaggcaagaccugaguuuguaaucuucugucucacccuccuguagcugagguuacaggcuugcucugcuagcccagcucuacugugcaggcauuggguacaggcggcagccuaccacg

SEQ ID NO: 3663 - RNA, 1359 nt, Mus musculus
guagagucagugauuuugggagauuuaauuggaauagaaccauauuuagggggaaucuggggaggcuuuaacuauauauaauuuaaaacuuuucuauuucuccauugguggugagaggaucaguccucuccuuccacugugagaugcuaaggucaaacucucagcuugucaggcuuggacagcaguggcuuuuauuggcucggccauuuucccagaccuauuugcggguuuucuaaugcuaauuugaauauguugagaggcguuugugacuccuucccgagauaagguauuugugaggacuuggagacauugccaaggccugaaggcuucgggguuucuggagauuggaaguuauucugcagucuuuagggaacugggggcacuucuggggccccucaagccgggcucuggaguggcuggguacuuuucacggcuggugcuuuccaggauggagcuucaagacuuucucacgcacuucaacacagugcagauuuguucacugaguccugagguguugggccccagcccugcuggcggcggcuggcauauccacaucuuccagggccgcugggugcgaggcuucaacuccggugggagucagcccagcgcuggugaggccuuggggaccccugagaagcaaacuugggugaggcuuguggcaggaugggaacuccaccuccuucuuuucugucagaaaacuucuggaccaacccccaguuccggcugacacugcuggagccugaugaggaagaggaugacgaugaugaagagggacccuggggaggcuggggagcggcaggggcccggggcccggcgagaggaggccgaguccccaagugcacgguccuguugucacucauccagcgcaaccgccggugucugagggccaagggccucacuuaccucacugugggcuuccacguguuccaggugaggccaaggucaaguugagggucuggaggggcagagggucacaagggcaccguuaugggcagaaguguacuguggguucaaagaggagugccacugcagauaucauuggagaaagggauucaggaacaggaagagaaaaacguugaggguccgagagcaggaggggaccaaagggccagagaagggaugugggcacagguggaaaggaaaggguugggggaggggucagagaggaccuaggucaaagaugaggaaauauuaaggguucagaaagaaggaggggugugagagguguggaaggggaggaaggaaaucugcgagcucuccaaccuucauucccuugguguuuucuuccugcagauuccggaggagguggguaucagaugcggcuccagaauuacccuagggcuugauggaccagggcag

SEQ ID NO: 3664 - RNA, 1892 nt, Mus musculus
uaaguagcaaaguaguguuuugucauggagugaaggugugugcacucagaaggugaaggcacuuucccaagucacuuggccugcccucccuaagucccccucucugucacagugcagggccucauggagggcucaagaguggcuggcaagguuagauguauaaagcagacucccaacaccuaagaguggagcgggaucaugggccuugagcaagugucacuccuggggucuuuccuccgugcaggagaucgggcgcaucuccauugagaugaacgggacucuggaagaccagcugagccaccugaagcaguacgagcgcagcaucguggacuacaagcccagccuggaccugcuggagcagcagcaccagcucauccaggaggcccucaucuucgacaacaagcacaccaacuacacaauggaggugagcaccacugcccaggggagugggcugccaagugcuccucaccuuucuaaaaccaugcagaaguuaccaaauuguagacacaguaucuaauggcccaaauccuagccuucagucugggucagagcaggaggaaugggaggaguuugacuaggccagccuagacuacauacagagggagacccugucuuuacagacuaguguacaugggcauuugaaaagccguggcuccauaaguuccauucuagaguucccugacccagaaagggucacauucacaccuuccuauggccuuacccgagcagcaagcccaggacaucuguuggggcagcccaccagggcagugagguguguugugcuagaacagagggucccaucugcauuccacagugcugacccgugcugccacaaaccucgugggguuucagagagucagguaucgggcagcgacaagcauaauuguaaagaguugucauaugacccaagcuccuuggcccuugcucaucugaguaagugaggcgcauaauuggcaaaaguccugugucccuugucaguuggugagauacggagccccuucucccccagaccuuauuuguugacagccacccguccauccagucacgcccucuuccucccucagcauauccgugugggcugggagcagcugcucacgaccauugcccgcaccaucaaugagguggaaaaccagauccucacccgagaugccaaggguaucagccaggagcagaugcaggaguuccgggcauccuucaaccauuuugacaagguaaccucacccuacccuaccccaccccacuggcauagcauugccuuuugucucccucauuguaugucccuucguacccucuccaucugcacccauccauccauccauuccauccacuguccucaugaugggcaggaccccagaguacacacaaggccaggugggcacagguuccaggacucucagaguuuuuaaaauuuggaucuagacugguaaccucuugagaggaauucugaguguugaguuugauugucuccagaucuccuuucacccaguaccacagccacucaacuucugugaguaccagugugcagccucuuacccuguccuguaaacacugaagacagggaaagguccccucuaucuuugagcccuggacuugguccuccaugcugcccacuggaccccuacugaggccaugaagaccucucugccccaccagucccuggccaccaccuugucugcaucgccucuaacuguguguuucccuucccccugugucuuccuccccuguccacugcauguggcccggccccugcaucacccuguacgccugccuucgauggcccccgguaggaccauggcggggcacuggggccugaggaauucaaggccugccucaucagccugggcuaugacguggagaaugaccggcagguacgcgaaccacggccccagcag

SEQ ID NO: 3665 - RNA, 1230 nt, Mus musculus
ggauucggcuaugaggagaggguccaggagacacgauggaaaaacaccuguagcccagagaggcagaucaauacuaaagagcaaguaucuuggggauucuggcuggggggcagccauauuaguuugggcccuuaaaacuuguuauguggggcuggagggauggcucagcgguuaggaaaacugacugcucuuccagagguccugaguucaaaucccagcaaccacauaguggcucacaaccauccauaaugggaucugaugucuucuuucggugugucugaagacagcuacaguguacucauauaaaauaaauaaauaaguaaauaaauaaaucuuuaaagagaaauuuguuaaauaaauauaauaguccacucuuaauaauuugggagcuagcuggguuaagaggaaaauugcaacacuuuuaaaauaacacuaacagccuccauguuugccccacccccacccucuacccccucuuuuucucuuucucacaaacaguaagaauaaguaaacaaacaaacgaaaaauuccaaaagcaauuaaaaaaaagaaaaagaaaaauuaccccagcugggcacggugguauccacuuggaauacagcacuuuagaagcugaggcaggaggacuucugugaguugugggccagcuuagcucugggcuaugcagugaccuuuccaaaagucaaaagaaaaggauugugggcaaaacccuuucuuuaaauuaagaacguguuuuauuacaggugugcaaauguuugucugcaugaaggcgugcgcaccgcaugugugcgggacaggacccacggaagccgggaggacauuggaugcccugaaaacagaguugaggaugguugugagccaccacgugguacugggaauugaaccuggaucuuccucgagagcagccagugcuccuaaccacugggcggucucuccagcccuaguuguggauaauuuuacuuuuauuuugauggugugguuuugguuaggagugauaauguccuuguggcuugucaaauaaaaggaaggccuugugugugcacacauguugugugauaccacugauaagcaggguccagaacaggccaaucucuagagacagacgcugggcuagugguucccaggggcugaggaggagggaaggauagugacugcuaaaggcuguggggcucuuucuuggggugauuugauguuuuaaagugacaacuggugacaauuacaccauucucc

SEQ ID NO: 3666 - RNA, 1230 nt, Mus musculus
ggagaaugguguaauugucaccaguugucacuuuaaaacaucaaaucaccccaagaaagagccccacagccuuuagcagucacuauccuucccuccuccucagccccugggaaccacuagcccagcgucugucucuagagauuggccuguucuggacccugcuuaucagugguaucacacaacaugugugcacacacaaggccuuccuuuuauuugacaagccacaaggacauuaucacuccuaaccaaaaccacaccaucaaaauaaaaguaaaauuauccacaacuagggcuggagagaccgcccagugguuaggagcacuggcugcucucgaggaagauccagguucaauucccaguaccacgugguggcucacaaccauccucaacucuguuuucagggcauccaauguccucccggcuuccguggguccugucccgcacacaugcggugcgcacgccuucaugcagacaaacauuugcacaccuguaauaaaacacguucuuaauuuaaagaaaggguuuugcccacaauccuuuucuuuugacuuuuggaaaggucacugcauagcccagagcuaagcuggcccacaacucacagaaguccuccugccucagcuucuaaagugcuguauuccaaguggauaccaccgugcccagcugggguaauuuuucuuuuucuuuuuuuuaauugcuuuuggaauuuuucguuuguuuguuuacuuauucuuacuguuugugagaaagagaaaaagaggggguagaggguggggguggggcaaacauggaggcuguuaguguuauuuuaaaaguguugcaauuuuccucuuaacccagcuagcucccaaauuauuaagaguggacuauuauauuuauuuaacaaauuucucuuuaaagauuuauuuauuuacuuauuuauuuauuuuauaugaguacacuguagcugucuucagacacaccgaaagaagacaucagaucccauuauggaugguugugagccacuaugugguugcugggauuugaacucaggaccucuggaagagcagucaguuuuccuaaccgcugagccaucccuccagccccacauaacaaguuuuaagggcccaaacuaauauggcugccccccagccagaauccccaagauacuugcucuuuaguauugaucugccucucugggcuacagguguuuuuccaucgugucuccuggacccucuccucauagccgaaucc

SEQ ID NO: 3667 - RNA, 9672 nt, Mus musculus
ugcuuuuuuagacuaguaaaucucuacagccugcuuuaaagauaucgaugugcaaguguguguacaugugugugaguguguggguguguauuugaguguauaugugugugagagaguaugugaguugcaugagugcaugugagugugauaugaguguauguaugugaguguaugugagugugugugugugcaucugugcaacaguuagaggacaacuugcagaaguuagucccuaccuuuuuaaaaaaaaagauuuauuuauuuauuuaauguagugagcacacugucgcucucuucggacacaccagaaagggcaucagauccccauuacagaugguugugagccaccaugugguugcuggaaauugaacucaggaccucuggaaaagcagucaaugcuuuuaaccacugagccaucucuccagcccugucuuuuaauucuuucgacacuuuguucuuuucuuucuuuguccuuuggauauauucucaagaauugcuuugaaagacaugugcuucugggaguggugguuugcauccguacucuuccuacucaggaggcugcagcaggaggaucaccucaagugggcuacauaacuacauaauuaguugaagaccaaguucggccaacaugauccugucucaaaaauccaacaauuuuuuccccaaacuaaugaaaaucagcauagccaggcaugucagcacacacuggucaucccaucacgugggagguggaagcaggacaaggaauucuagaucaaucuagauuauucuucacagaauaacuaagucaguaaacacgugggcauagggagaagaggaagagaacuucccagagaacgugccugagugagaaggggauagaugauuggauggguggauuaaugaaugaaugagugaguaagugagugagugaaugaauggauuaaugaaugagugagugagugagugagugaaugggcuaaugaaugagugagugagugaaugaauggauuaaugaaugagugagugaaugagugagugagugagugagugaaugagugagugagugaaugggcuaaugagugagugaguaaaugaaugaauggauuaaugaaugagugagagaaugaaugaauggauuaaugaaugagugagagaaugaaugauugagugaaugaaugaaugaaugaaugaaugaaugaacagaugaauaagcaagcacuagaguggcgucccauacuaucuuacccaccuccaggaauccaguuggagggagaggaggaggagccagaggaggagagcacucugggaagccgccucaugagcuuguuggaaaaaguaaagcuggugaagaagacagaggagaagccugaggaggagccggcaccugaggagcacaagccucgugaggacuggggaccagggcgagucagggcggggcaggcucucuguagcagaacaggaaagcuagaguugggagagaugacggugcuuggagagguggccuaaugugugggcugaggcugacugugugcaaaugugugggcugcagcugacugugugcaaaugugugggcugcggcugacugugugcaaaugggcuggcugcgauggaugaccuuguggcgguguuacauaccagagcagaggugcaucuagcccgggauggugacagcuccaggacugugguggcuucuguguccucguaguccuugauuucaguuucucucauacugagaugauuacuaugggagggauuagaaaacucggguccguguugggggucacaaacuguguauuagccgcgcccuagacagagucucuaauguuggcagaaguuugauccucuaacuuuuuuugguuugguuugguguuuugguuuucuuuguggaggggguugggguuuggauauggggaggguuggguuuuuuguuuuuguuuuucuuuuuuguuuuuggguuuuuugagggugagguugcuuuguguucagaggaggucucauuauguagaccugggacuugcuauguaaacuaggcuggccucaaacucacagagccuccugccucugccuccugagugcugggauuaaugguggccugccuuuugguuuguuuuguguguguguguguguguguguguguguguguguguguguguacacaugacuauagguggcugcagaagccaggggagggaaggagggagggagggagggaaggagggagagagggaggguuugauuccugggacaauagaaaaguccuuugaauccuugugcuuguggcagguggaaaacagggcagguggugacagaggagggcugcccgcuccucugguucagagaugcaacccagugucccaaccuuuccccagaguccuugcaggagcuggugucccacacaguggugcgcugggcccaggaggacuucguucagagcccggagcugguccgugccauguucagccuccugcaucggcaguaugacgggcucggcgagcugcugcgugcccugccccgggccuacacaaucucuguguccucgguggaggauaccaugagccugcuggagugccugggccagauccgcucacugcucauugugcagauggguccccaggaggagaaccuuaugauccagagcauugggugagagcgccucccuggccuggcugcccgcccacgcuguacugccccccuccgcccacgcccacgugcuguacugcccccccugcccacgcccacgugcuguacugcccccccugcccacgcccacgugcuguacugcccuuccccccccccaugcccacgcccacacgcuguaccgccaugaugucccuuuguccuaaugguuaacccuccucagaagauccuggucacugugacucuuggcacaucugcuguuucugagcuuaaaguccucugcuguaacaaagggaaggacaaugccuccccuuuagagaggccguggggcuucagggaccugugcuuagaguaacaagcuagcagauuugggguggcaucucaggccugucaccuuagcacucagaaagcugaggcaggaggaucuugaguuccaggccauugugggcuacauaggaaguuuuagaccagccugggauacauagcgagacccuguguuagaauaauaauaaauaucaauaauugggcuggugagaugguucaguggguagaggugauugccgccaaaccugaagaccugaguucuauccccaggacccacgugguggaagaacuccaggaaguuuucugugggaugcauggaccucccccacauacacacaaacaaagaaacaaauaaauucuaaagggggagcacuggagagauugguucagugguuaaaagcacuuacuguucuuccagaggaccaggguucgauucccagcacccacaucaggcagcucgcaucuacccauaacucuaguuccuccgugugcaugguauacaugacacacauaaguagaaauaauuuuuaaaaauuguuuuaaauaaugcuacaucgugauaggauugagcauugagucaaaugcaacucagccauuuaaguuccuacuguaugccgggcccacacagacauuugggaaugcugcaggcagcaucuaccuuaggggagccugccuuggauccagaccucauuuucugugucugugagaucccauaaguauaacuccugccucccagaguggauguaaucaugauucuucaaagagcaagaugguagcucauaccugucaucucagcacuuggaaggcuggaaagggaggauuacugugaauguuaagccacccugggcuacauaguuucaggcuagccucggguaccagagggagaccuugucucaaaaccuaacuaaaacaaaagagacaaacaaaaaaggauggaugaauuuaaaucugcaaaaggcgccuagagagugcagacuguugucaccauggugaccaugaaucucccuggaugucugccccgcccccaggcugcgcuuaccccacauguccugucuguucacaggaacaucaugaauaacaaagucuucuaccaacacccaaaccugaugagagcgcuggguaugcaugaaacagucauggagguuauggugaacguccuugggggcggcgagucaaaggugaggggccuggauggaugugucggcucagggagggggacacagagagcaggcacucaccacugguccucccugucugcucccugcaggagauccgcuuccccaagauggugacaagcugcugccgcuuccucugcuacuucugccgaaucagccggcagaaccagcgcuccauguuugaccaccugagcuaccugcuggagaacagcggcauuggccugggugagcuauccucagcuacauaacaaguucaaagccaaccugggcuacccugagacucuuucucaaaaacagcauaaaacccaaaccuaggaaacaguggcucagacaaccuugacugacccacaguucacagagcagacaaagaauaaaguucagcccaacccagagccccgagcguugggauuggaaaagcucagaccagcagaggcacuuaguacauuuugcaaaggggguggucaggaaggacuucccagaggaggagacacagucaggaguugagaggggcuggagagauuacucacuggcuaagggugcuuauugcucuaucagaaggaccagaguucagaucccagaacucaguuuaugugacucacagucaccuccagcccuaaaggaucugguguccucuucuggcuucuacguuuaccugcaucacacacacacacacacacacauacacacacagagagagaugcacuuaaauaguuuuuuuuuaaaaaggagugggaaacucuaacugcucuuugucuccacaggcaugcagggcuccacacccuuggauguagcugcugcuucugucauugacaacaacgagcuagccuuggcauuacaagagcaagaccuggaaaagguguggccggaggagaccuggucacgcccaacugugugggcacaugcuggcucugagcacccuguucagacugaugcuggccaucccagggcccaaucagaaaggggcugacuugcaaggagcagccagcagccaguggcuccuuuacucugcagaagaggggcugggagcaggucuaugggcuacgcucccauccggguggcccugguuaucauagaggaguagggcuacagagccuuuggaguucagacacuagucaguaguuccacuccuuguugaguggccugggaaagagacggcuucuuuugaccucugucacuuaaucuguucagggaauaugcgaucaugauuuuuaagcauuuauaagccaggccugguggcucgugccgucaguuccagcacucugaggcagaggcaggcgugagucugugagucugaagccagccugauauucauagugagcuccugcaaggcugcauuagaaagaccguguuaaaacaaaacaaaacaaaacaaaacaaaacaaaacaaaggcugguuaaagaagcuaaaguaauauuugcauaaagcucagaaugaugugagcagcucaguggaccccagaagaggagcagcacagaggccuuggagcagcagaggacgggugauggcugggacagaagcagugggggcugaguggcgagaggugacaucacagagguccugugggccauggcaagguuguugggcuuuaucacaagugagacaggaccaguguugggcaggagaaggaagcccuggcucauguuuguggggugggugugagguagauaaggaccggaucuuggggaggagaguggucuuagacuaagcuccguuuccacguugcagguugugucauaccuggcaggguguggcuuacaaagcugccccaugcuucuggccaaaggguauccugacaucggauggaaucccugugggggcgaacgcuaccucgacuuccugcguuuugcugucuuugucaacggugaggcaggguggggccuguggggucacuggcuaagcuucccucuggugacauucaucuccugggcaggggucccucuaaguagacuugcaggucaacagggaccugacauuacccuugaguguguuagcuucugggauugcguggggguuccccaagagcucuccugaacuuucugggugccaggugagagcguggaagagaacgcuaacgugguugugcggcuguugauccgcaaacccgagugcuuuggaccugcccugaggggugaggguggcucagggcugcuggcugccaucgaagaggccauccgaaucucugaggaucccgcacgggaugggccggguguccgcagggaccggcgacgugagcagugaguccccgucccuguccccuuuccaggaugguagccaucacuaccaugucucuggauucuaaccaccaccuucuccucuccagcuuuggugaggagcccccugaagaaaaccggguacaccugggacaugccaucauguccuucuaugcugccuugauugaccugcuaggacgcugugcaccugagacgcauguaagcccugggggcggggguggggggaauggagaaagcaagguggggugggagggaguugggugugcaugaucagcauucaaccucagcauucagguacuggacagcauucauauagcucacuugggugugguccugggcugugaugcugggcauacacuuaugaccaaaacacccucagguuccaaacccguggagccuaaccaguagaggagggagacaagaugugaagaagcaaaggacuccugguaggaguagagggauuccucacggagaguagaaccaaaacuggugccacacugcacccuggcacacacaccuaugaucacagcacuguagaggcaggaguacugagucugaggccaggccaaguuacgugacaagacccuaccucauagcuguguaugguggcccacacuuguagucccagaacuuggaagauaaaaagcaggaggaucaaaaguuccaugccaucuuggcuaaauagcaaguuggaggccagccuggauugcgugagaacuugucucaaaaaaaaaaacaaaacaaaaacaaaacaaaaaaaaaaaacaaaaaaaacaaggggauaggcuguagagauggcucagugguuaagagcaccugcuacucuuccggaggaccuggguucaauucucaacacucacaugacagcucacaaccaucuguaauuacuguuucaggggaucugacacccucacacagaccaauguacaccgauguacaugaaaucaaauuaaauuauuaucaaacaaggggcuacugacucagugugugaaggcaccugcuaccugccaccaagccuggugacuugauuuuggucacccaugguggagggaggaacccgacucccauuaguuguguuccaaccucagcauauacaccauggcaugugugcccccuaauaaauuaaacagccagaaaugggggugcaagccuuuaaucccaaaacucaagggguagaggcagguggaucucugggaguuccaggccagccaggacuauguaacagagagaucccgucucaaacaaaauaaaacaucuccaucuggaaaaagaagcaacgucccacaaaacagcaucuccagggacaacugcacagcuauguuaguuggagcaacgagcuucaggcucaaagagagacccggucucaagaaacaaggaagagcaguggagaaagacaccugacaucaaccaaccucuggccuucacguggugguacaagugcacauaugugcauacacacacauaugcauguacacacacauacaugugcacaguuuugguccaauguaugcacaugcacacaaugcauacaagacauauacacaaaggaggcuugcuuuacugucagugcgucaggaaugguuagaauagaucaagucccagacggggcaccauugucuaaugacaugccucuugcccucugcaccaccuccaguugauucaagccgguaagggugaggcccugaggauccgugccauccuucggucccucgugcccuuggaugaccucgugggcaucaucagccucccacugcagauccccacccugggcaaagguaggugggagguggggggagguggaauuguugagggaggcugggaaggagcacaugcucacaccccaccauccccgccuguagauggcgcacugguucagccgaagaugucugcauccuucgugccugaccacaaggcauccauggugcuuuuccuggaccgaguguauggcauugagaaccaggacuucuugcugcaugugcuggaugugggguuccuuccugacaugagggcggcugcuucacuggacacggugaguaacgcccaccuggcuaaucgcccacaugccuccacccaggacaucugauaggcugagagacagcaucugcagaacugggacugcauacauauccugacaccucugugacagaagacaaaacccaugaaagacagagugggugggacucccccacuaccuucagauacaagaaagcauuggccgcaugaagugguacacaccuucuaccuagcaucagacaaaggccagaggacagagacuucacugagcgacaggcaaaucuugucucaaaaaaaaaaaaaaaaaccaaagugaaguuaggcgugggaaugcaggccuuuaaucacgcaggaggcagaggugggcuaaucacuguggucuacgaggcaaguucuggcuagccaagccuacauaaugagacccugucucaaaacaaacaaacaaacaaaaacugaagcaacaacaaaaagcugggcaugccuguaaucucagcacuuuggaaguaaaggcaggaagaguccaggccagcccgggcuacaugagauccugugcaggaggccagcauugcagagcagcuaaaucaaagucauacuuaguuccuggcuuucgugugugugugugugugugugugugugugugugugugugugugugugugugugugugagagagagagagagagagagagagagagagagagagagagagagagaucuggaggagugagauuuaggagaauaaaugauuagaagccuggguaccaaggcaacgccaagagucugauggucucacccuacaucccaggcuacuuucagcaccacggagauggcgcuggcacugaaccgcuaccucugucuggcugugcugccgcucaucaccaagugcgcgccacucuuugcgggcaccgagcaccgcgccaucaugguggacuccaugcuacacacaguguaccggcugucgcggggccgcucgcucaccaaagcacagcgcgacgucaucgaggacugccucauggcgcugugcaggugaggaggggccgaugguggcggagggagugggcggggucgccaaggcggggucucgcguaauaucucugcccucucuggccuuguccuccucagguauauccgcccguccaugcugcagcaccugcuucgacgccugguguucgaugugcccauccucaaugaguucgccaagaugccacucaaggugagggcgguccucagcggaagccagcccuuuucucacccacagucuggcugugccucuggaccaguggggucuuucguauuagccacgcccacca

SEQ ID NO: 3668 - RNA, 1296 nt, Mus musculus
cagaggccccgcccaccgccaccacccugggccuuccaagcucgcucacgcagcagacgcaggccgccgccgggcucccgcagcacgguggcgcagucuccgccgcagagcgcgcgauccgggcagugcaacgcccgcagccagccggccaacugccgcaggaacucuuccucuguguccgggccugcgggaggaagaagccaucaggaagcagcggguuccgcggcucuacccgccguccacccagcuucucacgcaccguggccggcgcccagcacugcggugcccuccucucgccgcuccagagcucccagagccgucagcucggccgccagccgcgcgcacagcgcccugaagucugcacacgcgggaccccgagacgcccccuccgggagggcaucguaccugcggcggggcacgcgucagugcgagucccucugcguccgcguccccaggcgagugcgcccuucccguacccccaggccacaccaccgaaucuuuuaccccagugucagaaggucacccgcuaccauggccccauccauggcaacuccgucugcggacccggugcgcgcgcccccuuccgccagggaaaggcuccgcccccucuucccuccgccuccucucucccgcugcuauccaaccauauucucgugcgaaggcgcuuccacgcuccuauuggcuuggucgcgcgccacgcgcacccuucagguaacuuguccaguguaaauuuuauagcuugagguuuggaucuacgaggucgcaggaggcucgggugucccuacuguccgacucucaagaaaaaaaaaaaaaaaaaaaagcaaaaagcaacuuauuuaacuuuuauacuuuuggaggcagggucucgauuuauacauuuauguagcucaggcuggcuucuuaguccugcuuccuccuucuguuugcugguugacaggcgugugacacgcccagcugcccuuuguucuuagugcaccccagaccgaaagucccauccgacuuguuuuucuuccacuuuaggauuagauuuucagcacgucuucacauccacucucccaccucagccagacccuccuuccaccucacaguggguccaguguuagccagacucucugccucuguaggccuucgaaagaaaaagcagaugccauugagaaacuccauccuaagggggaggcaagccgaugggacugggguugacuccauuugccagcuaauguuucugccaaacugguuuuuuccaucuaugcgauugggauccaagggcaauaaaguauauguuuuaugugccugaau

SEQ ID NO: 3669 - RNA, 11035 nt, Mus musculus
agacacagucacagacauuucuuggagcagaucucaaguccccucccucccccaaugacaaggcugggucuuuggcccccauccucccuccacaucagccugcccugacacuaacaagguuacagacuggcuuggaaucaagaucaggaagagaaauguuggcggaccucccccaaggucuggggggcaagcagcuggaaaauugggcucgggagcucuaggaucugaggucuuccuggcucccaggguucaguccuccaugcaccccagauaugggggcaaugaaagguaaucauggaucagagguggguaucgacaaggaacagggcaaggggaccugggagaggggguacuggagaugggggacuagggaaccuuccccaaguccccacugcuuaauccgaagaucucacagcaccauacagcacucuggucccccuccccaccccuucccaaaacgagguagguuaagaauggagcuucccccgcuuaccauggaagggggggagaccgaggcacaaagagaggauggggacgcaggcugccccagcccccagucccucugcccucagcucuggugggucugacaauugaugagagcugggcagaagggggaugggagggacacccucuuuccccauuuucucucacccaucccaggaucugcuugggggagcugaaucacagguuccggauacaauaaauaguuaauaauuuaaaggaagugacacaaauauucaucccuugaacccccacaaggccacccaagucuggguaaugaaaaaugauucaaguguacauucccagguacuuagggccagauguagguccuaagcccaugaaccaucaagacuuuggcucugaaaucuuaguucuccuauccaggacaccugauccuagugucucuacuuagggaaaagaggcuguggcuccucucuucuccauggggaaguacuacaaaacaauacugagcuuuucagagcaacccccaacugagauggaagagguucacaggggagggaccugaauguacuagggguuauagugugggaaaucugcaagguuggggugggggugggucuucuggggaucaauugcuggccccggaauuacaggugugcaaaggguaggccuucugcggucucugcuugaucccuguagcugccugccucugcugagcugacagcacacaaucuuccauagcaaagccaggcccuagagaggggaaaggggaaacugcuaggugaucccggauuccaggaaucugaauuuacacuggcuuaaguacccugcccuaggauaaagggggugggggugggagucugggcauugcuagggcauuucaguuuuaugggccucuggauggcaggacaugggagacggggaaaucagguagugaggaaaugggggcuucauuagucuacaaguacuuugaauucaagaacaccuggagccuaacggugcugaaagacuguggcaucuuguugcugaaugucucuggucugaagggaucaaggugucaggccaaaaccaaucccaaaauugugagggcuugacuccugcacccaggguccaauggcaucuugggucuuagauccagggcucauaaagcccuuuggauuugcucucgggcugagagucaaggaaugaaggaccuggguuaccaugaccaccgcaucuucuaaguuccaggcuuccacccaacgugguggaaggggaguguaggcagaaggaagccgauguuuccagaauauuuuaaaauucaggccuaagggaaaccggaagguuagcuaaucucuacaaaccaguguguugggcccaaagugcagguggccuucaggcagacauuuaaggauaccaggcaucucagagcccauccacaagacucaaauucucauggcuggcuuaaggaguagguguuuggagccuggcuccccccccccccccccagcaucuugguaucugauaucuggaccuugcugagcucugaaaagagccucccaaguaauuuuggucugaaaauaccucauaugugaggauaucuaaggaguuaauacauuuuaaaucuggggugcuagggaauuugcgggucacuugcacaugaacugauggcaaugucuguggacucucaggagcggguagaguucaggccaguaucuggugauuccaaaccauccuggggcuauaagagcaucuaaaugugaagauaccaggucucaggugaaaauucagggaccauuuucuggugauucuggguccucuggucucaaggucuaagucauuugauaauagugucaaguuugaguaacucuugacuaguuugggggccguaagaugaguguuuacaaugucaaguaugaccugaagucuggguugggcauuuagacagagucaggguccaagaugugagcuccugggccccuugagaugcaauguuugaaaauauucuaagucuucucaguggggaaaagguauggagaauccagaauucaggacuucgggugggcagacacccugaugaagcagggccucgguaucucaguccucaguuugggguccagguaccagaucugggaucucucaaauccauucaaguuccagauauaccuaaguuuggguuuuagguucauaugcuguucaggguccuggaccuucaauuuuugggucuucagaccgauuuccaaaccagcucaacaauccucaccgugcagccuccucguggcgacccccacagcccgcacagccacaacgugcugcaacccagugacaggcgcgcaggggcgcauaacaacagagacagggcacugccagagacagagcagccagagcagcccagcgcgcagcagggcguggguggccuggcucacaagcacacggguccgagaagucacccucggcgucugacaggcagugguacagcaagcucucggcacaccacaagcagcugagccggcgcacuagcaggcgaccugggucaggggccucugcgcagcgaccaccacgcccaucugcccggcggcggaagagugcucggcagugcacacagcgugcagccuccucagccucuggggaggcuuuggcuggagcagggguggggccuggaccuggggguggacgagcagggggugcugggggugcagccucugugagaggggcagggagugacacuggaggacccagggcugcaccccgcaaugcaccagucuuggcaaagcgcacaacgcagguagacagggcaagagguggaggcggugguccagaucgccgguaguccucauagccgcggcugccccagcccuggcucccugccccagcuaaagacucugaagguucaggaaucccagugaacgguagaagcggaggguagcucugcagagccaagggacaaggaggucugguuaaggacauuugcaacuuacucaauacccauaagcuacccagguucagaagacccaaaaucccagaaugcaaacagaaggcaucagucagaagggacuguguuccuuugaacucucuugggcucgggguuccucaugcccgcagaaacagaacaagguaggcagcaaacacacaccuuaagggccucauggcuuaagauuucccaguugggucacacucaaccccaagucccuccuucaggauaaaguaaacagucuuaagaaguccuuccauaguaccagcaucuucuaacacacuagaaaaccuauccacgucaucccacaagucccugcauaaacuaggcagcccucaaaucucccagaaagcuagagacacuuggaaguuccuaccagcucucgggaguccaugagucuuuguucccaacccagcgccuccaacaccuucccacuugcuagacaagcacucuauugcugaguuacaaaccucagccccaaacccaggcccuuucuauuccacuaccacuuucagcucaguccuuaucacucaguggggcuucagcagcagacagcuuagggagcuguccaauucuauucagguuuacugcugacgggcaggagggcagaggaggucauaccugagcagaggagcggcgccuuugugggggcguggccagugggaaggcagcugcugacuccacuguggcaaugggagcugugggaggagucuccuggcggcugugacuggaggaggagucgcuguccacgugggacugcgggagauuggugagaccucagugcaggggaguuccccaaccaaagaaagauccccuuacauagaccucccuucuaugcagaacaaguguucugcagccaggaggucugagcucaaaccuuugcucugccacugacugguugugugacaagugagcucaccuaagagcccaagugucugcucuuaaauggggggucaucauaguaucuauucuuaaggaugugaggacacugucucuuacagcacccucuacagcugagccaccucucucaauacagucucuagcuggugcucucagcaauagcugucccuaauccuagccccuugcuaguggauuguggguaaacagcuaccauuuagccacucccccagccuuucacuggcagauuccacuaugucaaacucaccacccuugcucacuuaggccaggccucaaacucaagaucaucuugccuucccucaggagcagcugggauuauaggugugugccacccagaccucuggauaugggcaccguuuuuacuagacuccuaauagaacaccaaacuacuauacacuauaccuuccuucccagaagcacacuuccuuggcccgccaguaccuugcagcuucguuuccacuacagcucaaaaggauaguuugcuugccuggacaccuuucuuccacccagaccaggcgucauacuuuacuagcugaaaccccacuucccaggccucugcucccuuuccuguaaaaccuccuaccucaucuguucacagccuccagucuauauccacugaccaccaccgcaugccagaagagucccauacacaggaacugugugugacugcuggaaggccaccuccaucccucaugaccuugagauucucuuugacccaaggaaauaguuuuguugaucuccguauuauuaucacucaauucaaugcacuuggcccaucugccuaacacucaccauguacugggcacuguuuuagggacuggaggugaagcaagguacuggcaaaagauccguggcuucugggagcugacaugcuagcauagagaaagggcaggaaacuaacagguaagaaacugucuuagagggccagcgagauggcucagaggucaagagcguggaaugcucucccagaggacccagguucaauccccagcaaccacauggcaguugcagguaauccaacacccucaugcauacaugcaugcacaugaaaauaaaaauaaaggcugggcgugguggcacacgccuuuaauccuagcacucaggaggcaaaggcagguggauuucugaguucgaggccagccuggucuacaaagugaguuccaggacagccaggacuauacagagaaacccugucucaaaaaaaauaauaauaaauaaauaaauaaauaaauaaauaaauaaauaaauaaauaaaugauuaguuuuuaaaaaaagaaagaaaacugauuuagaagggggaggggauuagaaccaaauaagguacuuuggcgauuguaacuggggagugguggugacgugcaacgguuucguuuguucauugagacaggguuuuucuauguaguccugaauguagaccaggcuggccucaaacccacagaaauccuccugccaccugcuucuugccucccaagugcugagauauaaaggugugugucuaccuggagaaaauguucuauauauuccaagcuggcuucaaaucuguaauagcccaaggaugaccuugaauuuugaccuccugacuccaucucacuagugcugggauuacagaugccagcuggggaaucaaaaccagaucucugugcaugcuaggcaagcauuucacuaagcaagucacaucccggccugagaaugcaaucuuaaauagguugcucagugaagacaccaagaagacauuuguauaaaaccucaaaagaaaagaucaggccagaucugaagauguguucuggacauaagggucccaggacaggaauacaccaacccuguugcaaugauagugaggaggagucuggagugaccagaaggugaggggcagagcagcccagacccagauagauccuauccuaugugccaugggaagguucugaauggggaaaggcuaugaucaaacucagccauugauaauagcaccacugugugugugcacacgcgugcgcgcgcaugucugcaaagcacucauaaacauauauaaaaaaaaagguuuuuuugaaaaagaaagcagacccaauacugugacagauucuauggaaagcaggaaaacacaagacucagccagcguggugaugugccuguaaccccacucuugggagacugggauagaaggaucaugagauccaggcuagcuucaucuccuaacaaaccuaucaguuucucaucauuagccccucuccugccuaucaucaguuucuccaacagagccaggggauucuacugaugauuagcugccaucacacccucucuucacucagugcccucuaaggcaacaucacucaagguaaaggaacacgcccuugcaguagcauauaagauuuaagaucccacaucaucugucccugggucacaugaccugggcuguguaguaagacccugucccccccccccaaaaaaacccaacaaauaaacaaaugaacaauggagucaaagaugacuccaaauuuacaagccugcagcuugagcaguaaguagaagauagaauuaucaauucauacaagggugguuuuggugcacgccuuuaaucccagcacuugggagguagagggaaguggaucucugaauuccaggccagccuggucuacagagcagguuccaggacagccagggcuacacagaaaaacucuugucucggaaaaccaaaacaaaaggaauuagcaauucacuugucuguguauuuauuuuaacauuuauuucuuuuuauauuuugucuuuuucucuaaagcaccaagaaaagggaaagcuuguuuugcugacuuauauaucccuggugccuaaaacacugccuggugugugcgcuuuuuagcacuugaacaaaauguauggaucaugacaaaacaggaagccacaccuggugacacaccaguaauuccagcauucaagagaaaugaaaucaagauuaucaucagauacauauugagcuugagguuggccugggcuacauuagacccuaucucaaaagauaaauugauagcuggagauacaagaauaggaaaacuagcacaaccauggcugaaauggcauuauccauaugggccugauuuugugucccuagcauguggccuucugcagacuacacagcaaguauucaggaauauuuauagacuagaaccaacccucugcccucccaugggagugggaucccaagacucaccgucagagggcagggagucucugcaguguccugggaaggggaggaggaggaagaggaagaggaaggagucagcgaaccuaggguggggagaaaggaagaagugaguccccagaccccagauucucccguucuguucccaagccugguugugugugccuggaccacugaccucgacucagggcagccagcgcagccagcaggcucuucuggaacucauccgcuucugcaggacucugaaacgucagcccaaacuugcagucccccaagcuccaaugguggaagaugggauucacuuuguuguaaaccaaaccuggccucaggguacacuccaagguggucugaggggcaggaaggggccaggucagcuaaacuuagccccucuguacacuccagcaucccaacaccagguguaccuggacacuaauaugcccucauuuuaggagauguaucucugauucuacaauauuccuucaguccuuucauuucuaugccuaucggauuucuuccuuugaugucccaauaggaaccucaaaucuuauuaaauguuaaaaaaaaaaacaaaaacaaaaaaaaaaaaaaaaccuaaccuuuucucauacccuaacgauuccucuuuugauugaagaaaaagcauuauuuacauuguacugagcacaucaaaauauuacaaccaguuccuuucugaagccucaauaauuccuggaaaacuuacccagagauaguuaccuucuauacagucuacuggaugcugaccaccccuuguguucccuucauguucuugucugacaucaacacuuccucuacacuguuccugaugcccugcucugagauguaucccuuccccaaguuuuuuguuuuagauaaguucucacuaccuagcccaggcuggccccgacccuuacaauccuauccuccugcuacaacaucccuaguguggagauuaggagcacgugacauaggacugucaacuacauucaaccacuucuaagcagacccugcaaacgccuccagauacuuagggcagacaagggccacuugguugcgaucuccuggugagcaucugugaauaagauggagccagaggaggauucugaacagaaaggggacaugauaggaguugggugugagcugggucguuguggaauggaccaggguuagacgaggaacacaaccgaauggggcaggaaggccauuaccgaaauagcugauugaacagccagagaagcagaggacaggagcuuccuaauccuucaccccacccccaaaucccagcucuuaauucacaaaccagauuauuuauuccaaacuccaacccacggcccacuuugagucccaguggcagagggacagcguaaccuuuccuugccacccccuccccagccccagcccuccuuccccagggcucaucccacucccacaccccaggguggcucacuuucuggucccgaagccgcuccccguggaugacguagugccccuggcgggccccccccucgggccuggccccucggacccgacauacgcucaccuggcugaggcccccgccccccacaggcagccagcccccacuggagucaucucgggccaucaccacggcucggacccgcaccauguaccuggaggagguggggaggacagaaacaacacaggccgugaacucaaaucuuguucccgguuugagcguucucccuaacccugcccucgucuuuuaucccuuaccucuggauuuaccucacccucaagccaccaguacacccaccccuugcccacuuucuucuaucauggcuucuuucuucuuagugacaucuugcccaccauccuuuuucguaucuaccuuuucucgccauccccaccucuucagcaccuucccuuaucuccacccccuuagccuggguuugccacuuccccucccccuacagcucaucccccucaaccccagucuccuucccucucaucacaaacccauagccccacccauuguccccucucacagcuggauuccugcgcauauauauuuucucuggacucaucaacucagcuucagugcccccaacacugccuccgcacccuagucacccaggccacuaacugggugagaaaccuggcuucucuccccccccccccuucccggauuuaugaaugagaccggaugcaaagcucacugagucacccagcaaccaggagaugggcagggagcagagagagaaccagaaauggccagaaagagaggccgagaaggagauggaggcagagaaaaccagcaaccggagaccgaaaagauacaaggagcauuucauucacaaaaaucaaggcugcuccgguuggucucaguugagggaagccaagagagaugggaggggagauaaugauccagccccucacccccccgccccccgccauccuucagaaacauuuuaccccgcccccaguuuaggggauguagcccuccgcccagcaaucaggauuaccauucagccccacugucccaggcucauggagcaugaagucccaaccuuaugagcccaggcaacgaguucuagcccccucccccaccugcaggaugucggguuuccccagccguucaggaggggaaggggcggccacagcgcccccagcccccuuuucucaaugggaugggauuuugugaaugagcagucacgugacacugcuuccuuuguccgcccgccucccccaacaacaggugaagcggggaaagagggcuggggucccccccaaaggccuagcugagauagggcacugagaucuugggguguccuaugcucccacacaucuauuuucccggggagaguagucaucagaguuccucaauggcgaggguccacgacagaauuuugugaauggggcauccucggaagaaguccaggacccccaaauggagauuggcaccccaaauggcuaccgcguaguuuggugcccccaccccucuuguucucccagcuuguguccgcagggugcaagggugggcagaggauuacagaugcgauccaggcugcccccucacccuggcaggcagucucgucagccccccgcccccucgccacucugggcaccugccugggaggcuccggccgggcuccgagcggcggcgacgcggccuccuccuccuccuccuccuccuccuccucuucucucccgcucccucacuggcuccggcggcgcuggagacgggcaccgggagccggggcgaggggggagggagggggaaccuggaagaugugugugggggagggggcggcuugggggagggguagaagcaaggcaggcguacaugcccgcuggguccuagagcccggcuagggcuacaacgaacaucuauagcccccauuuucucgggacccagaagggaauccccacuuuuccacuuaucugaacgguuggucccugaugauaugagaagggaacagaaauagacccuggucccaagguucuagagagaaggugguccacggucagggcucugaaugggaggggcgggaugccug

SEQ ID NO: 3670 - RNA, 3769 nt, Mus musculus
uguauuuuucuaagggugauccagguuugaagggcugcacucaagcuggcuugcagggggcagggccucgagcucggggcggggccuagaucucgggggucguccucgcugucucgcccacuugccuucacccgcacacccguucuuuucgguuauuuucugcuacggccguuccccgcccugccuugggcccacggggcagugaucugaucuuuggucggcuggaggagucggugaguuggguccacuuaagaggcggagcugggcggagcuuuaggaaagggguggagccuaaguuaagaucugucacaaacgccaagcgggaaaaguuuaagaggcuugaggauuuguugcuggcuaggaagagggagggauccaaaugaucgacacagagagacggugggugaucggaggguuaggacugaaggacuagggaacuaauuagaucacagucccagguauuuguuaggcagagacggaccugauccggggcggugaggggcgaggauauggccggauucuugacaaucaggagcgacuagagaauggggcggggccugguuagacuaguguugaaagagaagcgugaauucauuguuggcuauugggcauaaccaucauuacccaugugguuugaaacuuucaacagagaggcuggcgagacugacuccuggagccuggagaucccgggaguggcaaaaguguuagggaugugauccaagggaucaggguuggcgccuuuguacacuaagaaguuagguucgaagaguaagaacugcagccuugagaccauggggaagggggcgugaccauggcgaaucggagaacugaagacuuaagagccgggggcugagauaauauuggaggacagggcagaccaaugcagacaggggcaguccaagaacagccugagccguggaguccccgcagaacccgccgacugacuggugaaaguuuuuuuaaccacaguccccgaccuucuucaaaaauggggaacgugcagucggagccguccgcgggcggggguucccgaaaagagcaggccucagaccgcgccuccgacucccgcaggacgccucuaguggagcccgaggugacccccucauccccugccaugcgccuggcucgagggcugggcgucugguucccuggcaguuccgggcccccgggacuccugauacccccggagccccaggccucauccucgccccugccccugaccuuagaacugcccucgccagugacacccccuccagaggaggcggcugcggucuccacaccacccccgccccccguggggacccugcugccugcgccaucuaaguggcgaaaacccacgggcacuucagugccucggauccgcggucuucuggaggcgagccaucguggucagggugacccuccaagccuccgcccgcugccaccgcugccccggcaacugaccgaaaaagacccgguccugagggccccagccccaccuccgacgccccuggaaccucggaaacaacuaccgccagcaccaucaacuugcgauccgcagccccugagccgcagaaucacucuggccucgucggccacaagccccacagaaagucaggucagacacagcagcgagggucaggcggccgggggagcccacggagggguaccuccccaagcuggagagggcgaaauggcucggucugcuacuuccgagucuggccugagucugcuguguaaagucaccuucaagucggggccccauuugucccccacaucggccucgggucccuuagcagccaaagccucacccggggccggugguggcggacuguuugccucuucuggggccaucuccuaugcugagguccugaagcaagggccccaaccuccuggagccacucgucccuugggagaggucccuccuggagccacucgucccuugggagaggucccucgugcagcucaggaaaccgaggguggugacggagauggcgaaggguguucuggucccccuucggugccugcuccccuugcccgggcucuaccgccgcccccuuacaccaccuucccagguucaaagcccaaauucgacugggugagcccuccugauggcacugaacggcauuuccgauucaauggggcugucgggggaaucggggcaccccgacggcgcacgaccacgcucucagggccuuggggauccccuccacccaggucaggucagacacauccaucuucagggccucggaggcccacaccugccuuguuggcaccacccauguucaucuucccagcgccaaacaauggcgagccuguucgcccagugccuccaaguccacagcagauaccuccucugccgccaccaccacccacgccaccagccacgccaccaccggcgccaccacccacaccacagccaccagcgcucccaaggacgccgauacugguggcccguccgccgaccccaggcccuggccacuuagagucagccuuggcucccaccccucccuccacuuuauccccaacugcagcugccgaccaggucccagcugcaacuccagccacagucacaucccaaguuccagcaaccgccaccgcugagcugucaccgccaaugccccaacccaagacucguacacgcaggaacaaagguccccgagcggcccgggguguuauccgugaagaagggacuucuggagauggcccucgagaaccgaauacggcuccggugacugacagcagcaguggaggggguggcggugguagcaacggaaccuccacagcuggggccucuaacaagggaacagcaaggcacuggccgccuuucgaggugcuuaauuccugucccugcaagugcuacugccgccaucaacgucgucaccgucggcugccacgcaacgugucugccuggugagggagauuggggaguuggaaggagagggcacacuccaaguccugcaccuauuuaaccuggauggaauaagauuacacgcuuuggcgucuuaaccauaggcugacccacaaguuaccuggaccuuaacuuagcugagcccuaggagccuuggcccuuuccuggccuuagcucaaccucuugguauucuggaugccaagcugacccugggucuuuauuaucuuagccuuccugcuggccugacccuagucacugccuugacuccaucccugagggcaggaaagaugguuuaucagagauggggaaaggaaacaacuguguuucugggaccugaggguggauuaguaagccuccaauuugccuggucccauugaaacucccagugcccguaccccauuacaacccucccacccacuugagaccaaggcuuuggccccuuugccaccucugcuacuauacuaagccccuggauuugguugccaggccugguuacagacaaaaccuccucugggggcuuagacucacacuccuucccauucuauauggauguaccucugccccugaaugcccuugggaaccuauggcaggacagccuucagggggaagugaagccacagacgacacaagacagacccugucaauucaccuucucaggcugagcacaccuaccaaccaccugagcgagccaccguggguggccacugucaagcuggcuggcucccuaguagcgggccuggagcacuacgacuugcaggccacccauucuaccugagugcgacugcccaacccccucggccucacccuccucgccaauaaaguacccagucuacaaguugccuaacugccuguccauuaccacuugagguggcuggucca

SEQ ID NO: 3671 - RNA, 3769 nt, Mus musculus
uggaccagccaccucaagugguaauggacaggcaguuaggcaacuuguagacuggguacuuuauuggcgaggagggugaggccgaggggguugggcagucgcacucagguagaauggguggccugcaagucguagugcuccaggcccgcuacuagggagccagccagcuugacaguggccacccacgguggcucgcucaggugguugguaggugugcucagccugagaaggugaauugacagggucugucuugugucgucuguggcuucacuucccccugaaggcuguccugccauagguucccaagggcauucaggggcagagguacauccauauagaaugggaaggagugugagucuaagcccccagaggagguuuugucuguaaccaggccuggcaaccaaauccaggggcuuaguauaguagcagagguggcaaaggggccaaagccuuggucucaagugggugggaggguuguaaugggguacgggcacugggaguuucaaugggaccaggcaaauuggaggcuuacuaauccacccucaggucccagaaacacaguuguuuccuuuccccaucucugauaaaccaucuuuccugcccucagggauggagucaaggcagugacuagggucaggccagcaggaaggcuaagauaauaaagacccagggucagcuuggcauccagaauaccaagagguugagcuaaggccaggaaagggccaaggcuccuagggcucagcuaaguuaagguccagguaacuugugggucagccuaugguuaagacgccaaagcguguaaucuuauuccauccagguuaaauaggugcaggacuuggagugugcccucuccuuccaacuccccaaucucccucaccaggcagacacguugcguggcagccgacggugacgacguugauggcggcaguagcacuugcagggacaggaauuaagcaccucgaaaggcggccagugccuugcuguucccuuguuagaggccccagcuguggagguuccguugcuaccaccgccacccccuccacugcugcugucagucaccggagccguauucgguucucgagggccaucuccagaagucccuucuucacggauaacaccccgggccgcucggggaccuuuguuccugcguguacgagucuuggguuggggcauuggcggugacagcucagcgguggcgguugcuggaacuugggaugugacuguggcuggaguugcagcugggaccuggucggcagcugcaguuggggauaaaguggagggaggggugggagccaaggcugacucuaaguggccagggccuggggucggcggacgggccaccaguaucggcguccuugggagcgcugguggcuguggugugggugguggcgccggugguggcguggcugguggcguggguggugguggcggcagaggagguaucugcuguggacuuggaggcacugggcgaacaggcucgccauuguuuggcgcugggaagaugaacauggguggugccaacaaggcaggugugggccuccgaggcccugaagauggaugugucugaccugaccuggguggaggggauccccaaggcccugagagcguggucgugcgccgucggggugccccgauucccccgacagccccauugaaucggaaaugccguucagugccaucaggagggcucacccagucgaauuugggcuuugaaccugggaaggugguguaagggggcggcgguagagcccgggcaaggggagcaggcaccgaagggggaccagaacacccuucgccaucuccgucaccacccucgguuuccugagcugcacgagggaccucucccaagggacgaguggcuccaggagggaccucucccaagggacgaguggcuccaggagguuggggcccuugcuucaggaccucagcauaggagauggccccagaagaggcaaacaguccgccaccaccggccccgggugaggcuuuggcugcuaagggacccgaggccgaugugggggacaaauggggccccgacuugaaggugacuuuacacagcagacucaggccagacucggaaguagcagaccgagccauuucgcccucuccagcuuggggagguaccccuccgugggcucccccggccgccugacccucgcugcugugucugaccugacuuucuguggggcuuguggccgacgaggccagagugauucugcggcucaggggcugcggaucgcaaguugauggugcuggcgguaguuguuuccgagguuccaggggcgucggagguggggcuggggcccucaggaccgggucuuuuucggucaguugccggggcagcgguggcagcgggcggaggcuuggagggucacccugaccacgauggcucgccuccagaagaccgcggauccgaggcacugaagugcccguggguuuucgccacuuagauggcgcaggcagcaggguccccacggggggcgggggugguguggagaccgcagccgccuccucuggagggggugucacuggcgagggcaguucuaaggucaggggcaggggcgaggaugaggccuggggcuccggggguaucaggagucccgggggcccggaacugccagggaaccagacgcccagcccucgagccaggcgcauggcaggggaugagggggucaccucgggcuccacuagaggcguccugcgggagucggaggcgcggucugaggccugcucuuuucgggaacccccgcccgcggacggcuccgacugcacguuccccauuuuugaagaaggucggggacugugguuaaaaaaacuuucaccagucagucggcggguucugcggggacuccacggcucaggcuguucuuggacugccccugucugcauuggucugcccuguccuccaauauuaucucagcccccggcucuuaagucuucaguucuccgauucgccauggucacgcccccuuccccauggucucaaggcugcaguucuuacucuucgaaccuaacuucuuaguguacaaaggcgccaacccugaucccuuggaucacaucccuaacacuuuugccacucccgggaucuccaggcuccaggagucagucucgccagccucucuguugaaaguuucaaaccacauggguaaugaugguuaugcccaauagccaacaaugaauucacgcuucucuuucaacacuagucuaaccaggccccgccccauucucuagucgcuccugauugucaagaauccggccauauccucgccccucaccgccccggaucagguccgucucugccuaacaaauaccugggacugugaucuaauuaguucccuaguccuucaguccuaacccuccgaucacccaccgucucucugugucgaucauuuggaucccucccucuuccuagccagcaacaaauccucaagccucuuaaacuuuucccgcuuggcguuugugacagaucuuaacuuaggcuccaccccuuuccuaaagcuccgcccagcuccgccucuuaaguggacccaacucaccgacuccuccagccgaccaaagaucagaucacugccccgugggcccaaggcagggcggggaacggccguagcagaaaauaaccgaaaagaacgggugugcgggugaaggcaagugggcgagacagcgaggacgacccccgagaucuaggccccgccccgagcucgaggcccugcccccugcaagccagcuugagugcagcccuucaaaccuggaucacccuuagaaaaauaca

SEQ ID NO: 3672 - RNA, 6596 nt, Mus musculus
auaucaggauucauaccauuuauuacagagggcucaaaugguagcccauagacaaagucaguuucaugucucauuuuaaaaauuauuuaauccacggccaacauuuuuuuaaaacugagacacacggugcuucacuggggaaaaaaaaucuagucccuggcccaacaccaaaacgcauccacagcuggauagaagagucccucagucugggccugugcucuccugugggccaccgggcaucuauacuuaaaacccagagcaaugacaacugggaaacgcuucgcaaacucccaaaucuccaggagcaauuuaucuccaccaucacacuggggagacucgggcccauuagagguuaaucugccuuuauugaaggccagccuauacuggguuuguuggacuagccauauccaccgcccuggucaagccucagacaaucaucuccagcugccgggcauacucgaugacuuguuuggccaguucaguagaggggauggugcugucuucuggcuucugcugcuggcuggcaaagcuguaguaguuguuagggcccagcacccaaccucgcugaagaaagagagaugagaaauagguaggugaccccacaggcugcuccccacccuaugcagcuaccucccaguguaccauggcuccuuuugucauggauuacugccacucugugccucaguuuccccauguuuaagaugggucuagaggacuuaugaagccucugagcaaacacucauuugguccacaguaagcggccggcaccaccacuccucacacuggcccugacagccugcucuugagcuggugccuuacugcccagccuccucuccugccuccugggacaccaaggucacugggcagcaagggucaacaucccugggggcacuguuccacucaaaugaagcaguguaaccauuaccaacaaguugcugcuuucuaaggaguucuuggggcaaagucaagaugcgguauuccuuagagcaggggccagcugcugugcuaggcuggcuccacacgucugucagacccuagccucucucuauggaaaggccagcaagcucagagaggcugagccacuugccuagguuuagucaugggcagucuuuguucugcugaugucccccucgacuaucacacagugcacuggcacuguuaggacagggaacaauacccuccaucccccaacccucaucacagucccuugucccacacuccagccaccuucuuggcauagucugucaucuuuuugggugugcugaagaagaggauccggguagccucagcaaaaaggauuuucucauaggccuucucaaugcauccugcgauuucaucccugugggaaggcaacaguuaucaucacugggcagacaacuucccagacccugucuuccaaugacugauuccaguacugagggcugagagagaggagacuaacuugaccagucacaaagcaggcaugggccagaagggacccacagcucagucucugaguaagccuuuucacauaggaaccuucaaaagaacacagcacccuucuucagaugucuagaggagguucuuguaugaacaaacaagagagcuugucuagaaugccuggguucuacccccagcaccacaaagaccagguguuuguaaucccagccugcacugugggagauggaggcacagggucauggccagccucggcuacacgaaacccugagggcagcucagcagcagagcauuccuuuaguuuauacaagguucugauuguagccccuagagggguugggacuggggcaauacacuaugagaaacaccagggcgucaaucauaggcaucaggcaguguggcauguaggggacuaacaaggccaggaagucuggggccuggaccccacauaccugaugguauccagcaggaugucaaugaagaagguguagcuuucggcagggauguuccccuuagccaggaauaccuuguuguagcuacccuccaugagguacugccaaagccaauggagaagaggaagaggauggaguggcacaggcuuuucuugcucccuuggugccucccaaucccugcucuaccauaacacccucgcuucuccacuuccaagaagcaccaccuggcuuacacacucacccuggcagccuccuccaaacuggcaucuaaccuccaauuauaaggggagaagaagguauauugaccccagcucccauuccauauacaucaacugcuggcccacgggccacucggccguccuucucacagcauaguacuuugcaggccucagcucccacgccucaccccugacuuaccggccuucuuccacugucuucuuugcugucuuuaaaauauggcaggagguuugugccucaggacacaaacugccucugccagaggaccucuuagcccuuucagacccucucugaccgcucccaagcccagguccucguaacaaugccucacaucccacacagguaccucauucuuuugguacuuaucugccuccacacuucauggauucuagauuagggguuucgucuguuugauuugccuuaacaugaaaaccuuuccuggugccuggcacauauauguuuugcugguuaaaagaacugguggcgcacaccuuuaaucccagcacucgggaggcagaggcagguggauuucugaguucgaggcaacccuggucuacaaagugaguuccaggacagucaggaguacacagagaaacccugucucgaaaaacaaaaaacaaaacaaaaccaaaaaccaaaaaccaaaaagaguugguggauugaaaauggcugaucauucuuccaggaagcccucccacaaucuaaacugguaccacccaccucacccaggaucucccuuccccugcccagccuuacuugcucgagggaaacaggguguuugauguagacauuggucuggauguccuuggcagguaaucguucuaauucuguguggaacucagccacucgguucugagauagcaggaagaggagauugaggcccaggagcuggugcauauaggcugacucaggaagcuguucucugugagccaagggagcgggaagaaaccacaguuaacagguacuggggagcuaaccaagucccucauccaccuuccagaauccuuacaaguacuugcaugaguucagacaaguuagguacagagaggcaaaaacgccacgagccacauggaccaaacauacauggacuacagugauucagccuauuucccaucugcuaagcaguugucacuagguauccacaccauaaaggcauguucaguaaaacauaagugaauuaaauggucuaucauacguaaagccauaagaauagcauccagaggcuagauacucaguaagcagaauguuucccucaaaaaaacaaaacuugggcuggugagauggcucaguggguaagagcaccugacugcucuuccaaagguccggaguucaaaucccagcaaccacaugguggcucacaaccaucuguaacgagaucugacgcccucuucuggugugucugaagacagcuacaguguacuuacauauaauaaauaaauaaaucuuaaaaaaaaaaaagaacaaaacuuuugguucaauccccagcauuucauaaacaagacaugggguacacaccuguaaucccagucacuuggagguacagggaggaguauccaaaguucaagaucggaagggcuacugcacaacugaguucucagccagcuuggggcacauaaggcauagccucaaagaacaagagcucaggggcagcuggggggugggggggcuggacagauggcucggugguuaagagcacugacuacucuuccagagguccugaguucaauucccagcagccacaggguggcucacaaccaucuguaaugggaucugaugccucugguaugucugaagacagugacaguguacucacauacauaaaauaaauaaaucuuaaaaacaaaacaacaacagcuggguauuguggcccacgcgguuaaucccagcacuggaggcagagagucaggcggaucuccaggccagccaaagcuacaccgaaacaaacaaaacaaacaaaaacacaaaaaccccacaacaacaacaacaaaaaaaccagcagggggcagcacuacauauaaucuccagguguagacagguggaccaccuugaacccagucucaaacaaaauaaaacaaccagcacuuugugaagcaaagcagcauccuauuggcuguuguagacaugccagcuagagggaaaaugaagggguaacucagagccacacuggguacaggggacauagugugggacuagauaagggaaaacagauuggauggaggggcugaagagauggcucagcaguuaagagcacuagaugcuugaagagcucugcacuuucagaaguccugaguucaauucccagcacccauguagcagcucacaaccaucuguaauaggaucccacgcauuccucugguguucagacauacaagcagacagagcacccauauacauggaaauacacaaauaaaaucaaacuguuuagaaacguacagaaccagacuacauaaacccagucucaagaucucuaaucuucuggcccuccagcuucuggggacagagcugagaacggcaaugguucucaggcgaagaaggcaacggaggacgccagauacacaaggaacuacccacuccugcuccaguccccucccuagagggcccaaccucacuuguaaucaaaguaguagcauuugaguugggccauguagcgcucgaaggagggaaugucuuugcacaggaugcuccacugggccccgaucuccagaaugucaccuguagguaaggggacaggggcucucaggugguggcuggaaucccuccugggaucaccaccccagucauuccuacaaugaccccaggcccaucacccuccaccaacccuagugacacucacgggccagaaugaguugcuguuuagucaguuugguccccgugguuggcaggaaauugagcucaagcagaaccaacugagggggaaggaaugaggacgagauuucaaauauagauuacuuacguucucuggacuuuuauguuccuacuuggaaaagcuugcaugcauccuaacccacacaacugccaugaauauuaguggagucagaccuuguaaagcaaacaccaaagggcccaagaacacggagcguaccaauuggauuaccucaucuuacaaauauuaguaacuccacugagaaacacgaggcacuuggugccugacccagggggaucaugggguagggagacgcccaugaccucaauucuuccuguugcuauauuuagcuuguuuuagguuucucucuuguuuaagacagcaucuccccaggcaggccaaucuagucuagaacuggagagccuggugugagccucucgagugcuaggauuacaagugugggacaucguguucagccauuauaugcaggucugggaagaccuccaccacagugugcccgagaagggguaacaaggaauguggggcauuccuuuucccuccccccccaguccaucccagacaccauuccuuaguaaacuugggaaccuaacacauauuuuguuguuguuuacuuauuauuauuauauauauauuuugagacgaagucuauguagcccagccuccucaaacucgcuauugaagaccagacuggccuucuauccgccugaguguguuuacaaccgaaacgugugcucuucuagguucguuuuuggcuucaaacuguuccuguugccccucuucacacagguguuuccuaaccucugcucccucacagcuuaccugggcuuuauuugccacacauucccucaacgucccgucaccucagacuuauucuuuucacuaucuccccguuugucacugaucccacuccuuccugccucccuccaaguaacaaagcucgaaccaucucauucgauucugccagaaccaaucuuuccaucaucacucccuuaacgacaccucagggcccgcucuaccagccucgaucucccgucugucaccuucccccaggcauuaggcaucuaggacccggcgaccucuuaccuucaggcggcccaguucuucuccacauuuacuaagguucggguucuuccgguuccacucguccuugaguugcucguacaugccggccgcugccugcaggaucccgaccgagguggccgcggguccggagcucgagacgguggucgacccguucaccguagccgcuguggccgccaucuuccgugaugcggcaagccgccgacccgacuuacggcagcgacgccgggcaauggacucccggcggaaaugaggccgggagguggagcccaaaacuggaggcggagcuaccacugccaguuuccgccccccgcgggaggagcgccgcggcucuccucggggugucuucgcagcccgacccuuaaugaacaugccgcagcuccgccucugcugucauucaaaauggcgaacggaaguccguucgcuccaacugaaaacaaugcccacaaugucccgcccaccuguagucaccauggccacccucgcuggcuucggccuguggaaug

SEQ ID NO: 3673 - RNA, 10690 nt, Mus musculus
cuuuuuccuuuuccucuuccucuucggggcgucgguggccgcgccuggagcucccggaacuaaaagcggaccucgggcggugggccggcgggggccacgucagcgggugucggggcuguacgggcaccaugcggcggggcgcgcuccuggcuagcgcccuggccgccuacgccggguaccuggcgcugggcgcgcugcuuguggcgcggcuggagcggccucacgaagcccggcugcgggcagaacuggggacccugcgggagcagcugcuacagcacagcccgugcguggcggcucacgcccuggaugccuucguggagcgggugcuggcggccggacggcuggggcgcgcagcgcucgccaacgccucgggagcugccaacgcuucggacccugcgugggacuucgccucggcgcucuucuucgccagcacgcuugucaccaccguggguaagugagugcuauccaucacccagucccagauaguguccggaccccuuaacauacaccuucaucccaaucguccuggugcucucagaacaaccuccauucccaacugacccacacuggccacagcugccucauuuggagagcccucguacuacacaccccaguucccuuggaauacuuucucagacagcauccccuuuggugccuuuuuguuugguuuugagauagcauguaccuuuaggcgcagguuggcuuggaauuucauccuccugucucagccuccuaaaugcugggauuacaggugugggucaccagccuggcucacucuugucuuaauccuaggauuaucauagaugauuggcaagggccuugguagggcuuuccuugggugucuaaccucgggggcuguguuacaauagggcuggcacaccaucucuuccagccuugucuucuggcuccagauagguccuuucuggaacagcccacuuuaacuuccuccugaacucagugccccagugaacugugaguugaacucaggccuucaugcaugcuagucaguaauagcagggcaacauuacuggaggucugucuucuaggaagagaccuuagccugaccugagaccgguucuaggaucccuuccgcuuugggcacucuccagcaagaucccugguccggggacuaacagacugacugaaggucccccccucccccccucuccuggacuuccuacucuaacacagggcuccuccacccaucuuuacaccuccccugaguuguugggauucucccaauguuuuccacucuagacucagauuccuggaucagcagcuccuacagcgggcuguaagaauggcgcgaacccagagcguccucaaggaagaaccauuggcugauuggcugucccgcuugaaauccuccaaguugagacuccuaccccuaacuaccuccagcaaaaccucuugcucuuuucuuuuuucuuuuuuuucuuuucuuuuuuuuuucucuucuuucuuucuuucuuuuuuuuuuucucuugcccuuuucacaccaaggacugguagugagggucucuuucagcucaagugaggagggcugagguguagcucggugguagaacacuugccuagcaugcgugagauccugaguucaacccuuaguacuucaaaaaacaaaacaccuaaacucaugaaugggacuccuaucucuucucuagacugugacccuacucagcgagaacaaauccucaccccaggacacaauccagacaaagacucaauucucucuaucugcucuuccuggccauguagcugucuuuggcuauuuuguggguucuuuuuuccacccuuuucaacccucuaacacuagauaagggcaaagaagggauagagaggaaagagaucccuggcugaaggcaggggucagaaagggggcagcguuauuguuagacugcuuccugcugauuagggcaucgaguuccuuggagcaaauuugaucuucacagucaggauauccacuuucuuguuguuucugcuuugcacaugacuacauaacaaaccacagccaacagugaccaacaaacagcccaccacaccucucagggcccuagcauuuauauauaccuuuuuaaaaguccccagaauuccagaugucacacaaucacagaaacuaccugcaucuggcaaaaucacgacccugcuagagcaugagacaaaucauagucagcugcuguggacagucagaagcagccccauaucccuauaccugggauuaaaacaaaaacauauucuuauauuucugugaucuuuauaaaaaaauauucuaaaauugucauuauaccacccacgugaccaacaugcucacugaggauuccccaaacaggggggauguccuggaguuggaccuccuucacaccccauagcugugacuucccgagacaugacacccucucuaucuggaacauucaggguccucucugacagagacccccugccccccaaaagcauuacucacuccacuugacacccagaagacaccuuagcgaugucuaccucacucuuuccuucagaugcccugggcucaggagcucuggcugcaggagaacucacacaauccagacgauaucuguuggugccuccuaugaaaccagggccccaaggucuuauuuacaaccaggauccuggucuugauuuaagguuauggacuccucagcugggcauggugggauacaccucgguacucaggagguggaagcaagagggucagccagaacuacgugagacccugucucaacaagacaagacaggacaagggagaagccagggggggggaaggugcuaugagaaaccggauuccaagucccagcagucgcgcagaugcugagcguggcuaugcaagccugcuacuccagccucagcguagacacaggcacugucuuggggcuggagucagcaagcuucugguucaguaauaagccgaggagggaaugagcagacaucagacgugccccucuggccucuguacacaccuaugcgcauacauucacgcaacacacacacacaaauauuagcgcugugcagaggcccauucagguaggacgcucucuaccugcaccccccagcccugaagaacucugggaaauuccucucagaaagucccuucuguccuccuaccacagaccugggaaaccccucugcccgcucgcucgcucagaggccagguucugcugcuccccaguucccugaggugacuuuuagggacuugaaacaggguggaggcugagccacaaucaauugccucucuggcuggaagcagcauuagaguuauggauagcuuuugucccccacuugaggugcucauugcaugugaccagcaaacugagguccuuggcaauagagcugggugucucuucaaagaaaacaaggaacuggucuccccugaggcuagcacucccccaagcuuccugggccggcuugaccugcucccagaaguccuugcaucauagucucuccucagauuucucacuucugacagguugucucuggugcugguagacuggcaggugaggggagugggacacgcgacaggcucagccuggaugaguagcugcauccucaguuaugaagugagaucacaaguuucucagccagagcauagcagggucucacuacauuuuaauucaggcaaugcaacagccuugugagguagcugccacuuguuugucugucuaucugucugucugucugucuauaaagcuaaggcccaguaaaguuggccaacuugggcauagucacacagauaggauaguauagacauuguggcacauguuuuuaguccuagcagccagaggcagaagcagcaggauuguuacaaguaaguucaaggccagccuggacuacagagugagacccugacucaaacaaaacaaaacaaaacaauccaaccauaacaaaauaacauuacugaagcugcugacagaggccgggggagcuggggaaauagaaagccaagugguucuagccgugacuuggugaaauggucuacaccaggugccuugguccuaauggagcugguggauaaaucugaucccaucugcuacugugggugauaccucuggcuucaaguccagagcacagggcucuguuuugcuccuuguguucugcugcucugagauuuuugguuccaccaaacugugcaggacuuuuugaggucaguucugaaagccagccuguacaguuagagggaacagggaaguaccuucuuagagccgguucauauagcuuagcaugcaaaaaaagugaugaugcagccaggcuugguggcucaggcucguagucccagcuaucagaaggcuggaggaggaggauccugauuucaaggccugccuaggggguuuugugagaugcugucuuaagauaugaaguaaaagcugggcgugguggcacacgccuuuaaucccagcacuagggaggcagaggcagguggauucugaguuugaggccagccuggucuacagagugaguuccagggcagccagggcuauacagagaaacccugucucgaaaaacaaaacaacaacaacaacaaaaagauaugaaguaaaaagaagccugcccuagaauacaccaggggaaaccagggcuugacucggccagcaguagauucuucagaaaaaucauuaguaagggacaugguguguguguguguguguccuaaaauaacucaacacuugaauauaucaaaacaguauaccucaugaccauugauggaagauuacuaaaauaaaacaccaagauaaaggagaggauuucugggagcagggcacaggaaaggaugccugggugaauaaggcuggguauggcagcucacaugggccaucucagcauccagaaggcugaagccaugugguuaagggcacuuucugcccuugcagaggucccaggucacccucaugauagcuugacuguaacuccaguucccggggaucuggucucucuucugacuuccgcagacucuuacauacauuugguguacauacauauacacagagacacacacuaaaauuaaaaagaaucuagagcagguggauugcuaugaguuaaggccacccagaaugagacccagcccccaaaagacaaaagugaaaaaguuuuuuuguuguuguuguuaaauagauguaagaaaagguuauaagccgggcguggugccacacaccuguaaucccagcgcucaggaggcagaggcaggcagauuucugaguucgaggucagccuggucuacagagugaguuccaggagagccagggcuacacagagaaacccugucuggaaaaacaaaacaaacaaacaaaaaaacaaaaagaaaaggcuaucauaaaacccauuauuuuauacaauuaauacaugcuaauugaaagguuacaaaaagucccagauguguuugcgugccuguaauccuagcccguaaggaggagaguauuugucugaauguauguauggguaucacaugcaugccugaugauaggcaucacucggaaggcagaggcaggcaggaguuacagaugguugugaaccacccuguaggugcuggaaauccaacuugggaccucugguagagcaacaaguacucuuaaccagugagccaucucuccagcccccuaaaauauaucuaauaacaacaacaacaauaauagaaggcauaaaggauuucuuacuaaacuuggcucaugaagguucucccccucccugaagccuggggcuuccuucaugcuacacagggacucuacuacucccacugcugcaugcucuaugcuaacaaaauucuuuuuuuuuuuuuuuuuuuuuuugaguuagggucugcccauguagcccacucuaguuuccuguguccugagcuuacagggauggagcaccaugccuggcuucccaaggagucuuccuguucccuggggauauaugacagauccucugugugugacauccaucacaggagaacagggcucugaggacuacacugggggaucaguccaugggaauagcugguagucguuguggaugucuacagugccccagguagcauuaucacagugagucaagcugggaguccuaacuaccuggagaaaugaacaaauucaacauccuuaaaaccucuuuccauauugcacuucacuucaucagaaggcaaggauuucaaagacuuggaaacugcuguugauuugggcagucucagugcugcuaaaggcagaaaaugggugacaagaagcaguccuaccagggaaagauagaagguuacaguccuuguagcuggcuggguguguggcucagugguagagccccugccuagaaucccccagugagaggcugggggcguggcuuagugguagagccccugccuagaaucccccagugaggggcugggggcguggcucagugguagagcccuugccuagaaucccccagugaggggcugggggcguggcucagugguagagcccuugccuagaaucccccagugaggggcugggggcacauugagugcuuacauggcugcaucagucuauggguuugaugucccagaauuuggggaaaaaguuuuuuaaaaugugaauaacucaaagcaaguccagaagguuuauuuaaaggauuuucccugggcgucagaaggaaccacaacucuuggauggagaugucacgacugaaauuagggaggguggggggagggggagcaguaggguugcggggagcuuaggccucaagcuguggaggugccaguguacaggaggacucuuauucccacaggcuauggcuacacgaccccacugacagaugcuggcaaagccuucuccaucgucuuugcacuccugggcgugccuaucaccaugcuacuucugacugccucagcccagcgccugucacugcugcucacccacgcaccccuguccuggcugagccugcacuggggcuggcccccgcagcgggcagcccgcuggcaccugguggcccugcugauggucauaguggcuauauucuuccugguaccggccgcggucuucgccuaccuugaagaggccuggaguuuucuggaugcuuucuauuucugcuucaucucucuguccaccauuggccuaggggacuacgugccuggggaagccccaggccagccuuaccgggcccucuacaaggugcuugucacaggugagcuggaaagcuggcugggcaccuguggguuggcagugggggcugggggugggcagagaaacagcccucuucuaagagguguugaagggguuccaagaaccacccagcugccccaaagaagaggccacauccuugcugcccuggagccugagcugaaagcugagccaucaacuugccgcuuccccgucuccccucccccaugucuacagcguaccucuuccucggccugguugccauggugcucguguugcagacuuuccgccguguuuccgaccuccauggccucacagaacucaucuugcugcccgauccggacccugccagccucagccaggaugaggaugaucagguggccguucuggaugcccggacagaucuacaucagcaccucucugcugccucccacgcugacuacgccuccauccccagguagcugucgaccuggacacaccugggcaggggcuuugagccccaugugacuagaucaacuggaaugcccagacacacucuccugucuuuucacagagcuccacugggaggugaggaguagucccucugcuccuauguccucugcuccucagggcacugacacagucauuuucuccuccuuccuuuucucccuuuucuucucagacucagaccacgugggcuuucugacuuuguuggugagaguagugguuuauacaauuuuuuuguuuuguuuuguucuuguuguuuuucuaugucucgcucucuugcauagcucauccggcacaccuaguucuucugggcucugggccuggacuccacuuuagccucuguauuaguggcuuugucuuggccaaaugauuuccccauucuaaaccuuuauaucccagccauaagaugcaaagaauguucaaacucauccacagaccuucacuucugccaugcuuuucugugcuaggcacacaguaguagauguggcuugggcucugcucuuauuggggugaccagccagugagguaaacugacugacuugcugucccuugauggugacaaacuccagugggcacuggaagaggcagaguggucaggacugaggaguggaccugaaauguccaggugggcuuuccuggaaaacgggacaagaacuaacccaagaccugccagucaagagaagaaauucugccuucuucucaggugucuaugggccguagggccugugggaagaggccugcaaggggccagcaucucccucaacgacuuaacaggcaaggaacugacccaggauaugagcccagauccaaguggcgugagagggguaacuuagccugguccuauggugaugcucuguguaccggggcacugacugauggccuuucugggcaugcccuguaacugggccauauuuugccaaugcauuuggacagucacucuaccuuugggacucugugucugcuaaauggggaaucauaaugcuacuccaaaaguugacaucaaccaggugcaguacuggguaccaguagccugagcugaagcaggaggcuugagaguucaaaggcaggaugggauacacagcaggagccaggugauaaaauaagcuaagcaauauaauaauaauaauaauaauaauaauaauaauaauaauaauaauaaaaucacaggaauauagugccaagcuaaaggggaguaggcuacagaaggauauacaguccuugggguuggaaauuacuuauacaauuguaucacuuaaggauuuugacugcaacugacaaaagccagacugaaacaaccugauuguucaauuguaacuggacagaacccggguggggagagacugagcuugaugcucugcauggcuacagaaggggugguggccguggguucagccucucuucuccccauagcagacuuagcucucauauguguucuccuccuggugucuaaugguugccacagacccaggcaucgaaaccagacguguuauuucuagugcaagcaauagaaacuucaagcaguauucugagaacuuuaaggaaggcuggcucaguaccaaaccacuguagaaagucacacgggggaacuggguguguuggcauacagcuacccuagcacuguggagggugugccuggagaguccugaggcuaggcuagccugggcaaccgauaaugacaccacaaaacuccaaagggagcuaggaauguucacagugguggaacacgucugccucaggugcuaaagaaaacaauuuacaauuauaggugcugggaagauggcuuagccaggcaggcucaaaaaccugaguuucuccccagucccuacauagaaaaugcuagaugucaugucauggugcugcccuuuaaucccagcaucuggaggcagaagcugguagaauuucugcgaguucaaggccagcauggucuacuuagugaguuugaggacaauuagggcuacauaguaagacccugcauccacaaaauaacuaaaaacuaaaaauagugugacaagugauuaggaaaaaaguagauauuaaacucuagcuuccauguguaaacucacacacacuuaaaagucugaggcagcaaaauauuuuuuuggcggggggcugguuucaagacaggguuucucuauguagcccuggcuauccuggaacucacuuuguagaccaggcuggccuugaacucagaaaucugccugccucugcuuccuaagugcugggauuaaagguaugcaccaccacacccggcuucauaaugaguuauuucucuaccagugaaaugagucaguucaagccagcuuggauuauauugaaggcagguuuauugggaaacuggccuugguugaguucacuggccccaaggauugagcccaggggaauugccauuggaggugguauggggagaaaagacacaugugcacacauacacagggggaaagacagaugucugaauuauauagggaggagccugggggggggggggagaacagcccagccccugagcuaaaaaguucaagcuuggggucaggauaugucagguagggacugagggaugcugggagaaccuggaggccaggucugcucugauauguaaaaugcauaccucaaucccuugucccaggguccaaaaccaaaguacccaaaguacaauugauuucucaagucuuuaucugcauauaggcuaugcacgaacuagcaauauguggaugugcauaugugugagucuuccacccuacacaaagguuaccagcaaugggaagugaugacuauuccugguucugaaagcagaacucugugaguuugaacccuuguccuuguauuucacuugugccucagauugcuuauuuaugaaaggguauuuguacagcacuaccucguggacuggaacacccagccgucuaaugcuuguaacucuuacccuacagcaccaucagggagucaauaaagugccugacccgucccucgaucugaacucuguucuuagcaaggaaggucacguaaaauagaaaugcgugacuuuugggauagcauuggaaauguaaaugaagaaaauaccuaauuaaaaaaaaaaagaaaugcguaauuac

SEQ ID NO: 3674 - RNA, 10755 nt, Mus musculus
uggcuacgggaaccgggcgggcccauuccaaacugcggcuguggcguucucggccguggcaucuaaagcaugcacgcgacagguuuggcggcgccggcggggacgccccggcugcguaaguggcguacguggcuggcugaggagaucgggcgggcgagggguguggcggggccgucgcggcgguuggcgaggucacuccaggucggacggaggucacgagaucccggaccuggaguuucuaggugugcacagcccagggaugccaaguccggguagggggcgcaucgcggguagguucuuuaaaaaaaauuccuuuaaaagaaagcaaguuggaggaaaauguagugcgguguucagagaaacgcuacuuccauucauuugcagucagcgauuugaccuccugugcuacccaccuuuccgagacucuucagugcuuaggaacugucacccacgcuccacaguacggccccugggcacucccugugcggacagggccauauuuacaucccauuuaagaacacaaccaguacuuauuguccugcuaaccuccuuuuuccagcuucguuaaccucuuuucccagauguaaauuugaauuccucuuggucucucaauaucuauguccuguuuguuucauuuauucaucuaacauaacuugcuccugugaacccugugccaggcccugggcuggaauuuggguacacacuaguaaccaccaaagcccugguccuugcuuucuuacagcuagaguucaggaggaagauagacacuuuccaaggaaggaaacuugucggucaacuagaguaguaagaaccagugugugugguguguguguguguguguguguguguguguguguaguccugauugugacuaggguuugaggaggcuccauuuaccccuucacuccuuagugucuggccggccugugauaugugaccagcuagcauuuauuccugucauaaagcugccaguacagagcaauggaacugcugugauagaagcaugggggaggguucauggugcacaccuguaacccuagcacuugggagucgacuuugaaugccugccugggcaacauguguuuaaaguaaacagugugagaagucagggguggauucccagagauggcuccaguaagggcacuugccaccaagccugacuaccugagauggaucuaugguggacggacacacacacacacacaaagaugaguuaguuccuuuuaauagagugcuggacagaugauguagagugcacaggcagauagguuggggcugggauggagauguggaacucaguuguugacuggaaguauccuugaguccuugaagagggcaugccuaaugaugaaagaccuaagggauuccuggagagaaaggcugugccaacaagauacacaauugaguugaugcugaggagggaaaucaggagccuggccauuaugagaagcgacagugagggagaacauuugagcagagucccuaguguggcgcagcaggcuccuggaggaggaugguucuagguugauaguacuguguguuaaggcaagggguuugucuacguugggaccugagagaccuuggggccaggggugcugacagggcugaggagguguuagaauucgauucucagcaugguggcccuugaucuugggcagaggaugaaaagggaccaugcaggugaugcaccuggggggcacuuggaauucaggcacuaguaaggcaagggcuagaggguuauccaugaguucaaagccagccuggguuacagagugagucccaggacagcaagagcugcauagugaggacuuguuaacaaaacaaaaacaagcuggucaguggugacacacaccuuuaaucccaguacucgggaggcagaggcaggcggauuucugaguucgaggccagccuggucuacaaagugaguuccaggacagccagggcuacacagagaaacccugucucgaaaaaccaaaaccaaaaagauaaauguaucagaggaucacagggccaagaugggugguacaagccugagaugccagccgcuugggagggagaggcaggaucuccgguucuaagcagcuuccuucccagguagcuaugccuggcgaacuuaguaagacccuaguuuugguuuuugguuugguuuggaugguugguuuuucuuuugagacagguuccuacuguguagcccuggcuguccuggaggucacuauguagaccagguugcucucgaaccuauagagaucuacccaccucugucuccuuaauguugggaucaaagacaugcaccaccacaccccagcgagacccugucuguaaaguaaaagggcuggagaugcagcuaaguguuagaguuucugcuuaaugugcacaaggcccugguuuccagugcucaguacuuaaaaaaauaucucuggcuacccacuggagacuuccuucaauggggcuaagaguggggccaggcaccugguguggugacggcacacaccuaagaugcuugcacuccagaaaaccaagaguuugagggcagccugagcuacauagcaaagcccugacucaagagccagaaggaaaaagaagaauaggugggacacgugaauccaauaggcagugguggggacgaaagggaaggugaggcacugugggaggcugagggcugguuggcuggaugucagaggggagcaggugggcagaaaggugaggcccagaggcagccuggcugugagcgugcacucugugcgaggagggcaagaguggacaaucaggucacccauuucugagagcuggaaaggauccagcccagagagugacugggaacgcaggagcauuggucaucuuaucugcugcuaggucuucagcagacagagccuuacugacagaagcaccagccagacauuucugggugaggcgcgugaggugagucgguaguuuuguggcgacugaggauuggacguugguaccgccuggguugaggaccuaauaaugcucauuggaguggaacaagcuggguuagagggagaggccuguuguucuagauacauggaaggccgaggcagaagggucuugaguucaagaccaaccuaggccagcuacauaaugagagccuguuucaaaaaaggugagggaggggcuggagaaaugacuuagugaagccaaaugcaccuugcucaagugggaggacccgaucugcacccacguaaauagccaagcguggcaguucaugcugugaccccagcccuucgcaggccaagacagaauuccaaggccuugucaucuggccugaauagccagaucagcaagcuacagguucagugagagaucuggucucagacugggagguggagagugagaaagacagcugugguuggccucagcacacagguccacccugcacucgagcgcacacaaacacauacacguguacacguggcauuugagacauggcucauuaguuaagaacacuuguugcuccugccccuagcacccacauggugguucacauauaaagucagucuuuagaaacaaaguggcacacauucacagugccucagccuccugagugcuggggcugcagaugagaaggaccauggccagcuguccacguagucuauggguguagacugcagguucaccauggucugacuguuccucccagugugcaguucccagugcucagcagccaauaucugggacccaggggcuaccccaucucugcagacacugccucccaccccugcuuagaccagucugaaaagguaggggauuccucucucucccuuuccucagcccagcucuacgcagcuuccauguuccacuggcccccuggcucaguacuuaaauggccacuuuccauguccccagcucuguucgccaugcucucuagccugacccacucagcagucuccacuucccggguuccccccaagaagucagauggaacuuuuacagguagcucugggguuuuguuuugguuuuaugccaugcaggggaauugaacccuggaccuuguauguggacacuggaggucaaccucguaugucauccuucaggcacuagcuaccuuggguuugggguugcuuuuguuaucguauuuauuuauuuauuuauuuauuuauuuauuugguuuuacaagacaggguuucucuguguagcccuggcuguccuggaacucacuuuguaaaccaggcuggccuagaacucagaaauccgccugccucugccucccaagugcugggauuaaaggugugcacuaccaccuaccggcgucuuuaauuuuuuuauuugugugacuguguguaaagguagaggccagaagggcgccccuggagccaaccaguucccugguggucauggguacuggggauuuuggggucuuccagaagagcagccaguacucuucacggcugagccacuuucccagccuuucuaccucauuguugguuuugcuuuguuucuggggagaguuguuugguuuuuggggaugucuuuggcaaacuguauguauuccuccugguucuagaacuugcuguguagacuagguuggccugggacagagauccuccugccuccuacuguaguaagagacuugcaacacuguggcuggccaggcaagcucugggaguaggcguggucuugcaggaccugcaugacucugaaccucagcuucuuuggucuuggcuccucccucugugaaaugugggcaauagcaagccgcccugagaagcccauagccucaccugguacaugucaccuucugugagucuuagagaagcucacacccacgccuucagaggcucuuuucuuucugagagccugucccuuaacccuugugcugaauuggaacaucuguauugguaacuuaaagaugguaauagccucaguugaugugggcuggcugugaguaagugagcuuaacuguugugcuguacacacggggcgggauugaugcuccauacuagccauggagcuggcuggguugcuucccguagcugcccaauagggugagugcccacucuaagccuguucugggaacuaggggauucaccugugaacaaggggccauucccgcuccagggacccuauagcgaacaagagaaaaacagcucguuugucuguggaugcucagugcuguagacaucaguggaggagguguuggugggggcugccaagagagaugcauggcagagaugcaugcagcaagaccuuagggcagagagcaggaugccaugagaguugggggagagcauugcaggcugaggcauggccagcgcagagcccugagcugaguaugugccagggacacugagaggacaacugguggagacucaguggggaagggcuaggagcagaagcacuguuggucaugguuguguaggauuugugcagaguagaccucgagaugaagagcucucaucguuauucauguagauggaaagugagggguaaacggugggugggugacagguggaaaaguaaguaaaggacgggcgauggauugguaaugggcgaugggcaaaaucaaugaaugcaugauggcuaaguagaugaaugaauggaugcauagaugagugggugaaucgauggcaggguagauggacagaugaauggauggauggguggugggauggcaggcaaccuaccugacgucacaacagaggcuauuuggcgacccuugccccagcuguggcaagagagagugauggaaccugggcagaauuaaugaaguccuucccuuucucuccgcagccucaaagcggagggucccagugucccaaccaggcauggcugauccccaccaguuuuuugaugacacgaguucugccccaagccggggcuauggaggccagccgucaccugguggucuggguuacccccccucuucauccgacgcagccuuccuggcugccccuauguccaacauggcgauggucuacgggagcagccuggccgcucagggcaaggagcugguagauaagaaugugagucagcuaacacgguggguugugggcugggagcagauggcugacaggcgggcgggcgccacagggccuuaggcuugagcuuugucccuccagaucgaccgcuucauccccgucagcaagcucaaguauuacuuugcaguggacacgguguaugugggcaagaagcuugggcugcuggucuuucccuaccuucaccaggugagcagcaccugcuugguacccgccagcaagcaggguggaaggacccccccacccuggggugcugccacuaccccaacucucuccacaggacugggagguacaguaccaacaggacaccccaguggccccccgcuucgacaucaaugcuccagaccucuacauuccagguuguccccucccuacucugccuaggcaugucugggauggauguuugggugccugugcccgggaagggcuucccuccucugacgagugucugugucugucuuccacagccauggcuuucaucaccuacaucuugguggccggccuugcacuggggacccaggacagguaaggauccuggagcaggggaagacauggggauauggaggccaagagccaucagagaggucucagcucuccuguccugggacagccccaccuuguggccagucacuccagugacaccuuucacauggaacccaucaaacccauuugugcuaggccaucuuuuaaauccaaccuuccuuccucuuggcuuccacccacaaaucuauucuuauguucacaaucccccuaaauaaguugcuucccacuuucaccccuuauaaucucacucuagcagcaacuaaaagcucuaagaggugggccuggccuccucccuauccugaagcugucaguggcucaaaggucaagcagcugacccugugcccccagcccugcugcugccucggggccuuugcacauccaguuaguucccugacacaggaaugugcucuuucccucugugucccgcaccugcuccuucacugugguccucauccugugucauuuccuaaccccuaggcugaucaggccccaucucucccuuacagucgccuguuucuucuuuuuuguggcaucgaaaacaagugucauggaacuaguggauuccuugcuaaggcuccaagaugaagcaaggccccuuccccaccaguucugacuucaggcuucagcucagcugcccuuucuuuaucgggaggaaccuuccugguaccccucacagggcucugaggucccccaucuaagcccugacuugagugucacugucuagggacagacccagauccuugguggucucuguuccauugacacagggcugccccgggugaugcucaggggacaucucuuccggcagguucuccccagaccuccugggacugcaggcgagcucagcucuggccuggcugacucuggaagucguagcaauccugcucagucucuaccuggucacugucaacaccgaccucaccaccauugaccugguggccuucuugggcuacaaauauguggggugagugcuccugcccugccugccagucccagaccuuggccucuucacacugauucuccccuccccccuucccccucaggaugauuggcggcguccucacgggucugcucuuuggaaagaucggcuacuaccuggugcuugccuggugcuguguguccaucuuuguauucauggugaguggggaucagggcgggcaaggcugaggccccaggcuucccaggcaggcuuggggaggucuuuggagcauccaaguaccaaaucugggggcuaggagagccuccuggaagaggcagacucugugcgcccuucugagagcaagagccagccuggaugcuaggcuagggccaggguugcccaguacacaggcucugcuugggcucucacucuuacuucugucucuguaugcugggcuuucugccaauaugccccugagucccuccagcugugguaaaauacugacuaggggccauguuuggacugccguguacucggagugaaucaccuccucuacuuaagccucaguuucuuuuguaaaaugggaugccuggugacugcaccggagucuugggaggauuuagaccgagcaugagggggaagcagaggguaacacgggcccugguccacaagcauaagccuugucaucauguuacuuuaagggagcugggagauggcuccaucaguaaggaagaccugacuucaauccuuggaccccacauuaaaaaaaaaaagagcccaaaguagaucuauucuuauaaucucagagcuaggaauguggggcucauugguaccagccuagccuacuugguaaaggguccucuaacucccacaaauauagguacacacacacacacacacccccaaagaaacaucgggaacagugagguggcuaagcaggugaagggcgcucgcuaccaagcuccugcaggcugcgcugacgugcauaccagggcucaaguagauccaucaccaggaacucgaggccaccuuggucuacaugucaagauccugccucccagagagaaagagcgcgggagggggagaaggagggggaggaaggcaucugagccaaaccaaaaaggaaauagcucuucuaguuugucuucuggagcuggcguguuuugggaguguuacucugugguagggcacugggcuagugucugugaggaucugcguugcgugaaggcaacugucucccaguagguggaagcagcuaggccaugcucuucaggccgggaucuacaauucuuagccucucuucuggccuuugccucugcaaagguuugcucacagggcuugggggagguagcuauucaaaagacccuucuaggaacacaaacuggaggccacagaggggcagggacucaucccgagcugccuggcacuuacgggacccccacuuuacccuuaccacccagauccggacacugcggcucaagauccuggcccaggcagcggccgaaggagugccagugcguggggcgcggaaccagcugcgcauguaccugacuauggcaguggcagcugcgcagccgguacucauguacuggcucaccuuccaccuuguacggugagcugcggccuggccuccagcucccacacucaucucgcuugaccagggcucccgcccuccaggcccgcgcccuccuuccuagccaaggugcucaugucgccuacugcacacccgcaacaauaaaccugaugggcucggcgcagccuccacuucugaccggcagagggcgcuggggagcggaaagggcugcaaguuuaauaagucaauggggggccuucuucuccuucuucuccuucuccuucuucuccuucuucuccuucuucuccaucuucuccuucuucaccuuggguuucuuggccuugucugaggagcguucaugcuucuugcagccagcggcauacuccuggagagccaaggacgguggguaggagaggagguggcccgguugaaagcuguacuggacccgccccacucaccucggcaaggagccuaacgugacccugaccgcagcggggccugggucugaggugcgagaggacacacugggagagggaccgucucuuaccuuccccucugccucugagucgcuggagcugcuacugcugcuggagucggaggagcugccagagacacgcuagauggggguuggggagggagugguuacagugaggacagggacccacucgagcagcuuccaacccaaacuggaaggcugauguguggccgaggaccaaggacggaagccaguucucaucucgggcccucgggacucggugccggugaugaagugacuuacccucggcuugugagcagcgccugccucuggcccgcccggcgcuuuaagaggacaguguuuggggucucccacauggccugcccccucuggcuucuuagaaccagggcccagggcugcggaggagaggggaguuacaugguuauguaggcgacguagcuucccuucaguauucccaggcucugagucuggccccuuacacagcaaauccaccacuccccggggaacuuaccugcggccaagucaaacuccauggcggugaccagucuggauggccggaaacuuuaggcagagccuagggcagggggugggacugcacgaccugcccaucucaggaauuccgcgaagccucacccuccggaccuuugucccucagcucccuggcccugacucacugcacuggcgcucccggcuccacccagacuuuccuaagugggaagugggguuagaaguggcuguaggugucugggagaaagggggugagacuagucaucaguuggucccuuugcggggguacuugcuuccggaaagccguuccguacacugaacaaaguuaaagugcauucugggagcaacgaggucugguucucagcuccuccgagcugagauaaguagugucugaagaauuugguggccagacuagugcgcccuggcggcagcugaaaagcaccagcaaaguuguacccugggguggugggguugaauuccuaggcuggugcuuggcagagugcaugguggugaaauguguugcguuguuuggguaaaggcaggugucuuaauuugggcuguuaaacauaacagauuagugcuuaagcagcaguuuaccucauagucggcaaggcucggggcuggaagcuaggcauaggcagggagagagccccaguacagagauggucugcuuccugcuucuagucuuggcucuccaugucugaauauaagaccuccaauuugg

SEQ ID NO: 3675 - RNA, 2247 nt, Mus musculus
guagaucuauucuuauaaucucagagcuaggaauguggggcucauugguaccagccuagccuacuugguaaaggguccucuaacucccacaaauauagguacacacacacacacacacccccaaagaaacaucgggaacagugagguggcuaagcaggugaagggcgcucgcuaccaagcuccugcaggcugcgcugacgugcauaccagggcucaaguagauccaucaccaggaacucgaggccaccuuggucuacaugucaagauccugccucccagagagaaagagcgcgggagggggagaaggagggggaggaaggcaucugagccaaaccaaaaaggaaauagcucuucuaguuugucuucuggagcuggcguguuuugggaguguuacucugugguagggcacugggcuagugucugugaggaucugcguugcgugaaggcaacugucucccaguagguggaagcagcuaggccaugcucuucaggccgggaucuacaauucuuagccucucuucuggccuuugccucugcaaagguuugcucacagggcuugggggagguagcuauucaaaagacccuucuaggaacacaaacuggaggccacagaggggcagggacucaucccgagcugccuggcacuuacgggacccccacuuuacccuuaccacccagauccggacacugcggcucaagauccuggcccaggcagcggccgaaggagugccagugcguggggcgcggaaccagcugcgcauguaccugacuauggcaguggcagcugcgcagccgguacucauguacuggcucaccuuccaccuuguacggugagcugcggccuggccuccagcucccacacucaucucgcuugaccagggcucccgcccuccaggcccgcgcccuccuuccuagccaaggugcucaugucgccuacugcacacccgcaacaauaaaccugaugggcucggcgcagccuccacuucugaccggcagagggcgcuggggagcggaaagggcugcaaguuuaauaagucaauggggggccuucuucuccuucuucuccuucuccuucuucuccuucuucuccuucuucuccaucuucuccuucuucaccuuggguuucuuggccuugucugaggagcguucaugcuucuugcagccagcggcauacuccuggagagccaaggacgguggguaggagaggagguggcccgguugaaagcuguacuggacccgccccacucaccucggcaaggagccuaacgugacccugaccgcagcggggccugggucugaggugcgagaggacacacugggagagggaccgucucuuaccuuccccucugccucugagucgcuggagcugcuacugcugcuggagucggaggagcugccagagacacgcuagauggggguuggggagggagugguuacagugaggacagggacccacucgagcagcuuccaacccaaacuggaaggcugauguguggccgaggaccaaggacggaagccaguucucaucucgggcccucgggacucggugccggugaugaagugacuuacccucggcuugugagcagcgccugccucuggcccgcccggcgcuuuaagaggacaguguuuggggucucccacauggccugcccccucuggcuucuuagaaccagggcccagggcugcggaggagaggggaguuacaugguuauguaggcgacguagcuucccuucaguauucccaggcucugagucuggccccuuacacagcaaauccaccacuccccggggaacuuaccugcggccaagucaaacuccauggcggugaccagucuggauggccggaaacuuuaggcagagccuagggcagggggugggacugcacgaccugcccaucucaggaauuccgcgaagccucacccuccggaccuuugucccucagcucccuggcccugacucacugcacuggcgcucccggcuccacccagacuuuccuaagugggaagugggguuagaaguggcuguaggugucugggagaaagggggugagacuagucaucaguuggucccuuugcggggguacuugcuuccggaaagccguuccguacacugaacaaaguuaaagugcauucugggagcaacgaggucugguucucagcuccuccgagcugagauaaguagugucugaagaauuugguggccagacuagugcgcccuggcggcagcugaaaagcaccagcaaaguug

SEQ ID NO: 3676 - RNA, 7876 nt, Mus musculus
accccgcccggagaugccugcccuggggcacucuaagaugggcaccccgcccccacccaucugaacccccgcaggaccccgggcuugaaggcugcacauuagccagcuugccucugcaggaagggaaacugaggcccggcgaucggggaggggcgggucccagagcacgagcccccgcccccgguggccccgccccggccauuaagaucccggagcgcgaggcagggcgcaaaguaggggcagcgggugacgguacgauggcugcgcagcggcugggcaagcgcgugcugagcaagcugcaguccccgucgcgggcccgcggcccggggggcagccccagcgggcugcagaagcggcacgcgcgagucacggucaaguacgaccgacgggagcugcagcgacggcuggacguggagaaguggaucgacggaugcuuggaggagcuguaccgcggcagggugagacucagaggggccggggcugagggacggagguagccuaagacccugcaacccugcgaccucggugacccuaguacuugcucgcuggugcaccgacugcggccuuugcuaggauucauggcccgaggcgcuggucucggugcuuagaggcauccagcucgcggacacucagacaugcacccaggauccccagacaugugugcguccaaucaacccagacaacugggaagggcuggggaugagaugggggguggcgggcagagccaacauauugagagaacggauagggacaggggauguccuuaagccaaacauagacaugggugacaagggagauaggacagcagagacucucagcagaggaaacaacaauuuucacagaugacggaagucacagccacucagacauagcaccaaagugagccacacacaaacucacaggaacacaaguggauuaaguuaagggacaacauggccugccauggaauacugacaugcacgcacaacacaaccccccugggcgccaagugaagagauacagcugggcacagauacacaucaguuccagcuggggugcuccaagcuccaauagcuauccagggacacagagugacucaaguuacaugggccauuaucugcugccaaaaaagaaaaguauggcugucuacaaacagaguggcagauguuaaaguucugugugcaugugcacgcgcgcacgcacgcaugcacacacacacacacacacacacacacgucuguggaaauuacacacggaacugguaaaagugucccaggaacacagaacacuagaaaccaagguaggcagggccgcuaacgcuugugaccucagcacuugagaggugaaggcuggaggguuagggguucaaggacgaccuuggauaaggagacccugucugaaaagucuaaaacaaaccuggcauggugcaccucacaccuuuuagacucagcauugaggaggcagaggcagagagaucucugugaguucgaggccagccaguucuacagaguggguuccaagucauccagggauacacagaaagacccuaucuuaaaaaaaagaaaaagaaaaaaaaagauaaauaaagauagucccuacagcuugccaugucugaccugggacagccacacuagagaggcagccacacuggcuacacucucucaaggcaaguaggccccucagucucgggcccagcacacuuagaugccagagaucccuucucccacacaggacagcacccucauugcccagcugggcagcagagcuggcaaaguagaagcuuagguccaguggucucuggcccaggacagcuggaucuuguccacaacauguucagauauccuuuguaucaccaccacgaggccuuagccuccccucagagaugauuccuguuagccggccauggugggccuagguggucacuucucugacugagcagccugugauguggcccagggaggucuggcuggccauaagccccaaaacccuucuuguccccaggggaaggggcccgccccagcagucuccccucccccacaccacugcuaagacuuucccuugaaagggcagaagccaaucccuccccaaauccuagaaucugacauucccagacucgacugggccugcuuugcugaguagggacugcagccaaggagagagcccugugccagccccaaggcccccggggcugaaccaagggugcaggcaucgauugaucgggcugguaccaaggccugggccuccuuccacccaucugucaccccccucacccccacaccccacccagaugucugacucgguggugcugucccugccugccacaucaucuaucgcugcaggcccggccagcugggccugggguuggugaagugccuccagagcccuugacaaaaggcuguggaguggguacagggagacauggacucugaccaguccacucucccuggccguaggagucagacaugccggacgaggucaacaucgaugagcuauuggaauuggacagugaagaggaaagaugccggaaaauccagguagguggagagaaaggagagagucgucccucccccaguccaacaaaucacagagcccuaaacaggacaagccaaguugacauguuuauuaaacacuugcuaagccagacacuaaauccuccacaaaacgcuauaaaacauuuaccaccgaaaggaaaaugagacucagcagggcugaaguguuugcucagggucacacagcuuguccaaagcuaggagcccaacccaggcugccccuguccuguccuuccccgcugaccugaccacagaggcuuggccuucuagccuucuggagcuggucacucugagcuccugcuugaagccacuugggcggaucaagaagucuuguucccuugggaaagggaagggccucugagggaauaggugucaucuauuuacugguuuuuguuuguuuguuugucuuggcuuuuguuuuguuuugcucucccccaucccccagggacuucuggaggcuugugcaaaucccacagaggugaguuucugucuuucccagagggaguggaccccucaccucacugggggagggggaggggaaggcuggccauagccaggauggauggggacaguccugcucuuugucauccuugucuccuccuccuccuccuccuccuccucccccucccccuccuccuccuccuccuccuccccccucucuuucccaucugucacugggauccacaggcugcugccucagagcccaucccccacggggcuccuguuucugcccauauggugccugucccuugcuggcuggcuggggguuggggggggggcuccccgugacuguccauaccguccugggguucccuguauaccucuggagggcccccauccugcagguccuggagcugggcaacacaaccacucccacuuccuucccugcuuuaaaagggaaaauauucacgguucuccccuuagcuccuagaugccagagggacaaacgucaccgccugucagucggccuggagcuggcucagaccuggucucuggggacugucucucagccugagaaacaucucccucuuccaucugagccugugucucucucggaucagggucuuugucucucuccaucucuauuuuuuauuugacuuuauuuuaaguggauaaguguuuugucugcauguaugccugugcaccacacaugccuggugcccaugaaggccagaagagggcucagauccauuggagcugguguuacagacaguugugagcugccauguggcugcugggaaccgaacucggauccucuggaagagcagccacugcucuuaaccacagagcaaccacagagcugccuuuucacaccccucccccuuuuucuugagauaaguacucaguguguaaauucauagcaauccuccugccuccaguagaacuauugacccagggaguaauuucagcuuccuccaaucuuucuaccugccccugcccuuuucucuugccuaucuuaggcuccauucccgcccuguuuggccccagaucccacuucgaauaagcuguugcccaaagagacacaggccuuggggugggaggccucucuccugcucuguucucagaaucccacucugucuguaggacuucguccaggagcuacuggccaagcuucggggccugcacaaacagccgggcuucccgcagcccagccccucagaugaccccagccugagcccccgccaggaccgggcccacacugccccacccugacugcgcccgccucugcgcuccacccccaaagcccagauuguuucuaaguuguauuuaaugguucuguaacugccucugguguccggauuuuccucuccccauuacccuggccuucugcagccccuuguccuuggucccccaagccacagcuggcccugacagacggagaaacauuccuccuggccacagagccugagaacauacccuacugacccugaggcguccuggagacucacauccuguccccaccucccccauauggacccagucccagcuccuagggaaggccagggccagauccccuggccuucagggucacgggggaugugcacggcccacugugacccucugucaucuucccauagggcaucacacagcgaugaggccauuaguccgcucuauggagagugugcuugguguaacuguaugagcugaggccacagaacagcggaacauagcauuaaagugggagagaagagcccagaagugcacaauggguuuagguaccagggaugggaggagcuauugccccuucuccaggggaggggagacagaacaauaggacaauagagcgcuugcuagaaaccuccagugagagacuagggguguggcucaagcaguagagcaccuacuuagcauaaucaaaacccugguuccauccucagcagggaaaaauaucugggagggcuuccuggaagcagcagcaucgaggccagaacuuacacagguugcuucaaccauucugcagugugaacuuggaagcagagagcuugauaccaggguucuguuggggauaauacaaacuauugaucaggaugaacaguguccccagagccaggcagggcaaucaaccgaucaaggauugcagaugccuugccuaccguaccucucagaaguggagaguggcuaccuaacaucagccucccugugacugacgcucugaccccaaaguuccggugucuaggaaaacaacucacccaucuuagugagacugcccaccccacgugcugcccacugcccucuuggacaagggcuccauccuggggauccgagccacagagcaguaagggaagauggcuaacgucuggcucguccuggguagccagcccugcugggggccuagcugucuccacacagaugggcuucacagcugccgcugccucccucagagcaaaggauugagugggggauggugggugucgaacgguccccauuaccuggccucuugucccggaacacuguaugagccgcagaacccuccacuucccuuucacagaaccuguuuuugguuccucaugguuguggaggugacaaaccccaguucaagcuuuggauguucacugugucagaucugcaguugucuauagaauacaucacagaugaagaaucagaggcccagaucaccagugccauuugcuaaaaagcugggacaugguggcccuggggcuucaccacgguaccccgucacuggguuguuuuuaguuucaggagauuggcuaaaucuuuuuuuuuuuaagaguuauuuuauguaugugaguacacuguagcugucuucagacaccccagaagagggcaucccauuacagaugguugugagccaccaugugguugcugggaauugaacucagguccucuggacgagcagucagugcucuuaaccgcugagccgucucuccagccccugucuaauucuuacuaagguguuggugacugcuaacaguucugggagaugaucccaugaaaaggcagugcaauuauguacgugugaggucacagcaaaaagcaccaggaagcugcgugccucugugguuaaaagccuaaacugagagccaggcagugguggcacaccccuuugaucccagcacucaagaggcagaggcaagcagaucucugaguucaagaccagccuggucuacauagcgagcuccagagcuacacagagaaacacuauguacaagaagcuaagcagaggguaguguucugcagcccuggcauuuggggcagaggcagcaagauugaguuccaggaugggugccauagccugguccuuucucaagauaaaaacaaaaaagagagacagcugcugaaggcacuggcugcuaauccugaggacuugaauucagucucugggacccacaugauggaagaccagaacaagccccaaaggcugcuccucagauccuucacaugugcacuucaugcaggaauaagagaccagccuggucuacgcagggagucugaggcuagcuauggcuauguaguaaggcagucucucagaaagggcugcacaccuuuuuuuuuuuuuuuuuuuuggagacaggguuucucuguguagcccuggcuguccuggaacucacucuguagaccaggcuuggguuugaacucagaaauccgccugccucugccucugccucccgagugcugggauuaaaggcgugcgccaccaggccuggcggcugugcaccuuuaauaugagugagcagaggcaggcggaucucugaguucgaggccagccuggucuacagagugaguuccaggacagcuacacaaagaaaccccgucuuaaaaaugccccacgcccccgacccaaggaggaguggcauuggaaagauggcucagaagcuaagagcagagggcccagguucaauucccagcacccgcauggcagcccacaacuccaccguucucgccucugugaguacccgugugucugccacacacgcaggcaaccccccgcccccugcacggugucuugagaagccccguagccucacugagcuuacaugccugaagauggauagcacugccugcuuccgagggcgaggagguuucuggaagggacaagguguggacacaggaugaacgcugucacagugggaaggggccgagcgccccacccaugagaagcucugcaucucaugccgguggugugcugacccugagggucgucacccucucucacuguggcacaugccuuccuggggacucuccguguccccccaccccacccccguuugcuucccacagggcagacaaaugaugagauuucucagaguccucuuccagucuccgcccacccuguucccuguuccccuuuccuccaaaaucgucucacccccacuuugauaaaaauccauuuccccagcuguugaguuggcccaguggcaccugccauugagugugacaaacaguuccauccugaggcugcacacggugggaggagaaagcuccucuucaggucacccucugaucuccacguguguccucucccaaauaggguuguuuuuuuuuuuuuuuuguuuuuuuuuuuuuuccaaaaagucaaguuuugguaauuuucccauuaauaagucuuucauucuuucuuuguuuuguucucagucaggagaucugucuuuuguuguuguuguuguuguuguuguuguuguuguuuucaagacaggguuucucuguguagcccuggcuguccuggaacucacucuguagaccaggcuggccucaaacucagaaauccgccugccucugccuccugagugcugggauuaaaggcgugcgccaccacgcccggcucuagaagccaggauucuuaaugucugaaccaucucucuagcccccaaauaaauauuuuaaaaaua

SEQ ID NO: 3677 - RNA, 2635 nt, Mus musculus
gcaccaggcuucugcucuccucaaagccauacccccgccuuugggcgggcauagagggguaguggaugcuagccagcagcacggaaagagccuuuuucuaaagaaaaagacaaaacguggaaaaaaaagggaaaaaaauuaauauauacaaagaguccuauaaagccuggcuggguggagaggcacuguugagugucugcuggggaccugacuuuaccaguuuccugaauggcgccuccccaccucauuucuggaguugcaauggucucaacucccaucugagguggguaccaccccuuccucaguacccaccguggauacugcaugugaacuaugguuuugaacucuuccuccuccuccuugagagccccgcccugcgcccgcguggugccugccugccaggccuggggcgugcagccggggaggcggguggggugaggcaggcaggcagccagcccccugcagugagaagcacagauugcaauggacucaguuuuuuuuuuuuuuuuuuuuuuuuuuccuuucucccuucccaccccuuuccuucccuacccagccaggcugggcugccuccugccccccucgcuagccauuuggggguggcaagggggugugguuguuucucgugguuguguguguuuguuguucggguuuuuaaaaggggaaauugagacugcaagugggggagguggagggucugggggagucugcccccaauccaggaguaccccccuugccaccaagucuccuuuauugccugccucugcugugaauuaacuuguucuguguauuaaacugggccugaccccucugcccacaacugcuuccaucucuaaccucuuuuggggugucaccaacaugggaagccaaggggccucacugggguagaagccacuguggcuggcccccaccucuuugccccuacaccaugccucccuguggcuuugucccagcuccucccugucuugcuggagagaagagggggaugggguggaggggcucccacccagccagcugugguugccauagcaacgggcugcugcagcugcagcgggaggcagcucaaagagggaggugggagugaagacuggggggaagggagggcuggagagaccagaaggcagcccccucccuggcuaggguuugggagauagcaccucagcauggcuggcugucacuugggauucccugaccugggugugguuaaaaguggaggacaggaggacaucucaaaacacagggauucaaggagacaggcagggugggguggggguggguggggguggagaaccagggcaauggucaggaaggaagaugguucugaggccacaaauguacugaauggaaaaaaaggacaaagcuggagagauacacagaugaagagagagucccaggaauuccgagggaagaggacagggaccagggacgggguggaggacuaguccaguaaauaauaguuuaaaacaagaaaaaggaaaaaaaaaaaaaaaaaaagccaggcuuuggcaagaccaggggagggagaaguggacagcuguuuggagagacaagcagaaaauguacaaagucagagggagaaaaugagauaaggggacaggcaaagcccccagacaaaagacacgggaaugagcgagacuuuugguuggaaggcaauaaagaauguaagggaccgccauccaggaugguaacacacuauguggcucagaacuccaacacuggaggcugaggcaggagggacggggaguuaguuacacgucauccugggcuauagcaugagccuucucuuuagaaaggggugugggggugcgaacagacaacagaaaucuggagagugccaggcagaugaggccaaagagauaggcagacugaggagaggugggggaggggcaugaaaaacuggggcaagaaagggaagggacuacggggcgcagugcaggcgccuucagggcuuggcgugcgugugcgggugcgcgugugaauugugggguguugggagauggugguaugucucccaggccaggagaggaugugagaacaguuuguucccggguucccucccccacuuggcccagguugauggggggagggcugggcuggauggggcccugaggaggguggcgagugaggaugucuaaguagcuggaagcccuugcaagggcugauucuccacuggauauaggcaaacaccuuucggaagauauuuggcgguggggggugcggguagggugcgaaggaggaucagaguucagcucagaccugaagaacacaacgaccgcugaugggauggggucaguccuguccagagaggcugacuucccacaggaggugagucuucaggaucuucuuggaacuccugaguccaaagucaguuugccuggugccucgcccacccgcagauguccacaguucggcgagacacagacccaggaccccaagcuucaagccgcccccucuuguccugucuggagggccauagaaauccugguuuuggccgaggcuucagguccgagacacuuccuuuagcuagaugacucuuccuuuaccucugguccccagggaccccugggcagcucuccacugcaauccauucccugcacuguuggcagagggagguccacggcauggugggacccag

SEQ ID NO: 3678 - RNA, 2635 nt, Mus musculus
cugggucccaccaugccguggaccucccucugccaacagugcagggaauggauugcaguggagagcugcccaggggucccuggggaccagagguaaaggaagagucaucuagcuaaaggaagugucucggaccugaagccucggccaaaaccaggauuucuauggcccuccagacaggacaagagggggcggcuugaagcuugggguccugggucugugucucgccgaacuguggacaucugcgggugggcgaggcaccaggcaaacugacuuuggacucaggaguuccaagaagauccugaagacucaccuccugugggaagucagccucucuggacaggacugaccccaucccaucagcggucguuguguucuucaggucugagcugaacucugauccuccuucgcacccuacccgcaccccccaccgccaaauaucuuccgaaagguguuugccuauauccaguggagaaucagcccuugcaagggcuuccagcuacuuagacauccucacucgccacccuccucagggccccauccagcccagcccuccccccaucaaccugggccaagugggggagggaacccgggaacaaacuguucucacauccucuccuggccugggagacauaccaccaucucccaacaccccacaauucacacgcgcacccgcacacgcacgccaagcccugaaggcgccugcacugcgccccguagucccuucccuuucuugccccaguuuuucaugccccucccccaccucuccucagucugccuaucucuuuggccucaucugccuggcacucuccagauuucuguugucuguucgcacccccacaccccuuucuaaagagaaggcucaugcuauagcccaggaugacguguaacuaacuccccgucccuccugccucagccuccaguguuggaguucugagccacauaguguguuaccauccuggauggcggucccuuacauucuuuauugccuuccaaccaaaagucucgcucauucccgugucuuuugucugggggcuuugccuguccccuuaucucauuuucucccucugacuuuguacauuuucugcuugucucuccaaacagcuguccacuucucccuccccuggucuugccaaagccuggcuuuuuuuuuuuuuuuuuuuccuuuuucuuguuuuaaacuauuauuuacuggacuaguccuccaccccgucccuggucccuguccucuucccucggaauuccugggacucucucuucaucuguguaucucuccagcuuuguccuuuuuuuccauucaguacauuuguggccucagaaccaucuuccuuccugaccauugcccugguucuccacccccacccacccccaccccacccugccugucuccuugaaucccuguguuuugagauguccuccuguccuccacuuuuaaccacacccaggucagggaaucccaagugacagccagccaugcugaggugcuaucucccaaacccuagccagggagggggcugccuucuggucucuccagcccucccuuccccccagucuucacucccaccucccucuuugagcugccucccgcugcagcugcagcagcccguugcuauggcaaccacagcuggcugggugggagccccuccaccccaucccccucuucucuccagcaagacagggaggagcugggacaaagccacagggaggcaugguguaggggcaaagaggugggggccagccacaguggcuucuaccccagugaggccccuuggcuucccauguuggugacaccccaaaagagguuagagauggaagcaguugugggcagaggggucaggcccaguuuaauacacagaacaaguuaauucacagcagaggcaggcaauaaaggagacuugguggcaagggggguacuccuggauugggggcagacucccccagacccuccaccucccccacuugcagucucaauuuccccuuuuaaaaacccgaacaacaaacacacacaaccacgagaaacaaccacacccccuugccacccccaaauggcuagcgaggggggcaggaggcagcccagccuggcuggguagggaaggaaaggggugggaagggagaaaggaaaaaaaaaaaaaaaaaaaaaaaaaacugaguccauugcaaucugugcuucucacugcagggggcuggcugccugccugccucaccccacccgccuccccggcugcacgccccaggccuggcaggcaggcaccacgcgggcgcagggcggggcucucaaggaggaggaggaagaguucaaaaccauaguucacaugcaguauccacgguggguacugaggaaggggugguacccaccucagaugggaguugagaccauugcaacuccagaaaugagguggggaggcgccauucaggaaacugguaaagucagguccccagcagacacucaacagugccucuccacccagccaggcuuuauaggacucuuuguauauauuaauuuuuuucccuuuuuuuuccacguuuugucuuuuucuuuagaaaaaggcucuuuccgugcugcuggcuagcauccacuaccccucuaugcccgcccaaaggcggggguauggcuuugaggagagcagaagccuggugc

SEQ ID NO: 3679 - RNA, 829 nt, Mus musculus
ugaagugugugguacugauaguuuuccaguaaaggagcagagaggagcaugucggagggcagcacccagucggagagaggaggagccagccaugcggagggaggcggggagugcuuggcagagagcagagagacauaucagaauaagcucgguuguggggacgguuguggggacgagcagacauggcaugggccuccagucggcugaaaacaugguggcgccugccuugaaaucccagcacuuggaucagagcaacaggcuaauaaucuccagauuugaggccaucuugggcuacacagugagaccuuuucuuuaaaaaggaaagaaagagaaagagagagagagagaaagaaggaagaaaaggaagaaaagugggagauucauguucccaaagccugcacugucuucagaccuagagguggcugaaggcaaggccuggggguuccugagucuggccucauggcugugugcaggcagagguucggcuucucaccgucacuagccuucccagggcccucucccggggaagacugguuccuauuggcaggcucuugcuuuccagccaagaaugugguuguucucacccugaaggugguccacucaugcugucaguggagcguagcccacucucuccaucccagaaagcugccaggccuuacucugcuuggaaguagaguaaggaucuucguggagaagcagcggcuaagucggcagagccaggaggagucaggcuccggcgucagcuccagcuucccugggcacugucucacgacuuuguggccuauccauggcuuuucaucugcagacugggcccaccauucugugcuua

SEQ ID NO: 3680 - RNA, 10707 nt, Mus musculus
cagccccaccuccaacccccuuccccugaccaagagcuaggggccuggcucgcagccuccgcggggcuggaagcccagaaccuagucaaagaagcuaguggcagucggacucucaggcuugagaucugaugucccagagccuucaguaccacggucccguccguagcacuuuggugccgccgcugcagcgcugaccgcgcuggcaacccacccucccgggauacccgucagcugggugguccccggucucgugcggccuacgcucuucuccggggacccgcucugaggaccccugggacucagguggcccguucguggguacagcugccgugcugacgcgcugcaccuaaaccccggccuggcuguggacaaggaccgagagggaaggcgggggccgcgacuugcacgguggagauacccugugcagaaccuuagauucccggcgggccuggggagcagagaaccgggggacaccucggaccuaaggcugggcagccccggacugguaacuggugaagcagaguggccgaagcagcaaacucgggcacgggugacugugggcugcuguagucuaucucgcuugcugggaucauacggauggggucagccuggagcccugaagcuuggaaggggauucugaucaauuucagaaaagcguaggggugaggccagaggacgugguggcauacaccugacuucucgggauuugggagguggaggcagggggaguaggcgcucaaggucauucucuacugccuaacguuggguugcaagagagaaaaagaaaagagaagaagaaggaaagaagagaaaagaaaagaaacaaggccuggagugucugccagucuucagaagagacccuagaagccagcagcuacuacuucuguuuaaaacagagauuaugugugaguuucuagaacuucuguguuccugugaaaugcuugaguuuuuguuuuucguuuuugguuuuuuguuuguuuguuuuugcuguuguuguuguuguuguuuugaguauggauuuuuuuaauuuccuucccuuugaaagacguuugugaaaauguuuuauucaacugugaguggugucacugccacuccacuaggaccaaguguucaaggccagccuggguuacauugagacccugucuuuaaaaaaaaaaaaaagcgaacuauucauugcuuugggucugagaauuucccugcauuuucagugggcagagacuuaaucaggauuccucuuugagugcgcagcgccugcgguucuaugguuauguagcacccacgugcuauacauuuagauguccuguuuuucuuaggauucucuaauacggaaauaugucugcuaaagucugaugugugauuggucaaggacgagcauguauuuaaaugauugaggugguggcuggagggaccacugaggcauuuccucaagccccuacacuuuucggguuuuuuguuuuguuuuuauuuaagauuuauuuauuuuauguauaugaguguucgaucugcaacaucagaucccagcauagauggcugugagucacggugcgacugcuagaaauugaacucagggccucuccaggcuacacuggucauucuuguguggcacuggagcagcggcggcggcggccgaugcaucucuugggggugccggugagaaauggcagggcuagggcuagggcuagagcacuuagcaagcuccggcuggacugcaggcuucagaggacugcaaaaacaagccaacaaagaccaggagagcacauucuuucucguaacauuuauuuuuauguaugugcaccucuuacauguguccgaggacgccaggauacugcguccggucaccuggaccuggaguaacaaauguaaggaccacgugggaguugacugcugaacucagguucccuggaacggcagccagugcuccuaaccacugagccaccugaccacccacccuacccaaaucuguuuuaagcagucuucuaggugauccuggugcauacugaggucucacagccacauuuugcagcugaguucccuguaguuuugaggagguuuuugguuucuguauaaguuaucucucaccucucaguuuguguguuggaaggcagguuguguauaagaagggagaaacgggauaauacauugauuuuuuuuuuuuuuuuuuuuuuuacauuuuggaagcucuagaacaguucugcucucauggcugcacccucucccuccagcucuagccucugugaacggcuucaccaggacaugauccucgaggaagaacaagccaguucuugcgauucuggaaucauggcucauguaaguugcuuucuuuguacuugauauuuucugacuuuacauguauguuuguauguauguauauacauauuaauuuguuuauguuuagcaugugcgcaugcacauaggggcguaugcaugcuguggcauacgugugauggccccaacuuuuggaaauuaguucucuccuccuuugugaguccugggguuugaacccagauccucagcuucccauguggguccaagugaucaagcucaugcauggauuuauuugcauuuacucguuuuguguguguggggggggggggaaugccacaagugucugugaaggucaaaaggucaaaggauaacuuuugggagccaauucuccuuccaccauaugugaccccaagauggaacucggguuaucugguguggcagcaaacacauuuacccuugcggcugccccaucauuuuuauucugucggguuguacaaaugcucuguuauuuugaaacuuccuaacagaaucggauccuagaacuguacccagucucuuccauuccacugagggaugggucuccucccuacucuucucuccaccuucauccaagggcacacuggucaaaucagucccuaacaugggcuuauuuggugugaagcccugaagagcagacaucuucuaaaaacaacacugcccccauagaauuauagugugaacaguaacuacauauauaauuuaaaaucuucaauuguugacauaguaaaagucauauaauaugcaugggcuuacuuauuuuauuuauuauuaauugugguguguguguguguguguuugagacagaguuucucugugaggcccuggcuuguccuggagcacacucuguagaccaggcuggccucaaacucagagauccaccugccucugccucccaaguguggagauuaauggugugugccacuaguauucagcauuuuuaguauuuuaaauauacuuauuuaauuuuacuguaugugagugugcaugggugugcauaugcacuccacacgcgugcaggagcucucagugucacaagaggauguuaggucucuuggaagcaggguuacgggugauuuugagccaccagguguauucugggaaccaaaccuggauccucuucaagagcagcaagagcucuugaccucugagcugucuccccagccccuuuaaaacacuuucucaaaaugucauuauuuuuuuauuuaugacucugagugcauguaugcaagcauguguuaugaauaauaucgguucugggaacucuguaagagcagcagcacuucugacugcugagccaucucucuaguccccuauggcugugacaggcucauauauuugaaaaccugaucccuaguuagugggaccacuugggaaggauuaggagguguggccuuguuggagggaagcaugucacagggagugugccuucaggcuuuaaaagcccacaccaggcccagccccucucucuccuuaugugucugucugucucugccugcugccugugagucaggcuguaaagcucucagcuacuacucuagagccgugccuuucugcuucccaccaugaugauaauggacuaaccuucuaaaacuauaaugaaggccccaauuaaaugcuuucuuuuaucggacuuggcuuggccguggugucucuucucagcaacagaacagagacuuagacaccccaccccgccccauacauuuuaucccaucuuaucuuacacgugggacaccggcuugucauugcagaguacggugauguucagagauguggcugugggcuuuucucaggaagagugggagugccugagugccuacgagagggaucuguacagagaugugaugcuagagaacuacagccacuuggugucacuggguaagcucaucuguaucaaaccacauucccagagcugacauucuaacugcaaagacccucucuuugugguuuagaauggucaccucugugaaauacuuuuauggucccacaaaacagaaauacauaguuauaauuuaacuuugauaaaauaaccuuuauaaauauaacauauuuuauauaauuauaaauuauauaacauaaaauguauaaaacguauagcuuauaaguuuuauaaaauaaaacuuuuauaaaaauaacuuuuaaaagggugggguaguaaacaaaaaauugaagucuggcucugccuuugagccuaaaagaaucuaauuuuaauguuuuuccacuugguagccaucuuaguuuugaagacuugauuaaauagaauuuuuaaaguauuuauuuguuuguuuguuuguuuguuuauuuauuguaaguacacuguggcugucuucagacaccccagaagagggcauuggaccccauuacagaugguugugagccaccaugugguugcuggcaauugaacucaagaccuuuggaagagcaaucagugcucuuaaccacugagccaucucuccaacccuaaaaagaaucuuucuuuugguccuggagcgaugucucagaggcuaagagcacuggcugcuuuugcagaagaccuagguuugguuuccagcauccacauggcaguucaccaccacugcaacuccacugccaggggauccaacgucccccuguagccucugagagaacugcaugcacauggugcacaugcgggcaagacaccuaaauccacaauaaaaaguaaaaaacuaaauucaacagcugggcaugauggcacacgccuuuaaucccaucacucaggaggccaaggcaggccagucucugaguucaaguccaggcuugucuauagagugaguucuaggauaccaaggcuacacagagaauccuugucuugaaaaacaauaacgauaauaauaauaauaaccucugugugugccuacccacaaggucuugugugcuucaucuugaauucacuguguagccaugacaccgaaccccugauccuuccuucaucuccuaagugcuggcgucacagcuguguaucacccccaccuggcaaauagauccauucuuuaaauaaauucugcucuuuucuuucaagcaggauguuccauuucuaagccagaugugaucacccuguuggaacaagggaaggagccguggaugauugugagggcugagaagagaagguggagccgaggugagggagugcucagcaggcaccugugguggugacuguuacacaucugcuggcuggaggacacgccccugagaugcugacggggagguugaaagaugcucuccugagaugcuggggaaagagacaugaaacuuggaaagaaaacuuagaucuuucagcaugagucaccaaugacauuuccucucuacuucaguuugccauuugucucuuucccacauuucccuuuccuuucaacgugggaaagcuuucuugucuggugauaauaguuuugccuguuuuauaucuaauuucuucauagauaauccuuuguauuuuaaauccgcccuggcgcacccuuaagaaauauccaaauuaguuuuauuuguaugguugcuuugucgguaugucuguccaugcaucggcugcaugucugauguccacugaggccuggagaccauggcuacaggugguuauggacaggccacuauuugguguuggaacuugaacucugaugcacuggaaggacagccaagugcccuuaacaucaggccaucucaacagccugauuuucuuuucugagaaagggucuuacuguucacagcagcugguugugaacucuccauccuccugucucagaucaucuccagcccugggccuacaggcaugugccccuaugcucacuuuguauuucaguuuuccuguaucgauuuauuguucucauuuccugggauucauauuuaguaaugaacucauacaauaaccggggauagaaagguggcucaguuguuaagaacccugacagguaaucauauaggaucugggaucuguucccagcacccacacaguggcucacaaucaucuguaacuccauuuccaguggacacaauccccuuuccuggccuccaagggcacucacuguaugcucauggcacacacacauacauucaggcaaaacacauguaaacguuaaaaaaauagcaagucugugcuuguggggggugaggggggauagcucaguguuggagcagcuaaccauggccuugaucaccagcaucacacaagauaaaacaaaaaauaccuggcuuguuaauauccccaaauggcuaggcaugguggugcaagccuucagucccagcacuucagaggcaaguggaucucugugaguucaaggccagccuggucuaaaaguaaguuccaggcuagccagggcuacauugugagacuguccagguggaagaaaacagaccugaagugauuaaguauuagaagaaaagcagauaggguauuuguagccaccccggcggccauggguuacuggguuccugaaaggaaagcugggguuggauggaaaaggcggcgagagaaauaacuagccgagacaaaucugaucaaggcucaaucuuuaaugugcagcacugaauauauaugggaaaacccaaggacccaucccuuuguuucagcuggguucccuugcuaguuucagcugguuagaguuguaaaguaggcucugccgugggcaguucucaguugucuggcaggaagauguaaauguaacaaagccagacuccuggcuccggugucugaggagguuuguuuagccaacucaaacccgggggggaaaggcacacacaguauugauauggcgaauuagagaccagaguaauuugagaauggccaagaaaauagaaccagucuaaagagguucggauugcuaaaaaugguuggcuagagaugggauuccuugaacaucaguucccauaaccucaaugccucgcaacacauaaauuacacuuuauuccauaauggcauuuuugguuuugcucauucgugcuggaugugguaguccuacggggccucacacaggccacccgggcgcucuaccacagcugcagaguccccacggguccguguucccucccaucagucuuuguaacaagugccuccgaugcaaaagucggguccgguucuuccucccagccccaugcucucagaaauaagacucagacucaaaaaauauuacagauaccucagccuugugccagcccucaggacuagucucagacgagaucaaaacuuagauaacccaugugcuuuaaccuacauccugacacguggcugguuaccugggcucagguaccaugugcccaucuccucacgucuucccgggccgaucuccagugccucauucuaucccagaauccuuugugccuccuggaugucccaucucuauuuccugccuaagccauaggccauaggcuuuuuaauugacauacaauacacagauauucucucuccauuccagagccuucaucucaaguuucagaggagagcaucuccuuaacugugaauagcuucaguugucugcaggaauguaacuucucacagucaaacuuagguacaaacacaauaacuccuuauaacagagccuguuuaucuacagaggaguuucauacuuacuugagacuguucacagugccaaauucugguuuguuuuguugaaaaaaaaaaaaaaaaaggacugggccuuauuacauaacccugguugaaauggaauucacucuauacauuaugcugacccugaacuccaccugucucuucugucuccugagugcugggauuaaagguguguuugggccacuacaucucacccuucauuuuuauuuucaauugugcaucuagacaugccaucuuccuuauccuucuuaaaccuuuuuuuuaauuacgugauuauuugggggcugcuaaguccauucagcugcuuguugucuuuucuuuuccuugucuugagcgaagucuugugacguagcucaggcuggccuguaacuggagcuuuuaacucugccucccgcgugcggacagcuagaggcuuguuuucguuacuauuauuucuuuauuucauccagauuaggacgguaccaugcguuuuucuucuuuuugcuuucagaucuggaauccagauacagcaguaacggguuacuuccagaaaagaauacuuacgaaauuaaucuaucuccgugggaaauaaugggaagaauucaaaggcguggccccgaagacucccuuuuggggaaagacuuugaauauaaaauauaugaagaacaagagaacucucauaggguauauuucagacacgugauaaaaaccaccucuggaaaaagaccucgguacagaaaacgcacaccuguuagucucuaucagaaaacuccuaacggagaaaagcccuacgaauguggggagugugggaaggcuuucaaaguccgccaacaacuuacuuuccaucagaggauccacaccggcgagaagcccuacgaaugcaaggaauguggcaaagccuuccgacagugcgcccaccucagucgccaucagaggauccacgccucugacaagcucuaugaauguaagaagugugcaaagaucuucacguguagcucggaccuucgagggcaucagaggucucacgugggcgagaagcccuacgauuguaaagagugcgggaaggccuuucgaguccguggacagcucaugcuccaccagaggauccacaccggugagaagcccuacgcaugcacggagugcggcaagagcuuccggcagguagcgcaccucacucggcaucagaggcucaacaguggcagcucacgccacgaguguaaggagugcggccgggcuuuccugugcagcacgggccuccggcugcaucacaaacugcacacgggagagaaacccuacgacugcaaggagugugggaaggcguuccgggugaggcagcagcucacccugcacgagaggauccacaccggcgagaagcccuucgacugcaaggagugcgggaagaccuucagccgcggcuaccaucucacccuccaccagaggauccacacuggggagaagccuuacgaguguaaggagugccgcaaguucuuccgccgguacucggagcucauuucccaccagggcauucacaucggggagaaacccuaugacugcaaggagugcggaaaggcuuuuaggcuguucucccagcugacucagcaccagagcauucauuuuggugagaagcccuauaaauguauggaaugugagaagacuuucagacuccucucacaacugacgcagcaucagagcauucacacgggcgagaagccuuacgauuguaaggagugcgggaaagccuuucgccuccacucgucucucauucagcaccagagaauccacucuggcgagaagccguacaaauguacggaguguaagaaggccuuccgucaacacucacaccucaccuaccaucagcgaauucauaagaauuuguaaggacccuucuacgaauccuugccuugcaaauguacuaaggagcaguaggaaaucagaaaauucuagaagaaaaaaagguuugaauccuuauuuugcuguguucauaaguaacagcauaaaaggucaaaggaaaaaaaugguaaacuuuuggaaauucuuucguaaauguauaaaagguauuuugucuuacuguacaccuaccuaagggcauagucaggguaccaacucauuuugaaaauuaauaaauaaaaagaauugucguuuagccugcauaaacucuccgagugacugaaagugguugagguacacaguucuuagaguguuucaucagaaucacgcagagucauauggaauuaagaaguuguaucaggaaaaccauuguguaauaacauacaguggagcagcgauucucagccugugggucccgacccucugaggguagagccacccuuucucaggagucaccuaggaccaucgagacacagauucgcauuaugauccauuacaguagcaaaauuacaguuaugaaguagcaacacgugauuuaauggugggagucaccacagcaugaggaacuguauuaaagggucacagcguuagggagguugagaaccacugcucuagaauucagccaugauagacuggcuuguacuugguagugaauaggucaggcugccaggaugugaaccuacugauccgucuugccaccaguguagcacaguaaagcgucccgugucuuccacugcgacauugugauauucccaccuaacucaacgcaccaaaccucuaaaucaaugagacaaccaccaacauuaaaaaaaaaaaaaaaaaaagagucaaaaaacauauaaucuaggccagaucuucacaaucuuucuuguguguuuuuuuucuacguauucaagagugaagugaauuuuguuuguaaacuuaaaaaaaaaacuuucuuaaaaguaauaaagacauuuuuacaggua

SEQ ID NO: 3681 - RNA, 2436 nt, Mus musculus
aaggauuuuauuuuuuuauuuuacuauuugagaauuuuauauaugcuuauguuuugauuaaaucuaauuccuauuucuucucugccaauuccuccccucucucuaccucuacuauucucucccaauuucaugugaucuuugccaagauuuauuuuuaauugugcgugcgugugugugugugugcaugugugcgcgcgcaugugcaccugcgugcaggugcccauggaaagcagaaauuugaaacuagauugcaaguaguuguaagcugcccagcauggcugcugggaaccaaauuuggaucuucuucaagaacaaugguguucuuaaccauuaagccaugucuccagcuccccaguaaguauggcuuauaacuagguggaaagauggauucucagcacuuucuacgcugucaucuucucuaaccuaagucuuuuguugucuuuuuuucgucccugcacacagguaucgugcacacagguauagugcacacagguaucgugcacacagguauaguucacacagguaucgugcacacagguauccagguaucgugcacacagguauagcacuacuccagaugccauuuaggugagcagguggcauagccacacaaugggaugacuguucagcaccaggggcaugagcuugguccauucacguagacagaggaaaccuaaaugcauauuagucaaacaaggcaauccaaaaggucuacauucugugauuccaacauaccauuuugggaaaggcaaaacuauggacgcaaucaaguuucuaaucaucggaaaagaaagacugacagacaggaggauguggaggguuuugggggcacugaacuucuuccacgagacaacauagugguggauaaauuuacucaccggccucacccuuuauuguguacaucaaagugacuccuagagagggguucgugaggcgccaccacuugcugaggagcagaugacaacugcugauaggaaggcgucucucugccucaggcuguaggaggcuacccaugcuccaguggaugggccugggccucuauguaugaggguaguauuaaucacauucaauggguuguuaaguggggggagcugggcauggugauacacacacacauacuugugacauguauguauguauguauguauguauacaugugucucaagcaaacugucauaauuaauugaaaauaauuugcagcaaaaugugcuucccuaaccugaggguugagcaucaagaucguggucagaucuguccaguguaucuggaaaucuaaacaagaaaccccuggugggccaggcagugguggcgcacuccuuuaaucccagcacuugggaggcagaggcaggcagauuucugaguucgaggccagucuggucuacagagugaguuccaggacagccagggcuacacagagaagaaacccugucucgaaaaaacaaaacaaaaaaucaaaaaaucaaaaaaaaaaacaacaaaaaaacaaaaacaacaaaaaaaagaaagaaacccccaguggguucuucagauccugcuacugucuuaugacuuuaguuaagucaguuugaccuccaguuaucccauuuccaggugaggugagaugaggcaguugcuaggaaagcccagagucauuacacaucacugccggugucagaucuugugcccauacccauagcuuccaugcacugcuuugcuugaauccuuccacugccuaucuuggguggaccgccugacuuucaaagaccuacccaucuuuucuugaugccuccaccccacugauucagguacccugggaagugggauaaagguccacccuuuggguucuugguggaguugaagagaacugcguguguagagggaaggaugaaggggcuucuuagauuuuuccccaaucacuuugagguucucgaaucauggcagcgaauucuggggagaagcacccacguauuucccagcuuuccuuucauuaagcaaguuaguaucagguaaagccugaaggcaaagucuggaauguuguagggaaguugggucaucucuguuggauccuccucugcagucaaauagaaaacauuggaggaacuugguaugacaagccagggucagucuccacaacgcacagucgggcaugaguauagacucgucaugguaaauggggaaaccauucuagagugaacaaaagacaacuaaguaagauauacaaggcaugggugccucagaggguaaaaagaaaaaaagaaaaaaagaaaaggagaggccaggaguuuaagccaagcagacagggaggaucuauguggaggggucaugcaagcaagacaugccagagcaagcuaccagauaaaacaaagugugcuguuugagaggcacaacagaugaaaaggcccugaagccagaagccaacugcuuugucugaagaauaugggagagaagggugcugug

SEQ ID NO: 3682 - RNA, 1263 nt, Mus musculus
caccccucgcgaccagcccuuccacacacauaaccuacuggaaauggagcgccgcggauggagaggacacuggccgccaccggaggggcagguuugacaggcgacggccaccggggcugccuggcggggagggagcgcguacaaagcagcccugcgguggcagcugcgcugucuuuuuguacggagggcccucacucugagguucacacacagaacucagagccaugcugggccucugggcucugcagcgggaagacggaggaugcaacgggguacgcgguguccacucagcgucaccgacuccaagucucucaagccaacuaaagacaaaccuacgcugcccccgcgacaauuuccucagugcaagggaccaacucaccucucagagcggaccggcgcuaagcagccggaaggaugcugcgcagaggccugugggaaauguaguccauggugggaaagacugggccaacgcagcggagugcgcaagcgugcucggggcugugauggguggaggccucugggugugaucuuggaccagcuggaagggcuaggagauuccgcugcccucugcccccaaauccccaccccaaaccuagcucacugggcuggggguugugucguugcccuaccagggcugagaacaccaucaucacauuaucacaugcuuaauaugugagauaagcauauucucaccccagcgaggguguaggcaugaucagggaacucaguaaaauacauucuccaaaggugcagucccacaucuacccagggaaagguugcucaggcuccuuggaguucccgcugccucugcuuucucccacugucccuucuagccguuguguauauuggucuagucguugguauuggccuuagguuuuguuuugcaaacuggagaugaagccaagaccucuaagacuggaaagauaauuaugcuuucuucuaucacagugguucucaaccuguuggucgagaucccccccccccuugggggucaaaugaccuuucacagggaccaccuaagaccaucagaaaacacagauauuuacauuaggauuccuaacaguagcaaaauuacaguuauaaaguaguaccgaaaauaauuauauagcuuguggaucaccacaacaugaggaacuguauuaaugggucgcagcuuuagggagguugagaaccacugcucuaacauuuucuuguguuugugccaggccucauccggucuucaggagacugaagcaugcagacugcaaauucaagaugaaugga

SEQ ID NO: 3683 - RNA, 1893 nt, Mus musculus
ugggcguggcuugggauucccuuaggguaaagugcugcacguccuugggcgaagaggggaggugacucggagcugcugaggacgcaaaaugagggcccuacgggugaggccccagcacgggcugugucgggguggaggggaaccccacaacccagaugccuaaccuaaacaugccaggauccggagucuuagaacaggugcacccuucagacugggacuuccucccuggcagccugagcuuccagacagcacuauccuuaacaugguccagaacccuggguuuaagccuccguuuacccgagucccccuuaacaucccagggggcccuaaaaccaacucucauggaacuuccaagccagucuugccaucccuggaaccugauuuucugguauuaaucuagcccucuccuucaaaccccauagcgcccauuucacauucucagcacuggagucucucacagccugcagagaguuccaagcuguagcuucuagacaccgauuccccauccccacuccuuuguuuguuuguuuguuuguuuguauguuuguuuugacacagggucucccauagcccaggcuggucucuaacuugcuaugcagcugaauguccuugaccuccgaccuccaccucccaauuguaacaacuuaugugacaccuccucucauuuucuaaaugcuuacuaaguagcccaggcuggccccaacuccugcuuuccucuugaaugcugggauaauaggcuuccaccaaugucuugacagauguccccacccccaacccccaccccacccccgcucucacuaguaacuaucuugccuuaagauaucuuaccuaguucuucaucagaaauguaguccccacaucgcaaagcgcucccuuccugcgggauccacaugagggcagaucuccaggugcucccuacagacccaucuccuaucccuccaggucucccaggcucugguccggucuuuuagcucaucuaccagaagccacuuagaaaaccguguggcagagaagcagaagcucuuccagguaggcgggacagagucucuggaccuaaugaggggugggggucgcugggcagguggaggucugugcaggagccagcaacccuguucucaccccuccaacucaggccgacaaugaccucccaguacacuugaaaggcgggggaauggacaacguccuguacagacugaccaugacgcugacucugggggguaagugcaggaccacuggcuugcucuggucauaagaauagccaggguccucgggcagugguggcgcaugccuuuaaucccagcacuugggaggcagaggcaggcggauuucugagucugaggcuagccuggucugcagagugaguuccaagauagccagggcuacauagagaaacccuuucucgaaaacaaaacaaaacaaacaaauaauaauaauaauagccagggucugggucgguuggugcuucagaaggucugaggauccacuagugcucaggaagggagcgauggguuaccuacagcccugaggaaguggggguagcaauugguaaugcccacaccaguccagaacaagcuccuggccuaguccaaacccaaacggguggagguggggauuucccaugaggaaucugguuugggaggaagauaacagccaaauaagagcugugauccuuuaggagcugggggaaccuaaggaggggccuuuagaagccuuucaagaggucaagagggaauuagggucuuauuugauauccaacuccuccuuccuaggcacugccuacugcuuauacugcuugggcugggccuccuucccccacaagaagugacaccaagaagcuuggaggacuuggacaaacaucaauaaauaugcuaaucucuugagaacccaacccgg

SEQ ID NO: 3684 - RNA, 6938 nt, Mus musculus
uaaaagacuuauauuuuuauuugcaagccauguaagugcaggagcuguuggaggccagaggagagggucagacccagaggagguacagccauaugaugcggucgcugggaaagaacucagaaucucuacaaaugcucuuaacagcuggcccaccacuccagacaucaagcguuuucuuuaaggcacaaauaugucuuuucuaugcuucaguuguugugucuguucuccucuuauuuaucccggaaaucucauuuuuaccacaugcugaucucaguaucugucaaucaguagcaguagauuagagucuccgauguuggacacaaaguaucugcuccuaugacacuggccaggguucagaggcuacacacagcugcaaaggaggaugggaaaugcagucuagcucuggaagcccauagggaaucagcuuuagugaaucauuaguguagggagccagagacccaagucuuucucagagguccugagaaacaaagcgacuuuaguucuguguccuuguccuggaggggacuuggcaaggcugaggagggcuggagccaaggccuugagggagccuaaguuggagcgucuggauacuggacgcuuccaccugggcugugguuauccacuuaggcagcugugucucagguacccuguguucucuuugccaacaucaucugacgcagcucucugcugaccuguuuuccggcuguuuucucccuguaaauaguauuugggaugcuguaauucuuaauaagcuugcuuuauaaacaucagcucauacaagaccuccugaucccagcuauugcuuuugucuuuuuuauuucucgucuuuauuucucaucccccauccucccacccgaugccucgcuguuuggaaacccuguuccuaccgguucgggucacauucaccaaucucuaccacgcauuuggaacaugcuagcucugaagaugggggaggggcugcaccgccaguugucuuuguuaguguaaccuccgagggugugcuggcuagguuuuuuuuuugucaccuugacacaacuggggacaucugggaagagggacccucaauugagaacuugcuuccgucagauuggccguuaggcaaggccuuggggguccaucucagugacuaacacggaagguuuccagugcaccgugauuggugcucccggccuuggggguaggugguucugaacuguauggaaaagcagguugagcgagcccugaagagcaugcuaggaggcaggguuccuccagggcucugcuucaguuccugcguccaggguccugccuuggauucccgagaugaacucuaaccuguaggucaaaccaaugagcuucgcuucccacauugcuuuuggucaccggccuuuaccacagcaauagaaagcaagcuagagcaauggacguugcucauccugcaucuccauuaucuaucccuggguuuagucaggacucaauaaauauggguucaaacaugaaggaaaaaaaaaaaaacaaacuucugcuagcuuuuagaugauggaauauuauacacaacgugaaaaugauguuuuuaagacugugggaaauuguucacgguguauacagugagcauuuuagaguagauaagauuuaaaauaaacccuaggggcuggagaaacggcucaauaguuaagagcacuggcugcucuuccaaaugacccagguucaauucccagcaaccacaugacagaucacaucuguuuguaacuccaguuccaggggaucugacacccuggacaugcaugcaugcaaaacaccaauacacauaaaacaauuuuaaaaauaauaaaauaaacccuaaaaacagaacucagaaugauagccaauucaacacaauagaauucuaccucuuucuuccacagcagccaaaguuuaagcacuugcgaugaugccaagccaccaaguacucagcuucucccuauggcccugcuacuccuaaggcagcaguuuggcuccacaacaccugugucuagccaguagggggaguaagagggcagagacucuggcaagcuaagagagacgaagucagccuugcagucuaguuuauugugcgugaaggauugugagagucauuggaaaccuuccaggagaaaaguggaugaggagcaacaggugagcaagggguggugaagacagcagcucuuuccgaguuaauauuacaugcaaaaaccgcgcagaauaaaaaauuugcauuuggaagagaccagccagaugacucaguggugccaggcugacaaaucgaguuuaaucuccagaucucaaagggaggugggggagaccaggcuggccuccagcucauacacauaucucucugucucccaagcguugggauuaaagaaccagguggagagaucuccucguguagaacacuccuuuaagcccagcagccgggagggagacagaggccagagaaucuuugaauuccaaucccgccuggucuguauagcaaguucccugccaggcaaggcuacacaaugagacuuuguuucauaaaaaaaaaaaaaaaaaagaaagaaagaaaacgaaguggugugugauggaguuaauuagaaaucugagaagaccccucucccucacugccaggaagcucuaaaagagaggucuuggaauggaguuccgugucccgacacagcuugcugguagagccucaagcucgcagagaucagccugccucugccuccugggacuaaaggagugcggcgcgaugccuagccaccuuguacugacuuagaguagcagggaggugaaaggacaggucaguaaagaccuuguggcuugagugaaaaacuuuuuuuuuuuaagugcuaggccuucaugcacacugccuugugcuguaccacggagcggcccucccuggggagggaguucugacucuuccggaaugagguguaccaggcacagaugggaucuggccugagccaggcuuccuuuguuugcagguuauagggccagagacuaggcaggaagcguuggugacagcuagaggcagggaggaauuagagguggggugaaggugaggugaaggggugggagaugggggugagcagggagggagguagcauugagagugcaggaggagccaguuagacuugcugacaggguggaacaguggggcauuauggaggcagacaguugggaccagugaagugugauuguaauguaaugagagcaucaagguggcuaaacaggauugccaugaguucaacgccagccucaggcacccagaaagaccuugcuugucucaaaggcaagcaagcaagcaaacaagcaaacaaguaaacagcagcaaguagcuggugaggaggcacagugguuagagcacuugcugcuccagcagaggauccauguuugaaucucagaacacacaaggcagacacagacauacaagaagcaaaagcaagacagagaagccaugaguccugagccuuguccagguugaagauagggauuugggggcugguggccuggagaugauauguaagacacgugggaucagacacacuccuguaaccccaagaacuuuuagggugguugcaggaagaucaguucaaagccauucucuguuaaacagugagauugaggcuagccugagcuauaugauaccaccucacaaaauauacacacacaggggacaaaaaucacugaaaaauacuucagggagguaccagauggcaggcacaaguugaauggacagagggacgauaccuagagcucacagaugccggcaacugggacucagggagacagaauuagaggacaauaugaccacacuggguaguguguauggugaaaaauggguuuuauuuuauuuuuguuuguacguguguuuugcuugcaugcaugacuuuguacauuugugccagcgccuucagagccagaagagggagccuagaucuggacuugagacacuugggagcugcuugaugugggugcucagcacugaacccggguccucuggaggaacagucaagacucuugaccccugagccauccccaagcaaaacucccaugaaccuucuuuuguuuguuugagacagggucucaccauguagcccagucuguccucuggaacucacuguguagaccaggcuggccucagaguucucccugccucugcccccugagugcugggaucaaagacaagugccaccacgauaggcucccuuaaguauuuuuaaaucguuguuuugagauaagacccugugguguagcucgccugccugagucuucugaggccugggcaugugucaucauguuuacuguuggucugagggcaugaagcuggcagccucuucaagccuuggguggaugugaggacaaagaggucuucccaaaugagagaugucugagcucugguccaaaguggaggacacagacagucaaguccaaacacaggaguauuuguaggcagaggacagggcuuaugccagcgaguugagccugaggucagacugcucaguguggcagggagggguguggcagagagggaauccacauuagucaucaccaaaugauuuauccgcuaaggcuuaggccugggucgccacccucugugcucccgccuuuuagaguuuccgguuucgacagguuaaaucuugcuucacacacacacacacacacacacacacacacacacacacacacacacacacagguuugagcaaugauuaccuggccuggucccagcaagcccuuagguggcguuagugcaauuacggucuugucugcugagaucuuauuugacugauuaucauauuaaguuaucggagauucuuugaacagguaaagcagacugguuguuuaaccucaguuuacuuauacauagaauggggacaauaacagaccuaucccacaggccugcuucgaggacacacaaccuagugaguggagaguauuuagggaccggcagguauuugucgauguuguuuaaggaugagcaagaguaaacgagcuaagggaaccaggugagcucccagcugagggaacaacauggcgacauagggacuaacagaagagcugccauuuacuauguauuuaucacuuaauucugauaggggcuuacccuaguguccucuagggucucauguagcccaagccggucacaaacuuguuauguacugagaauggcugccugcccucaccucccagugcugguuuuacaggugugugucaucacgccuggcuauguucccgccuuacacaugaggaggucauuacucagagacaccaggucacuguuuuagggaugagcaauaaagacucaaaccgagguuuauauaguuccuagggaguggccagacagccagacuagaagcccaacagcgaccugggugagaggcacaaacugaugguaaacuuaagauguagauuccuagcauucgggaaacagaagcaggaggauuguuucaaguucgagguuagcuagggcuuuaggucaucauuuagaggauguuuaacaaaccucugucucaaagugcacaaugaaugaaugaaugaaugacaacugaaguccuuuuuugcaacuauauacugcaacggugaccggguacccuguaucuaguuccuggaggcuccaguaccugggcguuagaauaauuuauucguacucaaagcuauuuaaucuggacagcguugaauuuccagcaguguguguauggggacggaugagcuaagcagagacuugcaaccauaacccucccgcgcaggcgcagucugcaauggaggcucuaggaccgcgcagacgacggcuggguggcggcagggucuaacccggaguagcugccugagucaccggccccgcccucccgaaccggacacagcggaggcccugcagcaggcgagcaagaccgcggaccgccggauccguaagugagacgggacacuccaguccagcaccccugcacccuguagauccggaauccguaguccucagaucuggcgagacccuaaagucuuggcccuugggggguccuaggaccgguguucucagauucgaaccaucgggccugucagccccuccagaacacuccuuaccaucccggaucugacgaccaaaaaauauaagcccaaagaucagagagauacccggaaauuauuuugggcgucuagaaccacaauccgagaucgugguucccauuugcggugggaagaacuccguuauccaggauccuccgggcgcacagccauaauuuuuggccggagcccacagaucccguagugacaguguagucccucugucgagaguaucugaaugucuuaauccacauuaggaacuuccuggucagcccugggucaucccuacccugagcuuaauuuuggaaggccuggaucugagacacguucgguuuuacacaccuuaggguuucuacacgagaauccccuguuuucccgcugccucaagacaggguaaagcaggcaggcgcuguagccgaggcuggccuugaacugguccuccagccucagccucccaauuucugggauuacaguagagcgcuaccacgcacgcccagcuguaccccuguccucaugccuauauauaugcagucaagccugggccaggguacuuucuagacccuaggagguuucacaucuccuaucaccuguccagaccccuagcuagaggcucuguccccaucucgaggccuuaguuuccuccccaaucuaguugccggaaaugcuugcuuuuuuuuuuuuuuuuuuuuuuuuuuuugcgggaagggcugggcuccuggcaaggccacuacccgacccaccccuuuuacuuuacaggacucagcugcgaucauguucuuggugaauucguucuugaagggcggcgguggcggugggggaggcgggggucugggcgggggccuggggaaugugcucggaggccugaucagcggagcugcuggcggcggcggcgguggcgguggagg

SEQ ID NO: 3685 - RNA, 2293 nt, Mus musculus
aucaggucgugcgguguagggugcggugcugcgcauaagcauccggccgagagcuggugaagccacagucuucacacacgugcagcuucucccugcgcucccgguaagcguagcuggcuggcugcccgugcaccuuggcaaggugagcuuccagggaacagcgcugggugaaagcuuucccacaggcuccgcagcggaauggccguauuccuguuaagaugagcagagagggcgauggcggccuuggagcguaggcuucuggccuugccacucccuaucuuuauuccuagcuaggcagacacuuauguuugugguccacuagccaucugcuacuucugcuuaaggcaacaggagccaggccaugugucuccuccaucccucaacaggaagcgucuugugagagagggagggacucuuagcuacuugccugcucucaaucuggaaccuggaaauauaucauauggauuuauugugagacaaggucucacaguguagcccuggcuggccuggaacucagagaucugccuuccucugcccagaagugcugggauuaaaggcaaguaccaaaagccuggcuuauuuggggugucuguguacguguguguuugcucacaaacguaugcaugcacaaaugcuaugguccaaguuucggggucagaaaauaauuugcaggaaucuuauaccaccuggauccugggaauuuaacucaguuaugagaguugccagcaauggccuuacccacugagcaaucuggcuggaacacuaugucuccuuaccugugccccuauuguauaucugaucccuggaaaccccauaccccaugcgucugccucugucauuccaucaccaucacuaucuggcguccagaagacgcucuuuguuccugcuguugcuuaccagugugaguccucaugugacgcuugagaucgaaggcaucgugaaagccuuuaccacaauaguggcacacguggcgccucgcugggcuguggcauuugaggugccgagucagcaugcguugcagcgggaaggccuuggggcagagugggcagccaagugucccggggcccuugggagcagaggucaguguccccugugaggacugccagaggguguaaggguuaguauggccagcuggaucuuguucagucuuugcuacucuguaguugugugcccagagugaagggcagcugugaguaguggggacagcugcaacccucucuccaaaccaaauccaucaaucugaccauuaugucccuccauacccaagaacacgcuuugcuaauacaagcuuuccuaguuuuauucucugccucuagcuccuaccaggaagacgcucugugaggaaauggaugucugucccuccugccguacacucacucauacagaaguggccucacacacugaguucugacuaguauuguucuuccuuucaaaguccgcaguuaaccuacuccugggaaguuaaggaaacagagcccccaccccugacuguuuauccaguguucugacauaaaucaccuucuacuuaguuuuuggaauccucuucgcacccacugaacacagaucccuggagcagggccuuacagcugcccaccuaccucaggaauaggggucuuaacugagacuggguugagcuggguccugggaagggaacgggaugccaaguaaagaacaauacucggggcuggagagauguuacagaggaccuggauggaguaagggcagccagcuuccugugcacgaguggaaagccaucccaucuuaguugccagcugcagacucaccacugcccaggugucucucagaccagaagaucugugugcugguggcacugccaggcugcugcagucugagaagagaagccagauggugaugcccagugccucccgagugccuucaccuccaggcccagaugggugcaugcguaccugggacauaagcaucuccccggagcuggucaggaagguggcuccaguuagguggcuguggacgccgacuccucacaagaaagacccugggcauugcuuucaggauggugaaauggcucuucacagagcugcugccucugccugcugccugucagaccugggccccagaacuaggugaaaucaggagacuccuggaagccucauucucuucaugcaaauuuugagacaagcuuggggagcaaccuuagcuggcucugguuaccucagcuggggccugccaucauggcuccuucucuaggcuaggcuuccaggcaacuccuccaucuccugagaauggagacaguggagaacucaccccccaggga

SEQ ID NO: 3686 - RNA, 40286 nt, Mus musculus
cggcuuucccgcggccauucgcuauucgagugggugcuggcuacaggcggcuguuaagaagcguaacggacacuggucuccgacagcaugauggcugccuuagcggccggagguuauacgcggagugacacgauagaaaagcuguccucugucauggcgggaguuccggcgcggagaaaccaguccuccccgccuccugccccaccgcucugccuccggcggcggacgcgacucgcggcggcucccgaggacacugugcagaaccgggugagaggcuggucguccuguuuacccaacuccgggcuucucugccaccuuggucccgccucggggccucggucccucccaucgcuucuuuauuugcucccucaggcggcuucccaggcccgccugguccggaagccccgcccccuuggcagaggcuuucccccugcguuccugcuggcuucaggguuuggugcugcccaucuuucuggcuccacuuagaguuggcacauugcuuuauuuuaguucuaacucccgggaaaugguuuugcauuuacaaaucaucucuaauaucacuuuacuguucagugagugaccuaagacacuuaucccuuucauuccagugugucuuugauuuuauuggaauagggcuggggaccacugcagccaccagugugcuguaucggagucugagcgagaggcuggccuguuggcucuugccacgccuccucuguagcgccucgggguaaggugugcucuuccaggccccuauuugguuaacauuccccugguuuuguuguuguuauauuguuguggguuuuguuguuguuguuauauuguugugguuuuuuuguuuuuuguuuuuguuguuuguuuuuuccuuuugagacaggauuucuuugugacugaauucauucuguagaccagcaggcuggcugugagcucugagaucuaccuuucugccuccggaguacuugccuggcuuauuugcguaacauuucuuggucuuccuuccuuuuucuguuccugauuucuuuccuguuccuucacuagaacugauuuuuaucuacuuacggcuuaaaauuauggagaauguaaaaaucuuagcacugcugccuggggagcaggguguacaaaacaguuccacaaaauuugagucacagaaagaaaugacuuuggguagaaggaaugcuauuaguaaaacuuuuuuuuuuuuuuuuuuuggucaggguuucuccguguagccuuggcugaccuggaacuggcuguguagaccagacuggcugaggucaacuuuugagaguucauucucccagagucagcuuuggccccaagggcuuuuaccuacggagcuauuggcuacuagucuagaggcagugggaccugggagaauggagucauaaaugaggcaagcuaaagucuccuguaguagccaacuuuagucugagcagcagacaguuuguacccugaggguuaagaggagucacaaggacaagugacacacauggcaaaaacauguuuuuccaucgagacauauaaagaaauaacaauacuuaguguaaugaauaaucugaaauagacucacuccuaucuccuacaccuggaggggcacaaaaccaggaacaauucaguucuguguuuuugaagaaacugagaucaugagauucuuggcuugguuucuuggaguuuucuuacaagcacccaaaucucacagggguccauucuuggaccauguucugacacugagcuaccucucuggccccaaagcaacagguuuuuguuuuccuguuugcuuuuaagguuuauuuauucuuauguguauguguuuugccuaugagggugccuggugccccaggaguccaaaagaggaccuucuuggguccucuggaaguggagcuacagauggacaagcaagugcacuuguuaacugcugagccaucuuuccaaaccccacuccccagcaacacuuuuaagagugguucucuagucaucgccugaacacacaaaucuuaguauaaaauagagaugaccacauacuguggaauugaagggagaugggauugugacugugcccguggcacacacaauguccacauaaaagauggaugcauggcagcugcuggugggcuuuugaugccucagauaauguauccccucuccccacacuucuggguucuaggcaagccacccuugcccaccaggucuauuauguagcucuauagucuggaacucuucauagaccagucuggccuugaacacacaaagauccacuugucucugucuuucaagugcugguauuaaaggccugggcuaccacgcccagccguggcugaccuuucuggcuauaccuucuaugaccucccucucauugaguucagccaugcuggccugccuucucuuuccuaaaguugccuccuggauuugcaucuaaugaguccuuugcuugaguguuuugcuguacucuugucucucuggcuccuucccaucccuuaagucuuagccugaauauugcuguccagagagguguuuauggaucccagccuagagacacccacuuuaacucacucccagggcccuuauaugcuccugaaagugccuuggaauucuuuuuuuuuuuuuuuuuuaaauaguuuuuuuuuuuuuuuuuuuuuaagauuuauuuauuuauuauauguaaguacauuguagcugucuucagacacuccagaagagggcaucagaucuuguuacagaugguugugagccaccaugugguugcugggauuugaacuccggaccuucggaagagcagucgggugcucuuacccacugagccaucucaccagccccgugccuuggaauucuuaagcuguauguaggagaugccagaagcacaaacagaaagaggaugcaguaagcugguuugaagcauagacuccacacuccacugccugaacucaaauauucauucuguuucuuguaagcaaguuaggaacuucucccugccucaguuauccuagcuguaaaacaaagauaaugauguagaaucccccacaacauacaucuuauuauaauccaaacugcccuuaaacuucgcuccuucuguuucccaagugcugggaucacagaugugugauaccuuaccaggucucccucuuaggguaccugugagauucugcgguuuccuauaucuuaagccucagaacaacaccgggcaggcacacugcaggugcucuauuaguguuagucagcacuguuguuacugugcuuuggguuaggucguugauguuucucauuugacaagcacaucccagagaucaucuggcuugcaaaagcuguccucuaaaaaugucagcucuaaaaauguccgguuacacuaaagccggguaaguaaccaugagugcuguugcccgauugucugugccagccugcuggcuguugcucuuucuggauggguagcugcucuggggcucuguuugcucaucuggagggcgacagugguggcuguaucuuagggcuaccaugaguguuacuacgccgaggcugagcacagucugauugugauaagaacuucauaacauuccaauguuugccugucaauucugacuggacuugagaaguguugugagaauuuugguuucuuuuaaaacacagaaauggcagggcaugguggcacacgucuuuaaucccagcacucgggaggcagaggcagguggauuucugaguucgaggccagccuggucuacaaagugaguuccaggacagccagggcuacacagagaaacccugucucgaaaaaccccaaaaacaaaacaaagaaacaaacaaaaaccccaaaaaaccaaaaccaaaacacagaaauguuauaggaauaguucuguuuuacuccuaggugugggauaugggaugcuucagauugucugcaagagaggggcgugguuuugaaagcuacagacaguuucugggagugugugacauucagaauucugguaacuuuucagaggauauguaaaugcuagaguccugauagaaggggcugguugacccguuguugguuggaugaaguugguugcugcuaguugugguugguugcaguuugucaagcaguucuguccagagagacaaaaagaagaaauuagauguccugacagugaggaucaaacuugccccaaaggagccugacgccucugaucagcaggaaggaguuuaaugauaccucccuuucccucuagccucuuuugcucuucaccugcuguuagggaguggaaaggguggaaaagguuggaggagggugggaaaaaaggaacccacaaaguagccaaaaaggccagcuacagagaaugguuuucucuacaguaguuagaaaccaguauauuuaauauaugaaaguaucacacuucugauagucuguaguuucuuacuuauuguuuuagcaaccaugauggaguucuggcacauaaauuuuauuguuagauuaaaaaaaaaaaaaaaccuuuuagcugggcauggcaguacagaccuguaaugugagcacucaggaggcagaggcagguuaagcuuugugaguucgaggccagccuggucuacagaguuccaggacaggcaggacugcacaaauagaccuugucucaaagaaaaauuuuuuucuuuucuuuuuucugugcugggacucaaacccaaggccuuguacacacuaggcaagcauccuguuauugggcuuuagguucaaccuguuaaaacuuuuuuuuuuagugugacuuguuucccuacucaagacugaaucugaugagagaacacugcuuuugcucaguguugugucugcucuguguggccugaagugcuggccuuggaacuucagugcuuugguuugcacugcaaccgugcugcucuccuguggcaggacugacccucuggcuuaccuguaaauaaggaugauuuacauuuaucuguaaauugugaugcuuucuucuccacagauugucaggauuuaggacuuucauccacagcauccuuugacauguagucagaggccaccuugucaccaggcgcucucccuccccuguagucccagcuucuuccucuugcagcagacaggggaauacuaucaaaggucaaaugcuaguugcugguagccagcauagcaugacuucagaagcccagggcauguguggaaugcagcaagaacuaagacucauggcugaggcagccguaccauguugggagcugcuggagcaaauauuuuucugacagcccuuuucuuugcaggugacacuugagaaggugcuuggcaucacagcccagaacagcagcgggcuaaccugugacccuggcacaggccauguggccuacuuagcaggguaagcacaugugugggcuucagcagcuggucacugguuagggauuuggaguugaagucacugguguaucucucugggccuggguuuucccaucuguagaaggcugcuuccugugagggcuauggaggggacuccacaggcccaucugugucaggaguaguacccagcaaggcagugcuucgaaagccuuuuaaucaaaugucagguggugacaguuaugggaaacucaaguggcuaaaacccaaacuuaggucaagcucaacugcauaugcucuucuuagugccugugcaucucccuaggaguacacuccauucggguaggugagagagcugaaggaguccaguuaagucuggagaugcuugucuagcccagcacugcuuaggcagugaaaggagccucuuccucucccccagcaaaacagggucggguagacucauaguaacaugguaucaguuaaugaggccuugggaaacagauugagcacaggcugagcucuuaaauccagcuggcacacauucaucuccacuccguuucugaccugugaccugccggguggccugugcaaagagcuuccccucucuggccugcgguccucugaaucagauauaaauaaaugauauauaaagcacccuggccucacccgacagccgaggauuuaaggcaguuauagccauaaggucuguaggccuagggccugcagaauaguccccacaaaggaauugcuugguuuuuguuuaacaauguaucaauauuuuuacaagugcccaugcuuucucagcauuaguaucuagaggaaggggcgagcagaaagagaaucuucugcccagacgaagcuuuauaaaagcuggagaugcaacucagccguagggugcuugccuagcauaauggaccuuggguuccauccucaguaccacaccaaaaccaaaagcuuccuggcaugggagccaaccuaggcuucaugaugagacgaaacccagcaacaaaaccgggggagccuuauuaacacgggguuuuucuuugggaagagagucgucccuggguccaguacuucucccaagcccccaguuuagacuuguauucuuuucccuaggugcguggugguggucuugaaccccaaggagaacaagcagcagcauauauuuaacacaaccagguaggcugggacugggcuuggggcaggguugggggaccagggugcugguccaaauccccguccccucagagcauggagguguucauggguggugacucacucccuaagccauguucacgggaccugcuuugugcuaaguacuguuccagguguugaugaccuagcagugagcagagacaaggaucugcccucuagagcucuagacugcaugagagacagaccacaacccacuagcugauuacuagcugauuguugagaggaaaaugccugcagggauguuagaaaagaaaacagggaaagcuauaucagaaggccucccugagcuugagaccaagcggaaguaaugauacccauguauaggaacacuagcaagggccgaggugcagcagagaugaagagucaaggaacagcagaguugucaugggcccaagugcugggugcaggggggcaggaaaggggaagggaagcuccaacagaagcugcaccaccccuugcaucuuagggagggagcugaugucauagggacgauaaagagaugucacuagauggcauacacaggccagggaggauggcagacaucugugggcuugucaggcucacauagaagccaggugggugccacacgagccuguaauugcagcacuuagggugcugaggcagaaggauugcgaaguaaggccugagcuauacaaugagaucuugucuaagaaaacaaaaacaaagugcaaaaacaggauugaaacgaaggaggagcuaaagccauacagucugggcaugggcuugcuuccagaagccaugccagcuccucaacccauguucaggcuaguuaagcguaucagagacuggcuggagagagagcucuguguguaaaguccuugcuaugcaagcaugaggaccuaacuccaguccccaggaccuacauaaauaguuaggcauggcgacaugcuuauaguucccagugugagaaagguagagacgggaaucccuggggggcucauuggccagccagucuacccuaacuggugagccccggguccuagugagggacccugucucaagaaaaucagccagguagcuucugaggagucacacugaagauugaccuuugaccaccacaugcauucacgcacacacagaguaauagaaacauuucaguuguugggguuucuagaacacucaaugagcuauaucugugcccugucuaccaggguccacccaugagcauagcucuucuuuaguuaggccaagccuguaccauuuccugcaucugaguuucaggacuguguuacagguggauaagguccuggaaagcucacuccacacugggggaaggaagcaaaaaccucgauucugggucugcaguguuuggguuugguauugagggaggaggagaccucugcuuucuuguuccauucccugagugccaugcugggcacacaggcuacaguggcuguguaggaacugcuggcucuuguuuccccagccuuggggaccaggaguggcuagaauggcaagagcacaguucuugguggaaccagugacgaccccuuugcuuguccccaggaagucccugagugcucuggccuucuccccagaugggaaguacauagugacaggagaggugagucuugacugagcaggugggaaaggucugggggccauuccuucugcuuccagcaggcuuggcaaucucugaauuggcuccugauuuuagauaaucccuguggcaaauaggggagguggcuuugggaacaagucacagcagugccaacuucuagcccugucugugucucaguuagggucuuacugcugugaacagacaccaucaucaaggcaacuccuguaaggacaacauuucauuggggcuggcuuacagggucagagguucaguccauuaucaucaagguagaaacauggcugcauccaggcaggcauggugcaggcagagcagagaguuguacaucuucaucugaaggcugcuaggagaagacuggcuuccagacagcuaggaugagggucuuaaagcccacacccacagugacaccccuucucccaacaaagucacacuuccuaauagugccacucccugggccaaguguauacaaaccaucacacccugccuuacauauaguucagcaauaguaauggccucauccccucugccucccagaauggacaccggccagcugugcgcaucugggauguggaggagaagacucaaguggcagagaugcugggccacaaguaugguguggccuguguggcuuucucacccaauaugaagcacaucguguccaugggcuaccaacaugacaugguccucaauguuugggauuggaaggugagaaccgagugggcaggugggcaggcagggagucacuagcacccuaaaccuugggcauuagggagcacuaccaaccuauugccugcuguugcaccaugcuuacagugaggcuucugucccugaggucaccugguggcaaggcagaguuugggucaucaugucuguugguauagggaacagaucaggaaccgaguagccacacugaaagguuaggacagaagugcuauuuuuguguugacuagcuguggccgugcacaagcgccuugacuauuuuuucgccuguagaacggcuuuccuagcaucuacccuuggcuaugugagcuccagcucccugacacgcacucuaaggcugggcuuuggcacagcuauagcaggacuugaaguccugguucugcuuccgacccaccaugugacuuugaacacagccuggcaggguggaggaacacuucccucaugagcuggcauccacagcuaugaggggcucagggcagggcccagagcaacagcccuuugugugguagccauagauuguguucuccuuaccaccagcuguuaccauucccaacauguggcugcagagcuuggcccuuggugggaguucugaaacuuacucuuccugggaccuuucucugucugcuccucuggagccuaggaaugaccagaguugcacaguuuuccuuagaguuuagaccacugccagguccaagaacaaugggagagaaagcagggagagcccaguauggauggguggauggugcugugaaccgcucugugccuacucuuccagaaagacauugugguggcuuccaacaaggugucauguagagucaucgcucucuccuucucugaggacagcagcuauuuugucaccguugggaaucggcaugugagguuuugguucuuagaagccucuacugaggccaaggugaguuuuugcacccauuauggucaggucucagagggucacuagcagcaugcuccuaugucuaccugagacuuggaggcggggucucccaggucacccagcuucuugggcauaaaagugcugacuaguaauccugcuggacucugccucuaggccagagcucacugauggacugcugccuccuggccccucugcccugaguacggguucugcuuuucuuccuucuccuccacauggaagacccucuuaaaagcccuccuuuucagcugugucaguaaaggaccugcgauggcccugcugagcacgaggcaaggacauagucucuaacaugucuugcuguguuccagguaaccagcacagugccccugguaggacgcucaggcauccugggugagcugcacaacaauaucuuuuguggcguggccugcggccggggccggauggcaggcaauaccuucuguguguccuacucuggccuccucugccaguucaaugagaaaagggugcuggacaaguggaucaaccugaagguacccgccucccucucucucugcuggcugucagcuggggaacugcucuucccacccgccgaugaucuggggagggguugagguguuuucucugagacaggguccccuucauugugaaauucaguccauccugaggcucaccaucucuugccucagccuccugagggauugcaggugugcaccaccaugcuuggcuucaugucaguggcugucagcacagguuccaugcgugacucuucuuuccuuaguuuucucauuuccucaucugucaaagcaaauacugagccaguaagauggcugagcaagucagugugccagcaucccagccgggcagcccaaguuccucauuggaaggagagagcuggcucccacaguguccucucacugcacaugugcuaacacugugcccagagcaucccuucccccugcauaaauacacgaaucaggaaaaagguuaaauggaaaugccuccuucucuaaaguggacacggaaguuacaugacauaauaugcaggagucauuuuuuccccguaauuuaagguaucuugagucuacuauuuuuuuaaaaaaauuuuuuguugguuuuguucuguuuuguuuuucuuuuuuuuuucuuuccuuuuuuagauauuuucuucauuuacauuucaaaugcuaucccaaaaguccccuauacccuccccgccccuuccagccuacuauuuuuuuuuuugucaaaaaagaaaagccuaugcaaauauguagaacuuuagacuaaaggucaguguuuuaauaaauugcagaguugcuggguuuuucucccaguaccugaaaguugaguccaagccgugaacccgcuccaagcuccaagcucaguuucccauuggcagugcacaucccauggaagcaaugggcuuuuacucauuuucuaggcuggccucugucacuguccccagcacuugucuuaagagcuuacagcauauggaaguguuccacauuuuaucugcugccugggaacuuagacaucauuuuuagaaugauuuuauuuuuacuuguguauauguguguuuaugcaaaugagugcagguuccuacagcagccagaagaagguguccgcuccuggagcugagguuacaggcaguugugaacugaccacuugggugcugggaaccaaacucugguccugucaccacauaaaugcaggugcccacggaggccagcaggugauguaggaugcacgggugcuggaguuccagguggucuugagcugccugcugugggcacuggggaccaagcuccuguccucuucagagccgucagcacuugugucugaggagccgucucuucagccguaaccucuuuuucuuauuuuuccuuucuuuuuuuuuuuuuuuccuagaacguaaacaacuuaaaagcuauuuuguuuguuugcuucuguugagacagggucucuuuauagcacuggcugacuccaaacuugugguccuuugucuucagucuuuuuagugcugggauuacaguuggucaccaccacuguugguguaagaaaaccccuuuguuaguaaggugugguguuuguugcacaccuuaauucuagcucuugggagucuucggccaggggauugccacucugucucaggcuccguagugagacccugucuuauaaaacaaacaaagccaagaauaacacacacacacacacacacacacacacacacacacacacacacacuuuuacagagcaccaaaugauucauaaauuaaaucccuauaggaaacuggaguuuguguagagucuggcacuuacaacccuuuugucugugugucugagucugaccugccacugucugcugaagacauacuuuuuuucagauuucuuucuuuuuauuuuauguguaugcuuguucugccugcaugugugcauaugcaccacuuaugcuuuggugccuguggaggucagaugagggaaucagagccccuggaacuggagugacggauggucuugagccaccauguggcugggacuugaacucagggccucugcaagaacaacaagugcucuuagcugcugagcagcucugcagccccgacacauuuuuuuacacacaguuaaguuguucugugaauaaguguggcaacucugccccaaaccaugcuucuucauacugggacaucuucaguggugacuguugcuguauuucaaaaucuugugaacuacccucaggucuccuugucuuccugccugugugucagugacgaguugaucuucuguggaugcacagacgggauaguccgcaucuuccaggcccacagccuacucuaccucaccaaccugcccaaaccacacuaccugggaguggacguggcccacggacuggacuccagguacuguccuacacugggggaagaaggguaugcccagaaucuguuggauagcauccagccaugcuuucacauccguucaccuucgagcccauacccgcucuuagcucugagcaucgguggugugugugugccuaagaguccugcuccucaagcaagcuuuaggguaaggggacacugcugcaucagggaagaaaugcucagggcaggaauggugacaagcaaacguguuccccugggcuguaacauuuauuaggcagcuacucagugacagaccaaggcugaaagcagaaaucugagccagaaaaaaaucucugccagcacccaggcauuguguuuaucauauuuaaccccggcacuugggaggcagaggcaggcaaaucucaguuaaaggccagccugguccacagagugagagccagggcagccagggcuacacagagaaacccugucuugaaaaaaaaaaaaaaucugacaaccaaaccccugcuccaugaaaccucaguccaagggagggagcuccauggaaaguccacaagugagauagugucagagggaagcagagacugagagaugugcuaggcggggcuguggccacugaguagcuggaagaagaaaccugugguguuauuaauggccaguauaaauggugcagcauguugcagaacuagcaaaggguugggggacuggguggcuggaaugcugauggggaagcugggugagccugugucucuugugagguucauggugcuaccuguaggggguugcacgauaagcccuugaauguggaauccuaugaaugccuuguccuggguggaggggagggccaagcugcggccuguucccuuuguugcaagucucuuugugggaaguagcguggauaucuaaucaugauaggcugccucuuuggagguuguuagcuccaaggacagcaacuucuccaagagaaagcuggagagaguggcugaguguggaaagggaagagaaggaaagaauaagcuacagauccuggccuguugcaguagccagacugcuagcuccuccugcuguagugugcuguggggccucaucagugagccccucugaguucgaguucucaucugugaaacaacugcuuuuccuggggagaguugaguggcacgcagcaaguacuauauauauccuguguaggaaacccaaggcuucgaggcugugccucagcccuuugcacugcuguuuuggaucaguuauuaacgaagccaaauagaagagacgaggccugagguauauguucauuuuggacagaaauggacaggaucuuggguugaauggaaugggaauagaaaugauaaucaguaauucagccaggcauuguggcacacaccugcagcagaucuuuuugaguucaaggccauucuuuuuguuguuguuuuguuuuuuugguuuuugguuuuuguuuuuuuucgagacaggguuucucuguguagcucuggcugucuuggaacucgcuuuguagaccaggcuggccucgaacucagaaauucaccugccucugccuuccgagugcugggauuaaaggcgugggccaccacgcccggcacucaaggccauucuuauucaauucacacccacugugccaucagaagaaguaccaggcuagcuaaguagugagguccuauuucaaacaaaagggacugaagagauggcucagugauuaagagcacuugcugaucugccagaggaccugacuuauguucccagcacccacguggggguucacaaaaguucaacuuccagaggaucuagcaccuucuuaugaccuuaguagguaccaagcacacacaggaugcauuuucuucuucuucuuccuccuccucccuccucccuucuccuuccuccuacuuuauuccucuuccucuuccuccuccuccuccuccuccuccuccucccuucuccuuccuucuccuuccuccuacuuuccuccuccuucucccuccuccuuccuccuacuuuccuccuccucuucuuaaaggguuucucuguguagcccuagcuguccuugaacucacucuauagacaagguuagccugaaauucagaguucugccugccucugcuucccagugcuaggauuaaaggcgugcccuaccacgccuggcuucacauuugccgucaguguccucguugguguguaauugcagacgcagaugcuguuggucuucucaccauugaugaccaucaagggugugguccuugcacaacuacagacuccagugggugccaccauuucuucaugaucuucaugaagcugcaugcuuuuguaacuucucaguuauacuuucauuuuuaguguagcaguaaauaauaagugcuaucauuuucaggaaaaugaaugugcucucugagccagauaggcacuuccaguuugcaacuuauauuagaagcaaaacagaaaagagagggcaaagaagugggauuggauuaggaagauggcugacuggcacugguggugacugacccguauggcuuugguagcuuccucuuccacagaaaagcagaagcagucuacccagauacaguggcccugaccuuugaccccguccaccaguggcuguccuguguuuacaaagaccacagcaucuacaucugggaugucaaggacauugaugaagucagcaagauauggucagagcucuuccacagcuccuuugucuggaauguagaggugagacugcuuucccucuucacuguccagcuuuguccccuugggcucagcuuggguauucuccguagagcuuagagaacucauuuaaccauugcguuaagagacacagacugagauagguuugacagcacaccuguaauccccacacuugagcugcagaggcagauggguugggagcucaaggccaucgcuuggcuguacggaauacucaaggccagcccagggugcaggagaacuugucucgaagaaaaggaaaacuuggacaggguugguggcccauguauguuuuuuuaauuccaguauucugaaggcaggggcucugcuauggccagcaaguuccaaggcuguacagaaagcgagacccuguaauaaagagaauagaugaaaggccaaaagcucuguuuagagacuagggagauagcucagugguaagaguauaugcugcucuuggaaauacugggaaugaucguggcucacaguggcccucaaccucaguucuaggagaucaucgccuucuccugaccuuagauggugugcaaaacugucaaacauaaaauaaggagaaagcuggccaggcagugguggcgcacgccuuuaaucccagcacuugggaggcagaggcagguggauuucuugaguucagggccaaacccugucucaaaaaagagagagagugcacucuguguacagcuaauugacuguuguuagcagcagauauaaagggguuugcuaugggccguccucaucugucaguucuuuugucauccugcucacguagauggggaguucuucucuguagcauuuggucacuugguguguuuggugcagugauggccagcugaugcuugguucuuucccucugcuuuccuguuugcaauacagccaauugauugucugccugcugcuggucccugguuguuucaguuuaugguguuguauaacuuauguauuuugucaugguggacaugcuuuugcugucaccauccauauuguuggaguucacauuguccauucuugcucaacgggaguuucucuacacugccuucaguacggugccaagaugcucuagcauuuccuuguacauuucuggucccaggccuggaccagccuuuuuuuuuuuuuuuaauaacuuuuuuuagugggaauuggcauggaugguuuaauuuuugcuuugauuuuuugcuucugagguugaacccacagcuuuauccauacuauauaagaacccuaccacagaacugcauuuccauccugccacucauucaggucacuaaggugacuccuaguugucacagacacagggaauuauagaauaaaaauacccuauuauuuauuuggguuuuuuuuuccauguuaaauaccagaauugaagaauggcaauuacucaauucugaaaaggucacuuuuuuuuuuuuugagcaaaaauuuauuuauuucuugcacuugaaguauuccucgaugacauccuuggccugagauucuuugccauaguccuuaaccacuacgcaacugcaaccagugguuuccccucuugaucgauuuuacagaggccuacccauuccccuaguuucuuguugucaucagccuuuaucagguugauuuggugcucagcacaaagugccuccaccagcuugacauacaugggcucaucacaguuggaugcgagcacacagagaugggcuuggcgcuugucuaaggcuuuggcagcuucguguaugccacgugcuaggccaucauggaugagggcggccuucagcaccucuuguagagcaguguugacguccauuacaccuccagcagcuaugccuuccucagccauggcgguggauuuugggugacgccaaaucuugaacgcacccgagcuuccgccuccacucaagucggcagcggcaggggaaaagcaaaaggucacuuuuuuuaaaacauuuuuuccuaucugggaaacacacacacacagagacacacuuuuagacagugucucauuuguagcccuagcuggccuugaacuugcagagauguaucuaccuuuuccaagugcugggcuuauagguaugcaccacugcuccugucuuguguucgugagaccgggaucuuguuauguaguucucaaaauguuuuuuuuuuucuuuuuuuguuugagaugaggauuccuguagccuaggcuaguuuugaacuuaguauguagcuacgucugaagugacuuucugacccuccugcaucaccucccaacuaggcggucagcaccacuucaagguuuagcuugguuuuucgcccaaugcagcaguccaucaucacugucauugcaguguugccuugcucucugggacuguagguguacccugaauuugaagaccagagagcuugccugccguccgggacuuuucugacuuguuccucagacaauaccauccgcuucuggaauuuggauagcgccucugacacucgauggcaaaagaacaucuucagcgaugugaguagcuucugcacucugguucccgggagugucccgguggagcagggacguuaggccuccccagggccagagaccaggaauagugcacuccugucucucucuguuccucccuccccucaccaugcucuguggcgugaugucucuucuuucucucccaccuggcuucugcuguucaagucugugucugcauccucuccuggcagcccaacuggagaugaucuugcauccaagucuugaguagcaacccaaggggagcacagugggcagaaccaggcagggacuuaccucaucuaaguggcugucacacugggaaccucagcuggugugccagguggaucauaggaagaggcugguggaggccggagagaaacaguuuccugaaguuuuguucaguacugcuagguuagcaagggaccuuuuccggggagcugagaacugaaucacucauuuuaugauuugcuaaaagacccaccuccaggucuaguguggaacagauagggguucaauaauuucaagucauacgcaaacacaacugcaggagcaccauaaaggaaaggacaggaugcuuagacaccguuacgccaucccaagaguccgucccgucagcagaggcagcuucucccggaagaaaaugcuuuagccccagaaaagaacaucuuaaaacucuugugaaagugugguuuucuaggcauaaaaggggcgugugggcuauagagguggggcagcagguaagaacacuuguagaggaccuggguuccguucccagcauccuauggcagcucacagcuaguuaacuccaguugcagaguaugcaaagacugauucuguccuagacacagcacaugcaugcaggcaggcagaacacucacacauuuguuucaaaaggucuggaggcagcuuauugagcuccaacaagcuccuagagacugggguccuccaucuccucauucugucacguaagauagcugucauccuuguggccagauggaaaaaggccacccaagcaaucucucagugccuagcaucgccucuaaccgcaaggaagcuccucuuugacccggaaggucugugcugugggaggcgcugagcacagagccgcuguaagcuccuugcaauacugaccauagccucucuucccacagucucugcugaagguggucuauguagagaaugacauccagcaccugcaggaccugucucacuucccagaccggggcagugagaacggcacucccauggauaugaaagcugggguucgagucaugcaggucaguccugacggccagcacuuggcuucaggcgaccgcaguggaaaucugaggcaaguggcccuuauaguggcugguguucaccuccuggaccuagcauggggggcucucaggguacuggggaagaguccuggucucaggaccauggauauaauccaguuaccagcagcacccaggacuucaacugggaggggcuuccugaagguccgaagucauaguagcuaccaggaccucagcagcuucguggaauagcuuccucacuggucagggauuuauggaacacuuucccgggcauugggcacagaaaaaaagaggucagugggaggagccagcuauaagggcauggguacugaggauucagugcaguagagcagggaaggcccagguggucuacccaccucaaaagguuguucacuacuuuuguuugguuguuuuguuuugguuugguuuugguuuuuuuuuuuuuuuuuuuuuuucgguuuuucgagacaggguuucucgguauagcccuggcuguccuggaacucacuuuguagaccaggcuggccucuauuuauggcuuuucgagacaagguuucucuguguagcccuggcuguccuggaacucaggacgcccggcugguuguuuuguuuuuguuuugugugucucgggugugugggugugucuaccuagaagaugcuaaagggauuccagaucaucuggagcuuaaguugcuugugcuugugagucaccuaacaaacucagguccucuggaagagcagccagugcuccuaacugcuaagucaucucuccagccccuggugugguuuuuuuuaaaaacagacuucuauagccaagauggccuugaacucccaauuccccuguuucuaccuccugaguucugggauuacaagugugcacucccgugucgagauuuguugucauuuauguauguauccguguguauguggguaugcauacuuguaugugccuguauggaggcuagagguugccgggugugguggccacgccuuugaucccagcacucgggaggcagaggcaggcggauuucugaguucacggccagccuggucuaccaagugaguuccaggacagccagggcuacacagagaaacccugucucaaaaaaagacaaaaaaaaaaaaaaugccccugguuggaggcuagaggucaagguuggaucucugcuuuugucgcuauuacacuuauuaucuucugagacagcugucucacugauccgagcucacccguuuggcuagacuggcuggccagcaagucccaggaauccccuuuaugucugcucccaagcgcugcaguucuaggcacacucugcuguaguuagcuuuuuacguggguguuggggaucuaaaccuagacccucagacuuacacagcaagcacuuuaccuacugagcaaucuccccacucugucucgggcaucgagacuggguuucagacuauggccuagaacuuaccguguagccuaguuuggucuucaauuugggugugccucagccuuuagggugcuagcguuguaggacaggcaugagcagccaucaugccuagcugaugggugcuaguggaacgugagcucuggucacgagagcagguuuuaaggugguacguggccgcugugccagccuagaaggaacaagcaagcggggaagagacugcaaagcaugugcccccauagaggggcagcuagcuaccauggagugacuagugaauugcuucuaauguauuuauuuacugcacgugcaugugcauauuauacuguaagugugaaagucaggagacagccuuuaagggucagcucuuccgagugugguuccuggagauuuaaaugguuagucuugacagcaaucacccuuaccaccaucucuuuagcacuagucuguuuuuuuugguuuuguuuguugcauuuuuccugugaaguucugugauuuuuaaaucuuggcaaugugauaucagucacugcguugagugaggugagugugucacuaaacucauggugacagcugccccuugacuggcaaacaguaaaaggugcuaacaugggugaacacuauugcccccugccuggugauagccaagcacugugauaccauuauuuaguccucugagccugcugggccuaagcccuggcuuaccucucuuuuauacaacucacagcagacgguggaggagcugugguggcaggaaugagcaaagucuguauuugagacuguuuaagaaugagggaugagccaaaugugguggugacaccuucuauccugguaucagagcaaguuccgggacacacagggcuacauagggagacccugucuuuaaggagagagggagacagaauggagagugaacaaagcauaauggagaauuuccuuaagcacuggaguggagccucgguuacaagugcuuauggcacacacacacacacacacacacacacacacacauuuaaaaaauaggcacaggacagagacagguagaucucugcgagccugaggccaccuuggccuacauagcaaguacaaggccagcgagggcuaaauagugaggacccucucucccucuaaaaggauaaauaaucuaauuuuauuuccaugggaggccuccccucuucugaggagaagggaggugggugagagggagagacuggagagaggaggaaggggaagcuuggaucaggauagaaagaaggaaaacggcugggccaugauagugcacgccuuuaaucccugcacucaggaggcagaggcaggcggauuucugugaguuccaggacagccagggcuauacaagaaauccugucucaaaaaaaaaaaaaaaaaaaaaaaaaaagaaagaaagaaaagaaaagaaaagaaaagaaaagaaaagaaaagaaaaaaaaagaaaaaaaagaaaagaaagguagaucugugaauauggccucugaugcuuugccugugauauuuagcucuguaaagauggcuuugcuccagaggacuguccacagccccugugguuauauuuugaccugcgaacuauaagaggucuccuugccucugcauuguucccuucaccauagccguguucuggaugggaagaugugguuaggcaucucagacuacuugacaugauaagacugcaguacugccuagagccaggccagggcuugugggcaggguacaguuggcaaugugucuuccaggauccacgagcugcacuucauggaugagcugaucaagguggaggcccacgaugcugaggugcugugccuggaguacuccaagccugagacaggugagcccacagcaugcugaggucaggcgggcagagccacaggaagcagcagcuagugggaaucuucaauaagagcucuguugcuagacucuggaccacauuggcuuggguuccacaaaguaagacagccagggcucaugcuggucucagaaccucaucagggcccgagguggcgugugagugaggaugugaguaagcucguuaucugcuggagggacggacugcgugcuccgcgugccuuuuaaaguguuaaauugcuacagaaagauugccaggagauuauagcaaauacacacagcccuuucaucuagauccagguuucucuuguaaauggagucuaacccuuugacugugcgugacuuccucugcuuuucucuccuguugcucuguggguaugcgagugcuacaugcagaucaaaauaagagcauacacauuuuauuuuuuugcagggugauguaaaaguucaggcauaauguccccugccccucccuccccucagaagaagacaucugcauuuguaugacuguguuagcgguguggcucagugccggaaccuuaccugucauuguagauacccugggucucaucuuggucacguguauccauacaugcaugcacguguguuuauauccauuuauaugcacacacauauggaacacugugcuacacuuaucaaauauguguauuccacuuugauaccaugauauuuauacaaugguucuuacucaaauuuugucuguuccuaaguacugucucuaauagaagcauuguuucucaucuagguucacauguuguagcugucuuggcuuuauuaucgucuuuauucuggaguacuucccagucuuaacuuaguauuuggacuugggcuuucugcaguguacaggccagucauguagaguuucccuccaugugggguuugucuguuuucuucaucuuuugguucagacaauacacuuggaauauccuguguugaguggcuuuugugcugcuguaaugaaauaccaugaccaaagaucauguacagaagagagaauuuauuuuaccucaugcuucaagagagagagagagagagcgagagagagagagagcgagagaagcacucuacccuuuaugucagggaaggccuggccugugacaagaacaggacaucagcugaugaucugucugcacacaggaagcagagagagcaggaaguagggugaggcugcaaguccuacagcugaucccuggugacugauacccuuccagcaacacggcgagcuccuggaggcuccauuaccucuccguaugggaggaccaacugggaaccacguguucaaccacgugaccuauggggccauuucucauucggaccaccacauuauccaguuuagauggaguuagauccuacuauagcaugacgauucucaguaccaaccuucauucuuucauccuccacacgcugcccaccagauucucuuucagugucucuuuccugagcuagcccagccucgggcgguguuauuaaaacucuacuagggggcuggugagguggcucagcggguaagagcacugacagcucuuccaaagguccugaguucaaaucccagcaaccacaugguggcucacaaccacccauaaugagaucuuauacccucuucuggugugucuaaaugaauauuuaaaaaacaaaacaaaacaaaaaaccucuacuaggugaccagagcaggcagagucugagagccaauaaagaggaagaaggcccaaugaaaggauuggcugaaaguggucagcaaggccugccuggggucuggguagccaaaacucagagcuggaccaugguuuaaagugaggcuaagagaaugcauggcagcccacaguaggacucacaggaggagugcugugguaugcuuagguaccuacugcagauaaguguaguacacacacacaagauuugccuuuccuaaacuggggcucugggaaaagacugucuggaguccaggacuuggccugucuugguuuggagcagcuuaggugaagcucucaagccaaagacccccuucuccaagcauuggacaucucagucaccugcuuaucugggaaguagaaacauuguuagcccaggcuuguccucuccacuuacaggagugacuuugcuggcuucagccagucgggacagacucauccauguguuaaacguggagaagaacuacaaccuggagcagacccuggacgaccacuccuccuccaucacagccauuaaguuugcugguaagcucuucccucccuccugcaggcccccagcagauggggcucuuuguuugcaaggaagcacagucgugcccuguggccugagagaaaggaguaucaaccaggggaaucuaaagacugauuuaugauuuacugaaaauaucaguaaugcuacuuuaaaagugauugggaggccucagcaguacugucucgaaccuuuaaucccaggacucaagaggcagaggcaggcggaucucagaguuuggggcccaccuggucuacagagugaguucuaggacugccagggugacacagaaaaacccgguccuggucucaaaaagaaaaaaaggacuuguuuugguucacaguuuaggagaagauagaguuuuggguaggaagacaugacugcagaguaggagacaguauccacagucaggaacagagaggugcaugcugaggcuacuccauacagggcugcccccauucagggagggucaucccgccuugguuaaaccucugcagguuuccucacagucaccugcuguguuacagaggugguugaucugguacugcagcuguaccagcacagaggcagaagagauggcucaguggguagaauccuuauaaguaagcauggugauuugaguuccaaucccuaucacccacauaaaaagcuaccuguaaucccaguguugaaaguguagagacaugaggauucuugugaacuccagcuucaaugaaagaugaagaccuagauaaaaaaaaaaaaaaaaaaaaaaaaaacuaagguggaagaggcagacacgauggcucagcugguaaaagguacucgcugccaagucugaugacccuggaacccacauaguggaagagagaaccaguuccugcaggauguccucugaccuccacaugcacacuauacacuguguguacaauaaguuaauguuaagaaaagguagacggagacaggaagauaccugcuugagucuuuuaaccugugggaucgugggccuauaaucucacuacuuggaaguggagauagguagauccugugcagcccacacuagccucagacuuaguguggagcuaacuaaggaugaccuugaguugaucucaccucuguuucuuaagugcugggaucacaggcauggaucacacacacgguuuucacuuguucugauuuaucuuacaguacuguggccuugaauauacuaaacaaggguuguaccagugagcuacaucccuggcccuuaguuguucuuguuuuuuugugacagaauuuccuauagccaagcuggccuagaauuugaguuccuccugccucggcugcccaagugcuggauuacagagugcugggguugccagugugcaccaccccccguguccugugugcccaugcucugcccagaccugccucacacagugucuuagaaggccucccaccaguaggaaccuuucugauccuaauagaguuggucgcuugcccugaaguaggauuuccuagcuucccauuugccuccuuccuauguagcauaggguagcccuguccagccccuucuccuccucuuccaggcaccagagauguccagaugaucaguuguggagcugacaagagcaucuacuuucgcagugcccagcagguaaagugggguggccuccuuggggacuaagaucaggaucuugucaggggugcccucugaaggucuugccugcccugccaggccucggauggacugcacuuuguccguacccaccacguagcagagaagaccaccuuguaugacauggauaucgacaucacacagaaguauguggcaguggccugccaggaccgcaacguaaggugaggaguucccugugcccuuuguuggccuggccccggcuugcuuccagcuuggccuaguaagaucuugcuugcugacugucuucucccugaggagacacugccugcuuuuucucacugugcaucuguuucuggagaagcugguaaggcugauggaccccgccuuuguuucuuagaugugcgcuucaagcaggcagguauuauaccuacugugauagcaguucuuaagcugggaugaggucacucuucagaagagcuuuaugaggagagccagaggcucuuggcuguaggcagccauguggauaauaugacagaggucccaaaggcaguggcagccuuuccguuuccagaauauuaggagaggcacagccucaugcuagugugaugagauuuuuuuuuuguuuuguuuuguuuuguuuguuuucgagacaggguuucucuguguaguccuggcuguccuggaacucacucuguagaccaggcuggccucgaacucagaaauccaccugccucugccucccgagugcugggaucaaaggcgugugccaccacguccggcuguaaugagauucuuaaagggagagagagcuggagcacuaggagaguuagugcagucuaugacgagcacaagagagucagugguagacccuuccaugcccagaguguuaggucuaacauaggcagcauugaggggccccaaaaggagagacgggccuuucaguucuguaagacaacguagguuucugaggggcucaggguaggaggauucaugugcccuagaaguuacacggcacugauaaaaguaguuauaauugaaggcugucucccagcugucugagggagagagaacucagcucuguaagagucgcaaggucacagcagcucugcucuguagcugagaaagacugcaagaggacagagccucucuucaaggggaggagagugucagaggauccugauccucauagcagugugugccuguaaucccagcacuggggaaaaacuggggguucaaggccagccuuagguacauagcagcaaauuggaggccaccaugaccuacacaaaacuaggugccuccagcaggcuuagccagcagcagcccugcagacuguggcucuccugggucugugcggacagagaagucacaaacuccucauagcuuacuuaacugucucacugggcacgagaaugcugcugucacaguggggccacaguagcccagcccuccaucaugaagcucaaaguccaggaaagugcacaguggucaggccugaaaugaagggagccuugggaguccugaguggccuguaggagggucaggaguugucaggguuaguuagccuggggaguguguucucugcuuccuuccuggcuccuccugccuggggcgaagcccuaaacuugcugugugaaagggagucgaugccaagucaacagugcuccaggacauaaccucucugccggaggcggggcucccucccagaugucauggagacuggaagaagcagaggcuucuagagcagagggcagcagggccaggaggaaaggaggugucuucugcuccaacauggcaaccccacuuccccagggucuacaacaccgugagugggaaacagaagaagugcuacaaggguucccagggcgacgaagggucccugcugaaggugagggugaaccucagacauagcccccaacacagcccccacucucuguuguccgaaggucucuguccuuggugcuuauuaaacacuugcacugaacagugcguacucagaccuggcuagccaagggugcuugaguggagcagagggaggaguccucuugcugaaugcacuguaguuugggugaccgugggguguggcuggaagaagcagagagacuuucaguccuuuccuggcuuguucucccacagggcacagaacaagcaggcacuucucagagacucuggcccuagggaauuguucuuagguuagggucccugaagaguuaccagcuguaccucagacugacugugaccuugggcaagugucaguccuguuugaucgcugucaaaugcaaauaaaagcagcuucuaugcuaggguuguucugcagaggguuaaguucccaggcacucaguccuuagccugggccuggccaccaccauuucugcccugguggcuacuaauucuucaccagcaaagugagagcagaaacugcucuccugaguugauucccuggaccaaguguccaaaacaagagagguggucccucggggugguacugagauguuuggcccaggcauccaaauugggauaaagcacgcagcucagggugacaugugacucuccccucagguccacguggaccccucaggcaccuuccuggccacaagcugcucugacaaaagcaucuccuugauugacuuuuacucgggcgaguguguugccaagauguuuggccauucggguaggugccugccugugccuucuuuccugcacccacaaccuggcccagauuaagaauggccucuccuuugcuugcagaaauugucacuggcaugaaguucaccuacgacugccgccacuugaucacaguaucuggagacagguaggacaaguguggaggcugcccugggugggccuuacucuaggaguaggugggcaugcaucguggggagaggggcucaguccuagcaugcugugcuuuuagccugcguggagagugcuucaaagcuccuagcuuacucucacuucggucaguauacaccuugagucauuuccagcccuaaguuccaccccagaucugucguuuccuugugauguugaacaggcccuuucccucucugagccucaguuugcucuguaagagagguggccccauuugucugaaagcacgaugcuguacccugucuaugggauugguugguccuggggaaggaggguucuuguuucucccuuugauuuaccaagguucugcccaaagcucuuuuccuugaaucuugaggccccaaaacagccccuagugagcuggaauggcuggaccugagccaggauccagagcccuuaaacuaagcugacagggcaucuguggaguggggucuuucuuagccauggugaugugggggacuccagacucaacuguagcuuuggcuguggcucccaaguggacuacugcugcuuugugcccuggucuuugcagcuguguguucaucuggcaccugggcccggagaucaccaccugcaugaagcagcacuugcuggagaucaaccaccaggagcagcagcagcagcccaaggaccagaaguggaguggcccucccagguccugccagccccaagaccagucaaguggccaaggccaagcaagccccggcuaagcccucuuuagccuuagccuguugggaaugucaggcuucgaaaacaaaguuccaaaaacacacuuaggaaaggcuuuacagugcagaaaucucaugcuuagaagguccuuccuuccaucaguggagaggggugcucaaaacgagaaccagcagagacuccagugucacugagugucuguccucuuacccuucugcacagagcugcccguucacuugcaugaguucccuaagccuuucucagacuguuugggaguaaacucccauaaugauuuuuaauacagucuugucagcuagcccaggcuguccuuaaacucaggcaguccuccugccucagccccuagguguuaagaucauaggcaugagccacaauaccuggcucagauaaugauuugagauugaagguguuggugaaugcucauuuuagcaggaauguuuagagauuucuuuucugcucugggucuguuccugucuggcucccacccuggaagcuuugccagggccuccauguagacucccaggugccugugaggagugacuggguaaggcaccacgggaaugggcccucguuggcgcuguagcuuugagacuaauccccugccuuguggcuaccagcagucauagcugaaccuuugcacagacucaguucuagacaaaucccucucuccuaccauuuaccuacguuucucuccuuucugauuuccuucccaaagccaggagacauaugcauccacaccaagugagauucguucccugagcccuggagagcagacagaggaugagauggaggaggaaugugagccagaagaguugcugaaaacaccauccaaagacagcuuggacccagguuagggaaggggaccaguagccuugggucaaaacuauuaguguaauacugagcuaacgauuugggcugauguaacuggaaaagugaguacuggccaagguuugcuggguagucaugugauacuaaagggaagauccuuucccauugagugcugugcaccugccuguuaucccagcauuuagcuacauagcaaguugaggcuagccugugcguuuaaucccaaaugaucccugaauucaagaccagccuggucuacauaggaagucuauacauagcaaguuccaggacagccuguucuacauggagaaaaccugucucaaaaagaaauuuugccgggugugguggcacacgccuuuaaucccagcacuugggaggcagaggcaggcggauuucugaguuugaggauagccagggcuauacagagaaacccugccucaaaaaaaaaaccaaaaggaaaaagaaaaaaaagagagagaaauuuugcugagugugguugccucuuaggaugaaggaagaggauugcaagucccaggccagccugagcuacauaguaagacuuuaucucaaaaccacaaagaugagagagauguuuuuucuccauccucugccccugcuuucuucacucugccuuuguguauaggcagacuguccauuuuugaggggaggagaggccucuaucagcugucagcauauggagcucagcagagaagugagcacccuuccuaauucucaggcagaguucuggaguugugaugugugcucuggaaguuaccuguggcccgcgucucagucaguugcugugaugggccagauccuacaggcuaaggcuuaaguaccugagcgaggccaggcagugguugaggaccaagcaaacuucccacaggguuucccagggaaagaagggagcucuuguucugcccaaggcgaauaccagcucuauuugauaaaaagcgagcugugccccugcuccccugcaagaugucugcucaagguccaggcauuagagcuggcugaagaggcaaggcugucuuuccuaagaaucgcccuuuaaagauacucccagcagaccuguaaucauggaugcgcaggagguugaggcaggagaacagaaaucucaagaccuaucugguuuacagagucugagccugggaaccugucuaaaaaaaagccgaggaaguagcucggugggcaagcguuugccuggugugugugcgagccugggugcaggacuacacgaugcauaaagagaguuccaggacagccagggcuacacagagaaacccugucucgaaaaaccaaaaaaaaaaaaaaaaaaaaaaagaggaagccuuuucucaggagucaugucuaggcuuuccauggacugaacuggccauuaugcuuccagcuguaagagaggcuggaaacagacagaaugguggcucucccaagagaaggauuucggcuuccugauacauaauagcagugugagaauuuagcuagaaaaagcagcugugacuuuucuuauuaucucccauacucccagucugcuguuccacguugaccacuaggcugguuuagauugucggccuuucccugaacacuaauauucugugugcauugcaacacauccuauuauggauguaagggaaccccaagagugcucuaaauucaauugguugugcuauccaaaaugguguguaaggcucugcuuacuuaaccccacacugccauacggauugaacucagggccugcacaugccagagcuaacacucacagccaaggcccacccauggccgugguuuuggucuuuugcaaacagguugucacuuuguagccugggccacccuggagcuuuugcuucuccugccucagccuccugaaugcugagaugauaggcauguagcaguacacucagccccucuccaauauuuagaguuggugagucuucuaaguaacaguauaccuuauuuaaauuuucauuucucuaacaauuaguaagguugaacaucuuuugacccuuguuuggguucuugugccacuccuuuuggagaagacucaguuguaagugugguccauucaucucugugguugccugacacgucuucguguauccaugugugucugcagauccucgaugccugcugacaaauggcaagcugccacucugggcaaagcggcuggugaguguccuggaaggaugggagguuuaguggcugccaggggagcccuccccuucccuucaggaaguccuuuuuccucuccaugucuccuuucuguggagaacccaucauacuuucagcgucagcugaggcagcccuugguccaggcagccaucggccccacgccugccacuguucgggccauuggagguggcacagggagcaagggauaggcccgcucuuccaggccugcuguccugugaagggaagugggagaggccguguaccccacauuaaggaaguaagccacauagugugugggagcagguaugugcaagagaagaaaugacacuaggaaggaaaguuaagauuguucaggauaucaguuuaguagcaaguggaaucugcugaaguuuccagaacuuaagguagugacaggaaauaggccaagggacagacaggugagaggccuggaagagaggcuaggggcuggaacaaaaggaaaugaguggacucuaaagggauuucaaagauggggccauucaguuggauagaagggaaagaaauacuacaaagauagugguaggguggaaggaaugguugcuuguugcuauggaugagggacaggcuuggagcccgugaggagagacugguagcagaacccuggccuuuagccagagcugugguacaggccuguaaucucagguguucaggagacugaugcaggaggaucacgaggucaaggccugugugcacugaagaaugaggaaaagaccacccugggcagcuuaguaagaccccuaacuggaagugaagcaguaaggcgaguaaacacccagcauuucggaggaaggggaggggauguggaguucucaggaguucaaggccagccuaggguaaaagcgacugucucuuaacaaagugauggguuggaggugacagagauuguuggcguuugugaugcccuuggcuguggcgacgcaccugucgagccccagcaccagaggguaaagacaggauuaggucaucuucugcuacauagcaaguuccaggccagccggggauacaugagggcaugagacaaacaaaauaagaagugguaacaagugaaaggaaagggggcagcagguuacagcacagcgaggcuaggcuuaaccucagcauugagcacaacaaggaagcuuucuaacuuuauuccuuccuaacuuuauaauggaaaucacuagucuguuacguuaauuuccuggaggacaguuguauuuuacguucuuaaaaguuagaguauuaaaaaaaaauuagcugagcaguggguggcacacgccuuuaaucccagcgcucaucaggaggcagaggcaggcagaucucugaauuccaggcuagccugcucuacagagugaguucuaggacagccugggauacacagagaaaucccgccuuggaaagacaaaacaaaaaaaccaaagcaaacccuucagugggguuuccuaucccuauuucacagacaggaaauuugaaguccagagaaguuaaguguauauucucacaguuggacaugagaaaauggaggauuaacacaaaucacaaguguguccucuccagcaacagcuuugguagaauaggaauagggcuguguuugagugacagcugacagaauuugugggugaaauacuguuuggggcuuaagaaacugcuaagaaucauuggaucuggugaggcuuugggaguggggcagauaacggggaaucggaaguagagcccccaacauaguaacucugagacacccauguggagaguggcaagccuuguugguaagagguuccgagcuggccugguggcuuacaccuauagucccaguucuugagagcugggucagaaagauuggcacuaugggagguuccagccaccauggguaacaggguaagaccuuaucuggaagaaggaaggagggagagagaaagagagguguguggggggagguaaauagguucaggacagaggcucaucaugucuggaagcuguuugcuuaaaggguguaaggccaggagaccacacgagaucugugcaguccuugucgaaaguagcagaugcauggcgauaguuaccugccugacgauugucccugucccucuagcuaggggaugaugauguggcagacagcucagcuuuccacgccaagcgcagcuaccagccacauggccguugggcagagcgggcugagcaggaaccccucaagaccauccuggaugccuggagccuggauuccuacuuuacacccaugaagccugaaaaucuccaagacucuguucuggacucaguagagccacagaaccuggcaggccugcuaagugagguacagccccucccccaggccaccugccaucccugcacugugcugcucacucgagagggugacaggggaaaguagggggcaaacaagcagucuuuaggagugggucacucagaggcuugaccaagcucuuuucuuuuuuaaagauugauuuauuugccgggcggugguuggcacauaccuuuaauccuagcauuggggaggcagaggcagguggauuucugaguucaaggccagccuggucuacagagugaguuccaggacagccacagcuacacagacaaacccugucucagaaaacaaaacaacaauaacaacaaaaagauuuauuuauuuuauguauaugaguacacuuguagcugucuguagacacacuggaagaggauaucugaucccauuacagaugguugugagccaccaugugguugcugggaauugaacucaagaccucuggaagagcagucagugcuuuuaacugcugagccaucucuccagcccuugaccaagcucuuaaaguuggggcuccaggauaggcuucucuaaauggagugcucaaguggguagagcccuggauuagccccucccuggcugugaccugagguaagagguuugccucucuucucuuaguuucccaaauaaugguucuauugccucugaguacucagagaugcaggacucagcccuuccucuuuuuuccuagcgggcgauccuuuccugcucuaaugcauacauuuccucuuuacugugacaguguucacucgguaauggacacacgucuccgggagaaggcuuggugagcuaccuacuucacccagagguacuugccaccuccaucacccacagagcauguucuaccucuuggaaaaucucuucugaccccaaguccguacccacccaccccaccugagcaagccugugcucucaccucuccucaugaacugguuuaccuguuuuuguuguuguguuuugagauggucugaucauguaacuggcugugcuagaacucacuauguagacuagguuggcugugagcucagagcccaucugccucugcugcugggugcugggauuuaaugugugugcugcugagccugcucagcuagcacuuggcuuaggccuccuggacuaagucagaccuacacuuuaucugugaaggggcugcugaugucagggugggggaggaggucuggccgagugcugacuucacacugugucugaugugucuggcaguggggauguggggucacuccuugugcauaacugcuggcagcauucuugggccuggggugaaccuggcuaccucagaauggcuuugcucuucacuccuaguuagggagucccaaagaggacaaccgaggccaccccuccuaccugccucuacagagggaagccaccgaggcaagcgaacucauccucugcuccccagaggcggaagugucacuuacagggaugcacaggugaauguccuacacacagggaccccauaguuggagagagggagcccuggugagaggcccaaccuggaaacauucuuguucuuccaguggcuugugggaauggacaugggugaguugagggacugucucagacaggcucaacugcaaccucauuuuccuugguuccggguuggaugagggauuuuguuuggaggcaggagagcuggggugugcucugggagcagggugugggccucaggguucugggaaagggccaguuguuaauugccaauauaaccccacccugacgguguugcagggaguauuaugaggaggagacagaggcaggaccugaagaccagcaaggcgacaccuaucucagggucucuuccgucaguucaaaggaucagagccccccugagggugaguggggagcaagcaggcacccucguggucuguaguggccucuugugggcacugguaguggucuugaccuaguucuccaauguugauaaugucauagaagacaaagggguuuccugccguuugcugaggaugcuaagccacuagccaggugcccagcucugccacugcuucacgugcugguccauaaagaagugaggggaugccugucaccccauccuccagagcaucugggcagugcgcccugucugacuuggggcaggcuccugacccaccucuaucccuucagacucaggggagucagaggcugaacuggagugcagcuuugccgccgcccacagcucagcuccucaaacggacccuggcccucaccucaccaugacagcagguaagccagguaaauguuuccucaguggaagacugccauuucugcucagccugguaagcaacccgguguguggcaggcgggugagucuggauuucuccauugucaagcgucguccgccgugacucagagugcugacaaguccucuccacccugccucccauccagaguacccaaguacagaagagcuuucccagccugagcugccaggcuugggcaauggcuccuuaccccagacaccugagcaggagaaguuccuccgccaccauuuugagacacuuacugaugccccuacugaagguaggaccugacuuugcacccugauuucguguguguguguguguguguguguguguguguguguguguguguguguguguguuuagugacaggaacagugugaguguucuuggguagucuuccaugguaagguggugaaggauggguggaggagcaggcgguuuggccccucgauucacaccugaggcaucugagauguuggcuggccugagggcccauggguaucuuccuagagcucuuucauggaucccugggagacauaaagaucucagagacugaggacuauuucuucaauccccggcugagcauauccacccaguuccucucccgccuccagaagaccuccagguagaagcuaguaugcccugcucccuucuuucuacccccagccccagguggaaagaugucccucaguuaccccagggggggcuaugugaacuaugugucuuucccauccggcuuccuccccaggugcccuccccgacugccccugcaccuuaugaagucuccagaggcucagccugugggccaagggggcaaccagcccaaagcagggccccugagagcagguacuggcuacauguccucagaugggaccaacgugaguauugggaucacucucucaggacacagggcugcgugccaggaggccuuguccuuaccaagaguugugcuugcagguccucucugggcagaaggcugaagaaacucaagaggccuugagucuacuggguaagucucccuaauccuagaggaacagcccuggggguccaguggagccaugggagugucuguucagauuugaagcuuuuuuuagggcagggcucugaggcagggguacaagugaaccaucuuuuacagucccuccccucucaggccugacauccugugucccuccuuccucggugccacccacagacaggaagccuccaacacccacaucuguacugaccacaggccgggagcaaaguaucuccgccccaucuucguguucuuaccuggaguccacaacgagcucacaugccaagacgacacgcagcaucucucuuggggacagugagggcccugugacagcugagcuaccccagucacuucacaagcccuuauccccuggccaggaacuccaagccauccccacuacaguggcacugaccuccagcaucaaagaccacgagccugcaccgcuuuccuggggcaaccaugaggcccgagccagccugaaacugaccuuauccagugucugugagcagcugcucucuccaccuccacaggagccacccaucacccauguguggucucaggaaccuguggaugucccaccuaguauggcagucacaguagccagcuucugugcacccagcccuguagacaugagcacccugggacuccacaguucuauguuucucccaaagaccucagccucugggccccuaaccccuccugcccaccuccaacuucuagagaccaggucuagggugccuggcagcacugcugcucuccuggagcccacccccggugaguacgacccuuggggcguggcuagaacccuagcccaucuccagggcugcuugacucaccuccccaaguggacacagccuggccacaggggcugugccagguucacucaugcauccauccauucccucauuacaauagccaaugagcauaugcuggccuuuguucuagguccugcgccugcgcguaggagacauaguagcaaacaagagaagguugauuuccuacacuaggugagaagcccagacaaaaauuggagugucaggcuuaucaccaggugauauaagcuagugagaaaaauaggagaagggggucagcaguguagcuucaguuucaggguggcagcaaaaggcuuuagggaaaagauuacuuucagcagagcccuguggggaagaggagccuaggggccugaaggccgugguccagggccagcagucuuuagcccagcuaccuguccucucuugggccaucuagaaagacaaaguuuccuagccauuuauuccucucuaccccuagaugcaucaggugugaucgcagacagcccuggacacugggacacagaagucccuaccccagaacuccuaggcaguguggaaucagucuugcacaggcugcagacugccuuccaagaagcucuugaccuuuaccgcauggugagccaagggagcccagggcagggugggacgauggagagggcucccugccacucccuggauguccucuaacgagcuugccgucccuuacagcuggucuccagcagccagcuggguccugagcagcagcaggcacagaccgagcuggccuccaccuuccacuggauccucaaccagcuagaagccagcaacuguauggcugcagcuaacuuggccccaccccagacacugccuagcccagacccucugucccuaccuacacuuuguccccuggccagcccaaaccugcaggcccugcuggaacacuacucagaguugcuggugcaagcagugaggaggaaggcaaggggugacugagaaccugaagccccucuaccaaagccccgcugcccuggagaaauagauuuguaaaccaauaaacugacaguuguuuccuggaac

SEQ ID NO: 3687 - RNA, 16642 nt, Mus musculus
ucguccccuucucucugucucccucucgucccccaucucgucccccgacacugacaccccgauacuccugaacucucuucagucccagccuugcucuccaaucggcgccaucugagguaagaugggaggcuggggagaaggggaggggcgaagcauccugcaucccuagauaaacaaaccccgggagggggcggccgagacccaggggccuggcacccgaagagaagaaugggaggcugggccugagagaaguggcaggcauuggggcccauaucccugggccuucuaacgaguaacggggaucccuuugguugcccaaauccagagcuggggacuagggggccgcccguggcucuugaaggggcuuggacccccgcgcuguggggagcccucucaugcugaccuauaucuuaaggguuugccuccaggccacccccccaacuuugcacaggcccccaagggcuacagaggaccaugacuaagacggauccugccccaauggccccuccgccccgaggggaggaggaagaggaggaggaagaagacgaaccaguuccagaagcccccagccccacccaggagcgccggcagaagccaguugugcaccccucagcaccugcuccgcuccccaaagacuacgguaaccacuguccccacccuagaaucuagucuggagcuuuaggugaugguggguggcuuggcugagcuguguugauggugaugaugggggcaugcugaaggugguccacuggagucuuaguugaugagcccuuuagacugcucuccuucguuaauuacacuaucaucuguuagagaauggggguuggaaaaauucuaguccuccauucaugacauaucaauucagucguuuagucauucaacaaacacugucuggaagcuacugcgagccuaacuuuaugcuaggaacuggagcuacagcacagagcaagauuuuccuaagacuuugccaagagaacuccccaaucgcagucccacaaaugaggcuaaauaugagauuacaggagacaaugagauugauuuuaucaagcacagaaugcugcaagagcuuuuaaagacaggguuccccuuaagagguagcauguggggaaaacccaggucggagcagggaggaggaggcugcaggagaauuaaacacaggagucaagggucugggguggaggggugugagggaggagcugagaggaacuggggaaacgaagugucuucauucguggaggacggaggauucaggcaucagccuugcucucagagagacccaacaagugaagggacauacuaccuucacugugcacaguggagugugugcugucaaaguaucaaaaggcgagacauccagcagaagacgcggguaguugcuggcucuuucugauuaggugcauugcagacugaggccagaagcaccaggaggaagcagcuguaagcagcuuggaccaauagcuccaguuggagaagagugugugcaaaggcccgggggcaggaaugcagaagagugugugcaaaggccuggggcaggaaugcagaagagugugugcaaaggcuggggcagaaaugcagaagagugugugcaaaggcccgggggcaggaaugcagaagagugugugcaaaggccuggggcaggaaugcagaagagugugugcaaaggcuggggcagaaaugcagaagagugugugcaaaggcccgggggcaggaaugcagaagagugugugcaaaggcccgggggcagaaauguagaagagugugugcaaaggcccgggggcaggaaugcagaagagugugugcaaaggcccgggggcaggaaugcagaagugugugcagaggcccgggggcagaaauguagaagaauaugugcaaaggcccaggggcagaaaugcauuuggaauugcaagaccacaaagcugcauuuagggaguaaucagaaauggggacaggucugggagggacuuccaggccacaccaagggcuuucccuguuuucugagugugaaaaggagagaacagugugugcaugugugcagucuaaaaauagaguagggcagccuuguuaauuacguuuuaguugauuuugugugugcuugcacgugcaugccauggcaucugugugccagucagaugacacauuucuguagcucuuucucuccuuuuaccccgugaauccccgggaucgaaguugggucaucuggcuuggugacaggccuuuaccagcagagccaucccacuggcucuugauugacaaccuugaaagcuccuucuggcuucugauuagagagagagagauggcgcucagccccgacuggaugugggggagaggcgugaggaccucuccagcgaaggcguuggcuggcagcgcccaggggcugugagauucagaaacuagugcuagguucagagaguugggggauggggcaggaggaaucgccuguggacaugucaccuacaagggaucgaucagagggacaaauuuuagucuagcuagaaaaauaaaaagaauauuaucuggagagauggcucauuugagagaguccuugccauuuagacauauuuagauccccaguacacacauacaaggcuaggcacugggcacuggccgcuggcaucuguaaugcuagugccagggagucagagacaggggaugccuggagcugacccuaucucaaaacuaagguggccaacagagggagacacccgaugacaucaaccucuguucccacggugcacacuguccauauguguauacacagagucacacacaacagucucaugugggaguuugggauccaccccagcaaaguggagaaccuuuagaaauugaacaggaucuggcuggaagucacagaaccuaggccgggccccaggaauaguccugcuuguaggacaaaggucuuggaaguguggcuuauucagggagaaagcugccagugguguuuguuugcuccguucauguuuuauuucugaagagauccacuagaccucuccugcauggugguguugugugaagugggcauaauguagacacaccucccagugaggauagaggcauaaggaaggcgggacagaaacacaguguguacaugaagucuuuauggugaaggugacaaucaaaaaugggagagagacaagagaggagagaaacuugggguguuguucagcuugcuuagcucaagccuuggauucuguccucagcagggagaggacuagaaggagaaagggaaggagagagaaggcaagggagagaagaggggagaggaaggaccacacgaaccauuuuugggggguuugcgcuacgccaagacguuaacaggcagcuuggacaggaggccagggcuagcaguugagacuggguggugugaggaggccucucuguggauuugggugugcaaagcauuaugaaggccugaaggaggacacuggacaacagcagcgcggagaggccaggauuugcuuggcacguuggagggacagaaggucaguuggcugaagggcuaagggagagggagggugcagaagauaaagggagcagauugugcagagccuugugcaccacggggaggccugugggcagcugggagccagaggaauguucugagccaggacaggcugugacgucaguggauggggacagacuccugacucgcuguucauggucgcuguccauggucacgccucuggaugugugggauccagucuucacuuauucguccacugagcacaggcugaggcccccguggagugucacccagagcagcucaccagcaucccauucaagaaacagacaugccuuccagcacugcccuggcuggccucagaucggaccgagcccauucauggcucuguuuuagagaugcuacacagagcuuaaacuuuuaaagauuuguuauuuuguuauuguucuuaauuacguguauucaugugcaucuguguguggguacauacaagugagugcaggugcuugagaaguccagaggucaggucaggugucacccuagaacaagaccuacagccaggugugagcuacgugaggaaggugcugggggcugagcuuaaguccucagcaagcacagaaugggaccugaaccgcuacgucaucuccccagucuccagaaauuuguaaagauaccuuugaguauuuuuuaaaaacaaacaaacaaggcugggcagugguggcgcaugccuuuaaucccagcacuugggaggcagaggcaggcagauuucugaguucgaggccagccuggucuacagagugaguuccaggacagcuagggcuauacagagaaacugucuugaaaaccaaaaagcaaacaaacaacaauaauaacaaaaacacaaaagauuucuggcauauuuaucuaucugagacaaggucucauuguauagccucugguggccuagaacucauuguuuagaccaggcugucuuagaacucacagagcuccaucuguuucugucucucaugugcuuugugucugaccgggcuuuucggauaaaaauugaaaagaaaaacuuaccuccucuuggaauuugacuagacuguguccauucuacacacacacacacacacacacacacacacacacacacacacacacggugcugaugacugaauucagggccucaugcauuugcuaagccagcaucuaccaccgagcuccgucucuaacaacuacauuguggaggcagggucuugcuguguagaucaggcaguccauguuagccucagauuccaacgagcugagaugacaggcgugugcuaccacacccagcucacugugcccagaguuugaccugguaacuggggcccagaggcuuaguaggacccuugaacaugcagcugcaaagaugcugaacaugcaaccacucucuuucaaaggguggaauuaccaauuucuuaagacacugggggggaucuguaugcuuuucauuuagugcccuccuugugcugaaaccugcugguuuuccagacaacaccuguggguugacuguggccugugugccaccauuucaaaccauguauucaagacucuuuaaaggcaacaauguagagucuccucucgugauguaaaggggagauggcuugccuggggugagucuguacuucuuucuccagcuuuuaccuucuucgaucccaaugacccugcgugccaggaaauucuguuugacccgaagaccaccaucccagagcuguucgccauuguacgccagugggucccccaaguccagcacaagauugaugucauuggcaacgagguaggagcacuucgggagguuggggagggaggagacccgguugcccguguuuggguaaucccauguuguuaucuggugcucacagauucuucgucguggcugccacgugaaugaucgugaugggcucacagauaugacacugcuccauuaugcgugcaaagcuggggcucauggaguugguaagagcccagaccccacaaccuaggcucccagcccucaagaccaccgaggacucaggcccaaauagcacaucuggugacuguuauccaagaccccaaaaugcauaacugagacacaagggucccuccugauguguugggcacuuguauuggaaaauggcuucccagcugacacccgcucuuugcaggagacccugcggccgcugugcgucucucacagcagcugcuggcgcuaggcgcagaugugacccugcgcagccgcuggaccaacaugaacgcccuucacuaugccgccuauuuugaugugccagaccuuguucgcgugcugcugaagggggcgaggcccaggggugaggaggcggagucucucuggaacgggguguggcuuagaugaaggguggaguuucuuauagggagaaggguacccaggguuuugagagcgugggggccaccauccaucugguuaaggggggaaaaacucaagaugaaaggauaaaagacugaggccuaagguugaagggugccaggauucaaacaggaaacaagggauagauagacaugcacgggcucgggauggcagguuguguugguuguguuggugggggguaaguggugauggggucauauaugugacagaaggguagguugggcaagauguuuagagacugggagcccugagcaggcaggggugaggcuccaugcagauguggcagacacucacucuuacccuucccucaccugcccacuucccaguggugaacuccaccugcagugacuucaaccauggcucggcucugcacaucgcugccucgaaucugugccugggcgcugccaaauguuuacuggagcauggugccaacccagcacugaggguacugucacccaccccuucauccccucccuccggccuucucucuuucccuucagcaggccuggccuccaaagagagaggaucaagcccucuccuaaaacaucaggacaccucugcacauuuaacaaacaagugaaaccacaccugagauucauguacuguucguugugcagcaggucacuucuaauuacuauacgccccguuuuacaauggggagucugaggugaagagaucagaagaauugcccaggaugugccgugaggaguguguucuuucaguccugggugaccagggucagugauguaacaggccuagagucuuggagguugacuuugagucucuauuuuuuuauugucugcuuuuguuugguuuugagaugggguuuuacuauguacauagcccuggcuggccugaaacucucugugucgaccaggcuggccucaaacucucagaguuaugccuacuucugcuucugccucccuagugcuggaacuaaaaguguguaccaccacuuuuuuuucccccaagguuccacuauguagcccuggugggccuggaacuccccccccucccccauacuuggcagauaugcaccgcugcacccaggucacaucugcaucuuuacccuccauuuccuccucuucccaaauugacguagaguguaacuuagcauaacuccagcuuuacccaaucuggaggucugagguguggucucuaaagggguaugacuugucccacucaguccuuguuucuuguguucucuuugauccacagaaccgaaagggacaggugccagcggaaguggucccagaccccauggacaugucccuugacaaggcagaggcggcccugguggccaaggaacugcggacacuccuagaagaggcugugccacuguccugcacccugcccaaaguuacacuccccaacuaugacaacgucccaggcaaucucaugcucagcgcgcugggccugcgccuaggagacagagugcuccuugaugggcagaaggucaggggcugggaugagggguggggaggacucagcucucgcaccgacccccccccccgcccccugcccccagccccuagagcugggugcaugggcuucggacagacuccccggcagucacaccauacuuuguuucuccuagaaguuguuaucagcacacuacguuuguacgauguacacccugugcugagcucugacagaccuguccccugaaugcagucacagucacagcugaaacagugauuagcauagcucucugcacaaccgugguucuccuggaaggccugugacccacuuuacccucgggugcaaagucagggcuuucacugggauguuaggggccucaggguagaagcuaagugacccaggagaagagaagcaggaagugucuugaguuaaagccaacagggggcggcuggggaagaggcagagaaaguguguuuccucuacccaccucagcuuucuuucccuugccuggugccccucgugccagcgcauuugugcuuuaggacagagggucauggcaaccccagcucugcuccguggaguucugcugauaauggaguagacaguaaagugcugcgguggcucuguucagucccaguggcagcagggauggugacagacacucagugccuggguuuaggaaacagacccuggcuggaggcaggagagguuuuagcuggaguguuccgagaaggcuucccugaggacgugauauucaagcugaggaaggcgcuccuaaagugaaggaacagugcggaagcagaggaauccugggauaggaggggagcuagagagaucggaaggggcuggaucgcaccagacccgcagaccucuuguaggaagugggauuuuggauuuuuguuguuguuuguuuguuuguuugucgaguguuuuguuuccuaaccaaaagcuccuggggccaugagacggcccagaggaaaaggugcuugccauacaggugcggcaaccugagcucaaacaccauuuuuaaagagcucacuguggcgcauccagaaaacuuccuguaacucacuggacaguuugaggguaugaggcguacccuccccauuugauagcccagaagaggcgcucgccuucuguccuuagccgugggauacccagcacuguuaaagcaacaaccagcuuaggcuuaguagcuugcccagguuccguucagcuuugucacacaccaggaguagguccugggauagugauguuccucugucagcuucucccccuguaagugagaugacagugcccaccacgggcagguuggaggugcgugucagaaagucugaggccuucagaagagagcccgguauaugcuaacugugcuuuguuugccgagcaccguccccauccccauagagaacaguuagcaggcuagcucugucaauccgucugucuguuguuccagagagagagagagagagagcuagugcuuccuagauacuaggcaagugcucugucgcugagccacaucuccagcuuuaguuagccuguucuuuagacaaggaacucauggcugggagugagagcuauuagcucagugguagaaugcuugcccagcaugcaugagcacugcagagagagagaaaaaaugaauggcugugugugguggcacauuccuagcucucaggaggcagaaacagggaagucagacauccaagcccagccugggcuacuugaaacccugauucaaaaaagaaaaaaagucgggcaugguggcacaugccuuuaauccuagcacuccgcagguggauuucugaguucgaggccagccuggucuacaaagugaguuccaggacagccagggcuauacagagaaacccugucucgaaaaacaaaaacaaaccaaaaaaaaaaaaaaaaaaaaagacgaauccaaaguauguuauaaucaggaggccucugaggauuauagugaccacagucauugagaacucucugcagcuaaguuuuuguuuuguuuuguuuuguuuuguuuguuuuguauagauguguuuuuaaaugugugcacaguggugcaguaccccaggaguccagaagagggcacuggauucccagaguuacagucacaggugguugugagccuccuggcauaggugcugggaaacaaccuucugccaucuuaacaucaagugcucuuaacuacuaagccacgucucuggcaucuguauaugucuuaaaaaaugucaucuccccuacucuuaaaccaggcaugauaccacgugccugaaaucccagcacuggggaagccuagcucaaggcagguggaggugggggcacaaaugaacugagacagggucucacucuguagcuuaggcuggacuggaaccugugugaucaagguuggccuugaucuuccugcaguucucugccucagcaucugaagugcugggguuguagacaugagucaccagagcuagugucaaacuuugagcugaaugucacuuguagcuaugacugaaguagguaagaccgaucggagacaaucuuuuuugcuuauggggcuggaacccagggccuuaugcauaaugucacucugccaucgaguucuauaucccaauccccucaacaucuuuauuaaguggaugcagucuuuguucccauuugguggaugaggaagcugagggauaaagagaccuaugaagucaccuagccaauaagagccagagcugagauuugaaccugguuccugcauccauucugccaugcugccugucuugucagugguccaccauuguauccacagucccugccuaagccaugucauccuugucccccccagacgggcacgcugagguucugugggaccacugaguucgccagcggccagugggugggcguggagcuagaugaaccagaaggcaagaacgauggcagcguuggggguguccgguacuucaucugcccucccaagcaaggucagucucugacuggagcccaggucggagggauggggguaugcucaauucugaugcugcugucuggggaaaggggaugggggaggagacacagcaaagccuaagggucucuuggcuugggcaaugcuaaucccagucucugcuuccuccucaggucucuuugccucuguguccaaagucuccaaggcaguggaugcaccccccucaucuguuaccuccacgccccggacuccccggauggacuucucccguguaacuggcaagggccgaagagaacacaaaggucaggaguguggagucaaaggcgugggaagaggcagccuugggaacacugugggguagcucaggauugucuuuccucaacaccaacuguagagaauaagcugacucccuccuucagugacucaguuucuccucucacccaccaccggcccaaaccagcuuuuagucugggguucccagccuccugggacuuaguuuacucucaggccccaagaccucucccaguuuuagggaagaaucugucuguagggguuucacucuuccagaaguuucuggcuuuuaugaauaaagguauucucagacuaaaacucaaccuuaucuuaccacuguccccucucucucugauguaugagaccauguguggacaaguguuggugggcgcucucauaaauacaugccugaucacguggagauccgccugccucugucuccugagugcugggguuagaagaguuugccaccccugcccagcuucugcuuaauuuuugugagacaggaucuuucacugaacauaagaucauauauuuggcuagacuggccagcacacaggcuccagccuguguccagugucuuggugcccaagacugccccugccucuuuacacgacugccaggaaucuaaacucggguucucaacgcugagcggagcucaacccuauuuauuuucuaggugaggucccacaggguugcauaggcugaucuugaacaccuuggcuuacugagugaugguggcguacaccauugaucccagcacuagagaagcagaggcagguggaacucuguggguucgaggacagccuggucuacgaaugaguucuagggccacauaaacccugucucagaaaacaaaagcaaaaaccccaccuuaguucaugucuccugagcccugggacuauagucccuuaucacuaccuccaguuccuuuucuuuugcugucuggucacacuagggauuguauucaggacucaaauauaugcuaagcaagugcuauguuucugagccauggcuccaacuuccuucccugcauuauugaagggaaauuugggggcuccugauuuccacuuccauuuuuccuuugggcuccauaucuuuaccuuucauucccagggaagaagaaguccccaucuuccccaucucugggcagucugcagcagcgugaaggggccaaagcugaaguuggagaccaaguccuuguggcaggccagaagcaggggauugugcgcuucuaugggaagacugacuuugcuccaggugagggugggcucuggggugggaugugacucggaugcacaaggcccuggguuggcacugaaguugaggccuccuggcaacacccuuguuacagguuacugguauggcaucgagcuggaccagcccacaggcaaacaugacggcucuguguucggcguccgguacuuuaccugugccccgaggcauggggucuuugcaccagcaucucguauccagaggugagccucgcugugccccuccacucaggaagccaccuagagcccaugucuccccucagaugguccuuuuggacuggcgaggcaugguugguuguuguacucucccuauuuccuuugcgcuccuggggguucauucagcuccuagcccuucaugguucugaauuuucugugucuccccaggauugguggauccacugauccccccggagacaguguuggagccaaaaaagugcaucaagugacaagugaguuggaggccgggaugcaggaaggaguauggguaucagaaugggagaagggcuguggggucucagcuauauguuagugacaaucucugccauuuacccugauacauguggccagaaaaauauaagacaggcccccaagaaaguuagguccuguagauauggggaaguuaccaagggaaugaggguuuagaauacaguuuaguuguagagccccugccuagaaucccccagugaggggcugggggcguggcucagugguagagccccugccuagaaucccccagugaggggcugggggcguggcucagugguagagccccuaccuagacucccccagugaggggcugggggcauggcucagugguagagccccugccuagaaucccccagugaggggcugggggcguggcucagugguagagccccugccuagaaucccccagugaggggcugggguguggcucagugguagagccccugccuagaaucccccagugaggggcuggggacauagcucagugguagagccccugccuagaauccuccagugaggggcugggggcguggcucagugguagagccccuaccuagacucccccagugaggggcugggggcauggcucagugguagagccccugccuagaaucccccagugaggggcugggggcguggcucagugguagagccccugccuagaaucccccagugaggggcugggguguggcucagugguagagccccugccuagaaucccccagugaggggcuggggacauagcucagugguagagccccugccuagaauccuccagugaggggcugggggcguggcucagugguagagccccuaccuagaaucccccagugaggggcugggggcguggcucagugguagagccccugccuagaaucccccagugaggggcuggggacauagcucagugguagagccccugccuagaauccuccagugaggggcugggggcguggcucagugguagagccccugccuagaauccuccagugaggggcugggggcguggcucagugguagagccccugccuagaaucccccagugaggggcugggggcguggcucagugguagagccccugccuagaaucccccagugagggauuagguguggaacauaacucaacaugcauaaggcucuggguucaauccuaagcacugagaaaaaaaaauagagagggggaaaaaaaaaaaaaagaacaccuguggggcuggagagauggcucaaugguuaaggucacugcuguuuucccaaaagaccagaguucaauucccagcacccccaugucaauucauaauuaucuguaauuccaguuuagggggucugacacccucacacagacauacaugcaggcagagcaccaauguacauaaaaaauauuaaaaaucuguaauaccaacauuccuggaguugaaguggaaggacugcaaauuuuagaccaaucucaaguacacagugagacuauuuaaaacaaaugaaacccaaccuaacuaacaaaaauaaggguguaagcagguccuggggaagagggcuucauuagaggaguauuggaggcguggguaacuaauggcggggucgccagguacuaauaagagguucaagaacauguagaugaugaaggggucuagucagggucuggagacauggauagauaugacuguguauguguguguggggggggaggguugucaauaacacaggugacuuaacugucaccucccuugagacuuugccuucuucucuagugacacagcccaaacgcaccuuuacgacaguccggaccccaaaggacauugcgucagagaacucuaucuccagguguguggcucaccuucuagcagaggguuagagaugccugcaaggccacuggcgguggugugcaaggcccuccuuggguuggaaauggaaguucaguuguaaguagaauggauguggguguuaugucuguaaucccagcacccagcagacaggaggaucaaggauuccaugccuuccugagcuacauggugugagacugucucauucaugaaacccacuuuaaaaaugagaaagaaggaaaggggaaagaggcagguggcucucucuggguucuaggacaucuuacaacuuggucuacaaaaugaguuccaggacacagggagacacagagagacacggagagaagcuugcccaagaaaacaaaaacaaacaaacaaaaaaccaaacccaaacccaaacccaaaaagccaggcagagauggugcacacuuuuaguuccagcacuagggggcagagccagccuagucuacagagcaaguucuaagacagcccaagcuacacaaagaaaccuugucuuggaaaaacaagccaaaacaaaccaaagaccagacagacagaguaugccauucuugucuuguacaguggcucaugcagcauagggaggcugaggcagaaggauuguccccagccugagaacagcuuggaguauauagcgaggagacccugccgugcaaaaacagcaaaggaggaaaggaggggagagagcaucuuuagaaagcaaggcuugccuggcuucuggagacuucagcugaggaagcagaaaccucccucccccaacaugugcacgugcacgcacgcgugcacacacacacacacacacacacacgcgugcgcgcacacacacacacacgcacgcacacaccguccaagcguacacaggcacagccagaggaagaacgccaggcacagaggugaagugagggagccagaugcccacaccuacaccccaccugacuguucuucuuccucuucuagguuacucuucugcugcugguuuccuuggaugcugagggcagagaugcagucuuagaggcccuggauaccuaacacagagacagaguccccucuagcaucuccuaacacaaggagcccccccagccaucccaagauagagauucccagugacuucagaauagaaaccccguuagccagcccucgauuacugaggucccauuauuaacagaucucccaccacgacgacucccuaaauacagaccucauguuucccaaaagagauucccugaguagcaccuucaggcuagucccuguccccuacuccucagagcagauuccccccaauaaacauuuuccacuucacccaagggaugcugacccucuccacaacaggacguucuugaguuaccagugaauuagagucccaugaaugaagaccccccacccugguucuccuuaagcauaggucauacuuccagaauagccagccacaucacuguccccauuuaacaucagucuccucaaaauguugugaccccaaggucaccagaaagcccuuauauucuacucuccuuaucagagaugccccccauucacuuaagucccuguucucaccccugaacaagacacccacuuagucggcccacucaccccaauuuacaaacaccaaaaccguccuggaagcaugaauuacaggacagcaagucuuccugcccucuguacccugagaaacccccagugccuuguaugaagcccaccccacauggcccacagucccugugcuggccaaggcucccagaaaauucucuauuuuuuaaagugauaacuuccccccuuuggggggaaauccccaaauuuggaggccccauucuagaacucuggggaguucaaauuccagagagaauauauauuauauauguccccaaauuucccaucccuccaagccccacgaucucuagaagaccccaaauuucuaauucccaggacuucccuacccaaguaacagaaucuucaaauccccagggaaucccaaacuuaagaccccaaucccaagcccucaggaaaccccaacuacaagguccuaaggacugggaggaaggacccuguugccaggcucucagggcaucucaaaccugacucccaggcaccaggagaccccaaacaggaagucccaucuuuggaacaaggauagaggacucuaauacucuuaguccauggaucaucuaaucucucaaccuccaaauuccaugggccccagcuucaagggaacccccaagucccaaaucucugauuacuaauaugugcagggccccagggcucuaacaggaccccaagucauggagucccuacuucaaucuaccuuccggucacagguccaagacacuaaaucugagucauuggccccaaaggacuucacagcuccugggccagaccaacagccugcgggagaaccugagggccccauagguccagagcagaccuggggcccugaccaccaaggacagcucacgacugccccuucacugcaugucccuaaaaucagcaugacuccuguccucuucaauaaagacguuucuauggccu

SEQ ID NO: 3688 - RNA, 5601 nt, Mus musculus
gcccuuagguucucugaguaugcccaguggucuaaaccuuccugcgucaguaaugcuuggcggaaguggcagggggggcgugcgaggaugcgcgcguugagucuggauauccgagaagacgcuguagacggucagauuuauuuuggggagagaggggagucuuggggacggggggagcgguaggagugaguguccaaaggacugaauguggaggucuaaggcgacucagggugagagcucuagggggcucaguguggaauccugacacucagggucugagagguucuacaggggaagaaacuuuggcaaucuggcucagaucugagggugcugaaguggguucugaguggggagauaagaggaagcugggaguggacaagucugagaaagcucagaaugggagaugugaaggagccgaggugagaggagggagggucuuuaggcucggagggaccugugcuuacgauugcauucgagagaggcuucaugugugggcgcguucucugugaugcuugggaagaagauucacguauacuuuggugggcaacgguggacagagcgauggaggauuuuacugacugcugauauccgggcugggaaaugggggucgcgggacggggagugaucuucggguggcuuugagaaacugaagacuccagcguugaagauuggaguuuauaggaagucugaggguagggucuggccccuaaugggcuggaaggaaggcuggucacagcuugaagauaggaggcuuagugacuuccuccuccccacaggacggcgcacaaggaguugguauccauggaggagcaggacgccagggucccagcacuggaaccuuucaggguggaacagguugaaaaggcugggguguagaggaaugugggaacgaugggugugagguggguggagugacagacucauuccugggucucuugguuggacugccccagcucuccucagaguauagccggcugccccacuuccaauaugcaguuucauaggccaucccaagucucucuccaaagggaaagguugcccagucacgauaggaucccuguguugggcaaagcuguucuuaaccuugcuagcgcugggacccuuuaauauaguuccucauguuguggugauucuccccuccacuauaaaauuaucuuuguugcuacuucauaacuauuuuaugaaucauaauguaaaggucuguacuucgugauggucagcagggggucgcgacccacagguugagaaccacugucccaacgguaguucuuaauuuuauaggcgccaccucuaaucuacuaugucccugacuucaucuccaaggaagaagaggaauauuugcuucgacagguaccucuuucucucucucgcucauuuuuagcguguguguuuguguauguguguuuguuucuguggucacaugacauaaacauaaacguuuauugggggaggggucauccguccuucuuggcugcugcuuuccucauggcugccagcacguugcucaccucuuccuacuuccccuucgcauggguguucgugcccacccucuucuugaugaaccugagugcccacuuguccuuggagaccuugagcagccccauggcacgcugcucagugggcacggagcuacacaccucccgggucaugucucacgugaccuugguguacucggugaggggccauggcacuggcugugccucggcuugcugauguuauucugucaccuugcagcccuuguugagacccagggccauggcugcugcucuccuauggggcuggaacaggacccccuccccugccuuucuugucuucucauaauuccuucccgacacucagccccuguaugagaacccuggaacugggaaaccccuggcaaggagaguaccuuugcacacucccauacuccucauuccucuuucugacauuucuagcucugucugaaagagcuuucuuagccaaguguagaggcgcacacacuugcaauccuggcuacggaggcugaggcaggaggaucccaauuugaggccuuuugguuuuuuagauuuuuuuuuuuaauuucaugaguguguguuuguuuuguuggcagguaugucugugcacuaccucuguacagugucuaagaaggcuagaagaggguguugccucucuccugaaacuggaguuacagaugggcgugagcggccacgugggugcuaggaagugaaccuggguccuugggcaagagccgcaagugcuuuaaaccacugagccagcucucuagcucuguaucaugaggucugguuugaaacaaagcaaacaaaauaaacaagaaagagguuccuuagaggcuuaggaaaacuaaaaugugugugugugugcuugugcauacacguguguguggguuggugcaugugcauaugugugcauguauguguguguguguucuugcuguggcguacagcuaggcacacacuguaccaucaugacacaccuccaccagccuaagggcacacuuauaaaguucaaauucccugcacugagauaguccagucuaaccucuaaaacaaggugucauugacaggaauagcccagugcaaccccagagccuugggaacaaaggaucagagcucauuuucccuguguugagacaucucagguugggugugguggcucaugucugcagugccagcucugggagggaggaugcaggagacucaggcauccacagccauucucaguuuuguggagauuuugagagcagucuuggauacaugauacucuuuccccacuccccccaaaucugggccuauacuacaccaagaguaaauucccauuugcagcugugggugcaaucuggauagaacaucuguuaccccauugauuaccaaaguugaaucaacugaucugucuggcuuggcaaguguccccgugcuuccccacaccaucaugagucuccuucucaaagcuaaacucuugauaaaacaaccugccuggauagaggaggaccaucuuucggucaagaugauaugaauagcugcucuccccaacuugaacccccagacaagcucuagguagcccauuuucacuccacauaaaggcccucguguuggcaugggcaggaaaguccugaaaaccccauuccuugccuccuagguuuucaaugccccaaagccaaaguggacccagcugucugggaggaagcuucagaacugggguaaguguuccuagcuagagaauaugauugggcaaagacgagaagaacucagguucaaugguuucaaaacauaugaggcuaucaccaaggcucaggggucccagagcaaggaggauucagagguuggugauggucuugagggauuuaggcaucuauuaguugguugggaguaucucuaagagccaagugcuuugaaggaaacuccagaaagauccagaggcaaucuccaaaacucaguggguagagaugcuuccaaccaacuggaauaucuuuaauggggguaccagauuccaagacucugaaugaaucccuucaaaccuccauugcacucugcaggugggcucccgcauccucgggggauggucccugagcgacucccuccauggcuucaacgcuacguggacaaagugucugaccucagccuuuuugggggucucccagcuaaccauguccuugugaaccaguaucugccuggggagggcaucaugguaaccgcacauccucaucccaaguuccccugcuaaguaccucccccagaucuccaggucauuaagaggaggcuagccaucauguuugccugcccucacuccacacacuccaccuaggcgcgguccucccugucccagcuugggaacuccacuuugacuuaguggaguggcguaggcucccuggugcccccuuccuccccagccucaugaagauggaccacuguacuacccaacugucagcaccaucagccugggcucccauacuguccucgauuucuaugaaccucgacagccagacgaugaugucccuauggagcagguggguccugagcugaugccccgggcauuugggggcauucuagcgucugacaucccauaugcuccaggacagucugauccuaccuguauuuagaguauucgugacacccagacaugcuccccugucccuuguugggcaucccugcuuucucccagauagccaacccauacccauccaaucuguuuguacggugccccagcugccaugauacccagggauaccgauacauacgucgccaugguauuggauggcuaaggcuauggaugaccugugacccucccucagaccacuugagcucaacacgguguuccaacaaaguuuuuuuuagaaacuacuguuuacuuauuuuugugaacagauguauguagcccaggcuggccucacguuugccaucuuucugucccauccucccagugccagcguuguaagcgugugcccccgugccuggcuccaaugcauauucuugacauccucaagauaucccacugugucauucacucaugugugccccuguguccuccuagacuguacagggcaccuuaauaccagcguccugaaacucuagucauaugcucuaucaccucuagauuccccuuaaccucacacggcucuuuuggggacacccuuaucucugacugcuagcucuuaagucaugcauucuugauaccccaguguucauagagucuuccuccaacucuccgaacacccuggccagauguuagcuccacucccuaaaguuccgucuuuuccaucucuucuacccaggcaggcuugcuguaauaccauuccugaguaaagccucccuaacagccagagucccgggauaggccauucccuuuaaccucuguauuagagccugaccccagcagugcacccccagauuagcucugcguaaguaucccuaggacugcccaugucugucccagccccucagaugccagcugaagcucccacaauguaguagcccuuuaugucuuaaaaugcagcauaggcccugucuccucccaaagaacuggacacacacacacacacacacacacacacacacacacacacacggcgggccaauagucuuguccccagaaccuauagauuaccacuccugagggccugcugacccuuguccccugaccagcuacggaugcccgcugacuuuucacacacucccaaacucuggauauccauuuaccauuaucaacugauucccgcagcccaggccuccucaacggcccaucaccucgcugcugguggaaccacggagccugcuggugcuccggggcacagcuuacacacgccugcuccacggcaucucagcuacccguguggaugagcuggacgccaccucgcugccacccaaugccaccgcuugcaagucagcgcugcccggagcccaccuggugcgcggcacccgugucucacugaccauucgccgcgugccccgugugcugcgcgccagccuccugcugagcaagugaccaccagguucuaagaccuuggaacccuagggcagagguagcuguccaggguuauuuauuuccccaguaacuauggaaaccauggagaagacaccauuccaaauaaacagaaaauaccuuuac

SEQ ID NO: 3689 - RNA, 2412 nt, Mus musculus
uguuaagacaacaaggaagugagcacaccucacuuuuauuuccuuuaugcaagaauccugaggacuaacaggaguagggacuagggauucuccaagagucucaggcucaucagcugagaugagcuaguguaaucucccucaugaacccgguucuucacaacgagucagacugccaaguuucucacgguucaucaggguauucuauuaaacgagcgcggcaaaaagucugucuucuccacguuaaaaacagcaaggggcggggagugaggagguggguguguucuuaagaagucaagagagcugucugucaagaggugccacggccccgaugggaggagaaagugcgccugugcucucucuuugacuuuggguugguguaucacagcaugucuuaugcaguccgccagugccacagaaugcccggaaccuccuuggugagggagugucugaucucucacuaugcaucgggaaaauucgguuaucucucaagacaucucagcuuccauuuagaugaguucacgauccuccccaaacugucagaaggaaccuuccucuaggucugucugucaccguccaucggaucgcgucucccgcgccccuguaucuucacaagaauucuuuggggcaccaccaucauccagccugguccccggggcugucgcgucgccgggcucuucagccggaccccgcgggcgcacgaagguacccauggccguggcguggcccgaacgcagcagcuguagcuggcgccgaccccggcgauacagauacucgauacgcagcacgucgguucgcggaaggcuggcgugcugccggaacucggcccgcacccgcgccucggcgcccggcgucccgcgcccggcgcgcagcagcucgcgguacaggcucagaacuugccucugcaaccggcugggccggcucaugaccgcggcgucgcggugaggccccacacuggccggaaggaccgccccgacacacagugcugagaagcuaacgggcagggcuacuggcacgucugccagaagucccgccuccugcucaccggcgcugccgcaucugauuggccaguacugcaguacaucuuggcuggcucuggaagugggcggagucucuggugcuccgggccacucuaaagaguaguuuuugagugccuuacaguccuggauauuucugaacuugaguggaagcauggggaagggccuaagcgguuagacucuggaaagaguguaggaggagauaguucugagcccucggaagauugagagcgaagggaucgaacccggggcucaccagaaggcagagggauauugggaagggaugagcaguuuuuaaaaagaucuuuacuauuuugggggcuggaacgugcauaaacugacgacaugaccgcuccgugguacggccaagcgaaaacuuuuuguuuguuuguagauaugagagagaggacagccagaggcaucuagaagaguccaaaauagagaggaaguagacugcauagccagggcugucugcgagaggggagagaauauuguugaaguuaaggauuagccacacaaaccacugggagacaccaaugucaguaggguaucggaacgguuuacugaacacacauaucaacacugauuaaucagggaugcacacccuagccaguuuucagggccaguuuuuauaugggaaaacccacgaacaggugcauuuggcuaucuagacaaagccguacuguaugaccuuuaagcugauuggcugggucuagaggcaggaagucuagggaauuuccauaggucucgaggcuccauacagcaacaugauguuauagucaaagaacauuaggucagacuaaggucaugagcuacaaaaugaagguugaggcaguauagcagaacuauugucagguuuaaaacguaauagcaggagauagugaacagagaaaacagaaggaggagagaguguagagagaacagugugaauaucaggauagugggaaugaguaaguaucugggggagggaagcuagugagcuggagggaauuuaggggauuggaguuuuagucaauguucaguaaacaacuuaaaugaaucugucucaucuuucuuaucuaugucuuaauaauaaucuguuuuaccugguggugcagacauuuaaucccaacaccugggaggcagaggcagacaucucugaguucaaggcuagccuggucuacagagugaguucaaggacagccaggaaaacccugucuugaaacacaaaacaaaacaaccccucccccaaacucccaaaccccgucuuauuauuuuuccaucuaaguuguuugcugaacucuuacuuuaugccaggaacaacucuacauacuuuaauguuuaauuguuuguuuucuaugauuuaugcuguacagggccagagauguaucuuccauuc

SEQ ID NO: 3690 - RNA, 5680 nt, Mus musculus
augaggaauagaauguaguuuuguaauuuuucccgacccugauccucaacaggucuucucgcuucuccaggcccuggcggucccugccacccuugagcagcaguaguugguacccuugugucuugcuugcugacaagaauguccaaucaucagugccaccggaugaauggcauaucaugggaacuugauuggucacccgcauucugcucuacaccugccguuccuggaaggaaggguucaagauguaagaauacugacaggcagguuaugugcagcaggaggcccauuaccccagaaagcugacugcgagucgcccggccguagccgcggcaucaccgcgagcgcccagcagguggcgccgcggcguuggguccaggcaggcucgcccacguggauuccucagcagcccucgggcacugggcgccggcucauugguacugacaguagcaccaccaucggggcccuucgggcgguggcaacacacacacacagccggaagucggguuucucagcgcccccguuuuccaagaaagcugugauuaagcggcggcccuagaaacccacaaacgcagcuguugagucugagugaacccggagcgcagaggagggaaccagaauaguuggguaaauugggaggccauuccgccagguuugaauccccacugucuuuuucaagccaugggaacuugaaccauacaccuaacuucugugggcucugguucccucaucucaaaaagcugcuacacacacacacacacacacacacacacacacuucacagagcugggagagauggcuuacuuuuucuggucugccugccuuauuaugcuuccagaaccaguuugucguaucuacuggcacagucugucaauagaucuuguccuaaccagccagaaucgcguccaaagaaauuccacuuucacugagccaugucaggcagccuuuccacccuuggcucugaggucaccagccaucgucuuuguacauccacaugucugugggaaauccagagcaucaagguguucgagcagguaugaaggcagcgaugaccgaguauuagagggccucuugacccucuucccugugggcacacucccagaaauggauaggauagguaggcuggggcucuugccuaucgggacccagggggagcuguguauacuacaagucacuuguguaccaucuuuaagcuugguccuggcccucaucacgcucccugaagcagcaagggauguguggcuccagucugaccuguuaccaucagguuggaauugugggguuagagacuagaggcagauggcggaagagggggggaagagggauugguugaggaggugagacauguuggagaugaacaggcacaugacgagggaauguugaggaauuacaaggaggagggagaggaggaagaggaggaugugagggaagggcagagagggacgaguggggagagagucaggaaggaagggaaggagacuugguggggaaggagagaaggagagagcuuauuugagagacauuaggacuagaaaagggucuuugaguauagagaacugguuugaucguguuuggagggagcagaggcucuauauuccuguaaacagaagaauggggcaaagcggucaagugaggaagccgacaccggaagaacauucuagaacagaggaacagccuccauagccugcugaggaggaagaagcuuuuggcuagaaguucugaggcccuaggaagggucgcagugggaagccuggguuccgaggaagggaguagagaucgcugcugcgucugaaagaggaccuggagacuuuagggaacgcccaaguuuagggaaggagaccuggaggccuaccguuuggccugcaggagcgacuggagacagagcaggagagaauacugggaaggcuggaugaggagaucuggaggguggggcgcugaggccuccaagggauagcuuuggccuccccucuccuguccccucgaggacugcuccuacaagggaguagcuggaagggggagcuaggagggcugggaaagacaggguggggggcagauucucaacaccuucucccccauauucuaacucucuucuccuuagaagcuuuguuguugguaagacauaaagagagagggagcuuucuuuccacagcuuccugugucgcuuucccgggaggcuugucaucccaagcaggguaaaugagggggugugggaagaaaggcaugaugggagggccuucgcuuccugggaaugguuaguauucugucuacacugaaggaguguuauguuggagaugguacucgaggaaggcgggggucauagauaccccaaagugaaggguuuuguuugcuuuuuuaaagacaaggucuugugauguaucccaggcuggcuucaaacucaaaaagucaugcaaccuuccugucucagccucccagacagcucugacucugaaccgggacccuggugagccauggaagcuuauaugcagccgacagguuugacacuaagaaggguuugggucagagaggaaugcuguggccaggaucccagagggagguccguggaggaauccggguaguuaaagcaguguuagaccagacucgaacuaggaaaaggaggauggggagguacaguggauccucagggcuugugggaauacaaacugggcaaaggugcuggccaggaaagacgcugaggcagguugcauauuuaucuaggaaaagggggccaaggaagcggugggaagccagaugugaaauuaggaugccagacacaggcucagguugauagcugagaagaacagaagaugaaggaggggggggguucauccccagcccuggggcaggaagagcauuuagaaggaaguagaagugcugauguacccauggggcugaggagagugcacugugccccagggguuccagggaguaugggccagaacacauccugaguaaaaucuuuuaaauuccauguucucaaauucuugucagcguugcuuccagcacaacucaugaguguucuuggguucuaagauuuucuagcacuuagcaugggcauuguguaagcggccacuccguguuccuuccccgugaacacuuaacaguugagaaugaaggacaggguugauccugggaccugcccaguuccuucuucagaauuguggacacuccguucccuuuaaagcaagcagagccacccccucccauacacauuguucuugaccacgugccucaauuuccccuuccacaggggucagguggcuuucugagugcugucucucuuugcccagcccccuccuuggcacaacagugcucuggggcagcaucggggcaccccaggucaccuguugcccugccuguucucccacuggaagcuccaaccacagcucccucaagcucguccuucaagcacgcccuaucuuucugucucugucaagcacgcccuauuuuucuaucucugucucucuugacauuuucucuguauaacagcucugacuguccuggaacuuuuagagcaggcuggccuugaacuuggagauccaccuaccucugccucccaagugcuggggccaaagguccccaucaccaccaccugugggucuuugggggaaaaccuagcucucuuccauccuucaccaucuucuucagguaggauuggcugcauaaucugaagggcggggugccaaaaagggacguggugcugagcuuguucaaaguguauuagggauuucaagguguuuaaggugagagcuggguguggcuaguuugugcuuguaaucccagcaccuggggcaaguggggcaggaagacugaguucaaggucauccuggacuaugcagacaagacccugucuuuuuaaaaaggacaguagcagcgggacauuaagccauuguaagcacaggacacauuaaaaagucccaucuucagcacaucuuggugcucccaucagucucaguuaggaguccccguaggcucccaagucccccaggaccgguggcaugcgguagugccuauaauccuggcacuugaaagguagaggcaaagagauuuggagcucaaggucacucuggcuuccaugagacccuguucaaagcaccagagaacaaaaaacggcugccauccuuccugccuauucuuucucagucuauccuggccaccauuuguaucugcuuguucucuaagaacugggaccccaagagggcagagaccugggcuguuugucaucccauguccccaacacucuaaccucacuaaggccaggacagugccaagcaccgacaccccuccaggcaugcgggguccagacuuugcugaugauccucagcauggaucacugggucgcacuauccaggggagacccgcugucuuugaggaguccccacacuccaccucaucagguucucccaccuaggagcccaugggaagggccgcagaagcuuggccucaaggaaggccugccagaggaucaugggaaucuccugauguuaugggcucacaccagcuccagucaccccaagagcuguggcuaggcaguaugguucgaggacaguacagaacccagacagcagucaccaggagacagugccucagcagccuagguuugguggccagauugcuuugacuagagaggcgaugggcaguagacaucauauccugaccucagggagcggguggcuucggcugggcaaggcuauuuaacuugaaauccuagaugccggcgguguuuguuugugcacaggggugcggggcagucugggugucuugugaaguuccaggggacuuugcuaucaccacuaucauucuccauucacaugccuccacaccugucguaggcugguacugggugugcaucuccauucuagccccguguacugggccuggauccaccucaacagccucagccucuuuuggccucuaucugcuggcugccuuguacuuggcuugccaaaggucacuucuuccuacagacaaaucagcucuaugggauggauccugggauuggagacccgggccucccccucuuccccuacuuucuacaaccuuccuucccucucuucuggaccagcugcuaguaguucacacuguccucuucgggguaggaaaggaggagccugcugcugucauugaugucagcucaggucuagccuggucuaagacagccuucugccagaacuguugcagugucuuccuccucaguuuccccgugcuuccccuuggcccuccacacacacaaaaucugccaugggagcuuccuugagauccgggaagauccucauagcccgggauccuccaguggccaggagugacggugcacgccugugauccuugggcucaggaggcccaggcagaagggucaugagugaggucaggaaaccugagcuagacaaugaauccaaacuggggcuaauguugugagaaccccaacucaaagaaaacaagacagaaggaaccuucagugguuucucaugucaguuagaauggaauccucccuccucuggugaauuuacagggcuuuuacaucgcccgcuuccugccugauauuaugacaauucccuucccucacuccaucucaccucuggcuucccucccucucccuuuuucucacaaugcauaccuuaucauaugccguuccauguccacugaacacuguucccacugcuugcuaauuaccuccagccucggcuug

SEQ ID NO: 3691 - RNA, 4412 nt, Mus musculus
cuuccuccuucacuugguuggacgucacaccaggucccaccagccccuggacugugguguccagugcauaucuggccaccaugggggcucuggagcccuccuggugccuucuguuccuuccuguccuccugacugugggaggugagucggggggcuucuguggaugccuccuguguccucagcucauguuggggccaggacuaggcagagagcaggaagggacagcacagacaaaggggaaggcugggcagaagaagguuccucuagagccuguggguuucacccugagcuagaggcccugagauuuggaaccugguaguaucaguaggggggacauugaagcucacagauauaccuaccacauguuggucaguaccggccgcugggugcugugagaccagcucuuuccaaccuucuucaccuucuacauccacugucugugccucaauuuacaucuuucuuuugaauauagaaucacauauagcccaggcuagcuucaaauuugcuacguaauugaggauaaccucaaccuuucuauucucugucuccaccucucucaguuuaccuguucuuuucuccuuaggauuaagucccguacaggcccagagugguaagccauaauacccccgaucuuucucucuuccucucaaagaccuccucaggccaccccuucuccuucuagcccucuuugugcuaacaccaagcccugauuguuaaccugugucccccucuucauccuccugagacacuuucccaagaugcgacuguucuuccgugagcccugguguacuggcugggauuguucugggugacuugguguugacucugcugauugcccuggcuguguacucucugggccgccuggucucccgaggucaagggacagcggaaggugaguggggcuggagggggcuggucuggaacacuuugggaccuggugggcaguggauacaguggaagcgucaaggucacaaauaucaaaaggaugggagggcuggcuuguuguuauuguuuguuuuuguuucuucccuuaaugcuaaggauccaaauggggccucccauuugaacugcaaaugcuuuuaccaacugaguuacaccuucaggccagaagggcugggggugggggacucuggcuuuuuucucccucuuauuuauuuuuuuauaauuuuuuuccucucucucugugugugugugugugugugugugugugugugugugugugugugugugugugugcauuugaguguaguguccacaaagaccagaagauggcaccagaugcccuggaacuggaguuacaagugauccagccacugguauggaugcugggaauugaacuugggucccaugcaagagcagugccuacucuuaaccacugaaccaucuuuccaguugcuuggaggggcugauuuuaaaaccaaaaauagucccagucuggggcuggagagauaguuuggcgguuaagagcacugacugcucuucugaagguccugaguucaaaucccagcaaccacaugguggcucacaaccauccguaaugagaucuggugcccucuucuaggugucugaagacagcuacaguguacucacauauaauaaauaaauauauauauuuuaaaaguauagaauagaguuuauucugggcauggggaggggaguuaagaggguagcagaggcagagaaaggcagagagaaggagagaguagagaaaugugggugggccaaggccacauggagagagggaggaagggaacugggaguaaguaggcaagaggcaagagaguaagaagguaaauaaaucuuuaaaaaaaauugucccaguccccagcuuaguccuucuucacaccauaugucacucucuaucccucucuagggacccggaaacaacacauugcugagacugagucgccuuaucagguaagaacgccaaauucuucuccacccuugcuccugccccguccuggcuaucccccuccccaguacagacacacagacaaacacacacacacaaauacacagagacauauauaaacacacucacauaaauaaacacacacacauaccuacacacacacacacacauaccuacacacacacacacacacacacacacacacacacacacuacccuucccagaaccuuaaggucccuuccucaggagcucccccaauccugaaggcaaaggacuaacugucaaacauauucgguggucaaccaugaccuuuaagcucagcuucuaaugagucucuugucaagauucuauuccucugucucucucucucucucucucucucucucucucucucucucucucucucucugcguguguguguguguguguguguguguguguguguguguguguguguguguaggcagguuauaagaggacaucaaauccuaucuuuaccuuauuuuuaaaauggcacugauuuugcucuguauuuacauguguguguggagcaggugugcauaugcacuggcagccaugugggggucagaagacaacccgugggggcugguucucuccuuccaccuuguggaucucugaacucuaaauucuaguugucaagcuuggcagcaagugcuuuacccacugaaccaucucaccagccccaagccuccuuccuaaccuuugggcucugggugaggcuaugucucuagggaaacacacacccaggcuggucucugguacaugcucucagagacucugccccugggaggcacagaccccugcucugugacccaauuucuggaagucuaccucccucccuguagccaguuuugcccauucgacugacuccuugcuggaggaacuuuuucucugaaaaguguuagaaucucuugauucuuguuuugaguuugguguggggaaguaguggcgugugucuuuaaucccagcgcucugguggcagagguaggcagaucucugugaauuugaggcuggccuggucuacagugugaguuccuggacaggcagggcuacccaaagaaacccugucuacaagcaaacaaacaaacaaaaacaaaacaaaacaaaaaagaaucucaauauuggccaucugauguccagaagaccccgggcugucuaguuucugagagccaggaaacuuuagggcaaaugucagccugauuuuuuuauccuucgguaucuugguugaggccuacauggaucaacacagcacuccaauuggagaagcuuauuugaagcaacuuaacaaaaucauuuggggugacauuaugaagagauugaagugaaccaauauaauggugggacaggaaagaaacugaagauggggaaacuaaaacauugccaagacucaaagggugagcagguugaagaucugugggcuuggugcuccaggcaucgggguggggggcugcacauguaaggacccugggguuggugccuaaugugcaggcagaaaggccaggagaaugcugagugcauuugaauaaaaucuugaccuuuucaugauuuuaaguuugaaaaaccugccagagaccuugaaggucauuaggaggcuagauuuguuuuuauuugcugggcccccuccaaugauggccuuuuuuuuuuuuuuaaggagcuucagggucagagaccagaaguauacagugaccucaacacacagaggcaauauuacagaugagcccacucuaugcccaucagcggccugaugcccggauccggucauuccagaugccuacucaacaagcccucucugggaucaggacucccguuggaauacagauccacaggguaccucccugagauaucugacauuguaccauuucuguccccaaauaaaagacagagcaaaaacaacgacugaguuauucuagacugggcugacgaauuggguaacaguggggccccaagagcggucuuaaaucaggaaaccacuaugcuaucuuggaggaagucaaauuuuggaaagaauaaaacuagaaguauuugaaucgcuuuauuccuguccugaagaagugcguucccacgcaccccaaacccacaggauccaggaugagcgggucagaaggugccguggucagccucugccaggcauguugauguagacucuaccaucuucugguggguggaguagagagagcaugaagccugaccacccacaacucuucccacaucgccaccuucuugggagacccccugccucagcaggggcuuccucagggguuccccagacaccuccaccaggguuucccaaacaccuccuccagggcuuccccgggaccgccuucgugggacccccuucuucccuagggacugcuaggggaccuacacuucaggccccgcccuaguguuggcucaccuugggcaggccugccgugugggcgcauacauacaaacaccaccccuacaauuaggagugacaugaccgcaucugcagccacu

SEQ ID NO: 3692 - RNA, 4412 nt, Mus musculus
aguggcugcagaugcggucaugucacuccuaauuguaggggugguguuuguauguaugcgcccacacggcaggccugcccaaggugagccaacacuagggcggggccugaaguguagguccccuagcagucccuagggaagaagggggucccacgaaggcggucccggggaagcccuggaggagguguuugggaaacccugguggaggugucuggggaaccccugaggaagccccugcugaggcagggggucucccaagaagguggcgaugugggaagaguuguggguggucaggcuucaugcucucucuacuccacccaccagaagaugguagagucuacaucaacaugccuggcagaggcugaccacggcaccuucugacccgcucauccuggauccuguggguuuggggugcgugggaacgcacuucuucaggacaggaauaaagcgauucaaauacuucuaguuuuauucuuuccaaaauuugacuuccuccaagauagcauagugguuuccugauuuaagaccgcucuuggggccccacuguuacccaauucgucagcccagucuagaauaacucagucguuguuuuugcucugucuuuuauuuggggacagaaaugguacaaugucagauaucucagggagguacccuguggaucuguauuccaacgggaguccugaucccagagagggcuuguugaguaggcaucuggaaugaccggauccgggcaucaggccgcugaugggcauagagugggcucaucuguaauauugccucuguguguugaggucacuguauacuucuggucucugacccugaagcuccuuaaaaaaaaaaaaaaggccaucauuggagggggcccagcaaauaaaaacaaaucuagccuccuaaugaccuucaaggucucuggcagguuuuucaaacuuaaaaucaugaaaaggucaagauuuuauucaaaugcacucagcauucuccuggccuuucugccugcacauuaggcaccaaccccaggguccuuacaugugcagccccccaccccgaugccuggagcaccaagcccacagaucuucaaccugcucacccuuugagucuuggcaauguuuuaguuuccccaucuucaguuucuuuccugucccaccauuauauugguucacuucaaucucuucauaaugucaccccaaaugauuuuguuaaguugcuucaaauaagcuucuccaauuggagugcuguguugauccauguaggccucaaccaagauaccgaaggauaaaaaaaucaggcugacauuugcccuaaaguuuccuggcucucagaaacuagacagcccggggucuucuggacaucagauggccaauauugagauucuuuuuuguuuuguuuuguuuuuguuuguuuguuugcuuguagacaggguuucuuuggguagcccugccuguccaggaacucacacuguagaccaggccagccucaaauucacagagaucugccuaccucugccaccagagcgcugggauuaaagacacacgccacuacuuccccacaccaaacucaaaacaagaaucaagagauucuaacacuuuucagagaaaaaguuccuccagcaaggagucagucgaaugggcaaaacuggcuacagggagggagguagacuuccagaaauugggucacagagcaggggucugugccucccaggggcagagucucugagagcauguaccagagaccagccuggguguguguuucccuagagacauagccucacccagagcccaaagguuaggaaggaggcuuggggcuggugagaugguucaguggguaaagcacuugcugccaagcuugacaacuagaauuuagaguucagagauccacaagguggaaggagagaaccagcccccacggguugucuucugacccccacauggcugccagugcauaugcacaccugcuccacacacacauguaaauacagagcaaaaucagugccauuuuaaaaauaagguaaagauaggauuugauguccucuuauaaccugccuacacacacacacacacacacacacacacacacacacacacacacacacacgcagagagagagagagagagagagagagagagagagagagagagagagagagacagaggaauagaaucuugacaagagacucauuagaagcugagcuuaaaggucaugguugaccaccgaauauguuugacaguuaguccuuugccuucaggauugggggagcuccugaggaagggaccuuaagguucugggaaggguaguguguguguguguguguguguguguguguguguguguagguauguguguguguguguguagguauguguguguguuuauuuaugugaguguguuuauauaugucucuguguauuuguguguguguguuugucugugugucuguacuggggagggggauagccaggacggggcaggagcaaggguggagaagaauuuggcguucuuaccugauaaggcgacucagucucagcaauguguuguuuccgggucccuagagagggauagagagugacauauggugugaagaaggacuaagcuggggacugggacaauuuuuuuuaaagauuuauuuaccuucuuacucucuugccucuugccuacuuacucccaguucccuuccucccucucuccauguggccuuggcccacccacauuucucuacucucuccuucucucugccuuucucugccucugcuacccucuuaacuccccuccccaugcccagaauaaacucuauucuauacuuuuaaaauauauauauuuauuuauuauaugugaguacacuguagcugucuucagacaccuagaagagggcaccagaucucauuacggaugguugugagccaccaugugguugcugggauuugaacucaggaccuucagaagagcagucagugcucuuaaccgccaaacuaucucuccagccccagacugggacuauuuuugguuuuaaaaucagccccuccaagcaacuggaaagaugguucagugguuaagaguaggcacugcucuugcaugggacccaaguucaauucccagcauccauaccaguggcuggaucacuuguaacuccaguuccagggcaucuggugccaucuucuggucuuuguggacacuacacucaaaugcacacacacacacacacacacacacacacacacacacacacacacacacacacagagagagaggaaaaaaauuauaaaaaaauaaauaagagggagaaaaaagccagagucccccacccccagcccuucuggccugaagguguaacucaguugguaaaagcauuugcaguucaaaugggaggccccauuuggauccuuagcauuaagggaagaaacaaaaacaaacaauaacaacaagccagcccucccauccuuuugauauuugugaccuugacgcuuccacuguauccacugcccaccaggucccaaaguguuccagaccagcccccuccagccccacucaccuuccgcugucccuugaccucgggagaccaggcggcccagagaguacacagccagggcaaucagcagagucaacaccaagucacccagaacaaucccagccaguacaccagggcucacggaagaacagucgcaucuugggaaagugucucaggaggaugaagagggggacacagguuaacaaucagggcuugguguuagcacaaagagggcuagaaggagaagggguggccugaggaggucuuugagaggaagagagaaagaucggggguauuauggcuuaccacucugggccuguacgggacuuaauccuaaggagaaaagaacagguaaacugagagagguggagacagagaauagaaagguugagguuauccucaauuacguagcaaauuugaagcuagccugggcuauaugugauucuauauucaaaagaaagauguaaauugaggcacagacaguggauguagaaggugaagaagguuggaaagagcuggucucacagcacccagcggccgguacugaccaacaugugguagguauaucugugagcuucaauguccccccuacugauacuaccagguuccaaaucucagggccucuagcucagggugaaacccacaggcucuagaggaaccuucuucugcccagccuuccccuuugucugugcugucccuuccugcucucugccuaguccuggccccaacaugagcugaggacacaggaggcauccacagaagccccccgacucaccucccacagucaggaggacaggaaggaacagaaggcaccaggagggcuccagagcccccaugguggccagauaugcacuggacaccacaguccaggggcuggugggaccuggugugacguccaaccaagugaaggaggaag

SEQ ID NO: 3693 - RNA, 7019 nt, Mus musculus
uagaucggggacccggcggcggcuccgcggggcagguagcgaggcuggcgcaacgccgaggccgcggcccugggggcccacagucugcauccaagaauccucgagguaagagcuggggguaaagcgaggaacgcgccuuucuggaugcuuugaagguuggcuggagcguaaagcugggcccugagaauugauucuggacguugaagaggagaggcugggauccuggacuucugaguccuugggaguguuggacauccuugggaguuggggugcaaggacugagaggccugauaccggggguucucuaagaggacgaagugacccggacuccuucacccaaggaggggcugcauugcauccuugaaauugcgguuauggacgcagguuugggccucgaaggucgggcgcuggaccucaggaguccacucugguagagagcagccccgcccugggacuucccagagcaccacuggugcagggugcccgggccgaacaggaauuccccgugcgcggggauuccacgggcgccgcgcuucgcugcgugccccgccuccgagccagacaccugcggcgcgcgcgugcggagcggaacugggagguggaagauucccuugcguuagcgccgugacgucagcgcgcggcgucucgucucgaggguuuccgagucaguccucggcugacuuuaacccuucucgcgcuggagucugagcugggaagucugggcuggggauuugcucuucuugggucgagggaaccggauuuucaggucucagaggagacugagggucuguacucuuggguucugggugaauggauugugccaaugggauacaggggcaucuccgggaugguuggucccugcuauucccaaguuugccgaggugggggcgggagcuuugcgacuccagaucccuggaucauugaggaacuacaccgcuacugauuugguggauccuggcagagaggcuagagcaagaguggugaucccaagacuuggagaggagcaacucacccuuuccugugcugaggacucugggcuuacguucuaccauccacccagccuugcgcccagccccacaugucagauucuagaacagagaaacauuuuguuguuguuuugagacagaggucucagguaguccagguuggccucucacuucguuuauagaugagucuggccuuaacaccugacccucugccaccaccucgcugggauugcaggggugugccucuacuccuaguuaaaacagagauauugggaaccuggaaaugccuuuucgggaaguugagauuagcaaaccccaguccuccacuccuaguguuaggaccuggucgccuagguugggauuuuuaacggaugugguggugcuuccgaggagcccggugucuccggagaagauagaugcuucagagaagugcuagccuccccacuuccucaguuuccacuacggugguggaaaguuggugcggaggaaaagcguggaggaaaaggaaggaaauggcggaggcggggcccugcacucaacaucuucuguuggcuuuguaguucuccagcucgcucgaaggaaaggagggcgcccacaugcacucccagccacccaccgcugccaccgaggcugcauucgggugacuuaaacauuccugaugacuuccuucugucuucccacacacagugagucggccugagcguagucacugcccaacacagacgguaaagaagcuucuggaagaacagaggcgccgacagcagcagccagaggcugcuggggugccggugagucucuggaagucgccaugugcgcugggggagaugggaguuguaguccugacucugaggcucugcaggugggggacagaccuggaagaaucuuccagauucauaaauucauuuccuuuacauugcagggacacuucuccccuccucugguccagccacugacuccaucugugaaugaggcagagccagguaagaauaaaguuagcuccuagcccagcuucucuuagacucaggcaucccagcucuuagaccuuuggggaccgaggagucaggcagcucucauuauucuugagccauaugggaaauuuugaugaccagccugccaucguugcacaugucuauauucccaguacuccggaguugagggggggcggauugccauuggguuugaggucaugugguuuuuuuuuuuuacuagcaaguuccaggccaccuagagcuaucuaagacaccuugucuuauaaccaaaaccccuggaauuugacguugguuuucaguagcccaguaguccaugaauaguguccuucaagcauccaggguuuaagacuccaggacuucagaucccaguugcuugagauccaguaggccuggcaucgcagcuugcugaugccccaggacuggaggacccagcuccucagugucucaggaccucuggagacuccagguuuaccuucccuggccaugucuccaggcuguaauaacaggcugguucugaccacccucucuguuucaggccauacucauuucccugccuuccaagagacuguggauuccggaccuggcaaccuggcucccccuucaggcuuugcagacugggacccuagcauccaugcuaccuauacagagggcucuuucccauucucugcuucugaaggcuuccugacuccugauuucuacccuccgucagacccaggccggucaggcccauuuccccuggugauggagguaaacuauaggguggggacagaugcuuaagggccccuaaaaacuucucaguggugcugagccuaguggcgcaggcuugucaucccagcuacuccggaggcagagguagaaggaucaagaccuaccugggcuacagaaugaguucuagauugcccuagccacaauaauaggaccuuuuuuuuuuuuuuccuaaauaaagggaaaaaauaaguggaaaacagaaagacuauugggaguuuugcucugugguccagcucuuuccucacaugugugaggccaugggguucagucuccaugagguagggauggagaguagagaaucucaguauucugagaugucagggacugguuuaagaucccauccugggccaagugcacuggcuuaugccuguaauaucagcacugggaggcggagacaagagcaucauuauuugaagccaguuaguuaugaguugaaacuaaccuagguaguguagcaaagcagaaacuaaaacaagcugggcauaguagugcaugcccagcagucagacuucuggggcagaaaugcuucaaguucaggccuagccuggacuucacagugagauccucuuucaaaagacaaagagaaaaaaaaaauccuuucccccuuguggccaaaacugaaguccugggguuuaaaaucauuuggcacacaugaggucccggucucacccauuugaccaugggcuguguguucugugugaugagaauucucaguugacugacuugccccacccacuuuauccccccaggacucucuggauacccggcuguauccugagccuucccugucacagguaggguccuggagagucucuagucuccccucaggauccccacaguugccuucacccaccggaccgucccuggagacagcccgagcucacauauuggcucuggggccccaacaacugcuggcccaggaugaggaaggagacacgugaguauagggggaaagggugauguggaccccuggcuugccugcaggugagggcuguucucauugcugcuccaccccccgccccuccccaggcuccugcaccuguuugcugcccgggggcugcgcugggcagcauaugcugcggccgagguguuacagauguaccgacagcuggauauucgugaacauaaaggcaagguaagggccacgugucaggacuucugcggccggggaagagggcuccugaugucagaggggagggcucugggaguccaggcugacuuuuuugugacuuacagacgccgcuccugguggcagcugcugccaaccagccacugauuguggaagaccugcugagccugggagcagagccuaacgccacugaccaccagggccguuccgucuugcacguggcugccaccuauggacucccgggaguccuuucgguauguccagcuggcagacccagggugucugggaugggccgguuauccagauccugguuuccaggaccaugcuuaggcagauccuuccacacccccucuuccuucuccucccaggcuguguuuaaguccggcauucaaguggaucuggaagccagagacuucgaaggugagcuggucauggccagggcugauguggcaugcaggcuagguggacaggguggacgcucaggugcaagucccucgcuaugugcauuccacaggccuuaccccccugcacacagccguccuggcccucaacgcugcuaugcucccagcuaguguguguccaaggaugcagaauucccaagcccgagacagacugacuugugugcagauguuacugcaaaugggugccagucauacaagccagguaagcuugggggacaagcuggggggggggaagaccagcaaacccacagggaagugugugcagagggccaccuggauguccaggggcacuaaaugcugaccuuacauccucuuuuggcacacagauguauguguccauaaagaacucauacaugaauuuuuaaaguuucuuuuuaauuuuaaaauuaaaacaaauuuaaauuaaaaauuuguuguaaaaauuaaaagaaaaaauauuucccucuaaaacagcaguucucgacccgugggucaugaccccuuuggggaaucacauguuagauauccugcauaucagauauuuacauuauaguuuauaacaguagcaaaauuauaauuaugaaguaguauugaaaucauuuuaugcuugggggucacuacaacgugaggaacuguauuaaagggucccagcauuaggaagguugagagccacugcucuaaaauacaguuguucuguauauagacuugucugcugauuaacacuacccagcucccguacuuaugauucagucccauccauaugagacagggugcauuuuaguguguacaguagggugccaggugaccaggguaaccuccagcccagacaguuccuucgagacacuugaucuggagaauugucacauugaaugugcaguucuaugacacacauguuacaaauggccucccuuagccauguucuucuuacauagcacacgacacauacauccguguaaggcaccccugguggcugccaggagcgguguggauggacgacuggccugaccucuguucuucuucuccuaggagaucaagagcaacaagaccauucugcacuuggcuguacaggcugccaaccccacgcugguucagcugcuccugggacugccaaggggggaccugcgggccuuuguuaauaugaagguaggacagguggcgaugugccggugguuugagauagaauaacaagauggcuguuagcacccuaugagcuguggaugucggagaaggaaauacccaggcugugaagggaguguguaccacauagugggguggauggaggugguugaagcggguguaugagauacagaugaggcacgaucuggguucaaagacccagagacgugggucugggaccccauugguccucccuuugugguuacaggcccauggcaacacugcccuccacauggcagccgcccugcccccugggccgccccaagaggccauugugcggcaccuguuggcagccggagcagacccgacacugcgcaaccuggagaacgaacagccuguucacuugcugcgacccgggccgggcccugagggggugagcacuggccugacuucugagcuaaccggggggucccccaaacugcacccaagccucauuuagaaaaugacaucuagucacagaaggugacucuucaaagagugaucuaugaguacuaugcuaaguacuacccuucugucaucccagcacuuggaagcuagaaaaaaaaaaaaaaaacccagacaaugaucucugacuuuaaagucugacccuuuccuucaacauuauggguccuuauggcuuucuuucuuuguacucucaacccugacucuugggucccccagaggggccucuaauuccuuucuguaacacuggauccugaucuuaaaugugaucucugacccuugccucugcccuuugacucccaaccauacugcccccaaccagcaaaaccuuccuggcucucuaccagagucugaacaaaguuuaguuucucccuugucaacuccacccggggcaccccucaaccuccacauguaacuccagccuccuccccucccccagcccccccuuaucucauuccaccucauuugcccccagcuccggcagcuguugaagaggagccgcacggcacccccaggcuuguccucuuaggaccgaaacccagaaccuggacugauuuuccaguccccaccgucccgugggacagucagcguaugcucaugucgcagauucaugauaauauauguguaauauccugccauuagggucuuacauuaaaacuccaaaguggcacgggggggaggugagcagucuccaauauuuggggucugugacaccuccucccccuacaaggggcuuucuaggugauuucugugaaaucgagcccacuugauuguuucugugaaacacucuagagaccuuuaacuuucuccuaccuggaucagucaugaucaccccccccagacugucguacccugaauccccauuggaguuuccaugggauuugaggcaucugaguaccuuucggucaggauuccuccccaggacccacaccccugagauguuggaaaggcccucugagauuaauguguccugaguccuggcuacaucaucauuuagaacccaaugucucugacgcuagcauuccccgugauuguuccccuuggucuguguaucccuguagcuaccaauuaaacucaauuuggccucaga

SEQ ID NO: 3694 - RNA, 10605 nt, Mus musculus
auggccgggugggaaagaggacuuuauugggauguuagugaagaaacgugggauggugaauuccagggagugacauacauaccugggacccaggucaccuuaaggagcaauaaauuaacguaaaauaaauuaaggugaagagguccuuugugggacaggagcuggggauuucuaaggguguggaauuuggaacuaggaaggggaaacaagaaugaauuugucaagaucucccucccccaccggaagcugggaguuggguuuggggggccggaagaagggcaguagggcucagcugaaggcagcuaggguaggggucaaggucguucuuccaggaagcgguaggugggguucucauagccaugccucugaaguucccggagcugcugcuccuccagggucagcaugggguccaccugcaacagggccaggggagugcucaaugcaugggggcagggcuacuuuuaacuccgccccucaccgcgaugucugccccucaccuccaccacuccauggcugauagucccauaggguuucuucuugcgcagaagcagcaaggauaggacaaugagggagccuccuccagcucccaugaucagcagaccugacaaggccucucgggacacuccagucccggaaggagccuggggagaaaggagaccggaccaagaguaucuuugaggcucaccaggauccagggcacugcggcuuuggagguuacagccuggaugccaaccucugaccucgcccccagaucugccucuucuuaccaguucaucccgcuggauaucugacgaguggaagggaaacccccucggggcggaugcauucaccuggggaagcaggagauggcagaugucacggaccccggggcuuagacgaguaccucgcagcccaacacuaaguccauguccccagcaagcucuuuccugaagcugagggauccaagccuccagaaccuccccuccucccaggguccggacgcccacucacuuaccuuuugcucauacugcuccaguggaguuagcuucucucucccagaggaggaugacucuugaucuguggacccuagcccacccaagucacaucagaaugggcacuggacuccucuccaggagcccuggguuuccugcuauacgcagcccuuucccuucgugguuuaggguucagagggauuugaugaccggggugugugacacuuaccuuuuggaagggucacugggggaucugccagcagaggagacaagaugaaaggcgaaacggugaagagcaagaaggggagagaaccccaccagaaccaagaaccucacagaagcccaauacccccccccccccguaucccuccuuauuccuucccaccuguugugguggcacagacucccccagaccuuagagaauuagaaagaagguuguaugcuggguaugauaguucacacuucucuuaucucagcacuuggaaagcuacgacaagaagaucaccagucugaggccaccugaggcuaaauagugaauucuaggcuagccugaacuacagagugagacccuguaaucugagcuacucaggauguugaguucaaggccugccagggcuacuuagacugucuaaaauaaauaaaugaauaaaagggguuggcggggaggaaaaagaauacuaggacuagcgcugaacggaaggacucuucucuagcuuagcaugcacaaagcccugggcucccaacagcuucuuccuucuggccaaggaaucugacauugcaaaggaaagggaaagaggcuugacucucaaaggugggcgggauucgguauucacucaccguccuuggauucgggaggcuggaggcuaccuuuguccucacugcugcucccgggcacagaggcguccaguucacugggacccaaguguucagcaaggagaagcuccucugagggcacacacagaaagauggcuaaggcgguugagugugcgaagacuacaucggggguaagggcagggacccucacagcgggauggaugggagauuagagagacagcagagaccgcaaggugcuccagcaggaaggauuggaggcuggaccugcaguaggagcuaggcagggacugauuggaaggaagucacaguagggggcggggcuacgcaggcuaacauuuuccggucuucucucucuuguguaggcucccucuguugaaucccgauuucacuugugacuccuucuaaccaguaaaaccugggcucaauagcccagggguguaguucagugaugcacacagcuagcauauaaaagguucuggguucgauccccaguaguacccaauuuuuuuucuuuucucuucuuuucuuuucuuuucuuuucuuuucuuuucuuuucuuuucuuuucuuuucuuuugagacaggguuucucuguguaucccuggcuguccuggaacuggcucuguagaccaggcuagccucaaacucagagaccugccugccucugcuuuccaagugugggauuaaugcuauguaccaccacacuuggcacuacacauuuuuuuuggaggagaguagggccaauguauggcuguauccugacacuggggaaacagagacuggaggacugugaauuugagagcuggccugagcuacgugguuccaggccagccucaguuacagagcaaaaucuugucuuaagaagccaaaggcuggggauguggggaugguaaggcacuugccuauccgugugcaguccuagcuucaucccuggugccauuaaaaaauuaauuaauuaauuaauuaacuaacuaauuaauuuuaaaaaaucuugccagguguuggggcacaagccuauaaccccagcacuuggaaggcagaagcaggaaggauugcucaaaguucaaggcuagccugaucuaacauagugaguuucagacuagucagugcugcaaaguaagacccuaucucuaaacaaagaaacaaagaaacaaacaacaaaaacaaaccacugcuuaaauuaaucuguacaauuaauugacuacuagccauaccaccaaagaaaaccaauccagaccagacagaggaaaaugauucaaauuaauugaaaaagaauugacucuuaauuugaacuaccaaguucuagggugauuuaagugaaggauggguugaggguugggcgucaaagucugcccuuggagcucugaaguucaggacaaaaguaacaggcacuuacggaucuguggccgcagcuccugagccaggugaggguucuggucgagcagccccaggcucugauucauucgcucuucgaucaccugaaggugggucuggaccugugggggagugagcaugagggaugaagcaggcagcaugggcuggagaagaacgggaugaaaggggaacucaacgggcgcuguggaaauggaacauggagcacgaacaggaaguagggcauaagggucagacacccagccacaggggaaggaagcuaaggcaggagaaaugggaugcagagaaaaggaagaggagauguguacaagacgagggguucaaggcuuggacagaggaaaacaguacuggaggcaagaugaugguaggauacaaagaaaaaggaaaaaagaauauauauauauauauauauauauauauauauauauauauauggaaagagagagagagagagagagagagagagcugggugugauggugcgugccuuuaauagcaguguuugggaagcagagguagaucucuguaaguucaaggacagucuggucuacauagcaagcuccaggggcaaacaggauuacuauauagugaguagugagacccucucuccaaaagcaaaaacaaaggagagagggagagagagagagagagagagagagagagagagagagagagaugguaccaauggagaaaguaaacucaugggucagagggagaaagcagggcuggaggaacacauguggggcugugggggaggcaggacucgguccagaggauucacaaaggagucugauuccugggcaaggcuugcuauucaggagcacagaggagagcaucugaggaacaaaugagaauguccaagaaaccagaaguagauggaaucuuagugcaugcagcagagguucuagggaaaacagggcuagggaggaaugcugagggacaaacuccaggagcaagggaaagguuucuggggaaaggacguaaaauccaagggcuaggaaacaggaauccaagagacaggaaauaggauuccaagggacaggaagugggaauccugagggcaagaagggagucaaaagaacaguaugauaggugugugcucacgcgcacgugugagugcgcgugugugggugcuugugcaugcuuuaggggcaguuuuccagcaucaagaagcugggauuugggguuggagagauggcucagcaguuaagaacacugacugcucucccagaagugcugaguucuauucccaauaaccccacaugguggcucacaaccaucuguaaugggaucugaugcccuuuucuggugugucugaagagagugacaguguacucauauacaguaaauaaauaaauaaaucuuaaaaaaagaaguugggauuugagggauaagaauggagggacuggaaaggguuuagggacacaaaggggauguuccaggcauagugaaggguucuaaacugaaaaugagggucaagaaaagaaccuggggccuggagagauggcuuagccauuaagagcacuugcugcucuuccagaggacccagguuuaguucccagcauccacauggcuuacaagucugugacuccacuucuaggagacucaacacccucuucuggccucuucacagaccaggcaugcaugugguaaacagauacacaagcaaaacacucauacacggaacauuucuuagagggggagcgggugggcggaagagaggaggcuggguuagcauccggggaccggaagcaugugguaccugaaagcgcaucugcugggccuucucaggauccacugcggccacgugcugguagugccucagagugugccucugcucuuucugcucggcgcgcagguagcgccucagggccaucagaacucgcucagccuguggaagggaccaaggcugucccaggcugauccucauccuucucaacugguguuugccccaccccuaccuucccauaccugaggcggaucgcccuguaaggcugccaggaaaccuuccagggcugcucggcgcuggucguugaucagagcgaugacucugguggcgugggucuccaccaggcguugccguucaccagacacuuguucuuccagggucugcagaauggacuggaagugcuagggagaggugcagaaguaggaaagagagcaggugggugaaaaccugaauagaugugaaucuagaacaaagagggugggcuucagugggucuuccuccggacagcggcaaucugggaugggaggcucaauggaagggaugggcugcagggucagguagaguugggggcggggcccuagccugaggguguaggcucuacuuaggugggagcaaucuaaaagcagaaauggucaguuaaagagaaggcaggcuugggcugcuccaacccaaaagacaggcugagccuccacaacgguaauggagugagacucaggacuggaggcugaucaagaggauucuacauagguagggucucaaaaaggcaaccaaccacagguaaguggggccaagaguuaggaagcuggguuuguuagagagggaccagaaggacagaaccaacuacagcgggggugggaguggggcuagcuuugauggaaaaacuucagagaaaggacuggccaugacucccuguuugagagaggauuccaaagccagccuccagggggcagugcuggcucagcagcaugcaccaagcccugggcuccauucugaguagaggcagugccaaauguaagggugggacugggagggaacaggugaguugaaaggaaccgaaauggacggaguggcccccaguagugggcggggcaugagggagagucagggaggagggaggagggaggagggaggagggaggaggaaggaguccuaccucauucagggccugccuguccgccuuuggcagguucuuagauuggcugucagccauggcccauucacgcaucaccuagggguggauggggacacuucaggaucccaugaucuaucuugcuccauacagggagucccccuacucaucuccaaggucuaagaggucgaagaugaccuaauaccgcugaacuucggguucccaagagggaauaaccagaggguuuauuuauuguuuuauuucuuuagagacagguucucauguagccaggcuggucucaaagucauuauauauuugaggcuggccuuagccuuccaauccucuugccuuagccucucaagcauccagauuaaggcaucugauauuacacccaaccagcuccaauggaauuuaaaguggauugugccauagaccagagugccuauggaauccgguggcauuucaguggucugcaaggcagaucaguaauccauugccugagugugggcucaggucgaaggaugcuugguuauccuuagagggagcgucaauaaagaauuucccuguguuuauggaauccugcgggaaugcugguuuccuggucucaucaccucauuaaucuggcgcauccuacgcuccuccagguccaucuuggcccucaggaaacccucaugcucgccgauuuccccaggcaugccaaaguaaacauccacaccaucaguaggccuuggggugggagugacugcaagacaaggggucaggcaggcaggucacuuucccucccugagaagugcauugcccaggaugcacuagauaccagcaugcauccaguuuagccgcgguuguugccuggcaucauggucccaggccuaaccaguguuugcaaagcuauggaauccaucaugucaucuucaaagcaacgucugucaaaugaccccucuuccgggcaucccuuuuugaggcaucucccccuccauucuucacagacuaaucuaccauauccaaagccacagcuaucucuuccauuccccccagcugugccccuucccacuaggucacuccuaaaggcaccccaauacccccccaaauacccaaaccacaaaugcugaagagggagggggcagaggaggcugccucaccucugcuaaccaugacaggggugugggagcugggagguggggcccuuucuuccuccucuuccucuucuucuucagccugagggggcucuacgaaguaaucgucuacuggcugagggaaagauuccaccuccucuucauccucaccucccucugcucugccccccaggggccaggaccggguagaggggucacugaaggagcagaagacucagccaguaagaucuccagagaggcucccaggcuuccaugcccggccucuagagccuuggggguaagggggguggguacagaaagagucucugucacucacccagcugccaucccagauggguugggaguugcaggagguggacagcauacauacuccacaccucggaaccgaucagagccacagggcaaaagcaugccagagccaugcaggaugaggcccugagagcugcaggccugcaggaagaggaggccaggaggaccugguuggagagugugggcagaaaagccuggaagcugggcucuaggaguggcugaggaauggauugccuacaucccaguuugaacgcuuggguucuggaaggaagggccuagauucccagguccuaggguuaggaaacaggcaggacaaggcccugaccuccugagccuccugaugccuccugguugaacucucacacugguccauacgcuccuggugcaagaaccgacagccuucgggcacuagcagggcuucacucacgaauucgccagcuggggaaugggagacaccagaaucaucaccagaaucaucacccaggccugcccaccucagaggccaggcauucauagcuuucucagcccaucacccagacuucaaauguagaccaaagucaucucugguagacucccacuucaccucaguucccaccccaccccccagcgggugacucacgcaggcaauggaagggcacaaccucauggugggggugggcgcaucugccacuccggguacccccacaccagcgcuccaucgggauggccugugcagccugcuccacgcgugcuaugugcagcucgggguacaucuguaggacacaaugugugugggaggaggugggggggggaucaaccuacuggcugacccccacccucugcaucucucauuuggcagcaguacuggggauugaacccagagccuuguacaugccaaagccaugcucuaccaccaaacuccuacauguccagcccucuuuuuacuuuuuauuuugagaccaggucuccuuacauuuccuaaacuggucuugaacucauucuguagcuuacgagggccuuuaauuugugauccuucuaccucagccuuuccaauaacugggauuaugggcccaugucacuaaucucagcuugagcaguuccuuuuuacgugucuugguuccuaaggacaucccugggccuucgucucuugucuauagaacuaacagguuaauuuguaagccucagaugcuaagcuucggguccacuggucauacccuaguggucucccuuaaguucaccauucucacgaggccuugauaaagguccucaggcuuugacaugccaaacucaacuucucugagcccacguuugaaggcaacccugcucggcaaucagguuucuugcucuuucacuuccugccuuucucuguuuagcuacuaaguaacucuucuuuguauuagccccgccuuuucauugcacgucucuuaggcaggcagccacucucauugggcuccaucacuuacugaaucuuguugguuuaaaaggucucuugaucuaagccuugccucucuuucggccacgcccacuuacacucccacuuuuucuaaacggauccauagauuccuaaaccaugccacucuucaggcgaccuugauuaguccaugggggguguggggggguguuguuggguuuuuuuuuuuucagucuccaccgccgccccgcggccccuaauuucucaaaauagguuugcgcuggcccuuuaggaggggccucuucacugaccacagacccccaagcuuucccuggcuuuacagauucucucaucucccuagacucugccaaguccagcuuccucaagggcgaccccgccccagcuuggauccacuuucucauugaccacgccucuccccguggggucccgcccaccugucugcaguacuccagcacgcgcugcggguccagaagacagcgucgugaucgcugugggucugguucccagcggccggugcgcaggucccggugaaggguuagacgcccacauaguccagccacuugagccgaccccggagccugggaaugaaggcagauggggcagugaggagccagggcaacgaugucaucuguguugucugguucuuugcucccuaaaacccagauagggcuccugccccuaucucuagcaccagcuccuucuaagcaccuucugaguggagagaccguuccccgggaaacaaaucccguggggcuggagcgccccagcucucccguugcuauggugaccuggguccccacccccccgccccguuucucgcggccuuguugcugagaagacaggcuccgcccccgccccagcggcuugggucugaagccugaagggguuaaacuugaaucguguugggggaggcggggggcgaacccaggcguucuggccccuccucccuccauccccaguucagguucccacugagggggugcaaagacgacagggcccagcuucccagcaggccugcacaucagaccuuuaaggacuagaggagcuauauccggauugaguaguggguggaggcccggacuacuggauguuugagggcaggggguucauguggguccagauaauacaagggaccuggguucuuagagccaagcgccuacugccuggugcguccuacgcuuaggugggcaggucuuggggcuuugucgucuaggggugcucuggauuucuuggaccagaggcucuuggaaagagccagguccgacgaugcgggugggagggggcagggacgucagacgauggaggaaccuaggaaaaucuacaguucggaucgcguggggcaggccaccuggccaaaaggacugcgguggccgucccgcguccaggucgaggcccggucccgccccuuccccauccccaggacccggccgggccucaccucggccgcgcuggggcucccaacagccagguucccgacggcgagcugcgcgcgcagaagcagcaaugacaguggcagcaacagcggcagcggcggcggucgccagcggcgacccugaccgcgagcggcggggcuggugggccccauguccgggccucgggcccucacguccccugcgcucccgcccggcccuacccggccccagcggugacaggagcucccagcgccaccgccgccuccuccucccgccgcccccgggcug

SEQ ID NO: 3695 - RNA, 10605 nt, Mus musculus
cagcccgggggcggcgggaggaggaggcggcgguggcgcugggagcuccugucaccgcuggggccggguagggccgggcgggagcgcaggggacgugagggcccgaggcccggacauggggcccaccagccccgccgcucgcggucagggucgccgcuggcgaccgccgccgcugccgcuguugcugccacugucauugcugcuucugcgcgcgcagcucgccgucgggaaccuggcuguugggagccccagcgcggccgaggugaggcccggccggguccuggggauggggaaggggcgggaccgggccucgaccuggacgcgggacggccaccgcaguccuuuuggccagguggccugccccacgcgauccgaacuguagauuuuccuagguuccuccaucgucugacgucccugcccccucccacccgcaucgucggaccuggcucuuuccaagagccucugguccaagaaauccagagcaccccuagacgacaaagccccaagaccugcccaccuaagcguaggacgcaccaggcaguaggcgcuuggcucuaagaacccaggucccuuguauuaucuggacccacaugaacccccugcccucaaacauccaguaguccgggccuccacccacuacucaauccggauauagcuccucuaguccuuaaaggucugaugugcaggccugcugggaagcugggcccugucgucuuugcacccccucagugggaaccugaacuggggauggagggaggaggggccagaacgccuggguucgccccccgccucccccaacacgauucaaguuuaaccccuucaggcuucagacccaagccgcuggggcgggggcggagccugucuucucagcaacaaggccgcgagaaacggggcggggggguggggacccaggucaccauagcaacgggagagcuggggcgcuccagccccacgggauuuguuucccggggaacggucucuccacucagaaggugcuuagaaggagcuggugcuagagauaggggcaggagcccuaucuggguuuuagggagcaaagaaccagacaacacagaugacaucguugcccuggcuccucacugccccaucugccuucauucccaggcuccggggucggcucaaguggcuggacuaugugggcgucuaacccuucaccgggaccugcgcaccggccgcugggaaccagacccacagcgaucacgacgcugucuucuggacccgcagcgcgugcuggaguacugcagacaggugggcgggaccccacggggagaggcguggucaaugagaaaguggauccaagcuggggcggggucgcccuugaggaagcuggacuuggcagagucuagggagaugagagaaucuguaaagccagggaaagcuugggggucuguggucagugaagaggccccuccuaaagggccagcgcaaaccuauuuugagaaauuaggggccgcggggcggcgguggagacugaaaaaaaaaaaacccaacaacacccccccacaccccccauggacuaaucaaggucgccugaagaguggcaugguuuaggaaucuauggauccguuuagaaaaagugggaguguaagugggcguggccgaaagagaggcaaggcuuagaucaagagaccuuuuaaaccaacaagauucaguaagugauggagcccaaugagaguggcugccugccuaagagacgugcaaugaaaaggcggggcuaauacaaagaagaguuacuuaguagcuaaacagagaaaggcaggaagugaaagagcaagaaaccugauugccgagcaggguugccuucaaacgugggcucagagaaguugaguuuggcaugucaaagccugaggaccuuuaucaaggccucgugagaauggugaacuuaagggagaccacuaggguaugaccaguggacccgaagcuuagcaucugaggcuuacaaauuaaccuguuaguucuauagacaagagacgaaggcccagggauguccuuaggaaccaagacacguaaaaaggaacugcucaagcugagauuagugacaugggcccauaaucccaguuauuggaaaggcugagguagaaggaucacaaauuaaaggcccucguaagcuacagaaugaguucaagaccaguuuaggaaauguaaggagaccuggucucaaaauaaaaaguaaaaagagggcuggacauguaggaguuuggugguagagcauggcuuuggcauguacaaggcucuggguucaauccccaguacugcugccaaaugagagaugcagagggugggggucagccaguagguugaucccccccccaccuccucccacacacauuguguccuacagauguaccccgagcugcacauagcacgcguggagcaggcugcacaggccaucccgauggagcgcugguguggggguacccggaguggcagaugcgcccacccccaccaugagguugugcccuuccauugccugcgugagucacccgcugggggguggggugggaacugaggugaagugggagucuaccagagaugacuuuggucuacauuugaagucugggugaugggcugagaaagcuaugaaugccuggccucugaggugggcaggccugggugaugauucuggugaugauucuggugucucccauuccccagcuggcgaauucgugagugaagcccugcuagugcccgaaggcugucgguucuugcaccaggagcguauggaccagugugagaguucaaccaggaggcaucaggaggcucaggaggucagggccuuguccugccuguuuccuaacccuaggaccugggaaucuaggcccuuccuuccagaacccaagcguucaaacugggauguaggcaauccauuccucagccacuccuagagcccagcuuccaggcuuuucugcccacacucuccaaccagguccuccuggccuccucuuccugcaggccugcagcucucagggccucauccugcauggcucuggcaugcuuuugcccuguggcucugaucgguuccgagguguggaguauguaugcuguccaccuccugcaacucccaacccaucugggauggcagcugggugagugacagagacucuuucuguacccaccccccuuacccccaaggcucuagaggccgggcauggaagccugggagccucucuggagaucuuacuggcugagucuucugcuccuucagugaccccucuacccgguccuggccccuggggggcagagcagagggaggugaggaugaagaggagguggaaucuuucccucagccaguagacgauuacuucguagagcccccucaggcugaagaagaagaggaagaggaggaagaaagggccccaccucccagcucccacaccccugucaugguuagcagaggugaggcagccuccucugcccccucccucuucagcauuugugguuuggguauuuggggggguauuggggugccuuuaggagugaccuagugggaaggggcacagcuggggggaauggaagagauagcuguggcuuuggauaugguagauuagucugugaagaauggagggggagaugccucaaaaagggaugcccggaagaggggucauuugacagacguugcuuugaagaugacaugauggauuccauagcuuugcaaacacugguuaggccugggaccaugaugccaggcaacaaccgcggcuaaacuggaugcaugcugguaucuagugcauccugggcaaugcacuucucagggagggaaagugaccugccugccugaccccuugucuugcagucacucccaccccaaggccuacugaugguguggauguuuacuuuggcaugccuggggaaaucggcgagcaugaggguuuccugagggccaagauggaccuggaggagcguaggaugcgccagauuaaugaggugaugagaccaggaaaccagcauucccgcaggauuccauaaacacagggaaauucuuuauugacgcucccucuaaggauaaccaagcauccuucgaccugagcccacacucaggcaauggauuacugaucugccuugcagaccacugaaaugccaccggauuccauaggcacucuggucuauggcacaauccacuuuaaauuccauuggagcugguuggguguaauaucagaugccuuaaucuggaugcuugagaggcuaaggcaagaggauuggaaggcuaaggccagccucaaauauauaaugacuuugagaccagccuggcuacaugagaaccugucucuaaagaaauaaaacaauaaauaaacccucugguuauucccucuugggaacccgaaguucagcgguauuaggucaucuucgaccucuuagaccuuggagaugaguagggggacucccuguauggagcaagauagaucaugggauccugaaguguccccauccaccccuaggugaugcgugaaugggccauggcugacagccaaucuaagaaccugccaaaggcggacaggcaggcccugaaugagguaggacuccuuccuccucccuccucccuccucccuccucccuccucccugacucucccucaugccccgcccacuacugggggccacuccguccauuucgguuccuuucaacucaccuguucccucccagucccacccuuacauuuggcacugccucuacucagaauggagcccagggcuuggugcaugcugcugagccagcacugcccccuggaggcuggcuuuggaauccucucucaaacagggagucauggccaguccuuucucugaaguuuuuccaucaaagcuagccccacucccacccccgcuguaguugguucuguccuucuggucccucucuaacaaacccagcuuccuaacucuuggccccacuuaccugugguugguugccuuuuugagacccuaccuauguagaauccucuugaucagccuccaguccugagucucacuccauuaccguuguggaggcucagccugucuuuuggguuggagcagcccaagccugccuucucuuuaacugaccauuucugcuuuuagauugcucccaccuaaguagagccuacacccucaggcuagggccccgcccccaacucuaccugacccugcagcccaucccuuccauugagccucccaucccagauugccgcuguccggaggaagacccacugaagcccacccucuuuguucuagauucacaucuauucagguuuucacccaccugcucucuuuccuacuucugcaccucucccuagcacuuccaguccauucugcagacccuggaagaacaagugucuggugaacggcaacgccugguggagacccacgccaccagagucaucgcucugaucaacgaccagcgccgagcagcccuggaagguuuccuggcagccuuacagggcgauccgccucagguaugggaagguagggguggggcaaacaccaguugagaaggaugaggaucagccugggacagccuuggucccuuccacaggcugagcgaguucugauggcccugaggcgcuaccugcgcgccgagcagaaagagcagaggcacacucugaggcacuaccagcacguggccgcaguggauccugagaaggcccagcagaugcgcuuucagguaccacaugcuuccgguccccggaugcuaacccagccuccucucuuccgcccacccgcucccccucuaagaaauguuccguguaugaguguuuugcuuguguaucuguuuaccacaugcaugccuggucugugaagaggccagaagaggguguugagucuccuagaaguggagucacagacuuguaagccauguggaugcugggaacuaaaccuggguccucuggaagagcagcaagugcucuuaauggcuaagccaucucuccaggccccagguucuuuucuugacccucauuuucaguuuagaacccuucacuaugccuggaacauccccuuugugucccuaaacccuuuccagucccuccauucuuaucccucaaaucccaacuucuuuuuuuaagauuuauuuauuuauuuacuguauaugaguacacugucacucucuucagacacaccagaaaagggcaucagaucccauuacagaugguugugagccaccaugugggguuauugggaauagaacucagcacuucugggagagcagucaguguucuuaacugcugagccaucucuccaaccccaaaucccagcuucuugaugcuggaaaacugccccuaaagcaugcacaagcacccacacacgcgcacucacacgugcgcgugagcacacaccuaucauacuguucuuuugacucccuucuugcccucaggauucccacuuccugucccuuggaauccuauuuccugucucuuggauuccuguuuccuagcccuuggauuuuacguccuuuccccagaaaccuuucccuugcuccuggaguuugucccucagcauuccucccuagcccuguuuucccuagaaccucugcugcaugcacuaagauuccaucuacuucugguuucuuggacauucucauuuguuccucagaugcucuccucugugcuccugaauagcaagccuugcccaggaaucagacuccuuugugaauccucuggaccgaguccugccucccccacagccccacauguguuccuccagcccugcuuucucccucugacccaugaguuuacuuucuccauugguaccaucucucucucucucucucucucucucucucucucucucucucccucucuccuuuguuuuugcuuuuggagagagggucucacuacucacuauauaguaauccuguuugccccuggagcuugcuauguagaccagacuguccuugaacuuacagagaucuaccucugcuucccaaacacugcuauuaaaggcacgcaccaucacacccagcucucucucucucucucucucucucucuuuccauauauauauauauauauauauauauauauauauauauauauucuuuuuuccuuuuucuuuguauccuaccaucaucuugccuccaguacuguuuuccucuguccaagccuugaaccccucgucuuguacacaucuccucuuccuuuucucugcaucccauuucuccugccuuagcuuccuuccccuguggcugggugucugacccuuaugcccuacuuccuguucgugcuccauguuccauuuccacagcgcccguugaguuccccuuucaucccguucuucuccagcccaugcugccugcuucaucccucaugcucacucccccacagguccagacccaccuucaggugaucgaagagcgaaugaaucagagccuggggcugcucgaccagaacccucaccuggcucaggagcugcggccacagauccguaagugccuguuacuuuuguccugaacuucagagcuccaagggcagacuuugacgcccaacccucaacccauccuucacuuaaaucacccuagaacuugguaguucaaauuaagagucaauucuuuuucaauuaauuugaaucauuuuccucugucuggucuggauugguuuucuuuggugguauggcuaguagucaauuaauuguacagauuaauuuaagcagugguuuguuuuuguuguuuguuucuuuguuucuuuguuuagagauagggucuuacuuugcagcacugacuagucugaaacucacuauguuagaucaggcuagccuugaacuuugagcaauccuuccugcuucugccuuccaagugcugggguuauaggcuugugccccaacaccuggcaagauuuuuuaaaauuaauuaguuaguuaauuaauuaauuaauuaauuuuuuaauggcaccagggaugaagcuaggacugcacacggauaggcaagugccuuaccauccccacauccccagccuuuggcuucuuaagacaagauuuugcucuguaacugaggcuggccuggaaccacguagcucaggccagcucucaaauucacaguccuccagucucuguuuccccagugucaggauacagccauacauuggcccuacucuccuccaaaaaaaauguguagugccaaguguggugguacauagcauuaaucccacacuuggaaagcagaggcaggcaggucucugaguuugaggcuagccuggucuacagagccaguuccaggacagccagggauacacagagaaacccugucucaaaagaaaagaaaagaaaagaaaagaaaagaaaagaaaagaaaagaaaagaaaagaagagaaaagaaaaaaaauuggguacuacuggggaucgaacccagaaccuuuuauaugcuagcugugugcaucacugaacuacaccccugggcuauugagcccagguuuuacugguuagaaggagucacaagugaaaucgggauucaacagagggagccuacacaagagagagaagaccggaaaauguuagccugcguagccccgcccccuacugugacuuccuuccaaucagucccugccuagcuccuacugcagguccagccuccaauccuuccugcuggagcaccuugcggucucugcugucucucuaaucucccauccaucccgcugugagggucccugcccuuacccccgauguagucuucgcacacucaaccgccuuagccaucuuucugugugugcccucagaggagcuucuccuugcugaacacuugggucccagugaacuggacgccucugugcccgggagcagcagugaggacaaagguagccuccagccucccgaauccaaggacggugagugaauaccgaaucccgcccaccuuugagagucaagccucuuucccuuuccuuugcaaugucagauuccuuggccagaaggaagaagcuguugggagcccagggcuuugugcaugcuaagcuagagaagaguccuuccguucagcgcuaguccuaguauucuuuuuccuccccgccaaccccuuuuauucauuuauuuauuuuagacagucuaaguagcccuggcaggccuugaacucaacauccugaguagcucagauuacagggucucacucuguaguucaggcuagccuagaauucacuauuuagccucagguggccucagacuggugaucuucuugucguagcuuuccaagugcugagauaagagaagugugaacuaucauacccagcauacaaccuucuuucuaauucucuaaggucugggggagucugugccaccacaacaggugggaaggaauaaggagggauacggggggggggggguauugggcuucugugagguucuugguucuggugggguucucuccccuucuugcucuucaccguuucgccuuucaucuugucuccucugcuggcagaucccccagugacccuuccaaaagguaagugucacacaccccggucaucaaaucccucugaacccuaaaccacgaagggaaagggcugcguauagcaggaaacccagggcuccuggagaggaguccagugcccauucugaugugacuugggugggcuaggguccacagaucaagagucauccuccucugggagagagaagcuaacuccacuggagcaguaugagcaaaagguaagugagugggcguccggacccugggaggaggggagguucuggaggcuuggaucccucagcuucaggaaagagcuugcuggggacauggacuuaguguugggcugcgagguacucgucuaagccccgggguccgugacaucugccaucuccugcuuccccaggugaaugcauccgccccgaggggguuucccuuccacucgucagauauccagcgggaugaacugguaagaagaggcagaucugggggcgaggucagagguuggcauccaggcuguaaccuccaaagccgcagugcccuggauccuggugagccucaaagauacucuugguccggucuccuuucuccccaggcuccuuccgggacuggagugucccgagaggccuugucaggucugcugaucaugggagcuggaggaggcucccucauuguccuauccuugcugcuucugcgcaagaagaaacccuaugggacuaucagccauggagugguggaggugaggggcagacaucgcggugaggggcggaguuaaaaguagcccugcccccaugcauugagcacuccccuggcccuguugcagguggaccccaugcugacccuggaggagcagcagcuccgggaacuucagaggcauggcuaugagaaccccaccuaccgcuuccuggaagaacgaccuugaccccuacccuagcugccuucagcugagcccuacugcccuucuuccggccccccaaacccaacucccagcuuccggugggggagggagaucuugacaaauucauucuuguuuccccuuccuaguuccaaauuccacacccuuagaaauccccagcuccugucccacaaaggaccucuucaccuuaauuuauuuuacguuaauuuauugcuccuuaaggugaccugggucccagguauguaugucacucccuggaauucaccaucccacguuucuucacuaacaucccaauaaaguccucuuucccacccggccau

SEQ ID NO: 3696 - RNA, 13168 nt, Mus musculus
cguugcuuagcgaggagaguaggcgcaggguuguuccgcgaagaagcuccgcuggcgcuaaggcugcgguaaaugccgacaaacugacugcaggugagguugguccucuuucagagaccacaggaggccugggaaggcaacacggguuuacgugagccugaagucucccgcccaaucucaggagaacuacaacucccaagauaccacacaguuugggcccuccaacaucucugagugucucaugucuuuuguucccgcagggugggccgaagaagagucgaaaagaaauuugaaaauuuaguucguuaguuuccaaauugccccagacaucuagggguguugucuaugaacuuuuucacuuaggaggagcccagugauucauggggauuguagucucuacugccccuuucucuuugggagucaugccaccaccucccccuucccuuaacagguuuaaccggaaacauauuguguacgguuucgucguggcucuuuguuaauguuuuguuuuugccuauuguuuucauucuuuuuuucauuuguaugcuuuuaaaaaaaagauuuauuauuuauuuuagguauaugagugcucucucugcauauacucccgugugccagaagagggcaucagaccacauuacagaugauugugagcuaccaugugguugcugggaauugaacucaggaccucugguagagcagccagugcucuuaaccaccgagccaucuguccagcccauaugggugcuuuuuaaaaugauuuguauuguuguuguuguuuaagacaggguuucccugcacagcccugucuuggaacucacuuuguagaccaggcuggccuuaaacuccugccucuuccuccuggguucugggauuaaaggcauccaccaccauucuuggcuacauuacuuggguuuuuuuuuuuuuuccucguggaauuaauuggagcuucaugaaaugggcuucuuggaacauguuuaaagagguagaaauuaguuaccuugauuugacuguaacauauuguauacacguauugaaauaucauacugugccgcauaaacuuguacaauuagugucaguuaaaaacaaaacagaacuaugcaacagaccagguuuuuccugaauggggcuggaaaaagggcucauugguugggagcaggggcuggucuuccagaggucccagguucaguucucagcaucacauggcuacucacauucauuccagggucuucaagggcauugcacauacauaaaugugcacaggcacaugcaggcauaauacuacccaugcauacaaaauaaaaauaaauaaaucuuuuuuuaauugccugaauagugugaagaaguugcagugucuagccuguuuccugauagucugauucuguuagccuggagugggaacccacucucacucauccucugggggugugcauggguaccaacccacucucacacauccucugcaggaccaggcacauccucucccacugaggccaggcaaggcaguccaguuagaggaacaggauccacaggcaggcaacagguaaaauguuauucuuguuuugagacaagaguucucuaugcagccuuugcguaugagugcacuuguuucugugugugugugagugugagagagagugugugugugugugugugugugugugugugugcacccuguggaaaucagacaggcucaggcgucuguucucaucuuucaccauguugagccagggucuucucuuugauguucaccucugaggcucgcugacuugaaaaguuuuaggggacucucccguauccaccucccaccucuguauagaaguacucggauugcagauugugcuaccacaucuggcuuuccauggauucuauggauuugaacucagguccccauguucggggagcaagcaucguauucacugagccaucuccucagccuuugcuuuggaacuuuggauccuucugccagagccucuugagugcugggacgacagaugaacauuacacauuuggcauuagucuguaauuuuuaaaguccuagcacucaagaaguugaggcaggaggaucaccucaagugcaaggcuaaucauggcuacagaguaagacccuaucucaaaaauaaagcuccuacuaggcuaccagaguugagaacuaccaacuacuaguuucuagguucuucuaugucucuaucaugggacuuagagcucaugggaauuaugggaguugugaugauucauggggauuguaguccauuucugugggaagccguugcagaguggcaguugcagagugguaguuggcuacugcuggccaccacacauacacaggcagugaagguucuuuugcccagaugagagacaaguuaaccaaucagaugugagacacgccucuccuaggccuauauaagcagcaccaguucugggcucggggucuuuucgccucuacagucaagcucucccaauaaacgugugcagaaggauccuguugcagcgucguucuuccuggccagucgagcaugcgcaagacauuucuuccaguaaucuauaggaauugucagcuucuguccuccucuuacuaugcucugcuucuuucauagccuguuaguuuucaccucccaagacaaccccuuuggaaauguuccccaagguggacaacccuuugggccaucaagaaaccagaacuggagccacaaggugaggacacuuuuuuuguuuguuuguuuuguuuguuuguuuuuucgagacaggguuucucuguguagcccuggcgugaggacacuuuuuagguaaaguucugugccucagacugguagcugucagugaccacuagagggaaggaaggcaugcagugagagauuaagagaaaccccuuaccccagugcugguggucuacgcauuucuagcucucuagcaccuggaucccugaccacagccccacuuagguaguuaacugaaccucccgaugguaacagugugggauguuuccucuuucugacacccucuauguguguucauuccccuaugaggucaccuuucugaucugaucuuuacuucuuauguuuucucccuauuuaaaucccggguccauccaggucucaaaggccacaagcucccaaggccacagcagccaguuccgaugagcugucugaggaguccuggccaucuaguucauggaccccuuccccagccaguaccacugagggacaaaguaccucuccacccugcaacuuaauugacaacgaggacucaauaguagccaagugaguaccagaauuccuggggggcgggggaagagaggaagaaggcaucccauaauaacuaucagagacagagcuguuuaugcaguacuuuuuuaggaccaggcauuucaucuguaguauugagggcuguagagccuggguucaaauccugcuuguuaacuuacucccuauauugcuuuggucucaguuuccuucaacugggaauauuaaucacacacaaacauuggaguuguuuugaaaucucaguuccuccauacagugaacuauaagagcaccuguugccaggugguggugguggugcaugucuuuaauccuagcacuuaggaggcugaggcaggaggaugucugaguuugaggacagccugauuuacagagugaguuccaggacagccaggaccacacaaagaaacccugucucaaaaaaccaaccaaucaaucaaacaaacaaacuaagaccaaaacccacucauuuuagaguaaguacuugaauuugaaagauagagaaauaaaagauucuguaacaaagguccuaagauaauuauggccuaaccaagauaacauuuauuucuguuucacuguuacaaaagaaaccagagcugacccagcagccccaguguaagguguuaggauccuagguucugucugucuuauuguuguccuaugucuaggcuguuguccuuucccucaugggccaaaaaugguucucagugacacuacucuuccagaaucauucuuccuuauucuuuguuggucaagaaucauuugggcuggcaauguaguucagcuguuagagugccugucuggcauacacagugccuuggcuugauccccaaagccacauaaaagcaggcauagugaugucugccuguagucucagcauugagaaggcggaagaaggaggaucagaaguucaagggcacuuucagcuacauagugaauucaagaccagccuaagcuaaaugaucccuuguggaaaacacacaaauaaaaaaccaggguccagcaagauggcucagugggucaaagcccuugccacaaaagccuggcaaccuccuuuugaucccuagaccuccacgugagcacggacagggagaacuaacuccacaaaguugucuucugucugcacacacaggcugugaugcgugugcuaucccuguacacagcaaguaugcagugcgcagaaacacacauacaaccauaauaaauaauuuuuaaaaaucuaauuguggcguagcagugguggcucaugaaaaggcaggcggaucucugaguucaaagccagccugaucuauagagcaaguuccaggacagccagggcuacacacagaaacccuaucuugaaaauaaaucuaauuauguauucacaaguuauaugacaaauguaguccauagcaccaacauagugguuuauaagucuauaacuuuaguuuucggggaucagacaccuucuucuggucuaugugggcaaccuguaugcauauguagauauguggugcauacacauauauacaggcacacacauaaacagaucucuaaaaaaaaaaaaauaguuauguaccuggcuaaaaauuugugaccaggcaguauagcauuuaacugauauacugguauacgcaaggaggcacugaguucaaguuucaucauuuccaaacaugaauaaauaauuuuuauuuauuuuuuuuuuuguuguuuuuuugagacaggguuucucuguguagccuuggcuguccuggaacuaacucuguagaccaggcugaccuggucagaaauccgccugccucugccucccaagugcugggauuaaaggcgugcagcaccacugcccgguuaaauaauuuuuuaaaaagaaagacagacagaccuaagauuggcaugguggcauacaccugcagcugcagcucuuagaagguggaaguaagaggaugaggacuucagggcaguccuuagcugcagagcuggagguuagccugggcuacaugaggagccccucaaaauuuuuaagauacuaaaacaaaaaauuaaaaucgggcugacuauggauaaaggugcuugccaccaaagccugccaaccuaagguggcuccgauccuugggaaccaccuccauguguguccgguaguaugccugcucaagugugcacccaugccuguaugcauguguauguauauacaugcguacacacuugcagaaugaagugugaaaaaauuaaaauuacuauauaagaaagaaacggauuuuugaggccaguuauaugcuuuugguagaugugaaaaaagcaauuuuuuauuuuuauuuuugcuuuguuuauuuuuuucagacaggguuucucugugugccucucgcuauuguggaacuaacuguagacaaggcuguccucuaacucagagaucugccugccuccccacccaccccuaucaacuacaagggcagggauuaaaggugugugccaccaccauccaccaaaaggaguucguuuugucugggcuucugagcauaccuuugcauggugcuugauaaacugaagagcgaugugccuacugcuguugugaugguuacuguuauuacuacguggcucccuuauucccucugucgucucaugcacugaugcucacagguacauaaacagguuccgccaagcucagcccacgagcagagaggaccgccagccugcaggcccgaccucagcugacuuuugguggcuacagccuacagcagacucgaguggucaccuugcagcagguauaccuaaaucuguccugcagagcccggccaccacucuuccuggucccggucauuuaacggagguuucccagcaggagcuggugaaccuacaggaagaucugcugugacagguccaucucccacugguguguccaguacaucucuggcuucugcgccucuucagaaaguaaagcaggugacaguguucucuucucccucucucaugugccugagacagaagcagagauacugacuaacuuagagcaucauaaacaaaaaaggguuuguagaccuagagguauggcucauuugggaaggugcuugccuagcagguacaaagcccugauuugaucucugggcaccacauaaaguaggcaugguggcacauagcuguaaccucaacacccaggagguaaagacaggaagagcagaaguuuaaggucaucccaguuggaggcugccccaggcuguagacuauccuuucucaaaagaauuaauaauagaauaaaaauuuaacaauaggauuugcuaguuaaauacaauuuugaaccuuuuuuuuaaaaaauagauuuauuuaauguaugaguguucuaucugcauguacaccugcaugccagagacgguaccagaucccauuacagaugguugugaggcagcaugugguugcugggaauugaacucaggaccucugaaagagcugccagugcucuuaacugcugagccaucucuccagccccacaacuuugaacucuuuaaaaaaguagauucucacccauguuaauaugaccaagacacuagguaggaagaagggaagaaagguuuauucuaagcccaguuucagaggcugccagugcaggaguguggaguggggguguucauguuuuagcagaccaggaggcagagagugcagguuggaaucgugugugggcauaccuucaagagccuguaccuaguggccugcaaggcccuacuucuuuuuuuuuuuuuuuaagauuuauuuguuuauuuauuuauuuauuuaugaacuuuuaaagauuuauuuguuuauuuauuuauuuauuuauuuacuuauuauauguaaguacacuguagcugucuucagauacaccagaagagggcaucagaucucauuacgggugguugugagccaccaugugguugcugggauuugaacuucggauuuucagaagagcagucgggugcucuuacccacugagccaucucaccagcccuaaggcccuacuucuuaaagaguccauagccuucaaauugguaccauaaacugugaccuuagcauuccaaacaugagccagauccuuauguuuggacagugcuggggggaaaccuaacucuugguucugaaucccugaccuaagccuucacagacuuucuccguacaguaaccaagauggccccaguggcucgagaugccugugguacucagauauaacacuggaaaguaagacugaaggacuaacugccuuccuucuucccucccuugucuuucuucuuguuuuuuaaugaaaaauuuuaugugaauggguguuuugcccgcauguaugucuguguaccacuugugggccuggugcucauggaagccagaagagggugucagauuccuggaacugcaguuacagacaguugugaacuuccaccugggugcugggaguugaaucuagauccaucggaagaacagccaguuaccuuaauggcugagccgucucuccagcccccacaucucugucuuuuauucagucacccuugagucagucucugaacuauuugauagaauguuuugauuaggcagagucuggucaggaagauaagcuucaucuuccuuuuuuacauuuuaaauguggugcaugucuguguauaagucugucugccugucuuuguguguguguauguguguguguguguguauguguguguguguguguguguguguguguguguguaugugugugucuguguaugugugugugugucuguguguguauguguguaugugugugugugucuguguguguaugugugucugugugugugucuguguaugugugugugugucuguguguauguguauguguguguguguguguaugugugucuguguguaugugugucugugugugugucuguguaugugugugugugucuguguguaugugugugugugugugugugugugugugugugugugugagagagagagagagagaagucagucuaggagcugauucucuucuguuacuucgguguagguucuagggaucauaggccuauacggaaaguacuucccccacuaagccuuuaauacugggguagccaaggugguaggauggagaguucaaggccagccuggggucaaaagacagaaaccccaaaagucaaagcaggaaagagagccucucuucccccaagguagagaaguagauuguaagcuucaagcagcagguggaauaucggcccccaggccuucugcagagagccucuuucucagcgaccuuuggcauaggggcuagcuucuggucccucucucugcagagucugaacucauggaacucgucucugcuggacuuggagacccuaagccuacaaagccgagcugccaggcugcucaagcgcaggugaugcccucccccuggucccccuucccagcuguacccagucccugcucuccucacggcugccuuccccccacagcaaggccucccucaacgaugccagcagcuccuccuuccccaucagcuccgauggccucucucccagcucugugaccuucaauccggacuccaacaagaguucuaaucccaaagaaccugugcugggagguaagggcugaugguagccagguucagaucucaucuuaucaguuacuagcugcgugacuugggccucucccggccuuguuucucuaacugggaaccaggaauuaauaacuggaucccucacucacauuauacuuuauugauuugaguuuuacuucuuugaaccagggucuugcuaugccucucaagcuggcugggaacccauguguaguucccgcuggccgugaguucucagcacuccugccucagccucccuagcacugggauuacaggagcacaucucuacacaaugguuuuuguuuuguuguguuuuguuuuuucuuuugcuuuguguauaucacaaugaacuacauggaacuuuuuugcaggucaaaaauaguugagugucuggcaauuuuauauggcuuagcugccgcagacccucugggucccuugucugcuuggaaugagucucuggggcaggugggcaaggagucggcgggugacagacagaccaacacgcgagauuguguagaaucuaaauguauugucacaaagugagcaccagucuuauauaguacagaaaauaaaagggguaggaagucacagcaggcaaaguacauucaaguugccugacacaaaacaaaggaacgacuucaaaaggauuuacaggaaccagguaaauguuuacaguaaagauaaagcaguccugccuagggucagcuaaugacagguaaggauuucacacccuagucacaacaauuauuguugcuccuuugagccuugugaaggcuagcuagcaccaggggguucugcucuuagcagaaugccccccuauuuccuaggccuugcuaaauucuuauaugaguguaacuuuuaaguaucuggagaaucuccauuugucagaaaaauucaccaacuuacuucuaagaugcaaugcagccuggacugaagauuucuaucucagugggauucccuggcucuauuaugguauucccuuguuugggugagauuugcuacuguucuuaguaaacacucugcagaccagcucugagcuacuggcuccaucuuuuguaaugcuuaauuaguuacugaauagauaacuuccuuacugcauucuuacaguuccaagcucuggaacauuggaacaguggugggagacuuaacuauaucagaauuuaaucuuaaaaagcacuuauaauaaaauaauacuaaaagagagcacguggauccauacaccagacuaacgcagggauaggguaugaguauacagguuaaugagaacgccaaagcuccaggaggugaguuuccgugaaacucuuugccucaugaguggcuucuaggcuucucagccugucaagcagacuucacugaagggcauggcacuuagcuaagucucaguguguuccagccuuuugccuugucccaaacccauaucuacacugcauauaaauaugucuauagugcacauaaacaccuccguagugcauucaucaaugcaacuuggcuacugaacuguugaaggccgaaaacuugagagaugaaguuuucagcaggcagccccaguaggaagaucagggccagccucagcuacacccugauuuuggggccagcauuggcucugugagacuaccucaugagccagagggaagcaagucugagacugcaugccuuuuuuggcaggggugggggugauauugagacaagguuucucugcauagaacuggauguccuggaauuugaucuguaaaucagucuggcuuugaacucagacccaccugccucugccucccaagugcugggauuaagacgagaacacaccucuuuaaucugagcauguggaaggcagagacagcagaucugugaguugcaggagagccggcacacagugagucucaggccagccaggguugcauagugagacaaggcaagaucuagagauggagcagugcaguacagguggccgaggcuggccaaggaggccuggagaggagacuucugagcacuggagggaacauuguuuucuggauguuaauagggucuuguggcugcucucugcuccuggaccagagcuggaccaacagagggcaggcaagugaucaaauuugaaagaaucacagaggaagagaagaaaaaacaaauaaggaaaaaugcaaauagaacuacacuacuggguguagugaacuugccuauaaacccagguugagucagaaggauugccaauuugaaccaggcccaggcuucagauuaaaacuguaagagagcuagaagccccaacccagcuucccacuucaaaacagaucuggguggugucugggcaucggccugucugcacaacccucccgcacaguggccugccggcgucaccucgugcucucuccuuagcccuuuucucucuacucccuccaccgcagccccggggccaucccaggccaucccugcaccccgcccagccucgucccaggcaacacuuaagccugaggaugacauuuuauaccaauggcggcagcggaggaagcuugaacagucucuccagggcgcaggugauggaaccuggguguugccucggaugccggcccucaccacgcaggugaguuggaagagugagccugacgguaauaagggucacucccagugacacagaaccauucaccucuuccuuucugcuuacagacuccuccugucucugccgugaaucuugguucccaggacacccagccuaacugcacugcaccauguggcaguguggcccagccuccucccucacaggccuucuauauggagaggccaccucuuucagggcccucuccacacaucugggcccccggaacccacgggguucucugggccccacaggccaauccuuggguaucuuuugggaugcuuccuaccacacugcuaaccuccacccuugcucccuuggcuuccuuuccuguaccaccuaccucuacuucaacuaccccagcucccacccccacuccccaggucugcaucccagggcccccaaccuccgcuccaccccccugcgcuuccacccccgcuuccacccucccacuaccugacaccccccagggaccagccaucccugagcugaguagcucuauccagcccaagaaggugggccccaagccaaggagggugagcacuucgucucaccagaagacuacggugccagacacuacagcuuuugagggucccuguucacagcucaggggggcccugagccagguagugacagcucggcuguucccggacagcccggaggauacgccuccaucugaggcagauuuccggaaaguccaggccaucccuucucaagccaaaguucugcgaccuccaccugagucucggcguggguccaagacagagucccgcaaaagucaagucacccucccagcugacgcuggggauccacagccggcuacagcuccaaaggcauccacucuguuagagguccaaccacgugaauucaagaugucugcacccaggaugggagcaggugaccccuugaccauuguccccccugccucaagccacgccccuuccgaggacuugcuaucccaggccaccaaacuucuacaggcugcggaaggugagggggauuccugggcccuuggguaucuugaugguggacccaaacccuguaucugccuucuggagcucagucuuuuauuccccagacucggacggcagcgaguuucaggaagauccuguguugcagcugcuaagggcucagagggcagagcuccggcagcagaaaaggugacucuucaucaccaggagucacaauacuggaccccugaguccugugacaucccuauuuggugccugucucuuccaagucccuuuccugaaccccucacccgcuguugcagguucuuauugugagcgcaugcuucagccucuaccucuccccacuuuucuccaggaagguggaugcccaguuaucucuccucuuggaccacacuaaagacccgggaucuucgucuccucuagccaggucaccuuccagguccucaagaaugcgguugaggagggaaggaaccucccuugaguccagacgacuuugaauuagaaaaauucugguuuuuccugggcugaggagauagcucagugggcaaagaacuugcaaguguggaggcucgaguuuggaucuccugaaccugcauagagguagcggacaggccagcuggcccauggagauggacggggcucaauccagguagaaggcaaagacgaaucucugaaauucucugacuuccacacacgagcuguggggcacauacacacuacaccacacacaacaccacacacacacacacacacacacacacacacacacacacacagaguaaaaauaaaguuguccccaauuaac

SEQ ID NO: 3697 - RNA, 3362 nt, Mus musculus
gcccaaacugugugguaucuugggaguuguaguucuccugagauugggcgggagacuucaggcucacguaaacccguguugccuucccaggccuccuguggucucugaaagaggaccaaccucaccugcagucaguuugucggcauuuaccgcagccuuagcgccagcggagcuucuucgcggaacaacccugcgccuacucuccucgcuaagcaacgccgucagccccgccccuuucuggcugugcagaguaggagcgcggccuccaaagcgaccaaugauagacuagaaaauaaaaguaacuggaaagcggccgaggggcguucucucuugacgaacugggagagcguguguuugauuggagcgugcagcaguaauuggcaagacuucagaccaauaguaaggaucaaaggccgggcugacgcuugaagagcgcuaagaguccugccuuuuacucaguccuuauuucuaaccgccaggauaccuguuggagcgaaggccugacuccagccuagcuacuauugcagggcuaacccgagacgucugucuuuacuuugacugcuaucccguccugauggucaccuuaaccacuuuccucuugagcagcuggccguacuccuugccaggcccgggcuccuggcccagguagugggaucaaaacgagcuauuucgggccccggcgcgcagcccccgggggccaaccuggaguguucaugcucaugcccccuggccgcugagcaccccaggcugagucagaggcacagaauuaggcccgaccuacucugggguagggucuguucuguguccuccugacugccuggcaugggugcagcauucuccaggagucuguuacuaagacugaugcgucauccucagagcugccagccuggcggagauggauuaagaggacugagaacucuuugggggacuaaucgggacccagggucccaacugccacaaugauugccacaccuauaagggucugccuccuagacuuuuagcuuccccuuacagaaauggaaaaaggcuuaaugacauuucccugguguccuuuuccgggcauccagcaggcguuuaauaacuggccaaguaauuauugaaguuucuaaauaaggaauacuaaugccugaguuuggccucaaucccagugucccugagaggcccgccgcaggggcggcacagggcacaguauaaaucggagccagcgugcguuugggcacugcggggcccaggguggcagcguaggaacaggauggagauccccgugccugugcagccuucuuggcugcgccgugcuucagcuccuuuaccagguuucucugcuccgggacgccucuuugaccagcguuucggcgaagggcugcuugaggcagagcuggcuucacugugcccugcugcgaucgcccccuacuaucugcgcgcccccaguguggcguuacccacagcccaggugccaggccuagggagagggccaauccaacuacuaacaagacugggggccaggaggggggucuaaccccgggccgggggugcgggaaugucuguugauuuuuaacuuagaggagaaugucaccccucaguggggccauugggugucccuugagugcgguauucugagccccuccccccccccccccccguuacugaucuucugagggggugaaggguggggcaagugagccgggaaucugggggaaaggacaagugagucccgacgggcuguaauguuccuaggguugcauauggugaugcugcaucuucaagagggauccugugauuugaugaagggggucuugggcacucuaaacgaggggaaaguacccguaaagggcacaggaggucccaugaccuaaguaagaacucuggcgauggggaaguggcaucuugguugcuagcaugguggggucucguagcagaaauggugacuguggagucaaggacauggggugggggguuauaggguagauaucuaacuugguuaccacaaagagguggacccaguauuugaaggggaggggggccaguuauuaugaggcugagguucuggugacuuagaggggacagucuacacaaguccucggcagcagcacuguaaccuauguaucauagagagugcugggucccagaagccaagaccccuauccgaucgacgccccaccccuacccgccaugugugcagguguccacggacucuggguauuuuuccgugcugcuggaugugaagcacuucuugccagaggaaaucucugucaaggugguugacgaccauguggagguccaugcucggcacgaggagcgcccgguaggucugcaugccagacuggggagcgggguaggcaggaggguaggagucucaagcccaucucucccuguaccccacccucaggaugaacacggauucauugcucgagaguuccaccgccgauaccgccugccuccugguguggacccugcugcugugaccucagcacugucuccugaggguguccuguccauccaggccacaccagcgucggcccaggcccaacuuccgucaccaccugcugccaaguaggggucccagcugcacaggaccgaacccaggaagccucuuuaggcucucuuuuaaaagccgaucugacuccacugcccagccagaugucccaaucgccgucaagacagccuuucccaaccacaccuagauguccuucggagaccuuuccaccccuaagccuaccugagcccuaguaaccuagacagccucccuaagcccucucccagcuuuccggcccgacccaggacaccucucuagggacgcuacugucaccccucagucaaggcucccaucaaauugaccccacuuugggcuucuaucaccacgcaggccuccuaccgcacuuguaaccuguguagaauaccccaaggugacaccagaguacaguguagucaccuaauucuccacauggagaaacugcaugggcuuuccacaucagaacauccaagccuaguccaccaguccuacccacuaguccuguucuuguaacauaaugcuccucugcccagcccacuuucagacuuaaaacuccaggcaccuaaauucuugaauacuauucugacuuccaauucuugggaaaacuauucccaacuaaccaggaaccccaaacucaaacuguauggacacuucaacuucuccagaugugcuaggccaaugaacaagaacccuugaguuccucuguccuggcugcccaucugcagccagaugucuuagggagccuccuucacaucugccauucucuaaggucacaccuucacugccaacauuucccaucuccgcaggccuuccuaccaucaguccccaauaaaugcacuugagauuugucaac

SEQ ID NO: 3698 - RNA, 3362 nt, Mus musculus
guugacaaaucucaagugcauuuauuggggacugaugguaggaaggccugcggagaugggaaauguuggcagugaaggugugaccuuagagaauggcagaugugaaggaggcucccuaagacaucuggcugcagaugggcagccaggacagaggaacucaaggguucuuguucauuggccuagcacaucuggagaaguugaaguguccauacaguuugaguuugggguuccugguuaguugggaauaguuuucccaagaauuggaagucagaauaguauucaagaauuuaggugccuggaguuuuaagucugaaagugggcugggcagaggagcauuauguuacaagaacaggacuaguggguaggacugguggacuaggcuuggauguucugauguggaaagcccaugcaguuucuccauguggagaauuaggugacuacacuguacucuggugucaccuugggguauucuacacagguuacaagugcgguaggaggccugcguggugauagaagcccaaaguggggucaauuugaugggagccuugacugaggggugacaguagcgucccuagagagguguccugggucgggccggaaagcugggagagggcuuagggaggcugucuagguuacuagggcucagguaggcuuagggguggaaaggucuccgaaggacaucuaggugugguugggaaaggcugucuugacggcgauugggacaucuggcugggcaguggagucagaucggcuuuuaaaagagagccuaaagaggcuuccuggguucgguccugugcagcugggaccccuacuuggcagcagguggugacggaaguugggccugggccgacgcugguguggccuggauggacaggacacccucaggagacagugcugaggucacagcagcaggguccacaccaggaggcaggcgguaucggcgguggaacucucgagcaaugaauccguguucauccugagggugggguacagggagagaugggcuugagacuccuacccuccugccuaccccgcuccccagucuggcaugcagaccuaccgggcgcuccucgugccgagcauggaccuccacauggucgucaaccaccuugacagagauuuccucuggcaagaagugcuucacauccagcagcacggaaaaauacccagaguccguggacaccugcacacauggcggguagggguggggcgucgaucggauaggggucuuggcuucugggacccagcacucucuaugauacauagguuacagugcugcugccgaggacuuguguagacuguccccucuaagucaccagaaccucagccucauaauaacuggccccccuccccuucaaauacuggguccaccucuuugugguaaccaaguuagauaucuacccuauaaccccccaccccauguccuugacuccacagucaccauuucugcuacgagaccccaccaugcuagcaaccaagaugccacuuccccaucgccagaguucuuacuuaggucaugggaccuccugugcccuuuacggguacuuuccccucguuuagagugcccaagacccccuucaucaaaucacaggaucccucuugaagaugcagcaucaccauaugcaacccuaggaacauuacagcccgucgggacucacuuguccuuucccccagauucccggcucacuugccccacccuucacccccucagaagaucaguaacggggggggggggggggaggggcucagaauaccgcacucaagggacacccaauggccccacugaggggugacauucuccucuaaguuaaaaaucaacagacauucccgcacccccggcccgggguuagaccccccuccuggcccccagucuuguuaguaguuggauuggcccucucccuaggccuggcaccugggcuguggguaacgccacacugggggcgcgcagauaguagggggcgaucgcagcagggcacagugaagccagcucugccucaagcagcccuucgccgaaacgcuggucaaagaggcgucccggagcagagaaaccugguaaaggagcugaagcacggcgcagccaagaaggcugcacaggcacggggaucuccauccuguuccuacgcugccacccugggccccgcagugcccaaacgcacgcuggcuccgauuuauacugugcccugugccgccccugcggcgggccucucagggacacugggauugaggccaaacucaggcauuaguauuccuuauuuagaaacuucaauaauuacuuggccaguuauuaaacgccugcuggaugcccggaaaaggacaccagggaaaugucauuaagccuuuuuccauuucuguaaggggaagcuaaaagucuaggaggcagacccuuauagguguggcaaucauuguggcaguugggacccugggucccgauuagucccccaaagaguucucaguccucuuaauccaucuccgccaggcuggcagcucugaggaugacgcaucagucuuaguaacagacuccuggagaaugcugcacccaugccaggcagucaggaggacacagaacagacccuaccccagaguaggucgggccuaauucugugccucugacucagccuggggugcucagcggccagggggcaugagcaugaacacuccagguuggcccccgggggcugcgcgccggggcccgaaauagcucguuuugaucccacuaccugggccaggagcccgggccuggcaaggaguacggccagcugcucaagaggaaagugguuaaggugaccaucaggacgggauagcagucaaaguaaagacagacgucucggguuagcccugcaauaguagcuaggcuggagucaggccuucgcuccaacagguauccuggcgguuagaaauaaggacugaguaaaaggcaggacucuuagcgcucuucaagcgucagcccggccuuugauccuuacuauuggucugaagucuugccaauuacugcugcacgcuccaaucaaacacacgcucucccaguucgucaagagagaacgccccucggccgcuuuccaguuacuuuuauuuucuagucuaucauuggucgcuuuggaggccgcgcuccuacucugcacagccagaaaggggcggggcugacggcguugcuuagcgaggagaguaggcgcaggguuguuccgcgaagaagcuccgcuggcgcuaaggcugcgguaaaugccgacaaacugacugcaggugagguugguccucuuucagagaccacaggaggccugggaaggcaacacggguuuacgugagccugaagucucccgcccaaucucaggagaacuacaacucccaagauaccacacaguuugggc

SEQ ID NO: 3699 - RNA, 1757 nt, Mus musculus
auuuaaaguuaggguccuuuauuggggcagaugggaaaugagaaacagaugucuucagggucugagggaaagccuagagcagagaagccuucauccugggagaaagaacagaucagcagcuuaugaaguuguuagggagugcccaggggaauggugaaggagagguaguccccaagagcgccccagcggggccgguagaucuggaagauggugauccagguggcgagaaugaucacccagaagaggaagcccacagcugagcgccaaacaucuagagugaagaacaagggugagagaguuggccuccagcugcucuggggggagcuggacccacccaggacagcccguucaucucugacacagaucuccuagaguucuggagccuccaucaucccuuccaaaccacccaaccacccacugucuuuuuuuuuuuuuuuuuugcuggugcccuagaacucacagccuuugauuuggcucugcucuguguaggcuggggcgaggaacgccucucugaagaaccagaaaauguugacuaaccaaagaaaaggcaggaacgcaaauccaccuaggaaaaagaaacccacacuuagucaaacgacaguaaagagcuuuccuaaucuccaccuuagaaaaccuauuuggaagguccucucccacguuuaacuggagauccuugcuguuaggggaugugggguucgagcucuaaucuaaggacugucuccucccaggcguucgcucauucuuucuuccugcucauugggacugugauugagagaccucaguuuccuccuuccugaagccucccuucucgcggacuagagucugcguucccaguuguguucccacgaauccaggcucauaugcccucuugccuugggcgcucuaguccuauccccucuauuacccccgaaaccuuaggggaccggccuuaccaagauaguacuuccggcacagguucaacuucuccucauuggauacccgcuccaaguucauaguugcgcuggagcccggugguccuaagggucugcagagcaagacccaaaugacagacgcaagaucacgagcaaccacgccccuauuacgauaaauuagaggagcguuggcuacaggaaggguaccucggaacaggcucgugggacgaggaaguucccuaucuagcuaggguauaccagacgacucucaacucaccagugcgguuuaucccuucugccuggauuccuuugcgggagauuugcgggagaugccgcaguuuucaguggaguuuguugucgcuuuuuuuuuucuucuccugcccagccccccucgcaccccacccccuccgcuacguuguacgcaugcgcucccagaaaaacacgcgcuugacggucgaggacgguccgcuggccucuaacacgcgugcgcaguaguaccacaggcagaaacuacacuucccaacgcuccuaagcaacggaagugacgcaaggagcaggcgcguuggaguguucggguaaaaauggcugaauauuuagcuucgauauucgggacugagaaggacaagugagaauggugaagggaguagccucucagggagccggggcacuugggucccuacgggcuggacggacaguguucgugggauacccggccuucccggccuucgguuuaccucugucuuugcaccucuuccaggguuaacugcucuuuuuacuuuaagauuggagccugccggcacggggaccggugcucccgacuucacaacaaaccgacuuucagccagg

SEQ ID NO: 3700 - RNA, 1757 nt, Mus musculus
ccuggcugaaagucgguuuguugugaagucgggagcaccgguccccgugccggcaggcuccaaucuuaaaguaaaaagagcaguuaacccuggaagaggugcaaagacagagguaaaccgaaggccgggaaggccggguaucccacgaacacuguccguccagcccguagggacccaagugccccggcucccugagaggcuacucccuucaccauucucacuuguccuucucagucccgaauaucgaagcuaaauauucagccauuuuuacccgaacacuccaacgcgccugcuccuugcgucacuuccguugcuuaggagcguugggaaguguaguuucugccugugguacuacugcgcacgcguguuagaggccagcggaccguccucgaccgucaagcgcguguuuuucugggagcgcaugcguacaacguagcggaggggguggggugcgaggggggcugggcaggagaagaaaaaaaaaagcgacaacaaacuccacugaaaacugcggcaucucccgcaaaucucccgcaaaggaauccaggcagaagggauaaaccgcacuggugaguugagagucgucugguauacccuagcuagauagggaacuuccucgucccacgagccuguuccgagguacccuuccuguagccaacgcuccucuaauuuaucguaauaggggcgugguugcucgugaucuugcgucugucauuugggucuugcucugcagacccuuaggaccaccgggcuccagcgcaacuaugaacuuggagcggguauccaaugaggagaaguugaaccugugccggaaguacuaucuugguaaggccgguccccuaagguuucggggguaauagaggggauaggacuagagcgcccaaggcaagagggcauaugagccuggauucgugggaacacaacugggaacgcagacucuaguccgcgagaagggaggcuucaggaaggaggaaacugaggucucucaaucacagucccaaugagcaggaagaaagaaugagcgaacgccugggaggagacaguccuuagauuagagcucgaaccccacauccccuaacagcaaggaucuccaguuaaacgugggagaggaccuuccaaauagguuuucuaagguggagauuaggaaagcucuuuacugucguuugacuaaguguggguuucuuuuuccuagguggauuugcguuccugccuuuucuuugguuagucaacauuuucugguucuucagagaggcguuccucgccccagccuacacagagcagagccaaaucaaaggcugugaguucuagggcaccagcaaaaaaaaaaaaaaaaaagacagugggugguugggugguuuggaagggaugauggaggcuccagaacucuaggagaucugugucagagaugaacgggcuguccuggguggguccagcuccccccagagcagcuggaggccaacucucucacccuuguucuucacucuagauguuuggcgcucagcugugggcuuccucuucugggugaucauucucgccaccuggaucaccaucuuccagaucuaccggccccgcuggggcgcucuuggggacuaccucuccuucaccauuccccugggcacucccuaacaacuucauaagcugcugaucuguucuuucucccaggaugaaggcuucucugcucuaggcuuucccucagacccugaagacaucuguuucucauuucccaucugccccaauaaaggacccuaacuuuaaau

SEQ ID NO: 3701 - RNA, 4664 nt, Mus musculus
auacuggcuucaagggaaacuuuauugauggaguaguaagccccagcaaacucugacucagccaaguuuagauagcaccugcagagcaucugugcgaccuagcugagccaaauaugugccgaauugacccagaguagcagaaggcucccuugccacaaccaucucaaucagggcccgcaggggugagcgacugggccgaagugaguaggcgaagguagaccagguggcaggcagcccguaucuugcagccaggugucgugugguaccauaagccgugcucccgcucggcccaggcucaggguccaauagcauaaucagcuccuccagaacuuccagcucauccagcaggagggagaggggcugagaggccagacccugaagcucugcaaggccagggaggugagaguaggaagaggaagcuuggaggcuacccucccucccggcagggcugucuuauacuaaccccagcuugagagcugcagcagauuagcuuucccucuguuucuacuuuccaauaccuccaggguaccugggcagggccaguaauguagagaggugcugggaucuccaaaagcugagcuggaaccaggacgggaacggacuuuucucuugaacaaagagagcaagaccacugccaauaucagaagcagcaccagcaacaguggcaacacugccagaggcagcacugaggcugagacaaaaccuggucggcuggagaccucauucuugguugucugcccaaggcuccaccucccaggugagcuagaggcaccugcgucuucagguuuaagaggacagacauccuugggagggacgggcuucugggaacagagguuugagagugaaacaagaggacccuuuagcccaagccucccaucccuuaggucccuaaauggagcucccucuccucucccugccucaucccccccuuucaggcacuccacuuggggugaggcucccccucugacccaagcuuuacccauggaaccacaggcaagcccugacucauaccccaggagucuagcaccuuucuacacugcuuguggguucuaccagggcucuccacgugagcuggggcugcggcggcuccgcugcuacacuggcuacacagcucugugccauugggguugcaauacccaggggaacacuuuuugaaaggaugugcuacaguaucgccgaagucauugagcccgcaguuuuccgugaacucgugaucuaguaggagacaauggagcauaggcucucccacuaaucccacuagaccaucccuuuucaaacccccaugaggacccuaccccuucccccaucacucuaccaagcccugcccucacuauaaauaaagccuaccuaaguccauucuccccauguccuccacucagagguaaaguuugcucuugguguccccauuguaacuggucuuuucugcacaagcuuaaccuguguccacccccacagccuuaccugccuaagacccagcacaccuacuccccaaagaagccuacugcaaggccggcaacaaccuugccacuugcuagcgucccuguucucuacaccaucuagugcacacccagucacugcucaccaggacaugcaggaggcccaaagcguugcaggcagcggcugcagcaccucuugucagaguuccaguacucaagguggccacagaagcuagaggcuuccauugacgcagcccgggucaggagcagcacugccaccgccacuguccagagaagccagcugggccccaucucagcagagccugcagcuugagggcugugaccacuuccacccacacuguuucugcagcacauuccaggaaguccaaggcagaagaaagcgguggaugugggggucacagacuuccagaaccucuuugggagcuggcgugucucauacccaacuccaagcccacaaggcguauaaagaacuugauguggaucaccagauuauuuguaaccuuacauaccugccuucucauuuucaucucuaagaugggguaauagaacuugucucacugggugaaggcggugugugugugugugagagagagagauaauaaaucuacuuaaaagaucacaauaggcguaguguguacacuucaaucucagcacuucaaguacaggcaggagcaucucuuggaaaccugaggccaacaugggcuacauaacaaguaccaggccacccagagcgagugaaacucugcuucagaaacaaaacaaacaagccagacaccacaguaccuagcagagaguaaacuuaguucaaaguuuuauaaguguuaggaauuauguagugccuucauuucggggugguaugguggguuucaauuaccaggccuaaccuacuguaaacucucaccaguaccuaagcaccucuccuuuucuaacuuccaucucuguuuggaauccucuggccugucacaaacaggcaccugucccuaaaaggcaccuagaauggauaaucugagguuacagguauuaaagcagccccgacuuaccagugcagacccagaccccaagcuggcuccaaguuccucugcugagacugugguuggcuuacacccuuucuuagguguggggguggaaggaaaccacagaccuugauugacaaacuucuuaaccuuuauuggaggagggacaggaggaggagguuccugugucgaacagauuauauuaugaagcuccgaagccuggggaugcugggacuggagagugaagggcacuuugaaaagggacgcuggacaggaacaucuaugcccuuggguggagagcaagggcacccgucucagaagcgaccaugccgguggucuggggaacgacgucgguuccuuucucggggacggugaccugugugggaccuuggaggugaccuaagaauuaggaagaggaguggacagagauggguaggaauaguuaagaguggucaagauuuuuccaggccugucucuuagggacagguggcugguaaugucaucugaggauugguacucagggacagguacccaagcuggggguggauaugggguuuacacuguuugggacacuaagacuaagguacuucuacccaggcaaggcucaaaacucuauuuaaagcacaagagcccacaaguuagcaucagguucauccuaggguacaggagaacacagcacccugggucugagguaccuaugccuggguccucgcccauagagcugccggcgcaaguuccgagauaugggccguaggugcauaaaguugcagaagccaccucgggugcauucccuaaagacagagaaggccaccaucacuaagaacucccuaucaaacacucaagcuucugggacucugaugcccaaccuacuuuuacacuaccuuaccccaucucauacugccggcagcaggacucucggaagucagugacaggagacagcucggcaugcacagccugcccguugaaccagcgguuauugaguuccgcuacagcccgcucugcauccuccucccgccggaacugaggggaaagugggugaccaugggcuguggaauucaagaucuucaggggacuagucagcucugaggcuggacucaacuuaucgauaguccucagguugggagguuucagugguggccauaggcacugaaauguuuccacuucuggguucuaagcagggggcaacaggcaccuuaacguagacauugcccacgaggugguccccgagguugucacacacauucaucucuucaaucucuccauacuucuccugcaguucugugaauaccuccugcagaagauggggagaagcucagcuaaggucuggcacacaggaaacccaguuacccuggcaacccucaccucaaagaaguuaucauaguguucuugcaccuccacgucgcucacgugaccuggaggagggauggagggugaaaugagggcguaaacugcuggggcugucugcccagucccugaacuaucuagccuuuuacucacagugugauccaucugcaguuugggcuguguucuguggauuccgguacaaguugagcaggacuauggucugaacaaaauuuaaaagagaccugagcucagacagaaagcagggcugcauacagugugaguaugaaguuggggagagagagaugugagccaguagagucagagacgccaaaacuaccuagccagccagggggcguggccgguguucaugggaggcgggguccagucccggggaagaagggucugucuacccagaggaccaggucagaaagcaaagagggguaggauuggcuuuagaaauccggaagaggcgggaccccgagaugauggacagcaggugaagcgcggggaggcuugaaucugggucucaccuggcugaaagucgguuuguugugaagucgggagcaccgguccccgugccggcaggcuccaaucuuaaaguaaaaagagcaguuaacccuggaagaggugcaaagacagagguaaaccgaaggccgggaaggccggguaucccacgaacacuguccguccagcccguagggacccaagugccccggcucccugagaggcuacucccuucaccauucucacuuguccuucucagucccgaauaucgaagcuaaauauucagccauuuuuacccgaacacuccaacgcgccugcuccuugcgucacuuccguugcuuaggag

SEQ ID NO: 3702 - RNA, 19893 nt, Mus musculus
cggugccaagauggcggcggcggcgggcggcggcaguugccccgggccuggcuccgcacggggccgcuucccgggccggccgcgggguuccggcgggggcgggggccgcggcggccgaggcaacggagccgaaagagugcggguagcccugcggcgcgguggcggcgcggcggggccgggaggagccgagcccggggaggacacggcccugcuccguuugcugggucuucgccggggccugcgccggcuccgccgccugugggcuggugcgcgaguucagcgaggccgaggccgcggccggggacggggcuggggcccgaaccgaggcugcaugccggaggaagagagcagugacggggaauccgaggaggaggugaggcggucggaggugucucuagcgccggguagggcggaggccaggggcuugcagggcuccggauagcuccgaaggguguuguggacaagugggauucucggggcuccuggaaagaagcacgaaggaagcaggcugcguggagcguuuggguagcuagggccuuugaaagugaucagagaaacccugacugcagcuagacgccuggagcccaauugguguccugagcugaucuuucgcgguagcaauggcagagcaggacaggagugggugaagaggccauagggauugcaugccggaccagcggugguugacagcagcagcguggccuuaauugaccaaggcuagagagccuccugggcucuuacuugcaggcugccuccuuggcccuuaaaauccgcgacauaucccugcccugguuccaccagggccccaguugcucucugguucuaagguagagugguggaggcuucuuaggcgcggguugaagagggauagaaugaaugcugagucuugaaucuggagugagugcagucaugguuuaucccucucagccuuuuggagaaggcaggaggguguggauucuauugcuuaggagagcuagcuguccucugagggcucagaguggauucuaauaugauaaaccaucugcuccaccucucaucucccccaaacacuccccauuuuuaagaaugcccugcaaggguguaaauggaggaccuacuuuguuuuaaguuggaauuagcccucauuguaaugccuauugcuuaacucgaggagacccucuaguguuuucuucugggcuagugaauuacugauggcugugcuggaauggucugguucaagaacgccuuguaccuuuauuccuucugaccuugccucagucuuuuaaguucuuugguaaaugaggaggaguauguuaagguggacgauaacuaucauaucugcaacaccugaagcccagauggaaccagggcuuugguacugacugcuguuucuccccuucacccuugguccccuaaaucaggaguuucaggguuuucauucagaugaagauguggcccccaguucccugcgcucugcgcuucggucccagcgaggugagugauggggaaacucuaccucucuaguguugcgggaagguucuugcccuuuguguucagcuagucucuaccaguuacugaguguccuguguucaguccaagguagccugggcuguggggaaaaacagacaaguaagacuuaguauccugucuuucuggggugcuuuucuuaagacugaagggccaguuugacccaucuccccacaacuguucuccuuuuaggucgagccccucggggucggggccgcaagcauaagacgaccccccuuccuccucgccuagcagaugugacuccuguccccccaaaggccccuacucggaaacggggugaggagggcacagaacggauggugcaggcacugacugaacuucuccggcggucccaagcaccccaacccccccggagccgggcacgggcacgugaacccucuacuccccgacggucucggggaaggcccccaggacggccagccggucccugccggaaaaagcagcaagcaguaguguuagcagaagcggcugugacaaucccuaaacccgagccuccgcccccugugguuccaguaaagaacaaagcuggcaguuggaaaugcaaggagggaccugguccaggaccuggaacccccaaacguggaggacagccugggagaggaggccguggaggcaggggcagaggccgaggcggacuuccccuuaugaucaaguuuguuuccaaggccaagaaagugaagaugggacaauugucccaggaacuagaaucaggucagggucauggucaacguggggaaagcuggcaggaugccccccaaagaaaagauggagaugaaccagaaaggggcucguguagaaagaaacaggagcagaaacuggaggaggaggaggaggaggaggagaaggagggagaagagaaggaagaaaaagaugacaaugaggauaacaacaagcaagaggaagaggaggagacugagagagcuguggcugaggaagaagcgaugcuagccaaggagaaggaagaggcaaagcuuccgucaccacccuugacuccuccagucccuucaccaccuccuccucuaccacccccuucaacaucuccuccaccuccagcauccccucuaccacccccaguuucuccuccucccccacuuuccccucccccauauccagccccagagaagcaggaagagucuccuccucuugucccagcuacaugcucuaggaagaggggcaggccuccccugacuccuagccagcgggcagagagggaagcugcucggucaggaccagagggcacccuuucucccacuccaaacccuagcaccaccacaggaagcccuuuggaagacaguccuacugugguccccaaaaguaccaccuuuuuaaagaauauacggcaguuuauuaugccuguagugagugcucgcuccucccguguuaucaagacaccccggcgauuuauggaugaagauccucccaaaccuccaaagguggaggcuucuauuguucgaccuccuguugcaaccuccccaccugcuccccaggaaccaguaccagucuccucuccaccucgugucccaacucccccaucuaccccagucccacucccugagaagaggcggucuauccuaagggaacccacauuucgcuggaccucacuaacccgggagcugccgccaccuccaccugcuccuccaccagccccaucuccaccaccugccccugccacucccucccggaggcccuugcuccuucgggccccucaguuuaccccaagugaagcccaccugaagaucuaugaaucggugcuuaccccuccuccucuuggggcucuugaaaccccugagccagagcugccuccugcugaugacucuccagcagagccugagccuagggcaguggggcggaccaaucaccucagcuugccucgcuuugucccuguggucaccaguccuguuaagguugaggugcccccccauggagcuccagcucugagugaaggccagcagcuucagcuccagcagcccccgcaggccuugcagacccagcuccuaccccaggcacuaccaccacagcaaccacaagcgcagccaccuccaucaccacaacacacaccaccacuggaaaaggcccguguugcaagucuggguucccugccacuaucugggguggaggagaaaauguuuagccuucuuaagagagcuaaggugcaguuauucaagaucgaucaacagcaacagcagaaaguggcggcuucaaugccggugaguguguuacuuugagcaagucccugcacucagucuagauaaguguuuagccggacaugcaggaccaguuucccuuuuaccucccaauuguuucuacccugacccuaucccuucccucuccuauuccccuguucccacuggucuucacuuugcagccccugacccuguuaauuucccccaccagcuaagcccugcaguacaaaccgaggaggcuguggggacugucaaacagaccccggacagaggcugugucaggucugaagaugaauccauggaagcuaagagagaucgagccucgguaugcagugagaggagggucuucugaagaaggcuggcugcagaaccacauggaaccauuucccacaccucuuccugguuuuuccucucucagggcccugagucaccuuuacaaggcccccgaaucaaacaugucugccgucacgcugcuguggccuugggucaggcucgggccauggugccugaagauguaccccgccucagugcccucccucuccgggaucggcaggaccucgccacugaggguaggggacuugaguagugggaggcuugaggacaaauaagguuugugcaugagcaagaguaccagggagcugagcagaggaauuggauggggcuuagggggcagauggguugcagugcugcuaggucuuggacagaucugguuagguccagaauaccuagagucaguguggaaaagcagagggaaaguagggaaaugagguaggauaccuaguggcuuuguggcucugucuccccuccaucugcugcaauagauacgucaucagcaucagagacugagagugucccuucccgaucccagcgggaaaagguggaaucugcagggccugggggagacucggagccuacagggucuacaggggcccuggcccacacaccacggcggucacugccaucccaccauggcaagaagaugagaauggcucguugugggcacugucgggguugcuugcgugugcaggacuguggcucuugugucaacugcuuggauaaaccuaaauuugggggucccaacacuaagaagcagugcuguguguaaguagcuggaguguagccucuggucccaccugggguugucagucaccugagccucuugucccagccagagcagugggaugggcauccuuguggagagcuuccucucuucccccagaccaccagucccuacccuggugacgugcugcuccccuccccagauaccggaagugugacaagauagaggcucggaagauggagcggcuggcaaaaaaagguaauaaggcuuggagaggguuucuucacaaaaccuuacauagauagcgggguggcagaggccauguuuucuuugcuuuccacucgugccuuugcauuugacacguguccuuuuuuaucagagcuuaaaccuguccugcauuguuuguuuugugcugcacuuucuggcuuuccuuuguccuggugcccauauaucccuggcugaguucaaauccuaccaaguccccuguucccacaggccggacgauagugaagacgcuguugcccugggauuccgaugaaucuccugaggccuccccugguccuccaggcccacgccggggggcgggagcuggggggucccgggaggaggugggggccacucccgggcccgaggagcaggacucccuccuacugcagcgcaagucagcccgacgcugcgucaaacagcggcccuccuaugaugucuucgaggacucagaugacucagagcccggggguccuccugcuccaagacgucgcacccccagagaacaugguaugcucucaguuuagcaguuuguuuuaugacucuuuuccuuuuggccauucuugggguggaauccagggcccuguguguguuaagcuuagaagggacaggacuccucagucugucuaagaggguagcugggaacaaaggaggaagucguucuuggggaacacacacaguugguguguucaguacucacugaaggucuuccuccugagcccugguuggaggaagccuugggaacgaacguaggugcagauggguagaggacccggcauaggaagggucagcuguccuguguccugccuagagcugccaguacuagaaccugaggagcagagccggccccgcaaacccacccugcagccuguguugcagcucaaggcccgaaggcgccuggacaaggucagcacggcccgcuccgagaaccccaagcccugugugaggcauggcuccugcucuccaggagcuaccuggcaagucagggugaugggcacaccugagugucgugguguguccucaccagaggacagguccugagggaugaggcaggccuugccuuucuggaaagccaagugggaucugggcaaaaggcaggguauggcagguugggggaggccagugaggagaggagucugcagaggggugggguuggcaucuuuugacaaccccaugucccuccuuaggaugcuuuagccccuggccccuuugccucuuuucccaauggcuggacuggaaagcagaagucuccugacggugugcaccggguccgaguagauuuuaagguacaggguugagagcaacuuagagcaugcaguggaugaaacuucuuuauuguaaccagagcuuucaacguggaucugacuuguguuccuggcugcuuuccaauccuguguccucucuuaccccaggaggauugcgaccuagagaauguguggcuuauggguggucucagugugcugacuucugugccaggggggccaccgauggugugucugcugugugcuagcaaaggccuccaugagguuggugcuuuguccuuuuauuuuucuuaaaaaacaaaacaaaacagaaacaaaaaaacaagacaguccuggccuccaagucuccauuugccauuccugaccuggagcucucaggcagggaucaccucccggcuguccguccagccucaugcugucugucugucguuuccuuaccccuccuagcugguuuuuugccaagucugcugcgauccuuuccaccccuucugucuggaggaggcugagcggcccucaccucagcaucgugacaccuggugcugcaggcgcugcaaguucugccauguuugugggcgcaaaggccgaggguccaagguggggcacuggcagcccugggcagguagggccuggggaggggcgaccucaugcagucuccuguacacuccguuccccuccacugccugcagcaccuccuggaaugugaacgcugucgucaugcuuaccacccagccugccugggacccagcuacccaacccgggccacgcguagacggcgccacugggugagagacgagccacgucccuuaguccugcauucuauuuaaccugaccaaagcccucauagagauguagggcugcccaccacucugagacugacuggcagcaugcacauaggcaagcuguagguggacagguggucucuaggagcucaugggcucacucugccccuuucuuccuccucccccgucuuaccaucauuucuuuuuuuuuuuuuaaagauuuauuuauuauuauacauaaauucacuguagcugucuucagacacccaagaagagggcaucagaucucauuaugggugguugugagccaccaugugguugcugggauuugaacucaggaccuuuggaagagcagucagugcccuuacccgcugagccaucucaccagccccuuaccaucauuucuuguacuggucccucuccaucuguuuccuucuacccauccuccccggcucaccggucagccuguuucagccugauguccggcuuucuucuaacacacccccaccccaucccccagaucuguucagccugugugcgcuguaagagcuguggggcaacuccaggcaagaacugggaugucgaguggucuggagauuacagccucugccccaggugcaccgagcucuaugaaaaaggugggaccuggcagcagaaagggcuugggggacugugguagagugggccgggcucuugcaccaaaaagaggagauuuuaguagcguucugccauugagcugcagaacuuuuccugugacucaguaguguucaaccaaagcuaacgagcacagagcagagcccucugggaguagugcagcuacagagcuuggggacccacucauuuucuaauaucccuccuggaagaaccccuagguuuccacugggccgugugaagaagaccugcacugucugcacuuauucacccauacaaugucagggcuacagagaaaacaggcuuuguccacauacagcuuuuuggacugaaggguguaggggugacaccuuguguagcugucagaugauguauacagccucugcacaugacucaggcguuggucaguccuggcugcuuugacuuuugccucuuacuucuucccccagggaacuacugcccaauuugcacacgcugcuaugaagacaaugacuaugagagcaagaugaugcagugugcacagugugaccacugggugcaugccaagugugagggacucucaggugagaagauuaccacagaguuacagguucagcccucuggggacccucuccccaccacaggccuguagggugacaugugcacuaacuguccuugggccuugggggcuccugggaaccccuacaucuuuccaauccauugucuccuuugucauugacuguucuagaugaagacuacgagauccuuucuggacugccagacucaguguuguacacgugugggccaugugcuggggcgacacagccccgcuggcgagaggcccugaguggggcccugcagggaggccugcgucaggugcuccagggccuguuaagcucaaagguggcaggcccauugcugcugugcacccaggucuggagggccccagacgcaggguggguggaguugggcucagcccuagcccuucugacuucccccauuugcagugugggcaggaugggaagcagcuccacccaggacccugugauuuacaagcugugggaaagcgcuuugaggaaggucucuauaagucuguggugagugagacaugggaaggagcagguggcugccgugagcagaguuaggcuggggugaaguuugggguaagggcucagaugcuaagaaacucaccuacagcacagcuucauggaagacguaguggccaucuugaugaggcauucagaagaaggagagaccccagagcgccgggcuggaagccagaugaaaggacuccuacugaaggugagugcuggcguggugccugaaggguggcuugagcauugguggagauagggaggggaaaagaguguguccuucagacccugcccccaucuauucucgagggaaggcugcucuucucauccucuuaacccauuucccagcugcuagagucugcguucugcugguuugacgcccaugauccuaaguacuggcgacggaguacacggcugccaaagugagcagggaugaguagcuggagggggaccaaggagugaggucagaagcaagggcauuugggauuccggggaugaggcugggauaagggguaaggcucaggucaaggcugaagagggugguagagccagagugagcguuccucauuacuucuagacuagcaaagauggcgcaugugcuguuggcucuuuguuucuacuuuuugaaagcuguuggggagguuaggcaggcucugaugauggcccagguuggucagaguggcgacauggaagcccaagagguuguaagagccuagauacguaagaggagaaaguacccuggaagggaugacaucugaacugaugugggguggagaacagcacauauaacuggcacagaggagcuuggcuucuuugaggggaguguggggggcgggagagagaaauccaugugagaaaggaagaaaggaaccauggcauguaaggcuaugucaugggaaggcuccagcucaaccucuaauccugucuccacagcggagugcuccccaaugcuguguugccuccauccuuggaccaugucuaugcucaguggagacaacaggaaucagagaccccagaaucggggcagccuccaggggauccuucagcagguagugggaaacaaggcugaacccugauuguugugccaugcccuagauucugacucuuguagauugacuucuauauccucugcagcuuuccagagcaaggacccagcugcuuucucacaccuggaugacccucgucagugugcacucugucucaaguauggggaugcugacucuaagguaaaggcuacuaugcagagcucuagguugugggguccaguccugggaacuuccccgugauuccucuccucuuugcccacaggaggcggggcggcuccuguacauugggcagaaugaguggacacaugucaauugugccauuuggucagcugaaguguuugaggagaaugauggcucccucaagaacguccaugcugcuguugcacguggaaggcagaugguaaggacgugggcccagaaaggcgagcauuucuuggggucacagguuggcacuuccuucaguguggaacuaaccuaauccuuuauuaaaugaugaucucugggacauguccuuccauuccacugcucguccuuguuacucuuacuguggugcugggaauugaagucagggccucacauaugcuaggcaagugcuuuaccuuuaagugguguuauagucucugcccccaccccccaaacccccuuuuuuuaaugggacagugacuaaugagcccuagcuggccagguacucauggugcccaaucuaauuucaacauaaucuucccgcuuuugcuucccaagugcucggauuguaggugugugcccugaaucuggcucccuuggugcccauuugguugucucaagacccuggcacugaugacuggcagcauccuuucucuagcuagaucuaggccuguauucuaagagauggaauuuacacaccuugucuacuguaccucugaaggccaccuuccauacagugucaucuuucucucacuaggcagucaagucagcuucagaaucgcucucagccaggcgagacacacaucuuagucccaguacucugagaggcagaggugggaugaucucuugugucuugugaguuugaggcuagccuggucuacguacagaaugaguuccaggacagccagggcuguguagaaaaacccugucucaaaaaagaaagaauccuucucacugugugcuccuggguggaguccuggagaagaccuacacuggcaggggcggugaggacgaguguaaagaaggugacaaguaccaaugaggaagagcugauagcuuucucaagaccuugcucuauguuccugagguaguuugugugugcuccuggcccugggcauagcuaggaaagggguuucccuucuuaccuaggcuguguagggugcugggccagccagggccugugcaguauugucagugaugcagagccacauaguucucaccucagcagccccuuccucccacagcgcugugagcucugccucaagccuggagccacaguuggcugcugccuguccucaugucucagcaacuuccacuucaugugugcccgggccagcuacugcaucuuccaggaugacaagaagguuuucugccagaaacacacagaccuccuagauggcaaggugggccaggaugcuggggauccacugcccucuccccuagcaucucgggcuucccugaggucauguucugaggucagaacuuugcccucgugcucccccaacccucugccaguccagcaacccccauuuacuuccugccucccaggagaucgugaccccugaugguuuugauguucuucggcgagucuauguggacuucgagggcaucaacuucaagcgaaaguucuugacuggacuugaaccagaugucaucaauguacucauugguaagccucuugcucucuuacauacugcuucugaccuuaccuggcacuacccuacuugaccucuccuuuguaccauaggcuccaucagaaucaacucccugggcacccuaucugaucucucagacugugagggucgacucuuccccauuggcuaccagugagcaccccagggcuggugaggggaggaggacuccagggcuggguguuguuucuagguuucccuaacccucuugccccauuugucugcuccagaugcucccgccuguauuggagcacaguggaugcucggaggcgcugcugguaucggugccgaauucuagaguaucgcccuugggggccaagggaggagccagugcaccuagaagcagcagaggagaaccagaccauugugcauagcccaaccccuuccucagguagguagcacuuggguacuuaugccucauccccuucuccaaagggggaccucgcaaagcuguucccccaccuccauaugcuccauguguugagaaacuucaggaugaucucucgaaaugacagaaacaaugguaguuggcuuugaacuucgaagcauaccacaggggcugugcucagcauuucacaggaagugagggaagagcaccaggcuaccagccauagggaacaggaauguucacagcuggcuuccugaggccugugugcucuuguaauguuugguuggucuugcuaauaaguucauagauucugcugcauuauguacaagagaaaugguuuauuucuacaagaacaguggcacagucaggauuugggccugcaugugcuuauuuccagccuuuguguacacaagccuacagaggcuaggagugucagauccccuagagcuggauugguuaugagccauuugacgugguuucuggggcacggguugggggguuuuaguacaggacccccaaccucccuuguucuugacuuuucagagccccccaaucaugaugaucugccagauacagauucucugaucccuggagauccuguacaccacucccccauucagaaucuggaucccccgcuucggacagauucaagcaauggcccuccucccaccccucgcuccuucucaggggcucgaaucaaagugcccaacuacucaccgucucggaggcccuuagggggagucucuuuugguccucugcccucuccagguaagcacgauggguagagaaaugggcaguggugguggucaucuuugaccccaguacuuaagaggcagaggcaggcagagcucuuguggguucaaguccagcauggucuacagaggaaguuccagaacagccagggcuacagagaaacccugccuuucaaaaggaauggguagagcuagcuaggaaaccuggaguugcugacugauacugaccuuuucccucuugcaggaaguccaucuucccugacccaccacaucccuacugugggagacucggacuuuccagcucccccaaggcgaucucggcguccuagcccccuggccaccaggccaccaccaucccggaggaccuccucuccucucagaacuuccccucagcucagggugccccugucuaccucagucacagcccucacaccuaccucaggggagcuggcucccccugaccuggccccaucuccccuuccaccgucugaagaccugggcccagacuuugaagacauggagguggugucaggacuaagugcugcugaccuggacuuugcagccagccugcuggggacugagccuuuccaggaagagauuguggcugcuggggcaguggggagcagccagggagguccaggggacagcucagaggaggaggccagcccuaccacucacuauguccacuucccugugaccguggugucuggcccugcccuggcccccaguucccuugcuggagcuccccgaaucgagcagcuggacggaguggaugauggcacagacagcgaggcugaggcuguccaacaaccccggggacaggggacuccuccuucaggaccaggagugggccgaggagggguccuuggagcagcaggcgacagagcccaaccuccugaagaccugccuucagaaauuguggauuucguguugaagaaccuaggggguccuggggagggggcugcuggccccagagaggacucucuuccuucagcaccucccuuggcuaauggcagccaacccccacaaagccuguccacuagcccagcugaccccacccgaacauuugcuuggcucccuggagcuccagggguccggguauugagucuggguccugcuccagaaccccccaaaccugccacauccaagaucauccuugucaacaagcuggggcaaguauuugugaagauggcaggggagggugagccuguagcacccccaguaaagcagcccccucuaccccccaucauucccccaacagcucccaccuccuggacucugcccccaggaccccugcucaguguguuaccagugguagggguaggagugguccggccugccccacccccaccuccacccccacuaacacugguguuuagcagugggccccccagcccaccacgccaggccauucgugucaagaggguauccaccuucucuggccgauccccuccaguuccucccccaaacaaaacuccccggcuggaugaagauggagaguccuuggaggaugcccaucaugugccagggaucaguggcagugggugagugcgucucuaaggcuggggcuggcaggcuagggagguaggcaggaggaggaggacacgugggcuuucugugcugcuuuucagguucagucguguucgcaugaaaacgcccacaguccguggaguucuggaccugaacaauccuggggagcagccugaggaggaaagcccugggugagugaccggguccccucccugaggcucuggacacccccucccgguaauuuuugccuccugacaggucuuuguugacaggcgcccccaggaccgguguccuuugcugccacuugcagaagcuccuucccaggcccucgaugguuccucagaccuacuguuugagucccaguggcaucacuauucagguagagaccagcuuuuccucucaucgccuccuugugcugggcccgguggagacugacagaaccuggauugguucacucgaaacacaguacacaccaugggcuaauuggguucauuuucuaacacuagaaaacaacaacaaaaacccuacauaagcucaguguguagaaacccaaggcucggugcuaagaguuacggacuguuagggagcuccuggccucaugacagcagaauuggggcuagaaaucaguaucugggaggugguggcacuuggggagcagaggcaagugagucucuguagguuugaagccagucuagagauggaguugcaggauaaccagggccacauagagaaacccugucucaaaaacaccacaaaagaaaucagauuuaauaauguaucuuuguagcugcaggcugagccagauuugauucagauacgguagucugggcuacauagugagacccugucucacaacagaaggaaacaaaacaccaaggaaaaacaacagcucuguguacaagcucaaguggcugggcuuuaugcagcuauaggggguggaguaggggugcaucuaaugguugggaucagaguuacugucuaacaaagcuuaggucagggucauccagggaggguggagccccagggcccaaguaaggggcaggaacaggaagauuagaaaaggcugguguugccaaggccaggaaugaagcugucagcaguccaccugccacaguaagccaccagaccaggccugugaguccuagauuggcaaagggcaugagcagguggcauggggcggguaggauguugaagauagugguuggugagaagccagagcagcacccaggcagcuagccaagaaguugugcuaaggaucaggaggaguucgggcagcaggucagagagcuugaggcuaugagggcugcaacuucaaagcugaggaaagggggaagggugguggcugaggaaaagggcaugggaggauagugaucugcuuugagcaggugacuccugggaugggagagagaucuggcagguguagcuggagguuuagucacagguggguucuugagugguuuugucugcuagacuucagacuagaagugaggcucuguuggccucuggggucacucuguggagcagcugugugauuagcaggcaaacuggguuuauagugacccauccuccccagguauuuggguucucucaguacauagagguaggcucgaagcaccacauaagagccggcuggaccaaggcugccuagcugagaggcuuuggucuggcugccacuggggugugauggugaggauaacaagcacaugccugcucguggggacccagacauguucauccugcagcucagcuuagauaagcagugugagaaagagaauggggaaggacucguuagcugccccugucuguucaguagaugaaucgaggaggaguggaaggccuuggggccuggagaugagcugacuucugugguagagucaggauugucugacuagagggugcuagagagaaaggcuguggugauugauggggcuugugggucuugcuccuaugucauguucuaccccugcccugcccugcccugcccuagauacagugguuggccuugguguccacugcagaugcugcuggcagcaucuguucuccaacuucccuccuugaaauguggcuuccaggaccccacauuguccucucgccucugcucaugccucauuuuacccuuccaauuuuugugucccgggcccuuggccuuguguuugugucgcucccccaauccacuuucugggacgucaaggccuuguuccuaaagcuaccacaucacuuucugcagcccagaccuaguuggucccuguacuuggccccugcuuucugcacuugugucagauccucuuaucaaguugcacggggauauccucugagagacagcucaguuagcaugcuccagauaguccuuagccucauggcaguugauggccuccuuacuguggccaagcccacaccucaggguugcccuuacccuuuucacagauaaagccugccacaucaggaguccuguugcuuuaucuuuacaaucugugaccccuggagguggugcacaucuguaugaucccagauaaucuugagucggagaggucucaugaguccagaaguucaaggccaaccuggacaauguagugagacccugucuuaaaacugaauaaauacauacaguucaagaagucccaaaaauaguuuaugaccuuccuaaugcugugugaccuuuuaguacaguucguuauguuguggugaccuccagccauaaaguuauuuuguugcuucuucauaacuaauuugcuaauguuaugaauccuguaaauauguaauaugcuacccucaaaggaauuacaacccacagguugagaaccacugguauguaauaaauauuauguguacuugaauguguccaagcuauacauuuuaacuuguauaaaaauuuaguguauuuucagcugggguauaaauuggugauagaauguuuuccuagcacauucaaggcucuggcuucaauucuauacuccccccaauuauuuacuuauuuaacuguguauaaguaauucuccaguaucuauagaguuuuguuucagggacagaauaauuauaggguguaaugaugggcuagcuuucagugagccggcagaguccaggcguucaugcuuccaugcaugcagcugcucuaugguggaaaaguuuuuccaggccccuuagaacauucaaaucaaugccacaggacucacucaauaauugaagcaggaagaggaccaucugucuccuguauguguuugugccaaagggugggagggauugaugucagcugggaaucaggggcacuaggucuuuuuuuuuuuuuuucuucccccuuuuguuuugagacaaggccucucuauguggcucugguugucuuagaacucacuaaguagaccagacaggccucaaacucacagacaucugccucacuuugccucuggaauguugugauuaaauacaugcacugcuugccuggcagcaguggcuuuugaguccaggaaagugauccucuccuacuuuuaccuuccccauggaagcaggcgaggccucaagcucugaggaagagccuccaucuccagaggacaaagaaaaccagguccccaaacggguugguccacaccugcgcuuugagaucagcagugaugauggcuucaguguggaggcagagagcuuggagggugaguugagggcagcauagcagaggggaagaguguucauaccccauccugacuucuggcuccucauuccaguggcauggagaacucugauugagaaagugcaagaagcacgagggcaugcacggcucaggcaucucuccuuuagugguaagaaguagccccaggaauccugggagcaagggcaagguggacccuccaugugauugcuauguccuucccguccuguucucaggaaugaguggagcgcggcuccugggcauccaccacgaugcugucaucuuccuggcagagcagcucccuggggcccagcgcugccagcauuauaaguuccgcuaccaccagcagggagagggccaggaagagccaccucugaauccccauggggcugcucgugcugaggucuaucuccggucaguguuuggggagcacccaggugggaauuaagucuagaaagauugaaacugagacacuaggcuaccacaaaagucauuuguagacuucacgccagaagaguggaccccacccaucuccuguuuaguuaucuucagcccuauagucccuggugauacuggaccagaugaaagaauagcuaggcagcaucucuuugaaggaauggcugugacccuccuacuuuuuuuucccgcuccacuugcaggaaguguaccuuugacauguucaacuuccuggccucccagcaccgugugcuccccgagggagccaccugugaugaagaagaggaugaggugcagcuucgguccaccaggugugcagauaaguuaggguccuggaccuggucagaaaggguccuaaaggggaguugacuggauaccaacuuaugugguauuuugucccauaccagacgugccaccagccuggagcuuccuauggccaugcgcuuucgucaucucaaaaagacauccaaagaggcugugggagucuacagguuagugggguuguggggugccccuuggguggacagauaggagccaugacgaggagcugacuggugucugucccccauccccgaguucacugugguuuguucugucccgcagaucagcuauccauggacgaggucuguuuuguaaacgcaacaucgaugcgggagagauggucauugaguacucuggcauugucauucgcucugugcugacugacaagcgagagaaguucuaugaugggaagguaaguggcgugaagguuugaggugaguggaugugggcugaccuugacagagaacuaauuccuucgucccgugcuguaggguauugggugcuacauguuccgcauggaugacuuugaugugguggacgccaccaugcacggcaaugcugcccgauucaucaaccacucaugugagcccaacugcuucucucgugucauccauguggaaggccagaaacacauugucaucuuugccuugcgccgcauccugcgaggugaggagcucaccuaugacuacaaguuuccuaucgaggaugccagcaacaagcugcccugcaacuguggcgccaagcgcugccgucgcuuucuuaacugaggccauggcugcccggauuccucacgugcccgcugccaucucacccuggccuguggcucccuagucucaguaucucacuccuaccuuccuguccauggugaaugugggcauguaguggggcaggagucugccuucaccccuccugccuacccagccauugccuccuuccuccuucccuggggacccaggauguagauauuguacaaagguuucuaaaucccuucuuuucuaugcacuuuuuuauuuaagagggcggggucccaggugggaauccccccacaauaaagucugucagcguuuggagagguggucuuuccgugccuuau

SEQ ID NO: 3703 - RNA, 571 nt, Mus musculus
agaggggaguggccaaaauggcugaguuaugagaaucugaagugggcaaagcucgggggcuagagagauucgguguaggggcgggguaugccaggcaggcaggaugacucuguaagagguuguugugagaagggccugaaggaaccuagaagcuagcauagaccucgauaugccaauagacgccaccaaaggcauagauuaauggaagaguucuaugucccuucugccaaagacgaggagaaugaccacuuuuagcaaguaaaaacgauuuucuuaagucccugagagaaugauggguuuugucuaaaagcccgaguuugggaaaaggaaauuucuugcacguucccacccgccgcccccuuuuuuuccccagguagagugaagcuuuuagaaccuucugccucuuacagugagugaaagaacaaagguggauaagcgggugucugaauuucaccccauccuuuucauuuucauuuacuaaccuacauacacuagagcgccaagagccgcuacggguagcggcccgguacagagagacccgucagccgggaccugcugucugcuuggcaac

SEQ ID NO: 3704 - RNA, 27235 nt, Mus musculus
uggccugguuucuaaaagucuagaaguucacgggggaaucugaugucuaaaaaugccuaggcagcacccugcgacacccugugggugaaauaucgcacuaagagguuuucucauuuuacaacaguuguaagaaaaaguugcaucagggccuuucuggccuugcaucccuucuaagguauucgggcauagucccuaagcguugucucgagggugguccuauggaaggugacagcugcagagucaggccccugagaucuggaaugccuggaggccagacacguggaguccgggagucccucaccuugcauagcugcacaaagagguaggugaccccggccuggacgcauuuccagaaggcguuguauucagaccugaagaagccggcggugaggggucggcccgggucccgcacccucuccaccccgcgcccgcccugcacucacaggccgcugcauuuguacgugaugaaauagggaaaguaggcgagggcgaagcaguucccgaaguggaacagggucaugacgccagccgcccggucccgcaaaugcgggacucgccaggcgcagcgucuccucuagucggccucgccggcaccggggccuggcgcccaccugcuuugccguggcccgcgcgcggccuuaugggaacuguaguccggccugguacgucgcgugcagugacgucagagcgcccagcuccggcuguguugcagggacuuccagagccuugcuuacaccguugaagaccuuguguucagacagcgcuuucccucucccacucggcucggagccaagcgccaccucuucucgcucauccgagaacuuugaaccccgcccugaacgcaaggugaucggcgcagagacaagagggcaaagcugugcgcauucucguuuuuauuucauuguugacccgguggcggcgccuuugaguggaagccgaagucaggaacgcgaggugcgcaggggagcaaggaggggccuuuuguguuacuucucucggcuaaacauguagcggaggaggucgaccacucgguuacuguagccauauucguugucguaccugaggaggcgaggaaggaggcgucaguguguguguguguguguguauacguguacgcacucgcgcgcucgcccucuugucagccucccccacuauccucuggcaucuauccccuuuaccaggcguguguguguguguguguguguguguguguguguguguguguguguguguguguguacguguacgcacucgcgcgcucgcccucuugucagccucccccacuauccucuggcaucuuuccccuuuaccaggcguguguguguguguguguguguguguguguguguguguguguguguguacguguacgcacucgcgcgcucgcccucuugucagccucccccacuauccucuggcaucuuuccccuuuaccaggcaacaagcuucacgaaguugucauugagggcaauuccagccuuagcaucaaagauggaagaauggggauugccguuaaaguccguggagaccaccugcgugacaauuucaaagauaaauguagucgagcaaagaucuccaggaacccagacucucaaaccacauugucagucacucaucugguauacuggacagagaccuuuuguguuggugacagaaugugaucaaggcagguggaaccuuugucucagggacacagcaggggagcucaguggauaaaagugcuugucacauaagcgugagcuuucuguguuuggauccgcagaauccauauagaggcugggcgguugauggacacuuauaggcccagcaguccagcuccagacugaggcuccuuggaacaagaugacuagcuagauuaguuaguugucaagcuaccuuacaucuugccucgguaacaaguggagugcaauggaggaagacauguuuaucaccuguaccugguguaccgguacaugugccccgugcaucugcauguacccacacgggggaagaggauacagaucacaauacccuaaugagguugcauuaaacguuacaugaagcgaugacuggcacgaggcugggucuugggagcagagggaaggagcuacagacacagaucuugggggcuguagcccuuaggaacacaggggguuggggguggguuggcauuggggcugauuugaucugacccauucaaaugacaucuuggcauuugagaguggaccuguaaaagccaaaugccagggaacuucacuaagguggaggugacuuuuuuuuuuuuuuuuuuuuuuuugauacaggguuugcuauauagcucuggaacucacuauauagagggcugcccucacauucauagaagucuacugcuucuaucaccugagugccugugccuccacaccuaagauagucuguucaguaaaggugucugaccuggccuggccccugggugugaauccagaaaaugagaacugcugucuuuuguucaggaguguauuaagagccuucuggggccggagagauggcucagugguuaagagcacugagugcucauccagaggucccgaguucaauucccaucaaccacacaguggcucacaaccaucuguaauggggucugaugcccucucuucuggugugucugaacagagcaauggugaauauauaaaauuauuagcgaaagcuccauuuuagcucuuaguucgcuguuuucuuggacaguaugugcuauggguuacacaagugacuuccagucaccauggugcagaaaagcagcaucguuagaucaaagaaacaucuggucaagacaccgaggcaggaaggcccacuuucccaggcuugcagggaaagcuguguuugagauagggucucauuguguaguccuggcuggccugcaacuccuugggugugaaacaccuggacagcuggucugcagcuuggcccaugcagaauagcuuccuggugagugggauuucccaagucccuccccagagcacccccccaagguuuccucagucccuaccugguccucuguguaagcaaggaugccagccaaaggucccuuggcugcagcuuucacagccuccgugauagccgaguaagaagcaggcuuggccaggcggcaggucagguccacaacugacacguuugggguuggcacccggaaugccauuccuguuagcuuccuggagaauuccagaguaagggugggagucagagccaaaggucuucuacucccauuguccccaugccuuggggccagugagguuuuccuaggguguguguccacccugguuccuggcuuguaucuacauacccuuugagcucugggaugacuuugccuacagccuuggcagccccaguggacgaugggaugauguuuuggugagcgccgcggccaccucgccaguccuucuuugauggcccauccacugucuucugaguggcuguguaggaauggacuguggucuuggggaacaagagacccaagaugaagccuccuuccuccuaaccacucauucuucuuucuucuaggacuugagaacguggcugagguauauggaggcaaccagggcaaccaccacagcuacaaccuuguuaaaguacuccaaacggugucuccacuaugggcuuccuuccuuccugagcugcucucccugcuugcuccuugccuugccccaaggccugggaagaagggguugguucccugccauccuuccugccccgacucaccauuagcccuuccacgaucccgaaguuuucaugaauaaccuuggcgagaggagccaggcaguuggugguacaggaugcauugcugaaacggccauagcaugccagaugaguggcagagccaccccuucuccacuacucuuacuuuaccaggucugacucugugagaugugagaaugggugugggagggcucccuggggaugccauaaggaggagccauuggaggugucacugggaaauacugccuaggcauguccucagauacugaacaugccuaguaguuuuagggugaaguuaacaugaugacuuaagacguaggaacugcugagcaggaacaaguugauguaaaagacauuaaaggauugagguggggagagugcuacauccuggcaugccugcugcugccacccacaugcuggaggauggccgucaucugggguaccugacaauggucauagagccaggguuauaguccuucucguucacucccaugacaaacaugggugcaucgggggagggugcagugaccaccacacgccuggcaccagaugaaauaugugccuagugauagagcacaagguuagggucuccaagcaccacugcccccuucccaggcagcccugggcacucuccccuacuuaccgaagcugccucgauggacagauagacgccuguacacuccaccacguagggauucccuauagagcuccaggggauuucuuuagggucuuugcuguggaguggugggaaggcuaugucaguuucccuugcuuggaucucaggcuagccagaggucuugguaugugaucugcuaauaucugaucccuaaacuccauauaccuaccugauccagguuggugccguccugcaagccccugucagccacacucccuuucuugugugcuauacccugcugugucuaaacagacuuucacaccuucaacugaggcucucaggaaccaugcccacaagugucugacuagaaccagaaccauuuacagcacaugcucagagcuuggauuccuaagauggugaggcugccaaugcugcccuuuggcccccagcucugaccaucucaccugagcccuuuuaggcucuuaucaccacugaacccuuguugggaaguccccaaagacagacacaucaggugacaacucaggggaggcuuacagcugaagcaccugugaauaucagggaccaaucaugggcaguagaaaagccagagaaaggcuuucuguuccugucucagccuauguuuucauuugauuuuuguuuguuggcuggugauaagugucuccuguuugaccccuacuggucugcaaucuccacaaucucccugccucagccuccuuagcacugggacuacacaaacaccaucacgaccagcuuugccuugauguacugacaaauauuugugcuggaaacuugucagauaccuauccuuguuuucuaccugcguccagcaagcagucucugugacugccgucugggcuugucccucaugucacuggaagauuuguuccuaggauugcuuggcucuacuucaggcuaguuucauaccauagguaugccaccugugaaugcuagaaauugaacuuggggguccucugaaagccauuuguggucauaacugauaagcugucucuucaaccccaauuaaugaguauuuauuuaauuuuuuuugugaugcugaggacugaugccagggccucaccugcaguggaagguauucuacuacagaacuucacuccuagucucagugucuuucuuuuagucauucuacacaugugcccugcgcugccuucugucugagguuuuuuggcuguagaaaacugauaaccaccggaacaccagcauacuuacuacuguguucaugcuucagagaagccagugucaggcaguggugaaggcagugugcgaaccuaggccuggguucuguccuccauuaggaauagugugggaaugaaugaaugaaugcagaggcuuucccacccuucuagccacaagaccguuuucucccucugcucagucagcccacaucggucaucuggcccaaggagcuuuuaucugaugcaccuacuuucugucuuucagguugagaguacuucggcaauuccugcaauagaacuugaguuuggcaugaccccuccgaccuacagguuuguugugaagauuuauucauucgguugcacugauggggaaggcaacuguguuguguaugauguuggcaaguuguuaugugcuuguuggggcuugcugagaagcugacucuggaagucaggcuggccucccuucaaacccaagcagguuuaugucaagugguuuucaagaccccuuguccucagguggacuggccucucccaccucugugacagaggagggauggcuuaucauagguaaacacagaguccccaagaguguagguuacuacuguuuauccugugguaugcaguguugccagugggagagcuuguaagcucagccaugagagaaagcucagucaggaauaccaacugaaaccuuggcuucuauagccagugucugcuggauaucgugagccccugacugcaaugaugccucucucaucagggucuguugcuauuuguucuuuuacuuggaagccuuaccagcucugccugggaacuaacucuuauuauaguauccccaucuaucuaucuaucuaucuaucuaucuaucuaucuaucuaucuaucuaucuaucuauccauccauccauccauccauccauccauccauccauccacccacccacccacccacccacccacccacccacccacccaucuauucauccauccaucaccuuccauccuuccaucuauccauucaaccaucuacccaccacccacccaucugucuuccuuaccuaccugugaucuaucuauuaccuaucuauuaccuaucgaucucuccauccuuugugaucuaccugugaacgaucuaccuaucuaucucuucaucccuugcuguuuacuuuuuacuuggcuugacacauauauuuuauaaacauucagaauugaaaguauggcugccacuggucucuagcaguguggaauggggugcuguguggaggcgaagaagggugacacccaggcaggggcagaaggauaggggugacuggaauugcuuuuggggcuacgauuucagacucaaggcaaacagccucuauucucccugauuccccaguccugccuucagccuuccuccaaacucugucacaccucaucuucagcaaguuaaaagggaagcugagagugucuugccugagaaggagccagaagaccuugccuggggcuacagaggguugggugcuucucuguuugcaaagugacgguaagguguuacugguuuaugcuguuuuguuucuguguagcugcaggcugaccuaggacuugagguaauccuccuguggcuucccaagugcaggaauuacacauguacaccccacaccuagcauguuacugccaaauacacagauucugagucuguuaacaguggggcuuaccaucaacagaacuuccuagugaggaagucagccuugcugggguguaagaggugcagcccagcgcccccagaggugauaaccagguguggcagaugagacagagaaugcagggugggaugcuuaucacaccggggacccugagagcuggggcaggagcauugggaggggggaggguagaagagaaccuuggcucaguggagaaucaaaaggccucagaggcuccuggguagcaacuggcucaguugccauagagagguggcuggugacucagagaaagcagaggauguggcacagugaacccacaugccgcagagaacacaugcggacauguguuaaauacaaaacauguaagaaccauggcagucuuaaagaugaguguccuuaaguguuuuagaggccagagaccuuucugagacccucucucuaaacaguaccuagaggcaugcaaauaugguagagccauggugucacauucuguccuuaccacugguacguguugaucucaagguuguccacaacuaguuguccauucuuauguuccacguuuccuuuguaucuaccauguguggagucauauuugaacauguaaaccugcaguagacagagugggguccugguaguaggucgcagagugagcagaccuagacaguucccacugugggcaagagguuuaggagguucugcauugcagccaggagacuucuagauagcucuuggaagcgucuccccaacacaagugccacuuuugcuggucuguccgucuguccccgcccccuccaucugcucaccauguauucuggaucaaugaaugggucauucacugcuaccacccuaaugcccuucuccaugcagacucgcagcaccagacgaccaaugcguccaaaucuguccaaucaggaacacaaagcaaagggaaugggugugagaaccagagugacagagaugucauggugucagugcccuaccaaaguucauguugaacuuugaaccauuggggguuauuaaggggugaacacuuggagcugguaagacagcucaguagguaaaggcgcuugcugugaagccuggcauccucaguuuuauccuguuuuagccucccuugcugcuagugugacaggcacacugccaugccuuccuaauaaugucccucaugcucacuccuauagcuggguguucccagggaagggccguaugucuccaugugaaaaccaccucccucucucagguaaacaagaucuauauuccuuuccauggugcuucaggucuuaaaggacucccucucccccuucccuuaccccuaauuuguucuuacagcugugaagauuuccuggcugucuuugaauguaguaagcaugucucuuucaagucagagucauuacuugucccacuaccucaaaaauuugccccuguagagagacagcuggcugccuugucagccugucuuucaggccucuuuccagaggccuucuguggcccagccugcacuugaacuacuuccaauucucuaucugaucguugucuccuagaagggaguucucugaggacuggccugcccagugagaaggaaggaagauguccccagcccauagugauccaaggaggccacagugucagccuuuggggcuggcuggcuccagcaucaccuggggucugacauacucacccauugauacccacugucagcucucuagcuggcuuuuggaguggugggggagggggagggggaggaggaggaggagggggagggggagggggagccucuucaaacuugucuggcucuaucugggguggaggaggaggaggagguggugguggagguggagguggcggcggcgguggcgguggcuguucuucaaccgugggugguggauccucaaccuuggguggagguggucugaucacuguagagagagagcagagaguucagaagggagguggugaacugggucccucacauaagacguggggauggugagacaccucagugggugcuugucccagaggcgugugaccugagugucaauccuggacaccacaugguagaaacaaaaacaacuuccauaaauuguccugugaccuuuaucuucacacgcacacaaagugugaaaaagcagucuuuaccauacagaaaccagugggcuuugagccccuaggggccaacuauggguugguucuuuuccaaacccucugagccagagaacaagcaagagcccugaggguaagguaugugaacuucuguuucagcaugcaugugugcguguaugcgugugugucuguaugucuguguguuuagcgguaacaugagggucuauuuuuugugcuaguuucuuauacugugaaauacagaugaaacauuccacacauguugugacaucaaucccuccuugacucuuacccacuuccuuuccuuaccuucagcaccugaaacagccucuggcuggguuugcccagcagcuggcagcagguuguacagagacugaggcccuaggagagucccagcuccaccauuucuuccuugguugggagccugggaagugguuuggccucucaugaucuuugcuggccuccacagaauggggacagugaaacacccaggccucaccugguggcugugagacucagugaacacaugccucccuugccuguaaagggagcagccuugccauggagggcugcaaguacccuugcucccuacagcccagggaggaccugccuaccaagcccccuugucccuggccagcagggacaucaaugaaauguggggggcacacccaccuagaccuguuccaaaugcuccugguuuccucucccucuccagccucccugccuccuccuggccucugcuucuccccucuccacugauagaacccaaaggucaggcaguccugagggcagagcucccaaccccaaccccaucccaagcagaagcucucuggggcgaggaaggaucccagaggagagaggccugaagggcccacccuggccugugccugcaggagcacccaguagagagcaugcuggugggggagggucucaggacucuaaguacccugggggaggguggagagacucccagaccacauuuuccuccucuuaacagggccacccccaacaacucuccuuaccagggcaugggcauggacaugggcaugggcaugggcaucggucccgccguagcuggacaacaguaacauugguaaggaccacgucacgucucgacauggccuaagaucucauggccuggcugccuuggccccccuccgugguguuacugaggugugaagcucccaaggucccaguggcucuugagcuucugaugaugucacauugaucaaugacaucacauagagaguggugugcagggcaaagaccucagcccacucuccagaagcuuuugagagucccacacugaggauuucaaggccacccucuggcaucuagaguggaacccacuagguucacacagaagcucauggcugccaucucucuuccucccaaccaugguccaccugcucuaugcuguuccuggaucucugaggcauuucccuugcucuccccuguguguggaaaugcugagaaagccucucccaggucuccccuugauggcuugggauccucucaagugcugucuguaacugaagugguccuuaucauggcagaaggggaggcagaaauauggucuauaaaagccugcgaugugggaggagacucagcagcugucgcugccugcaucagaacugcacaaggucaugccgcucagccuuccacuauggaggguagaggcuuacacgcacccaccucugccuggggagcuauggauagcuggugacuucugggggagggagcaucccuuugcuuuaacgguaucaacuaugcuccaauggauggcccaggccccuuaugcauggcccaaauugagucaguggaguagcaaaaggaaacaaggcaaacucccaaguaguuggcagggaggagagaguguugaaaaugaucaaguauggagucucucaugcuuucaguaaacauaggauauauuuaaaagccaggugugauggcuugguucucuaaggccagacucucaugggucagcuaggcuuguuuccuuuugcuacuccacugacucaauuugggcuaugcauaaggggccugggccauccauuggagcauaguugauaccguuaaagcaaagggaugcucccucccccaaugcugcagaaacaagagagccugccucacuuuguagaagaagagacaggaugacucaugaguggcccagaccuacacacugaccugacuggaguuugcaggcacacacacaaacacuaauaaaguuaaaaauuaaaagaaaaaaacugauuccauaaauaaaaauaucauagaauaugugguaaaaugaauuaaaauuuuuuguguagagaauuucaauggugauguuauugccuuuuauauaagauaaaguaauuuuuugaacguuuauucuaaaacuuuaagggacuagaaacacagcucaaugguagagggcuugcccagcaggcaggagagcucugaauuuaaucuucaacauccucaaaaaucccacauacuuuuagaauguauccagugucucaugcugcauggccccugagaucuacccucucagugacagccuuagguagcucacuuaaugccugugguugaaggcaagauuugugaacuggugcaggcuccaguuaacucaccugcaaaacccccuugcggugcaaaguugacaaccugaguucaggucccugcaccuuuacagacagcagaagcuccugacuggucauuauggccuauguaugugugcuguuacacacucgcacccccaagccuccaagcacuaagaauccagagauuaaauccucagagugagggacaggaaagucacucaguaguuaagagcauuuguugcucucacagaggacucgaguucagaucccagcacccacguagaaguucacaacauuguguaacuccaguuccagaggaucugaugcccucuucuggccucugcaggcacccguacgcacagguuccacacauacauacaggcaagcacucagacauaaaauuuaaaaccaaccagacuggagagauugucagauggcuaagaacaugcucauauagagaacugacuucuacucucaacacuuacaucaggugucuccuaaccuuuagcuugucugccucugcagacaccugccguaugccguauagacacaugugcgcucauacacacacacagaaacagauaaauacacacauacagagagaugcauguauacuaaggguuacaauacagauacauaugcauauacauauguagauacacacauagacacacagagaaaucuguagcacaccugucuaaaaugaccuagguuccagguccgguuucaacacuuugcucccugacccuauauuaugcuauaguguauuaaauauguaagagguuuaguacuaaaaaucccaagaacauggauuuuuuuuuuuuuaauuuucuuggcagaggcaugcauuggagacugaauccagguucucacaugcacugaccuuguguucugcuuuagagccacaccccagccuacaugcaccuuaacguaaaaaauacaugauuugccaggcacaugccuuuagugccagcacccaggaggcaggucucugugagacugaggccagccuguucaacacaaugaguucauggccagcagggauuuauaauuagguacuaucuaaaacaaaacaaaaacaaaaccaagaaacaaacgguggcgauaaggugcaugucuaaaaucugagcuccaggaaagcuggaagcaggaguguggcgcugagguuuuggucagccuagaccacaugacuggauuauacaggacaacccaacaaccugugcacucaugcaauauccaggagcccagggaagauacaaauaugagcagccuccuuucugcuucaccugccuuuucuugucuuuuuuucuuucaauccuggaguuugaacccagagccuuaggcauacuaaacacuuuucugcaauugggccacauccccagccccucaggauuuuaaaauauuaucgguugauggauugacugguuguauauguguaugcguggguguuuauguaagggauuauguauuguguguauagauauugugcuugaguucguguguguauguguguggucauaggagaacuugcaagagucuguucucuccuuccacccaauggggaguguguguguguguguguguguguguguguguguguguguguguguguguaggucaggacagacuugugucuccucccauguggagaaaaccacucuccucaauuguccccugccuccacguugugccgagacacacugacagccacguaaaugccuggaagccuuuggaagccaaggggggagagggauguauucaucuagagcuccaaguggggaccugcccucacucagaagccaugcagagcacaguaaggccuucccucccugcacccaccacacacccacuuuacacaggggacugaggcuggugggcacagggcaagucccugcuggucacccucuguugcucugucuuccagggagggugcuuacaagccuacccacuuacgggaagugagaacaccacggucaguuggggguugcccucccagaagcccuggcuuccucuggcuucagcaccugaaacagccucuggcuggguuugcccagcagcuggcagcagguuguacagagacugaggcccuaggagagucccagcuccaccauuucuuccuugguugggagccugggaagugguugggccucucaugaucuuugcuggccuccacagaauggggacagugaaacacccaggccucaccugguggcugugagacucagugaacacaugccucccuugccuguaaagggagcagccuugccauggagggcugcaagcacccuugcucccuacagcccagggaggaccugccuaccaagcccccuugucccuggccagcagggacaucaaugaaaugugggggggcacacccaccuagaccuguuccaaaugcuccugguuuccucucccucuccagccucccugccuccuccuggccucugcuucuccccucuccacugauagaacccaaaggucaggcaguccugagggcagagcucccaaccccaaccccaucccaagcagaagcucucuggggcgaggaaggaucccagaggagagaggccugaagggcccacccuggccugugccugcaggagcacccaguagagagcaugcuggugggggagggucucaggacucuaaguacccugggggaggguggagagacucccagaccacauuuuccuccucuuaacagggccacccccaacaacucuccuuaccagggcaugggcauggacaugggcaugggcaugggcaugggcaucggucccgccguagcuggacaacaguaacauugguaaggaccacgucacgucucgacauggccuaagaucucauggccuggcugccuuggccccccuccgugguguuacugaggugugaagcucccaaggucccaguggcucuugagcuucugaugaugucacauugcccagugacaucacagagggaguggugugcagggaggagccuuagccuccccuccccagcucuagaguccuuagagaguccuacauaggauuucaaggccaccuucugguaucuagaguggaacccacuagguucacacagaagcucauggcugccaucucucuuccuccccccucaguccaccugcuccuugcuguuccuggaucucugaggaguuucccuuuacuccccuguguguggaaaugcugagaaagccccuugcagaucuccccuuggcugccugguuuuucuagauuuaacaguagcucuucucaccaagguguaggagaggaaggaaauauuguaagauccacaggucugguaggacagcaacaaaaaaguuucuccugaacaugauaggacagcuguacugcagaccucacaguggaccugguucccagccaagaucaaggccggcaacauucucacgggugggggaggggcucaggagcugcagacaguugaaggcucccggugaagcaagaguugguucuaggcuaggauuguaaagcaaacacuacucugugaccccacucaugugagucuuauagcaguacaaaccugugugagcuuaaaaauaaacaaauacauagaggaggacacuggacugcagaagaggccaucaagagcucuugcaguacuuacagcugagugcuuacagccgagugcuuacagcugagugggcuucaguucccaguacccacauugugguuuucaaccaucuauaacuacagauccagggaaucuacugcccucuucucaccuuuuuauguacugcagcccugugguacacacugguauagacaaaacuacucacauguaagauaaaagcuuuacauuuuuuuucaugaaauugguagagguugggagguagaggggaucugggaggagcgggaggucagguagggauggauggaugugaacaaaacauuuuaugcauauugggaguucucaaaaauaucaaaauaaaauugaaaaccauaaaaguaauauauaaauaauaaagaacaacaaaaauaaaaauagaauuaguacacucacacgggugugcacaugggugugcacacgggagugcacacacacgcauagucugaugugguagcauucaucuguaguucuaaaaaggccugugggccagcuagccuggaguauacaaguacugcaggagcaagagaagagauccagccucaauaaggauagcuacaaacuccagaaggguggagcuauguuuauguuuaugucccacugacuucaagugugagacauuuaaaacauuuuaaaugacauuaaucuauccuguguguguaugugugugugugugugggggggucagaagaguaaagcuccuuccuuccauuuccuuugugggucuuggggacugaauccagagcuugucaagcauggaccaccuagcugaacugucuucaacucuguaacucagaacuuacucaguccaucaauagagcacauuugccuugcccauuuuuuuuuuuaauuaaggaaaguaaauuuccacuaguuuucauuuuauacuuuauaauuugcagcuuuuaaacauucuuuagcuaauuaaacuuucaaauaaaaauacuuucccaauauuauggcuuccauuuuaggccacggaaaugaugcaaguauuucggccagaugaacugcaggucccccaccccccugccuccccuccccccuccccacaguguucagguucugccuggggguuccugaugcuuugcuguuccuguagauaacacgaguucagauuccaauacugcuguggaguggaucacaacccuacgugacuccagcuccaggacugccgacagcuucaucuggccucccucaggaccuguguggucccagauccugucuuuccucaugagggugucuggauucugacgucuggaguagguggggucugcagucugccuuuccccuccagggcaucagacgccccugcccaccaggacgggaggggugaagcagggucagggaagaauauugugguuccgugucuucuacugucuucuuccggguugcggggguugcuucuccaagaaucuuagugcuaugacucuuaggcaaaggccuucucuggcuaucuuuaaugaagcggcucucagagaugaucucagcuuguucauauuucuucauuugggguggccuugaaccuacacaguuuauuccgucgaaccagggguuuuauagauacaguuuuggagaagggcuugagacuaugcagggacggggaaaggucauuggcuccagagaugccucguuuccuuggggacgaauuucaggugcugugcuauaugacugucuaccugugacugccugauuggaggucucaggguuauggguuacgugcucugaggcaggaacggaaacagggaaggaguuaucuccacucaugcuggccucaggauaagauucuaaucucaauuuuugagauuuccaggguuuagauuuuucucugccuuuccagaucuaugccccacauacuugcacuaaacauuuaaaacacauguguaaauaaaauagaguaaaaauaacaauaccuuuuuuauuuuuaaguuuuagcuugagguugagucauggagcacuuagccauuaugccuaguaaauuuucuguuauauuaaacauguaaccuaugugaugugcacagcuugcuucuuacccuuggcugguguaggaggguccuggggauugaauccagguuuucacauaggcuaaucaugugcucugccauggaaccccacuccugcccacacauaccuuaaaccauacgacugcugacaacugcucccggccgucugugcuguugaagagcuggggcaggagcaggagcaucugacacugggguggcacugauguucaauuuauaaaaaagaucaaguacauaaguaccugggguucugaugcaggaggccaacuuggagcuagccuggacuacauaggcuagccuggacuacacagugauagccuguauccaaacaaacaaggaacuggagagacggcucagugguuaagacuguuuaaugcucuuucagaggaccuggguucgauucucagccccuaccuggcaguucacaaucuucuauaacucuagucccaggguaucugauguccuguucuggccuccacaggccccugguacacacagacauacauucgggcaaaauagcuauacaauagaauaaaaaauaaaauuauuaagaacaaacaaacccuucccugcaguaucuaggaagcacagguaagucaggugugucuguauaugcaugacaaaaacaccuggucccccuccgccccccccccacacucccucaauguuuuuccuuuaauuucccuucuuugcuggaaauugaauccagggccuugggcaagcuaggcacguuuucuuccauucagacacucccugggguuauuuuaauuuuauucuucccccaucucucuguguggaggccagagaacaccuugugggaguuggcucucuccuuccaucccaugcgguccgggauugaacucaguuacucaggcuucgcagcaaucacccauuaccugcugagccagcuugucagcucuuauguagucucucauccucagucuugaagcagccucuaagccaugucuccccacaguggucuguucuuuuccuuggaguuuuccuguguuuagcaccucccuauguccuguugcaugucacccucaccaacuguguauccuggaggggugcaguauccacagcugugucucagcaucuggaacaacaucugauauaaacugagccuccuccuucuuuuaaaacaauacuuauuuuauguguccaaguguuuggccugccugcaugucugugcaccaugugcaauucugggugucuuaggaggccagaagggggcgcugaguccucuggagcuggagucacagauggacccuuguggaugcugggaacuaaacucggguccucugcaagaguaguccacauuccuacccacugagccuccucuucaggcccacucuucugcauuucuugagacaagaucacacuauguagcuaaggcuggccucuaaauugcuacgauccucuggcucagccuccuagaugcugggauuacagccaccaugugaagcuuacaaagcaggcuuucaggaagugucuagaaaaaaaagcaagugaaaaauguccccucaagcccagggcucacaugaccucuuaugacucacuaacagaugccuuuaccugcagggccgguugacacgcagcugugaccaacggggugugaggcuuagcuacagaaaggagucacuauccuagagagaaggguggaagcccaaaacucauacaauggcauaaccuuguucucccccaagcccccauggaagcuuuccguuuacauauagagagccuguuucauaaagccaaagcaagaaccagaucaugcaagaacuggccaugagaccgguuggcaaggcccuggagagcuaaacugaauauaaauuggaagagacaggcauggaucuguaaucgcagcuacuuggaggcugauguaggaggaucauagaucaaugccuaucugggcuacagagugaguucaaggccagccuggccaccuagucucaaaauaaaaacauuuuaaaaggucuggguuuucuggcacaugucuuuaccguuagcacuuggaaggcagaggcaagcagaucccgggaguuugaggccaaccuggucaacauagugaguucuaggauagcaagaccuacaaagugagacccugucucaaaaauaaaaaugaaaaaaaaguuaaaaaaaaaaaagucuaggauauaaagagccuugugacaaacaugcucuccuagcaugcgugagaaagcaggauguaugcggugggccacccagaugcuauugggcaaaguuuucuuuuguaugguggcacauacaugucaucccagccccugugaggcugcagcaggcagaugaagaggucugugcuagccuaaacuacaggcagagauccugucucauaaaaccaaggucagaaacaucaaaacacccccccacccagaggcgggcauggugguucaugccuguaauccuaguacuuggggugcugaagcagguagauugcuaugaguuugaggucauccuggacuuguauugucuagccuaaacaauuaaaaaaaaaacaaaacaaaaacaaaaaccaaaggaucaauaaccccccaaauccgauguuagaagugacaaaccugauuaauagcaagagaaguagagucacgagcucuucucccaacgucugguuuagaucaauuuuaugggcagaucugccagauaccagggaacagaaacauauacuagugaugcaucugcuuuucuaacugugguagaugcuaggcugagcuaggaagccccaggcagucccucuguagggccuucuggguaaggcucucacuaugacacccuugaaugggugaacauccuguuugaacauacagcacugugacaugaagugacaugauauccuagagucugagcuucuuccacuggcuuuucugauaaggagaaaggugagaagucaugaauccauuggcaaauggugacagaaagcugaggagaggggccaguggagggagagaaagguggaggagaaaauacagagugcuggugcaugccugcuacagucccagaggaucaagaguucaaggccagccucagguacauaguggguuccaggccauucugggcuacaggagacccuaucacaacaaaacauagaaaaaauagguaggauaccuuuuuaaaaggguaagccgaaccuaucuaucuugguguggaccaggauucugacaccccuaccuccauguuccuggcucccuucucugccuggccucuacucuccgucauuaagggaugugggaugcuucuggcugagugccuuugucauuggagugugaaccugggaaagagagucacuuugcagagugguccaguuagccaccucugcugucagcugucagaguugggaaggcccaugcucccgggucccugguucuggaauguuugguucuggguguggcuauugcuucuuugaggggaccaccucaugcucugguuugaaguugacaacacgugcugguucucagccacgccugggcacccacacagauaacuaccuccuccgcugugcacacccgcauuccuccaugccugaguguuccacugcucccuccucucuccucgcucagccucacuguuggcauuaaaaccuaaauacacacacacacacacacacacacacacacacacaccguacccaacuguuccccaccuacuggcucuuguuugccucccucuagacuauccuccagguagacauacuggggaggauucauuaccugcccuuccuucuaaugccagacuuuagccccaggccgggcuugcaucuccgucccccuauacucggagccaacaguacaaugcuuggggcuucaggucagggcacuggaggccccaggggagcagagaaggaaggagaagguccuggcccccagcccacaugucugaggcagcuucugcuccaccaggucuccaagccucucccuagggcugccucgaccggcuuuucagguaucacugcguccuuucucagcucauggcaaucagcccccagcccuugcccagggacugggaggagaggccuggauucugucaugaacaugugauccugguuccaaaauuugaggcccuccccaagagacccuauguagcuuuggggacccaguuaccccuucuccccagcaugcugugagguggguccaggcucgucgucuuuccuuagcuucuaacccauccaugagcuccaucuaugacuauaguuacugggccucaguuaauaucucgugaacuggggucauagcaguauccagaacaaagggcccgauagcuagaagugaacagucuaggaggggagacacacuuaaaaauuaaaaacaauuucagauugcaacaaggucuauagaaucagaagggugacaucacagaacacaauugucauaccugucacaccacacugccuggggcauggucaggaagggcuuucugacaugcuggccauuugagccagguguggaguuaguggagacagcugggucacacucuggcuuccaggcacaugaaaaguugccagacagccauggggggcaggguggagggcugaggagcucggacaaaggccauguaacuggagcagagagagaggugggagagggaacuccaaggacaaaaccaggcaacuccuucagcuccuugggguggggguggggggguccucuucucccugucugcuuuccacucuuccagaguuauccuguagagcaagccuucuaagaggacugacagggugguuagggauggagggugccugaagguggguucaaaaggaaggaggauggccagugggagagagaggaaaacaggagggggcugggcagggcagaacccuacugggguggagggccugagcagguuaaagagcagaggcaaggaucuuguccaugaaucauccugucuuccuccuccuccuccuccuccucuuaauugcucaaucccaaauaucucugggaaacacccccuugacugaaccgaagucagagccucacaggagggauugagucaugagggguggggaagagggagggaggugaaggauaaauagcggccucgcucccuggcuccucucugcauccucccugccuucccaacaacauguaucuugucaguuugcucagcuccugcugccucuuagugcuccuggggacucugccugcccgggcagcccaugaggaucccguugagaaggucauagaaggguucagccgagggcugagcaaugcugagagagaggugggcaaggcccuugaaggcaucaauaacggaaucacucaagcuggaagggaaguggaaaaaauuuuuggugaacucagcaacaugggcagccaggcuggcaagaacguggaacauggcuuggacaaaguagcccacgacaucaacaguggcaucggacacgcaggaaaggaagcagagaaguuugcccauggggucaaccacgccgcuggacagguugggaaggagacaaacaaaaucauccaucauggggucagccaggggggcagugaagcagggaaguuuggucaggggucccaccaugcuuuuggucagggugggaauguggcagacaaguuaggucaugaaacccaccaugcuuuuggucagggugggaauguggcagacaaguuaggucaugaaacccaccaugcuuuuggucagggugggaauguggcagacaaguuaggucauggagggaauguggcagacaagcuaggucauggaacccaccaugcuuuuggucagggugggaauguggcagacaaguuaggucaugaaacccaccaugcuuuuggucagggugggaauguggcagacaaguuaggucauggaacccaccaugcuuuuggucagggugggaauguggcagacaaguuaggucaugaaacccaccaugcuuuuggucagggugggaauguggcagagaaguuaggucaugaaacccaccaugcuuuuggucagggcggaaauauggcagacaaguuuggucagggggcccaccaugcuuuuggucagggcggaaauauggcagacaaguuuggucagggggcccaccaugcuuuuggucagggcggaaauauggcagacaaguuuggucagggggcccaccaugcuuuuggucagggcggaaauauggcagacaaguuuggucagggggcccaccaugcuuuuggucagggcggaaauauggcagacaaguuuggucagggggcccaccaugcuuuuggucagggcagggauauggcagagacauuugaucagggggcccaccaugcuuuuggucagggugggagagagggaggcagacuggugcaaggggcuggucagggacuuagccaugcugcaaaggaggcacagcaguuuggucauggucacgggcaugguuauuaugcugcggggcagacuuggcaagaaggagacaaaguaauucgucccggggucagccaggcuggggaggagauggagcaguuuggccaggguguccgccauacuauuaaacaggcugaaaaggaagcagaaaaaguggcccaugggguacagaauggagucaaccaggcucaaaaggaagcagaaaaaguggcccaugggguacagaauggagucaaccaggcucaaaaggaagcagaaaaaguggcccaugggguacagaauggagucaaccaggcucaaaaggaagcagaaaaaguggcccacgguguccaaacuggggucaaccaggccgggaaggagacacagagaguuggccaagggguccaaacuggguucaaccagggucaaaaggaagcagaaaaaguggcccaugggguccaaacuggggucaaccaggccgggaaggagacacagaaagcuggccaaggggucaacuaugcugcuggccaggccgagaaggaagcggagaagcuuggccaagguguccaccaugcugcuggccaggaaaugaacagguugcagcaagauguucauaauggggucaaccaacccagcaaggaggccaaccagcugcugaauguaggugaacagagguggggaaacuggggagaaggggguugugggagggaagaggcuaaaccuuugggaagccauaacacuggguuuccuaccuuccuucuccaccuccauuacuacagagcugguggccagcugguuuagaccaucuugucugcaaagcuuccccugagacaaggugaaagagaccuaguccugcuaucgggcccauccuacaugagggaaccuaaccuguucucucuccugggaccaggaaauaguucugaucccagacauuguacaaacagauaguggcugagaaaacccacagucagggagaagcuuuggugacaggcucugcuguguucuguccuuguagcaagccugugagguggucaagaugagggcacugacucuaacauuuagauaaggaaacuaaggcucagagaggccagggggacuugcugaggucaauggagagugcucagugcaugagaugcagcucuggaguuuucuuucuuccuuugccuuucugacuggguggcgagugagguucuggaguacuuucaugcccguauuuguagaggaacagaugcuggagaccagguaagcugcagcagagcaggcaccaaggagauaccugggaugguccauccaguagcaggcugacuccugcacggcccaguucccaguucucuauacucuugagugaagagucacugagaucagaaagcugggauaccaccccaaggauggauccaggucucagaguccagagccacaucugcugccuggaaggagccauggaggucuggguggggaggaggggacuaaagagaauccugaguggagaauaggacccugaaugagacacccaaguggacucuggaagagggucaagagccuuuguggguggagugccaugggguagguguggccuaugcugagugauguucugggcucaagagcaagaaugagcugaguuaggcuugaggcuacauuguagcaagugauuaaaaaucagggcugagggugaaugaugguucuagguauuuguguggguccuuugaguccuucuucugcaagauggaaacauuuccuaaaugcagaauuuaaagauaguuuaggugaggcgaguucauaagaggaacauccuuccuggaguucuguccaacucuccuaaucagcuuagcagcuggggcacuggguugucucuaaggaucaugagugaggagcccugugguuuagcuagguucccacuccagacccagucauauuagaaggggcagguuccuggugaaaaggaaugaggaagacccucaugguucaaggggugguaguaaugaucuggguuugucaacaggggucucaucaaggucaaggcggguacggaggccagcacggaggggccgcaaccacuacaguaguaucuggggugagucucuggguguaacauggguuuuggagccgggagaggggaguggaggcuacuugauguucucccaaggauaaugguugguuaaagguuggugacuugcuuuguccuugaauuccaggccucggucaacaagccauuuaucaacuucccagcucuguggagggugagugcugcauaauccccaguccccuugaauucccuucccauagccuucuugcagucagcauccuguuggacagacucagccucuguagagaccauccaaccaguucucccagcucugcucuggccuguugucacucacuugcagcuuuugggcacuuuccagucccaauuaacaaacaucagcugacagaaaucaccuccggggcacugaagcaucugggagccagggaggguggggauacugaaaccgucucucccaugcucaucugggcuccucaccaucucuccucccauucccaauggcuagcugccuccccuucuuuuuggccuuccugugaaugccucugcuccccugcccugcugcuuuacaugggugcacugaguaguggcaauuugguuuaucagcucguucccugccaggcugagauuguaaaucccuguagaagucugguccuuucucuagcuuugucuuugucuuuuucuuuuuuuaaacauuugaaauuguguguguguguguguguguguguguguguguguguguguguguauacacuauguuuuggaucccuugcagcuagaguuacagguauuugugcguuacaugaaguaggugcuaggauccaaauuugggucuugaugauugaacagcaacugcuguuaacuucucccuggacuuaaagcccagaauccgggguuugucacagcuccaacucagaguagcagaggguucucugaggugcgacacacagggcuucuucuguagaauacccaccccaagcuggucucccugagggagguggaucccuaucguuccaagguaaacagcugguuucucuaucacuucucagaggugaaacaggagcccagaucucagccccuguggucauguauuuaacaccuuuccucucucuuucagaguaucgccgccaccaugcccuaaacugaugcccaggcaacagaauguuccgguugucacaccagcugaaccgacccagaggagcgggggcuuggggagagcuuccugggugcccuugagagggcugcuuugagcuuugugaauaaacuugaacauacucucccuuuucau

SEQ ID NO: 3705 - RNA, 1094 nt, Mus musculus
ggccuccugaguugugguggaucugcccucuugggagccuggcagagucagagucauccaauuccacgcagugccccuugcccccagagguggcugcuacuucugaauuguuccucuuugaguccucgucacacauauuguuccccguccaggaccuguucccaaguagccagugaccaguggguugaguaccacacuccaggccccugugaugaguccuaacuuccuccaggagccuccuagguccggguuuaugaaacuagccacauuggaggcauuauagggccccaggcagagcaggagugugaggagagcgccuccggccacccaagcugcccugagcuuccguuuguggcucaggccugagcgcaccagggcccggaggcagcccacauagcagaaggcagugaugaccaagggcagaaagaagagcagaauggagaaacugagacgggcagggcgggcagagucgggaucccaggcuuccaggcagaccggggagccauucacggguauguugaugcccagggaacugguacuguuguccagccagcuuccggaagucuccaagccaagggccagccccagguggcagaggacaagggcccauauagccacacacacaccccaggaauagcggggccuccggauggcuugguacccgaaggggaaggcagcccccagguagcggccagcgcugagagcagcuaggaagccuccgccugcguagaggggagcaaagugggccaaggcaaagacugggcagaaggggagcggcaggggccaggcuccagaagccagggccuccacagccuucaggggcagagugauggccaguaggagaucagagcagcccagauggagaguguagaccaagcugggagugagucgcaguuuagcgugggacacugcgccucggauggcuaacaaguucaauggaaagcccagcgcaaaggcagauacauagagagcgaaggagagcugugggggcagguccaugaggccgagugggugcuggucgccacuguuccuccuguucacuguacucagcucaucugcagagaaaagaaugucacaacuggcguuccuccugc

SEQ ID NO: 3706 - RNA, 9639 nt, Mus musculus
gccucgacaacggauuccagaacagacacaagcugaggagagaaagccugagguaggacaauugcucaugcugcaguuggcugugugugugugagagaguuaugugagugagugagugugugugugugugugugcaucaaagcuuccuauuuggugagcaaaugaaaaggagaaauaaaaaggaaagaacaugauugcuccuaggugugguggaagagaaauuauauuguagauaaaagggagaacauagccagaggcaggcacaucugggagaguccagaguggauaugaccccgagccaggugaggaagggugggagaggggaaccagguacagcagccaaggaaaugggcuagagguaaaagagggugggcuacccagauggcuggauuauauagggaagagccugggggaggggcagcccggcucuugggcuggggagaugggcuagagagugggggccaggagccagccauucuuuguaauagguagggacugagggaugcugggagaaucuggugccaggcccucuuuaauauguuaaauaggcaccuuggcuguuugcuccaggguuugagcaggucccucuuugcugccgcuagaacaguuggcugucuccccaugccuuacccgagacauugaggugaaugggcuccauccaucguucagucccugcggucauccucaaccccagauucccacugucauuggcacguaucggguggauuuucaggguacaauugucuauucuguuccccagaaauguuacucucccuugcuuagaaagguacagcucagacucuggguccuucucagucuuuguggcguuguacaggacaguuccugugaauuucuugguggccuugucaaacucauaguucugaaaaaggaggauguuguccagacgugccuuggguaguggaguuuuguacuugcaaggaauccugaugcaggcucccucccaggcaaagaggguuuggggauggucaacgguccaaucauuugcugagcuguaccgagccgaagccacguguccuaaaggccacaacucuggucagaaguuguuacugaggggugagaacuuccacuggaaguaggagagggagacacuggggagacacacgguggagcaggagcacagaaucucugcgguuccccuccaaugccccagguccauccccucucugcauuauccacugauaucuccagacccagcuaccagccugggccucagcacuuaccuaggaucaagaggagccacagguaauggacgcgcauggugucucgucugggugggaccuaaagaaggaagaauuagucuguaaacuggauguguuagcaugugacuguaaucucagcauucaggaaguugaguaaggagaauugcuaugagucugaggccagcgugggcuacauucugagacccggucucaacaagaacaacaaaaggaauuugccuuugagccaucuuguugcucccuuaucuuguuuguuguccccugaguucuggccccuuucuuccugauuuuguguguguguguguguguguguguguguguguguguguguguguggugugucuaguuauagugauagagauguggguagagccccugccuaacaagcacaggaucuagauucaauuguacuaguacuagcccaaaaaguaaaacuaaacucauagugcaguauauuuggaggaaguuggaaagccuuagagcagcgagaaaucugagcgauugccuccugagcccugggugcugauagggagcaaggggcaggcaucccuuuucuaacaacagccagucguuagcaggugggaauggggaccucauguuguccgaucacccacugucugaccauaaggaagaagccagauugucaugagaaaugucuugcuuuagaagcaauacauaggaccagccauagugguauauaccuaaaaaucccagaauuuuggagccuggaucuaugaauacaagcuugaagcuagucuggcuuaccaagucauuaugaguaguauuaaauaaguaguagcauacagcucuagccugacggaucaauuuaagggcaacuaauuuacaacucuuaucucucucucucucucucucucucucucucucucucucucucucucugucucucucucucucucucucucucucucuccaacaagcuuggccuccaccauccuacacuuuauguagaguuaaauuuaacaauuuaacucuauucauguggcugugaucucugugugaguccccagggaucuugcaggaugugccaacagagugugucuccgguguccgagagcagagcugugucccuucgcuucccuucccuuccacccacccaagguuucccauaccuugcacagcauccucaccucccucucucuccugcuauuucucucccaggccgcagggcacagguaguaaggacuucugggugaccaggaacagguguagggaaagccaguucaguugcugagcgugggcuggguucugccuccacgguugggggugguguggccuggguguauauaagagguuugugggcugaggcuggagcagaucaucugaggaagagcuuaucuuaguuucccagguacagggaaugcaccacauagagaugucuucaaagucacagccacuugggaaaagcagagcucaacaggaggcuucacugcaggacuucuuaaguugucuaaagagcuuagacaggcaguggccaugcuucuuuggccacgagcucuauuuuaaucuuuuccaaugaaagcguugcaggguugcaagcucuguucuggaggacacacuuuaacacaccggugggguugcuauaacaagggcuguggugacaaucagccucugggugcuggaccacccuguuuguccggcagccccuccagccacauccuuagcagagccuggcuggagaacucaagcuugagcaggaagcaggcaguuccagagugaagcucugaaccccaggaauuuacagcaugagaagcagggaccugagccuggggcccggacgggugaagagguagagcagggugcagcagcaacaguuacuaaguccagaagcuuagaacagggccaagaacugugaucugcucaccuucugagagccucaagguuagcuuccuggucccaucauuuccucccuggcacucaaaagcuucuucuaccucagaagacccagaaagccuggaaaggggacacugaacgacagggauggggagaacaggguagggaugagggguugggguuggggguuuaggcguuggagggugagguuugucugugccuauuguaaaguagaugaaaaaacacagcaggcccucgaggccagcacacagaggccacuccauauccacuccauauuuacuugucgagaacaagagaaaagauugaaaugguuuuaccuguuuccuccuguguucgaucuucaggaucccuagcaggaucugagaguaagaaaacuaagaaaagucucacacgcuuggccacgcccccuuccucucugggccucugcgagagaccagcagauaugguguggaugagaggccgugguggagaacacaaguuuggggucagauugauucucugcagucacguguuggcuugggugucuuccaugucugaugaauuuccaugcugcuuuguccaggcucccuagagccagacaacacacaaauacauaccugaacacacaauaaucaaacacacacacacacacacacacacacacacauauauacucaugcaccugggcgccaucacaaauaaguaauaaugaaguaaaagacuucccauucaggaacccuucuucccagagcuagagcucccagcuggcuggggaaggaacaggucuucuugaagguggcuuucgcuugcugauacaucuuauugcuagcaaucacaccgaaggcaggagcagagugaucuagcacugacaugaauaccuuagcagcuccacgggcgaggggaggaccagagcucuggggaagaaagauuugcugaaugggaacucuuuacucccuuuuuauuuauaugugaucgugucaagacgcaugaguguguguguguauguguguguguuguguguuugagcauuguguguguucaaguguauauuuguauguguguguuugugugucaggugaguguuauguuuguguauauguguguguuguguguguguuuguauauuugaguguugugcauguuuguguguuuguguuguauguuuuugaguguuguguguguuuguguguguuaugcauaugugguguguguguacauguguaugugugugguguguguaguaugccuguggugucugugguguguauuugugaguguauauguauaugguauguguguggcaugugagaguauguguuuguauauuauguguauuugaguguuguauauguuuguguuguauguuuuuguguauggugucuguauuuguguaugaguuguguguguuuguguuguauugugugugaguguguguguuguguacauguauauguaugugguguguguauauauguguaguguguguguguguguguguguguguagagaucagaggacaaccuguggaacgcucuccuuccacauuuauguggguuccaggggucaaacuuagguugucaagcuugcccacaaccacuuuuacccacugaaccaucuggcagcccugcaaaugggaaagucuugagauugaaacugagucacuugcuaggcagcagccagcagagagaugcaaauucuacagauggcagggaacaugagggcagagcugaccucagcucuacaggcccagggaaugugcugcacaaaaaugucuucaaggucauggcuggucaggaaaaacugagugcagacgugcaggggccacucauggcugggaggaaaacugaaccgccaagaggcaggaaacuccuuugcaaaguauaugugaccgugaagauggauucuguagcuuaagagccuaggaucugguggggucucccacugagauagguagaggucagugagcuccaaaauguauaggggacacaugacaucccaccugguucucuauuaacugagagcuaaggauaaugguuuagggaggggaaagucugggauaaacauuccgggggauuuggaugaagucuggcucuacagauagcaaaggucaccggcuuauuaauaauaucuacuccuaacuuucuggguagaaaacagaggagacaccccuguauuuacaacauuccuguuuucuccaguguuaucugugaagacggaauggcguguccccucuacacaauaguaaguaggcuuuacuguaguccuucugaagcuggcuaaagagcucuauguuacuagacaugggaguagccugaggguagcuagaaacacacagcaucagaaagaguuaagaagaacuacagaagauagugaugggggaggggggagcgggauguagaaggacugcuucccaaccacucaagaaauugaaacaggaagaucaaaaguacaagaucagccuagauuacagaguaauuucaagacaagcuucagcaaguuaaugagacccugucuugaaaugaaaaaugggaccugggaguaugauagaagaguagaaucuuuucccugccuagaaucccccagugaggggcugggaguguggcgcagugguagagccccugccuagaaucccccagugaggggcuggggacauggcucagugguagagccccugccuagaaucucccagugacggccugggggcguggcccagugguagagccccugccuagaaucccccagugagggguuggggguguggcccagugguagagccccugccuagaauccuccagugagggccugggggcguggcccagugguagagccccugccuagaaucccccagugagggccugggggcgugguucagugguagagccccugccuagaauccuccagugaggggcugggggcguggcccagugguagagccccugccuagaaucccccagugagggccuggggguguggcucagugguagagaauuugucuaacaugugcaaggaccuacuuuuaacccccagacugccucacccaaaaguggcaauggaggagggcacaaccaagguggagaaacuccacaaaucaacagcagagagcuagauuuggucucugaccagaacuaggauugaaaaggagaagcuaucuggguaagguggugcaccauacccaaccaggaacuuuaauuaacaaccaggaacucuucaggaggggugaagccucauuaugucccucuccaucuauguuagauucuaauuacauuuuuugaaaugguccuuacuauguagccccggcuggccuggaacuuucuguguaaaccaggaguguccccagcucacagagaccauccuucuucucccucccuagugccaggacuaauaauauuuuuucauccauuuuuggcugaauccauagauuccaagguggaggauaugaaagaccgacucuccuucucccuauuucuucugcuaaguacagugaaacucuggggcuuuauuaggaagcacuggaaggcucagaagagcagagagacagcucaagccagguugacacccugaauccuugagguuuagucugcugcuauguauuuauuguaaugcuaaauucuguaucugaagaucuaggccuugcauuuacaagcuuuuguugagcaaaccuugugccuuaauuuaaaacuacugguuaaauaaaaguggcugcagugaacuacuggagggauuagaggcaagugagcaggguggaaagcaaagaacgagaggagagauguaggcugauaguuuuuaaaaccaacuuuaauaaggguucuuaaaugcuuuacccucccuucuagcccaccacccaccagaggcaguggaaaggaaagauuaauagggcaaaggaggguguggaccugguuuguuuguuuuuaaaauauuuauuuauuuauuuauuuaauacgaguccacugagcugucuucagacacaccagaagagggcaucagaucccauuauagaugguugugagccaccauguggaugcugggaauugagcucagaaucucuggguaggaauugaacucaggaccucuggaaaagcagcaagugaucuuaaccgcugagccaucugucuagccccauggacuuguuuagaaaugggguauuuuuggcuuuguuuuguuuuuuuggguuguuuguuguuaguuuuguuuuguuuuguuuuguuuuuuaguaaauccaaucuguguugucaggauaucaggaguuuaguucacuuggaucagcaguggcagcuugauccacuugcaaacaccauucauaaaucagcaacagcagauugaucacaaagaaacuucaaggcucugccaauuggccugaguccauggaagcagcaagaagcugccagaacaccaccagaaguucuuuggugcauuucucccuuugaagucauaacaaugaucagcaaagaguagcaaggugaaccaguaccauacagcaucaucagaagacaaacaucagcaaagcccaaugcugaucagcaaagaaugguagggaggcagccaggccaacaguuagcaaaauagauuagagguuauucccacccccacccccaaauaauugucaaagccaaauaaaauaaccauaaccugagucucauuuauuuuuaagcuagucagggauaagcuuaaacugguuguaccacacugaaccccaaggaaugguccagcaguugcuuuuccuggcucuuugcuucuuuucuugauguaggguaucauguagcccaggauggccucagacuuucuauagagucaaggauaacccugaacuccugauguggaccaucucccugugauguggggcuguggauugaauccagcuuccugcaugcaaggcaagcacucugcugagucccaucccagcucucucuuugccucaccaaaaccagacugcauguuggugaagccaacacacggcuagaacguuccaucaaaacccugcuuuuuuacccagaacagcaagagaaggguacccucagagacaggacucuuaucgguaacuucugugugcccgcuaaauacuacagaaaacuccaacaacuucacguccguguguguuuaugcuggagaaggucugguggcuguagacuuucaccccggucaggccguaaggaagugucaagcguccucuccacgcucagcccagagaagacagaggaugaagcugagaccuucuucccucaguacaguauggaccaccauccuccagagggcagugagccccuccucuucuccucccgccuaaaggagacucgggccuuucauccccacucaaaggaggaggccuaaaggagacucgggccuuucauccccacucaaagguagcacucuuuucccauuccucagugacacuggcagccauaggggaacagccaugugacacauuucuccuuccaaggcuggauggucuuagcaggaaccuaauagcauccugagcucucaauaacaugagggagggcugcauggagacucuggauuuacagcccugcgaagggaugagccaguauguugcuucuugggaacagcaggaggugacugccaaagugaaagucauaagaccucagcucaggcgcucauaaugcaaaaaaugcacuaaggucaaggaaaucucaagccaacagaggaaagauaaucuacagauaccaaccucaagaugacacugagguuagaauuaucugacaaagacuucaacgaugccuuuauaaaaaaaaaaacacuucaagaagaaucacacacucaugggccugaggcaggaagguggcugccuugaucgcuuuucauggcugugaugaagcagguacaguuaaaggggggaaggguguggggauggggggaggggugguggugggaguggaggguggggggaugggaggggggcacugucugaauguggcauauacccacauggacacauacacacauaaauaaaaauaauaaauagaaauccuuaaaaagaacucuuaagaaccaggccugagggugcucauccauugcucuagcacugggggaggggggagaaguggggcaaagaaaagauuguuguaaguuugaaggcagccuggacuacauaguaaguucuagaacagccagggcuacauaugaaaaccuugucugcacacacauacauacauuaaacauuaagagcucaguguaagccuggugugguagcuaauagcuaauauaccagcaguuggggagcugaaggcaacaggcuuucuaugaauuuaaggauuaauuacauuaauuaauuaauggugaugcuugcucauaaccccgacacuccagggcucaagcaagaagaucacaaauucaagauugaucuaucucaaaaacgaaagagagaaagucaaggcgguugugaugguggcucacaccuuuggucccagaacuugggaggcagaggcagagggauugcugaguucaaggccagccuggucuacagagugaguuccaggacagccagagcuacacagagaaacccugucucaaaaauaaauaaauaaauaaauaaaua

SEQ ID NO: 3707 - RNA, 4376 nt, Mus musculus
augcccaacauuccaagauauuauuguagauaauaucacaggaagguagaagucugaggcuagccugggcuacacaggauccugucucaaacaaagcauaaaccucacguggaaagguaaguuuguaagcuaagcagcacacaaccacucaagcugcacaucuuguguagagccucuguauuagauauauuccucacauccaaguggauaccuguggaggguugggaauaggaacuggguagaaugaagacguagauacauaaagcaguggaagagaggauaagaaaauggguaauuccaucucucggugcccuuuaauuccccccugggaggcugucuggguaccccuguacccugguacauaacccacagaagagaacgggccaaguggggcuuggaggccagcuagguaccugaugggcugaugagguuauagcagagcucugcacaacaggaacuuggagguuugcauguggauagcauuuggugggacccacauaacaggcaccacaccugccccuguuggacagugcugugaacugauacacaggucgggggguuuguuguacacucugugugugaccugaaagccaggcucccaucucuauuagggucccaacuucuuggcuuccaaacacuaagagacaacugugaaggugccaggaugaaccagccaagcuguaugcuugaaccacuacucucaaggagaagccuuccgugcucugacuguccuaacaugggcuguggguccauauuauagauguggauauagagaaccccaggagcugugagcacuaagacuggagcuggguccaucuagacuccauugucacauaccuaggaauccagugcuuccccaugggaguuucuuccugucuucucugccccaguuccuuacugccuuauuggaaguauuagccugcugcuaauuauaacccagccagucaauuaaugaagggacuccucguggagagagcugagcacuuaaguuuucugcucccaaauuagaggaagccuguaggguuccaagaagaguccaguaacuuuuguauugaacaagcaugcuuagcaagcacucugccacuaaccuauaucccaggucucuuuuuacuuauuucaagacugucuuccuaacucaagcuggcuggucuuaaaacucuggagcccuucaagacuggagagauuagcugggugugguggagcacaccuuuggcccuggugcucugugcguucgaagcuagccuggucuacaaagcaaguuccaggacaagccugggcuguaacaccgagaaaccaugccuugaaaaagcaaauaaagagcucagugguuaaaaacaaaacaaacaaaaaaaccaaccaaacaaaaaaacacuugcucccauaaagagggccagaauuugauucucaguucagcacuucccacuucagagcuauuguauuccucuggccuccacaggcaucuauacucaaaugcacauauccacguccacaacccccaacacacacacacacaaaauggaagucuuaaaaaaaaaaaaguccagggcuaguaaggugguugguucaguuaguaaaggcagcagcuccaagccugcagcggaagucugaucccuaggaccccugugguggauggagagcaaauuucugcaagugaucuucugacuugcacacacacaaugaaugugaaugugaaugauggggagaacacccagccucuagccugaggacaguucacccuugaacugucaagcgagacucagccgggugaguaaggccaguaguuagaaacccgcaagggacugcauuacucuagggugcaggcaagguaacuucuggggcucccgugugucugccuuacuccacuuacuacaucugggaggugacaggauguuauggacccaacagacuugacuuucccacaguacaggcuaggcugcccagcuuauggggacaguagcuagcccagaacaggggcuuuauauaaugacagugacuuugccuacuaaugccuuuagauacagaccugcccuucuugguuuauaugacggcugaggcaggaggaccucaaguucaagguuuaucuuggcuacagaguuuaggguucuuccucagccacuuaggaguccuugucucaagaaggggggaaggggcugaaguugggaauguaguucaguggaaagacacuuaguccuaguacccaaacacagacuacugcucuggauuuucacaugaaaucuuucccuugucagcuguuggcaaaccaccauguauggauugggccucugauguaucaguguacaccgcuguucucaacuccaugagaagucagauagaacguagggugaaggcugugucccuagucuagaguacugcaugggugguauggagggcagaaccaugucccagaaucccauuccagcauggggccacacagcuucugaucaugcucaugccauucugccuucccaguuuaugcugcuggcaaagcagccaccucaggugugccaagcaucuaugcccccagcaucuauacccaccucucuccugccaagacuccgccaccuccgccugccaugauucccaugcguccucccuauggguacccuggagacuuugacaggaccagcucaggugaggccuuggggaauccagacaagaggugggauggggcuggaagggagcaugggagauugggagugcccaacucugcuccaaauggcaagugucacugauaaccagucucuauuaguugguggccacagcucccaggugccccugcugcgugaaguggaugggagcguaucuucagguaagaugcugugauuuugaaggggucguugccuggaggguugauucacaugcacauccccucccaaaccaaucaccuuguuccucucuucagaaguacgaaguggcuacaggauccaggcuaaccagcaagaugacuccaugaggguccuauacuauauggagaaggagcuagccaacuucgauccuucccggccuggcccucccaauggccgaguggaacggggugagcugcagaccugagucuaaaggggaugaagcaugcuugccuguggugcuccccggggaggguguuaguguaugggugacaagauuggaccugucuuaguaccagugauaucucccuucucuacagccaugagugaaguaaccucccuccaugaagaugacuggcgaucucggccuuccagggcuccugcccucacacccaucagggaugaggaguggaaucgccacuccccucggagucccagaacaugggagcaggaaccccuucaagaacagccaaggggugguugggggucugggcggccucgggcccgcucuguggaugcucuagaugacaucaaccggccuggcuccacugaaucaggaaggucuucucccccaaguaguggacggagagggcgggccuaugcaccuccgagaagucgcagccgggaugaccucuaugaccccgacgauccuagagacuugccacauucccgagauccccacuauuaugaugauuugaggucuagggauccacgugcugaccccagaucccgucagcgaucccacgauccucgggaugcuggcuucaggucacgggacccucaguaugaugggcgacucuuagaagaggcuuuaaagaaaaaaggggcuggggagagaagacgcguuuacagggaggaagaagaagaagaagaggagggccacuaucccccagcaccuccgccuuacucugagacugacucgcaggccucgagggagcggaggaugaaaaaggugagccuagacccuuugacuucagaucuucaggacgccucuuccuccagcccguacaauuaacacuuuuucuuuucuccuuugcagaauuuggcccugagucgggaaaguuuagucgucugaucccacguuuuguuauguagcuuuuauacuuuuuuaauuggaauauugaugaaacucuucaccaagccuaauaaaauuccugaucacaagaucuaagccucuuguuuugcugcacgaguugagaggagggggaccagcaaaagaagcggccagacaggccuuuagccuucuucauagccagccgccuagaguacgugccccuugccgccuccgcccugccccgccccgacgugcgcaugcgccuucgggagcgcgcgagcgcgcaacccggcuccccaaccuccgggcuccuauacgaccuacuuuuacagucuucaaacccugugccccggcgaucugagccccgcauccguguugccggccuuccagccgggccugcguuccaaccggugguggucccguguagaguccccgggccuauguguguguacgcgcccggccgucaccaaagacagaca

SEQ ID NO: 3708 - RNA, 9761 nt, Mus musculus
agaggacugggugggaggcugaguugauuguccuuuuccccccuccccacuccccccuccuucucuuccuccuccuccucccuccagggucuccucccucucauuacauccuuccuuccacaccucacccaagggucuucccuucucugcaccuugcccccaucugcgucccucagauccucgaguggaggccaccgccuucagucccccaccauccuccuccuccccagcucccaccccugccuguggggccuggaaacgagagaggaaaugacugggacgcucugguccccgccugccugcguccgcgcccgcccguggccacacccuccacccugaggcagcucccacgcgguacucugacacuucagucuggagaucuccggcucagauguaagucccucuuuugcucuauugcucugggccacacacgcaggugggaagcugcuugggaggagaagagaaggaucucgaugccucucugccucguauucacucugugggcaccuuuucugccucagucucccuagagcgccuccauugcgggcagacaggucccucuaugaucugcccaucacgggugcugggcgcgguggugccugcagggcagccggacaccagcucacuuuuuccuuugagagcagcccugcguuagucacccuuccuguuccccuccuggccccgcugcucugggcuccugcccucgagggagcagacacagcgggccacuggcuuccuccacucaggaaccaugggucgggaggaucaguuccagcuuuaggaggagggagcggcaucuuugccucaggggugucaggaagccaggcucgccugaugcuucuggcuuucuuuggggaucagcuccuggaagaaggggaugguggccugagacggaaaaaaaaaucucuccccaaaggcagauaccagaggguccuugagaccagacgccugcuccaaagaggcugcgagggggugggagggugcggaggggcuaugccuuaccuuugccucagcuugucccacagaugucacuguccagucgccugugucuccucacuauugucgcccugauucugcccagcagagguaagacaccaccaccaccaccccucgccccaauccagcuccaggaggcagcuagaugggugauugcaaagcucaaauacuggguaccaucuucucacucuacucccucgccaacccccaccgagugagcgagcaccaggaagugggauuggcgaggcaggcucuggguagcacccucuuuggacacuuuugagcucgggugauccagagggucugacuggagccuguccugcugagcauccucccuuucaccucugagaagaacuugcugaguuugacuuggcugggagauuggugucaguuuucuacucggccgccaggaaaccccaggcuccaggcaaagcagaacugauggguuuucugagaauacaguugggcaaagggguccaagcuggggcucagagacccucacucuggccuggaaaguacuuguaaaagugcccaggugggugggcaguuaguucuguucugugccucgccaugcccauuuuguggauggagagaacuguuguucagugagcacacaaggcgggguggggcacaagaagaagaaggagcugcugauaagcccaaugaaucugagagucaguagaagacuggguuggggugaaaucgauaagaagaugugggaccagguaaaaauugugggcucugagccugcagggucugucuguccuggcauggguguucacgggugacuucuggcugcaaaggcugcuaggcaucucgggggggggggggaggagacagggucuagcccaugaagcaugaggagcaagcccguucccuccuuagcugucugucuauggggcagagagcccugcuccuuuacuagcucgugcuuuucagaugaggcaaaugaguggcucaggucacggagcgaggaggaaguggucgggaguggaaugugcuccaaggcccugguuuaccccaaacaccugcacucucaaugaggcuguccugcaagggugugcaaagguccugcggcaauaggaagacuucagucacacucaagacuguagagugacccaguuaaagcugauuccccugggucuucagugggucuggcgaggugggacagaagacaggagaagggggugagagacucccuccugaacucucagccuuuaucuccccagggcagacaccaaaaaagcccacauccauuuuuacagcggaccagacuucugcgacuacucgugacaaugucccagguaagaaaagugaucgagggcuggagagauggcucagugguuaagagcacugacugcuuuucuagagguccugaauucaauucccagcaaccacccaaccaucugcaaugagaucugaugcccucuucugaugugucugaagauagcuacaaugugcucauucccaugcauaaaauaaguaaaucuuuuaaaagaaaagagagaaaaggaaaggaaagugaucaaugaaauucucaccguggacaacaccaccaccaugcuuagaccaaagagggaaauuuacauuuguguaacugggaggaaaaaaaaauagggauaaagauucaauaauggcuugaucuaggugcuuaaaagcuacuacgaggaaccuaguaccaacucuugcuuccaguuguucuaugugggguucagucaucccagccagcuaaagcuccaucuugcucugccaucaguugcccuguuugaugucagaggaggaggaggagucuccaaccaggacccagccacugagugcugggcugacaggcaccccuccaugccuggcccaggaguccugauuagagcaggcaauagugguuuguggucagggagguuugggaaacugagucaaacaccuuuuuuccagggaaggcgucugaguccugcuaauggguguggaggcaagggagauccaggcauccuacaugagugcuuaucaaggaaccugaauuccucucauggccucaacauggaccauguucaaccaugaggaccccaguucaauccccagagcuguuauauaaggcccgccauaauggcaugugguuguaaaccccaagguggggagacagaggcagguggaucuccagggcuugucagcuuagcguacuuggugaguccaaagaagaugagagagccugucucaaagaagggagggcagguggcucuucaggaaagacaccgcagagugagugccucugcccaccuugcacacuguauaggcaguuaagaaaaacaucgaguugcuauggaaacucuccagucuucaccuagggaaacucucugcugcucccuucucacuucucucucugacccuguuuuuaccccagauccagaucaaaccagcccaggaguccagaccaccccucucaucuggaccagagaaggugaguggagggggaggggcagaacccacacuugcauccuuaccccugacagcugcugguccucacucccuccagcacaccccagcucuagacccuugccagcugcacucuaucccuuacuuauuuuguccagacauuacuauuuuguagcccaggguagccuaaaacucagggcaauccuucugccucagccucuggaguguuggcauugcagaaugugcugccugugucuaucuacacccaaucccauugacuuaaaaacaaaaaucucuuuuucauugacccauuuuuaaaaguugagcacuagauguuuauaaacacuuccggugagugcucagccauagcuucuguucaggucuggaucucuuuagauuuuuuuuuucuaaauaauaauuauacuuuuucuuggaguauaauauaauuuagaguacuucuuguaauuucuucaguuaaugauuagugaugcugaaggcauggcucagugguagagccccuaccuagaauccuccagugaggggcugggggcguggcucagugguacagccccugccuagaauccuccagugaggggcugggggcguggcucagugguacagccccugccuagaauccuccagugaggggcugggggcguggcucagugguagcgccccugccuagaauccuccagugaggggcugggguguggcucagugguagagccccugccuagaaucccccagugaggagcugggguguggcucagugguacugggcuuaucauguacaagauucugaguucaaucccagauaacauaaaaguuguuuuaugccagcacaaggaggcucuggcaagaggauuaaaagcuuaagaucagccugaagagacccaauuuuaucucguuuuguuuuguuuuuaaaacuaccaggugaagacugguagugggcgcacauuuaauucuccuggacuguucaaagagagucccuacuccaucccagcaaggugucaccugguauuucagccuggaauacccccauguggagggagcccuggcaggcaggucuggggagcugagcacaucucuuccccucagugcucacccuccccuccuuuccuuccaccaaagcagaagccacaggaagccagacagcagcccaaaccgagacccagcaacugacaaaaauggccaccucgaauccagugucagauccagggccacauacaagcagcaagaaagguagagccccagcuggcaguguuuaauuuccucuguuuguucucucucucucucucucucucucucucccucucccccucucccuccccucccccucccccucuguguguguguguguguguguguguguguguguguguguguguguguguagauguuuggaggauucuggguuaaagucagugauucuuugagaacgaccuucucggguccuuggugaagcuaacuucauagcaaucaacuccacguuggaacauucuaacaugccuuacccuaguauaauaguugagccgacuggccaacuggccauccguuucuccauugcugggcugguacugagaaguggaguuguggguuuccuuugugucuuuuuucuguuacaacaggagcuuuuuaguugcaaccuuuaaaaaaaaaaaaaaaaaaaaaagauguauuggcucaauucuguaaaaccugaagauaagaugucaggcauagcuagauagaggaaauuaagcacagucaguaugucuaaauugcuuguugugccucuuuugucuucuuucacuuuucuucuugguagucaaaaugccccauggucgcccagcucagagccacacaacuuucccauaagccccgccuaaaaccugggcuugacuuucauuggcccgguugagcucacauguccuuguaugauccaauggaagccugaaagcaggcuguucugauuggucgaugaagccucaauccucacuggaaaaguccacacagcccagaaucaggaaggaaguaguguccucgggacaaguagguuagugguggcagcagguguguggaaagaggcugagcugagacuaaggcagcagaugaccccuuaaccuuugugugacgucagagcucaggagugagaacaugaggccggcgugggguacauggcagacccuguguccaacauuuuaaauuaaauuagaauuaagaagagaaugccccgcuauuuuuugguccaaaaguagagaggauguucaggauauuuuaaauaaguaucucuaggcuggagggacaaagucgguguaauccuguccccugcucucggguuguuagcggagguccaaaagagggacccgccugggcugagcagcugguccagccuuggggggcggggggugcaggcaggugcuuguugccauagugugggugggaggugccugugcucugcaccccagauguagcccuguuauuauauccacaucccugggucagccccugaugcuccuccugccuuccacugucuucugaccauuuuuucugccuaucaccugaagguaccccugcagucuccaggaucgagccucucagcccauccaaaaacuucaugccuccauccuacauugaacauccacuggguuaguaccucuucuucuugaccagaaacaggcacucuguaguuucuuuaccguguggguaaaucuucagggcucgugcuauggaggaaacugugcugucagacugggugguagcacaugccuaagugccauggagccaaccaggucaucauguggauggcuaggagguugcuuucugagcucuaaauuuucaaaauugaaauuaaggcugggcucaguggggcagaucuucuggucacuauagauucacuuauacaacuuaagagcaguuguagaccagcaggggcuccauuuggucauccugauucuuccccucugauauccccccuuccugcuuauugaacccccacugaugacauagacaugcccacaucaccccuucaacuguguauucagcguggauucaugcgugugccagacagccaugaacaagacagacaaauaucuuugcuauugauggguguggugauguauuccuguaaucuuugcaccugggaaacagaaggaagauggcagcaaguuugaggcuagccuggacuacauagcaaguuccaugacagcccaggcuacauagugggacccucugaaacugacacuguaguggaggaagacagcagauaauaacuggaauacuuacaucaaucaucagaugauuuuuaguuugcuagcaagaaaaauagagcaaaacucaggauuagagaaugcucauguacagaaucaaagaagacuuccagugaaggaggugacucuccuccgggagagggaacggcaguauagaggcccugagaugaguggcugucgagauggacucaggagcagggaggcaagugggugcugagagaggcagauugaggagagaagaucuaaagacuuuguagcgugucacauugaggacuuccacuucuguucugaggucuuaggagaugaggcucagguguccccagcccuacuucugcauuucacuuauucacuccacaaauguccacccagcucugacuugcauguaucuguccucucuagauucgaaugagaacaaccccuucuacuacgguaaguuaccccgcucccgcucuccccuccccacccccgcaccgcuggagauaaguggggagaaaaaacaaagaccccgccccuccauuucucucuucacagaugauacuacccuccggaaacggggacugcugguggcugcggugcuguucaucacgggaauuaucauucucacuagugagagucgggcaugggcagaaagggcaagaaggggcugggggcgggcugggcugcauggugacugaggaucagggucuugaaacccccugggcaaagcugugcaaacucagcaccccuacaaaccaccccagggaugauucucggccuagccugcugguugcauccagcugggcgguuguucugguugcagcagggggcgcuguuccuagagugcacgucucuuccucuguuguccuuuucuuccugggcucggucacgugguagugccccgaugagcgauacagagacacacaggacagagauaugcagacucagaugacugcuaguggauacuacguuaugcuucuuuacaagccaagggucggcuucauuugugagaagagaaaacaggacuucauucauccuuuuaagacagggucucacuguguugcucaggcuggcgucaaacucacaauccuccugcuucagccuccugaggcuugagguuauaggugugccaagcugaucagcaguuuuuggguuuauuuuguuuugagacagaggagcaugucgaccaaagauggccuugaaucuguguguguguguguguguguguguguguguguguaugugugugugagugcagaggccaugacagauggaagagaguuggauacccuggagcugggaguuucagacgaugugagucuccuuagauagaugguaggagcuggaugugaguaaccacugaaccaccucuuccaccuuaaccuugaacuucugacccuccugccucuaccucccaagugcuuaguuauagguauaggcaguuaaugcagcacagggagucaaccccaucacauuguacaugccaggcaagcacaaccgaaccacagcccucuggaccugacuucuuuuauucacgagagcucugcggguugcuguucucauugugaccaaauaccggacuggaaucaauuucuggaagcguuuauagcuuaagaagagauccauggguuuaggagguauuggugggcaaagugcuugcuugaggaccugaauucagaggcucagccuggguaucugggugacacccacccaugcugaagagagaaaggagccagcccagcugcaucagugugugccagguucagcaaagaagacagaguccuuugacucugaaauacagugcagcccaaccgaggaaaacacuccacgucuaccucuggugggggaggauguguggucaaagaggcugaguaacaaaacaggaaguaagagagaagggaggagacuggcuggucuuucuaugacagcacacccucccgagggcuaacugaugggcaagcagagcuauaacuuccuaggugacccuagacucugccucucaaaggcugcccacccucuccgucccaacccugaguacuaaggacccaacaucaaagacagacauuggagggacacacccaaaccacacgcacuaacagugggaaaagccagggagacacagacagggagagcagaaggggaggccugagaggcagguggcugccaucuucucauggccccgugccuuuuuaaacucuacgccaucuccaauugacucuaauccaggucccagcuucucuugcucauguucuuccaucucacguccgcccuuuaccacagggauguuugcacaggcugcucugccccaccacagcccugcauuuguucaucucaguguguguguguguguguguguguguguguguguguguguguacauguagagaucagaggacaauuuccaugaguugguuuucuccuuuuuuaaaacaaagauuuauucauuuaucuuauguauauggguguuuuaucugcauguaugucugcacacaagacgagggcauuggauuccaugggucugcaguuauagacaauuaugagugucuauguggaugcugggaauuaaaaccaggaccuucugaagagcaaccacugagcagucucuuuagccccugguuuucucuuuuugcccaaaacucaggacaucuggcucagcagcaaacaccuuuacuuguugagccaucuugcugucccccuucacugggagcuuccugagguccagauugaucccccacccccaccccccagccggucuccagugacuaugugauaauuaguacuguuuccagcucaugggcaaacugguucuuuuucuuccaggugggaaguguaggcaguugucucaauuuugccugaaucgccacaggugagugcgggccagcacccugaugggcaccccagcuggagccuccaaacuacaccaacucaccacccccugccuccucccucuaccccaagagccuacagagugaucaacaugaaagaauccugaaaggaagaggccacuggagggagucaggcuuaaggcuaauggucuucccacccuggggagagaggucucccuaggcacugcuguggcuguucagauaaauccacauggucucucuuccauggccu

SEQ ID NO: 3709 - RNA, 8958 nt, Mus musculus
cacaucagucuguccugcuuccagcugcugcagccgcgccuucgcugccucagcauucagcaacccccugcucaggcucagcauggccaccccaacccagagccccacaaacggugagcgucgcuuggggaaugggugcuaggaaagaggugggggaaucuaggagcuuaggggacaggauguaggaagaaucccauacggaaaggaagacgaaggggagagaaucugccccuaucaugggcggaggcccaugagcacauucuuugacaucccuugggguuucuugagcacccucucccaggagauauccucccugugcgggaccuaugauuagagagugacagucccaagagaaaggaugcgcggacagguugccauggcaaccgggugccugguccagcacagcgguggaagagaugggguuuaaaggugggagcugagggaucugcagccagaagagguucuggaagacuucagcacuccgagaugggccagcuaaggggggauucauuaucucauguuugccuaguauaguguggauauuuacuaaauuccuugacaggcagacaugcuaagggacagagggacgauuaaagggagagagaagagggugaugguggugguggugauggugugaccagagauggacuaagaacgccugaaagagacagagaccaagagauacaggagagacagaggcacaaaaauccagguagcaagcuuucagagacgcauaguugggaggagacagacagacaaacagauggacagacagaggaaggaagaagggcugagauagaggaacauagacaaguauggagggagggggaacggguggggcugcagcacugcagugaaccugcaugguggggauggaauguuggggaccccccucccagcccacaugcacuuaugguuucauccuggagauacauuugucuccccgcauccagccgcacuggguuuacacuucacacccauuaacccagauuugcguucauguucacgggcuuaaacacucucugacuccgugguuuccugaucuucccccucugugugugguccucuguggacgagcuagggggaugcuugaacgaggcuggguggggggcagggcagaggacuggggguugcuguggagucccugaugauggaggaaacccuaauuccacucuuacagcaccuuuccucuuucccagcaggcgggguugggggagggggacugcugugcggagcccuagcugcagauucccaggcagggcgcgcgggggggggggggaagaggggcugcagagucugggagccaccccagagagaggggguagggcugagccagcaggucuggcgggagcccagggcuucuuuucgcagagguggugguuagcaagaucgauggcagcagacggguagaggugggagggcagaugccucgccaauccccuucucccugucacaggcugacaggggaccgcaggacuugggaaaccccgggggagggaaagcucgggugcauucuucuuccccagcuuacagaaacaaauuaauaaauuguugagggaaagaagggagaugcggcucuugccagagagcgggagagagaacagaauggggauguggccauaccugggucuaggucccuauuuuggggagugaaaacacucagguuggccagaagccaggucuccaggugcaaagaggggagguaagauugcccaguuccaaaacaucacacaggaccccacccagccuggaauaccaggaccccaccaccucgaaagaugcccugguuuccauagcaaccaccuccuuccugaucucucccuggcagcucgccaagagugguguacauugcuuuuccugccuccuggcuccacccguuacucagccacacccuaaagacugggacugcuguggacagggggauccucagaggauuuuuggaggagcccagcaagaugcugggacaagcaucuaccuggacaaggaauguaugggaaaacaacaccuccaucuuuggugcaaauaccugcaaccuaggagguccucucauucauucauucauucauucauucauuugcucacucauucauucauuccagaaaacuucuugcgaaccagacugaauggcagagaccaauuugcccacccucugguggugacacuaaggugcagcacaggugacucucagacacuggguaccagcuguaugcuucugagguuugcccuacuaaaauguuccuuuugcugauguuuaucuaagacuuuuccuccagagaaucgacuucuuaaaaaaaauacuagugaguuuuauuuuuuuaccaccacuauaaguggaaaauuuaguauuuuuuuucucucuugcccuaaagugaggcaagaagcagguguggucauccaugcuuguaaucucagcacccugguggcagaggcaagaggaauaugaguuuaagaccagccuggauuccauaguaggaccuuuuuacaaagagcaaaacuaaaucacauuccccaaacaacaacucauuuggcaaauauuaaagagacaucaacacuaaaccaggagaccugggaagacacaccauacaaaccagagcuaguuuuggucuugugucauaccagacuguaucagucaguuuaggcuccagguagcacugguaacaaauagaaccaaaagcccaguggaggcaggccacuaaugucauugcucacuuaugaaugugcaggaggccucuacaucccuaagacaacuaaagcacucacaaucuugaaaguucauuggucagauccaaagacaaggccccacccagccccaguagaacccagaaguggggggggggggcaacaaagccauuacccagcucccuuucuuguggcacaagcugcagaauucugcugucacaggacagaaagugauacgagcugcaggaggaagcugacagcuacaggguggauauccaugguaccacuguguaguccuggcuggucuaaaacucacuuaugcagaucaggcuggccucgaacucacagagauccaccuucuuaugcuucccuaauacugggauuaaaggcaugugcucccgugacuggccagagugggcaucuuauacgggaaggauuuuuugaguucccccucuuccuggcagggucucauuguagcccaggcuguccuuaauaucacucuuaucuccuucuuccuagagcugggguauagauguuggccaccagcucuuuucggggcugcuggaagggauuuaaagcaaaggugaaaggugaaaaaggguuacacaggcacucaugauugugcuugugcauguucacgcgcgugcacacacaguuacuuucuaagguuagugggaauccacuaagggucuucuguuucacaugauggagaagauucauuuacagaagagaacagaguugccacaagauugaucccgacucacauauguuucaguauagcugcccauacugcauuugguaacaaucaaagcagguaggagagcagguggcagccucaugaccucaggggcccuuggacuaggaagguugagggagucuucauggaaagccaaugcaucuauugguaguccuuuugugagacugggcuaucauagguccagcauggugugugugugugggggggggguguguguugguuguguuguguguauuuguguguuguguguguggcauggcguguggagguguguguagugugugugguguguauuuguguguugugugugcuucuguguuugggggggugcgugcgcaugugguucauagaaugacucuaaggcacguaccaacucuccuaggggucuaggagcaggacagcuggguggguugugcaccacacagggcaggguacugguugauggaguuaaugggccugaugagcauccuaugagcucuacggagaggcgguacuguccagcagcaaggaaucuccuaugccaaguccuauaaagcagcacuugguccaucuugcuccucaaagauguucagaaagccagugcugaaacauguuucucccuguucucuuccccugucuucuuccccacaguuccugaagaaacagauccuuuuuucuauggugaguguugggucuugugccugggauaaccuaaugcugggauggaggggugguuucuacugagacuaccauaccacagcuauguggcuguagcuagggcucacugagaaggggucuguggagggcagaggcagacuggggaaugggguuggccuccuaccuucugcagccccugaugaaggcugugaaccucauaaagccuguuuuuuccuuggguucaggguagagauuaacugggguuugcaagacucccucuuuagagacuaacaagagaccugggaagggcaaaugcauucguuauaucagcgcucgauggacugugacagucaggcuaggcugcugccugccucaguaacaaauaguccucaacaugucuguggauuacgacgaggacuaugcacucgugcaccggaaauaaucagagagcaacuuggaaagaguuauaaaacaacucugggguucaaauauugauuuauccauucccuagcucuguggacuagggcaagcaacuuuuccuccauggaccuuccugcaaguaagauguaguaacguuuuccaccacugaggaauauggagagaguuacagcaauggugucuuucugucauucccaagacacugaagcccugggucugacagaucugagaucuagcuugaaucuucuucuuucuguucccuugaccccauccaucuuugcuuaugcguaagauccaucucauaggccaaggucuuuacuaccucagggccuuugggcuuaacuguucuuucugccaggaacaugaccccccuccccccagcucucuacacagugagcuaagacuccuuuccuuucuggccuuagaucagauauugauugcucacuaggaagcugucccugagucccccagcagaagcagccauaccucacccugccaugacuuggggauuuguguguguguauguguaguuuugguuuuuguuagcaauuuuuguuuguugaugaaugguugaucacuaccuuggagccagcugcugaaguggcagaugcagggugcacucaccagguaccccaagucuccucccugcaaauauaugcagugccugucugcugggugccaggugcugcgccaggcucuggagacagcauggaagaccagacuuuuuugcccuggcagcucacaucacacauguauuggagacaagaaucauuccugcuagcauucagaagccugaggcagggucauugugaguuugaggucaguucacauugugcagugagacccagucucaaagcuaugcauucuuuuauuuuuuuuuaaagauuuauuuauuauauauaaguacacugucacagacuucagacucaccagaagagggcaucagaccacauuacagaugguugugagccaccaugugguugcugggauuugaacucaggaccuucagaagaguagucagcacucuuaauugcugagccaucucuccaauucaaagcaauacauucuuaugaaggaaacauaauggguuagagagagcugggagcaugagacuuuuaauugggacacuucauuuagguccacaggcugaugaggaagucacauauauggaaccuuuggguagagaaaguggcuggugcaaagguccugaggcaggaugguugguaugcuguaggaauagggaggcuuagauggcuaagcagaggacuguggaaagagaggggucccugaagccugaguaggaucaggauuaggucauucacugaaggacucucauuuauuacaucagugguagauagacuguguuagucaggauagccugcugccugccccaauaacaagaaguacucaaugucuccauuggguaugaacuccauugacuccaggacuaugggccugugugcugaaauaacuggagaagcaacuuggggacagucguaagaugacucugagauaugaauccugauuuaccuugguuucugcuuggaauccuguaagggcaauagagaggccucagggggcuccugcucugacuggaagcaauggaguucucauggccaugggagggaaauggaaacagggcagcaggaccagugagaggucugcugggauaguccaggccuugaucauagagggcaggaucaagaugaggaucugggaagaggcaacugauagaacuuaguguggaggugagaauccagaagggcagcauugggggagggggugcacagagguucuggcccaggcagaguuuggauucuuauucccugauggaauugguggcucagggacuaaaggcaugcucucuuguucugcugaggcacggacuuggcuggggcugugcuguccugagcuuccccugucucccuuagacuaugccacugugcagacuguggggaugacccuggccacuaucauguucgugcuggggaucaucaucauccugaguaagugcccuccccaccuguggguccccaccuuagaggcuuuccugcccaccccacccuauccccacugguaaagauccugaucuuugaucuuugaggguuuccugcuggucccaccccauccuuauccuugaagguccucugccugcccugcucuguccucucacaccccgauugcucccugcugucucucuccuaacaggcaagaaggugaagugcaggaaggcggauuccaggucugagagguggggcagccugggguccugggauggagaccccuaaccuagggcucgggagcauccccugaagccuguuaagcuuccucuucucucccuauacagcccaacaugcaaauccuguaagucggaacugcccuccucaggugagcaugguucugggggacacuuagaaguagcaggauccuuagagggcuacguggguggaggcagucuggggguuggauuccaggucccucggagguuggggucacagagggagaguuccagaaauaucucaagaagguccuaaagaaaugcaagccucggaaagcuuggugggguguggcuggggaagucugagaaguuggaagaggcuagcaccugagaaacccacacagggaagggcagagcaggggagagaagggagagggagggcagagcgcaggcugcugaauaaagacaaucagaagcauggaauacacauuuaaagaugggagugaggugggcaaggaauggugguacauaccucuaaucccaccacaggaggguuggagugagaggggauggagaaagggugaaucucugugaaucccauaccagccaggauacauagugagacccuguccuaaaaggggggcgggggaggaugcugcuggggaggaugcucgaggccccaggucuaguccucagaaauaccuaaacugccugcccauaaucucagcacacuggagguggaaacaggagaaccaggacuucgaggucaguccuagcuauagagagcaucugagagcagccuggccuacacacaagacugugucucaaaaacaagcagaagaaaggguucugucuggaaggaagugcggggaggaggaaacuggugcagaagacagaagggagggucagcgcauggagacaggaagacgauaagauggagugagaaggaggaaaguuucgaggggcauccaugggagacuuguuuaaauuuuagaguuguuuccuuucuaaggacuuuuggggaguaaaaacucucuuccuuuuacagugucuuacuguaguucuggcugugcaagaacucacuguguggcccaggccaagcuuacacucagagucauccuccugccucagccucccaagugcugggguuacaggugugaacuauugagguggcuucccauuaaaaucuuaugacagccaggugggagcugugcaugccuuuaguccuaguaggagacagaggcaggcaggucuacagagagucccaugacagccaaggcuacacagaguaacccugucucaaugggagaaaaaaaauaaacuuaugacaacgaguagugcuuaaagaacuaaguauaaaugggggagacuucaugagaaaacuacaucauguuucauauauucuuaaugagauuuaagaacaucacggguaucucucuguggugcuggagcaggauggaaggagguguuugguccagccuuagcugggcagaagaacaaagguagccuguccuggaggacaccugcuagaugccuagguugucuggagcauauguagaaaagaagccuggaguauagcaugaggugggggcucuuccaaggagacuuuaagccucccaaaacacucaggucagccuuggguguccaccacagcuggauucccuuucuccauugcuugagauggggcagacaguagcuaugaagauuucccugcagugaccagauaucaggagucaggaagacaugaggaucccccaagagcuaaagggcagccauccuuggacucugauucuuucccuccuuaggucaguaacuugaguucucuucuguuccuagccccuggagguggcgguguguaggauccucugcagauuuccacugcugucccuggccagagugcaggaaccagaggacccagagaaggcgguggggacccagccuggcgccagggagugugcccccaaucagccgccagacccaccccaaggccggagccaaugcaccccgcucucccuccccaggccuuggcaacaacgauccuauuuguacccuagacccagagacucaggccuccagcuccugggauccaggaguccauccccaguccccugggauccuagugucccucccuccugcaucuccuggucuccuucuccaggaccuucccagcuuccccucaggguccacaucuugagcuuaauaaaugugcauucguuuuuuccccccguuc

SEQ ID NO: 3710 - RNA, 5524 nt, Mus musculus
cuaucaagaaggaaaaccgaguuuuauuagaggucugagcagcaagggguguccgaaaggcagggcugaugcagggaacgcuggggguggucacaggcgagcaucuggguggggagaggugucaggugcuaagggggcucugcgggggugaaaagaguaaguggcaagcucucgccacuaucccacccuggcacugggccccuugccucccucccuccaaaccccucucccuccuuccucccaucaacugcagaaccuggcugaguuuccuggagucagguggagguucuaccgccugcgggaugacagaccugagagggacgcagagaguucugggguaagggggagucugcaaccagggcuaacucuccgccaaacccauucugaguccaagaagagggggcucuugaaaacagcugccccacaaaccccgcaguauccccgaacucacggcggauggagcugcggaaaguucccuccucuucgucggguuccccaguucuaaaaaggaacagauagaggaauucggauggaccaggagaggcagccgcuuccgagaagcccccuaaugcaggccuuauuucccgacccccaccguggacuugauaugaacgcgguccgucagaaacaagagcgcccggcugcuguuucggggugcggcaggaggugcucccagccugucacgggugaaggccuccgggauauuggggaagguacuugacuuuguugggagagggacggucacagcgucuugggagacuugggacuuggguccagugagugacccuaagucaccuuaccgccccgugccucaguuuccucauaugcaaaaugggauugaugauggagcgcaccucauccgggugggguaaggaguacauaauagagaaggaaucgggcaccuggcgcguagugcgcacucaagcaugccagagggucggcauggaggcaucugugaucaucuuagcacgcagaaggcaugccuacguuuucugcgcuuuaaagguuuauuucgagaggaauccugcgcgaggaucgggacuggagcuaaacugggccgcccugugaggugaucucauuucagcgcggcugcuucugcccagcuucgccucaccacgcuugaguuuccaucugcggggcuggugggagcccagcgcccccacuggcugggcgcuaggccaggcagagagggagcuugaccaucgcuccggcccaggagccugucuuaggguuuaacacacacuaagcgcuuaauacauguucacugcaggaugggugcacuugcugccucgccccaaccgccucuccacugcggaaggagcgagggaggcccagagggaccacucaccucugcuguugguugaauuugcaucgacaucucuugccuguggagugggaggguauaggcugagcuucccucucgcucccgcaucccuaggcucuccuccaaacuggggaggccgcaggggguggggccugaggcgcggcugaagaaggguagggugugggggcguggucugggugggaggugaggggcgugguuugagguggggguggggucugugcggugagagguuggagucagggugggaccuaagagaagugguuggagacugagccuguguugggcgugaauagcgcacaggcugcauguguugcugggagugggguuuggggagggaaggcuggaggcgggauggagaagacaggugcagacacucacuaaggaugauaaggaugcccaagaugaagaggaucccagcgauagugaggccgccgauccgcagggugugguaaucuguggacagccccggaggagggugaccagcggggaagaguauaguaugcagcucaaggaggaggagagagaaggggaaaggacagaugugagaggggaggagaggacagguuagaggaaggaggcagggaggaggugguaggaagagggaaaggauggagaggaggaugcugcugaaagugggggucguagagguugagguaccugauacugauaaaccaguucaaaugagacggggggggggucaaacaaacaggcaagggggucuaagacaacuagagcaggagagaguggaggaugugguguguguguaugagagagagagacagacagagacagagacagugacagagagacagagagagggaauagaaacacgcaggcccucucuccaaaccccacaguagcuuccccucaccguaggugaauggauccgguuccuguggagcuucuagaaagagaaauaaagagcagcguuagaguagcuccuggggucuguaacaggggaaaguauaagggagcccuucaggggcaccacugaucuucuuggacugggaguuuaggugcuacugagccacuggcaggcugccagccugcucugcguccuggaaccuccagcacugguccggcacccugauaucuugcagauuguucauguuuccgucaccccgggaauccaccuuccauccacccccgcuguugccuaggagaccccugauuuccuguuacauagugucuaguuuggggucucucacuggguuuucuuggggggcuuuucccuaccucugccacccacauggcugagaugcugagcaccuccuuuggacucaccugcacuggccauggagaggagacacacacacagagccaggauguggccgggagaugccauugcccuagggagucagccagggucaagaaauguccucugcccugcucucuuucccuccuaaagaggaucugaacccgugggguuaagucaaggacggccuaaggacuuaagugucagccauucaaguugaauggcucccuugcuucacccaaaaccaugucccuaaaacaacucaauaauagggaccaggagaccacagcauacacagcagcaagacagauggggagaggcagaguccuggggggaugggguggcucccacaggcuacucccauccguuagcuggucccagagucucaaaaccuacccuuguaagggaagcaagcugccucuggacauaggugggaacacuaggcgacauacagcaggacaugcccagccccaccugccccuacacaccucaaccaguggucucucuguacccaggccgucccagcucuccugcccucggccgccugcccgcucucucccugacccuggguauaaauaucucccacuucacccgggaggaauuugcugcacacgggccaccauggcaacagcuccccccccaaagacucaggggguccuguauaacacugcuggggugaggcccagccaggagccacaucccuacaggccaccccaucuccuuuucuugaagcugugagaaaagggggaacaucccucucuuuguccaccucugggugacaucuuucacaacaagacuuuaggccagugagugacaggcggcccaugccugagagaagucagauguuguuucagggacacacauacgggcacagacacauuuauguacagguacacacacacacacagaguggguguagcuggaacaggagcaaacaacacccucuccccaaacuguugauuagagagcgcaggguuuagacauaagcacauucucucgcucugggccuucugugccccccaaacagagacagaaacagaccuauacaaaugaguaucugagccucacccccugccaggggucucgcaguggccgcugaaaaagggaggagucucuaacucucccgccccugugcaaccccuguccccacacucucuccucccucuugggucaggccugccugagaagccacaggcuggccacucuuguucccaaaauaggccucccagcuaggggagcugaggggcccggagggagggcugggggacgcucaccccauucacgcuguccccuguugacagaagacccccaaauguccagcugugcacccuaggagcuaagcacuuuggacccccuggcccagaacuggaugcuccacccccgcaggcuccccuccuggccacaccccacucuugcccuccccaacgagcaacugaaacuggagcccaggcuggaggggggccagggggcggcccccagcccagacugcccuggcccgcuagcuagguuaacucucucagcacagucccaggagcagcaugugauugcguguggacuggacuaugagaggacacacacacacacacacacacacacacacacacacacacacagagagagagagagagagagagagagagagagagagagagagagcgcaagagagagagagagagagagagagagcacaagagagagagagagagagagagagagagagagcgugagcgccagaccagggucagaguguguuuucugcuagguuuccugggaaucagcccaucuggggacuaaggucacacagccuaaguacuuucgaggccacugaccucugacccaguguucugccagccuuugauaacuagaguguuguuuuguuuuguuucuuugauuuuaaauguguggugcuuuuauuuugcauguauguugugcugacucaaagucaccaggaguaacacacacacacacacacacacacacacacacacacacacacacacacaggcuaucugugcagugauauaguugggcuguaacaagacucgggaaccagaagcagaaggauagagaguucaaggucggccuggccuguagaguaagucugaggccagccugagcuacauagagagauauacaacccuucuuuuaaaaaaaaaaaaaaaaagaaagaaagaaagaaaaaaagaaggaaaaaauuacauugccgugcuucugucugcaaugacacacagugagauacuaucacacacaggccgcaggaacacaucaacgacagacucacccaguccucccauucccacaccacaggaggugagggcugugagcuugaacacacagcugagcacauaggaacacaagcacaacaacaaauugaccguggcggcuccucuuccacauggcugucugcagugcacacacuguauacauaccccgugcaugggucaccaguaaacuggcacacaguaaaaagcugucuauacugucacagacagaggaccauacccucaaaggccacagacuuacauuucaucuugaaacccccaugcccuuagcucagauagccgugucaacaccguggggaaucacuuccgauguucucccaggccagaccacuccaaaggcuuuagagacagagaaaccaggggccaagcauggguucaagguucuuguuaugugaccuuggacugaucuugauaccucacuaucccuucuccuguccuggacuacaaaauggagaagcugcuaauaccguaucuacaacuccuggccaggcucagagguccaugaacuugacauuuucuugucaucuccauuuuagagauugguaaacugaggucuagguagccagaacugauuuuccuuaagacaucugacuggucaaccaaauguccccagucuuaagcaagcaaacagcagcccagacc

SEQ ID NO: 3711 - RNA, 25773 nt, Mus musculus
ggccagacuuucucuuguacuagaggucugaauccuguaagacugaaggaagaacucacaagguagggauccugggucuccagagugcuggcaagguccaagccaggccugagagucagggucuucuuuaaaccaaagucacccuucccugguccccagugagcuggauugcagaagccuuugcugucuucugcugugaggagacacaagcucugggcuggcauugccagcccuacuguuaaguggugucaagaguaggggccugcuuccuccugccuguguaagacaccuucccuuuguguguuuugguugaggcauugagaaaaacaccaaagggaaguccuaagucugccuuucucugucccagcuuagcuagcuaugcuggaagcccagugcgggcuggaucuuuuccuggcccugguguguacagagagcaugcugucugggccuuacagccacagagaaugcucagggaagacacccauccuggggacaccaacagauguuuaccaagcuguuugugagcucugagcugagcucuaugcggcuggacgcucagcacuggcuguuuguucuggaauauucuaucucuauagggccuuuaguaugacgagagagaaacagaaucucagagucaugaggguaucaugucagcagcagugggaauaucacucaaaccucugcaaugcccccuaccccaaacuguacuuggacagggcucucugauuugcaucuccuuucucucccuuaggggccacacugcuguccaaguucuuccucauggcugaccuucucccucugcugcccugggcuccccagggggcccaggaugggaaccaggacucggcaggaucuccaacugagcaacagacacagacugacaaaguccaggaccucuccccuaaauccuggaggcucuugggggugccuacuauucacauaacuccauccagugauggagagucaccuccaggcacccccacuacaccacgauuucagaccuuggaccuggagugucugccgcaggacaggucagucuugggaauggaaugggagguguuguuuguauugccucagcucgagugugggcuccuuuugguuaacgugcugaagcucaauuagagucuagccugagcccaugagaccugauucgaggccaugaaauagauguguauauuaguuaugguuuuuuacguguaaccaaauaccugacaagaaggcauuacagagggguuuguuuggguucaugauuuaaagguaucauucaucaugauaaggaagguacaguacuaagggagucuugaggcuguggcagcaagagcagauggcuucagguccucgcaucucugaggaccgugaaacagcgagaugggcacaccagccuaugcucuuuuucucuuuuucuccucuuguauucagucugggaccccagcucaggacuauguggcacacauucagggcuacucccccccccccccccacacacacacacucuggaaaugcacucccagacacacucaaagcugugcccugaaaggcucuaguugcaucaguccacugaagucagcaaaauuaagucagcacaagccacaaauaaaggcccagaaugugcuucgggaccagugacugugggcccaacugaaugcuguuggcaagaaggcucccagcacaggcugaauguaggugaggccuggaugauacuaggaagcaaagguggcagacuguaaccagaauuugguuuccaaauggaaauaggcugacgugcgaaacagccuaagguaauggcucagagcuuaagaacaagugcuccucuugcagagaaacgaaauuagguucccagcacccacaucaggcagcucgcagccacuuagaacuccagcuccagggcaucagauaccuucuucugguuuccaucauaugcaacaucuucauuccccccccccccacacacacacacacauacacuaaucaaaaacaucaaaacaucuuuuuuaaaaauaauuuuaaaaauuaaaaauaauaccaaggacaagacaaagugagggcaagugugguuuccugcaucucuaguggcaagacauauuuguaagccaucacaagagcuauuuccuguuguggcucacagguggguguaaaacauucaaacaaaacuucuucaaagaaaaccaacuucuagcccagggagacugaaaacaagagguucaaggacaaaguaucagcaaaggaaagaacccgacagacugaccuuaaauagaaagaacugugugcugggguuucuccccagcuauggaugcugagaaggaccaaauguuuaggaagcacagcucugccagcaccaaaaaagucucagaaacaaggaugaucaagugggagagucaaacuguagaaggauacaaugggaacuaguuguaucuuucaacgauacugaauacugaggcuggcuuguugacuccuguguuguagcaaaaccgcacaggagugauccacacagacuucagggcaauagacaggcagagacaagaggaguaggcacuugggccuuuggugguaaacguuauaguuuaucuguuuuuaaagguguauuuuuuaaaugcauccucaugagcaccugugcacgugcaugugagugccugcagaggccagaggaggauacuggauccccuggcgcuggaggaaaugcuuacugggaaccuaacucagguccguggccaaagcagaacaguccuuaagcaccaagccagcucuucagcccuguuugguuuuugagacaggcucaugcuuuauugucuaggcucagacucaugguccuccagcuucagccuccagagggcuggaacaacaggguguaacaccacgugggacuuaacacuaagggacuuaguuagcccuuccccucccuccucucucuccuccucucucuuucucuuucucucuccuuccuuccuuccuuccuucuagacuguuuccugcauuaccuuggcaaguccaaacucucuuuguagaccaagcgggacuaaaacucacagcaauccuccugccucugccucccaaaguccucuaauaccacauaagcuuaacagcuuaauucaucuaaaacaaacaaacaaacaaaaauccaacuaaaaugaccaaccacccacagaaguccugagugauuuuuugauaugcaaauuugagcacaauggccuuccacuuaaauacuuuaaugacuuuccauuguccuuagaaacaauucagaaccuuuaacgaaauuaaugaggcuuuuuaugcauacugaaccucuuaugucuuauggugaggacacagauggccauuauacacuuuuauuugaaaugaauauucacuaaguaaaaauguaaaaauuugugcgguuggugguuccugccuguaaucccagcauuuaggaggcugaggcaaguucauaaauucgagcccugacucagcuacauacugagguuugaggccagcccaggcuauauaaugauauccaacccacccaagcccucaccaccgaaguaaaugucuuucuaagaguaaacaagcuacggacguauaaaaagagcaacacagaaagauggaaggcagccaugcaagaagagcgagcuuccuccuguggaagggauagcagugcaaagguccugaggccggaggcaggugggaugagcagggggguagauugacaccugggauaaucaaccaggaggcuaaggaggaaccaguuagacagacagguggaaggggcccaaucaggagggcucuggacaccaagaugagcacuuuuuuuuuuaaaacaaggaaugagguggagccaggguagggcuugaagccaagaggccucuggccagacuuggcgauucacaggcuagagcucuggcuguaagugguaacagagcgggauaggaauggaaaccaaacaaggugggacugggccuacuguagcuggacaagaggcugaaggccgaagagggguggggagaaaucccugggcugggucccaaagccagaggcucguucacauuguguucuccaacaaggacgacaaccacgccuggcuugcagaggugggugcagggcuggcuggcacaagaacucguccuacacugcaauguauggucauuucccguccugaggcucggcaggcuucccaguaucaaaaacgcugaugagcccugccccugugcuguucugggggaaaccccuugccugggagcagggggcuccccaggccugagggacuugcccaagcgcacacagcacugcuaggagccgggugggcuggaaucugacguggucugcacgauuaggcuggggaagucuccauacacacgcgcgcgcggaaaagugaacgcuucuaaggcaggaacugagguucugaggcuggguggggagaacgggaagaggcuuuccacccuccagcugugguuccccgaccccacccccagacuuccgccccaggccaguucuucccagcaucagccugucacccaccuccaucccacuucucagagacucuucuggguccaggggagaagcccaggguguuuaaacuuguuugcucauuuguuuugaagacaaauucucacucugcauuccaguggccuggaauucauuauguagcccaagcuggccucgaacucaugccaauccuccugucucagccucugggaugugaggcgugcgcuaucacgccccgcccaggcugcucauuuuaaauaaaaauuuucuucugucucccagccggacucuuuccccagccauccuaggccuaggcccgcgcucgcguccaugucccccucccggcgggggcggcgccgugacgcgcggggcgggagcaggaagggggugucgcugacgccgaggcggccuccggcggcuccggccuuuugugcggguggcaggguccgguggaggcggcggccgaggcaggcgaggcccgggaggcccaucucagagcagccggccggguccugcccugcagccggggcgccgcauccauguucgaguaagcaccgggccucggggugggaagcggggacgguggugcgaucgggcugcggcagagggccggagcuggguuuccaagcuggugcauguaggagcgaccccgcuggggaccagaagggguacacgugagggauugcaaccuggcggcgagacccaagauuggggcgucacuaccggccugggacgcauaugggcagcggggagcuccucuaggcccugaucgucccccuacggggagcccugacccaacacccagaugaaagggccgcgagcagccccaccccccauccccauuacugggcaggccccgcagauccuccggucggugguccccguuugucgugggggcuggggaaaaggagcuucuuugagccugagaucucggcggggugggggucggguguguucugccccccucccgcccccgccacuccugccuggucaccugugccugcggguuuccguuugugauugugcucagcgugguguguguguguguguguguguauguguguguguguguguguguguaacagcugggauucuuuggggcaauguuguguggcugucuguauguuaucuaucaucuucugugugauggcuaccacccaggucgagugcaucuggugcucuuggacccacugugguugugugugagacgugucucauuuucuuuguggcaccgugugcaaaucacacauucugagcuugugccucauugugacuuguacagcauuccgcuucagucucuuggcugacuguaccuauaauucaccaugaauuacgucugugaguuaccuccgugagcucucauugugauuugaguaugugugcaugugguuggggcucagcugcugugcgccugacauccacauuuggaugucuuuugguuccgugaacaaguagaaauugcaugugucuaccggugacaguguggugucacugggcccuguggguggcucacuuaccucugauuccgucugugggaaagucccaguguauccaaauguggcauuguugcaugccuugggugugugugggagauugucucugucucucagacccuuuguggcuuugucuguugaaagagacagagaccccuugugguuuucucagcugagaacccucccuccugggauguuggguguaaacuuaacugcuuugcaaagccugccccuccucaugcugacccuucaauaucuggcagugcauuguucccaagccccccuugucuaugggaaugucagggcucucucaccuugacagcugauaauuccauuccucgacucuugagaacuggcccuugcuuuguuuucucugccuggugaacacccacccugcaguuagagggucagucgggauguguagguugauaugaugacuucccauaggaaugcaugucugggucacugggucccaugacuaggugccgugugaauaguuuuguuguggguuucgcuguuuguuuugcucuucaguguaaaacuuucucgugguuguguauaggacgcugauuuauguggacuuacuguguuucucugauucugggaugcugugcgacuguagcauauuuguagcgagcgugcauguguguguguguguguguguguguguguguguguguguguguguaaaacguuccuggcaguuguguaugaauuugacacacuuacaaugcugugguuguuuaugcuugugacacuucuguacgugugaacggcagagagacaggugggagagacuucguucaccugcaggccaguuugccugggacccucuguguccccagccaucuuucccuuucccacacaccugugugugcucuugccccucugugcugaggccgauccugaggcccaggacgcagagcaucugcacagugaaaacgccauucucuuccgagucuccgccccuuaacgguccuccucucgccacucugaccccucccuucacucucucaggacuggcuggcuggcuggcuggcuggcuggcuggcuggcuggcuuuggccacccuagggcucugcuacccgcccuugagaacuuccucuuugucucuuccaagagcaagagggaugaacuuggcuugucugugccuucagccugccauugaguggaccuggggcuucagaaucaaucaggcccgaaucuuagcccagaggugagaagagaccacaggaacccccggggccuucugcucucuagaaacgugcaggguggcccaggguccucaguucugcuggucgcuugcuguucucagaccugccagccuccuuccuggcccugaacuugacgcuuugagagaguccagcacugucucccccacauuucgccagcucuguucuuuguccccagcccuuggccucaguaagccuggcccagcuaagcccuuugcagucagucuggcucacuuaagaaacccucucugcuccuaauuauucugucagaauucaaugugcaucagauuuuaaguugagguuucugaugccgguggggguggagauuuacauuugaguuuuguuucucuuuuguuuuguggcaguccuggugauggacuccaaggcuuuguacaugcaaggcauauccuccagauucuguugggcggauucuacugauucacaugcccagcuccuuauuggugauagcuacuggugagccacgcccccaggcccucaccacuagguucagggcccuuuagcuacacauucacaacucuggaguccuuaagacagacucuugcuaugcagccuaugcuggucucaaacucugugauccuccugccucagcccuggaauacugaauuaacaggagugccucaccgccucuggauggaaucuguuucaaacagguuccugguccgguugguggaguguucugggggagggggggaggggcugugcuaaccuuuacagcaaaggcaaaugucagaugucagaggccauuauuuucauuucugugggguuuuguguguguguguguguguguguguguguguguguguguguggugaucuggcucccugguuagugcagccagguaguugggaccugcugcuuacaguguccccacuguguucuguguauguuuagacagcaacaggaaggucuagggcaccagccgaggucccuccagagucagcauagcuucuugaucaguuccaugaagguugguggcagaggugucccuuuuauuucugaaguugugcccaggggaagcugucauacauugcuucuucgucccuuugccuuacauaucauuucuucuccacgcagccugaggagguaagaaaaccaggugaaagugaggcuggggaagguguagacgcggcccuguggcucugaggcugcaagccuuuagguccuuugaauccaggcucuggagggagcaagcaagccuggucacuuugcucaugccaugguggugccuacucaugggcaccuacuaggcgaaggggagaaugauggggagccaggaggacagcaugcuccugguagaugcucugagggcaagaaggugaggggcaucggcagagggcugugauuucaaaugggacguggagacaugucugccaagcauggcggggcucugggggaguuaguucugccuacaucuagugagagaagggcauauggauaaaggggagaaugaaggcaggagcuagagaagagggaguucccaugaugagggccagggaaggguugaaggcuuuccugggauaaguaggguggccugacagccaggaagucucagcucagugugggaauaggcuuucucgggcugaaaguugggacagacugaguucagacaccagagcauggugaccauggagagccguagugacccaggccacuguugauauccuuuuauuuagucauaucauuuauacaaugacuuuauaagaaucacaugacuuccucucucgcaccccaucaaagcagggcugcagcagagcaggaacuaagacaccccucuaacauguccccagaaacccauagagcugcucacuggggugacugcggcaccagcaggguaucggaacccgcagaaggcagagaggugcacuaaagucuugaaguguuguauaauauuugcaagggccaggcauguuccuguggccuguaagugacuucuugaugugacugcagaagcaacacaagccaggcaugauggcacagggcuguucuaccucagaaugcugaggcaggacaaccaaaaguucagucccagucuagacuacugaguuuaaagccaaucuguacagcuuagugagagaccccgccucaaaauaaaaaguaaaagggggucugggacguggcucagugguagagccccugccuagaaccccccagugaggggcuggagguguggcucagugguaaaauauccacuaagcguauaccagguucuagguucaauucccacucagcaaaaaaggaaaaaaaaauugcagagcaaagaagaacaagggcaauguggacagggagaccggcaugaacuaaagauuauaugggggagacauauuugaagaaacuuccugggggagcagagauggccuaguggguaaauaugcuucacuaaacccagccacccauguuguauuccugggauccacacgguagaggggaccaauugcugaagaaguuccugaaagagaaaauagaccacuuguacuccaaaguagaucuguguacugaaguuagaauccuucccagaaaccgcugugccucccacuguaaaacuggacaguccugggcccaggcacacaguguuuuugagcagcgauaaaaucaaucacucggaguguuugacagaauccugauaagaagucaacaaagauguccuuuaaagucccugccucucauccccgccgcccuuauggcugucgguguuugcacaguuaccagaauguucuguuugcuuaacguccaccucuggcaggauguuaacucgccagauccaagacuucaggucucuguuagugcugggcgcagccagaucagggccauucauucagucccacgguguuuauaagcauuaauuaugggcccugucucuaggugcuaaggauaccgacagcaaccaagacuuccuccaguucacaguuuagggcaggcaauaaagaaacuguguaaacaaaugaacagggugaguggagauagugugggugagucaggaggagggagggagcucuuuagggcugagggacgauggaggaggagggcugaggauggaguccguuaugcugaagcugugggugggcuuguuagauggaggggaccacagaugcagggugugacccuaggagcuuagagaacaagaggaggcuggaaugacugggacagaagaagagcaugaggccagggaaauaaugagaccuggucacaucgaaaucagacuugauuuucaucuggagagagggccagccagaauagggcuuagagaacccugagcugacucagcuagcuggucaccagcuuccagggcugcaagugaggagagagacugaggcagagauagcaguagagaaccagaagcaaguuugugugccgucuguguggaaaggaauggaggaugggaugaggagacacaguaaugaaaggaaagauggaaguuuuagaggugguguuggugggggucauggacagauuagagaugaggaaaggaaaaacacuaagaacgguacuuuggggcuggagacaugguuccugguggcuaagagcuuauacugcucuguaagagaacccgaguucaguucccguuacccauacggugauucacagccaccuaucacuccagcucccggagcuauggcacccucuuuuggucuauacuggcacugcacaucugcagucuacauaaacagugcaugcgcacgcgcgcgcgcgcgcgcacacacacacacacacacacacacacacacauacacaaauaaaauaacacuuuuugaaaauguuuuaacacuucaaaaggagggguacugccgggcagugguggcacacgccuuuaauccuagcacuugggaggcagaggcaggcggauuucugaguucaaggccagccuggucuacagagugaguuccaggacagucgggucuacacagagaaacccugucucgaaaaaacaaaaaaauaaaagcgggaggggguacuuagguuugcauuuugagugucacaugucaauaaagguuugcguuaugaauaaauuaguaagauuauguuuuuaaaguaauuggguguugggcauggguaaaagcauuugccguauaauccugcucaccugaguucaauccccagguggaaggaaagaacugacuuccagaaguccucugucccccagauguggucauaaaauagcaagugucaucgagggcgcgcugugugccugacuguuagagagacuugacaguuugauuucuuuaaucccccauaauccuacacaaugaugauguauguggggucaucauugccugggcuauaaggaagcaguagaggcacagggauauucaggccugcucuagggcuagagagacagaaggaggugaaugggugaguggggagauggauagaaggaaggaaggaaggaaggaaggaaggaaggaaggaaggaaggaaggguggauggauggauggauggauggauggauggauggauggacugacauguuguugacuagguuggcagauggauaaacagauagauaguuggauggacagaugguagauggauggacugguagguggguuauagguggcagguggaugacuguauggaugagcugugguuaggugcguagaggauccauaaaugaguggacagcugcguugggagauggauggauggauggaugaauaaacugauaggcagguagauggcuaggcugguggaugcaugaaugggcagguagaucguuggguggaugaauaggugggcagauggagccacuagauggaugcaccuucaaaaaucaggcuaauuucugccccuaaccuucccccccacuucucuuccucucccucccuagcaccacgccccacucuggccggagcucccccagcagcuccccgucucuucguaagcggcuucagcucuugcccccaauccggcccccuccggcuucugagccagaaccaggcaccaugguggagaaggggucugacagcuccucugagaaaaguggcgugucggggacacucagcacccagagccugggcagccggaacuucauccgcaacaguaaggugggugagagcucaggugggguugggagagggcggcagcaagggcagagaacacaagucuccuccuaacgcaugucuuucucuugcagaagaugcagagcugguacagugugaguaucugucugcacauggggcucgauaaagguaugggagagggcucucugccugcugggagcuccagaccagagagagcaguuaaggagugggcgauacauaagacgcuucuauuuaacacacaggacaggaugcugcuauuuauggucucugaauggccuugggugggucuuccccucccugcuugagaaguauuagccuaaucuuguaaugccagagggaagaguggauaagauuuagugaugcuaguggcgguaccuugcacagggccugacucuuacaugaagucaguaaacagagagaugguuaagacuacugucugcuuucucaaaggacucagguuugauucccaguacccauauggccauucacaacuaccuguaacuccaguuuuagggaaccagauacccuguucuggccuccuccagcccugggcacucuccccaugcacccauauacauauaagaaaaacacucguucauauaagucauuuuuuaaaagucaguaaauggaagguauucuuauggugguauguguguugugagcaaagaagccccaagggccgagaagacugagagggaucggaaguuuuggggggauaaauagcagcuuggaaucuucacucagguucccgugccccaaaccucuucacagaugcugugucccacauacaaacaacgcaacgaggacuuccggaaacuguucagcaaacuuccugaagcagagcgccucaucgugggugaguguccaugcccccagccucccuaagugaccuggacgggagcuucuggcuucuuuuccugccucccugcugguuugugggcuaccgcgccgggacagaucacgugacucaccgugucugcccaucucucccucugccacucucagauuacuccugcgcccugcagagggagauccuccuccagggccgccucuaccucucugagaacuggaucuguuucuacagcaacaucuuccgcugggagaccacagugagucgagccgcagguggaugcugaggggccucagggccggcagggcuucuggcuaguucucacugcccugugcugucuuuuaagauuuccauccaguugaaggaagugaccugucugaagaaggagaagacggcuaagcucauccccaaugccauucagaucuguacugagagugagaaggugagugauggauggaugggggugaggggcacgcaccaggaucacagcggagacaccuucccccccuccccccagcuuaccuagacaugcccaucagagcagauccccauuuguguugaacuuggccuguuuauugucuuggcccucgcagugguccauccccacucauuuuggcuggggccccuacaguauucuccugugcaauggcccccuuacauagauguucugcaaugcacugauccuaaaaucucccacgaacccaucaguucggauguccccacccccacccccagccaaagcugggauagaaacccagggcuuuauaucuuccagaaaaacacuccaccccugagccaucucucuagaucuuguuuguuugcucuuuguuuggguaacagggugucuuaugcagcucuuucugucccagaacccacuaugugguucgggguggcuuugaacccacagagaucugccugcuccugccucccgaguguugggauuaaaggcuugcuuguuuguuuuuguuuuaaguauuuauuucuuuuuauccugcauauguguaccucaugucugcaguccacacgaaagccaaaggagggcgucaaaccuccuagaacuggaguuacagaugguugugagcucuuugaagugggugcugggaacccaagcuggguccucugcaagaacagcaggcgcucuuaacaacugagcgaucucuccagacccuugaccuuguuuguuugucuguuuguuuuugagacggggucuggcuguguagcuccggcugaacucaaacuccaaaucuuggcuccacugcccuaguacugggucagcaagaaccacaccuggcauucguccucaauaucugcuugguugagagauagcugugucaauguggaguccuaacaggaaacaggaaggaccaggggaugaccugacagcagacuccccuuuguguuugucagcccagagcuggaagaguuagccaucccugacaucaaaaagggcuaggaaaggcacugagcauugcuucugccucaggcauggggaagguuuucucucccaucaccuccaggaggcucuuccccacgguggugaccacugggugucccuaccccauccugccucucagucuccucacaccccucucuuugcagcauuucuucacuuccuucggggcccgagaccgcugcuuccuccucaucuuccgucucuggcagaacgcgcugcuugaaaagguggguacgacugaugcucagggggaugggguuaacuagggaggacccggaacucauaggaaacucccagcuuuucuugugggcaccaggcucuucugcaucuguggcuucuccaaaggucuugccagggauaagccaagaguucccaugccuagcacugaacagaguccccgaaggaggaggaagggauugguacagacuggcccccgaugcugagggaagccuccaugugaggcaauacuuagcagggaggaagggaauagggugggcagucauuacgccuauccgucaacacugcugauaccccugagacacccuuccccaucccugcucggcugugugccucgcccucucugcggcacucaucccccagggcaacuccaaacgggccauccucaaaaguaagacugcgaaagaccucccucuucucaggagccugauggggcagcauccccaaagaggacaaggccagaggagggcccuucagucccauucucaucaccaagcaguuguguguggcaaaggggaccaucucuacuucagagcucccaggacugggugugggcugggcucagugauguugcuuaucucaaacugaguggauuaggcauugcuggggcucugaucucagcucugucaccucccagcagggugaccuugguugagcuacugagcacaucgugucuugaaguccugagaguguuguacuaguaucuacuuugagguagcacuuacgcagcguuuguaggaaugucagcagcggccacugcccuggcaguuaucauuagcuguuauuauuucauuaucucuggggcccagcagauaauuucccuugcagccaaucagugggcagugggaugcccagggcugcugaggauauauagaggagaauggagaccagauagcauaggaggcaagaacuuggacucuucuggaaucugacuagcuuugaaucccugugggucauuugugugaccuugagcacaugacuucuccuuacagaauuuccagauccuucucuguaaaaaagagaaucuucccuagccagagcacuauggacuuaggaguucuaagguguggcuuuuagggccuaggccccaggcucugcagaaagaggcaggcuagugauggaugccagcuagguagagauggguagagagucuggcguggauagccacgcugcccucucauggaagcuaggggaacugcugggaccaggcaguagaaacaagaggccaaccucauaucccuuaugccuagacacugaguccucgagagcuuuggcaccugguccaucagugcuauggcucggagcugggccucaccagugaagacgaagacuaugucugccccuugcaacugaauggucuugggugaguuggagguagaagauggcucaaagggaugucaggaauuucugaggggccuuccugggucccuuggaucuguugucuagagaugaauuguagacagacaugaggugacuaugcaaagccuggugggguggagggagaacacagugaguguagcaugugguggcaggaggguccagccaucgcccacuuccuucuuucccuugcaggagucccaaagaggugggagacgugaucgcacucagcgacaucagucccucgggggcggcugaccacagccaggagccaagcccuguggguucaagacguggccgggucaccccaaaccucucucgagccagcagugaugcagaccauggggugagcaaguggaugcuuauggggagagcugggaagauugggaauggaggagggagcacagaagaucggggcaagggggcuuggcagagggaugagaugcggauggguggagagaagaagacagggaaaauaagaggugaaccgggcaaauacggcagacuuggaggaagaggagacacaaggggagcaagauagauggauaggagaccgaugagcagcgaagcuaguaggccaagcuuccacauaagcccucaucccugggugguccucaggccucugucagacuagccaagagccuccagguacagacaucauguccccaggauugguccuucuggccaggaccuaaacuuuagucuaucaaacacuuguggccagagucgaccugugggaacccuugggcugggguugagguguggaagacuagauggaccgcuucucugcaggccgaggaggacaaggaagaacagacggacggucuggaugccuccuccagccagacagugaccccaguagcagaaccgcugaguucugagccgacaccaccagaugggcccacuuccuccuugggucccuuggaucugcugucuagagaggaacuauugacagacacgaguaacucguccucauccacuggggaggaaggugaggaaggaauagguggcccccauucauucucuuugguuauauccaagucgggaccagugagagcagaggcguugguacccagggcacaucauacagauggucggggaugucgcucagacagcauccugcauuagugguucuguggccagaaaaggccggcugugaaauugguuacauuuguuuucacuagguaaacuuuacucuugugagccccgagacagagcccuaggcuuggcuacccgacaauauauggcucagugacugccacaaaaaucccaggcauggcucugauuggucugacaugacaaaugauuccaguugaccauaggaguucugugccaaugggcaccauugcaguggcuuuuauuggcugggcuggggcgugugcccaccuucggcaaauccuauaguacaggaagaguuuaguauuguuucagguucagaggaacccagagauguacccacauaaugaggacacuuuugucucccaggugaccuggcugcacugcugccugaccucuccggccggcuccucaucaauucugucuuccacaugggugcugagcgucugcagcagaugcucuucucggacucuccguuccugcaaggcuuccugcagcagcgcaaguucacaggucagggggcaaaggaaacagaggacccugugucuggcaccugcagaagcaggcuucaugcugcuucuggcuagcaauggccucagagaggguuuucaaccucuugcucacacugggugugcuuguagagcuuguguuagugugaaacgugaaugaguugguaccuagaaagggccuccagcaggagcuaugcuaaaaucuaaccauuggacauuaguaccugcucucugagacuccuagaauacugggcagccauggaauguccguggcagagaacauacaauuggacuuguuuuaagcagguauuauuauuccuggguagagcagacacaauccucaggugacuagaggacaguggagcuggccuggagagauggcucacuccccugaagugcuuucugugcaagcaugaggaccccaguuuaauaaccagaacccacauaaaaccauggguacuggaucagcaagguggcucagugaguaacuguucacccgaacccacaugguagaaggaagaaccaacuaccacaaguuuuccucugacacacuugugccugguacacaugccagcccccauagauagauagauagauagauagauagauagauagauagauagauagauagauagauagagugaaagugucuuaaacgggcuagagagauggcucagggguucagggcauguacugcuuugcagaggacccaaguucuguuccuagcaccaugugggucugcucucaacugcccacaugugacuccagcuccaggaggacccaacaucuuaagcuuccacaggcacuaaacucacaugggcacacagauacagacaaacauaugccauagacacacaacacacagacucacagacacacauaugacauagacacacagcaugcacacacagacucacagagacacacaaaaacacacaugacacagacacacaacaugugcacacacagacucacagagacauauaacacaaaaacauacaugacacagacacagaggcacgcagacacacccacagacagacagacacacacaacacaaaaacacacagacauacucacacaaaaauauacacagauacacaggcacacacagacacucagacacauacaugauacacacagagaaacccaacacaugcagucacaugacauacagacacacacaugauagacacagagagacccaacauacacagacacaacacagacagccauacaccauaccacauacauacauauacuacacacacacacacacacacacacacacacacaaaacacuaagaauaaaauagaucuagaaauucuuuaaaagcugggcacgguggcucacacuucugagcacgugacuagcagguuaggccuggccagcugaccugucccaguuggugagcaucaggccagugacagacucuaucucagggaaacaagguggacagcaccugaagaggaacaagguucaccacugguuguucucuggcucuacauguaugcucccgugugcgcacacacauauaugcaccugaagaggaacaagguucaccacugguuguucucuggcucuacauguaugcucccgugugcgcacccacauauaugcagcuguacucaugaguacacauagacauauucacaguauauacauacggcccugccuccccacccuccccaagacaauagagaguaacauauuagggaaagcaagccuaggacuccuagggacugaaggauggugcaauggggacccaaugggaggguguggggagguccuggguucaguauggaaccugguaugugugaggguucaggggaccuccaagggaaggugucacaaagguuggaguuccuucauuugacgcuugggagaaaccaagccugauaccaaaaggaagcucaggcugagucuauggcaaugacugaggcggucgcagaaggugucagaaacuccccuucugucauuaccgcugcagucuaaauuguuuuagcuucuaaacuaaaaguggggugggcagcaugguggagacacaguguaggguggugggugcaguuggggacaaguccccagagaaucgaaacccuccagaaaggcuggguuuccuccagccugagagcaaagaaaggagagugugcucuucauucuccaccucccucccagaugugaccuugagcccuuggagcagugacagcaagugccaccagcgcagaguccugaccuacaccauccccauuagcaaccagcuaggccccaagagcgccucugugguggagacacagguaggcuuggggagguggcuggcgggugggcuggccccguggagcagcccugaccucccgacugcuccuucuguccccugcagacgcuguuccggcgcggcccacaggcgggcgggugcgugguggacucugaggugcucacccagggcaucccguaccaggacuacuucuacacugcccaccgauacuguauccugggucuggcccggaacaaggcccggcuucggugaucccgagugugcccuaucucuaccucaccucaguggucagggcugccuccacccagcauuggaagaggucauugugaauagaauaguugaugugcucagcuguucacugaaccccugagcaugaguugaacauagauauucuaggucucagggacaaagauuccccuguaagggaccuuaaacgucacugggaaaauuccagugaauuaagugauugcagaauguuauucaguucacuaccucaccuggcuuuagagaaauucacaggaggcuggagugagagagcaagggguuguacuacgaugaucaaggguggaccuucugagaaaggaauauuuuguaauagaggaaggggcuuccauucagaauggccaauacaaaggcccugaagugggagcauaggaguagcuggaguagagaagcaggagcaugggaguagcuggaguagagaagcaggagcaugggaguagcuggaguagagacauaggagugaggugcauucacggaaucaguuugagcccagaagacccugaauaaauuccacagacaggcuucaucuggcuguaaaugggagugggauaggagaccaagagaagcccacccacucugcugucuagguguagagguaggggcuaggaccaguugggaguggcaaaaaggacaauaguuggauucuggauagguuuuguugagagcagggccuauaaugucagcacugaggaggcugggaccaggggauccuagguucaaggcugcagugaguucaaauuuguaagggccuauuacaggauaaaaaagacugguguagacuccacugggggagggccugaggguagagcucaaccguagaacucuugcuuagcagauaggaauuucagucccuaguauagccccaaaucaauggcaguuauagggagaccccuaaagugugauuuaaguguaaauguggauggaggaagccaaagaguccaaggccuagguuugaggugauaaagacccuucucugaauuagaagucuggggcuuguagagucccccuacaaaccugaccuaggucccucuuguccuccuccuaguguauccucagagauccgcuaccgaaagcaaccguggagccucguaaagucgcucauugagaagaacucguggagcggcaucgaagauuauuuccaccaccuggguaggggacugaaggcuggcggcgcaggggcggcuguggcccagcaggguacagacauaccgagccaucucuugucccucagaucgagaacucgccaaggcagaaaagcugucccuggaggaaggagggaaagauacacguggacuacugucaggccugcggaggaggaagcggccccugagcuggagggggcacagagaugggccucagcacccagacccagaccccugcacccagaccagcaugcacaccucaggugcguuaccucgagauaggcagcuggaggaaauggacccuggggugcuccuggcucaccccaaguuguuguuuuacagguucccucagcucucgcuucucggaaccaucuguggaucagggccccggggcaggcauccccagcgcccugguucucaucagcauugugugaguaaggaagacuggcauggguuagcagccuggcugugugauguggaccacaugcuuggucucucugggccucugcuuugguugggaugugggugcaacucagagcaaggauugcauauugggauagguccagcagaguucccacaugcugcuccauuugucuuagagaagucuuuauugcugggacagcagcuacccuggggcccaagggaagucagagggaagaaauuucuggaagaagagacaaaguaugugaaguuagcuacucaaaagaagccaaguuguagauacauuguuuuucugcacccaguccugagcugcaugaaucuguagacacagcagugaccaagagucccaugggaaugguggagaguuguugucagacccgagggagggggcuggguuggugugggaggucguggcagccagagaugagaagacaucauaguuucggggaagccaaggacagcugagcugaaaccuccguaggacuugggcagggacacaggcauuuggaggccaguguguaugggaagggcaggacaguaaggaaaugcaaguaagaccccaacacacccgcuuagagcugacccgagccucaugcucagccucuugaggccucaguuucccaagaucacccaggaacccuguggucuugagguucagagcuagacgcccuagguggaggaaggccagguaccaacccugcccugggcaguucucacaucacuugucuuccccucacugccuccgcaggaucugugugagguagggcauccucucucugccauucuccuuuauugaagcucaucccccugcagcguucucucccuguucaaugucccuggcuuuuccagggaagauggcuuaguauggccagcaagcauguaggcaugacauaggucaaagcgcaaacccugucuuuucugcuuaugggcugugugacccuaggcauauccgucacccucucugagccccuuuccucugaaaaggguggguaaugacggugcccuuuaagguaugguugugcuagugugcugugggcgggugcagaccuccaagccugacuggaggggauauccaucaugaucccaggggucugauuucggauucuguccccagccucaucguucucaucgcccucaaugcccuccucuucuaccgucucuggucucuggagagaacagcccauaccuuugaguccuggcacagccuggcacuggccaagggguaagaggagagagccugaggguagaauuuggggccagggcucaagcacguuaagauggccagggccauucucacucugauucuucaucuccacagcaaguucccccagacagccacggagugggcggagaucuuggcucugcagaagcacuuccacagcguugaggugcacaaguggaggcagauccuucgagcauccguggagcuccuggaugagguaugcggcagccaugcggggcuguggggccuugggucaggaugcaucacaaccaagggguucaguuuccuccgucauaaaaugaggaagcuaguuccgguagcugaccucuuaguuugcuggggagauccaugggacagaaggaacaagacucauauccuggaaaagcauccuucaggcauggcuggauccagccauuuggcuguaguaagaauccccucuuucuaugcugcuaguagcagguugguuuagggagacaugcagaggauaguccuuucugucacuagcugcuggggucacauguccauccuuccccaauccgaguagccgggcuguacuaggcuugguucccugccugccuugggcuuagguuggcugauagagugacucucacaagggcauuugguucucaucuccaaaaagggauugaugaagucacucuguagaguucaggggacacucaaggucagacugacugcugugugaccuuauguaagugacugucauuugggccuuggcugcgucuucugaacuucuagaguaaugccaucauucauaagcugacagugcacugacauuugaaguaaugccaagcacacuguaaacacuuaauguucuugcuguuggugagccucgcccaggcuucuaggaggugcugaauaacuacccugucaccaaauagugcuccucuuagaucccagaggacugcagccagcagcugaggaagaccgaggaaaauguguggcacuggggugggugccucugauauggaggagaaugagggaaaggcucuagcuuuggucccugagggcaucccugagggaccgaacugaagaaauuuguggaaauucuguuuagugggccagagggcguggcucaaugguagggccccugccuagaaucccccagugaggggcugggggcguggcucagugguagagccccugccuagaaucccccagugaggggcuggggguguggcacauuaaugagagcaagagcccuuagcauagcagaucuguccuaccaccauccagaagugacaguccuccagccagcugugcagcaggaagcccuauggauuaauugcuuucucugugacauaaaggugaacuggugggucuucuuccuccuguggcaacacugagcagcgacucaggaaaggcuuauuuuaucucauggcuuaucgauguagucuaucggggucacugggaaggcucuguccaaaaguagagaugacauagaaacagagagaaaggccaggcuauaaucaucaaggcccauccuuagucugccagcuagacgcauccuggaaguccuacaaccucccuuagcccaggagaggauuaaguguucaagugcaugaggagagugagggacauuucacagucaagccaggaaaggaggaaguguuuauuaggcuccugaugugcugaccguccugggggguguccugggagcaugagaacaggccuccccucgcaaccuaaguagucagggaggcccugcuuccugaaggggcagcagccuuccgcuauagugccaucuaguggggaccaauagacacaccaaccugugggagaugguucagauuuaaguaguaagcaggauaugguaugcaggcagcauccuuugguucaaggcuagguacuuagucccccaguguacuacuuacucacuguggaccaggcucuagcaucccucaaaucucugacaaaacucuaugaagcugggguguuaaucaggugauuauauuaaucaccuguucuccaggcaaggaaacgggcccauagcaaugaaggaauuuacccucacacuguuaguaauaacaaaguccagauuugaacccgguccaccugaauccaccuugagacguuaccagguggugaggcagcaugaccgugcagaauggcguggagagugugcucauccuaccucccucaccucuuccggcagaugaaguucuccuuggagaagcuacaucaaggaauuacugucccggauccuccccuggacacucagccacagccugaugacaguuuucccugaggacuccugauugaaaagccacaccccuaaacggacagaaggacacauggaacccuggcagucacugcuggcacagugcgaaugccgccgggagguuccugccugccccucacuguggcccugccaagagccacacagaccuggggaccauagaaccaagaugcacuuuagaucugugugagcgauuccagcugccacugccugcucagccagggagcuggccuggucuuuggcagacucccccuccaacuaacuuauuuugcccagcugggguuguggggggcaccuuuuggggugcacaagaacccucuggguuuaauguauuuauuugggaauaaugaccccaauaaaggguuggaaauggcua

SEQ ID NO: 3712 - RNA, 1078 nt, Mus musculus
ucaguguccuugcuugggugggugguccaggguuucuuacugcuuggaggccauguaggccaugaggucuaccacccuguugcuguagccguauucauuguuauaccaggaaaugagcuugacaaaguugucauugagaguagugccagcccuggcaucaaagguggaagagugggauuuguuuuuuaaauugcaggagacaaccugguccucaguuuagcccaagaugcccuucagugggcccucagauaccugcuucaccaccuuuuugaugucaucauacauggcagguuucuccaggcagcacaucagauccacgacagacacauuggggguaggaacacagaaggccaugccagugagcuuccuauucagcucugggauaaccuugcccacugccuugggagcaccaguggaugcagggauuauguucugggcagccccacggccuucauuccacagauuucagaggggcaauccauagucuucugaguggcagugauggcauggacuguagucaugagcucuuccaugaugccaaaguugucauggaugaccuuggccagggaggcuaagcuguugguguugccggaugcauugcugacaaucuugagugaguugucauauuucucaugguucaaacccaucacaaaaaugggggcaucaucagaaggggcguagaugaugacccguuuggcuccacucuucaaguaugcuccgggcuuuuccaugguggugaagacaccauauacucggcaccuaccucaccuuauuuuauguuaguggggucucgcuccuggaaguuggugaugggcuucacauugacgacaagcuucccauuuucggccuugacauuuccauugaauuugccguggaugaagucauacugaaacauauaaaccauguaguugagguuaauugaggucguugauggcaaaaaccuccgcuuugccauguggagagcagauggcagcccuggugaccaggcacccaauaaggccaaauccguucacaagaccuucaccauuuugucucugggacgaugcuggcacuacacaaguggauguggcugucucug

SEQ ID NO: 3713 - RNA, 1009 nt, Mus musculus
cuuacaccuuggaggccauguaggccaugagguccacuacccaguugcuguagcuguauucauugucauaccaggaaaugagcuugacaaacuuguuauugagagcaauaccagcccuggcaucgaagguggaagaguggggguugcuguugaagucgcacgagacaaccugauccucaguguagcccaggaugcccuucagugggcccucagaugccugcuucaccaccuucuugaugucaucauacuuggcaaguuucuccaggcggcaugucagauacacgauggacacauuguggguaggaacacagaaggccaugccagugagcuucccguucaauucugggauguccaugcccacauccuuggcagcaccaguggaugcagagaugauguucugggcagcaccauggccaucacgccacagcuuuccagaggggcaauccacagucuucugaguggcagugauggcauggacuguggucaugagcucuuccaugaugccaaaguugucauguaugaccuuggccagggaggcuaagcgguugguggugcaggaugcauugcugaaaauauugagugaguugucauauuucuuaugguucacucccaucacaaacaugggggcaucagcagaaggggcguagaugaugacccguuuggcuccacccuucaagugggcucuggccuucuccauggugugaagacaccaguagacuccacgacauacucggcaccgacgucacccuauucgauguuuguggggucucgcuccuggaagauggugaugggcuucccauuaaucacaagcuacccauucucagauuugacuguuccauugaauuugccauggguggagucauacuggaacauguagaccauguaguugaggucaaugaagggguuguugauggcaacaaccuccacuuugccauguggagagcagauggcagcccuugugaccaggcaccgaauauggccaaauccgcuuacauugaccuucaccauu

SEQ ID NO: 3714 - RNA, 12176 nt, Mus musculus
aauaaacaauaguuaauuuuauaugcuaagucugaggcaggaggagugccacaaguucaaguccagcuagggauacauauagugagacccccgacucaagggaagggagaugcuaaaauaagguaaacacauauauauuugaauaugaaaauuugcuuuaauuuguauaaauaagacaaaguguucuacuuaaauaaaaauucaucugggucuucuuguagaacacagaauucuuccaugggcaucugcugauuuggaggccagcaacucuguuuacauguguaaacgagaaucguuccaaauuccacggcaagaccugaaaaacaucacuugcucuagauuccacaaggagaauguuuaaaggugcauucaugaugaggugaccaccggagugucagaaguucaaacugaucccugacuacauagccaguucaagcuggccuaggcuaucccaugcccugccuuccaagacaaaaccaaaaggaaacuacaucuauaucuguauguauguguaaacugccauaauaaauaaacugcauuucuuuagaauaaaaccaaaccuccacuaaagccggcgagaugguggcgagugagccaaagcccacgcugcucaagccuaaggaccugcgcucggcucgccagaaaccacguaggacgccaggugugugugugugugugugggggggggggcacacuucuuuuuuuuucuuuuuuuuuuuucuuuuuuuaacuuuucaagacagaguuucucuguguagcggugcacgcuuucaaucccagcacucagaaggcagaagcaggcggauaucugaauuugagagcauucuugauuuacagaaugaguuucaggacagucagggcuauggagagaaacuccugucauggaaaaacgaacacaaggcaggcaaaacaaggucuguaauccuaauccuccuagcgcuggaugguggaaacugagguaucccaagccagcuaaccugaguacaaggacuuuagcaaaugagaaaggcccugccucaaagugcccaggguugcccucugaucucuacacauguccaagcuguccucaagcacuguccugccucaguuuccugagaaaggaggacuagaagcauguaccuagucccugucaagcaguuuauaauuacucuguacuugccauguaugggugugcgugcaucuguguaggugcgcaucuggaggucagaggacaacucuguagaggcaguucucuacacaguugcauccaucccuuaugugcaaauuagcuuguucagucucaaauuaucaaaacgguuauuguuagcgugguauuagaauucacuggaguacaaauuucuuacaauuuaauuucucaaaccuuuuauaauauuccauauuuaauaauuagcaaaaagcauuucuuuuuucuucuuucuuuuuuuuuuuuuaauuuuuuuuuuagauuuauuuauuuauauguaaguacacuguagcugucuucagacacuccagaagagggagucagaucucguuacggaugguugugagccaccauguggucgcugggauuugaacucuggaccuucggaagagcagucgggugcucuuauccacugagccaucucaccagcccuuuuuuuuuuuuuuugagacaggguuucucuguguagcccuggcuguccuagaacucacuuuguagaccaggcuggccucgaacucagaaauccgccugccucugccucccgagugcugcccagcaagcauuucacuccacacugaagucagagguagacaagcucaguaaaggccuucuuaccuagauuagcacugcugagcaugcugaccagugcuggcauaagcugaaacucaaacguccucuggccuccacagccacugcaggcugggaccucagagacuucaaauguggggcaggacagaaagagaggcucuccacuccacgaauaccuagggcaagcagcgggagaaucauucaucagagcaaaucagcaucugggccaugguacagcaucaggauuaggacuagacagcagggaaacccaccccaggggcaaggcagugacuggagagcaucgaggggacugaagacuuguuaccacuuggcucagugccaucaaaggccauaaagaggugcuuggggucacugagccccuuuauaugauacucuuccuaauguguuaucuccuuuuugugcuuuccauaacuacuauucuguuauauuugagacagggucucaguguguagaugcuggccuggagcacacuauguagaccagacuggacugaagagucguaccugccuauuuacugcuuacuuagcaacaugccaccuuguugaaacuguccugcucauacauggaggucuggaagaguccucuuuugcuuaggggcagagcaggucucagaggaucacuucagugcaggguacagccucacccucacucucaucuggaagggccaucaauccucaaagacugcucauccaggaguccaagguaacuguaggguuaggaaaacgacuuaucuucagccuugaggggagugagacagguuggacgagacacuuaugggcuggucuuugagcccugcccuaaguuacuucauacaguaugaaauagcuccauuuugagugcaaacucagaaacaggguggcuuuaccucaccuuaagagagacagauggcacauuccugauggcagaaaggcucacucugagcucacagagagagguacaugggaaccauaugggcacacagaugcacucauauggcaucagcaaaaccaggaccagaaagguauccaacacaccaaaccuaggaccugaaacccucccuggggcccacagaggacaccugagcggccgaccuccagccugcugcaucacuacuugguguacggugccaacugugugggguccucagcucagcugggcccugacugcagacaugacacacugaaaagugcccucugucccaggaaacccaggacuguuccucagccccgugaccuucaagguccugcaccuuggcucugcaaaagcucaucaccugaucugucaucuuccuaucuaagcaucacagugccuucacugggaucugcaucagcuccccacucugccuccaggaaggcuucauuaccuucuguagccauuauguaacccacacaaagauguacguuugcauauacgcaccugcagauacugcaugauauggaaccugauucugauuaagacccaaaucaaauaauccauguuugccaacagccagcuaucaaggagauggguauuauuugccuaacuaaagccagaauaucucccucuuaaguauauuuuuuaaaacccaggcaugggguacauacaugaaauccuaauauuugggagguugaggcaggaggaucagaguucaaaguuaggguuaucaagauugcucagcaagugaagacacuugcuaccacguuugaggagcuguguuugaugaucauccaugugauagcagauacgauuaaaggaaagacccacacagauacacuguucaaaaucuacauuguagagcugcagagauggcucagggguuaagugugugcucucuucuuccaggagcugaggucaucuccuagcacccacaucaguugguugcuuuuaacuucagcuccaggguguuugacacccucuucuggucucugagacuaacuguaggugugauacacacacacacacacacacacacacacacacacacacacaacacaagugugaauggaggcuaggggagcacccuugauugccauuugaguucuuuugauuuucaacacacacacaaaguggagcuuacagaguaaaacucaguuauacacacaaguugaagauguaugugcuaagacacauccuacuacuuaguaugugugcagcucugggugugaugccuaacaugguauaaacuggaugugguaaugcagcccuauauaucucauugcucuggaggugaaggcaagaugaucagaauguuuuucaaaguauuuuuuuuuguuguuuuuuguuuuuguuuuuguuuuuuguuuuucaagacaggguuucucuguguacuccuggcuguccuggaacucacuuuguagaccaggcugaccucgaacucagaaauucgccugccucugccuccugagugcugggauuaaaggcgugagccaccacgcccagagauuucugucuuuagaguuacuguucucuuugauaagcaugagcugagaaacagaacuacagacaaaugcacagaaauaccaauccggagggcucagugguuaagagcacugacugcccuugcagaaaaccaugcuuuccagcauccucaagguagcucacaagcaucuugaauuaagcccucuucugaccucuccaggcuccugcaugcacaucguacacaugaacucucgcaugcacacauaaaaauaaaaacuagauggaaagugauagagugagacacacagaauucuccucuagccuccacaugcagugugggcgcaugcagcagacacacaggaaaccaucauaacugcugcugacuguaccggggucagugugaaucagggagcuucuuuacagucaguuccaaggcaggaaaguuccagcacccacacgcagcagcucacaaccacuagucuccucuggauuccacgggcacccgcagucaugugcacaaacacacaccacaaauacaguggaagcaaauuuuaaaaggaugaacgccucacuguuucugaggcuguccaggugauccucucgccuuaccuugaggagucucugggcugcuauguacuugccagcacgcuaccauuacauaaacagaaauaccugucuucuuuaccucaaaaucugcuccuggcaagcagcaauucucuucaugaaccuauaaaacguuggauccccacugcuaacuguggucuucucguacuuuucauccccgucacuagagcuaaggagagaagcagagacaaggcuaucaguguucgggaacuggaacagcugcaagaggaacaagaaacuuccucuuucuguauuguguuaaaugcugugugagcucgguguugcucacccgugcccaggcuacacgggucagaggccaacuuucaagcuaguuccugccccucuucagucucuggcauauggucuuuuuagguccgagcucucacuggacccaccagagcucugaggaaagcacagaaacagcacugcccaucuuauguaagagagcugaaaccccgaaacgaccccagcgccugaggcagcucugcauucacaguguugucaccagagaaggcgcaccucuucucaaucaucugccucugcuccaaaggcacugaaaacagaugguggccaggaaguggcuuagcaagaccugagaucaauccccagagccuacaugcucaagaaagagagaaggcucccauaagagguccucugaauuucacacaggaaccauggcagcacaugcauaccugcacccauaaauacaugcaugcacacaaauuccuugucaggaauuugaaaaagugaaaacagagccaggcaaugguagcaccugccuuugauccuaguacucaggacacagaggcagguggauuucugugaguuugaagccagccugguuuacaaagugaguuccaggauagccagggauacacagagaaauccugucucaaaacccucgaagauaugggcacagaggaaaaauuccugaauagaacagcaauggcuugugcuguaagaucaagaauugacaaaugggaccucauaaaauugcaaagcuucuguaagaaaaaagacacugucaauaagacaaaaaggccaccaacagauugggaaaggaucuuuaccaauucuaaaucagauaggggacuaauauccaauauauauaaagaacucaagaagguggacuccagaaaaucaaauaaccccauuaaaaaauggggcucagaacugaacaaagaauucucaccuaaggaauacugaauggcaaagaagcaccugaaaaauguucaacauccuuaaucaucagggaaaugcauaucaaaacaaccaugagauuccaccucacaccagucagaauggcuaagaucaaaaauucaggugacagcagaugcuggcgaggauguggagaaagaggaacacuccuccauuguuggugggauugcaagcuuguacaaccacucuggaaaucagucuggcgguuccucagaaaauuggacauaguacaauggaggauccuaccauaccucuccugggcauauauccagaagauguuccaacugguaagaaagacacaugcuccacuauguucauagcagccuuauuuauauuagaaaaaagcuggaaagaacccagaugucccucaacagaggaauggauacagaaaaugugguacauuuauacaauggaguacuuauucagcuauuaaaaagaaugaauuuaugaaauuccuaggcaaguggauggaucuggaggauaucauccuuagugagguaauccaaucacaaaagaacucacaugauauguacucacugauaaguggauauuagcccagaaacuuagaauacccaagauacaauuugcaaaacacaugaaacucaagaagaaagaagaccaaaguguggacacuucgccccuucuuagaauugggaacaaaacaccccuggaaggaguuacagaaacaaaguuuggagcugagacgaaagaauggaccauccagagacugccauauccagggauucaucccguaaucagccuccaaacgcucacaccauugcauaugccagcaagauuuugcugaaaggacccugauauagcugucucuugugaggcuaugccagugcuuggcaaacacagaaguggaugcucacagucagcuauuggauggaacacagggcucccaauggaggagcuagagaaaguacccaaggagcugaaagggucugcaacccuauagguagaauaacaauaugaacuaaccaguaccccucagagugucucuagcugcauauguagcagaagauggccuagucggccaucauugggaagagaggccccuugaucuugcaaacuuuauaugccccaguauaggggaacaucagugccaagaagugggaguggguggguaggggaacagggagggggaggguauaggggacuuucgagauagcauuugaaauguaaaugaagaaaauaccuaauaaaaaauuggggaggggggaaccacaaaagaaaaaauaaaguaagauacaauaaauaaagucaguaaagaggcuguggaugcagcucaacuggaagaguguuguccaccaguaagaaggccuggguucugcccccaacccucauauaaccagccgugccaaucucugcacugagagaguggaggcacaaggaucaggaauuccaggucauccuugacuacaaacagaguuugaggccaaccugaucuacgugacacacugucucaaaaacaagaugacaacaacaaaaucaagacagaguccaggagauggcucaguggguaaaggugcuuguuaccuuucccacaacccacaauguggaagaggagaacagaccugcuuaugucugaccucuacaugugcacuccaugugugcaugcacacaauaagcaaauguaaaaaaaaaaaaaaaaaaaaaaaaguuuaaaaaguaaaaagagaauagggcaaagaggguuggagagauggcucagugguuaagagcaccgacugcucuuccgaagguccugaguucaaaucccagcaaccacaugguggcucacaaccaccaugagaucugacgcccucuucuggggugucugaagacagcuacaguguacuuacauauaauaauaaauaaaucuaaaaaaaaaaaaaaagagagaauagggcaaggacauagcucaggguaaaauccucagguaaguaacaugcuccaggcucuagcuuccaucccuagcagccagaaacacaacagaaacaaaugagcauacagaagaacagaaaaggaaacuaaagaaaugcuagggguguuuuaaugacaaugauaagugucaucuggguucaguuccugagggcacucagcagcagguuaaagcaggcuggcugauacacauagcccaggccagcaucugcucucucaucuaaggggagcaaaacagaaaagcccaaucacaacccuccucucuagaacuugcccguggcagcuuccugccugcaucucucacccuagggaaagcagcugcuccauguccaccccuucucuccgcugguacuccugcagaaggcugugcgcaugaucaagauccacaacgcugccauaauccuccucuucagcaacacagauauaauagggcuggaacuguggcacugcaguggggacugucagcccuuccccugaaggagaagggcagguaacagccagggcaguguccugaaggcgaagagcuuggagcuucucaguccagucuagugcucugacaucauuagagucacuucccaaaucugaggcgggugguggaggcgucuccucagugucacuuccccagucuugugagccuucacaccaauucucagcugcaaggcuaucgcucugauucuagaacaaugaaugcaggccaaucacacuucagacuucagcuucuccacccauccaugcaccuucccagggagccugcauaucagccccucgcucuguggcacacuccaauuaaacguccuggauccuacccacucaaaaacauguuauggcuggguguggugcugcauccauuuaaaccaagcacaugcaaggcagaggcagauggagcucugugaguuccaggccagcuugggccucagaguaaaaacccugucucaaaacaagcacacaaacaacaaaucuggagggaaaaaaaauggcucagugauuucuuaagaguucuuucuggguuuuuuguuuguuuguuuguuuguuuuuguuuuucgagacagggcuucucuguauaucccuggcuguccuggaacucacuuuguaguccaggauggccucgaacucagaaauccaccugcuucugccucccgggugcugggauuaaaggcguacacaaccacacccggcauuucuuaagaauucuuaagaggucuaagaggacccagguucaggcaacucacaccaucuguaacuccaguuccaggggauccacuggcaccuucugacccccaaauggacuggcuaugcauguggugcacauacauucauugagguaagcacuaauagauguaaagugaaauaaauaauuccaaaaccagacaaaaucccaaccauguaagaagugacuuaaaacacugucucuugccgggcuauggggggcacacaacuuuaaucccagcacucgggaggcagaggcaagaggauuucugaguuugaggccagccuggucuacagagugaguuccaggacagacagggcuacacagagaaacccugucucaaaaauccaaaaaaauaaaaaacacugucucuuuugcuccagggcaauguggcacauguagguccaggugucuuuacccaucugucccacaaucuuucuguuguacuuuauguauuauugggacuaaaaaaaaaaggaaaggacuacauuucccaggcuccuuagcagcugggcuguuagauuagacguauucagugguuagcuccucagguccgccuaagagacaagaguguaauggagagcaaugccaugaagcaggcuggacacgguagcuccuaucagccuuggagaggcugaggcagcaugauggccaugagugugaugucagccccagugacaugaauuuccaggcuaccuugaaguauggauccagagaggggguggggggaggacagaaauauacaagagagacagagagcugcucugaaaacacagauaaacaaagacagcaugccaggcucugugacaaggggagcacgcacucaucaaaccacaccuaaguaucccgccugcaggagguagccuagcagaugggucaguuccgagaugugcucccacaagcccuugcuggacuuucccccugaggcuaucaauuuagcuaguaaagauuuaaaugucuuagcuuaaaaaacaaaaaacaaauaaacaaaaaagcauuuuucuacuucacacaaccuugugugccaugcacauacaugaauauauauauauauacacauauauauauacacacacacacacacuuaccuauauuuauucaaaugagaaaaucaguaaacuacaugucucucguauaaacuauuauacuugacuugguauuuaagaguacuggcugcucuuccagaggacuagguucaauucccaucacccauaucaggcagcccaggagauccacuaucuccacagacaccugcacugauggucacaugcauauauguaaacuggaaaguaaaaucuugggggcuggcgagauggcucagcagguaagagaaaugacugcucuucagaagguccugaguucaaaucccagcaacuacaugguggaucacagccacccauaaugagauccaacauccucuucaggggcaucugaagacaccuacaguguacuuauuuguaauaauaaauaaacuuaaaaaaaaaaaaguaaaaucuuaagaaaaagccagaaaacugagggaauagcauuugaugauucugaaagacuaaaguucauuccacggcagcaaagaagcauguuuaaaaguuugguauuaggggcagggagauggcucagcaccuacauuaagcagcucucaaaacaccuguaacuccagccucaaaggcucugacacacacgugugaagcacacacuuaaacaauuguuuuccugacaggguuucucuguguagcccuggcuguccuggagcucacucuguagaccaggcuggccuugaacucagaaauccaccugcuucugucucccgagugcugggcuuaaagacacgugcuaccaccacuuggccuagauucacuuuuauuccacguauauggguguuuucccugcauguaugucuguucaccacagugugcuuggugccagugaggccagaagaaagcauuggaaccccuggaacuggaguuacagguaauuuugaacugccaccugagugcugaaauuugauccugaguccucugaaagagcaacaagcaaucuuagcuaccgaaacaucacuccagccuccaaaagcaaucuuuuaaaaaacugucuuaagggacugagagaaggcucgcucuucaagagguccugaacucaauucccaacaaccucaucacaaccaucuauacugagucugaugcccucuucuggcaugcagguguacauacagauagagcacucauacauacaguaaauaaauaaaucuucuuuuuagcugucuuaaauaggauguggugauucauagcaguuaucacaggacuagggaagauuuaagccaacaaauuuaugagaguuaaaggccagcuugggcuagagaggggagacaaguugcuguaaacgauccucaaauuauugaaaaacauagugugccaaucagaaucgcuuuaccugcgcguuccaagucucuuucucuggcacuugcaggcacugggaacggaacaccuuccagcuuagaggcaagacagacacagugagggcuccacccuggacauccagccccaccgagugucacccggcccgccucggcccgccccaucccgccccaucccgccccguccugggaccagacuucacgacaggacuuccccgccuaccugcgcgucuggcuguugccgcagccuggacgagcacaggcgaacacguacagaagccgauggaacggggagccguccagcgggcaguacaccugcacgacgagcgugagcggcugugcgcagcggccacacugcggccccggagugguaacggccggcagggcguccugaggagcaggcugcagcucagacccccgggacccacgccgcucccgcccggacacccuccacgcggccccgccaagacaucgcagccgcacucaccggaacgccacccagcuugcuagagguccaggcggagggcccuuuggggcagcccuucaccgccgugucucgaagucccagcaguacaggcuuccugacggccgccauaacuacugggcucccacgugacagcgcg

SEQ ID NO: 3715 - RNA, 29012 nt, Mus musculus
gacauguaccaagucuuuuuauugacuggccaucaaaugggccuaauuaacaugguggaaaguagaaugacagggcugucacucagucucacaaggacucacugauagccaggauaugaaugugacaguaaugacacccugcuaaaacugucuuuugaaggguauaaucgaguucaucccuggguucuuuuguuuguuuuuaagacuuauuuauuuuauguaugugaguacauuguagcuguccucagacacaccagaagagggcaucggaucucauuacaggugguugugagccaccaugugguugcugggaauugaacucaggaccucuggaagagcagucaguacucuuaacuguugagccaucucuccagccccauuccuagguuuugauaccaaaaauaaagcgaagguaaacaaacaaacaagcaagcaaaaaccuaccuagugaagcagaauuacuuuuuccacgucaccaaggugaggaggggaaggaggugaacacgugacuggagagcaaguugcccaccuaacugcagaucccugaccccacccuacccaaccccuuuuuuguagacaggguuucucuguguagcccuggcuauccgggaacucauuuuguggaccaggcuggccuugaauucagauagaccugccugugccucccaagugccccuaucacccagcuguccccucauaacgaucaauccuccgagacuguggaccagcccaccaccaaguaaagagccaaccaaacaaggcauaagcagggucacccacaaguaacagauaaaaguacugacucaguaaacugaagaggcugagcccccaugccuccucuaggugucuuuauucuagcuggggugugaaauacaggucagaacaacaugacacgucaaagcccuuccaucagcuucaacagggagggugcguaguggguggauggcaguuccagaccagcuucucccaacagccuuguaguccaggccaacuaccgguggugcgcucugggcagggaggggcaggaccaugcagugcauauggugagaagggacacggaggaccagucaguagggccgcggcuggaguuauucuaguuuggugucccgcuguugcuugaugaagcugaucaguccguuaguggaggaaucaugggaggucacagcagagcugcccuccagcuccggcucaauuuucuuggccagcugcuuccccagcuccacucugucgggggaggguggaagaggaggaugagccagccacauuccagagacaacccaaaagcacaacagagauuccucggcaacucacccccacuggucgaagcuguugaugucccacaugaugcccugaacaaagaucuugugcucauacauggcugcagaggaaacaacagacggugcccguuagggucucucuccuuccuuccuucccuuccccauccaagugaccccaagccagccagcucauccuucuucuccucacucaccaaucaaggcccccagaaugaagggugucagcuugguaaacacaauagaguuggucgggcgguuuccuucaaagaccugcgggaaacaagaacuguccucagcgacgggcagaggcuccggagcacuuagcccuaaauggggugucuauauacaucccuccccucaaggcucuggggucucugcagaagaggagcuggaaagauucuaagggcaaaagugguggaugacuccaaggagacauugucuugaggacccaacagggccaaugcacuuagacccucacagcccaaaucccaccacagaggaggaaaagcagauacgaagucccaccucuaagcuagcugcaaauaauagcugccgggaaacaaugacacuaggucuaugaaccauauuccaggaccagagucacaccaaggaagagcagaucaacagaaaacagacuccauguuuuuaugauguugcuguuauucauuaacuucuuaugccuuuuguucuaucuaucuaucuaucuaucuaucuaucuaucuauccauccauccauccauccauccauccauccauccauccaucuaugguuauuuauauaugcuugaucuagggaguggcacuauuaggagguguggccuuguuggaguagguaagucacugugggcaugggcuuuaagauucuugucuagcugccugggagccagucuucuguuugccuucagaauaagacauaaaacccuuaucuccuuccacaccaugguuaccuggaugcuacaugcugccugccuugaagaugaugauggacugaaccucugaaacugggucauggugucugcucauaguaguaaaacuuuaacuaaaauacuaucuguuaaucuaaucuaucuccuuccuuccuuccuucuuuccuaccuaccuaccuaccuaccuauuuauagaaagaauauaaaguuggguggguagguggaccugggaggaguuggaggacaagaaagaagauugccaaaauauauugggcaggggggaaaguccccaggcuaauucagguccccaagcuuuugaagaggaaagcgcuccaccccagagcaugggacauuuacucugggggaagagacccuccgacuguguaggacaaacaauccugagcccccacccugacccuucaaugucaucccucuaggccccacaugucauccuagggcugaaguucaggagcaaagcugaccuuguguggcaagaguuucuccaagucuucugggcucuuuccggcagccuggagcuccuuccuggccucuucaggcaacuuccccuucaucagggccucagucugggccaagaaguuagccaggaggaucugacaagagggacauacaguuacaguagccagcaccaacagagacugcccaguccaucucaagugguaucaguuccagcaugguccacccacuggauagcgcaacuggagaggggaaggcggccgcaugggaugacauaggagggugacagugcuuaacuacucguuuuccuuuuagggaacagaaccucaguacccucugugaagcuaccaccuuauccuuucuuaaaauuugagacaguucuuugcucaguuccucaggcugcccucaacuggcagauccuccuucucggccucaaucacaggugugugccaccucgccaagcugccuagcagcauaugaauauucuugaauauucugauacaugauaagggauccugcuaaugacugucuuuuuuuuuuuugguuuuguuuuguuuuguuuuuugagacaggguuucucugugcaguccuggcuguccuggaacucacucuguagaccaggcuggccucgaacucagaaauccaccugccucugccucccaaguguugggauuacaggcagugccacuacugcccggcaugacugucuuuuaagacuuuaagagggagcagcauugacccccccuuuucuaguugaaucaagucaacaguguuguaucacaguauagcaggcacgcgccuuccaaucccuacacucacaaggccgagagaagauuaucaaguucagggcuagccugagucgcauugugugacccuguugcaaaacaagacacucagccaccaauaaggaaccagaauguugguccucagagaagauucugccaaaaaccugaaugaacauguauuuuccaagagucuggugguagucuagguuuuaacuugucaaauugauuuagccuaaagucaucugaaaugggaguuucaauuaugucugccccguucagauuggccugugagggauugucaugauuauuaauugauacaggaaggcccagcccacugugggcagcaccaucccuaggcaggaggugccggucuguacaagaaaacuagcaugagccugagaacaaacaagccagcgaacagcauucacccauggucucugcuucaaguucuugcccuggcuucccccagccauggacugugaccuguaaaucccagggcugcucgugcuuagagucuuuucucacaguagcagagauggaacuaauucaggccaacaccuugaguuuggccuaugacuuuuaugagauaggagcccagcgaggcuucuaacuuugggaacugagauaacagacuguguuucaaggcaguaaacguguggucaucugcuguggcagugaaugagucuaacugcugagccaggcagcugcgggagggcugccccacaauccugaaaagaacaacaguccagccaggcuuuuuaccuugugaugcagaccuuuccguauggggugcugggucuggacagggaugagaaagucacaggguaucaucuuggugccuguuaagcgcaaggggacaauagucauccauacaacccuaaguccauggaagcuacccaagcaaccuauagaagccacuacccuaagcaggaggguccugcugucccauccucggcuuaccaggcaucacgcccacuugcccagggcagacgggcccuaccuugguggaugagcugguagaaugcauguugaccauuggucccugguuccccccacacgauggggccugucuggugguccacacgggccccggacuuggugauguacuuuccguuggacuccaugucacccuggaaugaggacaaaaacucaaucuguaagauuugccugucacaaacggccuggauccuuccuggggugccugaaucagcuucauguggggaauccuguaaauguggguucucaggcuccuguuccugagcuuucugcuaaagacuacuguaaggaccacgagcaggagaagaugggucuggaggcaggaggaggaggaucucuuuauuuguucuuccuauagguggccuaaggaaacccaggaugacggccuacugcucucuugaccauaagaccuuucaaaaucauggaaauugauaagucaaaacuugaucacucuuagaacaacuaugaagaugcuuggaagauuguugcaggauaucugaucacacugugaaucccaagaucgucaaauuuacugaaaaaaacacguuucuaguggugguguggcucagcccuuggcacacaccuuuaaucucaaacaaugaagguaaaguuaguucguagaaggaagcacccauguuugaaagugaugucuaauugaguggcaggcaaagugaccaaucagagaaagauuugacagaguaggauacgcccaacucucaugagaggagagaggaaaggaaagcuacuugggggcagugcagaaaaacgaaagccguuguuuuaacaggaagagcuuuacagacacagguuacagagagaacaagcuggacacaggugaggacagaacacgccaaagaaugagaagccagagacuucuuggaacagacugcuagaguuagcaugaggccaaccagagccauucaauaagaacugagaggccggacugaagcagucagcugugagaggaguuugaaccacgucagcugaguugaaucagcagcuugagcucagaaagcacuaggaaggggugagcuuauucaaaagucagucccagaggcuggaaacauucuaggccuaauuaaggcuguacggaggcuagaagcuuccaggacuaggccuagguuagcaguuggaggcagucagccucggacacaauuacucagccgaguaagucacauuuacaggagauggcucgguagauaaagagugcuuccugcucuuccaaaggacccaauuucaacuccuggcacacacgccaggcagcucacagccaccuggagcaccaguucuaagguuccaucgagcuccucuggcuuccagggcaccuugcacccguguggcauucacucacauggacacauacaaacacacaugcaaggaaaaggagaggggagacugagcagguagguaugccuagaccaaacaauagggcuggacacagggucaggggccccaaagggugcuaauucuuguugcaugugcuuacaaauagggagagguauagcuguaaacucucuggucaccgaacguguccauccuggugaacaaaguauaccugggccacgaguuccagcucacaucaccacccaagaacagcaaugacaggagagagccaaagaggaagacacacagggcaccucucauagaggugaauccagcuggcagcauggauagaguaggacuugguuaacaagaugugccaggaacccagccgcagggaugaacuauggccacacucacaagcacaagguggggcacuggaccugccacuagaccucccaaagcacggcccagcggccgguaccugcuggaaauaggcagcaaagcggugcauguacuggucauagggcagcaaggcgugggucucacagccguagcaguugauguaccagaugcccaguagagccagcaggacgggggcauucuucuccaggggcgucuugaggaagugcugguccugaaagaacagcaaggugaguggcggcugagcagcuggcagggagagagggagggcagggcgggacccauacaugucucaggccacacagcacucaccauccagugagccccggacagcagcugcucgaaguggucaaaaccugugacacaaaagcagcgucagcaaaggugccccucgcaggcaaaaaaaaaaaaaaaaaaaaaaaagaagugccaccucuguguccucccggaaguuaguuaguuucuucuggaaccaggaaaagugggaccugggaggaggaggggccccaaggaaagccucucucuucagagcuggcccugagcauaauaucaacccuacaguucucucucccaguacuaaaagauaaauguuuguaggcagaagcagagaggcagggagccugugggcuaagcaagguauucauggauaugacaucaaccucacgcugcaauacugccuccugcaggagacgcaggaacacucaccuacaugcagagcaauggaaaguccaauggcugaccacagcgaauagcggccaccuacccacuaggagagaaggaaagggcauugaagguggguaggcacacccuacccccucccccuccugccaagccugucccuggaaagccacucuuccacggguacagcuuguagggcuugacgcaacccaacucuuccuaggaagucggcagcccagugccagugacccuccacaugggaccguucuaagccauagccauagaguagagauguuaccaugguuggccuuuuccuccuggcagaccaaggccucaaaccucugucaucugucagcuccugucuccucagcacuggcagacagacagcuuugccuucucaguguugacagagccagggcuucauaccugugcuucagcugccucagcaugaccugugguaguuccuacuuccucagugcugacaaaaagaguucccgaucugugcuaaaccuuuuucuucagaugccgaccuacauagaccuucauaccuguucacaaucccaucuccucagaugaaggcagaccaagcccucaaaccugugcaugacacauaccucagacccaacuuaagagcuucauaccugugccuaccuuaucgccucagacaccgaugguaaauuucauaccucauaccugugccgugccucaucuccucagaugccggcagaccaagcacucagaccucuacugaacuuaccuuugaaacauggagaggccgaggaccuauccccucagauacugacagauccagagccucauaccugugucuccccugucuccucagacacugacagacccagagccuuguaccugugccuacccuguguccuugaucaagggcagacucacuaauccauaccuauaucuaaccugucuucuaaguuacugacagacccagaacuuaacucucagacuuacccugucucuuuggucaccgacagacccaaaaccucacaccugcacuuaccaucuccucagaaaccgacagaccagagcucauaccuucaccuacccuguuucgucauaagccgacagauccagaaccccaggccuguaccuaccauugucuucuuggucauugacaaacccagauuuguggccacucugccucauuggcccagauuagacacagagacuaauacuuuaccuaccaagucgccucauauacuaauagacucagagccucagaccugcacccauucugccuccuuagcuacugacagauccauagcuuugugccuaugcuuacccugucuccucagccucugacagacccagagcuuccuacccaugucuaccuuggaucugaauaaacacugucauccagagaagcacuccagaguggcauauacaagaguccuguggcaggaguaaccuuuuacaacaagagauuaaaaacucacaggaaacaacaggagcgacuuccuuucuuaagucucucaggcugacacaggacuacaacaccacuagcuguaaaggagaguugcuagaccacauauccguuagcuguuuggauguaucuucuggaggccugaggugacaggcuucgaggaagcacagcacagcguguaaugugaaggacgaagcugagagaccagguuggagaacugcagucugagagccaggcacaaaugaagacagagaaagucccaagaugaugacauccuggccugugggguguagagagcuaacacaggaaguucacacaggugaaacugaaagaaugaggaagguggcccaagguaccucuggacaauaaugaucugcagacucaucuguaaggauccaggguuaagaagagcucugcuacagcaaccaucucacaagccucguuaggugugacaugaucuucccuaacggacuuaguuuuagaacgggaaucgaaugguuggcagcccugacugacaagucuagcuucugaccuuggcugagaggaacaaggucagauuucaucuagcuagcaauuccaggcagagucugacccaagccucugggcccucguauuguaccaugugcaucccuaguauggcucagacuaugaaccaaagagaaaggaaggccaaauaccauauacuagugacugcagacuagggggcugcagauccccaggucccugcaacagcccugagccuugccugaugaggacagguaguggacaggcuuagggcaccccaccuccucuauccaaccuccagacugacccagacacacauauuguaucagguuguuuugucucucucucucccucccucccuccuuuccuuccuucccucuguguuuuaugucaaggucucacuagguagcccaggcaggcuucccacugugguucucuuucucuuacacuaugacgucugaccaaccccucaggucugcccagccacgaacauauuccugggcuaggcugcacacacauuucaccuaacaagccuaggguaccuuuguaucugagcccaggugauaaggacaccucuucuuggauccaaagauugacagggaaggcugggcaaacaccagcauggaucaaugacaacagcuucaccugggaggccuggcuccaccuaccuguauccagcuccaaggauacagccagugccgcugcccaaucuugacccucuaccuaaggcaacaguggcagguccaucucccuaagagcaauuugagacuccuuaaccuuuauggggacccagcucuauguacuuccuugugacuccagcagucuccaacaagucggcagagcuucucccaccucacauaccaaaccaguaccaccaaccuuugcucaaccacagcaccagcaaugagccuggacuuaagagcgccaucccaacauaugcaauccacaggacccaccugaggugugcuucuacuggugagacuuacucagucacacuugggccuuaccucaaagacacaggccagcacaccccagccagaaccaagcuccgcggacugaauaaucccagguguauaccucuaucuccccaaguccuugcuuagagggcucuaucuaucuaucuaucuaucuacacguauagauuaggguuugaaaauaggcugucagccccacaguacuugucuauuuuauggaaccgugcuaugugucugauuuaagaggucacuccaacccacaugagcuuagccaugacuccuccagcuucuccacaaagacccagguacaagcuaccuuugcccaaauccugucaccaacucaacccuaucuauaaacguucaacuugaacuccuccucaagacuacaucugucagaacagcugugacuacuuacauaggcaaaugcugggccagccugcucaccugugcuccaugaugguaccuucugauguugcacuuagugggacaaacguccuuccucuuaguuugaccuuggcucuccuacccucaccucucaggccaguucugucugcccauguuugaucuuagcucaaucuucaucuggaaggccagguccacccaucugugcuggacccuuggguccucagaccacaucuggccagcuccaccuaccaguauuugagccugucucuccagagcauaccuggcagguaaccuuaccucagcauggcccuggcuucucaaaccaccuugacuuugaccacacuucuucaggcuccaccgccaccaagacuuagguguaacucuuaccuuugacugaauccaucaccuaccuguguucaacuccucaggccucaguggucuacaccuggcagaucaacugucagccacugacgcuggcccuccagagcacaucugauaagccagugccaccuaccggcacucaccucuaauccucacaguucaaaccuguaccggacagguuggguguggcaccacacaccuguaacugcagcaccugggaggacgcagaggcaggcggaugucugaguucgaagccagccuggucuacagagugaguucuaggggcgcaguucugccuacugauacacucugcaccuggcuccucugcacguccuuggugagccagggcuauugaccauggcucuucagaccauaccgagaaggccagaaaaacgggccucagaccacacaccagaugggcuggcccugcuuuaucuguaugugauccugggcuuucaguucuucacgucuaccugacccugagcgcgcacacuccguccauccgacaggccagcuccaccuagcugaccuaaugcaugcacuuucuuccccaggguugacuucaugucucaccagcacaggcaguuuugugaacucgggccuccauggauccucaccugcuaaucucacuccggacugacauagccaaaauaaauaaauaaauaaauaaaaaauccaaccucaugccaggcaaagguuccacaagccuuacccaagaaacugaccuccacguucccguaccuggccacacuucaacuuuaccaggugaaguuucacacacugggcgugaccauaccuggaacccagagacgcccacucacuccacaccucaagccccuagcucucucagacauuugcuccacucaccuucauucccucgcacagaccaacucuuugucucugaggccucaccugacagacugauucugucuucuuugcucggccagacugaucugagagaggccucucacaucgaccaaucucucuacuggcugcacagacgcgguuaccugacaaacucucacuguacuuagccaaguccggcagacuuaggguucgaggcugggucugaccucuucugugccuucccuaggaggccagcuguacuguacacaccuguaaggaccuggcuucauugcuuucuggacaggugccgcucuccaucccuugacucccaccagguuugagacccccccaagucaauuaccugugcgcuaccagaacuguucaggacucaccugaccacucgcuuuuggcccgauuucaaucauggcacuucagucccuaucugugagacuccgcuccaguucucccccccccccgccccccucgcauuuccugugaugcugggggcugaccaagccagggagcuccaucucccaccccugcaccuucugcgugcuauguucuacuuacaggagccuaaccuggcuccucugguuucagggaagacccagccacucacuuuugucugaucccggcuccugagaccucagccaugacacaucagggcagacucuaccacaugccugaacaaaugcuacuugccaaauuucaguuuccugcuuccggagugugacucaggccuuagcuaucaucauauucucucugaagaccauggucucccgaccuuuauguuucaugaaccucucgaacugcacccuaaugacauaguuccccaagugacccugccuguguucgaccuauccaccugccccaggccucgccuuuuaauaaccugucuacucuugcccuccucacaaccccacccuugaaacaccugaugacagagaacagccugugacaccuuggaagaucuggcaaggccguugaggccuggggucaccucaucugaacaaucagcucacuccuagccuguccucccucugcagaagcuaccagagaccauagcaugggcauauuugagaccacucagccucuuccuacguggccaggccaugcaucuccacacacccuucggaucucaacugcuagaacuauucauuuuguuguuguuuaaaaauaagaucuugcuacauagcucuggcuggcccagaacccacuagauagcccaggguagccuugaacuugugauccgaaggucucaagcaccugagauuacagagauacauaucuagcuaaugucauagcuggacucuccugaucccaccaguaccuauucucacucuuuuucagacccaauucuagcuccugugacuucugccaugacccccauccccacacacacacaccucagagacuccaucaucggaggaaauaaaacuugugaaugucagucucauucuggcccugagagacucuaagcucagaagcacaccugugcuggguccacaagccagacacaccaggccaugucaaguuagaccgcagcgcacacacagaccuuacuggacuggccuggaggacuggcccuucaggcugugcugcacuccucugccugccaucugucucacccgagagacuaacugcagaagcccaggccugcuccugagcuccaugcaucaucacccucauuccagcggcgcccacccacaccccuucucaggcuguuccguguagccugacccccgaggucuccacuaacagcccugccagcccugcccuccuuuucucugcaccuaaacaucacucuuugacccugccugcaagacacaaguuuccgucacaucgcaucaguuuucuguacacugggcaguuaccauggacgucccauucuguugggcuccuaggcuagcagcggguaccuguuccuccccuaccaccaugugcucagaugccaacgccuagggaggaaggggaaaggccccuccugcuuuaccaggcagggaacauuugucagaaaccgcaguuucccaacagggguuccucaucuaagccacaggaugugugccaaggacggccgcaacugguacaucugcaaggaaguuaacugagacacagcagauggcacagaacaguggggcagcauucucucccacagauuagauccacuguggcggugcaugccuguaaccuaagcacuugggaggccaaggccagaggaucacaaguucaagaccagccugagcuaccuugugagcuauccguuagcuugggcuacacagagacccuuugccucaaaacuccuuuaaaagggggcggggagcagcucagugguagagugcuucuuuagugugugcagauccuaggcacuuaaagaaaacuauuauuuaucaaucuaauuuaaagaaaggguuuuucuuuuuuuuuuagaacuuucaaagcaagguuacccauugguugaugaugccaacaggaaaagagccuccaguccaaaggcuggugggaaaaugccccaccuucucggguguaccccagaugugucagagagcaugccucugcccagccacagccacuacacucucaggacacucgccacacucacacaguagcccuacacucuaaauccucacagcccuuccucacaggucugcagggcucaggccaguggcaaggcggguuccugucucaacucccccaggaaugucgucuacagcgugaccugcaugcagaucuaccaucugaaguggggcuugcugugcaagcugccuagccuccaggucuacugccuccucccugccccacuccagcuguuccugcagccuaccaggcccaggaccugccuuacccugcccuuuggccuuuauagaucguagcugcagcccggagaaaggucaagacugagaauaacucaccucggcuaaucgagagggcagugguggcucugguuaccucacagagggcgcagcuggaaggcucccaagggaguauugcuucuccucguaaacuaggaacuugcccacagaccaagccucccuaagggccucucugccuuucccaaagggagacggacaugcaugcagcaagcacucaauaaaugcugaccugaccuguuggcucagcggccaagacucggcaaaggacacaccaagcacacagcacaaggugcccguacuuacaucccagaacucgaacauguuuugagggucaauuccaaacucuuucacuuuggccuggaauagacaaaggaagagagaugaggggcuaucuguuagagagacaggaagaggggcugcaaggugggaggaaugacaagcuccagggaccuuucaccuuccuuccaaccccagggagcaggcugagccaaggguaacacccaagccagcucacucagaacugcccaccaagccagcuccccuccgacacaccagggguccugagccuacagaaacuccuccugguguguaagaaccagagauguagaccaacccccauacccugaccucaacaucuggcacucaaacccagaggccauuccccgggccaggcaaccaagccuggaccacugccuagccucccuucugaagaugaggccaccugagagaucccuaaggagacagccuuguucucagggucuaggcugugggcaggcuaagcuagacaccccauaccuauccucacuggagauguccacugagaacaugagcucugcugacacaaggcagaaaaggcacagauuagcagccuaagacaucugacacgaccccacccuuuuggagguugaagugggaagaaggggaggcaaaggguggucgggaggaccgaggugcguucaucguucccagcuauguguugcacugcacugccacacggcuguguuccaguccacaggggcugugcuuccaagagcagcccucacucugacucgcugagcauccucgcugagugucacccaccucacacaggcucaaggcccggccaacugugagauggcugacaugaugggcucuaaucucauuauccugaccucgcacaguccuucuagaggaaaucugggaguguggagggaugacacagcaggaaagagcauucauucccugcccuugcacuagaccugaguugagcuccuugcacagacaccaggcagcucauaaccaacuguaacuccaguuccaggggaucccaugcccucuucuggccucugagggcauccguacucaugcacacccauaccuacccacccaaccccauaaaauuaaaauaaauaauuauaagaaaaaagucgcagggcagugauagcacaugccuuuaaucccagcacuugggaggcagaggcagguggcuuucugaguuugaggccagccuggucuacagagugaguuccaggauagccaggucuacacagagaaacccuaucucgaaaaacaacaacaacaacaacaaaaggaaagaaaaaaguugugacaggcuauguagcaaaugucuuaaucccagcacucaggaggcaaaugugaguggaucucuguaaguuugaggccauccaagauagccagagcuauacagucagucccugucaaaaaaaguucuuaucuagggcuagguagauggcucacaguaaaggcacuugcuguagaagccuagagaucagaguuugaucccaggaacccacauaauagaagcaggagagaaccauaagguuguccuccgaccuccaauggugugugugugcccacagauaucauggacacacaccugcaaaaucauaaacauuuaauucaaaagaaguuacaccgaagacuggaaagcuggcucagugguuaagagcacuuguuuguucuuagagaggacccagguucaauucccaguaggaugguuuacaaccaucccuaccuccagccccagaggaucuaaugcuuucuucugaucucugaagauauacaugugguauauagucacauaugcaaacauacacauagaauagaauaaauuaauuaaaaaaaaaagugaaugguggugguguaggccuuuauucccagcagucagaggcagaggcagguggauuucugugaguuuaaggccagcauagucuacagagaaguuccaggacagccagggcuauacagaaaaaaacaucuccaaaacaaaacaacaauaacaacaaaaaagcacauucauuugccagacuuaacagcucuagagaggaaaaagauuucugcacauccuaugugggcagggugccagaggccaggaaagggggggguggggguagggggugucaugcaucagccuggccugggagauggguggggacauuaucccacugacugccuguccuuccucaggauuagagacugaauggagacggcaggaaaggccaaucagcucucacagagccuucuaaaccagcaccccagccaugaugcuaccccgaagcagaccacugagcuugguggauucugagagacugagguuuucccauggcccaggcuuucccaugagggcaugcaggacuagcacuuaccguguucguagacagggcgacaaagugcuuugcaacugcagauggcuacaagagacggaagcagauuauaccaaauccaucccagaggagccacuaaggguggggaugccccaccacuggagaaaaccagauucuacacaggacuaacuauucucucucuuuggcccugaggcuguuagaggaacccacaaaaggucaaggucgagagggcaggaagaugguggcacaggacuauaauccuaacacucagcagacuggagcuggagcuuugccaugaauccaagaccugccuggacuacauagcaagacccugcccuggcacaaaccaggaaaaaaaaaaagguguauaagggccacagacaagccugcccauccccaccucaaaggcacacagggccaaggaguaaaaugaauccaaguguaaaugggugugguuucugggagcaaagaggcaagggaccaaaggccaagggacuuaaagaaaggauccuuagucauaacauggaaacuauuaaaaguggauaaagaaagaaaggcuccuuagacauuuagagcagguucugugaaugccaaagcucugaaagcucuccuccccuucauaccucagcaguuaaggcuuggggggggggggggggacacaggacauguaccacaccucccaccaagcucugucugugggagagcugagaacacacccuaccaccaccaccuccaggagaccccaaccacucacauccuuggccgcuucgagaaaccacuccuuugcugucucugcauuggugauggucuccuggguggugaaggucuguaagggaauguauggcggucagcccaguccagggugggcagcagaggguacacuggcugcuggcuagcauaucagcaacaccuacuacaggcacccacaagcacaugcacaugucacagcggcgcguccagcagcaaucuaccaucacacccaggcguggaaggaccccauugaaacucccaggcaucucccagagagggcuaagcuaugcugagcuugcuuuacuccagccuaggugggaccucacaaugcagauggaaauccuauuuuucaaguuuauuacauuuauucagagagagugugugugugugugugugugugugugugugugugugugugugugugcauaagagugccacagcacaugugguggaggugaggagacaacuuuuugggaauaauucucccccaccaggugggacccaggaucaaagcccaggucagcuggcuugcuggcaagccccuuuauaccugcugaaccaucuuaccgaccucagauggacuucucauuauuugcguguauuacaguacacaagguguacaggauaauaaauaaacccuuauguuaucaagccaaggcucugaaaucagagaggcauaauaaacaugucagguguggugguacacgccuacauacccagggcucagggggcugagggaggagauuacacccagcuaguaaagacccugccuaaaaacccugaggagggagagagaagaagguaacagauguaucuguugagaaagaaguuaucaggggcuggagagauggcucagugauuaagagcacugacuggucuugcagagguccugaguucaauucccaguaaccacaugguggcucacaaccaucuguaaugggaucugaugcccuuuuauggcguguagguguccauacagauggaacacucauacacauaaaauuaaaaaagagagaaaaagaaagauagaucacccaggacuuaggagccuuugcagaccuccgaguuccaagacagccaaggcuacacagagaaacacugucacaacuaggggcgguggggggaaggcaguuucagacacaugcuggugacauggaccugucuguaaguacuuaagcaacuaaggaaggaagaucaaaaguucaaaguggaccacaguuugaauucaaggcuauccgaauaacugaaagagagccugucucaauauaaagagcugaggauguaguucagugguagaggucuuaccuagcuuguaugagacccugaggggacacacacacacacacacacacacacacacacacacacacaggcaaagaucacauaaaguggguacugccuaugacaagaauccaaagugaacagguuccggcucuuauuagguaaaccucacuugcugccagacauggaaagcaucuaagggcagcugugcuaaccagauccacaaagccccauucacucagaauccuuccugacacuccauugcccagggcaauccacccauccuccccauccucagcgccauaccuuggaggcgauuauaaagagggaagucucaggggacaagcuggccaguguuuuggcaaugugggucccaucaauguuagagacaaaccagacacggggaccuccuuucgaguaaggcuugagagcuucagucaccaugaggggucccugcaggaagagaggacaagguucuagggagagacuguucccaaccuucagcccaucccagggugagcugggcgcuccuuaccaggucagagcccccgaugccgauguugaugauguccgugauggauuugccaguguacccuuuccagucaccacuccggacccgcugucacagaagcagaugugauuaacccaaacgcacagcucacaaaugucacuccucgugugucuugugucccuuuacccaaaugacaacugcuagacccugucaggagccucugguggucacagaaccagaucccugucacaaucugugacauguuauccugguagucugccacaugcugucuaaacagacucuaggaaaaacaggcuuucuugccccacccgcaaccccuuuugcucuggcucugcuugcucuagcccugcucacuccagcccauggguuuuuaaaaauuuguuucucauuacagaugguugugagccaccauaugguugcugggaauugaacucaugaccuccagaagagcagucagugcucuuaaccacugagccaucucaccagccaaguagggcuuucuugcuccagauuccccaauguuuauuucaaguggccccccaaacucccugucccaaggcaggcuggcuuccuaacuccaugacagaaagagaggcuuccucuuuaucucauggcauaaaagugcuugcccagggcuagagagauggcucagggguuaggagcaagggcugcuuuuccacaggagccaggcucaguuuccagcacccaugugacagcucaccacaccuggagcugauuccgggcgaucugaggacauuuucugagcuccguaggcgccagacacacacuuggugcacagaagugcacaaagcacucacgaacacugacagaaagcccagauguucugaccugucacucccucugugacuguaagguaacugcuucugcagggcuucuccugucgucauuucugcuggguuucaccagcacccacuuugauaacguuacuuuugcuugcucaaccaacugggcuacuccagcugcucugcgggauguuguaagcacucaaguggaugauguuuuguuaucugcggcuuuuaacuuuugcuugcuacauacuuaauaaacccacuuacucaaagaccaaaagcauguguauuguauucucuguaugaaaacauuccuggccagauggccuguuauauccucauugccaaagugggauucacaguggucucaccgugacacuuugccagagaccaacuuuuugccaggucuugaccagggacaagcagccagccucuagguagagagccaaguaaaugugggucaaauccugggccuugaaccuacuagacaaauacucaaccaccaagcuuuaucaccagcacauaugguuugagacagaaucuuacuauguauagaguccaggcugaccguguccuggcaauccccugcuucagccuccugauugcugggaucauaaccuauguuagcacgugcaguugcguccaugugacucuccccguucugguacacagcccuguagcagaguccuuacugugcuuaacacugcuuuccugugucccuacaaagcuguuguaaaggcgauccuguaugugaaugggaagcuuggucacaacaaccucugcuuugcucucugaucucuccccugaucgacguauuuuuuaauuuuugugcaugaccguucugccugcauguacgcacauguguguaccacaugugacaugugcccugugccuguggaggccacaagagggcaucagaucccccagaacugcaguuacagaugguugggagcugucaugugggugcugcgaacugaaucuggagucucugcaaaagcagccagugcuccuaaccacuggaagacgucucucuccaguccuccgacuucucucuuugaacaaguccagcuaccacgcugugaggacgcucagacccgugauuaagcccauguggaaaugagcugaggauuccuuccagcacggagcaccaacuugccauucacagagggaaucuuccagaacugaccccuucagagaaucacaucaugggccaacacucugacuacacugcuaagcaucacuaggaagcacagagcccccugaacaaaaacaagaacaaugcagguaaaacuccucccagcuucugacccagucacaccauguuugcuguauuuacuguugcuuuuagcugaguucugguguugaguccuccacaucgauagagaacuggugcaagccucaggacaggguccuagugaaaaugucaacaaggguccggagaggcagcucagcaguggagagcaccagaugcucuugcagacgacccugguucaacuuccagcagccauauggcagcucacgaucaucuguaacuccagcuccagggaaaucuaacacccucuacuaacuaaccucaggggguaccauaugcacacauacauauccugcacggacacacagaggcaaaauacagaacacaugaaauaaaaaauaaaauacuugaaaccuaaacaaauuguguuugugguagcuuaugucuauaaugcuagcaugcaggaggcuggcucgucaugauucuaagaccacugugucucuaaacaaacaaacaaacaaacaaacaaacaaacaaaaacaaaccgaacacuaacagaaagcuuuaagaguaagugaaacccuaauaaagacuagacaccccugaggaggccgcugguauggcuuuaaagaaaagguagaaacacacucgggacccuacuggguugccuuguccagccuugaugugaucauccuguaggcuguacugucuuugccugaugucccugggaggccugugcuguucuaaggggaggcaaaguaaggguggaucugggggaggagggguguccaaaauagacuagggggagggcagggaagggaagugcagguagacuguaauacacgaaaagaauuaaaaaaaaaaaaaggcaggaaauauugcuagaacuuauaaggaaaggaauuuuuauaggccagacuuaaagguguaugccuguaaucccagcacugggagguagaggcagacacaucucugaguuccaggccaaccugguauacagagugaguucuaacacagccaaggcuaaguuaagaaacccuggcucaaaauuaaucaaagagaaaaaaaaaaaaaaccuuucuuggguaggagauguagaucaguugauagagggccuaccuagcauguacuauguaugcacuguauaaacuggacaugguugcucacaccuguaauuccaggcaagggaacauaagucuauugucauaucaaguagggauuacaugagacccuguccauaaagaucuuuuaaauuuucagagaaacaugcagggcauggcgacacaugcuuuuaaucccaguacucaagaggcagagacagaucucugugaguucgaggccagcuuggucuacaaaguggguuccaggacagucagggcuacagagaaacccuaucucaaacaaaacaaaaacccaaaaaaaucaaaaccaggaacuugggagaggcaagguagauagacacaaauguuaagucaaaaacagggagguucccgaguggcaucacggucucagugggcucagaagcaaaaaugcaaaggaauuuaccuugggccagugacaugauggguggcugagggcuugcugccaagccugaccuccugagcucauuuccugggaaucagauggugcaugaggacugauucccacgaacuguacucugaccuccacaugcaccguggcacauguaugcgguguacaaauaaauacauauaagauuaccagguucucauaucuauauaaaccucauagagaagaaaccugugcauacagcgacugucuaacagacagccccacagugagcuucuuauggagucuuuuuuuuuuuuuuuuuuuuuuuuuuuuuuuuuuuuuuuugguuuuacgagauaggguuucucuguguagcccugguggcuguccuggaacucacuuuguagaccaggcuggccucagaaauccgccugccucugccucccaagugcugggauuaaaggcgugcacaaccacgccuggcucugcuuguggguuuucuagucuuauuuuaugugcauccauuucuuuuccauguauguauauguaccacacgcaugcuggugcccacagaggucagaagagagcauuggagccacuggaauuggaguuauagacaauugugaugcacugugugggugcugagacuugaaccuggaucuucugcaaaagcagccaacguuguuaacuaaggaggccuggugccaggcacaggaaaaaauauuuaguugcucagcuucucacucagucucgcacacacaaauuaugagagaaaaacacauuucuaauauaaguucacacagccuuucuuccuguauaugagguuuuaggacacacgccacuguuguuuuguauuuagaaacagugccaccacagucccccaggcuggccuccugagugcugggugacaggaugugcuaccacaccugaccaauaacuaacaguacaguagcaggacaauacagccacaguuacugacaauccugauaaaggaggggagguuuucuuuugguuguuauuucuccuuuacugugugauauuuugauacauggauuuaaauaacgaucaggucagaguaacugggauauccauuguuucaaacaguuaccauuucucuuuauaagagcuagccugucacaugccaggcucccuggcccugaccucugacucccccaccucagcuuccccacugcuaagaccagcagcagcaacacuugccugacuguacucuuuacuucugagaggaccagucucaggaaguagaauuccucacugggaucgccacugguuagcaguguuuugcuugccuuuucauuggguguuuugauuugagacagggucuccccacauagcccaggcuggcccaggacuggcaaaucuuccuacuucaggcucccugugcuaggauuacaggcacgauccaccacacccaagcugugcauuuugaacuaaaaauaccuggucagucuagagccagccaauccaagagccagcuuuaacggggugucauccugcaauagcaauggagggggacuagcaccgcacuguccacccaacaugucugagcuuacauagcaugaucagagcaccuggcucccacucugcuacauacagcagacagacagacagacagacagacagagaugccuuucacacucaaaacaucagggacauucugaaaccugaagucacaccaggacuuucuagcuucccucaucccaggaaguccuauauacaggugucgcaggccuuuaagauaaaugucacuuucagaucuagaaauggcuccuggccaaggcaagccgacuuugaccagccacaugcgggagcagccgcucucaggcgcaaguccagaaugcuuacagcugagcagaugaucacucucugagcaugcccaacccauacagacacacacacagcacacaugcacacacccacagcgcccacacaucaccgcugcacuccagaccugauaacgacugccagccaacccuugcaggauuacccuggggaauacacacugaggccacaaagguuuauguagguuaaguuagcuagucucuaggcaacccauacugccccccacccccaccuccauauacagagauagagaaggucggcuaggcaagguauaaugucuuuaaucucagaauuaggagggcagaggcaagcagaucucuaugagucugaggucaguauggucuacacaggccaguuccaggacagccaggguuacauaguuagacccugcuaggagagacggagagaagagaagggaaacaaggggguauguguauggugugguucugugcucuaauacggacccgggaugugcuuuacauuuuuauacugcacauaaacugugugcggggagggaaguaggcuguagcucgguuggcagcgcgcucucccagcaccuaaagccucgaguuugacaacccccacccaacgcccccagcaccaccuaacagguugugguggugcacacguacgaccccagaccuugggggaugaaaagagcaugcucguucugagaagagcugagggaaauucaggucucagcagagagagcagggucagcaaccacacaggucauccccaccugaggcugcaacacaaaguccugccucuagggagagcaacagggccagauuccuaaacacacauacacauggacaaaaggcacgucaaggcuagcgucugcuuaccuggcagaaagacuucaucuuguccagaacccuguucaccuccggcaucacaucuuugccguccaccuugauggguguguuggaccgguuccgaagggccacaugcagcaccgcccgauucuagaaaugaaagagacaaugaggagcacgguagacccuagagcuagacugguccuaguuggggaagguccaguguaaggcaguccucugcacaggacaaacagguccaggcauccauuaacaucaccgucuuguauagagggccugggagggaaagccauucugggacucugaggauaggcaauccugugcgcccccuucccccuuguaugcugugaacacucagaagcagauacagaaggaccugaacaaaccccuaagggccugaaggacccagggcaugaaaggccugacugaagaugagcaaugaauguauaguggugacgauacagaucagagaugagcagcaagcuccuucagucauaaacucagcccuccugaggagagcgcuucuuguuucuggcaccuucuaaaaaugucacaaggccucaggaugugaagcaagacagggaacagaaggcuccccucaccaaacagucucaccacugccacaaacuaaaccagaacagaggucuucaacaggugccaagcagcucaccuggccacaagggcaagagagcccaggcagcuaaagacaauagcaaugggaaggaagcaggugcaaaggucccaaauggucaggaaagcgacuucaaucuagacagagguuccugugugugggagggucugaggguagcccaucuagucucacccuucccauguuccucaaacaaaugcacauccccccacucaaaggaagccccccucgacuguggccucccucauaucacacaagcccagccgugcaagaucagcugcuucccauugcaccucugaccuccaagccuuagauuccucacauguaaaaagacucagggcugaagagauggcucagcaguuaagagcacauacuugccaggugguggcacacgccuuuagucccagcacucgggaggcagaggcaagaggcucucuuaugaguucgaggccagccuggucagggcuacacagagaaacccugucucaaaagccaaccaaccaaccaaaauacucuucuaaaaagccgggguuggauucccaguacacacacuggguggcucccaaccaucucuaacugaaguuccgggagaaucugacagcucuguaggcaccuguacuuauguacacacacccacacacucauaauuaaaaggaaaaaaauaucaacacugagaauucucagugcagagugucuccuaugccugcaggcuuccccaccaagucagggccaggguuucccaaccgcugucauacucucaccucuuauucauuccacugucaaagaaacuaagggcuuuggugacaugauuuuucuugucacuagaacaaccuguagcaaggauccaucagaguaucaagguugaaguuguccaagaaaaugucucagccaugucucagccagccuuaagcaaaucccucccuucaggcuuggguugugccccucccuggacaccaggaacugugccaauuugauugccaaguccaggcugccagucucagagaaaucacaccccaaagcucugcaaccucucuugcccccaaagaaaagccuuuagcaccuucgugaggcaaaagcauugcuuaagagcaagggugaagacacagggcgaugcugauaacggucggcaaagaggaggaagagggggggggggcggcggguguaacugcuuaccucgguguaguugaucuuggaaccacugaacauguugucccgugcagccuccacgccucuggacuuggccuagggagagaagccacugcugaggucuuguaucccaucccccauccucaucaccuaucacaaguccagccccccuccccccccacucccccccccccuugaggcugacagauguucuucauagacagauuccuuuuccagcaucuucaaagagucugcucaaucagcagggggccuggagaucccugggauaccaacuccacaccgggaccuagaacccaaaacaaagcgcagcccccacccacaacccaacccagagaucacaacuccccagucagaacauuaccagcuccaccagcaucugcaucaccuccuuguucacaagguucuuggaguaguccaccagaauaugcccaugguugguguugagguucaagcugcagaaagauggagacgcugcuggucacaccccagcggcagugccuggccacaaaggcugaccuguagcaguguuaaguaguguaggaagccacgccacagaaagaagauguagacagauccugggcagaacuucccccuucaagcuccacaucucaaacuuacaaggaaacacccagggagagguaucagggacguccagugaggaaccacagguggucaucccaggucccucgccuccuggcaucagugacaaggcacgaagaugcaucacauguacgauuucuuccacccucccuucuauuucgcagucgcucacaagucucucuggccucugcauccugccuccgccgcucuauuuuuacaccguggcucccaggaaaucucagccuuacccacccugucugaccaaagcccacuaggagcaggugggaggggacagcucucucgugccugucgagccagcagcggcugcuccuccucaugggugguuagaaaucccuacucaaauggcugagacugagaggcgggggcgaagggauccccaaggaggagccgauuccuccuaaugacuaagcagccucggcccucuggcuagcacgcgggucccaaaacccacuccaaggaggcaucaaggacaaagugcggccccggccugggcccugcagggcugcugggggggggggggucacgggagccccgaccccgugcgugcaccugaaguuguugaagcgcuccggauccgccucaaaaaguucgcgcagcuugagguuggcagaguucgcgcggugccacuccaggagcuucuggaacugcggguuccgggugagcgcagccauggcgagggacccgagagguacacggagcaggacgugcucggaagaggaaggaaagaggagcggcggcgcgcggcaagucgguaccagugcgcgcagcgggcuuuauggcgcaggcguccgaccc

SEQ ID NO: 3716 - RNA, 77168 nt, Mus musculus
acgucacuuccgguguacacagccgguccgggcggugcgccggagccggggcgcuucgcaggugagguacggucgccagcgggcucgggucggcggggacuggcuagggguagcgggcggcgggucgcaagggcgacuggcaucgaggcgagcucgcggggugccgcuucccucggcgccgucccucgcccgccugcuguggaggacgccgggcucggcgggcgcuggccgggcggacggaagcccggaggggccucucggcgcgcgcccgggacgagacccugaggggcgcguuggcgcugaaggacgcggcugccuugggccgccgcgggggauccgcucccggaagcucggggcgccgugcgcccggggcuggcggccugugggcgaccuggguccacgggcacaggcgggcgccgcugcccucaggccgccccgcggcuccccggccggccgcgcgccccuuccuggcucccucugagcccgugggcgcggcgggggucagaggagggccgaggcugggcuaggacugaggaaggacccacacccgucgggcgagcgccggggucaggggugugucuuccugcuccucguggagcaggggaaaaagagcaugccuguuuggcaugauaagaauuuuguuuauacuuuaaccaaaauugccugggaaacgaucagccuggggagcccccaguuugaaaauagauuguccuugcccuuccccacccguugccauuaugaaagcgauucauucuucuguccuuguaaaaaacacucgccacuguauacaaagugucaggagggaaaaugaccacggcgacucggugacaaccgcuccuaacauuuuggugacaucaguaagugcagauauauauacugucacucuuagagguuuuguaguagaacaucgaguaccauaauuuauccaaacucuaaugaauauuugauugucccugucacaagaaaaaacacuuguggcaaaaaggauuuauuugauuauugucuucggcuaaauuuacaaaugggggucaaagguaacauuccguuuuucuccuuguggauaugcuuggaaaccucaaacgcacuguuguagaaaauuacaucuguguuugcuucucauaauugcuuuaacauuuuuaaccuuuuuuaaaaaauuuguuuauuuacucauacuuauuuugaacagacccccacgguguagaccagauuggccuuaagcucacagagaucucucugcuucaguuucucaagugcuagaauuaaagacacaggccaagaggccuugccuuuguauuuguuuuuauuuuuaagacauauuucccaaguggcaguauagucauccagguaaccauuguugucuuauuaucuuauuuuaggcuuaaaguucuaagaauguauuuguaaaagacuacuugcgagcuugauucggugugcguuuggagguuuuuaugugccuugaaaauaguaaguuuuuccuuguaaucuuuaaaaagaucauuucuuuuacaaguucagagaauacuuucuuuauauuugauauuuaugugugugauacauauacauauaagauauacauauuaaacaagguuuuauugcuguuuuauuugcuuucuugcugacaagaucacagacuccauaugaagagugcaaguuuguuguggcaacuuuucagucuggcauuugagauucuaaucuuccucuauuuuugcacacgaauacguagguuagcauuggagaccaagauagaaaaguucucagauucccuuggcaagccuagauuuuuuucaaucuaaaauuaucucuggauuuuuggaagaccgcaugcuuuaagcauccuuuaaaaaaaaaaacaaauacaaaauacuuugcuaaauaauuuuucuguugagaacuugaagccuacuauagcaggagcugugcgucuccuaggucuucugcauuccagggaagucacuagcaggcuccaacaucccauggguuuuguguguccacucugucccuuuccugugagacuuucuccucaguggaaaaaaaugaccuuccuagauggacaaagaauguugguuagaauaaggaauugcuuuguuuggaguaagaagaacccauugcuggguucucucaguauuaauucagaaagaaccugaaguguagaguugugcucuaaacguuuucucuacagauauuguucagugaggcccccgaguugguugaucuaguggucacugcuugcuuuuuucuguuuucuuuucacuuuguguaguuguuuuuccucuuugucauucuuuaugauacaacucaagacuuugagauucuauuuauuuuuguuuuuuuguuuuuuaauaguuauuaauuuauuuuauguauuugaauacacuguagcugucuucaaacacaccagaagagggcaucagauucuauuacagaugguuguaagcuaccaugugguugcugggaauugaacucaggaccuuuggaagagcagucaaugcucuuaaccucugaaccaucucuccagcccuuauuuuuauuuuuguuuuuguuuuauauguaugagaguguuuugucugaagacugcacccugagcauacaaagccacugaaaccagaagagggcuuccgacccucugggucugaaguuacagauguuuguaaacuaucaugugggugaugagaagaaacccagguccuuugcaagagcagcuaguacucuugaccucugagccaucuuuaggccugaacuuacaaguuugaguaugcuagguguguacuguaccacugagcuaccuccccagaugcugugacuuuguaaauauuuggugagggcagccauucuuguuauaaaccagccuugcucuugguuuccuacuuuagagcaguagugucuauuuucuuaccuggucuuuuuugcccuauuuuaccuugucugucuagugcuauuuuguaaggccuugccucaugcuuucuccccaacccuugauucauguuuuucccuucacauccagaguagacuuggagguagucuccacuuuaucuccuugccccuuggguccuuagagugacauuuccauccuaacuucagcuuugcuuuuucuguuguuuguuuguuuguuuuugagagucuuuuauguacacaagcuggccuccaacuugagauucucaggcaucaacgucccaguuguugggucuauaggcauaugacaacauaucucugcuuucucuaugucaauucuuuauuuccuucuaaaugaccccuagaugcagauccuucaucacuguggccugucugauaaaucuaaaguuuuuuuuuuuuuuuaagaauuauuuaguuuauguauaugaguauaccauugcucucuucagacacaccagaagagggcaucagaucccguuacagaugguuuugagcaugugguugcugggaauugaacucaugaucucuggaagagcagucaguguucuuaaccacugagccaucucuccagcccgaaucuaaaguuuuuacuagcugccaucccacaaucucauuuuccuuguugacuuaagauuauucuugucauuuguauucuucccuacauuuuuguuguuuuauuuugagacaggguuucucuguguagcccuggcuguccuggagcucacucuguagaccaggcuggccuuagacuuagagagauccaccugccucugccuccugagugcuggaauuagaggucauacuuggccuccccuauaccuugauuagauuuugcaucuuuuuucucagggacuguucuaguccuacucuaguuaggaagaaaguaacccagugaauuuagcuggcucacagacaucuacgccauuguuagcuaagagacacagcuuggagaagacugucuaugaagugucuaaaguaccuagagagagacaccaaaaaaaguugugcaagguuucagaaauuuugccuguuuuguucauuguguuuaucaucggggucuagaacauacuguucuggaaacaguugagaauuuguugaauaaaugaccaucagagaauaaaauaaaaaaauaaauacaaauuugcuaucuauagaggagaugcagacauaagccaagagacguuuuguaaauagaguuugacaaauuucagggaaaacuuuaaauucaagccaaacugacccagcuauaaccccaaggaaggcauguuuggaauguguuuguggucagaaagcuuaaaccuaauuuuguauacuccaagaaagacuuguguuuccgggagagguuugggaugauaucuguagaaguuggaguggcuggugcaagagagcuaacuuaggcggugugaggguuucucuguaugaguccagaccaggagugguggugcacaguccuugcaggaucaaagggaggggccaccuuccuuauacccuucauaguuucaucuggaaguuucugccaaagaggugguccaagcucuauucaaagugcuguaguagauucuggucuuaggauguugucuaaucuaacuguagcaugggcacagcauuguacuuuucuuuuaguguugccaugagaacuuuaagcuugguaaaguuacagcuagggcuagcccuuuugguauagauguaguuauuggccuucugguuaauacaucagucgucuuugagccuaacuugucccccugaaacugcuccugggcucagugacaaagcugcuaaccagacugugggaagugaugacagacaggcucuucccaaacugcucaggcaggaaagccaaccugaaugugucaagagaaacuuucugaagaacguugagcuuagcugauagcguggggagagucagugacuccagcucauuguaagaacagaggauacuuagacaggauggugacaugaguaaagcuguagagaugagcaagccuggggaauauaauuaauggugguaucugcguuacugcggccucacuaugcuaaucagguuuacugcaaagugcugccugcaugcuccuuuauccuuacagccuugugauacguucagaacugacauguucgcuuucugucgcugccaguuaaccuacauacugcuuuacauucuaaagauguuguguacaugcuuuaauuuuccuaaaccauuuuuuagugcaaacaguacauuuuuaaccagucuaacauuuuuaauauuacuuuugagacaagaucuugcugacuagcccaagcuagaaucaaauucaaccaagcuagacucaaauucaagauccucuugccuuaucauacugguguaugccagcaugcucugucuggcuucacucugccuuggguaccauuuugaauggcaugcuuuuuuuuuuuuuuccuguucauuauuuucauuuuaaaaauuaauaaacuuuaaaagaaauaucugugguauccagucauauauagagggaucagagagcaaggaccagucaaacuuuaguccugcuuacuggccucuugagucacuaaaauuggguuacccaguaugaaaauaggagaggaaauaaugucgaggguuauagugugguuuuuauucuuuucuuugagaugcugucucuuuagcccaaacuuuacuguauagccuaggcugaucucaaauuaaguucuccugccucaauuucuggguucguguauuauaagcacaggccaccacaccaagcuuacaauguaguuuuacuguguuaauauaaagcccuuagaacagguccuggugggaaugugauuuuuguuacuuuccauucugugcaguacagaacagugagccuguagcuuacauccaucauggcauuugcuggucauuuggugagacaggcacaagaggcagugacaucaaaggcagccaaagcucaggaaaagcuucaugggacuuaagguguuggcuuuauugagauaaugaaaguuuacuuuuaggcaagguuuuacuauguaacccaagcugaccagguacucauuguauagaccaggauggccuugaacucaguaauucugugucuuagcaucccagaugaugggaugacagcauauaccagcacuaccauucauagcugagcuaauggaucuugaauauagcuaacuuuuuagaaaaaauaaaaugaaggugagggucuuuuuuugagacaagaucuggcuauguagcuuggcuagccaaaaauucaauuuucccccucugccucuuuagugcugggguuacgagcauaugugcccaaccgcccucugcucaccacaggucuuguucuaagggugauguggugugucucccagacaaccagucacaaggauuggcaacaggaaagaucuuagaggggucugaaauuggguuacuuuagugaugaugugucauugauguguggcagcuuuccuugggaucuaugugcugaugguaccauuuauaaaauuacaccuguuacccuuuuuggucuuugaacucauaucuaguuuagguaaugaaccuguuaaugccaacauaugugggucacuuccaagaugauucuguuuuguuuuguuuuguuuuuuuugagacaggguuucucuguagcccuggcuguccuggaacuuacucuguagaccaggcuggccucgaacucagagauccaccugccucugccuccugagugcugguauuaaaggcaugugccaccaugcccggcuccaagaugauucuuguaguucauggugccauugguuuucuuuucuuuuuggaacaggguuucacuauguggcccugacugguaucauuuguuuucuuaaaaaagccugugcauuuacuauaaguuuuaagauucauccccuuaaaaaauggcauuccuuuaaaaauuuuuuuuaaaauauuuauuuauuguuguacauaaguacacuguagcugucuucagacacaccagaagagggcgucagaucucauuacacgagugguugugagcaccaugugguugcugggauuugaacucagaaccuucagaagagcagucaguacucuuacccucugagccaucucaccagcccaccuuuaaaaauuuuuuaaauuacauuugaaaauuuauuuguguguaugugugggcaugaguacugugguauacguguggaugucagaggacagucuguaggaauuggauuuuggcuucuacauuugugggucuugggaucgaaaucagaucaucaggcuugggaacaagcagcuuggcccacugacucacuguggagcucuggcaggucugaaccuugcuguuuagaccaggcugaccuggaacuuacagagcucugccagcaaugggaagauuugaauguagacuuagagcuagauacuagcaggaaaacagucacauuuucauacucagaaugacuuggggguuagauacuaaugagauucaguuaugguuaaagaagucuucccuaccccaucacccugcucccagaggcaggaaaaaaaccuagcuccuggcucccagccuugggagcccuaggcuucggugaucuaggaaaggagaggugaaguugggcccucucagcagcuuccaaggacuugugcugccccugccccugagucuucagggaggggaggaugcugugcuuaaguaacuuuguucugugcuuugugaaagguaauagggccccuuccucagcuguguccacuacuuccuuuuagcuugaggcugaaguaggagggcagugauggacugagaaaagggaaagagccaugaccuccuuuucuucuggacacaccagguggcacauuuaguucguugacuggauuuuugggaauuggagccacaacugcaggaagguagguucuauuucuaugacuuaacuguaaugugggauuggaguggauugaucuaguggaccagaaugaggaguugccaaagauaccuaagcuaguccaaggcuucuugaagaguggcuguuuccauuuccugagucuggagaugugccaagucccaugcucuguagaguuuagccacuccauucuacuaaggaaacugacgcacaaguuuucagcugacuuguuuaaggucacagagucacuaagugccuuucacuuugcugauaauuaccgagagcagaaauucacgucuagaugaauaggacugcccaagcaaaaugcaauagccacugcauuuggcaggaccugccuuccaugaagguuuuuuuguauuggaacaucuuucaccuagcagcagguaagggccuuucuagcccauuaaacuaggcaguacuucuguaucccugaugucuggagaagggcuguacauacauuuggacuucaguaauugaguaugugaaggcucaugguuugggagaguagcagaguaggaagcuagcauaagccuuuccugccuagggagcccaugugaggagaugucauagaauuucuacauuucgggccuugggguguagcucagugcaggaauguuugcuuagcaugggcagagcccuggguucgauacccaucauacacagacagguagauuagcaggcaggcucucucucucucucucucucucucucucucucuuucucucucucucucuccccccccuucucccucucccucucuccugaguuucugauuguuugaccugcugaaauguuuauggggaaaaacagguuccuaacuuuguuucugacuugcuggucuucuuaacagaugauagggcuugcaggggauauaaacuuagaguuagugugcccaacuaggagaagagagauaccauaauuauccauuacugaaauuguuccugggugccuuaaauguucuguuuguuuguuugugaaacuagagccucacuggguagccuagguugcucuuaaauuuucucuuucuguuucuuucugccucccccuauccccuuuaagacagggucucuauguagccugucuguccuagaacacaauauguagaccaaacuggccucaaacucacagagugcucagauuaaauugugccaagccuaacuugaucuuccuuugcaagugcuggucuuagagacuuaugauaccaggucuggucacaaauuauauuaaaauuuugaaagugucuaaauguauauaauacuucauaguaagaaaaguaauuuuuaaguuuuuuuugacauauacuacuaaguagcaguguagggauuuuaaguuuucuugaauaauuuucuuuuuaaaagauuuuuauuuuagguauauuagcguuuugccuguauguauguauauauguauguauguauguaugcauguauguauguauacugugugcaugccugguaccuguggaggucagagaagguguugggagcugagugguggugcacaccuuuaaucccagcacucaggaggcagaggcaguggaucucugaguucaagggcagccuggucuacagaguuuaguucuaggacagccaaggcugcacagaguagccauguuuaaaaaaccaaaucaaaccaaaacaaaacaaagaagagagggugcuggaucuccuggaacuagaguuauagaugguugugagcuaucuuguggguacugggauggaacccaaacccuuuggaagagcagccaguguucuuagucacugagccaucucucuagccucuuaaauaguucucuaaaggauacaauaauaaguuuguaccaguucaacuuguuuugcaaauuuucaaacuauuuuuuccuuuucagacagugucuuccugugcucagguugaccuagaacucugugcucuagccuaaguuuucugagugcuggguuacauguguauauccccaugccagacuugaaagauguuuugaugugauaguugugaaauacauauuugauuuucuuccauauuggcaugcaaccucugaaauuuggggaaccucugaacuaauauauuuuuauauacuaaugagaucacugagcuggcagccccuggagagcuucaggcugggugcuggucuccugaaaaaacuuaagugacuuaggacuuagaguuucacccaggccuguaggauagagagggacugagugaaccggucauuaguggcugggguuucauguucugccugaguaaugaggccuccauauaugccaagggcuagggcucagagcuuuaagagguuucuagagggcgucacaccuggaaagggcuugaaugcuuugugccccuuccuaagugcucugcucugugcucucugcucuucaucugugauguuggcgauacccuuuacaacaagcuaguaaaugugaguaagucaguucuguaaguucugugugguacaauaggaaauuaacugagcucagaagucuccuaaaggcccuacuguaacagcacaagccuggaccuuagcacuuaggggauagggugaaggaaggaggaucaugaccagucacucucaaccacucauccauuucuucagcuggauuaacccucaauuuaaacagaauuaagccugucccuaaaaaugaccguuuaacacauuugacauauuuguuuucccucuaaagcccuguuauuuuagaguaaaucucaacuguguugacuuugugguuagaacaguuuuucuucuucuuaaauaaaaugauuaguuguuuguagaucacuagauauaaaaugccuuaggaccacuaaugauaacuugcuuugguuuuguggaggaaugccauauuuugugguaaagucuuauaggguaaaugccagcucagaggcaguccacacccuguguccccuucuacuauaggcugauagcugcuuuuguucaugucugggugacuaugcugauuuucuaggcgggugaagcuuuaucaucuaccuacuugaugguggugggauggaaccugagaccucacaugugcugggcaggugcucuaccaucaagcuauggccucagcuucugccacuguuaauaaugcugcugcuacuuuuaaaauauuuaguuauauuuaugaguguaugugugccaccugugugugggugcucuaagguauggaauccccuagaauuacgggaggcugugaagcugccucacauggaugcugggaacagaacucugguccuuuagaagagcaucaagugcuuuuaguugcugagccauuuuuccggcccuucugucaugucuuggcuagaaaaacaguaaguuagucgugaccucccuagacuuuccauggacugcaugugugcugauaagauucacauuuuagcagucuguguguuaauuuuugaauuaacaugcuuuagcauucauuuccauguaauaguugggucuggcguuguucaguuuuucuguuaagacagcuucuugugaacagaaaaugcuaugggcuugguagacacagaagagucauuuccuuuccucuggccuuggcucucccugccugccuuuccguuuaaugauacuccucuuugcucagugauuuguguucaggaagcugggcugagauuacuuuuguuucugcuuugugaacuucuucccccacuuccuauuuuuuacuggccuugugcaggaaaugagcuccugacuggcuccuguugagcacugauuugagguggcagaugaugaggccuuagguucugaggcaugccgcacuuuccaccuuugugccuucuuccucugggagacacaggaacauuuugugauaggguugagaugaugucaugaccuccucagaccuggggguuggggaagacugcuacucaaaacucugaggugaggcuuuauucagccugaacagcauggcuggguauccugguaugcaaacaagggucaguugaagggaugggaauggguuagggaagguggcuuagugaguaaaguacucagcacaagcaugaaguccggaguuaggaucacuggcaccugugugaaaagcaucugugggcagggagcauauagacccuguacucaccugcucaucagucuagcuagcuuagugaguauagggcucagugaacaacugccucaaaagacagaguggagagcaguucaagaagacacccaucguugaccucuggccuacacaaguacacacgagcacaaaucugggaaugugauuauggguuaccuugcaggcagguaggaagaacccuggucgguccagagcuuuggucucugcgauucuccuucuugaauugauuucuaaaccacuaagguagcauuuauucaucauuuuaauaauaccucucagugucuugggaacuugugccuuaauucauaggagaagauuguaacauuuccagaaaaaaguaagauuuuuuuuuguuuauuugcuuauuuauuaguuuauucauuugagacaguuucuuuguauagcucugauguccuagaacuccauuggccaggcuggccuucagccgagcucagagauucaccugccucugccuucugaaugcugagaauuauuuauuuauuuauuggucuuuucgagacaggguuucucuguguagcccuggcuguccuggaacucauuuuguagaccaggcuggccucgaacucagaaauccgccugccucugccucccaagugcugggauuaaaugugugugcuaccacugcccagcugaaugcugagauuuaaaggugugcaucaccacugcuuggccagaaaaaguaacuuuauuugucuuauuuugagacaagacugugcuuuauagcucagacuacucuugaauucucaugaucuccuugccuuagcuuucuaaguauugagaaaacagauauuauguauuaccacaugcagccaagaaauaauuucauaauauauuagguaacuugaaaguacuuaaagcauuugugaucaggguuucucagugcuagcacuguuggcauauugggguggaagaucccugcucugagaguuacuguguauuuuagaggauauuuagcagagucucucuggcuucuauccgcuauaugcuacuagcauuuccucaguugugacaacccagaugaguaagggggccaggaaagaaaaucacuuucccuaaugccuuaagguaggucagcuauggugagaacuauguuaaaggauugaauacugaguuacuaaucuuauaagauggaguaaaguacuaugcuuaguucuguggccuuauacucuuuuguuuauuuuuugagacugaaccucacagcauagcuuuggguggccuuuaacucuauauguagaccaggcuggcuucaaacacaaagagaucauccugccucugccucugggcuaguggcauuaaagacaugccacuaugaaagcacacagccuuuucugugugcuuucaugggugcaauggagccugagcacuaacauccuguuucugaugcucacagaaggcuuucucgugguggaugugccuuggauugcgauacaacucaugagguccucccuccucucugaccuucccuccucucuuucuuccuuccaguuuccucuuugaucuugcuguacagcccagguugcccuagaauucaucauucuucuacuacuaucucccaagugauacuugcauaucuucauguguguacaugaaugggugaauaugaauggggguguguaggugcucaugugcauguguauauguguguggggaccagaaguuaaccuugaauauuucucuucaagagucauuuaccccggggucuguuuugguuuuugcgucagagucucucucugggucuugguucucauggccagugagccccaggaacuugauugucucuccuuccccagcacugggauugcaagcauguauuuucucuauacccagccuuuucacaugauauugggaaaucaaaccuggucuuugcuuucauggcaagcacuuuaccuacugagguauggccucagcccuuaauucuugaauguuuugaaugaagucagugaucuugugccuuggagauagcagggacauacaggggagaugguaaacuguguuuuaggacaguaaugcuaauguagaaacaaagucugacagaacacaaugugaaccuuaacucagucuuuaucaaaacuacugagacaucccaaggagcccaaagagccuuccagaugcuaggagggaacaaguagacuguuugugacagggaagaugggucguaagagaaguaggugguauuaggaugaggaaggaggcauggaugccugggaagagcagugguguacaaucuucccaaggaggauaugguuggugaugucagaaacagcaagggugccccacaggcucugaggugcagauggcuggaaguaggaggaaaguuaggaggacaugucuaccagagagcuucacuuuuagauguggucacagauaagaggagccaaaagaaagcugguauuaaggagggauagacuaaggacuggaucuuuuaagguuucuccucuugccuagauggauauuuuaaauuuaugauuguugagaguaaaaguuuucaaagcauuuuucuggagcucauuucuaaauaugguuugugucagucugaacuaaaaacauggaagugguugggcuuugaacuuccauagacaaugacuuaacuaaucugccuaaggaauuuccugcagugucucuguauuagccaggggaaauguuuggguuuugcuccugggguuggggugggaggacaauagagaacauugcagugugcuuacaaguuauuuucccucuuuuagaagaaggaauugucugugucagcaguucuuaaccuguggauggcgaccccuuugggguugcguaucagauguucugcauaucagauauguacauuacuauucacaacaauagcaaaauaacaguuaugaaguagcaacaaaauaguuuuauuguugggguuaccacacaugaggaauuguauuaaagacuauuaaagaggaacugcauuaggaagguuaagaaccacugcucuauugccucaauauuucaguuuuauaacuuuauugaaauacagaucacaugcuauguaguucacuaaucauuuauaauucagugguuucaaggcuauuuacaggucaugaagccauuaacuauacuaauuuuagaguaguuuugaaaccagguauggcagaacauaccuguauucccaguaccugggaggcugagagaggaagaucaucaauccauagccagucuagacuacacaagacaccauuucugaaaagauuuuaucuuuucauccuucccuugagcauuacauacuuacccacuguacuggcugguuuugggugucaacuugacacaggcuggaguuaucacagagaaaggagcuucaguugggaagauaccuccaugagauccaacuguaaggcguuuucucaauuagugaucaagggggaaaggcccuugugggugggaccaucucugggcugguagucuugguucuauaagagagcaggcugagcaagccaggggaagcaagccaguaaggaacaucccuccauggccucugcaucugcuccuguuuccugaccugccugaguuccaguccugacuucuuucagugaugaacagcaauguggaaauguaagcugaauaaacccuuuccuccccaacuuguuucuuggucaugauguuuguacaggaauagaaacccugacuaagacacccaccaauuguucaguaaauugccuauggugggcaguuugugaucacaaacuuugugcgaguguucaugcaugcgugcauaugugugugugugugugugugucuaauguuggguaucuuucucaacuacuuauccauauuuuuaagacagaaucuuucacuugaaccuggagccuacugauucagccagaguauuuggccagaaaaucccaaggauccuccugucucuuccuccccagcucugcuauuacugucauucuuuguuguaucuguuuuguuuuuguuuuauuuuauuuuuuuuguuuguuuguuuguuuuucuuugagucagggucuauguacauagcccuggcuauccuggaacucacuauguagaccuaacugguuuugaacucuaagggaucuguacaccuccgucuccugaguacugggauuaaaaagcaucugucuuuuuaaaaagauuuuuuuuguugaugauguuuugccugcauguauuaugugcauaccugugcccaaagaggucaggagagggugucacauaucaggucuggaguugccaacguuugugagccacugugugggugcuaggaaucaaacuugggucguuugcaagugcagugagcauuaacuacuaagccaucucuucuguucccuuuccauuuuuuuuuuuuaggcuaaauaauuuucuacuguuugauuaugccauuugucaaguugauaagaugguucacauugcaguuuuugguuguuagaacuaauacuuggaacauguauaugcuguucuugguguaaucaugcuuuucauuuuucuugguauguucauaggaguaaaguggcuuggccauguggcaguucuauauuuaacaauuuagggaaguguccgcugguuuucuaaaguaucugcaccauuuuccuuaccugugagcaauauaugaagauugcagucucuuuauguccuucacaacauuugcuauucauuauugccaggcuagugguuaugaaguggugucuugugguuuugauuuguguuuuccucauagugaaugauucuaagcauccuuuaauauaugcuuuaugcacaauucuggagaguucauuuauguuugagcaucacuuugggaacuguaaagaaacgggaauauauauauaucugacuacagaaacaagggaggaaaguauacgugugcauacauguuuguuuauaaaaagauuccauaaacagauuuguaugguagagaacaggccucucagagaaacaccagaguuuucuagccauauuaagccagagcuugucuguggggguuccuaaugauccugaaaucuugacuuuggaaauggaaaccauaguaucugccuucuccacauuaguggcggcggcggcugcugcugcugcugcugcugcugcugcugcugcugcugcugcugcuacugcugcugcugacagauccuagggccuuggacaaccaggcaaguguuuccacugaguugcauccccagagugcaucacccaucuuaaagucacauguacacauccuauggcaagucuucagaucuggcacguuucagguagagguaacuugacauaagaaucgguuucuugcauuuacaaaacuaacacaguccaaauaaucaguaacuaacugaugucagguuuccagauagucugccagcaaacuuguugacuguguggaccuggcggucacaaagcaugcuguccuucugugccagcugcugagguguaugaagcaagugagauggccagauaauuggaaggugucaguaagaaaagaucucacuguggucaaggugacccuuguuucuacaguugacaggagaaggagugacacucauuucaggaauuacuaggguaggggaaggggaugagaauaggaggcuaggagggguaacagcuuccuagaagaggcuccaacuguacaaagcacuaggugcucugaaagaacuaggcacauggcuagagagugcugaaugaagguacagguuaaugaggcuggagaguggccaucagugaaugggucauguguggaguuugauuuuacuguaugguauaugucaauucuaagaaaauuacauacagaaaagagauuuuuuuaaaaaguugauagaaaagaauaaaaaaaugaaacuaaggacagagaugguauaauuguucugagacuauuagaauaacuuagccaagcuauaaguuuagugguuguuaaugaaaaauaagguugagccaggcaguguuggcucucaccuuuaaccuuggcaccugggaggcagagacagguagaucucuugaguucaaggccagccuggucuauggcgugaguucuagaacagccagggcuacauagagaaacccuaucucggaaaaaaaaagaaaggaagaaaggaaggaaagaaaguuaguugaaaaggccacagaaaagauguaguuugcaguuuuucuuucaugcaucuuuacuauauagauagguuuaauuagguuuugauagaaacacuuuauauguauuuuaagugcuuuccacuuaaaauauuuuuagaucuuuuuuuaauauaugaauguuuucccuacauguauguuuuuguacuacaugcaugccugguggcugcagaggccagaagaggguguccaauccccugaaacuggaguuguggguaguuguaaucugccgugugguugcugggaaccaaacccagguccucugaaagaacagccagugcucuuaaaggaugaacuaucuguccaguccuucccauuuuuuuuuaugaugcuagaauuaauuacuggguucagauauaaucaggcuugaguccaucauaaacuuccuccucaaauuauuacuuugucauguagauggcuagaaccauuguuucauuacaguugcaaaaugcugguuuucuuacuauuuuauacauacuggcuagauuuguuauuuauaaacuuuaaaaauuuuauuguuggacagcacuugggaaacagaggcagguggaucucuguaaguucaagacuagucugguauacaaaguccaggacagccaaaacucagaaaacaaaacaaaaaaaaaagaaaaauauuguguguguguauguguguauauguauguauguguguguauauguauguauguauguauguauggugagugugugugcacacaaaugccgcagcuugucuggagguuagggaacaaucuuugggaguccucuuccgcugugggauccagggaucaaacucaggucaucaggcuugcacagcagucagugccuuuacucacugaguuguuguacccugaauauuuggaagaggaauauggagggaagaauuagauuaaucagguacacauuguauguguacauugaagugucacauugagugggauaaauauguauaacugacugcucuaugucaauaaggauaugugagcgcuuuucucucucucucucucucuuuuuuuuuuuucaagacuagguuucucuguauagcccuggcugaccuggaaaucuuauuuguagaccaggcuggccuugaacucagaaauccgccugccucugccucccaagugcugggauuaaaggcgugcaccaacacgcccggcgugagugcuuuucucauuggaauacugaauuuuguuguugaguuguaggcaucucucucucucucucucucucucucuuuuuuuccccugagagggagagccagagugagagagccagagugagugugccuuugugaauguugguggaugugcgugccuuugggcuggagcucaccaguuagucuacaauugguggaccagcaagcccuaacuaacuacaugcuugagguacuaugcccaggacuuuuacacggccucuaugaaaugaacucaguuccucauacuugcaagacaaauacuucugucaacugagccaucccugacccuagaaucagccauucuuauaagcucugacucauuuuggugggaaaugguauuaggaguauacauugcaacuggauugggaauucuuucuuuuaaggagagcuaggaaauauuuuuggcaaaggagaagaucaaucggaaugauuccacccccucccucuuuuuuccuuuuuccuuuuugguuuuucaagacaagucuacuucgauucauagaccaagcuggccuugaacucagagauccaccugcuucugccucuugagugcuucaauuaaaagcaagugccaucaugcguaguuuaaaacuuacauuuucaauucaaguggauggaaggauuuuuauuuaauuuuauauuaucaauauguaacacuagaaaggucaaacaugagguaacuaaagcuaaagcuguuugugguaguucacacaucacaauccuagcacuugggaggauuaggaccaugaguuugagaccagccugggcuacauagugaguucuaggucagucuggucuauauaguugagaaccugucucaaaaacaaacaacaaacaguuggcaugguggcacauucuuuuaaucacagcauuuaggaggcuucggcaggagggucacuauaaauaugaagucagccuuaagucacuuacagugagacccugucuugggggaaaaaagaaacaaaacaaagaaaacauggcauaauugagccauuugucucuuauauuuuaggaauuaaaacauugaauauuuguaaauuauagagcuggggagauagcuuaguggauaaaguacuugcuguauaaaugugaggacuugaauuuggaucuccagcacccacauaaaacccaggcaaggcacuaugcaucuggaaucugauugcugggggacagagacaggagaccucaagggcuugcuagucuggcugagucagugagcuccagguucagugaagaguuacaucuuucuguauagguaagacuaaaacacaucauauguugaaagaaauguggcuuguauucuugccuuugcuuuucuguguaccuuacacaaaguauuuucauugguuuuggauuucuuuuuuuuuuuaagucucaacauuuuuuaagaauguauguauauuacauauagagagauggcucagugggcaggaucacuuccugugcaagcauagggaccugaguucaaaucccagaauauauguaagaagccgaguguggaugcacgugugcccauaaccccagacuuggaaggcagacacaggaagauuugaggcuuguuggcugccagccuagcuccagguuuagugagaccuuguaccagaggaauaugacagugagugauggagcaggacauacauacagcacugacaccacacugaacacaauguguauguguuuguaccuuacuucuguuucaguucuuccugucuuucaucauguaaucauaguucuuauuuccugguucucaagugucacauaggauaccauuuagaaaauguucagguguuuucccucuucucuugcuuuuuucauuuauguauuuacuuauuucuauaucauuugagucagugucuuucuguguagcucacacuagccccaaacucacuauauguagcugaggccuuacuuguacucaggauccucugccucagccaccuaaguucuagacuuuacaagagcacaagccuggcuuuuacaggucuuuuuguaggaucuaaaaugacuacuucuuggcuggggaggaguguuugccuaucaugcuugaaguucuggguucaagccucaagaccacauaaaacuaggccuagugucauaggguuauaaugcagccucugaaaucaguacucaagagguggaugcuggaggaucagaaguuuaagauaauccucagcuguugaguucaaagucagccugggguacauaauaagaccuugucuguaaaguaaaguuuauuuuaggagaacugaucuucuuuucaucuucgucuuuuuuuuuuuuuuuuuuuuuuuuuuuuuuaacagagucucacuaugaagcccagucuggccuugaauucacagagacccucuggucucugcgcuccugagugcauaugccacaccuaguuuaguguccuuugaagacauuccaguuugucuuuauuagcaagugacuauuaauggagggcuggcaaaaugacuuagcaggcaaaagagucuuccacuacaugguggaagaagagaaacaacuccuccaacucaacugagguccacacaugcacugugguaugugugucacacacacacaaaaagaaauguaauaaauguaauuuuuaaaaaaugaacugguuuguuggacugaaguguagcucagugguagaacauuugcuuaguucuaucauaagcuuagcccuugaugccauccccuaaaacaacuaaccaaacaaccaaaccuguagauagguaauugguaagagguuccucuuucuggcaauccugucuccuuugugagggcuggcuaacuuggugaucagaugggaaguauggaagagaugaaacugauuagauuguuucccacuccugaucucuguagcuguccauuuagagcugggcacuuacccagcuccuccaggaagcauugcuuaccucauugugccccuuuggcucugugggaucuaggaaguggucagcucugcuguguuguaucucagaauacaacauuuccugagcucucugucuccucagcaguagcucacauuuaaauagaccauggcucaaaccuuccuguuaggcugugauucucucgugaagagcuuuaccauuaggcuaccuggguuggagagaaugccaaguaagcuguugugguccuagagugaaucuccuugugccuguucauugcugacagcagaacuguuugcugcucuguguucucuguugccugaacgaaugaaaugaacugauaauuguuuucuggcugaggcuaaggagcauuucccuaccauggugagguccuagauuugaucccuagcagcaugcacacaugcacacacaaacacacuauauuuacaaaucauagcaaucacauuuuagucaaacaggaacucuaaugaauucauucaggaguucauuucucuuugcuuaaugcauugaaguaaacacuaggguucaugaaguauguguuuccucccuuccuagggagguagguagguuucuguuugguuuaggcauuagguaacucaacaaaaccuuuguuguuuaucaguaguguuuuuccagacaagcaaagauaaugaggccugcauucucuugucuuaugugacauuauucuuuuuuuuauauguaugggcucauuuaacucaguaacaguaguuacucuuauuaucucugcuuauagaugaugacaccucugcagagaggauaaagaacuuacucaaggucacauuacuggucagugcagaaccaggaccucacccagccagucagaccugcaaggccacucucuuagugacuucccuagagggaagugugcuucccaccacuuuccuagcacuuugaauuuucuuccugggggcccaagguugcuuuuacacugguuuccaucuaguuucaagaauguuuucuguuguuugaaauagaacuuguuggguaguuugaaggaauggauguaauuggucuguauuuaaaucuauugagaaccuuugcaaguuaugucauguugaaaaggugccauuuaaccuacugaaguguaauuuuucugauaugcuuaagaauuguaaguaaggccgggcgugguggcgcacgccuuuaaucccagcacucgggaggcagaggcaggcggauuucugaguucgaggccagccuggucuacagagugaguuccaggacagccagggcuacacagagaaacccugucucggaaacccaaaaaaaaaaaaaaaaaaaaaaaaagaauuguaaguagcauuagaauuuaugaagacagggcuggugagauggcucagcagguaugagcacccaacugcucuuagguccugaguucaaaucccagcaaccacaugguagcuuacaaccaucccuaaugagaucugacucccucuucuggugugucugaagacagcuacaguguacuuacauauaauaaauaaagaaaucuuuuaaaaaaaaagaauuuaugaagacauugcuggaugccugcacuaacuuguacagccuuucacagugaguauuuauguccauacugugugcagcuuccuauauuuugaauguuuuacuggugacgguuuuauaaagaggauaugaaagagaaauauuuuuuuguuuuguuuuguuuuuguuuuuguuuuuuucgagacaggguuucucuguauagcccuggcuguccuggaacucacuuuguacaccaggcuggccucaaacucagaaauccgccugccucugcuucccaagugcugggauuaaaggcgugcgccaccaugccuggcugaaaaauauuuuuuaauaguuuaguccuuaggaagauaaauguggaucaaaugcauuugaaagacagacagcaagggagaauuuucuuaaaaaaaaaaaaagaaagaaaagaagagaaaagaaaagagccagguauugguguuguauaucuuuaaucccagaggcagguggaucuccugguuugaggccaaccuggucuacguagucaguuccagggcagccagggcuacacagagaaaugcugucuugaaaaacagaaaaagaaaaaaaaagaaaagaaaggauaggagcuggagagguggcucaguaguuaaguaguuaagagcacuggcugagaacauggguucaauucccagcacccacaugguggcuuacaauuaccugcaacuccaggagaucugggacccuccuguggucuccauaugcaucagguacacaaugcacacccacacaugaggcaaaacacucauacacaaaauaaaaauaaacaaaucuuuaaaacauuuaaaaauuauucaaguaauauacccacagcugguguucgugugcaaauguguacauuuauuuuuuuaaaaugaacaucuuuuacuuuuuuuucuauguauggcuucaugcuuauguaucuacgccccacuguguuagucaugaaaccugauuacauuuagcauaauauucacacaucuuaucacccacaggcucagaauucauuaugguuuuuaaauauguccgcuaauuuagaaacauaguauuuauaaagugaaguuuauggaguuuuuuuuuuuuuuccaguucuggggauuaaaccuaaggccuugggccuguuaggcaagaguugagguaggggcucuugcucaauaguccagguuggcauugucuucaggcuauaagcaggagaucggaacuguccaaaagcaagaauacaaaagucaugagaucaauauuaguuuucacacaaaauuuauaugcugaaacuaauuuccaauauaaugccauuuaaaggcaaacacuggcagguaacuaauuagucauaaagucuucuugaguaggauuacugcauaucacauaaaucagcuguauauuaauaagaguuugagggaguuguuuuuagugcuagugauugacuucaaggccuugggugugaugaacacauagucuaccacugaauuauaccccagcccaaggaaggugucuuuaaacugaauuauaaaacaagaucacauauugguuucuuuuuuccugaaaguguuuugacuuaaugcucuaagaagcccuacuucuuaguguaggaacaggggcucaggguucagugacuggugauauuaucuaaugaccaugaggagugagagccaccucugugcggacucacuucuucacagcuuggaguugccuuaagauccuuugauccuaauguauccuaauauggcucucuuagucuaucucucuaggauguguuuacccucuuggauguauaguuucauuuucaucauuuguggacuucuuagucauaaguccuucaaauauuccuuguuauagucacacuugugugcuugauagugucccauagagcucucagagaaccauauaauagcuuucuuguguuaguguaccuguuuuuucaacuccagagucuugcccugucuaagguucaagcuggauugacacucagaauguaccuauacauaggcuaaccucaaaacucugcauucuuucugccccagcuucccaagugcugggauuacaggcauaaaccacuucauaugucucaggaccagaauuuguaucuguuuauuuuugauuguugagauagggcugucuuuuagcccaagcugcucugacacuuaaccugggcuggucucugacucauggaauuccuccugccuuggccuccagggugcuguauuucuuuucuuuuuuccuuuuuucuuacuuuuguuguuguugcuuuaaaaauaaauuaaaaauuuuccauauuuuuuugucagcauauccuuuccucuuccucuguauuuaguuuucuuaaaaguaguuucugggcuggagagaugacucaacaguuaagaacacuagcugcucuuccagaggaucugaguuugauucuuagcacuucuguggcagcucauagcuguugguaauuccaguuccagggggucugaugcccucuucuggccuuugcagacaucaggcacacucauaaugcccagacauaugugcagacaaaacacccauacacauaaauaaaauauauaaaucuucuuuuuagaugaauuaauucugccugguaugguguccuuuguacaguggguaagagugcuugccugauuaggaaucaacauaauagaaggagagaacagacuucuacagguuaucuuucaaauuccauauaaauaaguaaauguggaauuuuagaauuguauuuguacaagauacauacagauuuuuuuuguuguuauuaccauuaaacagaguaacagcugaucacaucgugcuuacauugcccuagauacuccaagucauguagaggugauucuccacuuugaucauauaacucugaucugaucugauacuuggcucuuuaaucuagacuggucucaaaacugaaggcaauccucugaaacagccuccuaagaccugggauuacaggugugcagcacuuugcuuguguuuuauagagcucauuuaaguuguacagggaggagguguacacaaguggagugcaaaauacuaucccauuuuauauaugcaucuucagaacccucagauuuggggaccuccaggcccugaacccagucuccuauggaugccagggagcacugaacucaucaauccucuuguagguuugugagcccuuugaagaggaaacaaaggaaugccaaauguugaacaggcccuguucaaaguguugccacuuaacuaguuuuagguuaguuaguuggucugaaggagagagagagagagagagagagagagagagaagagagagaggagagagaggagagaggagacagagaagauagauagaucuccccuauaauccagauuggccuggaacacaauagguuaacaguaugaccuaaaacuuuuuauuuuccugcuuccaccuccugaauguuaugauuagaggugugcaguugcuguugaacccagggcuucaugcauguugagucacaucuuuagccuccaacccaagaaaugaacagguuagcuugcuugccuuuguuuguuugcuugucuuuccucuccccuccccuccccuccccuccccuccccuccccuccccuccccuccccuccccuccccuccccuccccuccccucuuucuuuucucuuccuccuucugcuccuuuuucuccuccuccuccuuuucuccuaagacacaguuucucuuuguaacccuggcuguccuggaacucacuuuguagcucaggcuggacuugaacugagagaucccucugccucugccucccaagugcugggauuaaagauguguaccaccacugccuggcccccaaggaguuuucuaacauuccuccucucguagcuggguuucacggcguucugcuuucaugaagcuuauuauggugucuugauguaaagcucaccaaaguggaggauacagcauuuuagaaguguucagaauugcucuuuguccuacagccuccuugacuucaucuuuucuuucuuucuuucuuacaggaaaugacuuagaggccuuaugaauacaucugugcuuucuugcuucagacuuuacaacugcaggccaacccagucuggaagcacuuuuuauuaauguuacaaggaaaccgcuaccucagcaaacaaaagaaaggagaagacacacaauaacaaaugccauguuuaaagaaaacuuguucccagaaaccuuuacaggagauuuggaaguuuuuagcacugagaagcagcuuuccagguaaauggauuugacaggcaggcucugucagaauucugcagagguguguucuuccuucaggacuucuugugaaguaaccccuuccgccuaaaugcuguugaccagcugggguccuuuuugguauauagaagauacauuauauuacauuuuaaaaguuaaguuauuuuucugccauuguaaauguaaguaucaaaauauucuugcaaagcaauuauaagcaaacacuuuccucagcaagcauaucuucauugaggguaggaugcugaacaguuacagagcauuucggacacuguuauuuuuuuguuagaguuccugccuacacugaaaauauuaauuauauaaaucuguuauuuuucucaccuuuauguuggaucacauggucaccugccucauggaaaugccuuuuuuaaaacuuagauuugcagaacuccacuauuuuuauaccuagcuacaguuuuggaaaaaaaaaaaggacucagaacccugaccugccagugguccccgggacaguuccccacccguauguauugcugcagugcccaggacaauaagauggacuacaagcggcgcuuccugcuuggcggguccaagcagaaggugcagcagcaccagcaguacccgaugccugagcugggccgagcacugagcgcuccccuggcauccaccgcccccucugccccgcugggcagucugaccgcugcaggcagcugccaccaugccaugccccacucuacucccauugcugacauccagcagggcaucucuaaguaccuggaugcccucaaugucuuuugccgugcuaguacguuccucacagaucucuucagcaccguguucaggaacucacacuacucaaaggccgccaugcagcucaaagaugugcaggaacauguaauggaagcagccagcagauugaccucagccauaaagcccgagauugccaagaugcucauggaacucagugcuggggcugcaaacuucacagaucagaaggaauucagucuccaggacauugagguaaaguacugucaucauaggaaaauggacugcaaaugucaccgaggauacucaguuucuccaaauuguggcaguaauagccuuuguccuccuucuguugauauacucuucuuguaaaaaguuuggugccugccaaguucugaugcuuucauuugaaguaaguuaaaugauuaucgagaaggaugagaaagcucagugcuagagucaguguucagggugugagaucucaggaacaacccagcacacaccgaagaaaaaguuaaacugauuguguuugauguuugcccuucauuuucucaaauuggaaacuaguauccaaauaauaaucuaugaaaaguagguagugaaggacuggagauacacuacagugcccuugccuacacauaaaguccuagcuacaaucccuaauacugcacaaacagaagugcuuagaauucuaaguauaaucaugaaucguauuuuucaauuuucagucuauagaaucacugguuuauaagaaagucccauguguuuauagaauaagcuaguuuuccaguucuaaaucgaaaacuuuuuuccaucaaaaugcauuugaagcuuacucaguguauuucuuggguaguguaguaaaaaugaaacacucuucuuuaggacucuagauuagaaucaaguuuuauucagaguaaagauggcuuuuuugccccccugacuuccuuuauugaggaaauaauauuuuuuaagauuuauuuauuuccucgaaaaaacaacaaaaaaaaagauuuauuucaauuucaucuaugugaguacaguguugcuaucuucagacacaccagaagagggcaucagaucccauuacagaugguugugagccaccaugugguugcugggaauugaacucaggaccucuggaagagcagucagagcucuuaaccacugagccaucuguccagccccugaggaaauccuuuuuuacuauucuuuuuuauucagugguagggauggaacccagaacuuuaugcuuucaccacaaaugcuguaccacugggcuaccaugaguuuuguguguguguguuuuuaaauuuugauucuguuguauuaggcuuuuuuuuaacauuuauuuuguguauguauuuugcuugcacguauauccagucuuuagggaauuauagaugguuaucacugccaugugcugggaaucaaaccuggguacucuggaagggcaguuaugguucuuguuuguuuuuagauauguagucauggcugacauagaacuccauauguaaaccaggcuugucuuuggggguggggggaguugagacaggguuucucuguguagcccugguuguccuagaacucacucuguagcccaggcuggccucgaacucgugauccuccugccucugccuccuucugcaaauccuaccgucgugugccgccacaaccggccaggcuugucuuuaacacacaggguaccucugccuucugaguuuugggauuaaaggcuugugcuaucacauccagcuccaauuacugaaaaauaggaagccauggaguuuggagaaguggcucagagguucaguguguauacuguucuuccugaggaccugaguccaaguuugguuuccagcacucaucuaagauagcuuauaaccaccuguaaugccagaaucugagguuugaucuguccucugggcaccuacacacgugcacauaccacauaugucaauacacacauguguacacaccggcaaacaugauuuaaaauaaaucuucaaaaaccaaacucauuucauccaagggacugcguguucaguucacuguauuugauccaggagccauaguuugcuacuuuugcuguuacaaauguauaauauuggggcauucuuuuuauuugaauaugagacaguuuaggagauuguguaucaugcuuguggagacaucacaauccucucuguaucauccaaguuuguguguguuguuuuguuucaguguuaggucuuaaaccccagucugugccaugucaggcauauacuuuaccacugaguuacauacaccauagguucuuucuaucuugacucucuuuauucggguauauuuguaauucugaccauuucuaugauuucauaaaaugguucaucauaguaaaauuauuuuuuaaauuauaccuaaaggcugggaauguagcucgggggguggagugcuuuccuugcaugugugugcauuggaccuggguaaauaaagaaaucauuaaaaauauguguaaauuuucaaagauauuggacagugaaauguaaaacuuagcuagaugugguagcaccacccuacagucuuaaugguaaagagucagagaaggauuguggguguaaguguaaucugggcuguauauuuaccuguugcaaaauaaaauaaaaaaggcuggacaugcagcugggugauagaacacuuggccaguguccaugagaccucaucuauaccuccacaacaaauagaaauguagagcuuugugcuuucauuccccauccuguucuguuuccacccccaagaugccuauguaccugauauaugccuuuccagacugugcaugaauauauaguagagcacacacaaaugcacugcuuuguuuuuuauuguuuuuguuuguaagcuugaagacagguucucacuguggcuggccuggacuuacuguguaguugaggcuggccuggagcucaaagcaaucuaugagcccucaugcccacccuugucuuuuuuaagaacuguuuucagcuacagcgugcuugauuauuucuugacaaaggugugauauuuugcaagcacguuguuacaucucccgucuccucacaggaagugcagaucaguguuaggcauucacuguuaggacggccacccugagaugaugcagcacuuguaaguuuguguaggagcccaagugagagcaguuugugugagccuuaaucuuauguuacccguauuacuguucucuucaaaucuuacccugggauucgagaagacagcuagagccauguggcuuugucuuuaauaauggaggauaagaagugccuuugcuuccuagucaggguaguuuuaugauacacaggagcuuagugaaucacugggacguuguuuauuuguuuguuuuuuguuuuuguguguguguuguuuuuugcuuuuguuuugagacagacuaccuccugagugcuggaauuuuagauauguacuaccauguguucuauuguugauuugguuggugauauaacaggguauaucacuaacacaggcuauccuuacuuacaucuucuugccucauccucccaaguguugagauugcuagcaugcacuaccauacugggcugggaaaugcuucugauuguuggcaguuuacaauuuugacuugacuuuccucauugaaguucugauuaaggucguuggacuauuaccauggguuuuauacauaauagacuaaacaagcuuucugcuuccaguguuagucuggaaacuacuugcuguugauggguuuuggaauccuugggccuguucuauguggaacaacugacauaaauuaguuucaaaaugugucucaagcagacccacaaaaguaaaacuauacugaaguuuuauugcauucauuuguguguguauauguguacauaugcugacucauuaugacucccaccuguggagcugagaggagaauacucuccuagaaccuagguuguagguuuggcagaugccuuuacccacugagcaucucgccagcccagcauuauccuuuuccccuagagcaguauuugcuguuucuagaauuccuaugcuaccaggguaguuagguuaguagggguuucuccucuauguuaaccaaacucagauggaaaagcuaauaagcauuuggauuuuuuuccuuugguguuuuguugcuuucuaccucuucccccuguuuuauauucaaagccugagagguuuuaauguucauucuggggagaggaaucuaaagcuggcauugcauaucuugauuuacuguaguuugaugugcuugguccccagcaaaauuuauuucucaugugugaacaguggacaugaauuguagcucuagaagggcugggcuggguuaguuagcucgagaguggguuguuacagaggggaugcuucucauguucuucucugcuugcccugcuuucugccaggagacacagcaguagauugucuuugaugguccugugcuguuggcuuucuaaccuuuacacuugccagcuagacuuaccuuuccuagucacaaaacugucacagcagccaaaagcagacuaugaugacucuauuauggaagcaggauuguguauaaagaaagcccuguagaaguauguaaaugcucucacaaaguaugauguauugugcccccauucacucauguauguucuuaauagacaaacagugguaccuggcuccaagugcugcaguugcuaccugugugugugugugugugcgcgcgcgcgcacgcacaugcguggccacucugacauuuccauaggguuauccuuuguauaguuuccaguggcuuaucccuuacccugaaugcugcuauaagaguaugaguugugacugugaugguuccuaguugacuagcaccugugacacucucaugccaccccagguaagcucugagcaugaggucagaaaaucugaguuuagaaaauggcucugcuuuucagugcccauacagcuugagccucaguuugccugucuauacaauagaacuaccacccaccuucuaguguucuccugaagaucagaagcaguuaauacuuguaaaaaacuguacccagugaauggucuuauuaguacuacuguuucugacauggcuuagcaggugcugggaggucucugaagcacggaacaccauucugugugagaggcaugccagcaagauguccucuaauuggaacacuugguucuggggcagaaccagucgcuuccccagaacacugcccucugcaguguuuaccuggcucccaaggcagcauuuuccuuucccuuucgugucuugugcugcuuuuucucuugucuaaaagaugucuggugugggacugcuggaacuugaacguuuaguuuuugagggcgucagaucccauuacagaugguugugagccaccauguguuucaggaccucuggaagagcagucagugcucuuaaccacugagccaucucuccagucaaaggcaucuuuaugucacgggugauccuuugucuuagccuccccagugcuggcauugcaggugagugcuaccagguuagucuccugagcaggacuuuuuuaguauaaaaacucaggaaaaucucuugugucaguaaucauuguuguuugccaagcauuuaacagaauggggcauggaaaaagaaguggagggccagcuuguccauugaacacaccuguaaguagccaggaagcauuggauaagcccacugacagauuuggcaggacacauccucauagagucucaaagcugucagcaaaauuaaaauguguauuuaggaaaaauauguuuuucuuacugaacuuauuacuuguccaaagcuuugacaucccaccuggacauuuuuuuuuaagaguggacuacgcuggaccucuugagucuuaggaaaguccacuagaggauuguuuuauuuuauuuauauauauauauauauauauauauauauauauauauauauauauauauauguacacacacacacauacauguauuauauauaugcguauguauguauauauauaugcacgcacgcacacacacacauauauauaguauuaguuucaguguucuuaaaaaugccuagcuagaugaauugaguugacugauaucucuuucacuuucaaucaguuuaaagcuguuaacaguuaaaccuguaguucaugguagacaguucugugucuuagguuuguauuuauuagcaagucauguaauacuauuaaaucacauuugcuugugauuuaugcagcaauucuguguguauuaauugcauacuuuguugguguccagugcugucacaguuauaagggaugugguaaugaagucaggagucucuuucuguaccagaggauggcauguccuuaggaaaaggguuggaaggagagucacugaggugacaugugaguaaagaguagaagcugaugagggaacagacccaagagauugaggcagagggaauagcuagugcagagccucugaaacaagagucagccuagaguguuuaaagggcaggccuuuccugugcuugaaagggagugaauagaagggagaauuuacggcuauuuuagaauuaaauauauaaauuuuuuauacaugcauugguguuuuguuugcauguauguuugugugggaguguuggaucaccuggaagaggaguuacagacaguugugaguuaacacgugggugcugggaauugaaccuggguucuuuggaagagcagcuagugcccuuaaccaaugagccaucucuuuagccccuauuguauuguauguauguauguauguauguauguauguauguauguauguguaugcacauauguaggccaccacacacacacauuggagcucagaagacaacuugcaggaguuguuuuucuucuucuguacgaauccuagaaacucaacccuuauugucaggcuuggcagcaaucaccuuuacuuucucagccaacccacagcccuaaggagaguuagauagaaaaugcugcuuuaguuuagagaggccagagagggggcagggugaggagagugucuaaagggauugugagagaggguagcaggaugggcucaccacccucauguagugaauggauguugcuuacccucaucacccagcugacagcugcaggguucugguuucacuuuggguccucaaugucuugagcgccaggucccugggcaggugccauguaugaagacaguccagaaacccagcauagcugcgggcucucagaauucauaggcuuugagggggcugugcauuuuuuuuuacuggauucucaagucccacaagcagacauggaaucaaauuuuuaccugccugaagcuugccuuguaguuuuacacacugacaggguccuuggacuccuacaauugcccaugaguguaucugaagaaacuucuguacugacuuacucuucagggccuuaguuuagguauguaaccauuuaucagauaugugccaaaaauacuguacagcaguaguaguggaaaauauuagaaauuauuuuaaaaugugauuuucauuaaccuuaugggauugagacuuuuaccccucuaaagguaaaacuccauuguaugucuuuguuuugucuaggaggucuuuuauuuuuuaauuuuuggagguaagguuucucuaagcaaccuugguugauguagaacuagguagacaagacuggccucaaauucacaggucugcuugccucugcccgcugagugcugagauuaaaagugugugccaccaugccuaguauuaacuaguagaucuuuuguagcaaauuauacugaacuauuuccuaacuauauaugccauaugaaaauccagaugguuacuguuaaugagaaaaggaaguucuggcagugacgguacauaccuuuaaucccagcacuugagagacagaagcaaguauuucugaauuugaggccagccuggucuauaaagcaagucccagaacagcaaggcuauacagagaaacccugucucaaacaaaacaaaacaaaacaaaaaccuuuuuuuuuguuuuuugagacaggguuucucuguguagcccuggcuguccuggaacucacuuuguagaccaggcuggccucgaacucagaaauccgccugccucugccucccgagugcuguuauuaaaggccugugccaccacgcccggcaaaacaaaacauucuuauaugacuuauauggggugggaugugauggcacacaguguacucauaaauaaaauaaaucuuaaaaaaaaauaaauaaauaaguguagcuuguuuuugagauuuuuaaucaucuuacauuccucuuuucuccuaaacccucucguguacacuguacacacauccucuugguucucuuuaaaauuuguggccuguuuuucuuaaguuguuacguguauacaugcauauauuuucccccuaaauauacauacaacuuguucaguuuguaugauguuacuuguauguauguuuuuagggcugaucaugugaucauuugguauuggauaacauacuugucugcuguugaggccuugggugcccucagccgccaucauauuagcauaucuguuggugguguccuuguucaugucuuguuuagguagccauguugguaagacuuugugguguaacuugugacauuugcugugacacagcuuuagcaauauuccuguccuuuggcucucugccucacugucugcaaugaucccugagcuucaggugcaggagcuguguuaucaguuuggaccggcuccacagcugcauuucaauugacuguguuucucuguaauggucuccuucugugacaaagaaaagguuuguugaugcggaaugagaacuacacuuaaccugugggaauaaggaccaauauuuagaacauaguuagagguuaugcuggguuaguuaaaugguaguugaaaguucuccuccaagauacaugacuucuuuauccccagguaguuggcuaaguuuccaguaccgggcaugauucccuuuuguugacugggccuuaaguuuaauuagagaacuauugguuacugucaaggugugcuugccacuguggcaccauuaggguuacugugccauucuggucauuucaguucauaggcgucauagcuagguaggacauugguuuaauuucuugccguugaaagcuuaggaaaauuggaacauuuaauuuaaauucuguguguguguauuuuauauacaccacuuacauauauuauagauacguuuagauaguuaauaguaugauuccuuaggacuuuuucagguguucuauuaugcugcuccuuuucuguauuuaucuucucccucuuccaucccuaacuaaagccccucccccuuucucccuucagaucccuuguacccugcuguugucucucuauugcuccauuucccacuuccacaaugggcccuuuuuauuuuccuaguuucugcaguuaauccaaaucaacucuggagauaacuaauuaaaaaguugaaaaguggccaguccugguggcucacacccuuaauuucaacacuaaggaagcagaggcaggaggaucucagucaguucuaguucagccugaccugcauagcaagucccagcccaaaccaaggccugucucaaaacaaaacaggggcuggagagauggcucaucaauuaagaguacuggcugcucuucuagaggaccaagguucaauucccagcacccagauggcaucucacaacuguugguaacuguaguucuauacagucagcacccucacacagacagcaggcagaacacuaaugcacauaaaaauaaaucuucaaaaaccaacaaaacaccaguaacgauaauaaauaaaaagagaaaaguaaggaauuaagcagauuuuugcuuuucugguauguucuauagccugguuggguaaugaaacuucuuuaaaaagcaucuuagcacucuuuagucuggaaaugacaauacagguuagaaaagacauuuuguugaccaugaggaauucaguuacucaaacaguggugguaauaaagaaugaagccauuuagugaaaggucgcugaggaauuacauaaaggaggaauuaggucuucuguacucaaaucccagugaucagucucaguggucacugucaccagaaucaaggcagaugaugucucccauuaugaaagcuacacaguaugaaaauuaugucuccacuuaauuuccuuuccuuucuuuuuccuuccuuccccucucucugccauccuuuuuucccuccuucccucccuucuucccuuccuccaucccucccuuccuuccauccuuuuuuccuuccuuucaguguuggaaugaaacccaagagcagguguguuuuacugcugaguuacacuuguaaucuccacagcauacagucuuguacuuguacauacaguaucuuacucuuguuaaaaaaaaaaaaaaacauacagggcuggagagauggcucagugguuaagagugcugacuguucuuccagagguccugaguuuaauucccagcaaucacaugguggcucacaaccaucuguaaugggaucugauguccucuucuggugugccuggaaacagcuaaaggguacucauacaugaaauaaauagauaaaaaaaugaaaaacaaaaaacaaagaccaggaaaaaaaacccugaaauaauuugaucaagcuucugaaaugaacuuugagucuauagaaauaugggguauaauguacugaguuacacaguaccacaagaaacuaaucugacaggagguggaauauucgguaguuaguugaccugauuuguucaagacaguugcaugaaaauagguaaagguacuauucuagauuaaaaaagaauuaagagagauaagaacuaagcaaaauggggggcuggugagauggcucaguggggaagaguacccgacugcucuuccgaagguucagaguucaaauccuagcaaccacaugguggcucacaaccauccaucauaacaagaucugauuacuucuucuggauugucugaggacagcuagaguguacuuacauauaauaaauaaaugaaucuuaaaaaaaaaaaaaagaacuaagcaaaaugaccuuuugggaagcagaauucagacagugauuaauuugaguuggucaguuggugguggcgaaugccuuuaaucccagcacucaggaggcagaggcuggcagaucucucugauagugaaguuagccuggucuacagagaguuccuccauaguuagggacacaaagagagacccugucucaaaaacaaacaaacaaguuaauuugaauuaaguuugaauguguguuagcucuugguugauuggauuuuaauucaagacaaaaaaaaaggauagaggcagggauaguugaaaaguaugugucaccaugcaagauggaagccuuuugaugggugcguagugauauucucuguuuugcuuuuguguaugcuuggacauuuuccaagugugaaaacuagagaacauuacaaaugcaugauuggaguaccgaggaccuagugaaugauuguauuucuuggaggggcuagugcuugcgaauucgucuucuaacaguccaggcuguuauuagguaguuuagggaauccagggaagucaagcaugguacuacacaccuacauucccaguaggauacuaagagaugaggguggugaguugcaggccagccuagguuacacagggcaacccuguugaaagaaagagggagggagaaagagaaagggaaggaagaaagaaagacgcaagggaaaauuagauuucaugggaaaguaauaaguaaucagaaguauaaagaguucagagaauauaacuuagguaaggcuaauguuuauggcugcuggucaguuuagguuucauaugauugauuaaugacauauucuugcagccuuucuuuucuuuaaaaucagaucaucuguaaaauaauugcccaaaauccucugggcaaggguugggguccuagguucuauauucagcaccacaaaaagcaaccagauuuaacacacaggaguuaaguauccuaugcaucuggacccuccccagugccucaggccauugcuguauacacacagaguacaucccuuuaugggaacuaggcuaaugguaaaauguucagaacuaggaaagugcaauuaucuggauguggaggaaccccugugaauacguccugacuguagaagcccagccugcucuccugcuuugcuuuuuguucuuuguaccaccacccuccugauaaauaacuggggaaguagcuaccagcuugcucugauggguaaggacaggaagugcuccaggcagaugaaaagucuguggcacuagguguggaaagugugcuguaaugcaaauggaaaauggccucaagccugguuguuucaguucugcuuucagacguccuguaucccauuccccacccagacacauacacacacacacacacacacacacacacacauucucucauucccucauucucuuacccucccuccaucccuccguguccgugccccccacccccaccccgccaaggggcugcuauuugcucucuaguguccaaucuccuuuuuucuuacuaagaaacucuuuguuuuucagcuguguuguuuuugggauuacccuucauagucuccugacagcugacagugauaauugauaaggucuagcuagcccauggaccugugacaggaaguacuagaugagaacaacuaggucuccucacuggaaaagaagaguguuccuucuucuccuccacguugugcaaguuguugaggaugcagguggaacagcugaaggucaagccccauacaauucagggaguuguuauuaggcauaaaucugguguuagugagugaagaaagcuauaggccauaacaguaaucuaggcaagagauuguaguagcuuggaauggaacgguuguauaggagauaaauagguuuuguuguuacuaguuuuuguucauuuguuugguuuuuuugagggguaugggggaaauugggaaggaguugucuguuuuuugagacagggucuuguguagcccagucuggccuugaacucacagaauagcugagaaucacuuugaaucucuccuguuuccaccucccaggguaacggauuacaggaguguaccaccauguccaguuuaggacuagauuuuguuuguuuguuuguuuguuguuuuaggacuagauuuuuauaagguaaaauauauauaauguagagcuugcuguuuuaacuguuuacaaguguucaguaacaaaaaaaccaaccaaacaaaaaaaaauucacaugguguauaggcaccaccaccaucuaucucuugaacuuuacugaucuugugaaacugaaaacuggaguggagugguuugcauauaauuauuuguuuuuugugugaaugugacugcgggcaugcacauaugcacuuguaggaaucagagaaugucugggaguugguucucaccuuccuccuuaucgagguagggucacuuguuuuugcuacugccccauauacucuaggcuagcugacuuggaacuucugucucccccucucaucucaccauaguagugcuggguuaucaauggauauugccacaacugguuuuuugcauggguucuguggauuaggauuuuauacuugggcagcauuuguguggguuuuuguuuguuugguuuacuuugguuugguuugguuuuuugcaaggcaagguuucucuguguaguccuagcugaucuagaacuccaucuguagaccaggcuguccccagacucagagaucugccugccucuuccucccgaguacugggauuaaaggugcccaacaccauuauucaggguuuuuuucugucuguuuugagauagggucucucaauauagcuccugggugaguagaucgggcuggccuuagacuuaaaaagauuugccugcuucugccucucaagugcuggaauuaucuguaaugcuguguguguguguguguguguguguguguguguguguguaagagagacagagagagagacagagacagucagagauagacuaacagaggcagagauggggguggggaggaagggagaagagaaucaaagaugcccuccaggguuucuuucuguaccugggucucuuccuaauacugcuguuacuaagaacagaaggaagagaugccuagaauaauaggucugggauacuuguuaaggugugguuuucaguagauaggugaacacacuuugagagaggagagcugagguccacagcaacagaauaugggaacuauggguuaauagaugguauuuaaaacuagaaaacaggaugcagcaagugaguggugcugcagcaagccuuagaguacuccagcauguagaggucagaagaugacugggaagcagccagggagucugaaacuggaucagcugaaaagccaggagagauuuaagccaguacaguaucuuggauguuggaugucagacaaaggaaaucagucaaggcagagguggaggcucacccucuccgcauugcugagauaggcuaggcuuuucugaccuauccaagacucaccagagaaucacuaguuagaaacuguggggacgaggguggaggggucguuaguguuucugauggaugggggugggagcucugagucucagugaggcagcuccugaagcacugauucaaguuaugguguuuuguuuuuuuauguuguugaacccagccuggcuucaaacucaugcauuugaaugauucucuuuccucagccuccugaaaagcugagccuacagguguuugccaugccuaguuuugaagcauucuuaagggcaaugacaacuuuuuaacaaaaauauacuuaguucaacaacaacaacaaaaauuccuaaauuuuagugggcuuguaggccauacgauguguggugacuuggauauauuuucaauuucuaccccauagaaacauacaauauaaauuugguuauggagaaaauuuacaucugaaguggggaaagaguuuaagaacagauauugucuuugauuuaccauaauuaaugugaauuuagauacuuaccuuuuguagccuuucccuggauaaucuuuuuuuuuuuaaguuguauuaagauuuuuugcaaugaagcugaaacaugacuucuugugagguuggagagauggcucugagguuaagagcaaccauuguucuugaggaggacuugaguuuggcuucccugcauccacguugggugccuuacaaccaucuguauguaacucuagcuauaagggauuguuuggacucuauggguaccuauacuucuauggacacacaacauaugcauauaguuuuuuaaaaaucuugaaaaaauggcuagguguacuagaacaaaccuuuaaucccagaguuugagaaagcagaggcaaacugaucucuuuaugucugaauaugaggccagccagggcuacauugugagaccuugucucaaaaauaagaacaagauagauuucuuacauauuuagcacauauaacauggcaguaaauuagauucaggacccuaugcaugcaaaaacaggugcuguacuauugacucauaauaauuuauuuugggaaaugaacaacaaaacaacauauaauaacaucuagauuuuacuaaaauacccaaaguauuuuauuuauuuauucaggaauaguuaguacuguuuauuuuuuagcagaaucccuaccccuccaagcccuguccaguuaaaagugaagauguaucaccgucaaaggcuuugcaugucauggugcuuagcccauguggcaggcaggagcucagaaaccaccucugcuguuuuuacuggcaauauagcagcuuguccaggucagaauguucuuuugucugaacaugugguguuguaggcauaugcugacuuuauuacauuuucugguuguuccaccuuauguauagcuuggcuuuucucugugauugaaaauucuggcugcaaaaagauuuguagauuuuuuuuguuaaucaaggaaccacaccccugggauggaaaucugagucuugcgugaucaacaagcauucucccacaguacagcaccagcuugucaguguuugcaugcuauuuucaguaagcuugguuuuuuuuuuccccauuuuuaaccuguagugcaguuuucauaaguacuuuccauagucuucaaguagucuguguucucuguuucuccugagacacauuuagauggcaguaucaaggucuggucuguggguugggucauuguguaaugacucuggaauuaccauauagacaauaagcuguauucaaaacaagguugugaacacugaaaaugaaauggaaugcguaagguauauaaguacuggagagagggaaaugauggaauggcuuuggaauuucaauuggaagcagccagucuggcaacuugcuuucacucuagagacuuuuugucuggucagacauaagguacagaauggcuuaguuuuugcagggaucuaagaaagaugaauuguugaauggaguugagcagagcagugaacuuuuggguucuuccaucuguguuaauauggaaaaaaaguaagcuguuuugggagaugagguugaccuaggcauccacaguuccauucacaagcagguagaaagugcuguaggaaggaauggcuguaacaaaauuucagaacauagagguugacccucaacaacuaugaugguacagaaaggaugucuuaguucucaaacaggauggacuuaaauuagaacccuuuguaaucugcuuaagcuauaaaacuuacugagaagaaagagggugugguggccccaggccuauaaacucaguacaaggucacccuuguacuagugaggcuacacuagugaggccaguccagaugaguuguugccucaagaaacauacaagagguguagagagauggcugcuuuuggagaagaccugaguucaguucccagcaccuacauggcaguucauacuuuuuguaauuccaguuccaaacccucuucuggccuuuucaggcacuaggcauacacugggguauagauauauguguagacaaacacacagauaaaaauaaaauauuaacagcaacauuaaacaaccaaacagguacaccaagaagagagggacucugguuauacccaugucuacagugugguagauacugugcauacaguauaagagaauaagaagguucaugugcgcaacuguucugcuuugagaccuagucucacucuguaauccacguagauuuugaguuuguggaucucaugucucagccuccugagugcuaggauuacaggcauauaccauggcaccaggcuugugauauacccgucuuggccaucaggaauuuccaguaagcaggguucuguuucaguagcucccuaacgauuaucugcuuccagaaugucuucucuuuaguaccuacccacuguuguuuuuauauccuggaucuugucacaggcagacagggcaaccugguggucagaaaugucuuuuagagugagacagacauuccucacuuaaaccuacuugacauuaagcaaauuuaucuuuuuaagccuguuuugucauauguaaaauggguuacuuuaccauguguguggcuccuggcauggguuaaggugguggcuguugguagagcuucagugcuauuuuauacuuaaguaccuggccuugacuguuccacucacccauucuccagcuuauccaaucuguucugcagccuuacaugcccugagucugugagcugagagagcugucugugacccugggacacauucuuccaaaccugugugaggacaguccccaagaacuggcccaucccugagucaaggagggugaggucuauuaagggcguugagggcugagccaggaaaggagaugagauaaagggugagcagagacaggagcuuuguccucucagaaggugauguuuaugugucuguuacuugaggugacauuuuauaauaaguagucacugaaaccaguuuccaagagucgggcuaacuacugguuagguuggccuuuaauuauuuacaacguguauuuugucacaaucuuaauuggguuuaugcuuuacccaucgugggaaagaagagggcaguucuuacagagaagaacugcagcuuaaaugacucaucuaaggucagguacauaauaaagagcaaagacagcagacugacagcaggauuccaccuccaccucucuagcagugcauuaggaggacccaccccagccccaugcuucugugauccagauaccaggcuucacugccauuucucagaguguuccuuucagaguaggaagugaagcuuucuuccuugguuuauccucagagagccuuuuccucaccaccugccaggcagcuuguucuccagcugcaucugaccuugugucuauuuauggcuuuguugucucuuagcccuauuaggauguaacccuccugagcacagggauuuucucauccucuuuccuguguacccucaggauuuuugagcuuuguacauauuaggcauucauguauuauauauuuauuauuagaaggagcaaguaauuuucauuggucagaagcugggagaaugugaccccagagcagcauggcaacuucacuuacccuccauuucuuucucccauagcuugcuaagaggccaagaaagaggggagagagugugaccuggaggagccacccagcuccucugucgcuauagggagcuuccuggugcccuuagccggugccaguuaagacugaauuucuguugugugccugguccagugcugccacccucugucuguuuggauauugaaaguguugaagacaagaggacauacuugcuaaaaucguagaagcugaacacugaaugaagagacuguucugcuuguuuguuuuguaaccuuugugccugguuucauaacuugucuagccuuagucuuuuucucuguaacauagagaugacuucauagggguauucugggauuugugacacaacccauaugaacucuguaguguagaccaaguacaugcugaaugcuuaguuaaagccgacugguaguguguaugguacuagacagagggcguguauucaugucaggagucucuagcuggauucuuaggucugugucccucacccuacccuucauagccguagccuuaguagggaggagcucugaggaaaggggcaguggaaaccuaggagguagaauucagcuuugauuuagcuguucacuuagaggguggacacuuuaauaugagcuuauuguuuguuuguuuuuugcucuaguuuuggaugaaacuuuaaauuaacauguuugcucuggugcuuucuacaggggagaaaucuuuuagagagaauagguauugggagcuggccugucccaguuucuguagcaaagcagcucuguugugugaugcuggauuggguuuaugguuaagggcagcaucugacuuagauguggcugagucuuuaggcugcuccaagguacaagauggggugagagcgucgggacucuaauggauguuaaaucuuugagaaaggagugcagacaguuggagcagcuggggucucaccagauugcccaggcagacuuugaacuuucaauucuccaagcucagggucuuuuucagcuagcaguuucuccugcuuuuuagagaaaaacauaggaaaucaacaaacaucacagcugugcccaaguuagaaaaccagacugggaguuguacacuccugaaaucuaagaaauucaggagacugaggcagggggauugcaaguccaaagccagccugagcuacuuagugagacccuccuguauaaaguacaaagauaaaacggaaggaggauguuagcucuuccucauucugcuccaggcccuggggauagcuucaguaccaccaaaaacauacagagaaaguaagagggggggggggagguggcaguggugcaaaccuuuaguacuagcacuuagaggggacagagacagguggaucucugaguuugaggccaaccugguuuacagauugaauuccuggacccugucuccugaaaaagggggugggggaggaagucaagucacuaggaagcaagaaagggaacagcuucccuggucuccaagcaaauaaucuuucauggcuuaaaauguucauuuaacauuuuaacaauuuagaacauuugucuauuagcagugggauuugggcuucuauuauuguuuugaagcaggggaacaguggcuucuaacucucuuuguagaccaggcuggucuugaacucaugaugcaccuacuuaagucuuccaagugcuagaauuaccugaauauaucgccauaucugucagauuuauuguuugaaaaaaaauucuggcuggacaugguggcaugugcauuuaaauccagggcuugguagccagaagcaggcagauugcugugaguuugagaccagccuguccuacagagugaguuccaggacagacaguuccagugagauccuauuugaauuauuaacuagccaaccaaccacugauagugucagauuaguggguuucugccuuguugauagcauuaucuccuauguuuuguugacuccuggaaaacuggucugucagcuuuguuuuguaaugaguaggaggaacacaacaaacaacuguauucauaacaauauuagcacagcacugaaacaaccaguaucuuugaauuucauucccaauggaauguuuucuucuaggucaaaccaaccuuucagauuuuuacucacauaccaugacuuuuccuuugcguucugaauacucuguggccacaauugagauuaugaauggcucggacccacaggaacucaaagacagucuagacucgggaagugaggacagguggggggaaguuggaagacccacuugugccugaggcuuacugcuugcuuugaaauguuuuguuuuguuuuuuucagacaggguuucucuguauagcccuggcuguccuggaacucacuuuguagaccaggcuggccucgaacucagaaauccgccugccucugccuccugagugcugggacuaaaggcgugagccaccacaccuggcucuuugaaauguuuugacuucuaaauuucuaguaucaaggcccaauaggcaggcacuuguaaagcagggggacuuuuuagcauugcaugcuuuuaugauugccagucuguugacaguugaggaguuacugcacuaauccaugagcaacccacagccuaaaauccccuugcucuuuuguuuucacagguguuggggcgauguuucuugacaguggugcaaguccauuuccaguuuuugacccacgccuugcagaaaguccagccgguggcucacucuugcuuugcugagguaguugugccagaaaaaaagaacagcagucugucuggcaugggccacacaccugaacuggaggaagcugugcgauccuggcgaggggcagcugagguaacugaccugggagaggcugcugggauucuuugacuguuggcucccaggagagacacuugcuuuuagacauuaaguuguaaacuuaccacuagcuugcugcuucuucuucuucuuuuuuuuuuuuccuuuuucuuuuuuucuuuuucuuuuuuuuuuuuuccuagacaggguuucucuguauaguccuggcuguccuggaacucacucuguagaccaggcagccuugaacucagggcaugcaggcagggauggggagcaggagagaacaaacugcaguggcaaaugcaagaaagugcgaugaugaaaccuauuacuauauaugccaacuccaaaacuucauaaaaaugaauagaaaaagaugcuuagcugaacuaaucuuagguccucauuuaucauuuuuuuugcaugugaucuuagccauuuuccuauuaauuuauuugacacaugaagccuuuuauuuuuuaaugaucagaagcuacccagcacagccucacuaguggguagagaagcuugagcgggauagaauggcauagugaucagauuuggggagggacaugccaguguccaaugagcauucuccucugggcuucuggugcccguacaaccucuuggaugaggaccugcuuuagaaguuuacugcuggccaucuucaaaccuuuucauggagcauccugccuaguauacaguucuuccucuggccacucuagcaugguauucucuaguccagugguucucagccagggucucaguccucuucagggguugaaugacccuuuuacaagauaccuaagacuauccaaaaccacagauauuuacauaauuuauugcaguagcgaaauuacaauuaugaaguagcaacaaaauaauuuuauggcuggggggggggucaucacaacaugagggacuauauuaaagggcuguagcauugggaagguugagacuucucuacacccagaacuuaaacuuggauauuaacaagucagaaauaguuuuucaauuggcagggugguucaauuggugaagguguuugcgauagaaccugauugugcugacuuucaugaguuauacacacaggcaugcaggcacacacauagaaaaaguuaaaaaaagaaauugcucuuuauaaagucagucugucucuucccuucuucuuccucccccuuuuauuuuucgagacaguauuuuguugaauagcccaggcaggccucaaacuuguaaugcuucugucucagccucccaagugcugggguuauuuauagguaucuaucacuauacuccacuuauuuauuuuuaauaauaaauacaccuucauauauguuagugcaccacauguguacagucuuugagaaacccaaccagaagagggcaucaauuuccccggaacacaaguuauaggugguugugagccaccauauaguugcugagaauugaacuuggguccucuggaagugcucuuaaccacugagcgcugcuuucagcccugguuuguuuuuuagucagggucuucaucaauggcagcauguguuuuguaagcauuuuaacacauacaugcaaauguauauggucuuuugauaggaaaguauuauguugaaaaaccuggaggguacuguugccauaggagaagaggcugagaagacucaacuacauagucucaucaguguuccgccugaggcaggaggcaggaggcaguuuccagagccgcugcaguugccaguagcauugcauucuucaucagccagaucccacacuucauagagaccugcaggccugcagacacuuugaaaugagacccacagaucacagugauggcuaacacagcaagaguuaaaucuguauuguuaguggcccugcugcacuuagaacuaucugacagccuggcagaacuaucugacggugguggcggugguggcacacaccuuuaaucccagcacuugggaggcagaggcaggcaaauuucugaguucaaggccagccuggucuacaaagugaguucuaagacagccagggcuauacagagaaacccugucuugggaaaaaaaacaaaaacaaaaacaaaaaaaacuauucgacauuacauacaggauugaggccauuugguaguuuugguuuuuguuguuguuuuuaaagaauaauucucuaucugcuucucaaaguuuuuauuaaagcgauauaugccuucucucuaaguaucuuaaaccauggccacaaugcuugauaaucuaauugaaagagauaggaagauagcaguugaagucauaaggcagaaauuuuucacaggcucauagcagcccacaaagcccacacugaauaacaugcauuacagugauuacuauagggagcagcacaguggagugguccccuggguuauggucugacccaagguaagcuuaagcuggacuguggcacucaguacuaccacucaagccugaaguccagcagaggagccuagacagcacucuaaagcugugcacuccuuuucugcugcauuucaguggcucucuugcuaacaccucuuuccuagugagaaaaaggaaaaguaaaaccuuccaagauggccucacaaagacuugcuauuuuacuuuauauagagaguacauaaucuucguguaugguuaaggaguguauguauguuauuuccuagaugauuugaauuaccccacaguuaauuugcaguguauugccuuuuguuauggaccuaaagccaggcaugguagcaaauaccugugucacagcacuugggaggugaagcaggaggaucaggagcucaaucaaggucauccuuacuuagugcauucaaggccaucuuaggauauaugagaccuuaggauauuuauguuucaaaacaaaaauaagugaaauucugaucuuccaucucuucuccuuucucagagaguuguucagguuuucacaauauuccauuucugauguuauaauacucugcugugcugcugucuguccuuuuuucuguuauuguuuguuuggcuuucucuuucaucuaaaaggcuuuccucggaaagacccucaauggcacuuagagguugaguuggaggugggacuuacuacuguccuuuucuccugcuggcaugaguucaggccuuugucuguaaucuggcuucacagcccucugucauuauugcuucccgcuccagccuacagaauauucccuuuacacucugaaacuugagugccaccucacugaucuuuuccccugcccacuuccguguauccagugcccuuuugcccacugcuuccugugggugcccauucuguacacuaccugugaaaauggagucuccuagugcagucuuucuuccugcauggccagaacaguaccacuucuccagcucaccuccaucccaucugucccuuuuaugacacaacagaggagguacccuuuucacagguccagggcuuaccuuggcauuaucuuauuuccauuuucaaggaacuggcuucugccauuguacccaguauuuaaucucucucaauacuuaugugcugccaaccuaaaagucuaccaguuucucugcucuuugaacaguuaacuuuuugaaguuaucuuuuccucaccuuuuuuauucauucugagaaccguauauuuucugauuucuucucagccaaaucuuucaccuuuuauuaaaaaucaugaaguacuaugggcauauaaaaugugcuauguauuagcaggauuuuguaguagguaaagggguugacacagaaaccugauguuuuuuuucuguguaauaggucuaaggaaaaaacagauuccccaaaaguugccuuccaaucuuuacaugcagaauguggcacaugugugcccugucucagacuacacuaaauaaauacauauaagcauuuagaauugaaguuaagaaaaaaguugccuucuuuguaucaagcuguccuuucuucagcugcuuugcugccucuccucagagcagcuucuaaguugaacuucuuaugguucggugcuggguucccuucuccugaggggaucuugacccaguguaggacuuagaccacuccuauauggaggcaugcuucagauguauaugccagcccacuucccaugggcuccagagcccugaauuagcugcuccucucuuagguuccccagguggcucauuuuuggcuuuucacguacauguuucucucugugccauaccuaugggagucaguggugccaucugacacuagaccauacauucaagacccaagacuaaccuuucagucuucccaucaugucugucucccauuccaccagcucaaccaccccaccuaucuccaucuacugucacucccuaguuuuggaguuuggucauacuucuuucuggacuucauucucccauuucugccucaccacucugauuuuaaagugagacaucacugcuucucauuuuguucaggucaaauauagaugccucaguaugacauaccaaaugcugccaugucagacuccugccuugccuguggccauuucuugcuugauccuuagacuuuauggaguucauuaguguucugcuccuucaccuuggaucacuaauggauguuaggguuuguuggugucuucauauaccaccaccuacucugagcacguuccaauuuucaaccuaaauugucuuuuuaugagauggguucuuauuuuguagcccaacuuguccuggaacucauaauccuuuacuuuagaguauggugaguacaggaguggccacuggagguggucccuagauuccacuuucaguucugcucccuacugcaguuuuaguuauuaaguucaccuuuggcugauaaggcauuggcuuccggaaggcagggaccagacuauaugcucuaggguugggguaguagcuggcacaacuccuguggacuaaauguuucacuggaagauucuuagaagucagcugguuuuaaucuuaagucuauguauuagguuucagggcuugguuagacagacagccuggugugcacacauggcuugugaaauugaaaaccuugagcuugacagcauuaaagcuguuaguuuucuuuccugcaguucugugcauuuuguaaauauuaacauuucuauccugaccuggaagaauagagacuuaacuccuagaaauguuacuuggcuagagguggcaguauaggcuuguaauccuagugcguaggaggcugaggcaugccaguuguaaguuugagaccagccuggguuacaugguaagaucaucuccaaaaguuaagucuguaaaguuucagucugacuuuguagugugacugguccaaaacccugguguauauccagcucacguaguucauuuuagguaugggauuugucgcugcugguacuguuugaauuuuacuaguaacuauaauugccuuucuuuaccuacucguuacuauuuaugucauaggcgacaucuagauugagagagagaggcugugauggaugccuggcaggaaucgaaguccaacaacucuuuuguucucaaagugcagcaauuccugagcaccagcuaaaagagcuaaacauaaaaaucgacagugcuuugcagguaaguguguugucaauacuguuagaugcaagucaccaagggggaaguuggaccacucaaaaagguaacaguaauaauagguccucaagucucaauaacuguaggaaaauuuuaacauaauguauuuauuuuucaagaauuucauguauacauacaguguauucacuccacucuccuuaacuaacuccuuccagauccacuccccacaacuguagaaauguuaaguuccuauuuuugucagacuuugucauauucuaaucugcuacaugaucuugauucuuacaggcuuauaaaauagcuuuggaaagcuuaggccacugugaauaugcaaugaaagcuggcuuccaucuaaacccaaaggccauugaagcaaguuugcagguacacuuuucucuccagcggcucuaggacuuuaugggaguuguucacucagucguguggguaccaaaugcucaucacaugagcuguggaucaccuccacuccccuauucaaacuucuuccagggcugcugcagugaggcggaagcucagcagacagggcgaaggcagacacccccacagcccaugcagugugagcuccccacgguuccugugcagauaggaucgcacuuccugaagggggucuccuuuaaugagucggcugccgacaaucugaagcuuaagacgguaucuuucuguggauucccuggguuccaguaccugagcaugaacuuggaauagagcuguuacaggaaacucaagggcuuuugaagaauauacauuuaaaaacuaaaaugggaaucauggaaggaggcucuaacuuuucugaguacagugauggccaaauguaggccugugaugucucuccuuuuuuuguguaugaugcuagggguuuaacucugcuuuacauaugcaaagcagacacugagccacacuuuacccugggauaacauaagaagacauuuacugagcaaguuuuauuaauaauuuuguucagaucuuuaagaguuugagaguacaccaugagcuguugaugcuuaauaguugcugguggaguuuugagaauuaaguaauagaaaucuuagugcaguaauaauaaucaguuguaaagcaucaugggaaauacaacaaagugcuucucauacauuguuuuauuuaauuaagugucucauugaggcaugaguauucccccauuccaauuugacaaaggaacugaagcccaaaguaauaugccuggaccugaaacuuggccucucucagaacaaagagaguucuaggccagccaaggacacauagugagauccugccuccaaaaacuuuuuuuuuuccaaauggcaugaucugggugcucucagagugccucucuugagggugguugcauaaauaaccccuauaaguuuuguagccuugccagugucaagagucuugagaugugaacuguccucucucuugucaaucuguagcauaccauguuacagcucaucaaggaagcaggcugcuacaauggaaucacaccuagggaugaucuuccugugacugaaguccugaaucaggugugcccguccauguggcggggugccuguaagacugcugugcagcugcuguucggccaggcagggcuggugaguauaugugagagcaugagagcacaaugcaaaacacugcacagacugaggcaaaaggaagaguuggaggcuagccugagauacauaggaagacccugcucucucuucagaacugaaaguuuuguuguuuguuuguuuuaauaccuuuguaaccuguauuugcugggaaucuauuuacaaaauggugauguuguacgcuuuccucaucuuagaguaacaaacacauuaguacugccugugugggccuugacuggccugacugaucugcagcaacacuggaguuuccuguugcucaagugagcugggcugguggccuccuaucucaguccucuguacucugccuguucucugaccucucuaaauguggcuuguucuucucaccuuuacaggucagccccuguaaaggugagcuagggccccaacccaaucauuuccuauccuagcucucugcccauuaccuuuuguacaagaaaguggcaguaucugcuucagguaaaaaucuaucuuuuaccugucagagaaaagggaaggaaaauaaaaacuaaagaaacuucaggugaagucagaccagguccagagcucagcaucugugaucacuguuagcuuuuauugucugccaugucgacccaaguagcuuguauguacuagauucugccucauauucaugguuugagagugagacccugucuaaaaaauaaauaaauaaaaaacuuuuuuauagguacucuuuguagucugauuucugcuuuauucaugaaaaaaaaacagauuaaaauugucuuugucccuguuucaugcagauuacuucagagacaguguacagaccugggcuccauuuccuugaagauucauauagaaagaaaagcaagaaacaagggucacucugcuaaccuauaauagagagacugagccaguuuccuggagaccaggacugugucagcugaagcuggcacuauggcaaugugugcuccagaacacagaguacagcaggagaaggcaguuuugagaaaucaguuuaagcuaagggguggggggaguguaauuauacgcagaauccaggaacuuuuuacuucccuaccauugaugguagggccuuuguuguagcugacaaaggcguuuaggaccauagccauaggaggaggagagaggaaacaccugucagguccaacaaaggcuguuccuuggacaggaaauguuucucaaagguccagccauaagaacccuguuuauuuauaaccguggaaaugaacacacuggaagcuguguuuggaaucaugaaaaguaccuaugcguagcuuaacuccuuccaaaauggagauguguuuuucuacuagugagccauauccccagcccuugaauuuguagucuuucugccucacccuuguaaggagcuuagaaaacaggucugcaucacugggcccagcuugguucaguuucugacaucuuuuuuuucuuucacguauauaacguuuaaaaaaacaaaaacacuaaaauagcuguguaguggugcauaccuuuaaucucagcauucaggagguagaggcagaggcagaggcagguggauccccgaauuugaggccagccugguuuauugagcaaggucuaggacagccauagcuauacagagaaacacugucuugaaaagaucaaaacaagaacaaacuccuaaaauaaaagaugcaucaacucucuucccuuucucuuucucuuauccuucacuuucuuuuucucuuuuuuccaguccuuucccauuuaaaguuuuaucuuaggacuuuauuuuuaaguuaaauuuuguguguguguauuaucuuuggaggccaaaugagagcauuggaucuccuggaacuagaguugcagguggcagugagcaagcagccugauauguguguugggacucaaguccucugaaagaacaggaaguacucucaacauaugagccagcucuccagacuuauuuauuucuucauuuugagacagggucacauauugcacaggcugacugcaaacucauccaucugccauggccucacagguguugggaugacagaaauauacaaccacauuuaucuugaauaauuuguaauuagaacaacuacaguguagaaaaugccuacaaaaucgaguagaccccacaauuagaguuugguuucuguguguuugcgcaucauugcuugcuguuaucucugggggucucacuggucucacugcagugcagaugugcugcagacaguucugccgguuacugagugacuaauacgcuuauguauuugaauguuugauacugaaaucucucugaacugcgguugucuuuguuucuuuucuaggugguuguugacacagcacagauugaaaauaaagaagccuaugcaccccagaucagucuugaagguuccagaauugugguucaagucccauccacaugguaacaugacucuuuuuaauagaagccuaaacucugaaggcuguguaucuuucacaucuuugcaaccugacauaguagugcuugcuaccugugcacuucucagguagcagggcgguguuggagucuguuuggcuuggcuaugauggugaaucuaagaccucugagaaagagcuccuuugaccacaggcaacuggcauauaaguaauagaccauaaugagcaguguuaucuucuuacugaagccacaggguuuagugucuuuugcucucacugagucacccuuuauuuuucuaaagcugaggagagacuagaauuuucucucaagucuaucuuuucaguuacaacccugauaagcuugagcuuauaucauuauauauucauucucauuguaaaucuggggacaaacaaaacuguuuuuuguuauauuuguaacacuucaaaagauaaaggguuauucauaguuuguuuucuaagacaaaagcuccuauaaacaaggaagcaggccagggauaugaccucauacaugaggaaagaagacacugcacaaggagaugagaaaagguguaaccucacagugaucacagcaaguaaagggaaagaucaaaagauucauuuugcccuaaaauaauuaguuucacuuagauagcaguaagggauauuggcaaguacugguuugagcuauauuacagaaaaacaggccaagagacuuuuggauugagaagcaaccacacaagguuuuuggagaaaaguguauacagaaaaugaagcugaagcugaauuguuuuuuuaauauauuuauguggagggcaguggacaccuugcaggaagaguccauucucucccucugucuuuguagauucuggggacuggauucaggucauuagauuugcuggcaaaugccuuuacuggcugagucaucuuuuuaacccucuaauaacucucagugucugucugucugucuaucuugagauggugucucacguauuccaggcuuguuuaaacuugcuuuguagugaagggcaaccuuguagcuaaggauagccuugaacuucugauccuccugcuuccaccuccuaaguguugggauuauagguaugcauugccaagcucaguuuuacaggaugcuggggaccaaacccaggcauucugggccagcacucugcaauuugaauuccuaauuuaauucucauucaaaaguuuuuauuauuguuguugagacagagucuuacauaaacauaggguggccuaaaagcccacuguguaucuaaacaugaccuugaacuccugauucuuuugccuccaccucuugaacugggauuaccuauguauguuaucauaccuagcucauuggaaaacauugaccuuauauggauucucauuuugagaaaaacagacauaacuuauauagaauugggugaucauaaacagcuucuacaaagcuaguuuauuuucuaccuugggucagaggugauuggcagcuccaagucuuuaaagccugguuucucaaacuuugaagguagcagaccccugagagccagcugaagauggagauuucugacacucaggggaugcuggcaaucugcaugcuuaauaagcaccucagguaauccuggugcagguggccagaggccacacuugggaaaacacagucugcaugugggaaaggcaugaggccugcaggcugagaacaaaacugacagaacacucacugccugugugguucauuuccuuuguaauuuacuguaccuucugaaauggcaucuguuacugcuugcaaaggcucccucugcugucugcuuuuuguaaugauaaaaauugguuuuugcuuugagguuuucuuuuguuuuguuuuuucucuuggaaagccaagaucaagugucugacaugaaaugcuagagaccagaaguauuuccgauuccagccguuuugguuuuguuuugaaaguauuugcccauggguaugaugagguauugugagaaugaaguguaaauacaugaucaccuguguuucagacugcugugcccuaggccagugcugguuuugcauaguauuacauaguauuuguggugcucugaauuuucacugugaccuugcacuugagaucaucuguggaauucuucucuuguguugucacuguagcaucagaaaguuuguauuuugaacauuuccuguuuuuggguuagagauguugggccuguacaaguaugugcucauugggaaugcugaagugggaguguuacuucauuuuuaggaaaauaauugucagcaaacuaaucaagaguuuauucagccaaccauggguguacaugucugucuugcugucccuuaggaggcugacagaggauccuuaagcuuacaccauuauggguuacagaaacaagacacccuucccccugugucugucucucacaaacaugcacauauuuuuuaaaagacuuauuuauuuauggugggaaaaaaaguguauauuuagaauuagccaucuggacucaguuuagaugaccccaaucuuguuggcaacaucuagagcaucauaaucaagagcuaagcgaacauacgccuucuucucucugucaggccuugucaggguauggacuuuggccacaucaaugucauagaguuucuucacggccucuuugaucuggugcuugauggccuugacauccacaaugaacacaagcauguuguaguccuuuauuuucuucauggcugacucgguggucagugggaauuugaugauagcacaguggucaagcuuguuucuucugggugcacuauuucgaggauauuuuggcugccuuuggagccacagggucuuggguccgcugaaaggugggugacuuucugaucuuuuuuuguggcuauggucgccuuuuagcaccaccuucuuagcucucaaggcuuuggcuuugggaggggcaggagcuuccuucuucgcuuucgguaccaucuuggugaaaaggguggcuuuuauugcauacacucugugcuguacagauggcugugagccaucaugugguuguuggaaauugaacucaggaccuccgcucucucuggcccaaagauuuuauuuuuuauuauuauauguaaguacuguagcugucuuuagacacaccagaagagggcguuguaucucacuacagaugguuaugagccaccuuaugguugcugggauucgaacucaggaccuucggaagagcagucagugcucuuaccugcugagccaucucaccagaccaacacauacauguguuauuacauuauccacacaugccaauauaugacauaacagcaggaggaugacuuuuggaugaugaguggggaguuacagaagcaaauacagugagcaaagcacaguggcagggguguauggcaugucauagcgcagcaugggccagcaaacaagaucaauguguaaagcaccuaaugagugagggggaagaucuacuuuaucgccuguacccaugugagaguggccaaggaccaacuccacauaaguguguagcacagagaacacaccuuuuuuuuuuuuuuuuuuuuuuaauggaacauggcuguagggguggaaagguggcucagugguuaagagcacuagcugcucuuccagaggaccuagguucaauucccagcacccacaaggcagcucauggcugucuuuagcuccaggauaccauacccucacauagacauaugugcaggcaaaacaccaaugcacauaaaacaaaaaaagaaagaagaaggaacccuggcuggcaagauggcucaacuauuaagaagacuuacuguagaggaccugaguuuaauucccacacugaguaguucauagccaucuguaauucuauuccagggaaucuaaugcuucuggucuccuuagacacugauagucaccuguacagacucacacacauucauaauuaaaaaaaauaaagccaggcguagugguguagccuuuaaucuuagcacucagaagaagaagagauaagagaccuugugaguuugaggucagccaggacuauguaaugcgaucuuaucucaaauaauaagaauaaauaauaagucuuaagaauuauuuuguaugaaaguugguuuuagggggcuggugagauggcucaguggguaagagcacccgacugcucuucugaagguccagaguucaaaucccagcaaccacauggugguucauaaccauccguaacaagaucugacucccucuucuggugugucugaagacagcuacaguguacuuacauauaauaauaaauaaaucuuuaaaaaaaaaacuuuucaugauucuuaaaaaaaaaaaaaagaaaguugguuuuaaaaaguuaauccuggggcuggagagauggcucagcgguuaagagcacugacugcucuucugaagguccugaguucaauuccuggcaaccacaugauggcucacaaccauccauaaugagaucuggcacccucuucuggagugucugaagacagcuacaguguacuuacauauaauaaauaaauaaaucuuuaaaaaaaaaaaaagaaaaaaaaguuaaucccaguacucaggaauuaagggcaggaggaccaguuguguagcaaguuuaaggccaaccuggacuacaugagcuucuaacagaacaaacaaaacccugugagaugacuaaacagacgcuugaccccaagccugauaaguugagcguaauucuugggacccauaugguggaaggaggaaaccagcuccuacacauucuccucacauggcccuuugcacucguguccaucuccacacacacacacagaaugcacacaugcacacacacaguaaauguucaaacaaacaaucuuauauaaaggccucuaagccugacagccucagcucaauuccuggagcccauugguagaaggaaagagccggcuccugauaguagccuucuaaccucuguuuggguccauccauuuauacucauauacacacaauaagugacguaaauguauaaagccagggaugguggagcacagcuuuaaucccagcacuugggaggcacaaguaggcaaaucucuugaguuuggagucacccuuguguagaguuaguuccaggacaaccauggcuacacagagaaacccugucuuguagggucucacugaagcugcaggauauccauucagcuagagugaccuacuaucuaaugagcuucagggaccgagcugccuucauccccagccacccuaacagaagcugcaguuauaucccugcucugcuuuuuucagggcuucugggcauuccaagucagacucacucacaugcacacacauauugguguaugcacaaguguuuuccucuuacaauggaacguuuagcuuacuuuagauguguucuuauacagccaugcugcccuguaugcaucauauguugccuaaguauucucuuuauuagagcuugguccuacugagaaacccgugguaccucugucuccucuccuuuugcagaggacuugguguacucacuagguugcuugguuguuggacucccuaguuuuuuuuucuuuguugcuuuggcuguccuaugauaccuauguauaccagaauagucuuaaacucacagagaucuuccugcugggacuaaaagacacaugcaccaccacacccagcacucccgagcucuuuuugggugcuagaaguacuuaaguuguagugucuuucauaaugcuuugaacaccuuuucagagaaguauuggucaggacuaacaugacuugguuugugucuaggugcuuaaaggaagauccugcuaccaugucccugcugcagaggagccuggaucccgagaagacccuaggucugguggaugugcuuuacacagccgugcuagaccuaaaccgcuggagaacagggagguuggugucuccugcacuuacaugagggagcuauacauaugguuugcguuuuagauccauagccaggaagcaguguagccacauacaauccaacucauguaagcuccugccucugagaguauguggguaaauaaagcaagauagagaacuuuuuaguaacuuuauuucaagaugggucagacaugcagaugagauacaagaaguucuucauuauccacauuucuuaaccuguuaauacuuggccuuccuuguuuuaaucauggaguauggucauggagagaacucuuaacccaguucucauucccagacgcaaaagcagagaaaugcuuacaacauuuucuuguauucuucaugaaguuuauuugcauguagaaauagcugaguuacaaauguucucugugaguugcucguuuuaacacuggcagaaaucuuaaacauuuacccaugcccucaucucuuuuccuuuccucuccugacagacuaucuuauuuguaccucaggguggccuuaaacuuacuauguaguccaaauugucuugaacuuuugcaagcauuuugucucaacuccuagcgauaagaagucaucacacaaagccaggcgugguggugcacgccuuuaaucccagcacucuggagucagaggcaggaagauuucugaguucgaggccagccuggucuacaaagugaguuccaggacagccagggcuauacagagaaacccugucuugggggggaaaaaaaaaaagaagucaucacacucagcuuucuccuccuaaggcgaguucagugcaguaucuugucaagaguuacagcagccagcugccuugucuccugauucauggcauuuuuuauaucuguuguagaaagaguauucagggcccaguguggugacaaauaccuuuaauuccagcacucagaggcaaacugaucucuaaauucaaggucaacaggccuggucuaugugguuuguuucagaaaaccaaaagaaagaaaagaggguggggaagaguacucagaaauucauggaaggaacagcugugcaugccacagcagcaaugcagaguggccauaagccuccuccccaccaccccuaccauuugcauguauccauuguuucucugcugaaucucuuuguaccaccacacuagccaggcuuugcucuccuguccugcaguuagcuuucauucagcuccagaugcuacuguuguacagccuugagugagacacugaguagucauuuauguauagagcacaugaacccaggaccugccugaccaaguuuaccuucuguugcucugauaaauauagcacuaucaaaagcaacuagggggggacuggagagauggcucagcgguuaagagcacugacugcucuaccagagguccugaguucaauuuuccgcaaccacaugguggcucaaaaccaucuguaaugggauccgaugcccucuucugcuguaucuguaaacaucuacaguguuuacauauacaguguaaacauauacaguguauacauauauguguguguauauguaugucuauauauguauguguguguguauauauauauauauauauacauacucauauguguguguauguauguauauguguguguguguguguauguauguauguauauauauaucuuuaaaaaacaaaaaaacccaaauggggaaagggguuguuuggcuuacagauccuagaauccaucaccuagccaaggcaagaaccuggaggcaggagcguucuuauacaacccagaaucacuggcccagggguggcacugcucacaguggcaugugcccucaucaaucaaagauaauaggauugccucucaauuccucuccaauuccaagauaauuagcauguaucagguugacaaaaacaaacuuuuaaaaacaccauccaagacuccaaacucaggcaaguucuugccggucuccacucuuuccucccugucuccuuguagcuuacuugcucacugcagugcugggacuuaaaacaccaugaugccaguaaucaaugucuaguaaucaauaguauccauccucaggcuagcaaucaauacaaaaaagucuuguucuccaacuuuuucucuuguuguuuuuuuuuccccuguugaaauagggaacaagcuuuacccuguauacagauccagcugcaaagggauaucugcgauuuugggaaucaggcugaccugccuucuggaaauggaagcaaauccucgggacugcagaagacuuucuccaaacugacaucccgguucacaaagaaagugucaugcaccaacucuggcagcacacacuauuccaaaaacaucuucacagcuggguguucagaggaaagggccaaaaugaugggcaauaauauugauacacgguuacagagcauuuugaacauugguaacuucccuaggacuacagacccuucacagucgucucagaauuccaguaauccaauggucaauggcuuucuccuggagagacgugagaacuuccugcauggggaugauggcaaggaugagaagggcaugaacuuacccacugaucaggaaaugcaggaagugauagauuuucucucaggcuuuaacaugggccagucccaucagggguccccacuggugacaaggcguaacucuacugccacugccauggugacugaacagaagacaggaaccaugcaaccacagcagccaucacugccauuggcuccuccacuacggccaccccaggcuggagcacacacgccucuggcagcccagcaaggucuggcuccucagcagcagucuccaaagcagcagcagccccaaguccaguacuaccagcaccugcugcaacccauuggaucacagcagacuccaccucagccucgggcgccugcgaaauggguacauggcucaucucagcacccaucacagcccauggcagcgggucugucuccucuuggucaguggccuggcauaucugaucucagcucugacuuguacagcuugggucuagugagcagcuauauggacaauaugaugucagaaguuuugggacagaagccccagggaccuagaaauaacaccuggccaaaccgugaccaaagugauggagucuuuggaaugcugggagagauuuugccuuuugauccugcagguaggugaggccuucccacuguucaccccauuaaacguucaauacagucacugaggaauucuuagaggccuauuuaucauagccuuauaagguauaguaaguaguacauggguauacuaguguguucuaguacauaccuauacccagccccuaagcguaugcuagcacucucauugucuucugcaaggagguguaacaagaaugggaagcagauuaagaaagugucugagaaggaagcaccuuaauccaauuuuuuuacuuuuugugguauugaguauugaauccagggcauccucacauguguuaagcaagcauuccaccaaugaaccugccuuagucucucccucccuuucuuuuuaguuagaaagucucacuaauuugucagauugaucucuaacuucuucucuagccacagucaggcuuugaauuugggacuguggggugaaauauggcuuacuugcucaagguugacuugaguggcagugauauguaaccucuaucuggcuuugguaaauuccaugauauaguugguuaaaaaucguaugauucucuaaaguuauuaaauacuucaaauucauaguagcaagacauuagaaaacaguuuaguuuguggagaugggugggcuguuaugagcaucucuguguuuaguuugcaaaacucacaccugucaguucacacaccccuguaacuucagcuccugaggagccaguacuauuuauuggcuagcuuccagacacccacaaggacaugcacauauacacacauuucauuuuuuaaaaaaauuuuuauauguaugaauguuuugucuguauauaugugugugcuccauguacaugccugguaccuuuaaaggucagaauuagggguucagauucccuggaacuggaguuaugaaugacugugagccaccaccugggugcuuagaagcaaaccuggauccucuacaaaaucaacaaauauucuuaaccacaaauccucucugggggcuggugagauggcucaguggguaagagcacugacugcucuuccaaagguccugaguucaaaucacagcaaccacaugguggcucacaaccauccauagugagaucugacgcccucuucuggugagucuaaagacagcuacaggauacuuacauauaguguuugcguuugguggcugauuaugggauggaucccugggugggcagugucuggaugguccuuccuucugucucagcuccaaacuuugucucuguaacuccuucaauggguauuuuguucccuauucuaaggaggaaugaaauauccacacuuuggucuuccuucuucuugauuuucauguguuuuacaaauuguaucuugcguauuuuaaguuucugggcuaauauccacuuaucagugagugcauaucauguguguucuuuugugauuggguuaccucacacaggaugauauccauuugccuaagaauuucauaaauucauuguuuuuaauagcuugaguaguacuccauuguguaaaugugcuacauuuuuuguauccauuccucuguugagggacauuugaguucuuuucagcuucuuuuauguuuauuuuucauguuuugcuuuaaagaggcugucacuauauagccuuggcuaguuuagaacuuacugugggccagucuggacuugaacucacaaaucuaccugccucagccuucuaauugcugggauuuaaagguauacacuacccuguguggccuagauuuuuauguauaugaauguguaccacaugagugcauaggaguuauggaugguugugagccaucauuugggugcugaaaauugaacccaggcauaaugcaagagcaaguagucuucacugccgagccuuguuuguguuuaaaauuuagguuuuuuuuucuagacagcguuucucuguauaacccuggcuguucaggaacucacuuuguaaaccaggcuggccuugaacucagaaauccaccugccucugccucccaagugcugggauuaaaggugugcacuaccaccaccauaaaaauguagcuuugggggacuagauagaugguucagugguuaggagcacugacugcucuuccaaaggaucuggguucaauucccaauacucacauggcagcucacaacugucuauaaauccaauaucugauacccucacacagacauacaugcaggcaaaacaccaauguacauaaaaaacaaguuagguuuggguucacugagaguugcaggauagucugugcuauauaguugguuuaugggcacauagcaagacuuuuucucaaaaagcgaaaguagugguggauaguucagacuuuuguucuuugucuucuuuugacauccagccccugccuaugccagccccaaccuuagaccugugugcuauaaacccaguuucaguucagggaguggccauagccugcagccaaccaaugggacaguuacuugcuagguucucaccacuuuacuguauguaugaccaguucauccucagaggagaggaaaggaagaagucgauuuggccuuaaauccugccuuuuccuuugucucaacacagugggcucagacccagaauucgcacgcuauguggcaggagugagccaggcaaugcagcagaagcggcaagcucaacauggccgccggccaggcaacccccguggcaacuggccgcccauggaagacgcucaucggaccuggccuuugccagaguucuucacagaagggugaguucugccuagagcaaggaagccaaauuugggaucuggaugccucuuacggccuugcuuugaggaaggcucacuggccuucauucacguuuccugagcauugaaaguguaaugugcuaaaucuugguggguucagauucuaauauaggauguuaagggguagaauguauccaccuaaacauaccccugcaaugaaugagugacuuaagacagccuauuauaaaagcaauacacauauuauaagauuuuaaacauauuucucauauuaaaauauuuuauuucuaaaauuauaaauaugggggcuaaaauaagauuauauacuauauacauauauguguacuaacuuaaauaaaaaaguauaaauacuaacuuaugaauagagagagagagaaagagagagagagaggagaaacaaaaagagccuuucccgaguggagcagggauuuuuuuuuuuuuuuuuuuuuuuuuuuuuuuggugguuuuuugagacaggguuucucuguauagcccuggcuguccuggaacucacuuuguagaccaggcuggccuugaacucagaaaucugccugccucugccucccgagugcugggauuagaggugugcgccaccacaccuggcuuggagcagggaucuuauuugacagaguuucauguggucuuucugguaaagggagccuugguauaaaacccacuagguaucagaaugcugcuguuauuccacagaaagcaaagucggcuugguguguguagcuuagcaguagcauguauaccuagcgugugcaagacccugagcacaaaccccagugcagcagaggccaaggcacaagcuucagcucuaguguaucaaaaaacuguaggcagggcauggcaguacacaccuguccucagccugugggaggcaggcgcacaacaguguccuguguuuagguuaguaagggcuacaguuggaggcuagccugagcuaccuagagaaaccuaauuucaggaaaccaagcaaacaaaccaaaaaccccaggcuggagaggcggcuggaugacuuaagagcccuuacuauaccuuugcagaggacacacgugauccccagcacccacaugguggcucauagaugguuuuaacuccuguucaggccaggcagugauggugcuuccuuuuagugucagcacuugggagguagaggcaggcauaucuugaguuugaaaccagccuggccuacagagccaguuccaggauauccagggcuacacaaaguaacccugucucaaaacaaaacaaaaaaaccguccaaugcaucagggaguugaccccccacuucuagccucugagggcaccugcacauagggacacacauauacauaaaaacuuaagucuuugagagaauuaugaaucugugucucagauuaccuccugguuaguaaguauggagagugaaagagcauccccaauuuguuucucucuauaaucagucacgggcuucagagggauaaaaaguagugacucuuucuuuugaggagaaaggaagaaaaugucacuugugguagagagaggcagcagaggcugugggaggucugaccaauuucucugcauucucagggacagcuugcacagcggcuggucaggagcucagggagacucggccaguuccagugaugagaccucuucagccaauggggacagucuguucuccauguuuucagggccugaccuuguugcugcuguuaaacagagaagguaacgaaauugcuaaaccaaggauuggagagccaauguuccgccucuggggaagccagaagccccguuguuugcccugugaccaaccgaacaaaggcuguucuggaggcaucuucaaaaggugucuuccaagaagaaaaucugugcugggcuagugggacaccggucuuaggcugugugagaaaaggaagucaccucuguugggucuguguccauacacaacaguucuggcucagaucugcuguaucuugucccuuuuacucaucaguguaaagcaagcaugcuuuuuuuucuuuuuuuagaauauuuuauuuuugaaaguuucauacguguauacaauauauauugaucauauccaucacaaaguauuuuuuuuaaaucccaaacauaccgagugcauguuaaacacuuugaguaacuauugauuaaauuaauaaaaagcuaaaggggguuaacuuagcugugcaaacagccagugccaucuccaugcuggcugcagcucccacccacuuccuauacaggcuuuacagacagggaugcugccucccaggucauacugacccugguguacccaagggcucaacaccuagacuggggaccuagagaccagagccaagcacagagauuaacucugucccauacaaugaugccaaguggucaaugcccugagcucuugauucuuucaggaaacacagcaguggagagcaggagaccagcacacugcccucaccaccucuccugaccacaguggaggacgugaaccagguauugugagcuagcucaugguaaagaccuuggaucucaaagucauaaggguugucucugugcugaauuauuuucucgugauuuuugucuaaauggggagauauggucaccuuagcugacccagccauguuguagaggaagcucugagacuguguuaauaugagucacacagcacacucacuguucagaucaguuaaaguaagggcuguggcuguaugaguggugggaggcccuguaaauauugaacuaugaaaguuguacacacauguaaguguauaugugcagaaacacaaguucaucuccacaguugggcugcaagaaugcuguguggauugugcaggcauugagcacugauaucacuguaccaagcugugggcagcuguucucacucuguccacuagguagaaagaguuggaguucugggaguuaggugggcuggcacacaaugaaaacucaaccaaaaccucuaaaaccucuaaaccuaaaaucucucuucuguuucccaggauaacaaaaccaaaacguggccacccaaagcaccauggcagcacccuuccccgaugcccagcacgcugcccagcccagcugcaccacucuaugcagucgccaguccuggcagccaguggaacgacaccgugcagaugcugcaguccccugugugggcugcagccaaugacugcaauaccaccuccuucaccuauguucagacaccaccacagcccccaccuccaccagcacauaaggcagcacccaagggcuucaaggccuucccugggaaggcugaacguaggccagccuauuugccccaguacugacuacagcuagccugcugcccaucaaagcuguuggggcaacuguccccaaggcuaacuagcugauacuagcccccagaaggaccaguacacccugucccagggacagaaauauuccuugggucugaggugauuggcagcuccaagucuuuaaagccugguuucucaaacuuugaagguagcagaccccugagagccagcugaagauggagauuucugacacucaggggaugcuggcaaucugcaugcuuaauaagcaccucagguaauccuggugcagguggccagaggccacacuugggaaaacacagucugaagguaguccugcaugugggaaaggcaugaggccugcaggcugagaacaaaacugaccauucuuugaaacucuucucuuuaacacacugagugggacccacacccaucacuaauuuuauagauauuuuucauguaggcuuucgguuaaaacgucuccugccuaaaaugcaguggcuaucuuaagauccagguacacuggcugaagguuaguuagcucagcacugucuucauuuaagcuuauauaagaugcuagugaucagaagcaaccaccuggcuucccaugggucaguagcuccucugaagcacccaggggugcaggcucauguaauguacaagagcgggauugggcaacugcugucaggcauauucuggccucccagggggugcagcuggugcaugcugagugcaccugcugcccucacuuccuuccaccaugaccagggcagcaccagcaccacgcuccucuacggaaggaacuguggaggggagggguugcaccaagacccccacacucagaaccacagugacauugugagcugacucagagacaaaggaauuaugauguagacaggaauucaaaaucuuuguuuagucaccaacaacaccucacuuuuaguuaaugugugccauuaaacagaugacacuccauggauuuggggauauuuuccagcuagaauggauccagaauugaauggugcuuaaauugagaaauaauaaauauaucuauauagaguagacauuucccacuauauauuaauugagguugcagaagguucuuuauauaaaacuuauuuaaaauuuucauauuucaucuuugaaaaugucuaauugagaaaaauccaugauauuuucugguaugaaaguuugacaguauuaauuuuuuuauauuuucuuaaaucauuaaaccauuuuaauauauguuaacuacuaauaaaugguuuauucuuucuaacuccauguaagcuuuuccaaugaagauuguaauaacacauuuuuguucucauuuuucuacagauaaauuuauauuuaaaaauaccaaaaaaaaaaaucccuauguauacacaccacacacauacacacacacagacacacauucacuuauaagaaaauuauagaggaccuguagggugagcccagccaccugcguuuuuaguacugugucuccaggcugccugaggccucagcuguugucauucgugcugugugggggugacauuucugccuguagugaagauccuucucaguggguucggaauauucaccucaccauguuuacagagaacuauuuuguacauagaguuuuccaggcacguacuuugcaccagcccugcguggcuguugucuguguuagcugucacagugugcacacuaaucuguucagaguuccuuguggcuguuugacuuguaaaaacuguguauuuccuucaguaauguguccacagugcuguguuuccaguucuagucuucugcaguacucucauuuucauagugccucccugaagaccucaccuugggccaaggucacuccucggugccacagcacaggugacacugcuaauugucaucucuggucugucuuucucuauuaaggaagauauuugucuccacggcugugugaccgugugaaucagcuuguguagucuccacaugggugcuguucgaagcaccaccuugcucuaaacacuggugauuccaggugcugcgcuuggcagaggugucuugccaaagcgcauguaugcgugugaguguguccucagcacggccaagcauggcugccuugcucggcauuagcaggacaucaugugaauaguugugaccuuccaaaacuggaacucuacauuuuguaucuuacuuuuaaagcuccuauaaguaaaauaacuuggcuuuauuaaaauauacauuuaauaauacucuguaucuuuuuuaaauuaauugcagcagauauguggcucucagcagaacugugcaggagcuggauuaccugccccaacagccuuucuaaggaacaaacguaggaaugaggauuuucuggccauuuucccucagcaaacaucuguaaucccagcacucaggaggcugaggcaggaagccaggcauaaugguacaugccuguaauccuggcaguuuggagauagaagauuaguucaagguucuuguggcuacauaauucaaggcuagccuggacuacauaagacccugucugaaaacaaaacuacggugauuggguuguag

SEQ ID NO: 3717 - RNA, 3414 nt, Mus musculus
caaggcuuacuccuaacccuucccaacacagauuucuuauuguuucuauccauauaaauaggaaugugagguagugcuuguuugaguuccugugcauggagccagaggacagcuugauggauucaaugcccugcuguaacgugucaauccgaggggucaaacccaggucaucaggcuuggaggcaacaagugccuuuacccgcugagccauuuugccacccucacgguguaugugucucucugucuccaucuccuucucugacaccccuucuugcuguguagcccuggcuggccuagaacucacuacguagacaaguaauagugaccucaaaccugaaacagauccaucugccucucucucgagggccgugguuacaaaguguggggcuccccuguguuaucaccaucuggcucagaagugcuugauucucauuguagugcauuagaugugugaacagacccgaccaccaacuccacggacagugcugcacuggguaaugucuagcuucuaguaauuaaaauauuaguggugcagcccguuccuaaacuagagaaggcuagaugggaagaaaaagcugacuuagagcccuugaggacuugagaagucuagcuguguguauuccauauuaguuaucuaucuucagucauugguuucuaaucccgaagagccagaacacccugagagugcaggauuaacucugagucugaccuucucccguguaauaucacuccaacugucaucuguccccaggguagcagugagcuaggucuugcccuagaaacacauucaguaaguguaguaugguauucuuguuucuccuucgaaaacaaaacaaaagcuuuugagagagacauggugacacgugccuuuaaucccaacacucaggaggcagaggcagacagaucucugaguuugaggccagccuggucuacauggugaguuccaggacagcccaggguaaacaguaagaccaucucaaaaaaagaaacuauugaaugacgugauccuuuucacuuugggucaugacugcccacccaugaacacccucaccuugugaaauccauugcccuccacucccuuuuuuuuaaaaauuagguacguguuucuuuuuauuugggggauagauccagacuggcauugaaauuaagacgcuggccucccccuucuaagcacggagcucacagguguauaccaccaccacaccgagcuccuuucugccuaugggaugucuuuggcuucuggcugggaguccacaagaccaucauucuuguggccaugguguguuccucuggaagaauuccaagcagagggaagaggcccaggagcagagugcaaaacaccagauccaagcguugaaggagacuuaggaaguggagccucucaagaugcguccaguucuccaacguuaaguauacgggugaaagcagugcugccugccaaggcuuaagacucagugcccauggcuuccaugcugggguggggaggacuggcuacauaagcaccuucugccugccuuacacccaaaugccacacuuccagcaguaaccacaagcaaaccacauuguuugugcagacaguguagaaacagugagccauucuuagcaguucuggaauuggggcaugggaggggcuaucuggcaguacacacuuccagauggcgggcaagaggaagacucgugagaguccuaaagccacaggcaguucgaccugcugcgauaccucagcacaucacugcacacccugacuuugucccuuguccagugaucuuuuccgcucauccccuccuauguaacaccauggacacaccuguccauccaccccgucugcaguagcucugaguguuggcugucacucacuuugggcuucagcugguuggugggaggugaggcaccaggaauguaacuccgggucugggaucuuucuuucucgacuuuaugagcuucuuccuuucuguuccucccugccagucuccagccagcccagacaucauaauccaucauuuauauugcagauacucugaagucccacuugucuauacagucacucuucaccuagaagggaaucauaguugaaggguggggggugcagcuuaaugguagagcacuugccuagugugcacaagacccucccugguuucagcgcccagcaacaaauaguugggaaauggauacuacuguaauaugagucuuccucuccugggccuggacauggccagcaacacauauuuguguaaucaccucucugcagacagcaaguggucugaccagcgacuucaaagagaacugaaagcuaucugacagagacugcccccacaaucuaaaccacccuugucugccuccggccuucccuggggacccuacuuuaaaaagaccugucaacaguuuugccugugcccuggcacccuauccaccucccagauuuaaauuacagacucacucagcuucuuucgugagaagccuuuccauuauuaguuaauugcugugcuaguguacuauuuuauguuguauacagaauuacuuucauacuguaguagcuacacggcacauuugccuuuaugcuuuuuuggggggacacugggguuugagcucaaucuugcacuuagcagccagguccuuuaccacugugcuucacucccagacuauuuuagaaagggucccacuauguagccuuagcugacuuuagacuuagaggucugccugccuccaucucccaagugguguagcucacaacccccuguaacuacagcuccaaagguccuggugcucgcuccuggacucagcaggcacucaggcaugugucacacagacauacacacacacacacacacacacacacacaccaugaauuuuaaaaaaugguuuuuaagauuugugugccgggcgugguggcgcacgccuuuaaucccagcacuugggaggcagaggcagguggauuucugaguucgaggccagccuagucuacagaaugaguuccaggacagccagggcuacacagagaaacccugucucaaaaaacaaaaaaaaaaaaaaaaacaaaaaaaaaaaaaaagauuuguuuugugugugagaauguuuuaucugcauguguauaugugcacuacaugugugccuggggcccauggaguugagaacaagguguuagauccccuggaacuggaguuauacacaguugugagcugccaugugggugcugggaaucaaaucugaguccucagaagugcuuuuauucacugaaccaucucuuuaguucccaaaaucaaaaucuuuaaaaauuguauuuuuuaaaaacuggacauggugguacgugcuuugaaugaggaagcagaggcagguggcugucuaugaucuggaagacagcuuguuuugcauaggaaguuccaggccagccacggauacauagugaaacccugucua

SEQ ID NO: 3718 - RNA, 6312 nt, Mus musculus
cucugaaguguguacaagagucccggaucaucaaaacuuaaacuuuccuuucuaccaggguuccagaaaauuggcccauggggacagcaagcaagcauuuuaacgcgcacccuucgguugcauaagaauuccggcauaacagguaacaaucacagaggagacaaacgggaugcgaucgacuggacgguacgaaacggccuuucgagaucacaagucugcggcgcaaacccaaaguuuggagcacacuccuuaggaguucacucgacaaccgucgccaccgacccagacgaagaacgcugagaaaaugggugcccgaggaaucaacacauccgcauucaucucgagguaggcgucaagauucuucgacuccuccggcuuuguucggcgcuuccgaagaaggaacgaccgaauuucggucuuggaagccgcgaaccuggguguguucuccggcugguucccgggacuuuagcaucgccccgccccgggcgccgcgcacucguuccccggauggaaggcgcggagcuucgggggaaaggaagcagcccggggagcccggggaggccgcagcccggcccuugucgcuugggggccgggagggagcgaggcccgugaggaccgcagagggagaagagcgcgagggcggcggggcgcucuacccgcgccccccaaaaccccgaggcccgccccgccguaccuuuggcgagggcuaccguggaguucucggugucgaugguguagaggaugcccucguagcggaucuccgccuuggagaugaggcugaucuugcugccgauguaaggggugcccccgcucauggcgccgccgccgucgcccgccgcucgcacucagucagaucccgcgcugcgcccgccgcuccgcccgcccgcccgcucgcucgcucccuccgucggcgccucacagcagccgccucagaaccaacauggcggccgcgccggcuccgcuuacccucccccagccucccgcccucaaaccgcggcgcggcggcggcggcggcggcagcagcggcggcggcgcagggcaugccgggagggcgaggcggcgugcuuucucgcgagacucgccgagcucacggacggucccgggcucuuuccgcggcggcccagagcgcuuggcuugcgcucccgacguggaagguuuucacggcaccuagaugucgcgggaagacuagacgagggcccaucccgccuggugaugcugacugcggccucugccauuucuaggcgggcugcacuuugguacgagcccagagucuuuguaagcggucgccucccagcuccggagccgcucuccgcgggccacggaacucucacuguaaacgccagagcagccaucuucgccugaggagucucacacuccaagggcugccgcuccgggaggcucugggacucugucccccaaacugaguccaacccuuuuuaugcggcuugauccguguccuagcuuucaagauguucccggucacuaacuaugcaagaaacaccaguccaaguguuucucugccgcuuugaucacuuaaugucagcuccacuuucuuaauaacgaucaucucuccgaucggauaccaaauuggcaucuuaaaacuuugcauccagagauguaacucuucgguuuuacuccaaacucgucccucuagcuuguucucggagguaacuaugaaccgggaacguuugcuuaguagcuaagaccccaguccuggauugucuuacaccuccacaccuguccuaacuauaaaucuugucuguucaggcuggaccgucuccauccguacagcucuauauaacgccucaguuacccuggccagaguuguuggcaguagcucccgaagaauucuauuucucuuaccccuacuagguuuuucuuaacacagcagucagggggaaucauguucaaguagcaagagauuuuggacuuuuguucaacucaagauaacauccgucuacucagugcgcuccacagguuacauuuuacacaaggugaaaaccagacuuccuaguuuggcuuaugagggcauggaugauuuaauuuguuguuacacagcuccauacuguuccaagcaucccuucuucucacagcuuccacaguucauuauacucugcucaaagcugcccuaagaggugauguauuuacaaaacuacaguagaucucgcuuuacaccccucuucuugccuugcucccucccuaccccccaucgcauuugucuauuuagucauaaguguuugucucccuucuuggcuagaaugcaaauauuuugaggaaggguuucugguuuuagacacuguuugcaucauccuuggggccaaguguagcaaccggcccaggacagcugcucgguagacauuugcugcaagagugaacaacugggauaagagccgaacacaggcagcaaguaggaugucuggugcgcugagccaaugcauggugauuaucugcguguuccgggaaagcaggagagaagauugaugagcugagcugugacuggugcccaguggcuucaagggggucccugcuucagcauacagucauuauuuggugugcaaaucugcguuuggagucuucccuuuguaggucucagaccaauguugccuucucuuccauagugaacacauucuuucccuugucaguuucuauaaacugaugauaccuaacucucaaauuuacaucucucacaucuccuggcuucacacauaccaaccacaucacugccaucucuguuggguuuauuccaugguguuagcuggugauggaacuagcuguacuccaugucccaauuacauaguacauuuaauugccaauuugauaauuucuccguuacuguaucuauucuccucucuccccaucacccccaacaaacugucuuuauucaugguuccuagggucuucuggggcccaagguuugugucugcgaugguuugaaugugucucccaagaauucauguaaaguuuaauccucacuggggcaauauugaaaagugguugugggccgggcagugguggcacaugccuuuaauuccagcacuugggaggcagaggcaggcagauuucugagugcgaggccagccuggucuacaaagugaguuccaggacagccagggcuacacagagaaacccugucucaaaaauacaaaaaacaaaaaaacaaacaaacuaauugaugggggaagacccagcccauuguggguggagccaccucugggccgguuguccuaugaucuauaagaaagcaagcuaagcaaaccauggagugcaaagcuauaagcagcaccccuccauggccucugcaucagcuuaugccuccagguuccaguccuggcuucccucagugagggaguguuaccuaaaaguguaagggaagaaauucugacgcccccaaguugcuuuuuggucguaguguuuuaucauagcaauaguaacccuaaccaggaaacacgcaaaaucuuuuuuguuguuuugagacagagucuauauagcccugacuguccuggaauuugcuguguagcccaggcuggaacucaaagggauccaugugucucugccuccugaauaccaagaaaagucauuuggcacuacacccaacuaggcuauaauuaucaguaauuuuauuuuuaaauauaagguccacacuuuuuuaaagugaccuguguguggugcugggcauugaacccgcggccuuauaugugcaugcuagauaaguaccacugagcuaauuuccaaauucuugauuucaauuagucuuguacuuaucuuuuuaaaaagauuccuuuuuuauuauggguguuuguacagacauauauauguuauauaugaaguaugugcagugacuguggaggccagaagggggcguuagauucccugggacuugauuuacagauuguuaugacccaccaugugguuguugggaacugagccagguccucuggaagggcaaccuucacuguugaaccaucccuccaggccuuucuuguacuuaccuuaaccagcuauucaucccgguaaguauagucuuuuucaguucuagaaauaggcaguuagguuauuuaaauuuagguagguauauaccacacugguaguuccagcaguugggaaguaggagaauugugaguuccaggccugagcuacaaaaugagaucccgcugucucaagauaacaaaacaaaacaaacaagauugauuuucuuuuccuccugaaaaccuacacguuuuugccuauguugucuaucuaaugcuccaguucauuaacacauaauaaauacaugugaggucauuguuaauucuaauauugcaaucguguaaauuacauuuucuuccuuuacaacuaugcuagauacauuauuuaaaagaacuaaagugauuggagucaauauuuuuaucagagaggacaacccuauuccuuuccuagucaauaggaugagugcaguuguguggcuuucccugggagagaugaacaaaagccuaauccugccaggcaguguuauccacagacaaguguagcucaugaacaaauggguccauuuggcuuacuuacaggggcacagugaaucaaauuguucccagcuccuagaaguugcauccaguugcucccuaccagagcuucaggcagcuacucagaaggcauuccccucagcaauuacugacugugauagaaucuuggggaaaggccuugugaaucuccuuacuuucugagcuuccugagacauguaaaauucaggagcuuccugagauugugugcuuaguuuugggaaucuucugaacccucucucuuccacaaaggaaauaguuaugcaacagaaguugauugcuuaggucuaauugggaguugaacugagaagggugugauagcagguggugauguacaccuguaaucugccuuuggauuggaagcagaaaaaaaucugaggucucugcuagccugggcuacacagugagacuaccuaaaaugaaaaaauaaaauuuggugggugggugguccaguaguuaagaacacuuauuuuugugaggacccagcuucaguucacagcccccaugugacagcuaacaacauuccacaacucagagggcaccaagcaugcauguggugcauagacauacauggagacaaacauaaaauacaucaaaaaaauuuuuuuuguuguuuuuguuuuuuucgagacaggguuucucuauauagcccaggcuguccuggaacucacucuguagaccaggcuggccuugagcucaaaaaucugccugccucugccucugccucugccuccccaaugcugggauuaaaggcaugcaccaccacggacggcuuaaaaaaauuuuuuuaagccucuaaaaaaauagaccauguaaaaugaacuauuuucagcuuuaaaauuguuucuuaacucacacgaucaaaauagguugugaggaauauuucuuacuacuguucuauguuugguuuuugaaaauaaauguuuugcccccaauccaagcauuucaauuccuuucuugugugcaauguuaacugcaaauuucaauugccaguugaguagucgugugugguguuuucuuguuccuauguggcagacacccauggcuuucucauucaccccaucugggccuccagugugguguaauuauccugaaaagccaagaugugugagagcuuggcuugauuacucuaauggcacacaguguuuucgaaaaccucucaauuccugaauaauuaucauuaucauauuuauguguuuagccaaaagcuuaauuggaagauuccagaaugaaacaaugcuacacaaggaaaaagaaaaccucucagucauuucucuuugaaaaaaaauuuuuuuuuuuuuuuugcagauugaaauacagcugauaaaugcaugagacuaagcaucacauccugcagaagcaacugcagugcagggcaaccguucccagccucuuccuugcagaagcaacugcagugcacggccaccauucccggccucuucccagcugccuucccagggagcaagcacacuuaacucuuucuggugucucugucgucaucuagagaacgcacaugcuaugcuuauaacaccagcuucuuucucuuuucaagacuuauuucuauuuaugugcauguacauauuugcguauggacuugcacguguguacagguacccaaagaggccaggagagggcacuggaucuccugacccuagaauuacaggaaauggugaacugcccaauguaggugcugcugggaaccgaacucuacuucucuuuguccaagucuggugaccauauuggaacauauaugagaauaagauccuaaguaaccuau

SEQ ID NO: 3719 - RNA, 6312 nt, Mus musculus
auagguuacuuaggaucuuauucucauauauguuccaauauggucaccagacuuggacaaagagaaguagaguucgguucccagcagcaccuacauugggcaguucaccauuuccuguaauucuagggucaggagauccagugcccucuccuggccucuuuggguaccuguacacacgugcaaguccauacgcaaauauguacaugcacauaaauagaaauaagucuugaaaagagaaagaagcugguguuauaagcauagcaugugcguucucuagaugacgacagagacaccagaaagaguuaagugugcuugcucccugggaaggcagcugggaagaggccgggaaugguggccgugcacugcaguugcuucugcaaggaagaggcugggaacgguugcccugcacugcaguugcuucugcaggaugugaugcuuagucucaugcauuuaucagcuguauuucaaucugcaaaaaaaaaaaaaaaauuuuuuuucaaagagaaaugacugagagguuuucuuuuuccuuguguagcauuguuucauucuggaaucuuccaauuaagcuuuuggcuaaacacauaaauaugauaaugauaauuauucaggaauugagagguuuucgaaaacacugugugccauuagaguaaucaagccaagcucucacacaucuuggcuuuucaggauaauuacaccacacuggaggcccagauggggugaaugagaaagccaugggugucugccacauaggaacaagaaaacaccacacacgacuacucaacuggcaauugaaauuugcaguuaacauugcacacaagaaaggaauugaaaugcuuggauugggggcaaaacauuuauuuucaaaaaccaaacauagaacaguaguaagaaauauuccucacaaccuauuuugaucgugugaguuaagaaacaauuuuaaagcugaaaauaguucauuuuacauggucuauuuuuuuagaggcuuaaaaaaauuuuuuuaagccguccgugguggugcaugccuuuaaucccagcauuggggaggcagaggcagaggcagaggcaggcagauuuuugagcucaaggccagccuggucuacagagugaguuccaggacagccugggcuauauagagaaacccugucucgaaaaaaacaaaaacaacaaaaaaaauuuuuuugauguauuuuauguuugucuccauguaugucuaugcaccacaugcaugcuuggugcccucugaguuguggaauguuguuagcugucacaugggggcugugaacugaagcuggguccucacaaaaauaaguguucuuaacuacuggaccacccacccaccaaauuuuauuuuuucauuuuagguagucucacuguguagcccaggcuagcagagaccucagauuuuuuucugcuuccaauccaaaggcagauuacagguguacaucaccaccugcuaucacacccuucucaguucaacucccaauuagaccuaagcaaucaacuucuguugcauaacuauuuccuuuguggaagagagaggguucagaagauucccaaaacuaagcacacaaucucaggaagcuccugaauuuuacaugucucaggaagcucagaaaguaaggagauucacaaggccuuuccccaagauucuaucacagucaguaauugcugaggggaaugccuucugaguagcugccugaagcucugguagggagcaacuggaugcaacuucuaggagcugggaacaauuugauucacugugccccuguaaguaagccaaauggacccauuuguucaugagcuacacuugucuguggauaacacugccuggcaggauuaggcuuuuguucaucucucccagggaaagccacacaacugcacucauccuauugacuaggaaaggaauaggguuguccucucugauaaaaauauugacuccaaucacuuuaguucuuuuaaauaauguaucuagcauaguuguaaaggaagaaaauguaauuuacacgauugcaauauuagaauuaacaaugaccucacauguauuuauuauguguuaaugaacuggagcauuagauagacaacauaggcaaaaacguguagguuuucaggaggaaaagaaaaucaaucuuguuuguuuuguuuuguuaucuugagacagcgggaucucauuuuguagcucaggccuggaacucacaauucuccuacuucccaacugcuggaacuaccagugugguauauaccuaccuaaauuuaaauaaccuaacugccuauuucuagaacugaaaaagacuauacuuaccgggaugaauagcugguuaagguaaguacaagaaaggccuggagggaugguucaacagugaagguugcccuuccagaggaccuggcucaguucccaacaaccacauggugggucauaacaaucuguaaaucaagucccagggaaucuaacgcccccuucuggccuccacagucacugcacauacuucauauauaacauauauaugucuguacaaacacccauaauaaaaaaggaaucuuuuuaaaaagauaaguacaagacuaauugaaaucaagaauuuggaaauuagcucagugguacuuaucuagcaugcacauauaaggccgcggguucaaugcccagcaccacacacaggucacuuuaaaaaaguguggaccuuauauuuaaaaauaaaauuacugauaauuauagccuaguuggguguagugccaaaugacuuuucuugguauucaggaggcagagacacauggaucccuuugaguuccagccugggcuacacagcaaauuccaggacagucagggcuauauagacucugucucaaaacaacaaaaaagauuuugcguguuuccugguuaggguuacuauugcuaugauaaaacacuacgaccaaaaagcaacuugggggcgucagaauuucuucccuuacacuuuuagguaacacucccucacugagggaagccaggacuggaaccuggaggcauaagcugaugcagaggccauggaggggugcugcuuauagcuuugcacuccaugguuugcuuagcuugcuuucuuauagaucauaggacaaccggcccagagguggcuccacccacaaugggcugggucuucccccaucaauuaguuuguuuguuuuuuuguuuuuuguauuuuugagacaggguuucucuguguagcccuggcuguccuggaacucacuuuguagaccaggcuggccucgcacucagaaaucugccugccucugccucccaagugcuggaauuaaaggcaugugccaccacugcccggcccacaaccacuuuucaauauugccccagugaggauuaaacuuuacaugaauucuugggagacacauucaaaccaucgcagacacaaaccuugggccccagaagacccuaggaaccaugaauaaagacaguuuguugggggugauggggagagaggagaauagauacaguaacggagaaauuaucaaauuggcaauuaaauguacuauguaauugggacauggaguacagcuaguuccaucaccagcuaacaccauggaauaaacccaacagagauggcagugaugugguugguaugugugaagccaggagaugugagagauguaaauuugagaguuagguaucaucaguuuauagaaacugacaagggaaagaauguguucacuauggaagagaaggcaacauuggucugagaccuacaaagggaagacuccaaacgcagauuugcacaccaaauaaugacuguaugcugaagcagggacccccuugaagccacugggcaccagucacagcucagcucaucaaucuucucuccugcuuucccggaacacgcagauaaucaccaugcauuggcucagcgcaccagacauccuacuugcugccuguguucggcucuuaucccaguuguucacucuugcagcaaaugucuaccgagcagcuguccugggccgguugcuacacuuggccccaaggaugaugcaaacagugucuaaaaccagaaacccuuccucaaaauauuugcauucuagccaagaagggagacaaacacuuaugacuaaauagacaaaugcgaugggggguagggagggagcaaggcaagaagagggguguaaagcgagaucuacuguaguuuuguaaauacaucaccucuuagggcagcuuugagcagaguauaaugaacuguggaagcugugagaagaagggaugcuuggaacaguauggagcuguguaacaacaaauuaaaucauccaugcccucauaagccaaacuaggaagucugguuuucaccuuguguaaaauguaaccuguggagcgcacugaguagacggauguuaucuugaguugaacaaaaguccaaaaucucuugcuacuugaacaugauucccccugacugcuguguuaagaaaaaccuaguagggguaagagaaauagaauucuucgggagcuacugccaacaacucuggccaggguaacugaggcguuauauagagcuguacggauggagacgguccagccugaacagacaagauuuauaguuaggacagguguggagguguaagacaauccaggacuggggucuuagcuacuaagcaaacguucccgguucauaguuaccuccgagaacaagcuagagggacgaguuuggaguaaaaccgaagaguuacaucucuggaugcaaaguuuuaagaugccaauuugguauccgaucggagagaugaucguuauuaagaaaguggagcugacauuaagugaucaaagcggcagagaaacacuuggacugguguuucuugcauaguuagugaccgggaacaucuugaaagcuaggacacggaucaagccgcauaaaaaggguuggacucaguuugggggacagagucccagagccucccggagcggcagcccuuggagugugagacuccucaggcgaagauggcugcucuggcguuuacagugagaguuccguggcccgcggagagcggcuccggagcugggaggcgaccgcuuacaaagacucugggcucguaccaaagugcagcccgccuagaaauggcagaggccgcagucagcaucaccaggcgggaugggcccucgucuagucuucccgcgacaucuaggugccgugaaaaccuuccacgucgggagcgcaagccaagcgcucugggccgccgcggaaagagcccgggaccguccgugagcucggcgagucucgcgagaaagcacgccgccucgcccucccggcaugcccugcgccgccgccgcugcugccgccgccgccgccgccgcgccgcgguuugagggcgggaggcugggggaggguaagcggagccggcgcggccgccauguugguucugaggcggcugcugugaggcgccgacggagggagcgagcgagcgggcgggcgggcggagcggcgggcgcagcgcgggaucugacugagugcgagcggcgggcgacggcggcggcgccaugagcgggggcaccccuuacaucggcagcaagaucagccucaucuccaaggcggagauccgcuacgagggcauccucuacaccaucgacaccgagaacuccacgguagcccucgccaaagguacggcggggcgggccucgggguuuuggggggcgcggguagagcgccccgccgcccucgcgcucuucucccucugcgguccucacgggccucgcucccucccggcccccaagcgacaagggccgggcugcggccuccccgggcuccccgggcugcuuccuuucccccgaagcuccgcgccuuccauccggggaacgagugcgcggcgcccggggcggggcgaugcuaaagucccgggaaccagccggagaacacacccagguucgcggcuuccaagaccgaaauucggucguuccuucuucggaagcgccgaacaaagccggaggagucgaagaaucuugacgccuaccucgagaugaaugcggauguguugauuccucgggcacccauuuucucagcguucuucgucugggucgguggcgacgguugucgagugaacuccuaaggagugugcuccaaacuuuggguuugcgccgcagacuugugaucucgaaaggccguuucguaccguccagucgaucgcaucccguuugucuccucugugauuguuaccuguuaugccggaauucuuaugcaaccgaagggugcgcguuaaaaugcuugcuugcuguccccaugggccaauuuucuggaacccugguagaaaggaaaguuuaaguuuugaugauccgggacucuuguacacacuucagag

SEQ ID NO: 3720 - RNA, 16519 nt, Mus musculus
cauucugggugcaggccuccgcgccgcagggaccuuuggccgccgccgucuccaucgcgccgcgcucguccaggaaauggcgcgaguggccgcaggcgacgggccgggugccccgcgcuccccucccccgcgguggccaccgcguguccgcagacgucacggccggcgcugcuccccgggagaggggcagccggggccgagacccggggagagagggagggagagagggagguaagccgccuggcagcccaguuucucuccccuccccacaccaagucccgcccucagccccggggcgccgcggcggcggcugcuucucuccucuuuguaaccgaggagucgagaaaugugagaaacgugcccuguguuacuuauuugggagucgaaaauuuaugcccagcugaaagcgcccggggaaauauuacaucagaugaaaugacaaugauuaaaaucagccucucccccgcccccuccucgagcccggaggaggcccgggcgccgcguggccggacggcggggggcuggggcgcagagggcgcggggcucgggcgcagcgcucccggaaggguacugguccagcccccuggcacccaggcacggggcuccgggacccacggguggggaucgcgaggugggaaggaagugguggcgguggggaacggugcauuuuuuuuuugucgcggagcgcggcaggcgcgggcgcgcggagcuaauugcgacucuaauccucugccccgaggcgcagccgagccccgagccaggagucgcccgcgcgcgcccgcucgcgcucgccgcgccgggguaauuuggaaccggaucgcugcccuuugcaauccgggcugggccgcggcgaggcgcacaggcuaccggcugguuuuggggggcuauuuucuccccuccagccaucgggggaggccgcuggagagagagggaggagaagaggugggagcggcgggagggcagccggagagcugcgcgaaaaggaggcggcggcggccgcggcgaagagggaggaggcgaggggagggcggggaggggaggccccggcgcggcgcgccgcgaggggccgcgcggagcgggggccggggcgggagggguggguggggggaggguugggggcgagagagaaaguaacuccaggacgagaccggagcgacccgcgcgcaucgagcgcuaggcgacggggcugcgccgggcgcccgacaccggcggcugcggggggcgggggcugcgccggugcccgauccacugcuccggcuccgagguaagcccagcacgggcggccaccgcucagugccgcacaccccugguucccaaaguggcugcaauuccgagaaagucacucggccccgggccgggaccuaggcugggggcgggggggcggcugcuuugucccucugcugagcgcaggggcuggcggcgugggggcgcccagcacaaaggccuggcgcgcacggggcgggggggugcccacgugggcugguccuagccgcggguggacccuccccacucggccgggcucugaucauccugcugugcggaauaugcguccagguccuccgcacucugguuccaguaugggcucgagugcccugcagagcugaugacuuuccugagucugaaaccggcuccaugcagcugggcuuucggggcucacaggaccggguuggcgcccaauuuauagaaaagaaaaaagucucuaacgggacagaugugcguucucugacgcccacccuacgagucucaugcuagacgcacugguggugguuccaagcucaggaaggauguggggcggggaacgcgccgccccaagaccggaccgcggucucuagauuuccacugcccacacgcacccccucaucuggaugcgaacacccucauucucccacucucgcgucacaguagcaccucucuacccucccucgagaagcccccgacuguagaaagauaaaccuucaaguuuucacuccgugucucaaaugugcaugaaggaauuuaacugcgcgagugaauaacagcauuaguuucaauuaauuuuuuuuaaaucccggcaacaauaaacuuugagaacaaaagcgcuuuuacguccuuaauuaggcgagcuucccaucuguggucuugaagugucugccucuugauuuaacuuugucuccgccccccaccgcacucccaccccuucuucgcugggcccuucggguaccuuggccaccccgcccgcggggccggagguucggcccagcggauccuguagccccgaaguucacaccggccggcuggcuuugcggccccgcuggcgcgcaccagguggcccgcugcgucccucccguuccaccccuggacaguccugcaggccccuggcacugcugccucgggcaagcgcccugggcguaagagcugaagggaacuggagaggcgccuucuguuuaccuuuuaugguuaagauaacagcuuagcaaaagaagcgacuucacgaagaagcgauuuagugaaaucgucucaagcugccgcagcucagccaguuuaaucacccccagagagcugaacaacugcgagcacaaugggacacaaaaucauuuuguguguaaaugagcguggcauucugcucacuucccucugcucgggcgggcggggcucggcugcgggugggcgcgggaccggggucucccaccacagcuuggagaagcgggucaaugcugggccaguuugcaaacccgcugaggucccugcaacaggcggcuuggccaagccucagccgcgucuggguccugguguuuggugcagggaacuugugucucuuaucaauugcacgucuauguuugugaucucagcaguguucugggaagaagggucgugguccaccacagaugcguuuggcagagggagcaguggagauucgggucaaggcuuaaggccuggggcuuccaauggugaguuucugguuuguguugugagaaacaggcugagggcaggcuggggcagcuugguagaugggcgcuugaugcuacuugucacaucugaguuggguccugguaguggaaaaauguggugcuuugguagaauuugggugggaauucuaucucuguugaccuucaguggguguuccuuuauggcauccucucccccacccccacccccccucccaggacuggauaacccaucccuuggguccgcuuugguuuuucaaaaacuuccuugagguaaaugaccugggauguccaaagcaggggacugaacagccacccaacucuuccaggaggauagaacacccucccucacccccaaacagucucaggucagagaacuucccagggcagcggagaggugaagcaaaucauaggaggggagacacuuaccuuccauugaaucgguucagucuauguaccucagaccauguuuuaucauugcaugcugaauguuaagacagagaucuagaaguuuaacagaaaaagcaccauguggguacccaggauagcauguaguuuugacacauaaggguuaaaucugugucagagaaguccagguuauguuuguagacuucccuccuccccuuuccaugucucucuguguguguaugucuguguguaugugugugucuguguguaugugugugucagugugugugucugugugucagugugugcaugugcgugugugucuguguguguguguguguguguguguguuccucuauugcccuuggagacaacccggagccagugaaagggguagcuagaaacccgcccuuccccaccccuucuucaggggcccccugaaaagcccccaggguagcuucuggggacugaggcacaauuuuauuucaggugucuguggcacauaggaaagucccugaguagcucuggggaggaggggagaaagcccauuugcugauugcugucuggccagcucucaaugccucaagggccugugauccugagggggucuggaauacauuaggcccaggcagcaccauucugggggucuauuggagaagcagggaggugcagaguaggcaaacaaagacagguccugucugccugccguggaagcucuaggugacugguggcuucccagugaugcuccugcaucucugugcccuggcuucuguggaaagagguguccuauacaaacugcgucuucuucacuggguggugagagauccuaggcuccccagccaacugaggggagcggcacccccacccccacccccccacccccgccccaagguucucuccacugaugcaagaggagacacgcuugguaacacggcucuaagucaaaauaccaaagaaaucagauuuguucugaaacauugcagggcaauaauggcgagcauauguuuuaggcugucauuagccaaauuagcagacauggaacugccuagaaaacgugugugugugugugugugugugugugugugugugugugugugugugugugagagagagagagagagagagagagagaggcuaugcuguggucuggaggucugcuuagggguauggagggguguguguguguguguguguaagagagagagagagauguuauacuggggccuggagguuuggugggaucuggggaagcugcuugguauauauacauggggucccagacagcaucuuuguagaacucauugguggcggcugagaaauaagucacugcuuccuacagauacucugggcagggauggaagccuagaugccucaccgcaaggagcggccgagcggguccucgcuuaacgcacacggcagcagcggcacggcggugagcuugcguggugggcuggguuggccccucggccccucuuugcucuuuucuaggguaccugcucacuagcugcaggucuucugagacucaguacauaagagauggguauugacugucuguaugauuauguauuuuuuuugaaacgaaaaugcucuuaauuugaugugaaauuuacuacauguauaaagcucagcgccuuaggugcugaggaagucacuaauuuagaggugucucguuacugagacaaacuugcaaaaaaccccugaaucccaauucacaaauuggugauucguuugucaggggauauuucacaucuaacacauaagcccgcgaccuuuaauuagaauuuugcaguuuguuuuaugccccuggaggcugacaccuugaaaaaaauuuuuuuucuugauuucuuauugcuaauaagcauccuccucccacccccaguacuuugaagaaaaugaugcaaacacacuuaauuacagugguggccauaauuugucagcugaauaugugaucaggcaccagaagaagugaucugauuaaauauuugaucacauuucgaaauaaaggcuguuuaggaacccuuguuuuccuauguauuucgaucucuaggagggaggaaauaugucccggcugucacucacccggucgccugugucuccccuggcugcccaggggaucccacugccagcucagcucaccaaagccaacgcacccgugcacaucgaugugggaggucacauguauacgagcagccuggccacacucaccaaguacccugacuccagguaagaucucugcucucagugucgggcagugugaagcccagguauccauaggauaccauuagaguaugaaaccaaggccugucgcucccugaugcucuugacuguuugagagacugcuugcuuguggaaggccacuucugacaguggcuuuugacccuacgcugauagccuuuguggcauaacauggaguuccugaccucuauggcagauccagucccacgugagccuggccaacagcuggcuggggagucuuaauagagugacacccaggagucagguguggguggacauggucguuccuauuuccaguucuuacccuuggggaaaagcauagagugucagcugcaauugcacccuccuuugucugggcggccaccauuugauccuaagugcuaggagcgggcuuucuuuuggagcuggagggcguggcgaugaauuagcaauggcaggacagucggggauauuuucaacauguagaacgcgguaugaguucgacacccuguaauguacacaaagcuaucugcagccgggacucugauagaggacuuacagacucugcccaggagagacccuuaguggcauggugcugguaaccaguagcucgaugacucuuacuucucauggauuuacuucccaaggacacaccuuggcgcggcagccggcagcaagacacgugggggugggcugugucucugugagcaucuccuacaggugacacugcauugcagcuugcuaggcucaugcugcuugcuccugggguggugcagcaacaagcagcauuggccagcgggagggcaggccugcuaggcaucaccucucuuucauacauuuaaaguaagaagaggaauuaauuaauccccuagauacugagggcucaucaccaggauggaugcucagccaggguagauucagagccuagaggauugcugugcagagaugucugggcagggccuuuauccuuauggaagugccccuggagaagggaaugggggaaggagauuuugugugugguccagauaauagcagcccagagucuaggugcagggguccuuaugaacuuggaguuuugguggggcaggagccagaaggcuguacuccucauuggccgcaugcuugcuugcagagccccugucuaggcuacgagauggauucuguucauuuaauuucaguuuugccuucugcggcguuccugaguugugugagauagaucaucccuuaaccggcugacgauguuugugagugaaaucccuaaaaaucuuugcccacaaccuucuuggaagaguguuuucugaaaccugacauucgcuuuccugcagcagccgcccccuggacguggugggcagggaggggaauccucccuucccuugugucccuguaguggcuuuuggggacugaggagcaugugcccucccuguuccacaguguggauugcccaugcuuaccaaccugcuguagagugggugauagucuuccucuggggagcugaacacuuggcccugugaugugacauguggcgcccaccacgggacaggugugcccagaagggguagcacucugugggcuucaccugagccagaugcagggugacucugucuuucuaccugauucggcagagguguucaccaggccugaagccgaggccuagagcgagggcuagggcggccucugugauagcagagacaaggguucaucggggagcuacacagcuguugugaagcgccacuuacggucccauccccucccaccccucaccccccauuuuuuugaaguggauuauuacaauucugcaaaagauguaucacugacugugcagacggaggcguaagagugcuaagguuaccaauggagacagcuccagaugcuggcacuguucccacccccaacaacucccccccucccaggaagcauugcaagauccccaagcucauauccuugcaccccaaucuccagcucuuagcugaucgaggugccuuagauccugugggccuggugcugggugcuuccucagguucagccugagacgauagccugagguugagaguggacucuuggauggccuuccucuguguguuguucauuggguguccccuaguugcugcuggcacgggagcagcacaugaagauggccaagugacccagaacuaauagaacugagcgcuaaaccguucaggaagucaguuagcgcuuuaaaggaagggcuagaguggaggggaaugguggcagccucuauacgucaggacaaguggcucgauggugcuucacacaggucccggcugccacagggaaccuccaaagucggcuccucauaucucaugugcucccugagcgagagggcuggccuagaggugguucccaccauaugaagcuaccaacagaacucaggaggucacauaggaacuuacucacgagacccugugagaugcucaggguuuccucauggugacuguccaaaaugcuccugcagccuggcccucuguaaggcuugguugcugggaccaccaaaggccucuguccuaagaggaggugccauuagucccagaacagacaccauaccauggaaggaucuagaacuugcucaucuuggcucaguagacagccuagaacccaaccagccuugcacuguugguggaccgggaauccuccagacugacaggacgcucaggagucucagccagcucugacgucagagcaguuuggaacccagccagacccagcauuuugcuugccacacagaacagaacguuugaacucggccggggaaggguggcacgagaguucccaggaaggcugagguguugaauuugcugacucaccuuuguguguggcuaugaccucuuucuugcuagagcccgauguggacccccagcucccuguccuggcacuugaucuucuggccgagucacaccugugucucaggauuaugggugcccauuccccucacacccccacagcugaauguucaaguuuuucugggccuggucucuagugagcuauggaacucaaggccuuguuuucagcagggauagggucaccaggcaguggaauccugaguucucguugauugacuggucaggguagccuacaugcagaggagugucacauaccccagccagagagagagagaggcagagagacagagagagagagagagagagagagagagagagagagagagagagagagcacagccugguguggagggacccuuggauuugcccuucccuguguccuggggaagacauugucaccagcagccuccggagcccugaggaguuacauuugucaguuguaccucugguucuucaggcucaggccuccacaccccuaaccacaggcucugaccugcucacucccguccgucaggcagccuugccauuuauacugcccuccugggacaagcugggcuguguccccaggaugagaacaagcaauggcacggccaugagaacacaggaugguguggauuggcaauaacuaagaagagggaucggggguccaaaccucucagcuccuggcaauugucaugcucuggguaugcacgacugugacuggaguggccgacuuggacuaagcagggaguggguggcuguaggaacagggacaggaagaggguucuuggaaggaggcggguuguuggugcaggcagagugaaaggauuggacucaucucgcuugugcaggccaggcuaguaagucuccuuaucuccucguuaccccgguucuccaaggugcucucagaaauaguucuuccaggcucgaugucaaccagcuacugaagggcaagucccaagcuagggucuuagcugcucccaacccauuuaggggcuucugauuaucuagauuagcuugagauagcuuagccugcacaacacuuagcaaaaaaacaaaugcugccacuucaggaggcacuacccuggggucuaaggccagguuccuccucuguggauagggggaggcaucagggacuccccuaaggccuucccacaggcccugugucaucuuguagcacugucuuucuagguaauuguguucauucccaccgccagccugucucuugccugguaugcagaaacugugauggguaugaauaccugacccaggcuugggccacaugaccaggcuuugggguuugugugccagcaguaguccacaugcaaauacacacuuccucuugaugucucuucccuguggguccucaugugaacagcuauggggcauuugugaguucaugucuccgagucucuguguuagcuggcaagugucacugccugggucugccugagacugugacccugugccuguuaccugaaugggcucugugugugauguugguuaauguggcuuaggugaggagguguguguccccagagacuugguuggcugacauacuuuuagcaggaggcguguggcuaggggccggagggcuggguggucgacacaugguuuguugggcaugucuuucugacauggggguguguguuuucagcucggaccagcugguuucugugacugucugugucuuaucucgguuuuccgggccugauuaucuagauuagcuugagauagcuuagccuguaccacacuuagcaaaaaaacaaaugcugccacuucaggaagcacuacccuggggucuaaggccagguuccuccucuguggauagggguagguaucagugggccaacagacauagcuggauaugucccuuagcuguggcuucugaauauagcuggaguguauggcacaaggacccuagugguguguguguguguguguguguguguguguguguguguguagaugacccaucugccauauaugugugugugugcugaccugugaggcuugacaaggucucuaaguuacccacccauggccucuugucacuccagcugagugacccuaaggacugugggcagggcagguuaaacacagccccuacccugcccauagccccaucuugccugucucucccagaauaagccgucucuucaacggcacggagcccauuguccuagacagucucaagcaacauuauuucaucgaccgcgauggggagauuuuccgcuacauacugaguuuccugcggacgucaaaacugcugcuuccagaugacuucaagguaaguccgcagccggcggcacccccugcgcugugccugugucauggcauuacacaggggacgcugugacuuaauaaauggacccaagguugucauggcaacugcaaaaaaguuaaccgaugaagccgagggcuaaaucaguuuuucuaaacucguuuugcuuucucacaucuucagcguauuuaucaggguguaacaacaauuaagcuuuggcacuuuacuccagguugauguugguugugcuuaaggacugcugugcgcuggaauagagucguuagagguccuagugucuguuccuuguuggcagucugcaguggggaaaacccuugagagcccagguggucacccuuuaaacaaacguuacucccaggacucagggugagcuugucuuagguggcugauguagcucccugucauccugccuuggugcugagccccacugaaauccuaggacuuaaacucaggccuggcucuugcuggcaaaugucugucugucuuugugcuucccugcuuugaggcuuccugcagcgaccacugcaccagcagcccuagggcccuuuuucauccagccuaguuacuaaauggcaacaacugaguuuggucugaaaauagaccuacacaggaggaagccauaggcuuugccccuuccagucaagaaaauagagguggcgucugaauuucauggggcugguaguucagaaauagcgugugccugcugugguggaucuaccuuuaucccaggccuuccgagaucgaggcggggggauugcugaauacuguaggcuagacugcccuacagaguaagacacuauuucccaagaaagggggugggguggggggcaucagcaagugugauggccuucaaucccagcccaggagguaaaaccuggcuagaucuuugugaguuugaagccagccuggucuacauagggaguuccaggccagccagaacugcauagugagaccaguucucaaaacaaagaaacaaaaacaaauaaacaaacaaacaaagaaaaaaaacccaaaguacuagucaaaugaugguaaaaccuggccuggcuggguuugaaagaaacaguguugcuuuaggggcuggaggaagaaugacuggagcuagugugaggagccuggugagggucuggaauggcucuggagaggaggucuggagccuggggcuugaggaccaggaaaggaagggggagggggaggcugcugugcuaccuggaucuuggugggugguucagcauuuggcaccgcugagaauagggaaagaaagaucagguuugcaaacuggaucaugcuggcucuugugugagugaagcagggaacaggggcggggacgggaggcuggauuacauaugucaccguguuucugguuugcugggggcaaggcagagacuaacguguagaagagggcacaaaggcugagagugcgguuaaucaggccaggagggugugcccagcuaguaguuugagcccuaaaucaguuaaguaaaacauucuaggcuguggggaaagauuagguguaaagaugucacaugaaacucuaggagcugcugagagcuggaagagcagaaaccagggauggaggagucuuuauggucacagcucaugacgggcguggaagauagguuaggagucugggccuuuggggccaacaaacagaagcacauugggcuucuagggugagcugugcuuugagagccggccuucccugccccuccuucaggagccucagggucaccaugugucuaugcacuaagccugccccaugaaccauuggcacaggccauuuaaaacuggggcuggcacuggugggcacagggcugguaucagggucugagggacagugguugugagugggcugcuuggugaggaguagcaagucccggggaccuuguuguguucucuaccuguugggucagggacaagaacucagcagaucuguccuuuauuccucacagugcuucccaggguccaguguuuauauucauuguaaagagggaagcuggcccagggcaggccaguaucaggcucauaggccuuguggcugaaauggauuucaugaaggucugccugggagcugggcaagggcacaguggccucaagccagguugaugucugucuucucugaggagauuuuucaggagagcaguguaugucugacuccugccccucuggcuuagcuuccagcuccuucugccuccucccucccucccucccucccucccucccuccuuccuuuccucucucuguuucucucucucucuucuuuuuuuguuuuuuuaucagagacaggguuucuccuuguaaccauagcuacccuggaacucacuguguaagaccaggcuggccucgaacucacagaucugccugcucugccucccaaguacugggauuaaaagcgugugccaccacugcccggcagcuucuaucucuuucugugacgucucucuuugccauccaugugaagauccgggaagagagucucaacagaugcaccccagccuucucuuuauguucuuuacguuuauauucuuuauguuugggggccagccauuggaguuggaguuguuaccucuacaguggacaugcccacccucguccacauuguguccugggaguuaugacgucuguguagagggaaggggccccacuggggacgggaugagucaccaagacggacugcugccugcuucccugacacucuguguuugcugacaggacuucaaccugcuguaugaggaggcaagguacuaccagcugcagcccauggugcgugagcuggagcgcuggcagcaagaccaagagcaaagacgucgcagccgggccugcgacugccuggugguacgggucaccccugacuugggugaacggaucgcacucaguggugagaaggcccucauugaggaggucuucccggagacuggagacgucaugugcaacucugucaaugcuggcuggaaccaggaccccacacacgucauccguuucccucucaacggcuacuguagacucaacucagugcaggugagggcccugggcugccaccccaggggauccugggaugggggagagggggcggggggggggagagagagagagagagagagagagagagcaagagagcaagagagcaagagagcgugugagggcgaggagagauagucccagaauggaauggacgaaacccauacagaaaaggcaacaaugugucgaugcauaauuuaugccuugcucauaauuaaaugaucgugccugggggcuggacuuaaaaaaauugaucuguacuuuucuuuuuccccuaaaaggauguucuauaaaaaaaaaaaauggcccagaguauuuucaacagaacaugcuucauuuagcaugcagaggcugacuuuggauucaaauuaaacccaggcaccaggaaaggcagggagccuuccuaugaggcuggccccagggccacuggcuggcuacagccgcccagagcucuucuuucuuucugagacuucucugucuuucugggucuuaaguguaacccgggccaggugcaaauuuuagcuccuccugccucagccucccaaguccugggguuacagguugcacccccauauccuccuguucagagagucucugaacuggcucuaccagggaggaggagaauaagaacuuggaaaccaaaaugauguaauaacccuauuucugaaagcuuuuuccugacucagaaacacuuagauuuuggggguuaggacagaaaagacccuuuagggaaaccccccuccccacuuccugaaggcuacugguaagaguugacuaguuacaggacaccaauauaagaccagucccaccuuccuagagacauuaauucagggggccauguaggcccacagagaugcguacuccgagagggcucccccucuuucccuccaccuagaaguccuuugagcugaugagcccucaggcuucaaaccaucugggacucagauccaggaagcaggugguuacccugaggcuagggggcaggggcuuuccauuauggagcaggagauugagagagggggcgccuggggcuaugugugugugaagauggggugggacacacccuagauaaccccuuugccuuccguacuucucuguugugcacccccacccccaagguuuuggggaguagccuggguggaauaucagagucccaugcuggguggauaaguugaggggccccugggccuuacugcgccugucccuccuaggguagacuccagcuggugguacagcuaggaacuuugucacugggacucaucagaaggugacuugcucugucuggcgcccaacugcccaccaggccaggcaaacucugguggcugggcaauugcugaccccuuauucuuccccugcagguccuagaaaggcuguuucagagaggguucagcguggccgcauccugcgggggugguguggacucuucccaguucagcgaauauguucuuugccgggaagagcggcgaccacagccuaccccaacugcuguccggauaaagcaggagccccuggacuaggcgcugccucggugcccaccuaagaccccucaguccuggggcaaccccagggacauggaaauagcgcugaggaguucugccuguuugugcuucacagugggcacaagacugggggcgggaucggagggucugcacucaccccugggaaugccaggugcggaggcguguccacggaaggacuguugaugugaccugggguugaugugaccugguugaugugaccugcugcuccugcugcaacugugcugccagccucccagcccuccugcuccucggccugguauagcguccucugcugggccagucacuccagagcagcuguuucuccuccacacuuggcagacauauuuuucuacaguauuuaaaacaguacuaacugucucgcugcacaggucggcaaggcuaaggaggaccauccaucgcugcuuuuaccuggugcucaguucucaguccaacuguucagcaagccuugcaaaggaugggcugccggcauucggggcccaggugccugcugagcugggucuguggggacagaugugagguggcgggugcuacaggacguggaacagaguccucuaggggcagggcaguggggaagagggcaaugggggcuuugugacucugugacuuuuaucugagauacucugcugccaccugugucccagacugcacuuggugcacaccugaccuguuaaugcccaggggcuuccaaucccgacugacugugcucacaucuggggguucuuggagaagucuccgcccacccagucagcaugggggccacagcuuaucucaggaaugggcccuucuaccaagggacccaucugucagcaucacucucuggguccccagcucagggaaccacccuccacccuagcgccaguuuccccauucauaugcacaccaaguguuaaugaaauguccuaaacuagccugucuguaagacccagacccaagcuuaccuagugcucuuaaccccagauuuccaacaaggacugguccugagagguccucacagaucugcucuucucccagacgacagggccaaaagauggauacccuggccuugucacaucucccuuagcuccucccaaguggaggaaccgcaaagaacugacagauggggugcccuggccggcacccccuuguguauaacgccuguagacuuguauaugacuccuuuaauauuguaaagaugcugauguacaauuguucuguguuugugugaacacaccgcguucccgguucaugccauaaagaacgcuauaaagcaaaagacugaggcuccguccugugcag

SEQ ID NO: 3721 - RNA, 10154 nt, Mus musculus
gucauucuaaaaguauuuuuuauuaagaccugauuuugucacaaaguauaaacuucuaacacaaguuacuaggaauaaacgaacuagagcaggagcuccagcucuguugcuagagcucaccuagcacacacaaagccccagguucaagacccagugucauauacaaguagugguacauaccuguaauccuagcacuugagagguggaggcaggaaggccagaaguucaaggucauacuuggcugaauaucaaguugaaggccagcacuggcuacaagaccaucucacuaaaacugaaaaacaaacaaaaaauuacaacgaagucaaaggaauucuguucugcaccacccauagaaauuauuuucuuuuuuuucauuuuuaagacagggucucaaugguacucaaacucaaauuggccuuaaacucaaccuucaucucuguaauacugggguuacagguguauaccaccauaaucagccacacaauuuucacaaccacacaacaauuagaaacuuauuuccccaaacacgaaaagacuaaaaggaccaaaguaaagcgucuaaauggccucuuccugccccaccccccacccccaacacacaauucuguuucuuagagucuuguuuuauuucugaaaucagccaguacacuuccauauccaggcauauacccuguguaagucaagaugguauucauacucuaaaauguaguguuggggauacaccucaaauggaaaccauaggcuaggacccaccaggacacaggcagcccuuucauccugcccccuacacugggaugcaguuuuaaguuagaccaaacaacuacaaucaacugaagcugcauuccaaguuuagagacaacuccuucccugucaacucagggaaauccaaacuugcacaaaguaccccgcuguccaugcacuccagcccaggacaacagcaagaggcaccuugcaggcucuuuggggccaauuacaaaugaacuucuugcucauguccaagauaaagaaacccacgaagaaaaagucguuguuccaaaagguguuuuuuauuuuuaaauucguugaaagaaauaaaauuauauuuuaaaaaaauagaguaaucucacaaacugaaggccaggaacagauagaacaaguuaguauuuuuccugaggcagaucugauuagcuguggaauggaaucuuccccagccugucacacaaacaggcgucuuuuccuauuucuaaggcaucaggagcacucuacaagcuccauggguuguccaggcacgaagcuucccuggaaaggggugagaggguuaagaaacaaaagcagcugcauccuuucuuaucaaacuguacauguuucuaguuucauaaauugagaaccguaaaaacugaauggccucaugacccaauuucaaacacccagucauauuuuaguuaaauccuuacugagaucccaaagucaccugugacccaaagggcuagacagagaggguggcucugauucccccucuaugcccagaacucgucaaagggcagccaucccaggagacagagacaaggcuaauucacacuacaguuugauuccuaagccaccaaccuguccacaaggcagaucaaacucuaaaggucccccgguaacaagacuuucaaaagucacucuacaguuuccaaagccuuaaguuuacccauuccccaaaccuaguuucccccaacuuuacagagaaaucuaucaaauuaaacaucauucccacuugaguaagaacauuugaguccaaacauuuguguucaguauggaacuacuugcuugugcuaacaaucucuuuuacaaagguaagagcaaagauggaccucauuuguauguucugauuugauaccuugagcacugaccucccuacagcuuuuuaaaguccuagcacugguaaccacaaauuccacaagaacauccauuugugaaagcugguguuuagaaguaagaguuuccggaagucugccuagccucauacauguucaagugggaccuaacugugucaccaauuaaauucauuacguaauuaucaauccacugaugaagauuaggauuauaugggugaguccuuguuaguuauccaaaccaucucucaaucuuuaggaguagaugguauuccaacccagguaaaaugguacugagcccuaauuuuuaaaaccccacucauuucuuggcucccaaagaacagugucggcuccugucuucagcucugcugagcuccagggcccugaaagcuucugucccgaacagucagcaacuuccugccauacuagggagcaaccugagcgacacugggguuaccaaguccuaguagaacacagggccagaaaugaccacauucaaacaagauucccagaacccaaacuuugaucacacaagacccauguuuagcuaccgucucaggaacuaacaaacugacacuggagcugugcacaaacuaugaguuaccaagaagacgaucuaaauacaacacugauaagagcagacccuacagacacccagcuuuucaguuucacaacaagagucaauauccugaguuuuaucagcauuuucucucuaaaauaaguuauacagaacacaaaagcauacuaauggaagcaauaacacaugaggucuggaagaacagcccacuaaacuagaaaaagauuccucaaagaaauaaaaauuuaaaaauuuaggaaauaaauuaaagauucaaaccucauacuuucaaguuuucuuugacuagucuuuugagagauggcauaaaguugauucauuuuucuaauaauuguucaguugagaucaaacaacaaaaggugccucuucacacaagcacacacacacgaacacuuuaccuuuaaaaaucauggccccauuggcaguuauuuugaacaaacacaggagaaaccaaaugaauuaguaguauuguaaaucauggucuguaucaucaagccaaggcauuuuauuuacuaacuuggcugacaaaaaaugguuucucccccaaaccaaaugcugcauuuacuugcguccacagaaacuaaaaugucaguacacaguagaugcuguuuuuuaggacagagaccaugcuuaucuaauaagcagaaggccccucaaaguucaaucgcacucuaugcccuuuaaaacaaacaaaagggaaaaaaaaaaaaagcccaagaccacuucuuccuuccuaaacacacuuuguauuuuaaccaccuccucaacaugacagaugggguuucuuuacuucaccuaaagucauuuuuaaaaauauguauguuggaaaaaacaaugcugacaaugcuaacacagguuuauacaucuauaaaauagggccaaauuauuaggacugguuuuuguagccccagaauuuaccauacacaauuuagaauaaaaucacaaacugaggaacccagauggaauucagcuuuucuuuuuguuuguuuguuuuguuuuuuuuguuuauuuguuuuuguuuuucgagacaggguuuuucuguauagcccuggcugaccuaggacucacuuuguagaccaggcuggcaacgaacucagaaauccgccugccucugucuccuaagugcugggauuaaaggcgugugccaccaccgcccggcuagaauucagcuuuucuuaauccaagguauucucucauuagaacccaguaccuucuacaugaccuuccauugucccauuccuacaaaagagccauuucuggggaagugaggauuuauuaagaauauuaaaguccaggaauuuuguuuuaacgauaaacccuaaauccuuuuagugcuucaaaaauccauuaucauuuaagaccagauaaauuacauggcuaaucagcuguucaguguugagccuagaaaacaaccuccaauggaaggagaccgaguucagccacugaagcaaggggugcaggguggucacaccucucauguucaagucacaagcccugggccuggaaggagaucuacugcccuggguuaucagaauuugucgcuguaguuuccgugcugaugggcugcacguugucugcgaggcugugcgcaugcucaagaaacaaaucuuucaguacacuuaauuccuuugucagcaacuuaauuuuggcuuccaaccguucauucucuuccuugagcugguuuacucuuugcaguguaucuugagcuuucugcuugcuuuuuaaccggcuuuuuuucaccgccauauuguuccgcucucugcgcuggcgguauucgucacuauuccgauccaugggugagcucuuuuugcuuugcuugcuuggaggcacagccuugcccccucccccaggcccagcgggcaccagcugaggaaccugcuguaagccgcuggcaugugccugaguaugaaugacacuuauuccauucacuccuggaguaguggcuggcugcgacagcuugcucauuugggcacguuccuuugccaacacagaauagguagaaaucagagcaaugugauccgaggaggccacacucaacugccaaaaaaucuucacauguaccuaguuagaaaauaagucgcauuaaaauaucugaaaugacaggaucaagucagaucaaacuugcauggacuuauaacacaguaggcaaccuauuaguuuugcugacagcaacugcaaaccguacagaaguuuccaaacuucaaaagguaaguuggcucagaagcaucuuaagcuaaagaccaguccaccuguaacuaucaaaaaagggacaaaaaaaugaaagcauagcaggaauacuagguagaauaugugagcuaauaucgcuggacaaucugccaggguaagcauggaaaacaaguucaauuauuguagacuagacgccugcaucugcagcaugggggaugaauuaagucagguuagaacgcuggaucagaacaucugucugcagaacccaugagggucuagaugcgccuaagcuccugacaaguucccuuucaguauucccaggaugaauuaacaaugcuuucaccuauuaugguuuguuuuuguuuuuuaaagacaaguuuucucuauuuagcucugccuguucuguagggcucuguagagcaagcuagccuccaacucaugaagauccccccccccccaccucugccucugccucuugaacgcugguaguaaaggcacaggccaccaccaccuggcuuguggauuacuuugaguugacugauuugcauuuucacauuuuaguaccauacuacaaacgaaacagcugaaucaacuguuuggagacgcagaacccuuagaaaaguaaaaauuauuauuacgaaccaugaaacuauccuguucucuuuucccagaacugcuaaaaugaccuugguggacaaaguuagggaaguuagcuagaguuagagaaugcccccgaggagcacacccaugguuacugagaaguucagucaguaaacaucaacagcuuuggccaagccuuucuucaagcaugcuuauuaaauuggcuuuuuuauuauuuauuacuauuaaucuuugcuuuuaaauauccauauaucauuacuuugaauuguuuuaaaagccacucagccagcccugagcuagugggucaucuguucuugcuccagcacuaaaggaagacagaaagcuuccucccaagccaugauggauauggacuccgaguuacacucacaauggauauuucacaacuucccuugaaaaugauuauguggccuaauuuuucucccacuuaaaagguggcuguucaaaauaaagaaaguaaacaaauuaauuaaaaaauaaggguuagcuauucaauauuaauuuaagccaucaggacuaccauuuaacacuggagcuuaucaaguugguauacuguguguaacccaauuuuagggacuuguagaacucaauaccccuccuggaacugccucaaaaaucauguucaucuuaguugccuauuuucuuauauucuuuuuucuuuuuuguccguuuuguuuuuugcuuuguuuuguuuuuguuuguuugguugguuggggguuuuuguuuguuuuuucgagacaggguuucucuguauagcccuggcuguccuggaacucagaaauccuccugccucugccucccaaguacugggauuaaagguaugugcugccaccgcucagcauuuucguauauucuuauucuucaaaacuaaucucuacagucaauuuagcaaagcucaaagauagcaaugauccaaagaaguacagacuagaagcaagaucaaauuuuuccuuggcacuggcucccucaguuuuacaaaaccuagacauaucucuucccuccugugagguccaacucucaguccaagagggauguggaaaggauaugaugcccaacuaacaaacuacgugaacucuagucacuaacaacuguugacaggcuccacauucaggauguucugccuguuuuugaacccaaagacacagaauugggguaagggucuaacuuugcuaaguuagaacaaaggauagguuuugggugaaccuuuuggcuagaaaaacaagaguauuguuuacugcgccuacaaacuugcaagaaaaaaaaagaguaaaaaauaauuuaugauuuuauuuuuuaaguaggcuggauauaguggugcaugccuuuaaagccagccuugggagguaagacucagguagaucucugugaacuuaaggcuagccuggucuacauaucaagauccaggauaaccagggcuauguaaagagacugucuaaaaaagaaagaucgagagacagaggacagggaagaucaaggaguuaacaggcuucaaacagaacaauuuugguuuugcacugaacaaagacacuugucauuuaugcuuuuguuccuuuccacaaacauuugcugaguucuacaacaaagcaaucugacauuuaauagcugaauauuuaacucuaaaucaaagucugguuccuggauggacuaaucuacuccaaaguucagucuacaggagccaggguggugccucuuuccgucugcuugucaaauacccaagaagcaagagggaagcugaggggcagcgguccucaaaguggucccuggaccaacaccagcaauuuucuacaagucccaacucucggcugccagucuggggaacaaguuuuggaggugagcuuucagucuuguuuuaggggaguccccaaaaugauuucgaggacacaauggagaaccauggcugcauauaaacaauggauuuuacuaaugugagaguaaaugaaaugagugacaagacuuuuucaaaugcaaauuucuuaacuaaaguaauaauguucauucaaaagaauaaaacaaugaaacucuggaauauuagaauaguaaaauaaaauagaauguuucuaaaugcuugcuuagaacaauaaacugguauagaacuucccuagcuugucgcuuuuuucauaaaacuagauaaaaccacguaucucuccacuggcuucucaaaauaaaaucuucacucaauuuccuuaaugaagguucagucuucagauuuauaaacaaaaaucuauaguccuuccuaaugccacagaaauuaccucaggcugacaucaucucccaggggcccuagucucagguguagcagccugagcucccuccaaccacucacuaucuagacuaucuagaacaauaguucuuaaccuucuugaugcugccacacuuuaacacagguuccucaugcuguggugacccccagccaguuauuuucauugcuacuugagacuuuugcuaugguuaugaaccauaauauaaauaucuguguuuucagauguccuuagaugaccccuguaaagggucagucauuagaccgacacccccccccccaagagguugcuaccugcaggucgagcagucuaccauucaaaccuaacuaugucacaucauccuacuaaaacuaaaugucugugacuccagacuacaggaucaaacccaagguccuaacccucucuacaaguucugcucccuuaugcucaacucaaggccacuacuuaauacauucuaaauggucucuguuuucucuuuucuuugugcuuuucuuauccaaucugcucccugaguuucuuuggcaacuccagaucccuggagacuguuggaggcagaguccacaagagagaggcgacuccuucaaggaguucaguguaaguuguccacuggaguugugaagaaaacauacacuuacuuggauguuaucuuuuaaauacucauaugcuuguuugaauguuauccuuuaaaccuauuuauaguacuaguuagcacauucaaaacaaauuguuuauaaauauauauuuauuaggaguuccuguucagguuuuuucccccucuuuaauggcagggcagggcaacggaauagggaaaggaccaacaaacuugcuaguguaagaaccuauguacccaccccucugaggaaaaccuaaaaucgcuccaggacucauuacugugacugaggcaacuuuugaccagguccugugucucccacgaucucuagagggacuguucccagggacuuucccaggguguauuuaauucacuagggaugaaagcaccucuccaagaucacagugcugggacgacaaucaugacagguugugagaauuuaaaggauauuggggagaggggagggaggaggucuguucccaccuauuuguuucugauaggucauaaaaauaacugagucagucaagcauguccaucagacucaggaaacaggcucaagcuuuuuuucagcucaguagcauccugucauuauuuacaguuuuucaggaacagggaaaugaccacagggauagcuagcuuaucauuacuacuacucaaguggccauagaugaacagaccuuagagcgcuuugaaggcuagaaauguggcucagagguagaggggcuugccuaccauacucugaauucuucuauguacaauuucucaauagagaaagaccuuauggugcuuuguuucaaauucccucugugagacaggucugcacucaaugauaauauauucaaauaaggauucaaguggguggaaacucaagagacacaacacccagcuguugugcaacccacaaagguuaaaaccuuucuaaauuugauacaucuuaugaugcaguuuacaaagaaacaaacaaaaaagcaagaaggagcagagcaaaacaaagcaugccaaccuucuuaagaccagaaauacacaagcccacuuggaaagagaaacaauucucacacccgcaugcccaacuuccccaccuggauaccuccgcuggcucuuuucccgagcucccuccaggcgagcuaaggaaaggcuucauggcuugaccuucugcgucuggugcgcgaucaucuaggauguccucccccucccagugaacugcaggacacacgaccgcguccaaaaaaacaaacgaaaucucccucuugcaacguuacguguguaaaaacucgagugccuucccuagaugaccacuagguuauuaacuccaaauaggacccgggccaucccccccagaccgagccguuugggaagccgacaggaagagaguccuagguggcuccaaaguaagauucgguccaccuucuauucuaggaacacccuccaucccuaggggccaaugcgcgccaggcuugucacgcugcacgucgccgaggggcagguucuggagggaccaccugguacuccaucccuuccccgacuguggugagggggcgcccgggggagcgcgggggucggcgccaagcgcggcggcgcugggccguggccagggaugagcucagccccgccggguguugcccgcagguugcaucagacgccgcuccgggcccccgcccgcgccgccaagccgccaggagccuuccgggccaaccugccgaaucgggcagggccgggucuccuccggccgggucggcgccuacgcgagcggcgggcucggccgcggccuccucccccaaccccuccgagcuacaacccgcggccuccuuaccugcgccuccggccggcccgcccgcccccagacggccuccacuccgagcggccccgcgcggcgcggcccgacccgacccgacccaggccucgcagcccgcgagucggcgaggaggagcgacgguuacgaaaccggcaaccuccgcccguuccgccaccgcggccaccgguuuuccccgccucuucggguccgcgcgcug

SEQ ID NO: 3722 - RNA, 2638 nt, Mus musculus
cauucgcgacccgaagcugcgcgggcgcgagccaguuggggcacugggugggcggcggcgacagcggcgccacgcgcaggcuggaggccgccgaggcucgccaugccgggagaacucuaacucccccauggagucggccgacuucuacgagguggagccgcggcccccgaugagcagucaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccgacagcaggagaaggccaaggcggcggcgggccccgcggguggcggcggugacuuugacuacccgggagccccggcgggccccggcggcgcggucauguccgcgggggcgcacgggcccccucccggcuacggcugugcggcggccggcuaccuggacggcaggcuggagccccuguacgagcgcgucggggcgcccgcgcuacggccgcuggugaucaaacaagagccccgcgaggaggacgaggcgaagcagcuggcgcuggccggccucuuccccuaccagccaccgccgccaccgccaccgccgcacccgcacgcgucucccgcgcaccuggccgccccccacuugcaguuccagaucgcgcacugcggccagaccaccaugcaccugcagccuggccaccccacaccgccgcccacgcccgugcccagcccgcacgcugcgcccgccuugggugcugcgggccugccuggccccgggagcgcgcucaagggcuuggccggugcgcaccccgaccuccgcacgggaggcggcggcgguggcagcggugccggugcgggcaaagccaagaagucgguggacaagaacagcaacgaguaccggguacggcgggaacgcaacaacaucgcggugcgcaagagccgagauaaagccaaacaacgcaacguggagacgcaacagaaggugcuggaguugaccagugacaaugaccgccugcgcaagcggguggaacagcugagccgugaacuggacacgcugcggggcaucuuccgccagcugccugagagcuccuuggucaaggccaugggcaacugcgcgugaggcgcgcggcugcgggaccgccuugggccggcccccuggcuggagacccagaggaugguuucgggucgcuggaucucuaggcugcccgggccgcgcaagccaggacuaggagauuccgguguggccugaaagccuggccugcuccgcguguccccucccuuccucugagccggacucggugcgucuaagaugagggagucaggccguggugguuucuccuugagaccgagagacuuuccgcggagcugagcugggggcccggcaguacuaguauuaaggaaguaaccuugugccuuggauacucaaaacucgcuccuuuuccuaccgaguagggggagcaaaaaugugccuugauauuuuauuuggaggauuccugcuuccucucgggccucagcuggccccgugagaaaaaugaagggugcaggcccagggcaggaggaagauacaggaagcugagaucccggcagugcccugagcugccccucagucccugucuuuagaggggagggacuuagguguuggggauuugagucuguguccucacccccagcuacagggagguggagggcuccuaaucccuugcuuuuugcaccuccaccuacauccccccccccccacucagcuuacaacaggccagguuuccugggugaguucauggagaaugggggcaccacccccagucagaccagaaagcugaguugugaguuagccaugugguaggagacagagaccuagguuucugggcuuuguggggugggggauaggaggacacggggaccauuagccuuguguguacuguaugucgccagccgcuguugcugaaggaacuugaagcacaaucgauccaucccagagggacuggaguuaugacaagcuucccaaauauuuugcuuuaucauccgauaucaacacuuguaucuggucucugugucccagcggugccuugugcaauggcagugugcacgucuaugcuaaaccaccauuuuauuuggucuuuuguuuuguuuugguuuugcucugauucuugccaaacugagacucuucacuaacggcugggggaaggagcugagugaggcucucauucuuuuugguuuagggauguuuggguuuuuucgucugccucccagaggaccaaugaaaugaagugggcuucccccucuccccuaguuguccaaggguguauguaguagugggucuuagcuuccuccggcuaagacuuaggcuuccccacccacccaaccccauccccaacggcccuggcucugggucuggaaagaaggccaccuccagccaguucauacacacaccccuguggcugggagcagggcuggaccgcuuccuucucuucuuuuuuuugggggggggggacacaaaguuucaugcuagaugucguauguauuauaucuauaauauaaacauaucaaacucaau

SEQ ID NO: 3723 - RNA, 2638 nt, Mus musculus
auugaguuugauauguuuauauuauagauauaauacauacgacaucuagcaugaaacuuugugucccccccccccaaaaaaaagaagagaaggaagcgguccagcccugcucccagccacagggguguguguaugaacuggcuggagguggccuucuuuccagacccagagccagggccguuggggaugggguuggguggguggggaagccuaagucuuagccggaggaagcuaagacccacuacuacauacacccuuggacaacuaggggagagggggaagcccacuucauuucauugguccucugggaggcagacgaaaaaacccaaacaucccuaaaccaaaaagaaugagagccucacucagcuccuucccccagccguuagugaagagucucaguuuggcaagaaucagagcaaaaccaaaacaaaacaaaagaccaaauaaaauggugguuuagcauagacgugcacacugccauugcacaaggcaccgcugggacacagagaccagauacaaguguugauaucggaugauaaagcaaaauauuugggaagcuugucauaacuccagucccucugggauggaucgauugugcuucaaguuccuucagcaacagcggcuggcgacauacaguacacacaaggcuaaugguccccguguccuccuaucccccaccccacaaagcccagaaaccuaggucucugucuccuaccacauggcuaacucacaacucagcuuucuggucugacuggggguggugcccccauucuccaugaacucacccaggaaaccuggccuguuguaagcugaguggggggggggggauguagguggaggugcaaaaagcaagggauuaggagcccuccaccucccuguagcugggggugaggacacagacucaaauccccaacaccuaagucccuccccucuaaagacagggacugaggggcagcucagggcacugccgggaucucagcuuccuguaucuuccuccugcccugggccugcacccuucauuuuucucacggggccagcugaggcccgagaggaagcaggaauccuccaaauaaaauaucaaggcacauuuuugcucccccuacucgguaggaaaaggagcgaguuuugaguauccaaggcacaagguuacuuccuuaauacuaguacugccgggcccccagcucagcuccgcggaaagucucucggucucaaggagaaaccaccacggccugacucccucaucuuagacgcaccgaguccggcucagaggaagggaggggacacgcggagcaggccaggcuuucaggccacaccggaaucuccuaguccuggcuugcgcggcccgggcagccuagagauccagcgacccgaaaccauccucugggucuccagccagggggccggcccaaggcggucccgcagccgcgcgccucacgcgcaguugcccauggccuugaccaaggagcucucaggcagcuggcggaagaugccccgcagcguguccaguucacggcucagcuguuccacccgcuugcgcaggcggucauugucacuggucaacuccagcaccuucuguugcgucuccacguugcguuguuuggcuuuaucucggcucuugcgcaccgcgauguuguugcguucccgccguacccgguacucguugcuguucuuguccaccgacuucuuggcuuugcccgcaccggcaccgcugccaccgccgccgccucccgugcggaggucggggugcgcaccggccaagcccuugagcgcgcucccggggccaggcaggcccgcagcacccaaggcgggcgcagcgugcgggcugggcacgggcgugggcggcggugugggguggccaggcugcaggugcaugguggucuggccgcagugcgcgaucuggaacugcaaguggggggcggccaggugcgcgggagacgcgugcgggugcggcgguggcgguggcggcgguggcugguaggggaagaggccggccagcgccagcugcuucgccucguccuccucgcggggcucuuguuugaucaccagcggccguagcgcgggcgccccgacgcgcucguacaggggcuccagccugccguccagguagccggccgccgcacagccguagccgggagggggcccgugcgcccccgcggacaugaccgcgccgccggggcccgccggggcucccggguagucaaagucaccgccgccacccgcggggcccgccgccgccuuggccuucuccugcugucggcugugcuggaagaggucggccaggaacucgucguugaaggcggccgggucgauguaggcgcugaugucuauagacgucucgugcucgcagaugccgcccagcggcuccggggcggcagguggggcugggggcggcgcggggcccgcgccccggggaaagccaaaggcggcguugcugggcgcgugcggggggcucuggaggugacugcucaucgggggccgcggcuccaccucguagaagucggccgacuccaugggggaguuagaguucucccggcauggcgagccucggcggccuccagccugcgcguggcgccgcugucgccgccgcccacccagugccccaacuggcucgcgcccgcgcagcuucgggucgcgaaug

SEQ ID NO: 3724 - RNA, 15669 nt, Mus musculus
gguucagagcuagcggguuccggucggagccgcgugcguggagcuguccagcaccccgaggcggggcgugcgccccccggcccgccccagccuccuccgcccgcccugucagcgccacugcggcucggcgggcgcgucacguggcuagcgcggcgcggccucccggcuccgggcuuaggcgaggggccggccgggaggacggacggaccgagcgacgcacccucguaggcaccgugcggcgcagcgcgggcggcccggggaccgacgggcagggcgcgccggggcaugggcgcgccggaggucucggugcgcaggccgggcugggcgcgccggccggggcuccgggacagcggcgggcgagggucuucccuggcgaccgccgcugagcccccgcggggcccgugacgccgcggccgauguggccccgcgcguugcgggccugcaccgccgccgcacaaagacgccgccgcagccgccgcccgcacccgggccgcagccgccgcgccagcccuagccccaggcggagccccggccgcagggcagcaggcguccgcgcgcggcccgccccggcauggagaagcgcgcggccgcggggccggagggggcgccgggcgccagggcgccgcucgcagucgucugccugggugagugggccgcgaggggccgggcgggaugggagggcuuggagccugcacugcgauggcuuccgcgcccaggcacccuugggcugccgaggagggagccucccaccacagcagaaccccaggcccggagcugggggacgagaacgcuggccuuggguuccugggagaggcuggggucuuccugaugcuuuccagcccggccugccugaguggugcucuggcuuccagagcuguggacaaaggccuggacuacugcucccuaaagaaggaacccuuuccugccuggaguccuggacaggccugggagcuagccaaaagauggggacucagcaugggggcuuguggcgggggggagggaggcagaugugagaacucauuuucccauugugucuucccagacccagauggucauaggucgguucaucccugauggggguugggggggggggucugagucuguuccggggagggccaagaacccgccaggacuggaaccuagguuagaaggcuccuucccugaccaggaaaaauuucuguccacuuucccagagcccauugcaggagaggggaaggaaggaguuaaauccccaacccacaugguucuuuauuuaccuugaugaaggagggaggcccuuagaagagcugggucauuaggggacacccagugauaucacuguugagggccuaggaaugugacaggcucccuaaaaccacugaagugacaaaguugugagggguguggggcagcucuuucuuuuuaaacuguaacucucaucuggccuccaggaauagagaagggugaguguccaggagaggacuacugcacaggcuaugugagcuaaucuaagcaguggcuuauaugcccugaguuccugcuucaccugcugcuaguggucacugugucuggguccuggcuauuguguuucccaggugggcagggcaaaggugagggcuuccuugcucaggagaugcccgugucugggucuaacagaaccagaaugcccugggggugcagauggggugaauaccccuauuucuucaucaaauguagaaucacugcuccugagaugagugccucaaucauggagggggggcacccugguccccaggcuguuagaauucuuuucauuuggcuuagacucugucucagccuggagccaacugaagcaauggacauuccuacugagguggacacuuacugugccggugucaggagagcacucucugccuuuaggaucauggggugcagggaagaugaugguauuguuaccccaaaugcccaucaaaggaggaaguccuucaaggugguagaaggcugcuugaaagguagagcucuugggacugagcauacgggauggguagccucaaaucugagaggaaaacacugaauucuguggcaugaguaucaucaugacacaggaugacacagccaagcuagcacacugcugucucuaucccgagacccucugaguuccucaccuuugccugucccagaaggaauggcgguggagggagagucucuggccuugacaugggccauggcaacugagauaaagaggggguaccuucauuucaacuguguuguccuguguucacuccuagcccagacaugggcucugaacuccaagagcuacuguccccuacugacaccucuuuguucuuucacagugaaccucuuucucacugggaggcucagcagugcaguucccgccuuaggugaguaagccccuuucucuugccugcccaggguuagcaaccucuggggaugucuguaccucauggccaagguugggaaaacuuuuaccugaguauuuuaacagcaucaaaaaggagcuguuggucuugagcaaauuuaaauuuagugacauugauuucuuugacaagauaggugaaaugccagacuaccucaaaccuagccguuaggguccauugaagcaaugacccaagaugcucagaaggggucugguucucuguggcuugguaccacugcaaacuagcaaaugcccuguacagcugauagauugugccucuuguggccuaagggguuccuuagggacacuggaugcucauguauuagaauaauacccagagauaauauuaauggugccacagagguuaguaccauuaaaaaaaaaucagacuuuuaagacugguuugguggcacaggcuuguuauuccagccacucaagagacuaaggcagaaaaguugacauuauggccugccuagguuacagaacuaguucaaggaaagccuggcuaacauugugagacucugucuaaaacauuuuuuagaagggcuggggauguaguucaaugguagagccccugccuagaauccccuagugaggcccugggggcauagcucaguggcagagccccugccuggaaucccccagugaggggcugggggcguggcucagugauagaacaccugccuagaaucucccaugacucugggggcgcagcucagugggagagccccugccuagccuggauucaagucuuaguggguuugaccaggcugacaaaggaugaggggaaggcagaagccccagcuuucacuggaauuuccaagagagaagcaaagcaaucaggcaaacagcuuggacagcuuagaauggccaguuagaguaauccuggaggcgaauucuagggcaggcucuagcaagcuaguaccuaacccugggaugcuucagggcaaagaggguauuggcuggugugugagggucaggaggaugguggauaggaaugcagcccuggaucuauugcucugcaugugaaaggcuugucccagguaaaccacccugcagcagagagguugacacagcgugugaaaaagcagugcagaguccuguguuggccucuugccuggcaggauuggcuggccaucugaugaccaucuuugagcucucaccuggugcccagagagggaagagcagccauagauacucauccucaguugaggaggggcugucgcucuuuggagaaugacuaggucugaugucuaccgagguagccugcucuaucacuaauauacugaguaaaccucaccaucucuugcucguuuagucaauacauggccaucuucagcaaacccuaaaaugauguuuuaaugccaggugugguguugcaugcuuguaauccuaguacuggggaggcugaggcaggaggauugcaaguuccacaccagccugggcuauacagagagacccugccucagaaguaagccaaggguaaccaaagucugaguaagugguaagagcuuuaaggcaaggacuucaggguguguguggucagcaaggaugugugaccccaagucuggggaccuggaacuuguuuguugucucuugugccacaggcaaagcaggagcuacgugggguuucggguuucaggcugccacugagcccacugggacucaagguggguagauuugucuggugaucacaaggggugugggggagggcaggcagaggugugggggagacauucacggggugggggcaauagcucuacccaucuagaagacugggcuuuugucccuauaauuuucucuguaccccagcucuguguuuuucugcagcugggccuccucuucugacccaggcuggcccagggcccugcuguagucagcacugaccagccccacccugccugauguacugaccacaaaggacagcccaauuucacauccugguuccaggaaagcacugacugggucagguucuggccagggugcagugcggggggcggggggggagaggaggggugucuugcaagcgugaaccagagaccuguccuuccacugcuggugggugucugugggcauuccagauguguuccccagguuugcagaagcgaugcuugagggacgagaccuaaggcacuguacacucuccuuacucaccuccagaggugguuguucacacauugaugccuguguauggcacccuugauuuggggagauaaaagcacagcuugccuggcaaugacaaguggcaggauggguccucaucucccugaaauccaccucugacacucaucaggcauugcugaccagcuucuuccuggccuagcugacccuucccagcauggacugcgugauggcauuuccaaauacuuuugguauuguccuacugucucccagccccuucucagcccacaccagauagauuuuggugccucagccuaucucuugcucuuuccacgucaggcauucccugggucaaaagacuaccuccugaguacagaaggguucacacugucuucuccucaguuaggcacuuguucacgugccaggggaugagggaaggaugucggguuacuauggcagauuguccagguuaccgauagccccuggaaaucagaucuacaaacugugccacaucaggccugccccuguccucucaagaggauuugacaaugcuuuggcuccacagcuaaugacccugccuauaaagcugccacccaucccuuuccuacuuugccacuaagagcucagacaaucuguuagagcaaagguuggccuccaccucaagcucacggggaccucccugacacaccaaaugcucucuccuauaccagcaucccccaaaugcaguccugcugccucugcucugaccuuuauguaaccugucaaauccucccuucccacaagacuccacuguagacucuucugccccauuguucuguuccguuacaugacugucugccucaagacugucacuugcuaauuuuuuuucaaccauagcaagcaacaugcacuguuuuuacagauggauaagaaguauccuuuuauaaggauacacauggccauggccgguauccucuacaaggauacauauggccauggcggguauccuucuacaaggauacauauggccaugguaaguauccuucuacaaggauacauauggccaugguaaguauccuucuacaaggauacauauggccaugguaaguauccuuuuacaaggagacauauggccaugguggguaucccucuacaaggaaacauauggccaugguggguauccuucuacaaggagacacauggccauggaggguauccuucuacaaggagacacauggcuaugguggguauccuucuacaaggagacauauggccauggcagcuuaggucugggccccaggguagagaugcugcugcugccauagagaacugaguuuuaggguguguuggccaagcuagacccaucaccaagcuuauugccagguggugucuagacaagagcccuucauggagauuccagagcagacuguucaucuugauguaagacccaggagguggcuguagaauccuggucuaguacuuugugacauccccagagaagaagaaaugguuaacagugacauuccguggggguuauagacaagaggguuuguggaaagguugggugggcugucagugguccagucaucuagacagauaggccaccuaaacccugaaugaauggccagaugugcuauacagggacaggugucuggcugaggcaggaagagagcaagauguugauuuagaaccuugaucaauucuuuguaugaggaagagacucccccaaucucacuggucucggccuacccaggaaccacccucuccaggucauuucagguggaugccuaggucucugaaagauucccuaguuaguagcuuuaucugccagcaggagucaggcccaggcuagggcacccugcauguucucuugaggucguguucugcuaguuugggcuccuguuuccuugauuaagcccugacauuagaaaggcugcaugcuagggccacguauagcaucaggagcaaaggaacuggcucguaccucauugaggugggacucuugauacaauaaagacaaagcucugaggaugaccacccucacuuuagggacaaagguagccuuccuucccucccuuuguuuguccuuccccuuuccuucuccuccuuuucaccuucucuccccugccaagucucucuuuccucugucugucugucugucugucuugucuuucuaucuuaucuaucuauucacccauuuaugaucuaucuauugucuaucaucuaucgucucucucugccucucaucuuuuuuuccuuggagucucauguaguucaugguggccuagaacccacuauguagcuccaggcugaccugaaacucaggacccuccugccuuagccuuucaagugcuaguaucacaggugugugccaccacacuuuguucaaagaugcacuucugacuaaauucuuugaugcucuuaugaauagaauggauagccaaaauuuccauggucauggauggcagagugaucagaccccuugggaagcucaaaagguacuagacugaccaucaguaguccaugcugggcacccacuguaugucaggcacugugcuggccccugagugucagucaggccagagcauucaagccugcccuccuauggggacuugucaugaagcaauuucuagaacaagagggagguaacuguugugacagaggcugaggaggaauggaggggcaaagguuaggagcucugcuggggugaucugguguguagacuucccuaagaaggggacccacagagcugaagcugagaaggagugagggggauaggagguggggaacgguucucccuuccaugggagggaucuugggcacaggggaagcaaggcaguuuguuagauaggugagcauuucuucuugcuaagagauagggaugcaaagaguuggagugagguccuccugcagcagugucccagacucaggccacagagcgagagaaugcacuuucagaggcaacacgacagacgccugcagugggagggugaggaugcagacuuggagaaaagagucacucuuugcuucccgagccuugcucauccaucuguaaaaugggccuagccuuugugacaggcuggguaagagaacuguuugagggucauggcagggauguagccaaguguaagggugcccugccuggccaugagagaaccugcacagcagggcagguguggggggucucucacucaugauggcuaaugaugcuuuaucaucauccccgauguggcauacaguuggcacucuaucaaugcuugugagcucaggacuugcaguaaggcugagcccaccaaaggauccagagguuucuguaccuacccuugcuggcugugugcccagaaauaauuuacccucucuuucuuucuuucuuccuuccuuucuuucuuucuuucuuucuuucuuucuuucuuucuuucuuucuuucuuccuuccuuccuuccuuccuuccuuccuuucuuucuuucuuucuuuuuuucaauuuauuuauugcuauauguaaguucacuguagcugucuucagacaccccagaagagggcaucagaucucaucuauggaugguugugagccaccaugugguugcugggauuugaacucaggaccuucggaagagcagucaguucucuuaacugcugagccaucucuccagccccacccucucuuuauccauuucuuuuucugguuagggugucuaccucuaguguuguuuuguuuguuuguuuguuuuacauauauuuaaauaaaacuauuuauuuuuuacuuauguguguguguaugucuggaggaagaggggcuguacacauguauucaggaggucagaagaggguauuagauccccuggagcuggaguaaaagguaguuaugaguugcccacugugggugcugggaaccaaacacugguccuccucaaauguaguaagugcucuuaaauacugagccaucucuccaguccccagucccaaguuuauucaaggugucaugagacccaucugcagccaggucuggacaucgccaccucccuucuugucaccagggacucuguauaaacucuguguucuuucauccccuacuugugagauccacaaggaagauuuucagucuugcuuauuuaugccuguuauguuugcuuggugcauaguagauguccaguaaauauguaucaggugacaaagcaccucuuuucccuugggcccugucauuuaaaauauuuacuuauuucauuguaugugcauaugugugugccugagcauauguuuagguaccaugugggugcagaggccgguggagaucagacaagggaacagauccccuggaacuggaguuauagaugguugugagcaucuguguuggugcugagaauugaaccuggacccucugcaagagcagcaagugcuuuuaaucacauauccaucucuccagcgucccuggggguguguuccacauggguagguaagaacucuaauggccugugcaggccuacacgccagagaccgaugugcaagacauccacuaagcugaggccauauugcaugugggaugccaaggggaauuaaaagugucuugcucuuagcccugcugagaugggggcaggacacggacuggacacacaggaucaagacuccaguauagcacaggaaugggcuacacugccuuaagucuggaggguuccuccuugaaccccacccacacacggcuuccaugaugcuugaacuguagacugacugggcuuaguggaaacuuguguucaagccacgagcagggacacccgcaggaaacaugccuccuacccaaagguggguggacauuucucagccuucucucccgacagccgccugcagugggaaguuggaacagcacacugaacgucgagggguuaucuacagcccagccuggccccucaacuacccuccaggcaccaacugcagcugguacauucaaggagaccguggugacaugaucacuaucagguaaggagagcaucccugggacugcacaugugugugugcuuagcagcugcggagggcacacacauggguauggacaggugugauguguacugugugugacagguauguagguguauggaacaggcaucugagagaccuguaugaccaugugugagcuguaagcaugugugggcaugugagauauuauggccauuuaauugagcaauuccuuggucgggugcucugagcugggcucucuuccucuauugauucuuuccuuuuugguccccaaaagggagccuugggagcuggugggggagucuggcugcuugaaguagcacagguuucugcccucuacccuuugggaguggcuugaggcuaggguggcauggagcccacaucaggguuucugcaaggaccucaggugguccguugggaggggagcuguagguagaaggcagagggaaauaggaugaggugcuagagggugucaccgaggagcgagaaacucugaccuaggucauggggacauuuggcuagggggucacuauccauucugucugccggauugcugcaugcugaaauccagaagcccaccucacucuccaggacuaaugacuguagaucugaaggacaggaaugggaugggccugcucugguggcuauugcuuguuuggcucagaucuggacuaacguuucaccuggguaacuuguggucaccaagcugcaguaucaccaagcuagcagcaucaccaagcuagcagcaucaaguagccuccaggacagagccccuccuucagggcacaauccugggaguuugugcuauccaguugacuucggaugagagggaucugagucuuuuugucaccgcccuuuaggggaaacugccagagggcugcugacccccugugcucaguucagagcuggggaugcuauuugcaugcuaguggggcagggagcuguuuaggagcuggacugauggacgcugcccauggaugccaugacgucucauggagcugccuuuggacccugggguggggucagagccaggcgauuucggagggugguuaggugggacagaacuccagcuugacugcuguuggccagucccggccaugaggacccugucugccuaaccacccgugauccucucugcccacaguuuccgaaacuucgauguagaggagucucaccaguguucccucgacuggcuccuguugggcccagcagcuccuccucgccaggaggccuuccgccucugcggcucagccaucccacccgccuucaucucugcccgugaccacgucuggaucuucuuccacucagacgccuccagcucuggccaggcccagggcuuccgccucuccuauauccgaggugaugccagcgagguccuccacuagccccaauuuccugaaagggcccccuuuaccagcucugcuaauccuaggcugauucuggugaugccuuauuuaccccacuuugcuggacgaaucugcccucagccuaagcucaacugagauagugaaccuagccuuucaccugugagccucugccccauagguggcccugccuuucuguacagagacccagcugggacugaaccuauuugccugcucccagccucagacccggugcuggaaggaggcucacccugccucgcucuuugucuccagggaagcugggccagacauccugccagacagaugaguuccgcugugacaacgguaaaugccugccugguccuuggcagugcaacaugguggaugaguguggagacggcucggaugaggguaacugcucagcaccugccucagagccaccaggcagccugugccccgggggcaccuuccccugcagcggagcccgcuccacacgcugccugccuguggagcggcgcugcgacggcacucaggacugcggugacggcucugaugaggcuggcugccccgaccuagcauguggccggcggcugggcagcuuuuacgguuccuucgccuccccagacuuguuuggcgccgcccgugggccuucggaccuucacugcacguggcugguggacacgcaggacccgaggcgcgugcugcugcagcuggagcuacgacuggguuaugaugacuauguccagguguaugaaggccugggcgagcguggggaccgucugcugcaaacgcuuuccuaccgcagcaaccaccggcccgugagccuggaagcagcucagggccgccucacuguggccuaccaugcucgugcucgcagugcuggucacggcuucaacgccacauaccaggugaagggcuacugccucccgugggagcaaccaugugggagcagcgagggagaugacgacagcacaggggaacaggggugcuucucagagccacaacgcugugauggcugguggcauugugcaagcggccgagaugagcagggcuguccagcgugcccuccggaccaguaucccugugagggugguaguggccugugcuaugcaccugccgaucguugcaacaaccagaaaagcugccccgauggcgccgaugagaagaacugcuuuuccugccagccgggcaccuuccacugugguacgaaccugugcaucuuugagacguggcgcugugacggucaggaggacugccaagauggcagcgaugagcauggcugccuggcugccgugccccgcaaggucaucaccgccgcccucauuggcagccuaguaugcggacugcugcuuguuauugcccuaggcugugccuucaaacucuacucccugcgcacgcaggaguacaggugggcaccccgugguggccuggagccccaguucuuccguuucccuggagaaagaucucacuacauuccaggcuauggguugggucgcccugauacaggaagacuguuucugugugugcaugcaggggucuggauggagggguggggguccccagauccugcucuauguuauccuaucaugcuucccuucugcccguugcuuucagggccuuugagacccaaaugacacgcuuagaggcagaguuugugcggcgcgaagcccccccauccuacggucagcucaucgcacagggccucaucccaccgguugaggauuuuccugucuacagugcaucccaggugagcuuccauaaguaugugugugugggguggggguggggcauaaggcccgguuucuuuuuugcuggaccucagagagcccccaagaccaggaggccuaggggcaagcuagagcuaggguguuuggagucggggaagggaauaugguuuggugguggaagcacagauuagucccuggccuggaagcauggcaugcugaggauuguucagucguuccggaauggccuggucccuaccuuagcugcuccccuacccucaggcuucagugcuacagaaccuucgcacagccaugcgacgacagaugcgucggcaugccucccgcagggggccaucucgucgaagacugggccgccucuggaacaggcucuuccaccggccacgggcaccucgaggccagaucccacugcugaccgccgcucguaccucacagaccgugcugggugaugggcuccuccaggcagcaccggggccugucccagagcccccagcacccaauacagacacaggcagcccuagggaggcuggagaugggccuccuaguggcucuggccaugcaccagaaguggggccuucagugccacccccacccuuaaaucugcgagacccagaguacaggccagaggacaaggagagaaaggccuguguggaaccucuggaagacagcccagccccuguggacacgccuccagagcccugcuuggcacaagacccccacccucagacucccacugccaguggcacccaagacccccacucagcagagccacugggggucugcaggagcccuccaccacccugcuccccaauauuggaggcuagugaugaugaggcccuucuggucugcugacccauuggacacgccggugacugccacagccccgcuuuggaaccagggaauacacagucauuucuacccugccucugcauucuuucuuacagaggcccacccagcagccccugugaggggccugggcucucagucagucagcugccucugcaacccuauugcucugaagagcugcguugcuggcaggggcuucggggguuggccuggggaagaggguggagugacgagaccaccucugagaucagcaugagcauagcccuuggagucucccagcaaauugcucugccacacggaucuggggauucauuuccagaaaggcaggagagccagaaccaggcuuucuggaauguucccuguggcuucccaguucauucaccugcaguggcaccagcugcucauccccagaacugugucaggagcuguagucgaggccugaaaaggccaugggagggguugcaccucauucauggugagugcuuccaugcagggucccuggggaagauggcccaguggcuucugccccagccuugugccuguggcagcagcaugggccuggcuaggcugcauuaguccccaagcauuaugguaaggcuaaaaguauaugagauaggaugaccgcaagagaggccagucuaugccuucucaggagacagaagucaaggcaccagcugacaauggaaacaaccauccuguccugccucagagacucaguuuccccaccugaagccagggcugugcuaucagaaguuguagcauucacucuggugauuuugggggaggacaguagucccacuuagggauuucuggguucucuuggaucgcugagucguagauggagccucacugucuccucugggcagccuccaguucaaccagcaaaacccacuagggcugaaaaccuuuuccauggcaccuucccagcuagcagcccauauaccgcgcugaggcauguuuccacggacuccccuugcacacagcaacaaccagcccuguuuauuuacaggcauuucuggagaagcuagcagggcauugcuaaggcaggaagcccgaccccaguggccagucccuuacaauaggccucuaaggguugggucucucuuucucucucucucucucucucucucucucuuuuuuugcagaaaaaaaauuuuugaaaacaaaacaaaacacaacccccuucucaauaaacaacauguaaacagaaucggcuguuccagucucuacaaggucucauugugucuucaagggcuuguccgugaugggcaauggggagggcuggcccauggggccauuuuccuccuccucuagggagcccuggggguaaaccacgaaacacagcuccuggccccagcgugucauggacucuaagaacagacagacaagacagacagauagacaauggcgggggccaggaggggagcaauccuuuaagacagggaugacccuaacuccagauaccucccuugggaugggaguugcuucuuuugcagaugaaaccuagccacauguguauguagcaagaagcuuugaggaaagucauuggguccugcgucaccagccaggcugauagaaggccccggcucuggggugggauccuacaagaggcaugguggcaagacccuucucaccugugaaucuguguacacacuuugguuugcuucuccagaacacucccaggaagaagaugggaaccccagugaggauaaugaugaugccgaccccacagaccaugggcuccgagaugaagcugaagaccaguaggaaugcccagaacaccaaguacacaacaggaacgaggagguucaccugucggagaaagggugaacaggagcaccagggagcaacacccuaguucuccugccacccaggggauuagaagcacuuuuuccaucucuugggaauggggccccuaugcuggccccucugguagcuacccaguguacuggagagcaauuccuggguugaccaguuggccaaacugcuaaggcugucuauuugagcagugcugagcugucuguaacaguuauacacagaaagcuguuuacauuuggcugcaacucaacuguuuuuuuuuuccaugcuucaaauuucaggcccucuucaggauccauaugcagaugggagucuucucugucacccuuucaugugggaucaugagaauaccagacucugugauuggcagccucugugaccuuagucucauugccccugucuguguacuggggauauuaaaaacacuugcuuccugggg

SEQ ID NO: 3725 - RNA, 9753 nt, Mus musculus
cuuggaugucaaaaugaaugucauuugguuuuaaugcaaauacuguauguuaauuaucaaguugauucuauggcacgaccaugacauccccuuugaaggaugaucacuguuuauuuauauuaacuuuccuuacugugaucaaaagcccgacagaagaaacaagggaccuuccuggaggcagaaaccugaggcaaagucugcucgcaucuccucagauggagaaacaaaggacccugcuggcacagaguuaagacucgaucccucaagacccuagcuaaagccugccccucaguuuucacaaccugccaaaauggcuaccaaccagggagcaagugggaguccucucacaucugacccucagcacucuuuaacuagguaucucggaaucaauuccugcgaaaguguaagagagccagggcucagucuccacagcgcaccaggaaaccugcuaacgcgugggacaguuagaggauggcaggagaccacuuuccaauguucaacuaauaaaacaacugucgugaaaccguucaucuuggugacaagagcuuuacuacuucguccauucuacauuuggcuugcugugcagucugacaaauggcagaggcucccaaaacacacaugacacagguaacaccucauugugacuuuuauggguacauuccuuagauuuuuagacagguucagucaaucuucauuauuugcuaacaguacauaaguagugcggcuuacaggugggcaguacaucucuuauucacuauguaguuccuaggguacacgugcuuauucucugacggaagagucauguagauuucguacacauagggacuguggaucacaacucgguuaaggacuuugccuuccuucacgauuucuucagucuuuuugucaguagacauauucuuuuccaagaagucugagucuuucacauacagcucaucuccugaaaaauaguaaaaauguauuuccguagagcauuguuucauaacacacacacacacauaucaaggacuuaaagcaguguuuuuuggauguauuucauggugaagcuuaguugguguuuuucuuguugcuuguacuaaaauuuauuuuauuauaauccauguauauguguaugugugcguguauacugccugggguggggacuggggacugaccucagcuacucugagagcagcaacacagccucuaaccacugggacuggcuguuucagguuuuuauugugggggggagagggagggguauguggugcauauauucaugcaggugggggucagagaccagccugcuaggguuggcucucucccucugccaagcgugugcaugauuacaggcaaggaagcaggagggccagagaaccgccuugguguuccuccagaacuuucugccuuuuaucucagcuaggauuccuacuggccuggaacuuuaccacuuaggccaggauacuuggccugugagcauccagaaaucugcuuguguccaccucccauccugccacugcaaggcugagaucagagaugccuaucaccagaccuuccucucugcaccacuucaggggacccaagcucgggccuucacacuugcuagccgaccuuuuacugacuuagucagcucucuaguccucuguguuggauuuuaauaucccuacauuaugccucccuccaagauaagcauuugcuucgggcacaucaaaaauugaugccuaucguguuuccacugucagcuguaauuauuuuaucauaguucagcagcacugggaauuaaaacugaggccuugaugcaguugaggcaagcaccccaccaagucccaugcccaggcaagagcacuuuaaguucugaacuaguucaugacucucuuuauuaaauaguaauauuaauguuggccuuaguaacaaugauuuugauguuucaauacaaguuuguucugauaaucucauggcuaauccauuuuuuuugcuuagucuuaaaauuuuccuuauguacuugcguaugugcgcaggcgugaaggccagaaguugacacagggggucuuccucagucacucuccaccuuacguuuugaggcacagacucucaccaagccugaagcucauucauuuaaugagacuccuuggccagcaagccucaacaaucuccugucuuuaccugcguagcugggauuacaaugaccaccagguuggccucuaaccuggguacuggcaauaugaauucacauccugugcuuauacagcaaguacuuacuggcugagccauagcauaaucaccaagguuaauuuagaugaguuaucacuuguauuaaacuugcuagggguuggagagaugggucaggguuaagaacacuggcugcuccuccagaggaccugaguucuggucccagcagccacaugacagcucacuacaaccuguaacuccaguuccagggaauugaugcucucuuuuggccucuguggauauuaagcacauuggugguacauguacauacagauaggcaaacauucauauacauaaaauaagaauaagucuuaaacccugcuaaacuauccuucuguagggugaauaacaaaucuuaucaguauuaucagguacugaagaggcagauaugaaauacuacauagugcuuaaccccgaaacuguccaguguuugccaaacuauaacucaccaccgacaaucuuuauaauucaaauaagcugacagucuacaaguucucauaauuugaaaugaagauguaaaagugagaaaaugcaugauuagagaaucgugcccaugccuaggaaauauauauaugcauaaauucaggauuucuaguuauaauaaacauuaugggcugggcacagugguauaccugugaucucagcaaauggguaaugaaggcaggaggaugccagccugggauaaacaguaaguucuaugccacuuagucugagaucuauauuagaaauuuucucaaaaauaaauaaaaauaaagacuauguuuccuaaaguucacuuggacaaaaccauacagccuauagucaucugaaauaaaguaucuuaauugaaggacugcccagauuauaugggcccguggaaguauuguccugauuguuauuugauacagcccacugugggcagcaccauuccuuagucagugggucccaaacugaguaagaaaguuagcuaagcacaguucuuugugagccagcuagcaaguagaauucucuaugguuccugauguaugccucugauugugaagugaguuuguugguuggaagcaaugcugugugugguaaagcuugaggccuguuuucaaguuacugccccagcuucucucaauaaugaaccauaacccacagucugacauaaaccuucuuccucccaaaguugucuauggucaugguauuugucacaagaacagacucaaacuuaaaacacguacauuuuaugauucuggccuuccccucuccucccuccguuuuuugagacaggguuucacuguauaagagcccuaauugucccggaacucucaacguagaccagacuagccuccaaaucacagagauccaccugucucugccuuccaaauacugggacuaaaaagcaugcaccaccacaguggagugacagugaccuuuuaauuacuauuccaccaggcacagcaaaccucguaacuaaaggcuagagccugugauugagcaguggaagggaaagguggagcuuuuagagagggagaagagaggaaggaggagaggagaggagacaaggagauggaggagacaggggaagauggaggaagaggagguggaaggaagauggagcagaaccauguggcuuggagaagucacaaguagcaauggcucucauagcuggggaacagaguagugcagugguaaaucugcccaauccuuauaaauauuguaacugaguugucuguucuuugcacgggcuuauugggguuggagauuuacugcaacccuugacauuaaagauuaugucugagaaccacacagcugaacaacaauaaaaaaacaaacaaacaaaaacuuuaaaauaaagaaguuaagaaaaagaucccucaaaacuugucaggaagcauaagcuuuuguauugggcugcauucaguuaucagggggugcauggggguggccuauaagcagagguuagccacacccacaggcagaggcgacauaaaacaggcuguaacuccucccucucugcugggcaaugcugccagaaagccuggcuguacccaacucgaauccuaaugaacaggagugcuauacuucucugacucaccugggagaagauggauggugccaucagaaguuaaaaguauuauuggcagccauuucucagguacuucugaugggcgauccgaacaaaaucuauacagagcagagagagaggcaaaguuuucaagucuucucauuucauagaacugugguggugccagccagauuucuuuugauaggaaacauucaguugccucugauggggacaaccacuguaagagacaaagggagaagcuuuguaagauguauugagucaccagucagaucuguggucguuagauggggauacaagaucgauuugaugugaaaaacauuaacuuauccaaaggccuugcuagagcucuccgagacagcauaacuuucagaggcccagacacugccauguaccaaucgcccugcuuagucaggaggcugaagcaggaaaauugcuugaguccaggaguugaaguccugccuggguaagauaaugagguccugucucagaaagaaagaaccggaggcuagagaacugccucagugguuaaaagcaguugcagcucuuccagagggccagaguugggucccuagcaucuacacaggacagcucacaaccauccauaacucaaguucuaggggauccaaugcucucuucuggucagcugcaugcguguuaaacaaaaauaaucaauaacaaccaaauaauaaguauaaauaacaacacuuaacaacaauaaaaugccaauuaaaauauuaauaauuaguaaauaaaauucaaaaauccuuucagucacaagagcuaaacccacacguuacacagcaacucaauaaaaucuaauuuuuuuuugguuuuguuuuguuuuguuuuuucgagacagggcuucucuguguaguccuggcuguccuggaacucacucuguagaccaggcuggccuugaacucagaaauccgccugccucuaccucccaaguguugggauuaaaggccugcgccaccacugccuggcaauaaaaaucuauuuucagacaccaaaaaugccuaacuauaaguaaguaaauaaauauauaauagaaugaagugagcccaccuaucugcuuaaagucaaucccaguccaagagcacugggggagacuaaguagcauccaggagucuuacugacuagagcagacuggagcagacuggggcagacuggagcagacuggggcagacuggagcagaacuuggaaggcucacuuaguaucuggugagcaugugccgagaaguucuacccagaacugaacuccacagcucuacugacuacuuaccugggccugaugacgcccagggaaagagcaacuaccugggagguugcugacuaaauucuucaugcucaccuggauccaagacguuuucuaguuuuccccagcaguauauuccugacagagggaaagccuuuuuugaauguaaggagcuuuuccacucaagugagcaggaauagaaccacagaauagaacgucagggaaaugagccccaaggaugaaugcuacuguggacccacuugcaaaccauuuuaaacacaccucaaaaggguaaaguccaucucuaauaacuuaacugccuuccggggagagugcaacacuaguuaagagaauagaacaaaacccugcauccagcgaccuaaaaacaaugcuaacaugcacucaaaaacuucagagcaugcugacgucaagcgcagggaaaugcaguccauaacuaaaaugcaugcacaugcauaaaauaaaaucguuuguuaaaaagacaaauuuagggcuggagagguggcucagugguaaagagcacugacugcucuuucuaagguccugaguucaaaccccagaaaccacaugguggcucacaaccaucuguagugggauccgauggccucuucuggugugucugaagacagcuacagcaagaguacucauauacauaaaauaaauaaauaaaucuuuuaaaaaaugaugaaguuaaaaacagggucaaagagaagcucaaggacaauuuuuacuacaguuuaagagcacaaagcuauagaucucagcaggugcuagcagaagggagaugggguggauagagagagagagagcuaugcuuuaaguggucaccugguggacgggguuagcagaguagcuuuagagaaugucugggcaagcacacccaggcuuuggacaguacuucaaggaaaggaugaaaaaggcauuugugagugacucaagagaagcaggcaggucugcauccuccaucacagaagcucuguaaguaucuguaccaagaggccccugagaggaagucuagguuauggcaaacugacaaacuccuguucucagcaguuccauugguccaaagauguaaaggaacuaucaacauaauaaaauaaaaaggaaaaaaauucaaaaaaaaauuaaauuaaaaaaaaaaggaaaaaauucgcuuuauaguuaguuacuuuuuauucauguauuuuugccugcuuagaaaucuguacaccagaugagggccagaagggggcgucagauccucuaguacugagguuacaggcagcuauaaugcuuccagaaauacuauuuacaguugauauuucauuuaaaaaaaaaaaaagcaaacuuaaacaauugagcuggguguggcagcacacgccuuuaaucauagcauuuaggagacggaggcagucagaacucugaguucaaggucagcauggucuacagagucaguuccaggacagccagggcuacagagagaaacccugucucaaaaaaacacaaucaaauauuaaaaagcaaaaaaacagccauugaguuuacucaauuggaauacugagaggaaaagguugaaaugagugaacgaggcauccagguccagugggaggccaagcuguccaacauauguguaacugcagguacaagaaacagggaguggcgcgagagacuggcucaacugagaucuggagaggaagcaucccgcagaaggccugaguucagugcccagcacccauucaagguagcucacaaccuuccucaacuccugcuccaggugauuagacacuucuggcaucaaugggcaccugcacucacgugcauauacucucacaccagaacacaacuuaaaauaagucauuuuguuuauuuuacaaaaaggaaaauaacgggcaguugaaaacauuuuuuugcauaaauaaaagaugaacuugaagcgguggcacacucaagaccucggguccuaggccugaagccuaacuaacugugccuggugcauugcaagugacacgaaaaagaaagggagggagggauggagggagacagacagaccaacucgcgcgcgcgcacacacacacacacacacacacacacacaccuaccacgcgugcgcaugcagagagagaaagggguuagaaaaaggagaaagauggaaagggaaaggagagagaaagcgaaagacgaaggaaacgggaacagagaaacaggaagagaugaagaaggaagaagaaaguuaaugacugaaauccuauaauguguucuagaaacccgaaugaaaacgauuuagggcaugaagugaauugggaaguguccagaacaggcaguugggagcauugccgcgcccccgcuuagggugagaguugaguccuugagagccuaaagcaaggucacgcacgugcgccuuuggucugggguaaggcucagcgcaucccggggggcgggucccgcgaccccuaccugguagcccaccaccucggccacgucgggcuccacgcgcggaaugucgcgcaggcagcacaggaagaagguggugucgaaacggcggaugguucgcccauacggggugagccauccgccccagucgugcagcgcccagaugucaggcgugcagucuaggugcgcacacagcuggaggaagcagcgcgggucacugcgcacgcgcgagcgccauucggccaggccggccggaggcgacagcgccugacugggcuccugagaagcuggagccgcgucccgcggccgcaggagcagcacccccgccuccucgaaggcuucgcggauggcacagaugcgcagcgcuacgucaucgggcagcgccgcgggguccgcgucgccgugggacagcccggggaagggggguugccgagggggcuccgggccuaggccgaagcgcggcggcgugugccgaggcgcgaacagacgcacccagucgggugagcugucggccgcguccagcacgccgcccgggaagacgugcgcgccgggcaagaagcgcugguuuugugcucgcuggagaagcagcagccggaagccggccgggcucgaguggguccagccugcugccaacaucacgguggcugcccgccgccagcugcucgagcugcucauggccggcguccuucagaucccccuuaggaaguggccgggucguagagugguguccagaagcccuauaaauguugagggccugaaaaauccggccuggcggcuuccggagguuuacuugugggaggagcgugauucccgcgccagagcaccuccucgaaugcccugcgcuucagucagggucauucucgcccugucacagcccugucacagcugcugcagucaccagccagccucugggagcacgggugccaguguggaguggaaaauaauuucuaguugugaaccuuucccacuaaacgcaaacgacuaggacuuuguccccuacgcuggccuguugccuguauaggagguuccaaggugucuggagcucucuugaaccaugcuaauaaacgaauggguggaucagaugccaaguuagacuaacuacucuguaguuugaaugucuuuggcuagucccugucccuugggguagucugucuuaaguuguagauguuguuauugccugagcaccugaggaucagggaaaauuaucuuagugugauuaguucucuuucuacgugggagauguuuaauccuagacuagcaaugcuucccccuccucuccaaccuuuuuuccuuuuuucuuuuucuuuuuguuuuuguuucuuguuuuguuuuguuuuguuuuuagacaggguuucucuguguagcccuggccgcccuggaacucacucuguagaccaggcuggccucgaauucagaaaucugccucccaagugcagggaucaaagacaugcgccaccacugccuggcuuccucuccaacuuuuaaguggcuggaggacuugcacuucuauuuuguuuuuuggaaacagcuuguuucugucucccuuuuugcagcucucucucagucaccaacucuuguaaaucccauccuaacugaucacauauuuuuaggguuucggaugaguuaggcuguauucuuggggcuauagagauguuuuuuguuaguuuugagaaaguauuauuauguagucuugcuuuuuugggaacuugcuauguagacgaccaggcuagccuugaacucacagagaucuaucugcuugucucugccuccccaagucuaggacuaauaaaggugugugccagccuca

SEQ ID NO: 3726 - RNA, 104700 nt, Mus musculus
caacggcggaguaaagagguaggcugaagaguggagccaccgcacccggguggugggcacucaggucccagcccaggguccgggaggugcugucguagcacagaggugaaacuauguagccucuuaaguaagugucuucugcggguauccuccagcgccucccuacucuggggaacgccgaggucgggcggggccugggagaggaagggggagggguucccugcacugaaggggagccccaggcugggcugaugggccccaggggcccggacccguggcgggcugagccucccagcucucccguuccucugcgguccgcaucgcggcgcgcacguuguccacuagguccagagggaugccuaggcggcgcggagaaugcaucuguuccuguggcaccacggcaggccugggucccccggagcugggacuuggggcagugggcagagcugucgcucccaggccauguggccugggagguuuuccggugaccaaacugagggaggaggcuguguguucagauccuggucuaggccagcugauugaguuuccgccggggcugaaaguggaaaggguaucccugccugcuuuacacguggcgagguccucucguccuguauguagagaagacuuauggaaaacucagguacccagagacguacaaccacacagaguguguucgguuucuugguugaaaacggacugcccagaugcgcgcgcgccaggcggugccccuccagccucuccuccagcuccaggggaccuggacacucaaggcgggguggguggcaggggaagcaagugacacaucaccaucuaggagugagaggcuugggauaagagggcuagugagacuggacagacagaguucucaguggcugggauuucuguuucauucuguggagagaugcuccuguuuacaucaaacacuguaaacuucccauugauccggagcgaaagcagcacauaguaggguuuucagagucccccagugcaggccgugguggugugucaaccgacaggaucuagggcccugaaccccaguacuuacugucacucaggggucuuuccuuuagccagcucagcugucgguuugcauucagaauuuggauauugugagacuuagccauucuuggggcagggcggggugaugauugcagccacgcaggagccacccacccccauggguuuugauaggggacuagguuuggggaccgaauggguggaaggagggagaacccaucccuuugggaagcuguagggcauggggaaugauggggcuuagaaaauggacaauggccaaacaccaaguauggaucauucagcuuguuaagggggggugggggugggggaggaggcuuggcggggcgggggugggggggagaaggaaagacagaggaauacuguauaggaguauuggagaggucacuugggugugguucaccaggacagguaugugugcaauugggaggcagaggaagagaaugggcagaggagauguuguugggaaagcagccagggucuugcaguuggcugaagguguauuccuggguuagaccucgggagagcuccuccagcccugaugccucaccugagucauacagcaaacagcaguucuaggcgagcagcaguggugucugcacagggccuggggucaaggucaugacugggccuccauguguuuacuggacugugcuagccucauaccaagcugcugcaggcuuuuuuguuauugauuuguccgggugccgcucaaugauuuugugcuguuaggacacucccugguuauuagccggugacauuagguugguguccaguaucaucugccucuccaaggggugccaaggaaugugaccaucugauuauagaugacagacuuagagaggagucaguucaggggaaucuggauuaaggugucacgagguuggccaucuuagggagcuaauaauuacuggcccucugagugccugagauccuggcagggagaugggugcauggcuguuccaucugcaacuaccgggagcagggugauggggucaaucugagcagagaccauaccccuuaacuggcucccuguuucucccuaacaccaguuaccagugucaccguguuugaccagcuuugagcacuuuguuuauuuuuaccuguguggcugcugucugggauuaacccuucaccuaccugguagagacagcuguccucuugcuuccucuuggccucgaagugagcugaaugcggguguuaaagcugagugcucuaacgugggguuuauggacaauauagccccaucuguaaauaucacaaggccagaaggacuagggaccagaaagcacagauuacaucccugugcuuccguugauauuaaaaaaaagauggcuagaaacuguucucguuuuguucccaacccuacccuucccuuugcaucacuuagagggccuugcucauugcuuggauagcaugccugguuagggucuuugguuccgaaccaggucuaggguuccuggcauguacuuggcagggaguacauuucugggaggcauagacuccccaugcuggauuuugcagagcagggcugugcgcaguccccagauggucccugacuacccagacucaucuggcuugucaggacagcugaagaccacaaaaccacaccucagugugcaugcuaucuccugaaauguucagacuuucuccguauggcugucuuguucacaggguaacucacguucagggguauuuggcaguucugacuagugcugucaauuuucacuggaggucuguuagggauggucaggagcccccuggucuuggauucuuaagacuucuuaugaacugaacucacgaccucccgaauccuuagccuugcuuugguccacaucucagugucucccccauccccugcuaggccuuuuccuuucuggccauaucuccuugcugaggagugaugguuugagugcuuugccagugucacgugcccuuccccagguuuaucucgccaucacauacauccuguuucucaagugguuuuuauccgaagcaucuucagcugucauacucugccccauggaaccaccuaugggaaaccagaagaaugcuauucccuucugacucuguccccccccaaauugcauucucugcuucucuuggggaaucaugagaaucuggaaguaauugaauucaaugaaucaaacaccugaaccauugccagggucucucugggggcccaaggaaggauuauuuacacccauuuuauuuucuuuuagguucuuuuuuaaaaguucccuuagauccuccugugggaggaguuaaggucccagugagaagaguccccaguggggccaguagucaagccagcucuuauugggccaagagauuuggugauaggccuguguggcucucugucagguagacuuuuccaucuggguagauggaguuuacagccuuguguguauguguagaagucagaggacaggagcuggagagguggcucagucguuaagagcacuggcugcucuugcagaggagccagguucaguugucagcgcuuacaugguggcucacaaccaucuugaacuccggggggggggggggggggguugacgcccucuuguggcuuccacauguaccaggcacgcgugugguucguaguuguacaugucgacagcaaaacacccgugcacuuaaaauaaauaacgaaaauaauaauuuaaaagagaaguuagaagacagcuugcaggagucaguucucgcccggggauggaagugaggacgucaggauuggcagcagugcccucauccacugagacaucugucucauaggccacauuaauuuuaauuuuaaaguaaugauuauuuauugaaaguguauuuuggauaggucacaauauauaaacuguuaaaaaccaguuuuagcuguuuuauuuauuuuuuaaauguggcuacuagacauucauaucauguacuuaucaggcauggugggcacaccuggagucccagcuacuuagagagugggguuacgaagaucacaugaacccagggguuugaggugcaauaaaaacaaguacaguuggcuggcaaggugguacauucaguaaccuuaaauccauccccacggccugcccugcccacguuuuggaaggagagaaccaagucccgggagucacccucugacggucacaugcauacuguugcacguguugcucacacuccacacccgugugcaaaagcaaaaaaaaaaaaaaaaaaaaaaaaaaaaaaaaguagaaaauguaauaacuuaaaacaaaccaaauacacuaaaaauaucuauuuaaaauguaauaauucaaaaugaaacaaaggcaguaagaauuuccauguggcuguaugaucuguaucuauaauucuauuuuuuuccccuaccucuuuuuaagcagcccaggucuagaccacuaaaaccgaguagggugaggaaauaggaugaacgcacauaagaacuugggaguaugucggagacaguuuucucaacuggugugugaaagaaagagacugugccaaaagcaauguugggacaaucagcguaccauauggaaaagugaaauuagcugccgauuuauagcguaugcaaaaauaaaauccagauggguuggagaugggaaugugagacaguuuaugguuuuuagaaguuccaggggcuaugcuuguggaauuggagggguccugguugcaggaggccuuugcuguguaaccaagucagaaugcgagagcucccagcugcccucauuucguuacucucuagauguuuuccuuggcauaacugcgaggcuccauuuuguuccugcauggcucaguucauuagcucacaugggcuccucucucuccccgccauggcuuuuuccuuacuugggcuguuucccagcaugcugucuugggguauauugagaacgagggcgggauauacaaggccccucgaggcugaugaacagaaacuguagccagugaagucaggcuacagggcuggcucaggaugaaaauaaguggagaaagcugggcauggggugcacucuacuacagucccagagcuggggacacuguaguaggucagucccagagcaguggggaccucgguaggaggauccugauuuugaggucagguugggcugcauacauagugaggccuugcuucaagcaaaauaacaaauaacaaagugguugggcauuuaggucauugguugauugccuugggcuacauccuuagagcucugggggggggggcgagaggaggggcggggcugcccacgcgcacaugcauggauuugugggucaccacaaccaaaaagcacaaaaaggcaaaaagacacagccagcuaugccaguuaagguggcagaaguguuuaaucccaacucuugggaggcagaggcaggugaaucucuuugaguucaaggccagcauggucuacagagugagcuccagguuuacugcacguggugagggccuugucucuguucacagcuuuucccucccuuguugcaggaagcucacuuggaucccccgaagucccuauggcucuauaugaugaagaucuccugaaaaacccuuucuaccuggcccuucagaaguggcgccccgacuugugcagcaagguggcccagauccauggcauuguaagucuaccggccuucacgcgugagcagugucgggaguguggcaggugaaggggauauuuagaggaagucaguugcagagcuguggaguuaaacgaaccccugugcugucccucccccccgggagggggugguuacccaauguuggauaugugguugaacagugaggggccaccucaaucuccuuccuggaugaagcguccugagacugaccugggcugccuuagggugucuauugcugggauuaaacaccauaaccaaaaagcaaguuggcaaggaaaggguuucuuuggcuccuacuuccaugccacuguuccucaccgaaggaagucugugcaggagcucagacagagcaggauccuagaggcaggagcugaugcagaggccauggaggguggcuuacuggcuugucucacauagcuugcucagccugcccagggauggcauugcucaaaauggacugggcccucccccaucaaucacuaauuaggaaaauaccuuacagccagauccuauggaggcauuuucucaauugagguuuccuccucucagaugaugccggcuugcaccgaguugaccuaaaccagccagcacauccuggguugucauccugucuccaaacucuugccccucaccuaugguagauccuaccuuuguccugguacucagcguucuuaucuccuuguugucugugagugcuccuaggacucggguaacgguccucccuggugcucagcaguccuccucuguucagcugggugcccuccuauggaaucagggagcaugugaaugcucaccgaguggcaugguuagguuuaaaugcuccucgguuaagagcacuuauggcuucugcagaggacccagguucaguucucagcaccagcuuaauaauuaauucagaauaugucaucucagcacaccuaccauaaccugaggggaaagugcuaauugaggaauuaucuggauaaggcugaccuguggcugugugugugugggggggggggggggaggauugucucuuuguuaauugguucaggaagacacagcccacugugcgcuacauuguuucaugagccuuggacuucagaagagugaagaaaacacguaagaggcagcaagcaggaggcauggugcaucugucucucgcuguuugaccuuggacguaaugggacugacugucugcuagauuuccuggcuccacaucuacacuccccucuuccccccagugauggacaguaccuggacauucuaagucaaguaaaccguuucccagcaacagaaaugaaacugagcaauagccacggcucagaagccucccgggcggggccccgggagcaggaauagaagaagcauuugggagcaacuguggugucgggaaccugugccgccuagagugggcacccccaugucuugguguugcagaucuucccaggacauggguugggagcuuuagucaguuuucuugauaacgugacagaaugcuuagcagaaaccaccuauuggagaagaguugggugcuggccagugguggcagagcuuucuguccguaucgagacugcugacccuggaccuguggugaguggagcauugugugguggugggagucugugaggcaggauguucuucaucucaggaucaggaaggaaagaguaagagagggaauagggaccagcuuaguccacagaggcaugccucccaaugagcugcuucgaccagguaagggccccuccacagccuaagcugucagguccuucucaaaagggccaccagcuagggaccaagccucuaacaccugagccugccugugggggaacauucaguauugcacauuagugguuguccugguuugugucucugucuaucaugaagggaaggcggggcaggaacucaagacaggaacugaagcagagaccacaaaggagugcagccuucuggcuucuucuccauggcuugcuuagcugcuguccuaugcagcccaggaucaccugcucaaggauggcacugcccacagugggcuggcccucucacaucaguuguagaucaggaaaaugcccacaguccaauaugacggaagccucuuuccagcugagguuccuucuuuccagauaacucuagcuugagucaaguugacaaaaugacaaccagagcagcugcagcugcugcuguuuucuucuucuucuccuucuccuccuccuccuccuccuccuucuccuccuccuucuucuccuccuccuuucaucuucuuccucuuccuccucuuucuucuccuccuccuuucuuuucuuuuucuucucucuuuuucuucuuuuuauuuucucuuccuccuccucuucuucuuccuuuuccuugcuuccucuuucuucuuuuccuuuuucuucuuucuuuuucuuucuccuuccuccuccucuucaucucccuccuuuuccucccuuccucuuucuucuuuuccuuuuuuauuuuuuuaaaucagugccaaggaggaaaaucaggauuuuguacaugccaggcaaguuaccacugagccauugauugauaccccucacugggagaguuuaagcaagugcuccaccacugagccacgcccacagccccucacuggguauucuagucagggcucuaccacugagccacgcccacagccccucacugggggauucuaggcaggugcuccaccacugagccacgcccacagccccucacugggagauuccagggaggggcucuaucauugaacuaucccaguaucuuaugugugaguuuguguguaugaaggcaaaucuauaugugcauguggcggucacgggacagccucaggugacauuccucauacuacauagcucuuguuuuugauauugagucucucauuggaucgguacacaccuacgcagcuaggcugacuaaccuaccaucugaggguucucuugcuuccucugcucagaguucauacauauaugcuccaccagaccuguuuugucuggcuuuuucacaugaguuccggggguuaaguugaaguccugcaccucacugaccgagcuagccucaguuucuuuuuccacacuuccuuuuauguuguccuugacucugcuugggaagucccuguuggcuucuguguccugcucccuucucaccucacugagcuucugcuucucuucuccuguggugacuugcucaggucaggccuccgaggauuugcaccaaaggagaaguuuagcuagcucaggccaaccuccguuugcugguagcuuuucuggaaaaccagaagugauugcugucuuguuucugcccacaggagccuccuccucuagaggcuugcucuggguuuuaggauuaguauuuugcuucauguguuuuaaccagagacuuuuggucucuuaauuuggauuuuggaagccauagaauucauuauacaaaaaauaaaaauuccagguggaacaugacaaaacaggccaguaacuccaacacgugaguuuugaguagcauauguuaccuagugggacucaucuuguaaaacuccaauaaauaaguaaagaaacagacaaggggaugaagagaaggcucgguggugagagcacgugaggacccacauucaauacugagaucccagcugugugugcaccauggcgcucagccccaucuuuugaaguaggacucugcuccagucccuuccgagagccacagauccaccuggcccacucuggguggcgauccgcuucaggccuuccuuggcccgguuggaugaggccagcuucccugcaggagucaacugugcgaugaaccacucugccagcggacucagggguagggcugaagcugggugacucgcucugacccccuguuguucaaagcaugggcaaaugggucacagcuguucacugugcagugugaucuacaugguuguuagcacagugaaugaaaaaaaaauagaacguugcaauugcuucuagaaaguuccucauccuuccugucacuucugagagagcagugugggaucagcagcuucgugcuuaguuucugccccgggaguuugccauugggaccacaguauuaaccuuacuuguugccacgaccaaccuaaggagggaggguugguuuggaaucaguuguggaagauuauguuccauccuacuggaguagucgcaauggcuggaguguuugcagaggcgucucuacauuauggaggaacaggaagcagacugcuaaaccggaaccaguuacaaacagccaugccuuuccaaggccucgccuuagugaccugcuuccacucuccagccuccgcccccuaaagaugccauagacuucuagacagcaaugcaagcuggggaccaagcauuuaagaugugagcugugggagacaucucagauucaaaccauaaccaugggacuuuaaaaaaaaaagauaaauucaccguuuuaagaacugucuugggguuggagaaauggcucagugguuaagagaagagcagagaagagcucuggcugaucucagaggacccauguuugauucccagccauuaccugguggcucacaaccaucuguaacuccaguuccaguggaucugaugucucuguucgggccucugugggcaguguguggaaaugcagcgcacaggcauacgcagcgcacaggcauacacauaggcaaaacacucaaacauuuaaaauaaaaaugacggaguaauaaauguauuucuguaguaucagccaucucugggacuuuccccuacaaacuggcaugauacccugcucggccagucugccauagcacggguguggcagcugagggggaaggcugacccggucuccuaccuggcccagccaccgcuggagcuggcuuccuuccagggcuuccuugccugggaggacucuucuuccugcccccugguugcaccauggaaaagccuccuccugcaccccucaucuuucagucacagggaccuggugacacccacuuuguucuaauagucaccucugugcuuauuaucuaggcuaauaaugcaccuggggcuuucugagaguggcuugggagggucucucuccagggacucuuguccacaggcagcuguguccugacuuuguaagagagauauauaauuaagaucuaccaccaaggugagacaucacgccccccaugacucauuugcauucaucugguuggguaaaauaaauuuaugcggguuacuuacagggcuuugggucacuaccgauggcuacauuuucuuaaguugacaacccacugauuuuuuuuuuuuugagauucccauuuuacaaugacucuaagcguagcagaauuuauacagacuuagauccagccacccugugucaaagcgaaacaggugacuauaagcucagacaaugccaggcuugggaagaguuucuugaucauuaucagagguucugcugggcucagcaaacacugugcagcugugggcaggacgauugucucaccgcagucuguugcagagagcggcuaaaugguggcuugcugcacauuggagucacugggaggugaaggacugguuuguagggaguaucucauauaagcaucaccugucaguaaagccuauggccaaugagcugaggcaggaaauaggaggugggacacuggcaggaagagagaggauucugggaaauagcgagagaauaaaagggaguuuugccuggaaacuaggggagacugacggaaaccagcaaguagcagaacugagaauagaaugaagagagagauuggaaugauaugcugaggcgaugcaaagaagaugcaaagaaagaaguggccaggacugaagaaaguaacuaaccaagugguagacauaaaauaguuuaaauggaguaaguaaguuaugagcugguuagggaaugagccgaagccuauggccuaggcauuuauugauaaauaaucagucucagggucgucauucugggagcaggagcugaaaggaagaacaaaucaucucuuuuuacacuggcucaugacaacugccuugagaaaguuguccaaguuuccagugugacuuagaggauggguccauuugcucgucagaaaaaauagaagaaggcagguagguacccgagggagaggagcuggaguuccaggcuggccugggcuacacaguaagaccuucucucaaaacaccggcaacaaaaagcaagcaaacaagcuaaauaaauaaggguuagggcugucuauagcuuauuagugggggggcuuucuguagugggggauccucucccuugaaauggaaggguuuagccucacauccaagucugucaggaaacuggggaagggcaagugugugaaauugcagggucuccuguucagucagugagcgcaugccaccuacucugccuggcaugcuuggugauccagcauggcgggugcugggcacgggaaggugugccggcaagccaacaggauguacaucuuacuuggguggcauuucccaggacacacacaaguuccugguccuguggaaguuagaugaaggccaggagcaugccuguuucauggauggauggacgguguguucuccuccucagugcagcagcaguggccaccacaaagucucugagucugacauuacaugcccccagaacugcugcuaggcauccgcuggcuggaacccacucuccggcuucgaggucuucugugugugcacuuagcgugagcugcacuuuuuauguaguccugaggucccauagagcuggcugggaguuguuucccauuuugaaauugauauacccagaggccucccuuuaguuuuaaaugaagcuuucagaucugaggggccuggagagauggcucagcaguuaagagcucuugcagcucagcucagucaugaaguccagaauuuggauuccggcacccauaucagcuggcugacaaaugccuguaacugcagcuuucaaggaauuggacaaucucuuucagccucugugggcacccaaacacacgugcuaaacaaaugaaguugaauccauauauauauauauauauauauauguauguguguauauauauauguauauauguauauauauauauauacacacauaugaauaugaacaaaugcauacaauuuuaucccagguaggccucaaaugacugaggcugacuuugcaccagucagcccccugcugggccccuuugagugcuggguuacaggcauaugccacugucugccuuuucuucaguacuggaaucucaaagggaauucagcaagagcuacagaauagaguuuaaauacauaaaaggaagucuuauuuucccugaauauaaacagugaagacauaaauaucagaaauugaacauuugggccagagcagaggcccauugguuaagagcacuugcugcucuugcagaggagagggccuccggucaguucccaccacacacauggaguccuaauggucuguaacuccaguuccagggauuuagcaucgcuuuucugcccgcuguggguacugaaugcaacuagugcauagauacccauucaggcaaaauuuguacaaugaauuaaaaaaaauguuuuaaaaauaauguuuuuaagaagaaaaaaaaaguaggagguaacuagagaaguuugaagugggcauuuaugcauaauaaugcacuaugguucugcuuuuaauuuucauuuauuuuuuuagauuuauguguauauguguguauaucaguguuuggguuugugcaugugugugcagugccuccagacgccaggagagggcguuggauccccaugacugacaugggugcugggaaccgcugggcgaucucuccaaccgcguguucuguuucuuaaaaagaaggcucauuguucagaaaugcauuccuaaaauauauauaugaaugagucacuucucuaccuuauguaauuuucugggcuuugcuucaaaauaaccuagagauugcguauagaaagcuauggcccaggaccggacacugaauuccuaauuuuugaagcuggaugaaggacaugcggggcucaccauauuguucuccagucuacaaauuaaacaaguugagcugggugugguggugcgugccuuauauauuggcacugggaggcacaggcaaacucugugaguuugaggccagccugguuuacauaguaaauuucaggacagccagggauaaaagagacccugucgcaaaagaauauuuuuuuaaaaagaaagagaugaaacaaguuagggcucaugaaguggggggagggggggcagggaagaaaagagagagagagagagagagagagagagagagagagagcgagcgugcgcgcaaguaaaagcauuugcugccaaucauaauaggccacgccucuaaccuuaaccagaaccauuuuccaaguaagcuggcgugccucaucccagcccgggcugcagaagucacacagcacucugcccaccaaucacuaagcuuccuucuccucuagguccuagugccuugcagaggaagccugcccggcagugugcaggccuccugccaguucgaguccuauguuuugguacccacggaaggacacuuucagaccuuagauggaaagguacucacuucuaagguggcuccggauugaugggggugggguggggcagacagagacaagauugacccuguuuuuccagcuuuucacauuguuggcaucaaauauugauuuuuguuuguacauagcagcuuuuggaaagaguuaugggucccccaucuuuauuagggagccuuugagacagggggccaugguaauagugaguaggacccagacucugucaugggaggugugguggggcuggaguucuucccuccuucccucagccaagggagucaucuaccuguauguugggggccccuggaguaccccuucucaggucuguaucccacuaagcuauuucuuuuguugugguuguuauuucgagacggucucaccauguagcccuggcuggcuuggaacucacuuuguaggacaggcuggccuugaacucagggacuuuggcuugccucugccucccaagugcugagauuaaaggcaugcaccaccacaccuagcccauauauacugauuuuugacacagaguuuuguugucucaggcauuaugucccaggcuggcuuggaagucaugauccuccugccucagccucccaaguguugagauuacaggccugagcugccguguccagcugugugcgugcauuuuguugguuuucuaacggaagcagguagaaccuaagagguagauguuucauuugcacucagcuggccccauccccccaacugaugcacagucagggguccaggccacucuaaauuacucuucucacugggguugcucugcagucugacccagggcuggaacaggugggguucguagauaccgaggcagaucggagagggugaggguuguuaucagccugcuugguugguugacaucccucuguggcucaugaggccuggcacguaacuaucacagauuuuuaucaccacaucuccuagucacauguccagcuaacccacacugggguggagugacaggcucugccuaaauaccucccaagagguggcuacaagggucccgguggccacccuaggcugguccagugagguuuucuucauuccaggcugucgucauugaaggaaacaggauuaagcuaggagcagguuuugcuugccuucucucugugcccauccucuuugaggagacuuucuacaacgagaaagaggagaguuucagcauucucugcauugcucauccuuuggagaggagagagacuucagguaccgagggagggcugaucuuuucucucgugcacgugcacgcacaucacuccccccccccccagcuguuaaaugcuugaaugucacacacacagaaauaucagagagcccauuagagaccugccuaacuauaaaaguccccuuugggacuugaucuaugucuucccuugcuaaggcgaugugcggauuggggcugccuuggcggauaugauaggacuccagcccagaggcuucggggcucuaaucaacccuugaggaagauugucccuggagcugugcagagccgcagugcuggcugaaucuaggcucagccucgggacuuagcuuuguguuuuauuaaaccagcuacaccguugccucucugagagcucauugguuuucaauggguuguuuaguuggcccaggaaacagcacagacccugugccaaaugcaccaugacaccgaauuguccugagccaguuucaccucagccccauggguugucccuugggucacacaucacuggcauuucguuuccugaaaagaccuugugugguuuucuggacucuaugcucuccugcaacugggauguucuuggacagcaguuucuuuaccuucuucccugguccuuggccauccucucuuggaagcguguauguguguguguguguguguguguguguguguguauguguguguguucuagaucuuucuuucuggaacagggacacccccaccccacccccauuguucagaaaacggaaaacucuagccagcccgacccucccucucuuuucucagaagaaccuucagcgccugcagauccuuucucccugaaaaccaucgaagaugugagagaauuuuugggaagacacucagagaaauuugacaagaacauugccucuuuccaccggacguuccgagaaugugaaagaaagagccuccgccaccacauaguuaguauccguacucucauucugccuaacuggccacugucacucacuccagugccauuagucugucugcuccagaaauccccuggguacccacugcauggugggaaauuuuuuuuuaaauauuuuuauuagguauuuuccucauuuacauuuccaaugcuaucccaaaagucccccauacccucccccccaacuccccuacccacccacucccacuuuuuggcccuggcguuccccuguacuggggcauauaaaguuugcgggaaaauuuuuuuuaaauguuucuacuauacaaaguagcauaagacccuucaggaagugaaaaaucuuugcaacgucuaaaaaugaauaucagaaagaaacuaaaacuccuacuuacuguggccaucuguguuaaccucaaagagaacuuuucccccauauacacuuuaaaaaaaaaaaaaaaaaguugagagccagaaguguucaguggguagaaaugcucaccacgcaagauggacagcuugguggauagcuuucacgugggugggauauaaaauuuggacacaguggcacauguccauaaccucaguauacuuaggagaggagaugggagcuggagacuggagaauccuccagaaacgcaugagccagccagccugaaguacucaucacuguggcaaacagcaaagagagguccugccucuaagcuaggcgaaaggugagaauugguaccagagguugaccucugcacacacaacuacguaaacacauaaaguuaguauguuaaaaaguggaggguugaccagauggcucagcggcuaaaggcacuugccacugggccugacagguauggguuggcuuuucagacacacuguaaauaaauguaauuuuauagagcugaauaucccuuuuagaagaugugcauaugcccgagagcccgucacucuggguaguaagaggggucuccucucucuguucuugguugcauaggacuccguaaaugcucucuacaccaaaugccuccagcagcuucuccgagacucucaccugguaagcacgggucuaaacagaacaacagcgguuugcacugugugcagacccagacucucaaccagcguuucucuugaauucuagaagguucuugcaaagcaggaggcccagaugaaccugaugaagcaggccguagagguaaggagagagugaagggcagugacugggagacucugugucaaccccaauacauaccacaagccugucuuuugaacccacagauguauguccaucacgauauuuacgaccugaucuuuaaauacguggggaccauggaggcgagcgagguagguucuuuguuaccagucuuuauucuccgggaugagagccuuaaccuaagaaauuccaaguguuggggcuggagagauaguucaauacugcuuuugcagaagaccuaaguguguuccuagcaccaaugaaggguggcucacacauuccauaacugcaggucugggagaucuagcaucuucuggcuccuguggcuaccugcaaucgcauguaccagaauagcuggagcuauguagagagacccugucucuaaacagccagccaaauaaacaaaagucuuaagugaaagaaauuugaaaucuguugcuaggaugccgccuuuaacaaaaucacgagaagccuucaagaucuccagcagaaagacaucggcgugaaacccgaguucaggugagucggucccacagcuccgggaaguccagcacgcucacggcugggcuccaucucccccaccccuccacuuggcagccguggugaccacugauuagaugagguuacaaccaaggaguuguacacuuggucccagugaugcccgacagccgaaguugagcugcggcugccuugguucccuccuguguuugugggccagugugccagcugggugggagcuaaggggaagaggguuugguaaaaccggucuccgagugggcaugcgacucucagcugggcccuacacagaagccaucgacccucaucugccacucggagagaacccagaccucgaggcucucacucucgggcaagcuucauuaggguaaauaugucugaaguauugauguggaagccgcuccucacgcuuggguuauuuccaucuugggcuuuuauuaaauuuuuaaaaguuaauauuuuuuguugccauauaaaauuuuuuccuuuuuaauuuaauuuaauuuuauuuuaguuuuaguuuaguuuaguuuaguuuaguguaugagugucuugccugcauguaugugcacacacgcgugcggugccuuuggaagucaggagagggcaucaguauucuggggauuacaauuagaaccaguaaugaaccaccaugcgguugcugggaaucaaacaggggucuucuucaagagcagccaguguucuuaaccacugagccaccucuccagcccuauauuauuugaaauuuuuauuuuauuuuauuuuauuuguuuuguuuuguuuuucgagacagaguuucucuguaucgcccuggcuguccuggaacucacucuguagaccaggcuggacucgaacucagaaauccgccugccucugucucccgagugcugggauuaaaggcgugcaccaccaccacccagaugagacuaacauuuuuauuuuauuauuggaguuauguguauaugcaucucucuguguggguguguguaugugagcucagguguccucagaggccagaggagcuggaggcacaggcgguuguaagcugcccagugugggcucugggagucaaacuccaggcaucuguaagaacaucacaaguucuuagccacugagccaucucucuagcccccuuuuuuuuuuuuuuuuuuugagauaauagcuaccuauauacuccaggugccuuuguagcucagguuggcuuugaaauuguaauccuccugccucagcuucccaagugcugggaucacagaccucuaggucaggcuucuggauuuuuauauuuuugaauuccuaguaaaagcucucuugucugcaagccuggaugaaacaccacugaccugcaucaaaguacuuccugucuggcuuuuuuuuuuuuuuuuuuuuuuuuuugaucauuccuugaagcuguaagaaaugucuaagcagcuguaugaucaggacagacauguugggcccuccaccauggccugauauuucuccuuuguaaaucacagcuucaacaucccucgggcaaagagagagcugggucaguugaacaaguguacgucgccacagcagaagcugcugugccugaggaaggugguccagcucaugacacaaucucccagccagagagguuggugcugggcugggcagggaccgggcuuggugaggcagcaggugggaggaaaacuuccaagagaccagcauugcguggggaguguccugggcgguggguaaggcaggagcagguuagcaaagccugagagagacaagcagcggcuucagcugggccgggcugggggugggcguccggcuagcucgccucauuuuguauauauauuuaaaaaaaaaauccaggguaaaaguaaaguagggguugggauugucacuuaguggcugagcucuugcugggucuucaugagccccuccacccagguuccaucccuagagccacuaaaaaguuaagacaaaggacguggagagaaucuugauugggauaaucaagcaagcauacagcgugcuuccagcagcagcaaggaagaggguggagguggggcugacccuccuuugggugacggauucauaaacuguccuggaaaguagauucucucucucucgggagggacacugagugacagagguggcugggacauucguggucucucuuucuguacuguuugccauuuccuuaguuagauucugcugcugauguuuugagacagggucacauuauguaaccgaggcuggccucagcucgcccauugcugggauuacagguguguccuaucucguccagcuuuuucuuuuuuucuuuuuaauuuuuucuuguuaauuuaauuaauuuauuaauuaguuguuuuuuuauuguaugaguacuccgcugcaucugcaugccagaagagggcaucaagauccccuuauaggugguugugagccaccaugugguugcugggaacugaacucaaaaaccuuuggaaccuaagugcucugaguugcugagccaucucaccaguucccucuuguaauuuuuuuuaagccagggucucauuauguaguccuggcuggccuggaacacaccccguagccuagacuggucucaaacuuaggauccuccugccucugacucccaaaagcugggaugacaggccugugcuguuucacucugcugccgguacagccuuucaucccuuucguucugacaucuguucaggacacuuucugccuggagugugguuucccgggggcguggcuguggucuugguugguggagcagggcuccguccucccgcuuggggcucauggaggcugugggccuguuucucuuugcagugaacuuggagaccaugugugccgaugaucuccucucgguccuguuauaucugcucgugaagacagagaucccuaacugguaacauuuuccuguuaaauauuccuuagcuccuugggcucuuuugagcaggauucucuccugcagcccggacugggccccaacucuuguucuucuugccuuggccccugaguucugggauuucaggagagcuccauucuggcuggcauauauuugccguuaacuguucuaugcauuuugaauuggggggugaaucugggccaagcugccuuuagggguuuaccucugaagggggcaguguucucuccuccauccuucaggggcagcuuuccuucaguggauagauggggaaacugaggccuggagagcugcuauuucacuuugugaagaauguggcgauuuuguugcugucaacuguguaggaagcagccaccaucucauaggaaaccauaauucacuuuauaacauuagcuaggugugguagcuugccccguuaaucccagcacgcaggaggcagagacacauggaucugagaccuccaaccauuagcugucucaguuacucuucuagugcugugaagaggcgcuaucaccaagacaacuuagaaaguauugaacugggacuugcuuaucuuuucagaggguuaguccauaaucaucauggccgaagcguacugacaggcaggcaaggugcugggucaguagcugagagcaugcaugaucuguaagcugcagacaagggagagagggagagggagaaggagagggaggggagugaaggagagagagagagagagagagagcacuuuugaaaccuugaaacucacuucuauugacaugccuucuuuaaaaaggccaaaccuaauccaacaaggccacgccucccaauccuuccccaacaguuccauuaacugggcgggggggggggguggggauggagaggggggaaggggggcaagcauccaaacaugugagccagugcaggucaucuccagcuuucuaauagccagccuuucccaggaaguaacucauaguuuucuuguccuaauuguauacaauaugggcagugggcugaagcugggcagcagccauuauacccacccucuaccucuaaugaauacacuugauggagccauacaagucaguaguguuuguaaaguguucauuauccagcaguaaccccuuuuucuucuuuugguuaggauggcaaauuugagcuacaucaaaaacuucagauuuagcagcucggccaaagaugagcuaggauacugccugaccucagucgaggcugcgauugaauacauccggcaaggaagucucuccacgaagacgccuguaaggucucccugcuaaagcuaacccaccccuccucccucuguggcugagaguuugguugaggggauggcuguucuuucaucgucucccaagccuggagccucagcugguuaaucguuuugaaguuugagagcuacucaagaaacugaacguuaagcccuuaauugauugugagagcuggugugauaccagugggauuuacacugucaguagccggcuccauuaauccugccaucuucaggagcccgaguguggggaagggagccagauacaucagauaaggacucuuuggccuuauuauugcuuccuugguuggugagcuuuggugagagagagcagaucuguuucuauguaaauuaugggagucuuaagcucagguuucaccacgggccuguuuuauguacuacaugucaacagacaaauggugaaacucaguaguacucagaaagaucuccaggcugaagucagucaugguggugcauggcuguaauccuagcaccuaggaagcugaggcaggaggauugcugugaguuugaggcugaccuggucacauggugaguuccaugccagccuggacuuuacugugggcacugugccagaagacaaagggaaaagacaaauaaaguaaauauaauuaaaauaaacaaaagaggagagugaauuugaguucagccugggcuacauguaguaagacucuguauaaaaagacacacagucagcccuggguguugagcaggucaggccuugcuugaucuguugacaagccagugcuguggugccauugucccauguggcuccacaugggagucugugcauaagaauggacucugcuuuuacugcagacugccuucuuucaguucacagaguuugaguaggaaugccugaagccauuucccuggugagagagcccguguguaucuccacgcggcaagcgaggcuucugcauauaagucauuggaguugguuucacuaccagcucuauguaacgugguuucacagacauuuccucucuugaguguugugaaacuugagcuagccacaggcauccuuaggauguucauaaauggagacuucagcugucggcaaacaguuccuacaucgauggccgcaggaucaaggcagagacccuuggaauaaagacacuugccuacuuaguuucuaagauugugugugugugugcgcgccacaugugugcaggugugcaaguuccugaaggggcagaagaagaugcuggguucccuggaacugcaguuacaggcaguugggagccaccugaugugugugcugagaaacugaacuaaagaccucuaggagagcaguggauauuuuuuuuuuuaaagauuuauuuauuuaucauauguaaguacacuguagcugucuucagacacaucagaagaggucucauuauggaugguugugagccaucaugugguugcugggauuugaacucaagaccuuuagaagagcagucggugcucguaaccacugagccgucucuccagcucucuauauuuacauuuuaaaaguguuauaccucugcugccuucuuacacacuccuggucugccuugcuuccucauuggcuguuugguuuuggaaaggugaugcugggauuggaacuuggguccuuaagcaugcaggcuuuucugagcccuugcuuugggaggugagaucucuuugcuugggccauucugaccuugaacucccaauccuuccccucagagaugauggcauuuguuaccaggcccgccucuggguuccugugguauuugcucuuuucccaugagccucuggguuaugugccucucugagcacuugcuccuccccgaggacuuaguccugcgugcuccaccuuucauugcugcccuucagcuuucucccuagacuuuuagagaagaucccugacuggccugcugucccaggccuuugauguucuucuggucccaagcuccucagccuucagucuccgcacaaagcagauugcuggggcuucauuauccucagcugucagucaccguacagagcagauugcuggggcuuuauuuaagcaugaggccgcuggggacagaaauggcuccuucugaggugcuggcagcauuuguauaucacauuagucaguccucguuggaggugggcagacuuaagggaugauguuugauagacgacccuggaaaugaucccuccugcggugcaccguuggcuucauccauagccuagucagaacguagagacacgggaagaaagaaccguguucugccaugucaccagggcccgugaguuuccagcaucaccugccuugaaaaacuauucauuuuccucccaccaagacucuuugggaagaagcucauaugucacugucccaguugggcccaagugagcauaggagcacuguguuagcgaugauucuguaaaauaggcacaagacuggggauguagcucaaugguuaagcccuuuccuagaaucccccagugaggggcugggggcauggcucagugguagagccccugccuagaauccccagugaggggcuguggguguggcucagugguagagccccugccuagaaucccccagugaggggcugugggcguggucagugguagagccccugccuagaauccccagugaggggcugggggcguggcucagugguagagccccugccuagaauccccagugaggggcugggggcguggcucagugguagagccccugccuagaauccccagugaggggcugggggcguggcucagugguagagccccugccuagaauccccagugaggggcugugggcguggcucagugguagagccccugccuagaauuccccagugaggggcuggggguauggcucagugguagagcaccugccuagaaucccccagugaggggcugggggcguggcucagugguagagccccugccuagaaucccccagugaggggcugugugugugagagucaguguugauaacuuugauucagauucugcagugagaagcuggagucauuucuuuaagauagggcuuuggcuagcaugguaaggcccuggcacugcaaaacaaagcaagcccacagugaaacaaacaauauaguauugaaagucuucccucagacaccaccugcaugcacauaguguuagccaucaugaucaucaggugguaauaaucacuaauagcuaaugaaguguaaauuucuagauuuuuagauuuuauuuguguguguauguguguguuuguguagacauaugugugcaguaccuguaaaagccauaagaggccaucagauucccugcagcuggauuuacaggcaguugugagccaccugauauaggagcugggaagugaacuucuagaagagcagcaggcaucuagccauuccccagccccaaauuucuagaccuuuuuguguucggguaagcauuaccuuugauaggaaaagcugaauauaugaauuuggguggaucccugaaaugcacuaaguguuugggagugagagaggaggcaggaauuccuuugugucuuccuagauuuuuuuuuucuccagugaauuagacagacguuuuccugagcagauuaguaaaacaagauuccuccugcugcuugacaucaggaaguagaagacagugucgggugauguuguccacagcccuggauaaagcagcagagucaggcaauucaggcgagaagggaggucagaagggguggaggucaggaugagccaagugucaaucuggaugacgagauggcguguauguggcaaauuccaccccuguagaugacuuucuucaccugcagucuugcugcccagggcaccgucuucaaagcucacuuuccaggcuaccuguucugugcugaggaggaucugcacuucagcucagagagcagaccugggugggagaggccccugagggucaugcccgggagggauggcagggcuuguaccugggaccucuccgggaagggggaaggguccgugacgggggucugugaugugugaugaccacaggacgcugagggauuuggcgacagacuauuucucaagcagcggaugaacuugcugucccagaugacaucaacacccaucgacugccuguucaagguaagacgccacaauguucuuuggaggugaugggugagcauugucccauuuguguguguguguguguguguguguguguguaaguccuggggagauuaauuugcguucugucugggagaguggucgcaagacuaccugucuuccucagcacacacugugugguuaccacuguacagcacacaggggcugcugggccucaucaccuuugucauucaaggcuagcucaguggaaccucuuccuguaccugauacagcuguuuccccucuuggacccgaggugccagcacucuuguaguaggccuuagcugaguguagcaucaaaugcccugcagcuuuugguccugagugcaggaagcgcccuguucagauguuuacugacuccugggaaacucacgaggcagucuguagccaucacuauggacugccugaggguggaccuucucccagagucugcugauguuucuaggcuucugggagccagaguagaucccuagagggagcccaucugugagucacagaggccaagccucaugggcuugaaugcugggguaggggggccucccaauauugcagccguuuuauuuacuuuaagccuaggauacacuugauuacuauaaagauaacacuggggcucuguauguccguccguccguccguccaucugacucccucucuuccucucuugucaguacuggaaauugaaccuaagaccuugcacauacugagccacaucccagccccuuacugguggguucuaggcugguauucuauagcugaacugugcccucaguucauggugcuuugggacagugucuaccuauguagcccaugcagaacuuaaacucaugauucucuugccucucugcuccugggugcuagggguuaaagguuugugccacccuacagaacugaggcuuuugcuaaugaagugucaaaauccacacugaggccugagauggaccgugugccucuucucaguauuuuggaaauuuugucagguuguuuaaaaaaaaaaaagugacugcauuuauagaaacaguaauugaaugugaauucauguugcccugaagcugucacccgaaguggcuucgucucauuugcaaagccaaugucuccaucugcccagacaggcagggagccauucccagagaacagccauuucagugucaucucagagaagccuuuaaucccagcacucggaggcagacagaggcagguggagaucugaguuuaagccuggucuacaaagugaguucuaggauaaucagauacacagagaaacccugucuugaaaacagaaacaaaacaaaaaagaguccaaggauugccugggcuacagaaugagaccuaucucaaagugaaauaagccaggcuugguguuccgggcuugucaucccagcccuucaggaggccaaggcaggagagugacaaauucuaggucaccuugguguacaaagugaguucaaggccagcaugugcaacuuggggagauccuuucucuaagcugaagaagacccagguugugacuccaugagggagugcuugccuagugugugugacacccuggguccacccacaaguggaccaaacccaaccacaccaaaccacaucaaaccaagccaaaccacaccaaacccaaccacaccaaaccacaucaaacuaaaccaaaccacaucaaaccaagccaaaccaaacuacaucaaaccaagccaaaccaaaucacgccaaaccaagccaaacccaaccacaccaaaucacaccaaaccaagccaaaccacaccaaacccacaccaaaccacaccaaacuaaaccaaaccaacccaaaccaaaccaaaagagccauuucuuggaaagcgagugauuccuuaacauugauaguauucggaaugccaucuuuagcacaucgccucugguaaccaaaaggaaguggaaagacuucugagccaagaugaccaggacaaagacgccaugcaaaagaugugccacccacuuuguuccugugaggacugugagaagcuuaucucuggguaagagcgccagggugaggauucucgggaugcagccaugaaauugaauuauuuccauggccccucggcugucggcucuuguccccagugcggggugacacacuuuccucuuccgcauccucagcugcaucccagggcuuugcauauguccugccugagccucacaagaggguuuuaagauggagaggggggugggugccaguuccuucuagugacuuuuuggcuucccuuuaugcucuaagggcaauuuuguaguuuguugaggccuaagggauugguagagaaggacacugaagcuacaggccucagauucucacccuacagaggccugaaagggucucauguuggauggccuccacuuuggcacugccuugugccacuggcaggucgcggcuuugccuugccuuucccuguuguauuuuuccacaucuucuuucuguuucaggaggcugaaugacccgucaguugucacuccuuucuccagagaugacagaggucaaacaccccuccauguggcugcccucugugguaugugacccugggcuggcuucugugaggcaaaaggaugguggcccaugagcuaguggaggcccagaugaugggauacugggaggggcuggguugugggugcaucccacagggcaggaaagauggacaacugccccucuguuuuugcuggccaccaugcuaccucacaggcuggaagaggacucauguggcucuccaugcuuggggcugcugcuggccagugagaacgggcugguaugucugcuaagacaaucucacagaauugugguuugggguucacauaucacuguccucaaagauaauguugagccagguguaaugaugcagacuguaaucucagccacucaggaagccgaggcaggaggauuugagcuauagagugagacuccagcucaaaacuagaggggcugaaguacaaauguuuccagcaccacgugggugcuggaaaucgaaccuggguccucuggaagagcagccagugcuuuuauccacggggccaucucagcagccccugguccauuguuacugagaacagaugugggugugauucccuucauagggcauccaucccacagugauuuaagucugcagagccugacucaugucagcucaggcuccuguacagcugagacugggucuccuguggguuuccugccagggcuauccagagugagguagcauuguaguugggagccccucuguuuccucuaccaacaagagguccuucuguucugcaggucaggcaucccucauugacuuccuggucuccaaaggugccguagugaacgccacagacuaucauggguccacccccuuacaucuggcaugucagaaaggcuuccaaagugugacgguaagcagcaggguuguguguagcauugcaugguggcuucauggcuguaccaugcacuaaucuagugcuagcugccaggugugaggaacccagaggccaagggaccucccuggauauggguugagauggggaaaucccugaucaucucagggugggaagggcaggguucuggacauuucccuuuaaacuuuguguugaugggaagcaauggcuuauguguauauuacauacguaugugugcaggugagccacagugcacauguggauguccaaggaaagcuugcugucuguuuuccccugccaccaugugggucacggggaauugaacucagguggucaggcuugguggcaaucgccuuuaucugcuuacccaucuugccacccugcaauggaacaauuuuaacagaaguacagguugaggagccuuccccuugaugcucggguguuuuggauuguucuggauccuuuuggauuuuagaauaucaggcacuuggucuaaaggucauuugguauacuauuugaacugucuaaguauuccucuguuuuggcucaugucaaaugccucugacacacuagacaugguacugaauuuucuacuuggguugccuuaaaagcucaacgcuuuucaagacuggggaguuggugggggguguaucucuguguugaagcaccugugagugaagccuugaguuucucaccuagcauggggguugggagaagaaaaagaaaggaagaaaggaaggaagaaauuaauuucagauuuagggccagagugcacagccuauguaauguuuaggauaugaucaugaccucccuggaaggauacagcuuugugcuccgugcuccuucucgggcucagcugcugucuucucuccucugcuagcugcugcugcugcacuacaaggccagcacugagguucaggacaacaacggcaacaccccgcugcaccuggccugcaccuaugggcaggaggauguaaguggcuccggccgcccccaagcgcugcuuuucgugucucucaccuguggagaaauacagaugugaaaguagaccaguguuauguucuguguuauagugauugaaacauugguaugugauuauaauuuuuuugucugcuuuuuaucgugugugugugugugugugugugugugugcaugguugugugcacauugggacaggugccaucaugucuggaggucagaggaugacaacuguguggaaucuauucuuuccuuccaucuugcccaaguuugguuucuauugcuaugauguugcgguauauaauaauuggggguuuccuaccccaccuuugauuguuuaguuccuaaauaaaagacacaaccuugauauuuauaagaagccuuaaagcauuagagcugcgcagauaucaauccucugugcuauuuuaucuacuucccugucaguaaucccaagauaucacuugccauguacugcccagaccacucccacuccaacuagccaguccuuguggccauggguucaugaucuaccuacaccaugguaccuuccuccuucuuccucccucuaccuccugaucucugccucagaccccaagcugaaccaaugcuucacuuagcucucuucugcccagcuaccggcuguaggcaucuuuauuaaccagucauggguaauggggggggggggauuugcauaacaaaggcugauguacucgauagauuugcaccacuuggagcaaugcagaacuuagcauuugaauacaagcaucuuuagaccaacccauuauuuuaugagaccacgugcaaccugggggagggaacuguuuauuuucuauugcaccucccaaaggaagucgggauagucacuccccagaggcugaaacugaagcagagaccacaaaggaguguugcuuacuggcuugcuccucaggcuugcucagccugcuuucuuauacagccugagaccaccagcucaggguugaccccaccguaaugggcugggcuucgccucaucaaucaccagacccugcacagacuugccuacaggccagugugacggaggcauugucacacuugacguucucucuucccagaaaacuuuagguugucaagcugacaaaaaguaaccagcacacaccuuuacagggguucugggauggagccccaggcuuguguagcaaguguguuuaccugugcagccaucugcuagcccuguaauuuaaaacaauucaguguucaguguauuacggaugcuauauauugagaaauguaagaccuaaccccaaaguuaaaucauuuuuacucauccgcacuacaucuggcucuuaaacucuguauauuacauuuuagcccagcaucgaggaacccugugguuuccaguucugccuguuacuuuacuauguauauaucuguuaccuggcuucccccucauuuccagaaguuauaaaaaaaaguacacugauuuuuuuuucuucugguuuucugguguagcucaggaaagcacugaacucccaguccccuguguggucuauucagucaguaguggggucaaagguguggcgucaccacagguauccuugcagaaauuccaaauuguaucaaauguuacauaaaucguaucuauuuauacaacagcucuuuguaguaagaaaagugauuuucaguuacaguuggaaucccuaucugcauaaacuuuguugguaaauacuugcccagcccuaguuugagauucauuuuggauggcucugcaguccacuauauaauuuuauuuucuuaaauguuuucccaauaugcauauacaauauaacuacauauauacacacauauauacauacauacauacauacauacacacacacacacacacacacacacacucacaguccuggaaguuuguaaacgucuucuauuauuuuuuggauuauuuuguggcagaccaucccugacugucacccaggcugaccucaaacucuuucaguuuuccaaacacugagauuauaggcaaggcuacucacuucuuguugacaauuggugaugguuuuuccccuguccuguuuugcuucuuauuggaaguugcccuaagguuucuuugaaugcuagacaaagagacaaaaguuauaccacugagccacgcccucagccccucacugggggauucuagacauucuaccacugaccuacuuggauucuuuugaaagaaugagguguccugaucagggacuauagaacccuuaaacuguaacugcuggguuucauauuuugucuuggugaguggagccuuggucaaaccagggcauggaccauggcugagggagggacugacguugcccuuggcuuucauguuagagaaccaugauuuugcugucuuugcagugcgugaaggcccuggucuacuaugauguccaggccugcagauuggauauugguaaugagaaaggagacacagcccugcacauugcugcacgcugggguuacgagggcaucauagagacacugcugcagaauggagcccccacagcaguccagaacagacugaaggaaacaccacucaagugugcucugaacucgaagguagcucuuuccaucucggagcaacccugugacucuuaaaaacaaacaaaaacaaaaaacugcuuacagacuggccuccugagaaaauguacauuagcaccccaggagaacacuuggccuccauccuucuguucuauuuggaacaugguuguuaaugagcuuugcuuuuugauacaauuuugaguuuuuuuagcaguuuuucucauuaugagcugcucccagcagaaauggcucuggccccugagcacuaggucucuagcagccaguggacugugugaaaaugggugguggccuugucugugaagagcagagaaagcaaaaagggacaaagcacuguuggggacaaacacuauucucucucucucucucucucucucucucucucucucucucucucucucucucucccucucucucccucucccccucucccccucucccccuucuagccucuagaaacuuuauuucaauuuggccaaaauugaaugaauuagguaaauuagagacuguggccccgcuagccuugagcucauagugugccucggucuccugacugcugggauuauaggucugauaccaccaugccucuagacuuggucucuugaagaagaggaaaaaguccuggauucuccauuugcccagguggauggagggugguugaccuuggcagcaaggacuuuuaaccugcugagcagucuguccagaccccagaguuagcuaagaccaucugagaccaucuccucugaccuccccuggggacuggcaggcagagggugcuggggaugcagagagcuugguuguagcccaucucauuagaugucuuuccugugcccaucauccucuagauucugucuaucauggaagcucaucaccuauccucugacaggaggccaaggccuucugagguaagucucuaagucucuagggccgugcuuacuggugucccuggagcuugguacucuccucugggccugacauggcugugacauacccacgucccuucuguugccugucccuccuuccccuccagguuccugcacaguccccuacacgcucuguggauuccaucagccagggcuccuccaccuccagcuuuucuuccauaucggugagcuucaggcaagaagaggucaaaaaggacuacagggaggugagccagugagauggguagaccuggugugggugggccgguaacaucacugugggcugaccacagcugccugccagcuuaccaguuauuggacagccaguuuguugacuccaaggucaauuggccuuugagaugcacccaacugugagucauguggucuucaucuuuucuggcucuccugggucuuuucuccauagcaguauuuggaaugugugcguuugaggggaggaggggugggggggcacagagacacagaaagagacagagacacagaucuggcgcaggacaagaaauagacaaagugccaugcccacuauauucuaagaaaaauauauguugauaaagcugagaguucuagugucagacucucaaaguccauccucuguccccacccggugagcaucccuguuaauauccuggugcacauuaucccuuauggucugacacguacacccaucacauuuuguaaaaccugauuuauggucagucuuuuuguuuuuguauuuuguuuguuuguuuguuuguuuuguuuuccaugacaguguuucucuguguagcccuggcuauccugaaacuagcuaugucuaccaggcuggccuugaacucacagagaucugccugccucugccucugccucucugccucucugccucugccucucugccucucugccucucugccucucugccucugccucugccucucugccucucugccucucugccucugccucucugccucugaagugcuaggauuaaaggcaugagcugccaugcccagcuuuucuuuccuuuguaaugcuuguucagcaucaacacaauccauccaucuccucgucuucuccuucggcagagguggagaucauuaccucacgguucuguugcuccucuguggagucacuguccacccuagaggggucagccagcacccacaccccaaagcguucuccugauggggguauucagugagcuccaugcagagucacagaaaggaaagccacuaugugccccccgacagagcacccagucccucagagaccugcacucguucuugggaaggggugucuacucucagacuccucacccaucaaacugugagagcugaguaugacgaucaggguggcuggcuucuucagaagugauccugaccuggcccuggugacaggaaccucuugucuugacuccucgggagggugaagcaggaagaugaucacccuggcuugcuuugcuugggcuguauugugaguucaaggcuuagccugaacaacucagugagacucugucuugaaauacaaaguaagaagagcccugggggggucucucccugggagaacgcuugccuagaugcuuaaagccccagguucuguucccagugccagcaagcaaaaggaagaaagccuuauuguguuaaggucacugucacuucgccucccacauaaccagcagcuccagucuguguuaugugggaggugguuccgugcggcuuucagaauguucuagauggacgauuugggggauacauuugaaaggcacugagugagccacuagccagaagacugcccaggccuccagaacacugugucucccuguuguuuguuuauuguuaaagcagcuucccugacucgcuuucuccuuccauuaagguagaaaagcuucuaagggcaguugcugauggcgaucuagaaauggugaguuuuucggugacugucuuucucaucgcugugacaaaaugccuggcacuuggaacugaagagaaagagcguuuguucacaguuuccgaguucagucugccauugcagagacagcggcuuuucgcaugggguggaccaagaagcaaaggggaacuagagacaaccaggggugggugugaccuccagaggccugucccuagcgcaggacuuuccauagccagguccagacugcuaaaggcucuacagccuucaggguaugacaugaauagcagcccagugaacgggagucagaacaggagccugugugggacauuuugagauuaaaaucccaagaaagcacauguuccaagcucuucguuggaaguggcuguacuccugucuccugccucugagucucuagcuauguggccucucuguaagcucccccucgaaggugguggcuuccguaugcucuuuaucauggcggugguaggcuuucccagggaggaggcgccuagcaagcauggccccgccccuccccgcuccuggccuucuagacauugccauucugagagucaaagugaugcuggcaagaauccacacuaagguuugggaaagagaggcgugagggaggcagacauagccaggguugcaugaaacucagcagcaguaugaggacaucgggcuccuugcugggucggcaggcuugaggcuuuggaugucacaagcagggaugggacucacacuaacaguagccgguagaggcagucuuccugggggugcccauggacaguuucucuuggcuuccuggaaguagcaugccugugcuuagcaaaccuggagcucuaaaugacucaucuuccgagggcacguuacagcuuucaagagugcuuucugaaggcugguggcggcaauuguggaaggcuggcaguggcggugguguacaucuuuaauccuggcacuugagaggcagaggcaggaggaucucugaguuccagggcaaccuggucuacagagugaguuccaggacagccagggcuaacacugucucgaaaaagcuccaggccucugugggcaucaggccugccugcgaugcucauauacucaugagccgugugcacacaugcauacacacacacacacacacacaaaauaauggauaaaaaaauguacuuuucacugaugaucaagugggcccugucuguuccuuguguugucauggugacaggacaacuggagagagcagaauuguuucagccuacgguuucaggggacuggccagagcuguuugguuccaugcauuugagcagaagaccuacugugauugagacgcagauggauuucuucauccugugacagccaaaaagagccuagaaagagggccuaugagauggccuagugagcagaggggcuugcugcacgugcuguggcacguguaugaccccuccccccaguccaggcuccagucaugcaugcacgcacacacaaacaugcauacaauaacaguuuuuuaaaaggcaggguaagagggaacuaagcguuggagaucauauaaccccuccgcaaagacccacccccaggucaccugcucccuccagcuagaccacacugcugguaguucuagcauuuccgcaagcagcacuguuagcugagguguagacauccaacccggagccugcaugggagauuucagauucaaaccauugcagaggugguaaauagggucgucugggacagaagaaauguaccccaguugccauauauaauaagccugucucagaggcugaugucauuccaucaggaugacacacagcucucuggaagacacagaagucugcaccuaucugcugcugggcugguccucucacgagagcaucucuggaaaacccagaguuccagugcucuuuggguauuugaaggccacugugggagccugauacauagucugugcagcaagcaaugacuagaccaggucaugacccaugugcucugccucccacugggaugggguucaggccacauauggaagggguggccaguggcacccuaggcagcgcccugagucacuguugagacugaccuugggcugucacaagaccccuuucaaggccacuugucaaucuuguucuuacccugucuugagaucugagcuggccgauuuguaacugccaccccaguauggaaccugggggacaagaggcuuggcauugauggggaccccacaagcucuacccuuauaugcugagcccugaagaccugcagggaagccuacaaacgcaugucuguggaugcuuucuuucucaaaggaauucuuacugauaguuuucuuuggggagggacaggaucuuacuaugcaguucaggcuggucucgaaccugcaguucucuggagggauggaguugcagguuugagccaccacacaugcugucuucucaaguuucagguccuaguaacuagaggaugcuggaacccagcauauccugccuggaaguuucuuugcuuuggcccuuugugcuggcguguagugcugacaggaccgugguguggggucagggauucucgugugcucuggaacacagcaugaggacucaucacgagguuucuguuggguaucaaggaaggaucugggguugacauggcaucuuagaguuuuacugcugugaacagacaccaugaccaaggcaagucuuauaaggacaacauuuaauuggggcuggcuuacagguucagagguucaguccauugucaucaaggugggaacagggcagcauccagguguccaugguacaggaggagcugagaguucuacaucuucaucugaaggcugcuaguggaaggcugacuuccaggcagcuaggaugagggucuuauagcccacccucacggugacacaccuauuccaacaaggcugcaccuauuccaacagggccauaccuucuaauagugccacucccugggccgagcauauuagaaacuaucacaccuagucagguggcauaggagugcggacucagggccagggucuaaaagcuugcccuccaggcaguuucagucugcuccucuuaagaugggcaaagacucguaugcuagaaaaugauaggucgauccuucuaugcuucccagggggaccuaggacgacuugagcacagguggaauguagauuuauugaggaacaaaugcucuucgucagugacagcggugguccagggagcugauuuaggaagugugugcguccgugcgugugcaagugcgcgcgcugcugguaaaggugucagaauaaugaaguucccguuucuccucauugcccgccaccagguacgauaccuuuuggaguggacagaggaugaccuagacgauguggaagacgccaucagcacgguggaucucgaauucugucaccccuuaugccagugucccaagugugcuccagcucagguuuggcucugccugugucuguggggcagcauggggugggaggcaccgucuuuuauucugccuaggaaguccuuugcuuuaaguaauucaugauugacacaggcaucccagagagacugaauagucaggugagggcugagagcaucagcucuucuuuggucauuuucaacucgccaguuauuuauuuauuuguuuguuuguuuguucauucauucauucacucauucauuuaugggacagagucuuacuacauagcccugacuggaagucauuuauguagaucagguguagaucagagugguuggucucgaacucacagagaucugccugccuccgccgcaugagugccgggauuaaaauguaugcaccaccaugccaggcuuuaguuugguuuuaugcauguggguguuuugccugcaugguuauaaaugcaccucaugugugcagugcccaugaagcccaggagagggcaucagaugcccugcaacuggaguugaauggcuccacauggcugugaauugccaugugggugcugggaacugaccucagauccucuggaagagcagccggugcuuuuaacugcugagccaucucuccagcccucuuuuucauucauguuauuauuuuuauucuugaggugugaguuacauucagugagacccaaccuuuaacucagaugguuaacuguuuguucucaaugagaugcuccacacugcccaccauuuugucugccuucucccugaccacuguccucucagcagaacuuuaaagccgccagggauaagaaggcagucucaggauuaaaaaugaaggugaugugugaggaaaaugacguacuggcuguuucaggagguuuggcaaacacuuaggggaccugguuguuuaaucucaggcuggccgcaaacccccuuuguugugaaggacgaccuuggaguccugaccuucuacuuaacccaggagccgugugcugcccgcccgcccguuuuugugcauagucuccuacuaagcacugucaugaagagaggucaugucugugugucaguucuccaugcucaugaacagccucccuuccccuccucccuggagacccaugaucugucuccugagcucuggggcucugucacuccugaugcugauguggguuuccuuggcaacuggccacauuaucaagcacuacagugagcagcuuuucuguuccacggaaugaccaucacuuggcuuggcgacugugaugccauccgguuuauguguguggaguuaggguugguguccagugcgccugugugcugcacccccgccccaggcugauuuauuaagcaggcuugguguucuccauugcaccucgugggguaccccuucuacguuuugugucuuuggagcuccuuccugaugugaucaggcauucuugcagagggcuuacucuauugaaauacagaagucagucuuuuguugucucaucuccuucugaagaagugggaggucacucgugggccauguugaguccaggucccucugugaucccaaaauuugccuaaaagcugggaggugggggcagagagaugcuucccaucacccccacccccggcccagccucuugaguacuguugccacauguuugcacccucugccuuuucuagaaacuggccaggauuucugccaaugggcuuagugugaaugugaccaaccaggacggcuucucuccccugcacauggcugcccugcauggccgcacagaccucgucccccuccugcugaagcacggugcuuacucaggugccagaaacacaagccaagccgucccgcuccaccuggccugccagcaggggcacuuucagguaugggccccaucucccggguagcaaaauagcugugcuuugauuuuuggcaagacccucacuuggugacgguucaucggggcagugcugagggaagcccugaggacagagcaguucuuuccuucccacgauggaaccccuggccuggggccugguaccagugccccuccccacugcccuucaggcugggugguguaaugcugucccugagcuucugaccccagcaacagugugucuccugccaaggugcuggucucuauacuaccuuuagaucugugcaaaauagcuuaguauuuuauaaaugauaaucaaggccuuaaauagcgguucaagagucugcaaugacuaacuuuuguuuugagacaaggucuucaaauguaacucagccugcucucaaacuuuccauccuccugccucagccucuugaguguggggacuacaggugugugaccucacaucuggcuuugaaccaguuagcuuccuaaagugcguuuucuuugggaaguugucuguguguaugaccuugagaaguuccacugugggguuuuaaagacaggaccaugucuccagccugcaucugucuuagauguccagcagaccgcuucccaccguguguugagagcaauggcuacaacucuccuuagguagcuauaaagaugaaaacccuagugccuggugcauugugggcacaaagcaggccccccacagaugagagugccccccuguuauucaucccccuugauccagagggcccauuucaccugagaggagagauuucuuuuccugaguuaucauuaacacugaaguuuuucuucucuggacuagguggcaaaaugucucuuagauuccaaugcaaaaccuaauaaaaaggaccucagugggaacacaccccucauuugugccugcucugccggccaccaugaagucgcugcgcuguugcuacagguaagaucucucccugccacaccuggccuuauuuuuuuccuuuuaaacaauuuuuguguuuaugcuuuuuuaaagauuuauuuuuauuuuuguguguguuuugccugcauguauguauaccauguacaugcaaugccuacaguggccaggagagggcgccagguccccuggaacugaagcuaaacaggcuguugugagcuaaugugggugcuggggaacuauauccagguucucaucacagagccgugcagugagaguuuggaauuuugguguugauagaguccuuggagguugaaaauuccaauauugaauauaaaaaaguuacuagaccauuaaaggcauggacagcaccuauagacaguggauaagggauacaauugauauugguucuaacaugugccaugcuaauagcauagaacaagcuauauagcuagagggcucagaucccagaauuccuggugcccuaauuguggcaauugcagucauuugcacagagguggugacgaagccgcuaaaggucucagcucucaaaauauuuggugcuuuaauugugggaaauuuggucauuagcaacaaaauugugaacaaggcaucucuaaggucaaugguuuuuuuauaaauauaaaccagaaagaaggccuaggcuucuacaccuagggugugcaggcgauguggcaagggcugccauuggaccaaugaguguagguccaaaagagauauccaaggauauuucuuacuuuugggaaacagcuuugggggccuggcuugaagccccauagcaaaaguaucaaccgaucaccucuuaucagccagggagcauuaagcagacagaaaaaccuuaacacucagcaaaagagagacagguuauagaucaacuguggaauuaaaucauucuguauacuaucuggauguguuaaugucagaguggaagcccggggagguuuugcuuugggaauguggauuuguuuauaucuccacagggauuggaaagcuguggaucccaucaaaauugauaaagauuagaaccaagcaggagaggucuccugaaaaccuuggccacugguccgaaaagcacuaauuucaucgaaaaugucucuguuuaugauuucccgccauccagccuaauuaacggcuuaauacagaaaggaggaaauguagugagaauuuuggaauuuuggauucuuuaaaaaacauagaaauauaauucuaagaguccguuucuguuuuaaucccagguauagggacauggggcugcuucagacuguccauagcagcugacuaugauuugucucgugcucuaacaggggcgugauuuugucagccgcagaugguuucugcgauugugugacauuuggaguucuggggacuuuucagaggguguauaaaugcuagggcccugagaggcagggcaacuuguugguuguuauugguggcuguuugucaaguggucaugcacaaagaagaaacacacauacacguaccuaaaaauuggaggaaaaggcagaaaaaaaaucuaaguuccaagaauuuuauacugaaccacacacccaggaguugaguuugaggccaaccugggcuacauaggaaguuugaggccagccugugcuacauaguaacaccaucucaaaaacagauuuuuuuuuuuuucuugagacagagucucaccauguacccuaacuaccuaaauucuaaauuccaugccuggaacccaggcucugaagcuaaugagaccagugguguuaagagcacuggcuauucuuauuuuauccccuucccuucccuucccuucccuucccuucccuucccuucccuucccuucccuucccuucccuucccuucccuucccuucccuucccuccccuccccuccccuccccuccccuccccuccccuccccuccccuccccuccccuccccuccccuccccuccccuccccuccccuccccuccccuccccuccccuccccuucuucuuccauuuugucuuguuuuucaagacaggguuucuuuguguagcccuggcuauucuggaacucacucuguagaccaggcuggccucgaacucagagauucaccugccccugcuucucaagugcugggauuaaaaguguguagcaccaugcugggcuuauuggccauucuuucagaggaccuaaguucagcuccuaguacccacauagugacuuacaaccacccaugcuccaugguaucuggcacccuuuuguggccuccaaaaccauagggcauacacacaaugcacauacaugcauacuggcaaaacauucauacacuaaaaauaaaccucuuuuaaaauguggaugcccuguguuucgugccuauagccccaguacucuaaccucaggauaggagguggggacaggagaauuggcaagauguccucacauucaguagagcagcagaauuaagggagacccugucucaaaagcagccaggaggagagaucaacucccaaaauguuguucucuguccucuguguguggugugacgcauguaccucugccauuaaaugaauuuuuuaaaaagucauucuauagcgaauagucccacggauugugcugucccguuuucucccccagcacggggccuccaucaaugcuugcaacaacaaaggcaacacggcccugcaugaggcugugaugggaaggcacacccugguaguggagcugcuucuguucuacggggcgucgguugacauccugaacaagaggcaguacacggcggcggacugugccgagcaggugagggagagcgcuugaggaggcagcuccgugcuuccugaagcacacacacuguggguuccuuguguucaaaccagaugggugaucacaagagccaggccuuuggugcuccgugcugagcuaagugagcaggccagacguccacaggcagggcuaguuccuugucauugucaccuggcggggcaugcucgaugugccagugcucuuccugggguaacuucagaggccuaagggaauguggaccaccuaugaauugcuacucuuagacgccuuggcguggugcacacagcugcugucacaucugagaaguugcagguuacacaucguucuggguuuaccagcccuguagcauaauggagaguuuuagcuguggguuuuaaaucccucggauucugagagaguuuagauccccagcucucucuggagcuaaucauggagaaagaaaguugcucuccucuguuccucucauggugaaucuuggcuuuaaacuccaaauaacccaauacagauguuaaagucacuauaaauccaaccuaauuauaugccuauuuaauuuuaaggccaaaggcauggcucuguagagccccugccuagaacuccuagugaggggcuggaggguguggcucagugguagagccccugccuagaaucccccagugagggacuggaggguguggcucagugguagagccccugccuagaaucccccagugagggacugaggguguggcucagugguagagccccugccuagaaucccccagugaggggcugggggcguggcucagugguagagccccugccuagaaucccccagugaggggcugugggcguggcucagugguagagccccugccuagaaucccccagugaggggcugggggcguggcucagugguagagccccugccuagaaucccccagugaggggcugggggcguggcucagugguagagccccugccuagaaucccccagugaggggcuggggugggauagagccacugcccaucauguacaauguccuggguaccaacccuaguuccucaagaagaaaaacuuucaaauauugucucaaucuagagauuggguauaccuuuuaagaaacuguuggugaauuuuaggugucccuugacuggguggaggugucugugaggguugacggaacuuaccagauaaugcuuaacguuucauuugcuccuuucucaaagauaaaugaugcugcguguguucuacugcagauccaaugguggcucccggacagcuuccugguagccacauaguaacagcccuacugugcuuauuaccccaguguguguaguagggaugugcaggcuggggaauccuagugcaggucagagcuucuaaaugaagagcagaauucuuuuucaaaacaguuucccuguugcccaggcuugaacuccugcacucaagccacugccuggccucaggugcugggacaggagccaugugucaugggacccugacgugguuucauuguuguuuuguuguugcggagauacuuaaggaggggauucggucacacgaauaugacauuuagaugggaacccgaaggauaaucggcagagaaaacauuuaaacaacuuacugacuuagccccuuuuaaauuguaggacucaaaaauaauggaguugcugcagguagugccaggcuguguugcgucucuagacagcgucgaggaggcagaccacgaggguuacgugacuguugagaucaggagaaaauguaagugcuugcgaauucucaaccucccucuguguauguuaggguucucuagagucacagaacuuauggauagucucuauauagucucuauauaguaaaggaauuuauugaugacuuacagucugcaguccaauucccaacaaugguucaguaguagcugugaauggaagucuaaggaucuaacacggcaaacaggcgagagagcaagagcgagacucccuucuuccaauguccuuauauugucuccagcagaagguguagcccagauuaaagguuuguucuaccacaccuuuaaucccagaugaucuugagcucggagauuuaaucuuaaacuucuaucuccaagccuccagauaagggucacuggugagccuuccaaucuggauuguaguucauuccaaauauagucagguugacaaccaggaauagccacuacacucuguuugggaauuaauggguaggugaugcuuucugugugugugugugugugugugugucugugugucugugugucugugugaguguauauguguguguguuugaaggcguguguguuuguguuaaugugugugaguguauguguguguuugaagauguguauguguguaauguguguuaguauauguguauguguuaauguguauauguuugaaagugugugucuauguauuaauguguguuagugcauguguguuaauguguguguguuugaagguguguguguauguguuaaugugugcguguauguguguauguuugaagauguguauguguguaauguguguuaguauauguauguguguuaaugugaguguuugaagguguguguuaauguguacguucguguguguguguguguguguguguaagugggaguccaaccuugacugucauuccucaggagcuauccaccuuguaguccgaggguuucccuuugggcuggagcuccuggaguagggagccuggcuggugaggacaggacuccaccugugucggcuuucacagugcuacgguuacaaguaugcaccgcuacaccugaccugcauguaugucugcgcaccauguguguuugcugcccuuggagacgagaagagagcaucagacacccuggaacuggaguugcaguugcacgugggugcuggaaaccaaaccaggguccucuggaagagcggccagugcucugagccuccgagccuuuacuguggagcccaggcuggaacucagaucuccauacuucuauggcaagcgcagcugagccauguccccagcccuucaguauuuuuuacuuuugggguuucugugugucgggcaugaaccugugcauccacacaugguaaacagguguuccacugucagcuucauucaugcuucugcucacaacugaagagagcagccaucuugaaucucucuggccuuguguccuaaauccagguguucuguacaauuucaggguaugccgggugaauggcagcuucuaggccugagccacuuagaccuuagagccuaaggguuuccucagcacaugcuaugcaaaugccuaccacugagucacacuccuacccuccuaagguuaaaaaaaaaaaaaaaagaaaaagaaaaaagaaaaaaagaaucauuuagacuggagagauggcucagagguuaagagcacugacugcucuuccuaaaagucuugaguucaauucccagcaacuacauaguggcucacaaccaccuauaaggagaucuggugcccuccucuggcuugcaggcagaacacuguauauauaauaaauaaaucuuugaagggcuagagagauggcucagugguuaagagcacugacugcucuuccgaaguccugaguucaaaucccagcacccacaugguaccucccaaccaucuuuaaugagaucugacgcccucuucuggugugucugaaaacagcuacaguguaauauaauaauaaauaaaucuuuaaaaaaauagaauuauuuauuuauuuuauucauaugagugcacuguagcuggcuucagacacaccagaaaagggugucagauaucauuacggcuggcugggagccaccaugugguugcugggauuugaacucuggaccuucggaagagcagucagugcucuuaaccagugagccaucuuuccaguccccaagauuguacuuuuuaguuauguguaugugggcaugaguggaggugcucaugaucauggagucccgagagggcagcagaucccuuggaaccagagucgcaggcggugugucucugugauccaaagccgcauugugucuaagaguagcacagugccuuagccacugagcugucucuccaggccuucuuguuuucaguuugcaggcgcaccaagggugauaguaacuagauuccugcccaccacugccuggaaugagcacuuccuuuuuaaaagauuuaaaagggauucuguuuuuaggagcuuuucaaaaucaaguaugaauacaguugcaacagguagauaaacccacugguauuccuaggaagucccagggcgaccuugccaugacuggcuacggcuaaggggucucuauggagugagcucugucuaaccaggguuugccuagcaaggaacagccaucggguggguuauaaagcagauuuagcauuuagcuuucuaaauuucuguaugcuaggaaaucagaggaugugugugugugacaguguguaugugugugagagaacguguguguguguguugugaagucaccuuuauguguguuguaaagucaucuuuauguguguguguugugaagucaccuuuguguguguguguugugaagucaccuuuaugugugugugugugccugugugugugugugcguguguuguaaagucaccuuuauuugugugugugugugugugugugugugugugugagucaccuuuauuugugugugcguguguuguaaagucaccuuuauguguguguguugugaagucaccuuuauuugugugugugugugcguguguguguguauguguguguguuguaaagucaccuuuauguguguguugugaagucaccuuuauauguguguguugugaagucaccuuuauuuguguguguguguguguguguguguguguguguguguguguguugugaaagucaccuuuauuuauggaguuuuccacuguuuugcuguuuuacuaacagggaaccccaaaauguacaaccugccagaggaaccucuuaggagacaguuuugccucauuaacccggggggucgguuccaguaaguaucuaguucaaguugacuggguuuagacccugugguuggcuucccagggguggguugggagauugggguggggugguggggggcuaugauucuaggauaucuguggcuuuaacugcucacgcaaugcugccaucuuguggccagugggcuuuauaucauugcccagauauuuaacuuuguuuuggauuaauacuugguuugucuugcaucucagggagaggacauccagggagacuaugggaagggauagaagugugcccgaucuugcaggacguucucuucaggaggugagugauuacacgguaggggcuaugaccuagcuuuaaaaaaaguaaccgacaaaggacauuucucaacagucaccuucauuuucuuaucucccuccuugaaagaauuagcaacaguuaagacuuaagcucuaaggcuggagagauggcucagugguuaagagcacuucugaagguccuagguucaaaucccagcagccacaugguggcucacagccauccauaaugagaucugacacccucuucuggugugucugaagacagcuacaguguacuuagauauaauaauaaauaaaucuuuuuaaaaagaaaagacuuaagcucuacagcgaagcagacaagaguguggacuuaggaguaaauuuacaacuacagcccuggacaagcaugguggcacacgcuuuuaauccuagcacucgggaggcgggagugggugggugucugugaauucaaagccagccggggcuacauauugacacccugucuucagaaaguauaaaacugcaggcuugagcugagaaagucagggagacgugggacgucguauacaugggaagcugcaauucacuguucacaaaaagcagacuaggccggaguuuacugcuuuuuaguauuugaaaugaggacaguguguguagaugacauaauguuacacccccagccccccaccccacagaguucuuuauguacccagcuuccuacugaaucaauuagaaaaggccugauguacagucaguuccacugcacagugaggcuucucagaaacaugugccuuuuccaguugcugaagaggaagaguggucccagacacacagucaaugacacagccauacuccaggucccagaggugacuguccaaaaugcacaaaacuuagucguuuuaaagaauguaugcaauaguuaguguggcagauucagccccuugcccuuuuugagagaguuucauacuguaaugcagacucuccucaaacucaugauaaucccccugccucaguuucccaaggcuugggguuuuggugugaacucccaugcccagcuugcaugauaaaaucuuauugcauauguaguuuuccauugccuugcuuguguccugcuccuggagaggacauguaucagcuuugacaucagucagggguccccuucccuugcuacgugacagucagaugcccuuacugugugguucccuugucagggcagcaaccacacauaugaucagagauuaaaagcucacagagcacuuucugugugucacacagagcaccacaagccccaucaccacauuccaguuggccacugugccugugggauucugagugcauugccugccaccuugggggaggagugggugcugccauccuggggguuuaaaaagcacaguacagcuaugaacuaaguuuucucuuuucuuuagccagagaagcaaagagucaccggaaagcagagugaccugucagaccugagcagguaucagaccucugaggaaggaaacaaggggcucccggagaggcccgugucgagacaggcugcuccaggacaccggccgaugguccgcagacacacagucaaugacgcagccauacuccaggucccagaggugacuguccaccucaccacccacgaggcgaguguuccucagucuuagcgguaagggccugguaaaucuacggagacacgaguccacgguaagauggugagcaugaacacaguauagaacuaagcauacuuucaauaaccagcuugagagacagccccucggacuuaccacccucuccucuucaaagcuaacucacauacuugaaaaggaaugggagggacugaccgagccccuccaucgcagcauucggguuuccuggucacaggcagagacuucaucgccaggucugaccuccuuuggcuggaaggugcuaagugucugugagguggauaaguaggcaagccuuacgcuagaaggaugcccauguccaggagaugucagagaagcaaugccggucuuccggaaccguggauaccaagcagagaagcaucccauugggaugaagaaacggaaccuggaaacacuugaacuggaagauaccugaaugcuguuuugacguccgucccagugaaaaggaccuaccauucugccuuguucuacaccaugugucuggggaaaguuggccgucgcuuucccaacaacacagaccccccugggucgcugcacguuugccuguaugaauuucugcucacucuccuuuccguuagagccuccccagcacagcacaccugacagacgguuacuagagagcagcuuuggcacaucuuaagucuuucgauucaaauucaaaacuuagagcacaaaccaggucagaguuuaaguuaggauuuguugccauugauuccuuuuuauaacuuucuauagauucuauuauuuuuuuauguuccugacccuaaaguugcagacauggauucagaggguuuuguaaaggggaaaugguuuugugcacgcuauuggaaauacuugugaauguauagaagggaggggcugauuauuuuucuacaaaguaauuuaugauuucuaauuuucuaaugugccuuggauaugugccaaaugauggaaaagaaaacaguaaacuuugccucucgauugugucgugccauuuuuguguuuuguuuuuguuuuuuguuuuucgagacaggguuucucuguguagcccuggcuguccuggaacucacuuuguagaccaggcuggccucgaacucagaaauccaccugccucugccucccgagugcugggauuaaaggcgugcgccaccgugcccgguugugucgugccauuuuuaaauguugcugugcaguuucccagugagucuucuguaaaccuguuguuaagggucucucccugggggagauggaaugugccuguucuuucuaggaucccagugacaaaccaagauggaguuacucuggagaaucacugaguuuacgaggccuccugcagggcagugagugagugagugagaggucacacuggcagcucaguguccagcacggaugaggucuccugccuguguggauggagccccaucccuagucuuucccggccucucuguauauacucuaaccccucucugaggccgcguacaguuucagcagaauuggauacaacuggcuggaggagugggguagacauucagcuggggguccccuggcuccccuacccccaacagacacacacacacacacacacacacacacacaccccuucccuagaggaacaguaacauucaacaaaucuagcugcauucuuuuguacgugggcacagcucgugugaagguagugguaguuuggcuccaggaugguccuguacaacuccgugcugcgugggaaacaguccucaccggaaggacagucuuuuguauuuaagggugacugggaugcacaucuggaucacucaagagcagaccaucacccuucuaccugcuccagguugauaggucaauggcauacaccauucucgaguacucacaaagacaccucuucaggugacaccuaaguuaccuuggcuggucuggacuucuguucccauccccccagcuuccugaggcgcugugauuacaggccugcacccacacacucggagcaggaaagaaugaacgcagccucuuuccugauaggaugugugugaaugcucucaguuuguugaccuuucucccacuuuccacuuacugacaaugcguguuugccugcuucucagucuguguggcacuuaggccaaaagagggcaucagauucucugaguagaguucuaggugauuguggggcauccuguggaguccuauccagaucaucccaagaauggccagugcucacuacggcugagccaucuuucuagcccuuccuucuuaacaaaacgagacguuacugcuauuugcugcugucuccaggacucaagguuugucagggcagagaaucacaagaggcagacgcacacauccgagggacguguuccaguuugccagugcggacuccucgggcacaggcucaucuaucucuugcuaacucacugcagugaggaguagaguagguuacaccgauuauccuugcaaggguuccaguugcucuucccacuuaaaggaaaacuugacauggccauuaaaaaggagcacuguucaagucuuuguguguuguuugcaaccgcaagcacugcccgcuuuacacccacaguaaaugcauguagcacaugagcugucuucaggaccccguccuuguacaaacagccagcuuuccagucccaaguguccuuccacacaccucagccagucugggcauuaggauugguaacuguacagaaacauguaacaaaacuuccgacaugucaggugucuuucuagcauuucauauaaaugagccaugaagcacacuuuuuuaaguaucacgggucauuucugaaaagucuuaggcaggguggagaaugugccucaguuaacacugucugcuuaguguucaugaaguccuguguucaauucccagcgccacacacaacaggugcagugcuacaccuauguaaucucagcacuagagauguggaggcagggggaucaggagucuggggucauccuuggcuacaugguaagcugagaccagcuuuagacacaaugaaaccauccuacaaacaguaacagcaaaccccaaacauuacaggacaaaacccuucaguagguuugaguaggacagugcagaccugaacacagauugauuuauuucucugauuuuuuuuuuuaucauguaugugugugcuuauaagggguucguguguagguuucugaggccugagggcaucugauccucuggagcuggagguacagguaguugugaacugcccaacauaggugcuaggaaaccaccugguguccugugcucacucagccgucacuccugccugcuccucuuguaaacacgucacuuucacuguucaacagggaccuccuaguuauuuuguagaaauaucacucuaguuguuuuggauccgagugguauuuguucgauaauacccaacagcuuuaaacagagugcugggauuaaaggcaugugccaccaccgccuggccgucagacacuuuauaaagccucacacacccaacagcuuuaaauccaaagcugggacucugggaggcuaccggccgaggaggagacaucccugcccuaagaaugcaggauaugcucagcucuuaaagcugaugcuguugccaggguuucauucucuggccgcugagcacgcuggcacagcugcuauuucuccucauguuaacgucccagcugcaaaggauaaacucgcauugccaccauuuaaaagcucuugguaaggggggaaaaaucauucaaaaugcagaucuucuuuugaguugccugugauucugaaacacccaaacuguuugaguuugagguacaaguuuauuuuucaaaaggcauauauagacagggaacaaaguaaacauuuacaagguggugacuguccuagacacugcuccggaagucugucuaagugcguccucuuaguaaucggcgucgucuucaucggaguccauuacuuuucuucuguugaacuagggggaaaagaaagguaugucagacacuuuuuuuuuuuuuuuugguuuuuuucgagacaggauuucucuguguagcccuggcuguccugaaacucacucuguagaccaggcuggccucgaacucagaaauccaccugccucugccucccgagugcugggauuaaaggcaugugccaccaccgccuggccaucagacacuuuauaaaaccucagauuuucugagaaagacauuauuucuuaagugagcuuauguguguaugucuuugaagagggguaggugugagagguaagaaguguuaacaauuacucucuucccaaccucaucgcagaauuaagaugucuaaaagcucacaggcgcuuggccagcucaggcagcuggaaacgcuaccaccucccaccuucccccaccuuccgccacacacuuacuuucacuguuguuuucuuuucugucuguuggcugacuuucucaaguauuucuaucaaaccuuguucugacaccuauaaccagaaagaaaaacaggguuacaaagcaaacagcaucucuaaccacugucagggcucuccgaggaguaggaaaaaggaacagagggcucaggaaagugagcaguuuaaguccaucuuuugucacugcuagcaaggcaaugacaaccacugugugaaaggucacaggcauagaugugcuaccucugcccacgccacccuagagacagcauccuaaaaaaaagacccaguucuuuguagcucugagugcaggcagggcucuguguagccacucaagcuugaggacuagacuucccaaauauaauccuccuggucacacacacacacacacacacacacgcucucucucucucucacacacacacacacacgaaccaaggacuucaaccuccccucacaacuacacaaccugcacacaggugguauuuuaacugauacuugcaaacccuaucuccagugcagaacaguuuaagccuggagacuaacagucacugggucacacugccacacuguuccacacaaugccaggaagggagaaaguccagcauuucugaacaugccgucuuccuuuaagauuuacagcgcagggaucauucucgccuuuaaaacuuucuuggagucagucaauaagaacucuguauucaaagauggaaguuacuuggugcagcugauuuuuuuaaguuuuaagaauucaugugcaugaguacuuugcuucaaaaagaaacacacacacacacaccccacgugcauguguggagaugagaagauggcacagggucuccuggagcuggaguuacaggcacugggagcugccugauacggcacugagaagcaagacagccagcgcuguaguugccgagcuacccagcagccccgagccaaggucucauacugcggguauguacagcaugcugcucaggcagucuggccuuaccuucccacuuagcuguccauaccgcgccaucuguauaagguaguucuccacugcuuuaguuuuuucaggcuuuacaagugcuaaguuacuuacuaaaaagaaaaaaauacauaugcaaaauagcaagaaaauuaaaugcacuaauuauacauuaauuauaccugacacuuccaaaguguuucacaagcuaugucugccaacaggcaaaagguagauaaggcaaacaguguggcuaggccuucaagagcaccagcguucagccacgucacucauggcaggagggccaagacuaaacuccaguucucagguccuaaucuccaugcucuccugcuucugaugauguacagcucuuccgaacacgcuacuuuauucugacuggcuccuuucuauaguuuuccuuugagauuuuauguaugaaaacuccagacaucacaccgacacccagaauacaaucaaucccuagcucccaugaccaugacaacuagcaacacugcugugacugacucuguucaagagucaaucccuccaaacuuuucugaaaaaaugucaaggggcaccuucguaaggaaugguguuucaauuguaaaacaaucucucuccagauuuauaaaugucauacuucuuauaaacauucacucugaucagagcaguaacuucacguggguaucuacacauccaauuaccucaagccaauuuuaugggaagaaaagaaauugaagaugcuuacaucuggcccgggcugacugauccagaacuugggcuaagauacuguuucucauuucugcuucccuacaaggaaacauaggucacacaagguuagaacuaagcugucagcaucugaaugcacaaaacauuuauucaaugucucuuuaaaaaaucuuuacauuuauucauucauuuauuuauuggaguuuggggugggcacaccacagugcacaucugaaggucacagaacaauuuuugggagucaguucuuuccuuucacuauguggguccugaagcuugaccucagaucaugaggcuugguggcaaaugcuccccccugagccauccagcgagccaccgugagaccccucuaguuccgacugcauggugccaggugcuucugccuuccaggagccagcuguggauguaaacuacgagaauggcaggacacuauuucaugaggugguaguccagggcagcaaccaucaccaacaguaaguauccagugugacacgugcuacgggccugaguggagccucggcaguuagacagacaaguggacuuucuuuagggaggacgcagagacuuauggagauucugaaacacuguggcaggggcagaaccagauccugugaaauuguaacucugcaagcaucgcuucuuccugaauacucaaguaggaacuguggcacacugcuuucaaaccuuuuuggaggcaggauuuagcuauggagcucaagcaggcucagaauucacuauguagccaagguuggccucaaauucuucaacuuccuuccucagccuccugaguggaaggaccacuggauuguaccacuacucuaaguaggagacuuaaaacaucucucugaggaacacacuacacaaaagacaguagcagauacggucuggcagaauuaagggacggcuggggcugguuaugccuauuaucaagggcucauagaaccagacuuaauuuauuuccuuaggccaccuucucaagaguuccugaaucuaagaugcuaugguccauaagacgcaccaaucuguuuaugccuuaucaguacuugaacccagggcucugcauaugcuagaaaaugcucgaccacugugcuacagccccagccuuuuuuuuuuuuuuucauauauauauauaaucacuuuaacacagggucuugcuaagcuauccaggcagaccuugaacuugagauccuucugucucugcuucccaagcagggagguuagaggcgugagccaccaccggcuuuaugcgcucaaagcauaaaagagacccuagaugaggaguccugauuagagagggaaaaccaaacaaccugcuuugagaauguggacuuccaacggguuaaccgugaagguugccaaagagaguggggagcaagggacuuagugcucagaucugaacacaccccaaacaacgggagaggcaaaagcagggugugaaguagucacgucaaaugcaugcuugaacuugagugaaagugcucugccacgcgcagggguaaaacagcagaguaaguuaguguccacggaccgcucacggggaggccuugggucuagaaucccuaugagguuauuuacuguugggcuuaggcagaacuucaaagugaggucuuacuggaacuccguggguauuuacugaaucagacuaaaaagggaauuaccuucaagcaggcuuaguagaaaaucacuagguucugagauucacuaagagucacggaccaauuccaacuacuaaauaaaagccaaaagcucaaucuaugaaaccacucuuccagaaaguucuaguuccagcccuaccuuugcuuugcuuccuguugggcugcaucaccaggauccugaaaaaaaaauaauuuuuaccuuuuaauggaguggaacuucaaaagaagagagaagaacacaugggucagggaaagguggggugaggcacauuugucaccauaguuagcacuuaggagacacaagaaucucaaguuaccggccagccugggcuauaaacagagaccguauucaaaauaaaguaaaauaccaaauaaaugaaaacaaaaauaaagggcuuauucgauauucuuucugcuauaauagguucccgagguggaaacuggaccucaccaaaaaaaaaaaaaaaaaaaaaaaaaaaaaaucaauaagucaguuuccauuugcaauguuguguucguuuuauuaaauaagggcugaggguggaacucagggaagagaggguguuguguaugcuagguaagcacuguggcccaggcuaacccccacucccagccccacauuucccaagcgucucaagucacaaucuaaaagaauguuugagaacgcacacauuccugaaaaggccccgguaucauggagcccuauuuuuaaccagugagaagacuggaaaaaagagacccuggcuuggcacgaaagaugcuggcucaaaggcucaaaugcuugccacugaggucacccaccaccacuagcguuugucccaaggcaaguuuacaacccgcuacucccuccuagccggcaccgcaggggcugagcaccaucucuggaguccgcgguucgacucccgcccggggaggcgcugucagagcggcguccuccgcaccagagcucagaggaucccccucuacacagcgcgggcuuccggucggcaagaccccccccaauccgaggacaccccaaucccggcgaggaucgccugaggcucgacggcagcgaaaaccgagacuuggggggugggguggggggugacucgaaggcgcgcacaccccaacccgcacaagccucacgcgggacccuacggcagccgaggaggcggcggugaccuccggggacacccccauccccgugggcacacacacguugccaugggguacgcggaagccggggucccacgagcaaacgccgagagccugugccuggggcgagggcgucaccucgcccgcccgcccgcucgcucacucacuccaugcuuggccugcaacucggccagccucugcuuccucagcgccucaaguucuucguccgccauggcgcggcugucccacgucgcgcaggcgcagcggccgucgggggucgcgcagccgcagccgcccuccgguacacucgguuggaaucgcuucggccggagacucgagcccggcgccuucgacugcgcagacgcgagugaugcucaggcaucaaaagucgagugccgaguuggggcugccgggccucggccagggugccuugcagaggaccgauccugcgaugggaaaaggggcagaaccucuaagagggcgcuuguggguucccaggcucugaacugcgcguuaacacgccccacccuaaugauuccuaggacuggcaauggcgcaguucugcaagguguaaacuccuuagucgacgcccugucugcuuuaccccaacccccaagggccuuugcugagaagaugcugugugugugagugugugugugaacuauggcaauacacacacacacacacacacacacacacacacccugauuuuggagugagggucccaguaagggauggaguggguggaaaaaaaaacugcucaauucuccaauccugugacuugcuuaugguauauguauuuuaauuuuuccaaauacaucuaaccauuuucauuauauauauauauggagguaagggaugagugagccugaggagacaaacauuggaccccuggaguuggaguuccaagcaacugugagucaccugauauuggguugagaaucgaauucuggugcucuggaagacuaauacacacuuuuaaccacugagccaucccucuagcccauauaccuacauccacccuguugagcaauggcuacucucuauaaauuuuucaucauuacaaacuggcacccacucacuaaauagaaauuauuuauuaucccugguucccauuacaaaacaauguucugucuguauaaaauugccuauucaagcacuauuuauuuauggcuggcauauuugaccaaucauauaccaccuucaaguuuuuuauccauguuguaccaugagacagaacuucauucuugauuggauuuggugggugugugccuuuaaagucggccaauccaggggcgucugaggcaggaggaucuggaauugaagaccagcuugccauuacauagugagacuuuggcuccaaccaaacaagcucuccccucccccauuucauuauuuccuggcugaacauauuuacuguacaaagcacauuagauguauucaucaguuuaaccuuguucacuuuuugcuuagugugaguaaagccacuaucaaugcauguguucaaaugccugccugcaauccugccuucaguuauuuuaaauauguaucuauggauggaauugcuguguuagggacuguggugguuugaaagaaaauggcccccagaggcucuuagggaguggcacaguuaggaggugugccuugucguaggugugucucgguuggaaggaaguguuuuucugggacucugagguuucaagugugcucacgccauaguguuacuuucccugcugcucgccuauugaugcagaacucucagcgaccucuccuguaccaugccugucugcacuacaccaugcucccugccacgaugaugauggacuaaacuucagaaccuauaagccagccccaaucaaaugccuuccuuuauaagagaugccgugaucauggggucucuucacagcaauagaaauccuaaaccagacaguugcuuuucuacuacugugauacaauaccaugaccaaggccauuaauaaaagaaagcuuuuaauuuggagcucacaguuccagagaauuagaguccgugaccaucaugguggggaguaugguaaugagcaggcaggcaugacagugcaacagcagcuaagaucucacgucuugagacaacuacuauuuugaaaauucagagcccuagugacacaccuccuccaaggccacaccccuccaaggccacaccccuccaaggccacaccuccuguaaggccacaccucuuccaaggccacaccuccuccaacaaagcuacagcuccuaaucuuucucaaaugccugugucaaccucuccauaguucuaauagcaucugaaacucaacauacccguaguuaacccuugacuucuucaucagcugucccuucuacuucuccuuacuuugguaaaugucaccguuuauuaacuaggucagaacacaagcaccuggaccugaggaaaugguuuagguaguaaaagugccugucaccuaaguguggugaccugcauuaauaucuccuccccucaaaagccuaucugaauacagccuagcaucccaacccuggggaggcagacccagacagucuguucaaagugccgcucuucagguucauuucaagacccugucucaaaaaauacagugaagaaugacugaggaagacauccaauuguuaaccucugaucuccaugugcacacauauccaaacacacaaguacagucuuguguggcagaugcucccuaggaagacacaauacacaugucuaucagcccagaaagggaaccauaaagacagaccaauauaagaguccaaccaaaaucuaaauuugugaaccauaggguuuuuacugagguucucaacaggagugggugugaggguuacuccuaagaguaagaaugacucaaagagcagacuuuuugaaaaguccaucccaccaugggcaguuguggcucaugaaagucgcagcccuggggcucccuccugucagcuguuuacuggagaacagcccuccagaaucccccaaauuuucauucucccagacaugaugcauuuguuuacuucuguagugguuggaaugagaaaugugcaccauugauggguguguuugaacacguggucccuaacugguagugcaguuuggggagguuauggaaccuuuaggggguucauccucgcuggaggaagugcaucagcagcaggggugggcuuuuaaaagccuuaucugcuuccugacuggacucuguuccacauuccuggcugaagaugcggucguuguguuucuuccuccagccaccuccugacaugccauuuuggacucuuccccuggaaccauaagccccgauaaacucuuccuuuuauaaguugcuuuggggcaugguauuuuaucaccgacaaaaaguagcggaggcaugcccugacucuccugagccuucccuuccagagggaguguuucaguucagaggccauugacauacagagcacauaggcuuguacauacgcaaacaggaaagaagaggagaaggaaggaaggaagagauggaaggaugcauuugguagaagcacaggugauacacagcuauuucauggccuccuuguguuggccacugaugucacugcuugcugcuuaugugacagcagugggccaguaaucccagcacccacaggggcaaugcuuacagcacucacuggucccucugucaugcuuaucucccagccuuuucccugggcaagccaucuucucugcuuaauuguccucaaguccccugcagcagagcccuggccaucuccugucagcagcagagggagccauacucuaccgaaagagacugaguucuucauuacgcuacaaagccgagaagacccguaacuguugcuuugugccacacaguauguccucacagacaaagcuuuaaucucccucauccgucuuuguagcuggauucuggguccagaggcauggauucacucugagaaagccucagccagcuuggugggugauuuggggcuucagcgcuauccuugcugcaugcuguguuguggauucucaccucccauccucaggguucacgccuucaugguugcuugccagcagugccuuagcuaugguguuuccgcugaucaguuaugucauggcuggcagcaugaaagucuccaacaaaggcagaaugcaagaggcgggccagcugggcagucuccgaccccagcagcuguagauggacgcuagauugcuugguugggacuucuuguagcuaggaagcuuccuggcagggcaguguguuaagcucuucccugaccucuuuacuucugguguuuuugcuguauaagcuuucaaacagagcaauggacucccgucccacaucaaacucagugugugagcaguugauuagugaugacagagccugagaucccaauugacaaacguuucuucaacaacacggccaucguuuggggacauggcaaguuugcuuguaggccacuacaguaaagccaaccacaugcucuccacccaacauguauaaaaguggugcuuacaggacuagagagaugguuuacugguuagcagcacucccugcucuuguagcagaccgaacggagguuugguucucaggaucucaggagucucacaaccuucuaaaacuccaguucuggggcauccaauaccacccucuguccucuggggggcgcccacaugcacauguacacacucaaguacauauaugcaaaauaauguaaagacaugcaaaacaguguaaaaauaauauuuuacauuuauggguagugcucugguuagguuuuguuuguuuguuuuacaagguugcuacaagccauuguccccuggaaagcaggucucucgauugagaaaaugcuuucaucagauuguccuguaggcaugucuaugggacacuuucuugauugaugauugaugagacagcccagcugacuguguguggcaucgccucucggcaggugguccugagcuguauaaggaagcaggcugagcaagccgcugggagcaaaccaaucaguagcgucccuuugucaucugcccuucaguuccugucucuagguuccugccuugaguuccugcccugacuucucucagugauuaacuguacaguagaagcuaaauaagcccguuccuuuggaauuacuuuuggccacgguguuuagcacagccacagaaaauuaguguuuacucuauuaugugguuuagaccacauuauaugaccaggcugggcaacccagaaagacauagauauguaaacauauaaauagacagguguggcaaugccugccuguaauccuagcacuuacauguccagggcaagaggaucaggaguuugaggucuggacugcauaucaagauccugucucaauuuaaaaucuaaaauaaugaaugcauguggagaaggaauuuagaauccuagcuagccccuauacaagacauagaagccagauauuuuuauuuauaagccauacgccucacuugggccaguuuggagcucuacuuauucuccagcuguaacaugcuugucacauguuguuucuccuggccacgugcucauggucuaucuccucucaugguggccgcccucuguggcugccgucugucuucuuucuucuucuccucccucuaccugcaacuucccccuauccccgccgccccacuugauccucaagucucaccucucucccuccacugcccaaucacaggcucuagccuuuuauugaccaguuaaauuggggagcaagguucacauagcaucacuugaugucggugaggaucugcuugcugggggcaaccagguacuuguugagaagccaguauuuaguauugaaauacaagcagcaucagaccaacccacuacaugcauggauggaugggcgaauggauggaugggcagauggauggauggauggauggauggauggauggauaaaugagcuauucuauauccacucaguguacgauggcauacucaguccucgggagcacaagugacaagcacucagaaucagcucuaagcaucaaggcucggucagcuccucugccacagcccugaccuuguuccauuugaccccccccccccaugauauuuaaaucucauaacucugaucuguccagaaagaaaucuuaaauuuaaggugauuuuuagaaaugcauuuaaccggucuaaugcccacacuuguuacaccagaaugaugagggaaauggaggcaggaauauccugaauuucaaggcuagccuagauuacaauguaagccaaggccagcuugagccacauagugagacccugcccucaaaagcccaaggggcagacagguagccugaugagagagcacuugccugacaggugcagggcuuggguuugguuccccaauguuggaaaaaaaaaaaaaaagcaaaaauugaacaaauacaagcuauugaucucaauuucacuuuguaaaucagagaaaauuacuauucagugugaggagauuucuuacaucuauguguucauucauaauuaaggcaacugugucacacaggaauguacgcauaugaauauauguauauacaugcacagcucucguaucaagauaaacgcgguggaaaaggaccaaaugcuuuuaccuauuauuuuuuugugaauuaaagucaucccucuuaucuugcaguuagcaccccaaaucaaaaguuauuaacaucaaugagucaaucagcaagcacauuuagagcgguggaaggggagaugugcuuguuauguuucuugaaaagauggacgcucaacaagcagauaguuccagaaaugcccccaauccccauucccuagugaaaucucccaggcuccacucacggacccaucuaccccuggaggagacugacugaggagaaacaaaauggaagaugugggcaggcgggcuaucgauaggggucuccuuccucagaaaccucccagaugagcaaggggcuggcuggcuuacucuucuucuuuccccuccucucuacagcccccagcccacucagccacccacagcagcagcguccccaguuuaccuuuugaggaagauugggugagaccuuugggucgccucagcugcuaaggagccccuggcuacgugauguaacaagggaaaucgauucucucacgguucugcuugcuuucuuccgagaccucucccccuuagcuuguagguggcaccuccucuguaucuacccaaauuccuggugcgcaccaaaggccaagcauacugguguugcaacagccaccgucucaauauaccaguuaaauaaugacgauuguagaccgucaguaaaguuaugcauucagaaaccagacuauuguaaacacaagggcuggaguuuaacaaggcuaugugaccugcgugacaucacuuacauguccucuuucuuuggacuuaugcucuuuaaccacccccucauuuuccauuuccguguauguguguguguguguguaugugugugugugugguauacaugugcaugcaugcuugcauacgaguguuugcuugugcaugugaaagcugaaugagacauuccacaucauccuccaucacccuuccgucuuagucacugaggcaggucucucaaucaaacccagagcucaccgauguggcuacccacuacggaggguagagcucgcuuugaggaauuuccugucuaccuucugaggcugcaauuauaggugggguacuacacccacccagcaucuaguagguucuggggaucccaacuccagaccucacaguugggcugcaagggcuucaagcccaagucaucucccggucccucaacacacauucuuuuccuaggaggacaaucaccuauggcugguuaaaacaaaagguaucgaauguuuuggagaauuagaagccccuccuuaguugauuuuggcuugaauuaauuguuuucuaaaauuaaaagcucugcgucugccucuauauccuuucauuuucauauaucauuuagaccuuuguuuguauucuugugguuagcuuacaauuuuuaguuuuucuucauaagaauaccaucgauuuuuuucccccaagagagugugcuuggaugaaaacauacaaacaaaaaaagucauuaucagaaauaaaaggcuuguguuauauacauauauauauaacacaagccuguguuuuauauguguuacauauauuauauuauauauuauauuauuauaauaauauuauauauauauaauauuauauuauuauauuauauauaacacaaguuuguguuuuauauauauacauauauaaaacauaguauauauacauauauaacacaagcuuuuuauuuuugauauuuuuauauauaguguaaucuaucaugagauuaugugauuaugaaauauuuggauaaaaagugggcauuucaguggucugcgcuuuagcuuucugcacugcgacaaaauaguugagagaaguagcuuauaggaggagaagcuaauuuugguccacggccucacucugugguuaucauuugucugccacuucagggugcccaugcugaagccaagcaucuuggugacaggugugugcuggguaccucauugugaccagggggagggggaaagcaagaggaagagucuggggaugagauacagcuccuggguccaagccuccaagaacccuccaaccuccagaguuuccaucguccccuauuaguccaugaaauuacggugcugucaguggacagauucacugacgaagucagagcccucaggauccaagccuguccccagaucccugcaucuucugguggcugcuccagagacugugccagucagacucugcugugacagaacaccggacgcaaacaacgugagugacaaaagagcccggauuuucagucguucaccgcagggagugcauggaggacugguuuuacucacgcaggcaggcaggauguagaacacagaggaacuagugagggaccgagacaagacaguguacccaagggcaugacccagggacuugcuuccucuagcagcccuggcugcuccugucccacuaucuccugcagagaaagucuuuggugcaguguaugugaagcaucaccggucaauaaaaagcugguggccuauucgcugaggcaggagauaggaggugagaguucuggcagggagaggggauucugggauagagccaggugaggcgaggauuugccccaaaugcugauggagacagucacacgaaacugaaggagaggugacuauccucauggcaggacuuagaauagacuauacgagagaggugaguuacaagcuagugggaaagaggcaaggcauauggccuaagcauuuacucacaaaucagacucagagucgcuacuuagugaacuuggccaugggugggaaagccugugguuaaggucuccuaacggucuucucauaaguagacuaaguuaccuaucaauucagagccuuuaugaccugaucauuguuuugguuuuuaauuauuuauuuuacauguguguaccugaguguaugcaugugccagguacaugcaauaaauguccucagagggcagaagauggugcugaaucccucggaacuggaguuccagguauccgagagcuaccgugugagugcugggaaucaaacuccagcccuccacaggagcagccagccuccugaccaccgugccaacucuccagcccuucuaguggacuucuuaacccaggcaaacaugcugucgagaccaaccguggcagagaggucagagagacaggcaucccgugucuugcccuacuucugugggaaucgugagauguccuaaaccucuugcuugugaaugaaguacuuuucaucaaaacacuagaguaaaacaacugcuaaaagcuacacuuuuaaaagauuuacugggguguguguguauguguguguguguguguauguguguguauauguguguguauguguguguauauauauguauguguauguauguguguguaugugugugcuugcauacaguucccuucugaggccagacaagggcaucauugucccugaaauuagaguuacaggcagcagcugugagcagccauguaggugcugggaccugaacccugguccucagaaacagcagcagauguguuuaaccacuaaguuaucuuucuggcccucaagcuaaauuuuuuaaucuuuuuucuaaaguguguuaggcaguaggaaaguuugaccuugcaccugccaagauuauuuaaaugucgagacacguaggaauucaagaaucaaugcucuguugggauguuuuucuaugacuaagguaagggccagacacaauaaugacaagaaauaaguuacaucauuugggguaauccaaaccccuagaagaucuugaccuacugugugcaucugaucacuaauuagaaaaacacguuccuaccuagacaccgcugaaauaagugagcugagagauguuaguuauguaaauuaaaaccaaaggcaucaaacuuugcauuucugauuacauauucaaaccauacaauuacagcauauaaaaucaauuuuuacuauagucauaaguagcaauuagacauugcauuuuaaaauucaaaugauguuuguauuagauggaauuccuccucuucccccagccuggggaaaacaucugacugggaaaugauccccugugguuccuuucuucauccgucccuaaaauagcagcuugugaccccuuucagugggagagagaugacacugacacccuuaaagaccguggagacagggucagggcuucauaguccucaaagauuugacaaccaaagaaaguggagagaaaaaaaacaagggcgaaugaugguagauguuuugaagguggugguggugaaggcuugcaacccauuguuaauuaauuaaggucgaaaucuaccauuguccagauagcccacugagcucagugcaaaauggaggauuuccuuuaccagcagggcuucuccuucucugaccucgucugaggggccccaaaccccuguacccuguagcuucagaaugucaccuggccuuggagagauuacagguucagcuuccuaucucuaaaaguacuuccccagcaaggacccgggauuccuggaaugucucuccgcacaaaugaggcauucacagaacuuuaaaacuccagccaacgauuuucauuuacccugaaacucuuucccaccucugcaaaguccauauagagccgugguucaccccgaauaaaguguguguguacaagcccaccccaaaaagaguugugcacacaaacuaagauccuucaagagagcuguuucauugaagaucaucagagaagccuuugccuacaagagcuguaacacuaagaucuuuggacaaggccuuccccuacccgucgccauuacucccagccagaccgggacccugcagaaccacauccauuccagacucugcuucauccguccagcccggugugcaguggcaucuggacacgcugagaggcagggaacggaaggugcggaaccacagcuagcacccccaaaaugcacaccacaauccacaaaaacccaacacccgaucaugguuucuaagcacaauucuuuccuaaaaggagccaaggcuacaucggaaugauggauuccaguguggagaaaaacagaaacuacauauauguguacaaaucaaacuugaacauacucaggauuaauggaaacauggugaaaggacuagcuuaacuugcuucucuuuuucuucuuuuucuuucuuucuuuugcgacaggguuucucuguguagacuuggcuguccuggaaccggguuagccucacacucagaucuccuugccucugccuccugagugcugggauuaaaggcaugagccaccauauccgucacgcuuaacuuucuauggggcaaaucugagcaacaagaaugauaucagucaugaaacauagccccccauagcucaugauacauagcccccacagcuccucacaaacaaugcuaauacaguaaaaagagagagagagagagagagagagagagagagagagagagagagagagagaaggauggaaaggaaagaaaaggaaaggaaagaaaagaaaagagaaaagaaaaaagaaaagaagagaaaaaagaaaagaaaagaaaagaaaagaaaagaaaagaaaagaaaagaaaagaaaagaaaagaaaagaaaagaagagguauuuuuuuaguuuugaaaagcuguguuucugugggcauguuucugagugcaguaccuauaguggccagaagagggcgacagaucccaggagcuggagcuacaggcuguugugagccaccccacaagggugcugggaaacugaauuuaggucccuugcaagugcagccaccacucuuagccacugagcuaucucucuccagcucaagaaauagcuuuuauuuuucguguaguugacuuaagcaaacuuuucuggcagacacuguaucaguuaccuuucuccucgggauucucgggaugacaggauuccugacugaagcaauggaaggagaaggcgagucuuggcucaugguuucaugaugcggaaagcaugguggccgggguagcuugaccuauggagacaugagcuuguagcagcuugccacauugcccuggaaaacaggacacaaagagcauuuggucuggaagugaggagagggaacccaacucccucaaguaggccguaucuccuaaggguuccaaauucccccaaacagcaucaccagccaggggaccaacuauuucaacacaugauccuccgggagagauuucauauuugagugugacaaaugcuaagucguuuucuguguuagucggcuucccagcacugauagaauacuagaggggggaaaagcugcuuuugacuugugguuuccauucauggucacuuggcugucuuguuuuuggaucuguggugagauagaccaucacgguggggagucgcaauggcgccuagcugcucagcucaugacagccaggaaggggagaaagaucaaaguuggggaggggagaccgcaggaacgagaucuauuuccgaagguuagaaccacaaugacccacauucccucgaaguccuucaacacccguguuccuaacaccuuccaacaguccguuaagcucugaggcuggagucuggaaagcuagcucgggcaguuaggagcgcaggggacuggaguucaguuuccagcacucacacuggaaggcucacaaccgccuguagcuucagcuccaggggacacgguauccucuucucuucuugccuccgugggcucuggggacuggagagauggcucaguggcuaagaacacugacugcucuuccagagguccugaguucaaaccccagcaagcacauggugguguaauggcauccaaugcccuauucugguguuucugaagacagcuacaguguacucauauaaaauuaaauauuaaaaaaaaaccacacacagacacagaauucaacaacaacaaugaugacaacaacaacuuuucagcugugaauccauccauaggcuaauccuuugggaugaccagagcucucaugauccaaucgcuucccccaaagucgaacuucugaacauugcugguugagaaacaaauguucagccucuggaaacauugaagacccugacuauaccagccauugacuaggguguuguaggacaggacguccauaucuguaucaccucaaaagacuuauucguuacacggaggggcaggggguccacagagacgcucagcgguugagagcacuggcugcucuuguggaaaacucagguuugacucucaguacccacauggcagcucacaaccauuuguaacuccaguuccgggguggggaacugaucuaaugucuucuucugaucucugaaguacaccaggcaggcaugugguacacaugcauacaugcaggcaaaacauucacauaaaauauuaaucuacgggcuggugagauggcucaguggguaagagcacccgacugcucuuccgaagguccagaguucaaaucccagcaaccacaugguggcucacaaccaucuguaacgagaucugauucccucuucuggagugucugaagacagcuacaauguacuuacauauaauaaauaaauaaaucuuuaaaaaaaaauauuaaucuaaaaaaagaaagaaagaaagaaagaaagggaagggaagggaagggaagggaagggaagggaagggaagggaagggaagggaagggaagggaagggaagagaagagaagagaagagaagagaagagaagagaagagaagagaagagaagagaagagaagagaagagaagagaagagaagagaagagaaaagaacuuucucuguggagagaucugccagagaccauuuuaaccaaaaguuccaauuuuauggccaaugaaggaguagcugacaccaugggucuccugacaaagggcucauuuccuguaaguaccaaagggccugucagaauccaaagacauagaacuuaaucuaacuguggggacucaacggaacaauccaaaucaaggggcugucuguaaaacagcaugcucagauucuaaaaaugucagcuucaagaaugcuuaaggcaggagggcaggcaugguggcacacaccuuugaucccagcacucaggaggcagaggcaggcagauuucugaguucgaggccagccuggucuacagagugaguuccaggacagccagggcuacaucgagaguaccugucucaaaacaaaagacaaggcuggaaggaugguucagugguuaggaguguacacuguucuugccaaagaccugaguucaguucccauagccaacugcuuguaauccccaguucccuggagucuggcacccucuucuggucucuguggcacugcacuaaugaacauggccacuccucccacaagaccuacacacacacacacacacacacacacaccaccaccaccaccaccaccaccaccauacacacuaauuaaaaauaaaucuuuaaaaaaaugaagaguguacuggcuggugucaauguaagcuagagucaucagagaagaaggggccuaaguugaggaaaugccuccgugagauuucagcuauaagacauuucucaauuuaugaucaaugggggaagugccuagccuguugugggcgaggccaucccugaucuggugguccuggguucuagcagaaagcaggcugagaaagccaggggaggcaagccagugagcagcagucuccauggccucugugucagcuucacccagacuuccuuuagugaugaacagugaucuggaccuguaagcugaauaaaccauuuucuccccaacuugccuuuuggucaugguguuucgccgcagcgacaaaaacucuaagacaaagaaugcaauguggggguuuaccacauccuuauuucaguauuucugaaggguuaaaucuaguucaaaugacagacaugaacccgggauucuauaggccacauggaaagugacaagcuaggcaaagcagaaccccacguacccuccuugagguuaacacccaugauggggugcgacuuugucgugaugcagcugaaggucaccuacgcuucuguaagugaccccuugccugugcuagcuaagaagcucaggaaacccauugauugcaacaacaacaacaacaacaacaacaacaacaacaacaacaacaugacuaaguaaguaguuagcuaaauaaauuucaaaugaaagguugaaaggaacaagcugguuaauuccuuauuacuuuacuuaucuaaacacguuagcuaagucuuuacaaaauaauggauuuauuuuuaauaaugaauuauuaaaugaaugugaaaucacuguaacacgccuugcuuuccuucaauuaacagcuaauugacuuucaugcauauuuaacuuuugaauaaaaauauguucauauggcuaaaaaugaaaaguucuauaaaauaaaaaaaaaauucccuggggcuggagagauguuucagcaguuacaagcacauuuuacucuugcagaucaagucccagaacuaacgccugugacucuagcuccagggaacacagagcccuuuucugacuucucuagguaccaggcauacacgugguacaaguauauacaugcagcugagacucucauauacacaaaauuaaauaauaaaucuaaagaucauuuuuaaggguccgagagacgguuuaccaguuaagagcacuggccgcucuuacagaagaugccgguucacuuccuguacccacauggcagcucacauuuguaacucuagucccagggcguccagcacccuguuuuggcgccuuugagcaccagcacacacauagugcauagacauauaugcaggcaaaacaccuauguacauaagaaaauuaaagucuuuuaagugaaugaagaggcugguguuauauaguucagugguaguugacugguugccuagcaacccaacauauacaagguccuagguucaauccccagcacuuaccacacacagauacacaaagcccccugccuagagagaaccguuugauuagagucacuugcccacugaccgaggagucugcuuuccacaggaagccgaugccaacauacuugucuugcugauagaacacuaaauuaagaaacuaagccuaaugucacuugccugagaacuuuguaagauuuuacaaaguucuacgaauccaaauuagcacgucucuguccaagggguaugaagaacuaaucugagucuaaugaccugauaauucaauacccggagcagggacccgagccacugccugcgcaggugaguuguagcggggccauuaauagacuccaucagccaggcccugauuccgaaggcuuagcaagaacaguucccaagaugacccuuagcgaugagaaggaucagcugucaucgucaugguagggccugcagagcaacuucugcuccgagcccugacugaaauccgcauucaacacucagauuucagggauucucaaagggagcugcuugggaagugagugacaaggacagugggaggggaggaggcccagagccugauuaacagccaccucccuucucugcacgccugacucccugagggaggcgacccacgagucuguuuggagucugaggggguggugggcugcuucaaacagggcaucaauacagcuucaggauaauuagcugccuaauugagugugucacuucaacugacgccguuuauguggagucuugucaugucuacagagccagguccacguauggaucaguuuacauauuuucucuuguguguuugugguucgugugcucucugggguguuugucuguugugucugggauugugugugugugugugugugugugugugugugugugcgugcgugugcgcgcacgcuguguaguggguuugucuguggugucuagugugcaguaugcaugugaugugugugcauguaugcacgugugcuugcauacccaugcacgaguguguggcagcagaggaggacaucagcugccuuccucuggcucucccuggacgucucuugaggcaagcucuccacuugagccugagcagcugaguucucagaaucugugcuuuuccauccugcuguacugugcuuacagaacgcacagcaugccucuuuuucuuuuuuuaagauuuauuuauuuuauguaugagugcccuaucugcauguacaccugugcaccaaaagagggcacaagaccccauuacagauggcugugagccaccaugugauggccggggauugaacucaggaccucuggaaagagcagacagugcucuuaacuguuuagccaucucuccagcccaauagaguuuuuuguuuuuguuuguuuguuuguuuuguuuuuguuuuacaagggugcuggggauuugaacucagaaccucgugccugugcacauuaggcaagcacucugucuuuaagcugcaucuucagucugccccccuuuccauaaggcccuaauccccuccccagaggucauguguuaaugauguucuaguuuccuucugaugguucccuaccucuuaaugucuucacuuugggggugcaggggugggaaucuagcauuucaacacaggacacagauauccaggccacagggggaaaauguauugauauauuuuuaauaugaucuuuaucaacauauuuugcucuuaucuccagcggggggggggggggagcuacugcuuuuuguagagugcuauuauauugaugccugaauacucaguuaaacauuuaugaagugcuuacugaauacacugauccaguauaguucuggguccuagguguuggcccacacuuucagaucuggguuuguucuccuuuuaagugagucuuggcuugaaaccucaaaccgucauggagugccaggaugggauaaauggggcuuggcucugugcagaaguccuuggagcucuagugagcauggugcauguugcuggcuucucucugugucucccacugaagagguggagucucccagcagcgaccccugcacagucuucugguugagaugucucagaaggaagaggcagccaagucagagcuuuaagacaaagaacacggaccuaauuuaucuaguaagccggguccgucucuguguuagucagcuuucccuuguguuaaaauaccuaauacaagcaacucagaggaggauguauuugaacucaugguucccaagguuucgugguugacugaaugcacagcuuugggccugagacgaguuaucacagagaaugugugugucucagagaauggcagcugggaagcagagggacagaggaccagaggccaggugucccuucaaaggcacacacauauccuucaaucaaggaauaucugccuucuaguuuccgcaacuuccuaaccaucaucuguuauuucauucuaugcacuuacccugagugugugugugugugcgcgcgugcgcguuuuaacagaguaucuuuuacuuauucuuugauaauuucauucauguaaaccauauauuugauuguguguauaccaaacuucucccuuacacuuccccaacuccccucaggagcccccaacuccucccuugcaccccaaugauuccuucuccccuucauauucuccucucucccuccucucucucucucuuucucucucucccucucucucucucucucucucucucucucucucucucucucucucucucucacacacacacacucuccccaucucucuuuccacuuaauucugucuguugagugauccugugcagagaacuagaugcugccgaguccaugggugcagugccagggccuguccugaagauggcauugcccagcccuccuccccauccuccagcccucacaucccucugccccuccuccuaugaugcucuucaaccugggagauagggguuggaaagucuggaaagaagacuccucccccucccccaacccccacaagccccugagguccaggaacaccacagccucgguaccauugggcccaaaaugcuucuccaucacaucaguccuugucgcugauccuuaaaucagcacaugcugcggucacccuggccaauacugugguccguggguugaagauaucaaagucaguaguguauaaagcacacaggaagauggagaaaggccaggcuugggaauuguaucacuucuuguuguugugauuguuugugggaagccacaugugccaucccaugcauaaccaauccgggugugagacacgccucuccuaggccuauauaagcagcgccagugcugggcuuggggucucuucgccucugcaaucaagcucucccaauaaauguguguggaaguauccuguugcagcggcguucuugcugggcacgugcaagaauuguugguuuuugagauagaggcuuaagcuugggcuccuccugucccagccucuuuaacacagguguuuaacaggaauucugugugcaucaccaaugccaacuccaugcguucaaguuugcugccgaaugccuccauguuuuacaaaaacaagcgugguagcauccugugacagcgaucccaccguucauccugucgugguuuucuguugcuauuucauauccgcacaguaaaacgguuagucugaacaguaacugcuagguuuuuacacaaggugcccugggggcuagagagcuggcucaguggcuaggagcaccucuugcagaggaccuggguucaguucccaggacccacaugacaguuugucacuccaauccaggagaucugaggccuuuuucuggccuucaagagcaccaggcacacacuugauucacguaaauauauggaggcaaacacgcaugcauagaaaacaagaauuaaagagaaaguaaggccuggagugcacacugcucuuccagaggaccugagugugggucccagcacccacaucagacagcucacaacagccuauaacuccagguccaggagaucugacaccuggccucugagggcaccacguggcacucaucugcuuauacauccacacagagacacaugcacacacauaaauaaaaacaaaucuuaaaaaaacaaaacaaaacaugucacaccaggcuggagauuuuucucugugguuaacaacgcuggaugcucuugcagaggacuuggguucaauucccagcacccacaugauggcucacaacccucugugaccucaguuccaggggaucugauguccuuuucugaauccacaggcaccaggcaugcacggggugcacauacauacaggcaggcaggcaaaacacucauacauauaaauaaucaaauaaacuaaucuaaaaaaauuaaaacguagaaucauguaucuuugcguguuugugauggaguguguuuugaaguauuuugacagcuggucauucuucccaugcaguucagacuggugccgccuguuggcccuucauccuggguuuugauugccgggcaaacuuguuuuccagagucucccugggucucacacgcccucagguaugaaagcgagaggugauguaaugggauugacgucuaaguccaggaucagcuugccugauggguuuuaauuggaaaagaguauucuacagaacggaaccgccgcucucugguaaaggcauuggcuuugaaagaguuaccaugacaaccucugucuuuagggaagcauuugaguuuuaugaaaacaaaggacuuggcuuuguaaguuggucaccauggaaguggcacagcaggcggacuucuccagcccccuuugcucccuccccgggguagggggugaagggugggggguagagaggacucuuguuuuucuucugagauuuggagacuccuuucaaucggauggccuucccccaccucccuguggcaucuuggacucagucacauccgucccuaaagaaagcaggcucucuguggcuggacucagccuuuuaacauauacacagugcuucuuagauacaggcuccaagucggggaagaaaaaguuugggcaucccaacacacucuugaucacaucucugcccagcaucccucucugcccauagcaaguugcuuguuccuugacugguccaccaacacugccagaacaaugaguuauucucuuaagggagaaaugauaucugcacuugcaagauucucacaagauuauguguggauuaaaaaucugaaaguggccuugcuggccuggcccgcaguggugcugcgcaugagagggcuggcuccgcccaucacaggcccaagcgaaggccagugcugaccaacucagcuaccaggcaggcccaggcuuugaguugguccacaucaauauguugagcugcuggaguucagaaggggccaguccugccgaucagaaaguugcaggaccucuaccacucaaggcaacgacaggauuugugagccgucucaguauugacagagaggguucagcagugaugauguagcagaaaccagaggccucgaaccagacgaaagacucauuccaaugaacauaugcaugcucagauauuuggguaaaaggguauauauacucugugacacucugaagcuuccaaagccacugaguuaccaauacgugacagagaggcgggaaacagaggaauggaauggaguguaccagacggaacugaaggagacacaggugugagaggagcagguccuuacccaauaggguuggcaggauggugugccacagccugaagcuucugcggacucagccccacccccacccccaaccccacccccgcccugaaacaagcugcccagccacauggucgcccagguucugaauagcaacaggaugcuggagaugagcaauguccauguacuggauuggacuuccucaaaagaucuccacggucuguuuuucucccggaggccaugcuggucuguggcuuguauuucaguagagaguccuguugaugcccaccagaguccaagcagagguccugaugcuggagaccacguggauguucaugguucaugcuguugccagaaaccagguagaagcccaggauccgugcucucacugacuguaaaggacaaggaagcuguuuugcagauaucgaugccugcuguagcucucaacagcugauggcuuccagggcgggggaugcagguagagaacucagcuuuccuuuggagcugaccauugggaguuugacagugcuccagugaguauauggaccacugaaaauggaguugucuuuuuguuuugucccccucccccuuucuucuuuuccuuuugaugguggucgaggaggucaaaggggaggagagaacauggaagggacuggagagugagccugaucgggguccaugaugugcggcucccaaauaaucaauaaaaauauuauguugaaaaaaauuugaaaagugacucagguagcagaagaaacuauuagugugucuccguguguguguguguguguguguguaugugugugugugcacacacacacauacacacacacacacacacacacacaguacccacaaagaccagaagagagcaucccauccccauuagaccuacugggaaccaggaacacucaacugcagagccaucucuugugcauuuuguuuuguuuuguuuuugagacaaaguuucucuguauggcccuggcuguccuagaacuugcucuguagaccaggcuggccucaaacucccagagauccacuugccucugccuuccaagugcugggacuguaggagugugccaccacuguccggcuuuuuuuuuuuuuuuuccgagacaggguuucucuguagagcacuggcuguccuggaacucacuuuguagaccaggcuggccucgaacucagaaauccaccugccucugcuuuauuuuuuuacuauucuauuuuaugggcuggauauucaacacccucuucuggccucugugaguacuacacacugcacacauacauacaggcaagcacuccuauaaauaaauaaaaauauauagcccccccccacacccauaacaucuuaaaaucuacucuguuuucucuucuuuaguuuugucuccauucauugcauuuauuuuucauuuggcuuuacuguaugggcuuugugacuuuuugaugaaugaaaaagucacuuauuuuucuugcaugccaaugaaugcggcucuccuugcuguuggcuggucucugucaucccccccccccaacaccuaaggauccugggacgaugauuuggguuauuuuaaaaggagucuugaaguuccagguuuggaauuuuuaaaaauuaaccucucccaggagauuuuuagcuuuacuccguccggcacaugcugugguggaauuagacauucuccaccuguggggaguccauuguuuccaggauugaguugauuaugcguuaaguaggaaaaguugcgugggcccggcagucagcugcuauacaauagcucgcuuguuuucccacgugaaccuaucacaaauggagaccugugugccgaaggaugucacugugauuuucccuucagacacucauuccucgguuucuucuguuuugcuuaaugugguuuagcuuugguaacuuaugcucguucauucguucauucauucauucauucauucacucauucaugugucugccuugcuccagucaccauacuugguccggugacagaauggugaccagagccacuacagucccuguguccacagagcuucugggaagagacgugaccuaaccucaccugacccgagccucacauuucauggucacucagcuacacugccacucacucccccucagacacacccauccaugcccucacacccacucucagacacacaaugcccuuuugccuauaagaugcaguacuaugaaaggaauuaggaaaggcauggacaaaauugccaccacuucugccuucuccaaagauugccugauuuuauagucugugacggugagaggccagauccuuuaaguucagaccccguuuuagagaagcugaccuaaguuugaauucagguagacuaacaggcugguaccuagcauuaguuuccaagucauaccccaacaaaacccgagccuagcuccagucucagacuaauccccagcaagaccaacgucuccagguuacacccccaacaaaccugcaccccagguuacaagcccaccacucccugccuaacaccaccaaugcagagaggagcagaaguuuaugauaugacucccagcaccagccaauuauguuaaaggccacagcagcuuuccaauuggaugcuugcacacuuacccuccugcuugcugcucacuauaaagccuugccccgauagacauucggggcucccccaccaccaaaaccauccugcgugacugcagugcuuuggaggggcuggagcuagcuugaauaaagacccuucugugaguugcaccagaguggcuccugucuguuuuggggguccaauccuuccuuggcacuacagugguuauuguaaaauauccagaagauggaaccaccugggagauaggcgugucaggggugggguguuaacagggacuguggacuggcuaggaagggaauccacuacuuguccaucucuuucuguuugcuggcugugggugcacugugagccaccaggugggugcuagggacagaccccaggucaccugccagagcaacaagugcucuuagcuccacuucuccagcccaguauaugcuguguucugaucaaacgccuccccuccgcuccucagcacuuucuccucccaaccucauauccucuuuuucuaauuuuuagcuuaauuuaauccccacggaguccaaauggugcugccuauaaagcccacacauaauaguucucuggaaaaacuuagaacuagguguggugguucacacuguaaccccaaugucucccguguauauauguuucugugugugugugugugugugcucguguguacuauauauguuuaugugugcauguguguuugugugguauguguaugugauauguguaugguguauauguuugugguguguguguguggucuggguauggcaugugugugaugcaugaguguguauguguaagcacauacuuauguguguggugaguguauauguauguguaugauguguguaagguauguauaugguucauguguauguauagugugcauguacuguguauaauauuuauguaguauguguauguuuuguguaugguguguuuggugcauuguguguguguguguauauauagugugugugaacauacuuauauguguggugagugcauauguaucugugugguguguauaagauauguguaugauucauguguauguagagugugcauguacauaugugguaugugguguguguguguguguguguguguugugucuacccaggaagucucucauaagcauauagcagccgucaggcauuucccuccugcauggcuucugcaggcccuggcgucugaucugaccuucgggacacugucugugugcacuugaaggacacagacucggcucucccugccugccaccucccagccucaccuugcagucaauggacugaaagcuuuggaaaaggguacuuagagagugggggggaacucucuucaagguuucccauucugcuuaauuuuaacaaauagaauauauaucagcuaaugaauauuucagucuuucacguaugaaccgagaauguaauuauggauuugauuuugccgacuguugcugccugcgguagucagagaucacaaaucgcauuaaaugaaaggugaaccccauuacaguaucaggaaaauggagcuuaauaaguuuuauaauuaugggguaaaucuaugcaaauugccauuuuuuaucaggcaauuuuccaucuucuucuccgugcuaauaguccauuagacuuguggcagcagagccuguggaaugggagcacuccagauuuucucuggguuguucuuuguaauaaagacacggugcugggguggaacagucaugggccgguuugacuucuuauucucaagcuccuuuccuuuccuuuccuuuccuuuccuuuccuuuccuuuccuuuccuuuccuuuccuuuccucuccucuccucuccucuccucuccucuccucuccucuccucuccucuccucuccucuccucuccucuccucuccucuccucuccucuccucuccucuccucuccucuccuuuuauuuccuuuccuuuucuuuucuuuucuuuucuuucuuuuuuuuuuuuuaagacagggguucucuguguagcccuggcuguccuggacucacuuuguagaccaggcugcccucaaacucagaaauccaccugccucugccucccgagugcugggacuaaaaggugugugccaccaccgcccagccauuuucaugcuuuuuaaaaauaauaagauuugaaucugguguaagccauucagguaagacucuagagccaguuuauacuaucuuauuuauauagagaauaggagaagccagguucaaaggguuguuuuguuuaaaagagggucucacugcgcagcccaggcuugccugggguuuguuagguaaaccaggcuggccuugaacucacaaagaucugccugccccaacucccaagugcuaggauuaaaggcuugcaucuuaguuaggguuucuagugcuacaaugaaacaccgugaccaaaaguugggcaggacaggguuuauugggcuuacacuaccacaccacaguccauccuugaagcaagucaggacaggaacucaaacagggcaggaaccuggaggcaggagcagagcccacggagggguacugcuuacuggcuugcuccucauggcuuucuuauagaauucaggaccaccaucccagggauggcaccacccacaaugggcugggccucccuucauaaaucacuaauuaaaaaaaacuaaggcuugccucuagccugauuuuauggagacauugucuaauugguguucccacuuucagauggcacagcaugggccaccacaccuggcuuugucauuuauuguucugagauaggauuucacccucuagccccaggcuagaguggaaaucgcuggaauccuugugccucagccuccuaagagcaagaauuacaaauguguaguuuggcuaaagucaucaauuuuguagugauucuuuuugaaaguuuuuuuuuuuuuuaaauuauugggagagcagguaaugugcaaagugagugcaguaccaauaagaggccagaagauuccccaggaacuggagucauaggcagcuaugcgcuguaugauguggaugcucuuaacugcuggcccuccucuccagccuugauuauuuuggggggauuguuuuaucaaauguuuucuuacucugcaccacuauucugaaguuuaaccauggugguuuguaaaaaaaaaugauuuuauaguuaaauauuuugcuugcaugcacauauaugaccacacauauaucuagugaccuuggaucucagaggaggcugucaggucccagacccccagaacuggaguuaaaggcaguugugagcagucaugugggggcugggaaucaagcacagauccucuggaagagcagccaaugcucuuaagugcugagccuucuuuagcauccugcaucagaaucuaagaacgugcugucucuuuucuuaaugagucuaccucugccucauacacacccaugcugaagcucuuuucuguaguucgaguuagggucccaguaggcaugugggugcaggccucuaaggugugagucccucaggcuucaguuggcaguaagggugccuccugcugcugccgacagaugccaggcaccaggcaugcagagaagacagccuguggacuccuuggauucucuggacacaugaaaagacauauggauccagaauugaggguucuggcuugagcaacaggguagauaagaaugcuguucacagagacacauguccuugcuagaauggcucagaauguaugucgaccuggagggugugaaaguaucuucacuuuggaaaugagaagggguuuuauggauauagguaggaaccuuggggcuugggacucagcauauaacucccguuuuagggaaauuugauucccuaaagguauaugcauccacauaggcaugcaggugcaugcucacggguacacauacccaugcacacacacacaugcacgcgcaugcacacacucacacaaaacuaaaaaaaaaaauguuuuagaaaauaucuugagaccuuucuagaugauucuaggaccuucuguaagaaaauauagaaaaaaauccaugacauauguaaaauucacauaaagauagaauaaagaauuggccgggcggugguggugcacgccuuuagucccagcacucaggaggcagaggcaggcggauuucugaguucaaggccagccuggucuacaaagugaguuccaggacagccagggggaaaaaaaaaaaagaauugaagcuauguaguagccuuaagcaagaaccacaggagauaagaaggugugaaguugggcuggaaagauggcucagcaguuaagagcacugacuguucuuccagagauccugaguucaauucucagcaaccacaugguggcucacaaccaucuguaaugggaucugaugcccucuucuaaugugucugaagauaguggcaguguacucagauacaugaaagacagaaagaaagaaagagagagagagagagagagaaagaaagaaagaaagaagaaagaacgaaagaaagaggaaagaaaggaaggaagaaagaaagagagagagagagaaagaaaaaaagagcaaaguuucuagaaauagaaaaaaaaauccggaccugugucaaagauucuacaaggucauugacuauuaggauuguggagaguuggaauauugcagauccagagccaaaugauuguggguugucuuuaaauacccuucauagucauuucucucccaccucugugucugaccuaauaucuuuugaacucuuggguaaaaucuuuuagaauguaccaacacgaucacuagcuuucacccacucgaaagcccagacuguggcgaacauucaucagacagcggcaucugauguacaagaaaauaaaaacagaacaagcaaagcuacaccugggugcuggaggggccauuggggcagcgaacugcugaauggaggggguggagucacuagaggaaggacggggaugagcccgcccccucuguguugaguggcaggcaccugcaucacugaagauggaucugcuucuucgcugaagugagaaaaguguuucaaaacaggcacacagaagaaaacaaacauugauauauguuuuagucacgugugggguagacacuucacagcaaaggguaaaagggggagcuacauaagccaaccuccauguuagaaagugucagaacuguguuaauaauagcaauaaauauuuauuagguguuuagucugcucagugcuguucuaaaagcuuuaaauuauuaacuaauuuaauccuuucaaaaaacuccacggcauaagacugcugacucaaucuauuuacagaggacgcauagacgaccugcccaagguugugcuucaggcuauugugggcuuuuccaccaaacuucucagaaggacauuaaaacauaauagaaaauggguuuggagagauggcccaguguuaagacgcauuuuaaccuugcagaggauuugagcucaguucccuguccacauguucaacaauggcauaaccuccucuaacuucaagggggaauccuaugcccccugcuggccuccaaagacacugcacucauauacaaauacacacacacacacacacacacacacacacacacacacacaggacuaaaaauacaaauagauuaaaaaaauaguagaaaacaaagaguacacuaacugaaugucuuccugccucauccucuguggugcugguauuuagacuugguuccuuccaccccuuguuguuacagcaauuucccagcuaccccauguacaguuuaccccauaacaacauccuccaccacagacgcacaucaucauggaagaggugacauggacaucauaagcuuccacgugcuccuucagucaggcucucucgugaugugacuuucuaugcaucaucgugacuagagacagaauguucccuguuucaaaaauccuccuuauugggccugugagauggcucacuacauaacagggcuugcugcccaggcugacaaucugaacuccaucucaagguagcucuagucucagagucuucuuugcagcuuagcuugguuuagucugaaagggacucucagcuuuuauugcuuaccuuggcaggaagaggccuagcacugaucaguuucagggacuuccuggcucuucugcguuggguuacuuccuggcuuuaggagcuucccugcaggauggaauauuucaaucucugaggaaauuguuacacaauaggcacacaugugaagucagaggaaaacuuggagcauguguucucuuccaugugggucccaggauugaaccccagugucguccccaguccccauugccaacgccagccuuuacccacugagcccuucuaauggguguguagugauagcuccuggcuguuuaauuuuaaaauuccugauuggaagucauuacuuuaauuacagacuugaguucaagucuuaccauaagaaaaucccaucuggcuaagguccaucagcaaucuucucacuucuuucuaagcuccccuuccccugccagggacagcagauuggguuguugacaaggggaggugcauggagugggaccaggaagugaguucagcagagaauuuacauaucacugaugaugucacauagugcuaugccaaagauacuggcacugucucccucacaucucaggggguucaacaagaaagaauaugcauggauucauuguauuagucaggguucucuagaggaacacacugauagaauauauuaaaagcggcuuuauggggggcuggagagauggcucagugguuaagagcacugacugcucuuccagagguccuguguucaauucccagcaaccacaugguggcucacaaccaucuauaaugggaucugauacucucuucuggugugucugaagagaauaucaggauacauaaaauaaauaaaucuuuaaaaaaaaaaguuuaugggucuggagagauggcucauuggcuaagagcacuggcugcucauccagagguccugggcucaauucacagcacccauguaaccacugacaacccuauucauaaccgucuguaacuccauguccagggaaccuggugccuucugggucagacggguucaaggcuuugggaguugcugucucuuuuccuuugcgaaauccacagccgcgaaagguuuccugucucuugguugaagucuucccuuccagaagacacaaacagaaaaacauccccugguaacaggaugccuugggggcacuugaacaaagcuuagcuucuacaacugacaaccacauggggauagggccaggaacccuggcacaccccaccucccugcacccaggaugugauuggcugggcuggggcagacacgugccucaucccaugaugugauuggcugagguggggccgacaacacgccucuccccaggaugugauuggcggagcuggggugaacacagcuguucucugcugcccaguccuggaggcugagcuaggaauuaaggugguaagacaaaguuuugcuucugaugccacagacucuuccuguuuuuuuuuuuuuuuuuuuuuaaaagauuuauuuauuuauuuauuuacuauauguaaguacacuguagcugucuucagagagucagaucucauaaugggugguugugagccaccaugugguugcugggauuugaacuucggaccuucgggagagcagucgggugcucuuacccacugagccaucucaccagcccgacucuuccuguuuuaaaaccaaauuuucauuuacuuucuuaaauuguggccuguuauuugcuauaagcaagagguuuuagaaauauuucccaggaaggcuugcuucacuucgcaggcccacacauuuacacauugauuguguaaacaagacucuaggaacucuucauaauggaugcacugucaacaauacaugggcuccuccccaaaugaacguccugguuaagugagccaaagacaaaauaugaauaauauaaaauuguaaacccacagguuccugcugugacccguguguguguguguguguguguguguggugugagacaagcucucagaguuauuuuacuucgauaaauccacaccugcuuaaggaauagaaauggguuuuuuuguuuguuuuguuuuucgagacaggguuucucuguguagcccuggcuguccuggaacucacuuuguagaccaggcuggccucgaacucagaaauccaccugucucugccucccaagugcugggauuaaauguuuuuuuuuuuguuuuuuuguuuuuuuuuuuuuaaagaaaacauacaaguggccaauaggggcugaagagauuagugguuaagaguggcuacuuuucuugcagaggacccaacguaaguagguuucuaacacucaaaucugauggcuuacaauagcauguaauuccagcucucucucucucucucucucucucucucucucucucucucucuccuccuccuccuccuccuccucucccccucccccucucccucgcccucacgcucucucucucucucucucucucucucacacacacacacaaaccuuaaaaauuuaaaacaucuuuagugggcuggacccucccacccaccugaccagucaucagucaucgaucaugaagaugcccuccacaucugccuccaggucaaucugacagaggcauuuucucacuugagguuucuucuuuuuaucuagguuugcaucaauuugacaaaagccaacuggcacagccacucugcccuagggguggaugggaaaaugguuuccuuuccuucuuugaacaaguuuuaaauggccgucuugacaucuuugcugacuuugacauuuggcaaucuuacaggccaucuccagugccugcauuuucucagccuaugggaugcgcauuccugggccuucucacgucuuauaauuuuuuaaaaauaaauacauccugucauuacuccugccaccguugcauauuuagagccugucggcuugagcgaccguauauuuuuagugggauuuucauaugcaugcaguccuucggaauguacaacucagccuguuugacaggcagcaggaagggcgaguucguuugucaggcaacacggucccuguucucacucuguugcuuucuuugggagaaacccauuggccccucccccaaucuuugucagaucaugaaaaauacuaguacauuuuuguagccacauuugagcaaucuuccuuauuuuucacaacuauuucaaacuuucaccauuucucauuuuuacuuuaaaaauuguuuugagagcuucauacaugaguacuauguucccaucacaccucccacuucucucccuauccaacucccuacucccuugcaaauccuuggcuucuauuauuguuauuauuauuauuccuaguacauguauuuguagacauauaucuguacacacaugcacaaguaaaaauaaaauaaggccaugcgugguggcacacgccuuuaaucccagcacucaggaagcagaggcaggcagauuucugaguucaaggccacccuggucuacagagugaguuccaggacagccagggcuacacagagaaaccuugucucgaaaauaaauaaguaaauaaguaaauaaauaaauaaauaaaaaguuuaaaaaauaaaacaggaagaaauccauauuccugaggaccugggcuuugcuccugucguaucgucacagagagaaugugguuagcugucugcucguaucagaucaaggcaaagaagucaacuacuagaaauaugacaucaauacuuuguggaauccaagaugaaccauggcugagacucacacguggguccauagcacaaguuucuucuucuucuugacucauggaaacuacagucuuucaugaauaaaaaucgaauaaagaauaaaaaauaagaacgauuuauguuuaugcaugucugucugccaugugugugcaggugccagaugaggccagaagagggcaccagaucccuggagcuggagagacaggcuguuugugugcuggccaauaucagugcugagaagguaacucugguccucugcaaaaaagugugcaccucuuagccaggaggcaucccugcaggcccucagccccacugcuacauuuuaguacuuguuucacugcaggguacaggcaacuuugucuucauggcaugcacgcaccagcacaagcucgacuccacaauucccaaugcuacuggagacuaauagggauucuauaagacacaggguuuucuguuguaguugcuuuguuuuugucugcuuuuuuguuuguuuguuuguuuuuuguuuuguuuuuuaacugcugggccuggaaaccaagcuuuguguaugcuaagcaaauggaaugagcccacuggaauucugaaacaaggucucacuauguuguacagguuggcuuggaccaaagucuuccuaccucagccaccucagcgcuggaauuacaggugagcacgccaggguugacucuguuuccaauuucuguugcuuguaguugguaagcauaccggguuuuuccuuuuguuuuauuuguuuuuugagacauugucuccccauguaguccucgcugaccuagaguucauuauauauagaucaggcuagcccagcacucagauccaccuaccucugcuucuggugggauucaaggugugugccaccacaaccaacagucuuugaaucuuguggucucuuagucucacacuuaucgacacagcagcuuuagaaaaucuugaugcagcauccaaggauguacgcucugaagagcgaggucagcaucacuaacuggcucaagaaaccugccuuuccuccaugcuuuuguuaacacuggggaaacauccacccaccucaguguggcaucuguggccuuaccacccugucucuuuccugccuccuuauucacaagucacugguaccaaacucuuucuuguucuggggguugaugauauccggcccaucaucccggaaacuucuucccucaucuugucacuugguggguuucaauugucaccucaaauguuuccugaagcaccaucucagaugcagaaucagcuggucccacagcacuucugcucuuuuaagcaucuggcuuuccuaccgcuauucuuacacaguguccgacucacugcuaugaugcuaagcucagcgagaauacggaauguauuugcacuguucacugaugagaacccuaaaccuacugggcacaaaccuaucaguugagcugauacacaccugggguccuagcaccuaggaggguaaggaugaaaggucaugaguuccagaccaaugugggcuacgcagagacccuguguccaaaaaaacggggcaaaacaaaaugcucuggaaaaaagaaagaaggaagagaaagacccauggaugaauuuaaucaacuggaacaucagauuaaauguuaucugaaggucugauaguuuacaugugcucaaaaucuguaaggauugggcuagguuuucuguaacagacugaguccccaagcugguacucuuccuuaaagggcaugguaauugauuuuuaauauuuacaguuccugggauggaauugagggcacaaacaaccagggcaaguguucuaccacugcgauacaccccagccccucacugggggauucuaggcaggggcucuaccacugagccacgcccccagccccacacugggggcuucuaggcaggggcucuacugcugagccacacccccaggcccucacuggggacugcucacaaagcagacuaccauacacagggcuuccccaaaaugggugcacugaccauuacccccaguucccaaaauaauacccuagccauggagggaggcccagugugagaucagguguuggaaaaggcgcacaucacugagcucuaaaugagcacagcuuauguaaauaaucuuaguagcaauaauaagggagauaauuguucacaggugucauuuccugggaaaaaaaauccaccuuuucuacugagagaaaaugcuaauaguuucauucaauuuaugagucuuaauuagcacacuucuguucuaauuauugugcggggccugaaaucacuuuccugcaccccuucccucucccacacagccacacucaaucagccacuucucuuccuuuaugaauaugcacuucugggcaugugcacacaucugcgcaugucaaucacccagcacgagugagggcggucugaaagaaagcugucagucuugucucuaucaauggccuguucccaguuuuuuuuucucuuccccuuucucuucuuguacuuuaacacacagacauaaaugugucuugacuuuauuuuuaaguuguauuuauuuuuauuuuauaugucugugcuucacuucugugccuggugccuucagagaggcugucggaugccuggaccccugugcgggcgcgugugcuugacuuaaugcgugcugugacggggcugcaagcgucccagcagucuccucccaucuugcuguaggaguccugggauuauagacgcacaccagugcucaugcccuuucuagauuugugacuguguaucugugugcauauaugcacuccaacccagguguccucagagucuagaagaggaaguuggagugguugugaguugccuuaugggugcuggaaauuaaguuuggguccucuguugagaacagccagugcucuuaaccacugagcugucucccagccccugcaucuggccuuuuagauggguucuagggaaucaaagcugugucuucaugcucgucugguaguauuuuuacacacugagccaucacauuggccaccauuuauauauauauauauauauacacacauauauauguauauauauauauacacacacauauacauauacacacacacacuccacacacucacacacacacacuccacacacucacacaugcacgcacacauuccacauacacacacacauuccacacacacacacacuccacacacucacacauacaugcacacauuccacacacucacacacauauuacacacacacacacuccacacacacauacacacauacuccacacacucacacacacacuccacacacucacacacacauacacacucacacacacacacuccacacacacacacacucacacacacacauacacacucacacacacucacacacacacacacacacuccacacacucacacacacacuccacacacucacacacacacacaguuaagagcucuggcuguuuuuccugaggagcaggguuugcuucccaucacccacaugaaugcucaauuccaggggaucugaucccacuucuacgggcaaccacagaguauaaaaacacacauguaggcacaacccccuuacacauaaaauacaucuuuaagaauguuuuuauacaacuagguauggugcuacagucccguagucgcagguuuuggaaggcugaagcagaagaaucccaaguuugaggauagcuugggcuacaaagccagauaugggggaggggagggaggagaggaggggaggggagaggacagagagaggggaagcagacugacggauggagggacgcagggagagggagggggagagaaagagagcgagcgcgagagagcaugcguaacagaacaggacuuauuagcagagaucucuaccuccuccaauuugaccuucaaagcaacagaggacaccacagauuauugaaaagagcuuuaucuaguauauaaucuccaccuaauucaguacaacaaauuauaaaugcucuuuguaagguuuuccccaacagaugccacaaacaggcaaugccccuaccugauaacagaccagcucucuaccucucugagccaccugcccagcuuccagcuuagauguuagaggugggaugggcacauagauacuuguaugaaggaauuuaagcucacucaucuucauuuuaaucccuccaguaccuaauaauuuuucugaucaaauuuuuauuuaaaaguaaaggacuuccuuuuauuuuucauuauuugucuguauacgacgaaggcauugggugggucccuuggagccagagcuauaggcaguugugagcugacagacgugggugcugagacccaagcuauacaagugauauacacacugaaccaucucugcagacaugaucaaguuaaauuuaaaagcaauuuugaugagcaacccaccuuguaaagcauuugauuucaauuucugcauaauuaucucuuuuucugucugucugcugaagugcuaggaacaccaggcaaacauuauacucucaagccacacccuuggcccuuuugugguuggggcucuaaacucacaaucagcagcagaaggugcacccagacaucugaggugggcuaccacugacuggagcucgguaucaggaguggaaacacaaggcaguggccggccaccugcgggacugcagcaggcggcucccaagagggcuggagacucgaggcuccguggacucagaaguggaguuaauuaagagcacuucuguuguacuuggagguucuucugggaacucagaagcagagccucgagcuuguucuauccagagucacagcugaacacuauuaccaacaguccccagggcccgcacugcagaaagugagggcuacaggcacuggcuccugcuugcacagugugggggcuguggccaaggguggaucuguuuuccuccuguguguucaaagacaaggucauaagcuagacuccucaccacagcuaaaacgaucaaauguuauuugcugaaagaucugguucccgagagcgucgggagccauuugucugcuucugggaaagucggccugccaggcagagucagggcaggucggcgucugcuggcagguuuccuggccugggaagaggggcugaacguucuguuaaauuuauagaaaggagcagggaggcuuccugaugggaacaaaccuagcauaugaccuuguuucccaccgcgcuguaaagcauaaaaagaccaagaaccguaaacucaagucugacgugguagugaucugcagccuucccaauucuaacuccugucucugagucuucuuuccggcuuucccaggaucauccucacucccuccucagaggacuguuccacuucccaccggcagguggcgcucaaacagggacgcucugagaguuuggggaucaagugguggacaccccagaaaaagcaagugcucagaaaaggcgaaugugcggugagacucucucaggagcaaagacaggauggaguagauaagggcgcucaggaaaaguaaaggaacucgaaaaaagugaaaacacaagaaaaaagaaacaaaaaugggaaauggaaacggcccuaugcuuucuauacaaaugcuuaagaaacugcuccacacucguggggcuaaagaagggcaacggcaaccaccugacuucuuagcuuuugugggggggggguuguccuugguuuccugaggaagguacaguaaaucuagcuguggcuccguguaucagguuauuuuggguuuguacuagaauccacguguaagacacuaagggaccaugcccucauuugguucugauugguaaauaaaguuuccggcagccaauggcugggcaggauagacagaggcgggaccuuuaggauucccgggugagggacugagggaaaggaaggagauccgcaauggcaggagaggugggggagggaagcugccgugccugagagggugcagggcagagagcauagcggccaucggggagagcggcccuaugaggguugccuuacagcagcaaagauggaauauaggauuuaguaagaaauaacuugggaauaucagagggagguggaugagccauguggagcuuaggaaguggccuagucauugaucuguuuuaggcauuaccaaaacauaaaggcugugccugucuuucauuugggaacccagaacauuuggggcaggcauugaggaggcaccgccgcugggaucaaaaauggguuacagggaagcagcacccauccaggaugcucuggcaaagccaaggugccugcucuugcagucuggccucugaauacugaagcagugucugagccaccaugcccggaggaggagacgaugauaacgacugagcagcuggaagaggaagcggcuaaauaucauagggaggagaauucuuugccacuuauugccucugaagaacucaagauuccuuucaaggacaaguuaguuacagagaaaauccaacagcugcaaaaugcuuuuacuuugcugucugugcaagugcagaaauuacaggcuugccaagcucaaggggaaaucuugggaccaucagaguggauuccuaagcugagagccaguaaaaccccaugugucgaagcuggacuggacccuccuucugagguggaguugcagcacuggugagaaagccaucugacccugaaagaggcuaccagaagaagagcugauguccagagauuucagucuauauuaucaguuauagaacaagguaauggagucagaguuuaucagccucuuccguuuaaacaguuaaaggaauuaaaaacugcuugugcacaguaugggcacagucccauuuacgcaggcuacgcguaaaugguccaccgaggcccucccuccuggggauugguaacaacuggcaagggugugcuuguuugccggaguagauuuuuuauuauggaaaucagaauuugcugagcagugucaaaacacugcugagaucaaucaagcacagccgauagguuucagaugcuagcaggagaggggcggggucaggagacugcucagcaguuacaguuugaugcagcuguuuaugcacagguuaauguugcagcagagaaagucugggauacgcuaccuucuacagggaggcagacugaggauuuauguaaaguuaggcagggucuagaggaguaguuucaagacuuuguggccagguugcugcagacaguaagcagagcuauggggaauacugaagcaguauuuuauaagauggauagagucuaauuauuuuaaucaacuauuuaaauaauuuuuuaaauauauaauuuauuuuuaaagaaaaaaauuugcucuaacaauguccuguacauaucacagugucucggggagagcgccuguggggaagacugguuuuuggcacuucucaucgugguuuggcagcaauggugcgguggagacggagcacuaacuagcauggauguuaccacaguaaggaugugcauccaaguuuaaguccacggcucuuggaucacaagacaccaaacaccaagugauuagaugaaugcacgcaggaauguuuaacauaaaugcaaacucacccacaaaguaaccaucaccgggccccagugcucugugccaucccugugcuugcuuucccuuaaggguaaggcacuggcccagaacgcuccaccagugcgggcagccgcagcaggcacuacagccucauuaagccuuuagcacuggugaacauguuuccuuguguuguuagcccaaacugcaguggucucccacccuauuuagggguccagaggaggcaggauuccaaaguucuaagggcuuaauuuaauaaccuagcugucgaugucuuauuugagugaguuuuacauaaaacccccacacccgaugagacacuggaacacaguuuuggaugcuacuuaagcagcaaccacacugcggcgcggcccggcggggcucuccggccggugugcucguggggauuuauuacacuaacgcgcggggagaaaacauuuaaaucacuuccaaauggcaagagcgggagggaaaaguuaauuucauuagcucucuugauuuaauuaaguggacaaugugccuguaucagcagcuuuuacaugcccccaccauuagaaaugaauuauaaaagcaauuaucaaaaacuccgagcagguacaccaccucucucugcugcgugguggcacuuggucaccuuguagggagggacacgaugucuccagggcugagaaggaagacuggaggccagaagucaaagagcaugaaaugccacauagaacucuaggagucauggaacagcaucuaaaacagccucagacuuugcaaguuucuaggcucugaaaaaauauaaagguuaaaaacacaaaaaguuuaccaaguuuugcaaacccaguuaauugaaaugaguaagaagugaagcaaaacuauuuuacuugcaggagagauuaaaaagcaugaagggauuccccucaaagacuucuauuauaagcccugacacacuuugcuuucuugagacagggucucuuuacauagcccuggcuggcccagaacucacuauauagaccaggcuggccucgaccucgcagagauucaccugccccugccuucaagugcugggauuaaaagagugugucaccaugccggcccaguagcacccugacugcugugcccagaaucaaaacaaacacacacucuaaaugugugugacaucuuagagcaugaauggaauauuuaagguucaaagaccuaaaauaauuuguuucuucacacaugugaaagcaugguaaacuggaaauguuauaaaauuuuaacaagacaggacaauaaacuguuaaaaagccaccaagcggucucggugaagaaaugucagugacugaacugugcggccugucaacuacacucacucacagcuggcucagggucacugaaaaucacaaguauuucagaucucaaagaggcucucacuucccaggccacccagugggucacacauaauucccucaaugacaaaguuccuagccagccuugggcaggcacaccugugaggcuaagaacacucacagaaaagacagagacaggacagaaaaggcuaacguuagcaggaggcauuuccgaugauggcgggacaugccugcaggccgucugccaccccaguauucaagucccacuccugacgcgaacuccaccagcuguagaugcacugcaguuuuaagaacagcugugguuauuuguuucuggacagcuuguagacauggaaugucuuguucuggaauacucuagugaagugggcugcauaggagggcagguuccuuuuaaucucuucacagaagcgaggguggucugcaggucucaagucagggucacucucuccuggcccauccauuuc

SEQ ID NO: 3727 - RNA, 65623 nt, Mus musculus
ccuccccggcgcgccccuuccccgggcuguagacgccccccaggcccauccuugcagcgcgccgcacagagccgggaacagcuggguccuccuagucuucaccucgcuguagcccgugaagugggcgcgucccuaaggccugggugcucggggugcuucuuugccaacccgagccgccccugaggacugcugaggccgcaggucuguggcugggggucgggccgcgaggggacuggacgcgcagugucuacgggacacgugggcggggcgugggagggagcgucucagagcgggagcgagugucgcgagguuccccgggccggcuagcaccugguccucgcgugggcucgccaggugcgcaggggaguggcuccaggugcgggggaguggcgcgcguccuggucaguaguccaggaauugccuuagggucucuuugcuaaugucuggcagggcuuugaguccggcuggccggagcaacuuuuuguuuccuaguuggggaggcuguugccaugcagacgggaaauguaauuagcaccuggcauguuuguuaacuuucugcuuuaccaggcucaggguagauguaaggugggcccccuguauagcccuaacccgccgagggcuagcagggaggguauaacuccucaagaggggacaggauuccagcuguggcugcaagacuuugaaaagauuucuucucucccccccccccccccguuucuugugcuuuuugagcacacugcauuugagucuguguucagucugagcauuuuugaaugaaugaaucuuaacaaaagcauugugugguguuggcuuccucuguuguauuuagcaagagccuuuccguuagauaaacauagacuuugguaacuagagugcagguuggauuagcugccgaaacaaucgcgucuggcuacuccucaucuuuaauagauaauuaguaaaacgcuauucauuagucagaggaaccaggcaagauguucccgggggacugaagccagcuuacucaccaccaccacacccccgccucccccucauagcuuccaaacuagguaacugcucccgcagcuacacccacaguugcuccccagagagagcagccacccugacuggcacagccccgcacugucuuacugucuuugacauccaggcauaaagcuuagcagggauuuuuuuuuuuuuucaaagaacacaggugcuaaaauucagguaucagaaacaguguuucaguucuucaaaaucuggcugucacaaguuuacuaggaaucccucccacguggucaguucugugggaauaaaucagacccacuacuuucuguaggaacuguagaaaauaauguaaaacugugucacgcaacaaaucccacaguuaguguuacggaaucagggagggaaaacaucacaagggugcagcauccaagauggcuuccuggaagaaguccugggcaucuucacguggcucaccuguaucccuaccuguaucacucccucuuggcagugccugcuggaggaaaggugcuucgucaaugugguuuaguuaaacauuuguguuguaucuuuaaaggcugauuaagauuuguuugggagggucugcugagcaggggacagcaggcuaagacaggccauuuaagcacauaaggguguguuggguaaagugggugcugacauuuccauggggcauucaucuggauguuguuuguaggagugguuggaagaacaaugcguaugagucuuugacaucaugauguacauccggcaaagaaaagagacaaaacccauagaaguuucugaggauuuuccaucaccaaaagaagaugugaaguuggaaaagaaauugccaucugguaggugguuggaacuaaagcaguauuuuggauuacuuuuccuucugcguauuaacauaugucacgaucuaauaggguaaaaaaaaaaauuggugcgauguaugaaggacacuuguuccagcacccagaaauucugacuguacucugauuauauuggcuuuucagcuguaaucaguaaaacggcuuugaugagaagaaauccuugguaaguuauguguugauuaaauuacaguggcagugucauuagguccuuuagagagaugcucugccugcccuagccaacugucucuuucgacggguaccuugucuggugugcccugcgcgugugugcugccccuuccagguacccucaucuuggcuuagucucauuucacuaaagccuuugaaaaagagauuuaacauuuuguauucaggcaaauucuugaaguuaccucuuuuucuuuauuuaggcaguggguaggaagggaaggaaaaaagaacuuggugaauuguuuauauaauguugagcaguugcuagguaauuaaauguggccaaauuucuuuuagugagcauaaagaacuccacacccaucagccauuuucuguaugggacauaauuaauccuuuguaggccagugaauucuuagcagccagagcuaguagguagcagagaaagcuguuuaauaagauaaaaggucucucaguuggaaagcuggaccauuuggccaagcugaugaaaggcauauuagguaauuuggaguaguuucugauggugugcaguuaaaaucuauguuagauugugucuuuuuuuuuuuuuuaauuacauguauuuauuugccuuguauaugugguggcugaacagggcaugcaugugaggcucugaggacaacuagcaagagacuguucucucuucccaccuuguggguuaaagaaauucaacucgggucaucaggcugagcagcaagcauccccacucacuggcugccucgccagccccuggcuugguccuuguuucugaagauguauuuguguauuuuuacguguaugaguguucugccugcacaugcacuacaugugugucuggcguccccugaggucagaaguggguauuggcuucccuagaacuggaguuacaguugguucugagccaccauaugggugauaggaacugaacccggguccucugcaagagcaaugaauguucuuaacuccugagccauuguuccagcccccauuuuguuuuauuuuuuaauuuaaaaaacaaacaaaaaaaacaaccaacaacuuugaagauggcucauuuuaugaaaucacaucagaaaaaaaaaaaaaaaaaaagcaaccuugaaaauaaaagacaauuuuaaaaagaaggaaaaccugcuucggccaaccugcucauccagggaguagaugacgguauucaucuugcugcgugaauguuucgucugcacguggcuacccucaagcagccuuauaaagcgaagcaagagccaugcgcugcucuggagcacgcugcucuucccguuccuuguccugagcccuucauaaguacaccaacugcaugugccuggcugucagaaagaggaaggaacccucagaggucagaaaggggcaucagguucccuggaucugggguuacaguuuaagucacuauguuagguacugagaauggaaccuguguccucuguaacugcaauaagugcucuuaauuccugaaccauuucuccaacccccuagauguuagauuauuuaaauccaguccuguauuaguuaggguuuccauugcugugaugaaauacuaugagccaaaagugacuuggagaggaaaagguuuauucaacuuacacuuccacauugcucuuuaucaccaaaggaaggcagggcaggaacucaaauggggcgggaaccuggaggcaggagcugaugcggaggcuguggagggacgcugcuuacuggcuuguuccucguggcucgcucagccugcuuucuuacagcacccaggaccacacuuugcauagcccacaggcagucagugacuaggaaaauccacuacagccuugccugcagcccaccuuagggaggcaacaucucaacugaagucucccugcuucucagcagagucuagcuuguaucaaguugacauaaauacaagccagcacauuuccaaagcaguccuaagcuccaguuacauauaucccucugccguugugggucaugccugacaggugcucuaccacugagccacacccccagcucauguaucagccauuuuaaguuccauauuuaccaagaacuuugaaaauacagcucauucucuuuccagugguggggaauuugaguggauuuuaacagguuuucuucuguuggcuacaguuauuggccauuugucuccuuugcucauugguguuuuauauccuuacucuguuccuuacuagaauauucauccuuucugacauccuuaaaccuccuaccuuuguauuuuucuagugcgcaugucuucugauuuaugcucuaucguuucuguaacuuucauuuuuaauuacgcgucuguguguguugguguguagguuguacaaaugagcaccggacagaugagggcacccacuucccugcaccuggagucacaggugguugugagcugccugaagccagugcugggaaccaaaccccggucacugcaggaacagccagugagauuaacaguggagcugucucuaaguucuuaauuucguguuucauguguuucucuuuucuaaaagguugugccucuggaagguucuggaagauccugucauccgcaguuggcggaacuguggcucuuugcauuggacuucuuacauccguuuaccuggccacccugcaugagaacgauuugugguuuuccaauauuaagguauggggcaucucggaccguugugugaucaacucauuuguuuccccgguagcugaccacguagaugagugaccgagaccacacaguugaaccaugaggaccaacccagucucucauccuggcaugagaguacguaucuguaauccugggacucaggagguggaaauaggaagaucagacauucagaggucugccuggguuauacgagaccuuguccccucaaaggaaaaaauaauccaggaucuugaaagaguuugacucuaggguaaagacuuacguguucaucauuuaaaaauagcaucaggauuugucuaaucaaaugagggucucacuggcuaugauugugucuggauuuccccagcccuugagagaaagaggcagaaggguuguaaauugaauuugaggcuagccugggcuacuuaguaagacccugugugaaaaacauaaaaagcaaagugaagacuugaguucagcucucuagcacccauguaaagagccaggcagagugguguguucugacacuggugaguucugaagcugguguagugguugugaguccugcucuccagugcagugcagugcagugguaccaccacaugauggaguaggcaugagggcuggcagugcagugcagugggguaugauggaguaggcaugagggcugucagugcagugcagugguaccaccacaugauggaguaggcauaagggcuauuuuguuacuuuucguuuugauugcauguaccuguguacaaacugggcagagguagaaaguuuauuucuuagauuuauauuuuucugucuguugguugcaauaggcauaaagaaaagcagagacuauuggagcccgccuccccaucuggagcuucagaccuugcuauugcuguguguggauggcuuugaguggaaaagucauuauuuguuuagagugggggaccacaccgacucucgggacauuuuguuuucucucugucuuucucagaacuucuagaacuuccuggaauaguuucagggcuggucugugacuucacggaaugaaauaugcacauugccaggguuuuuugagccuucccauuuuccuuaagguuuaucuuauuauuuauauacagugugcacauagcuccggccugggagagaccagcgaagagcaucagauucccuggagcuagagcugguagugcugggaacugaacccugguccccuggcagagcagcaagugcacucagcugcugagccgucucuccagccugggguaaugcuuccuuaggaacgugaagaucuuuauuuugaauaaagacuaaaauaccucugugggacuauguagccaaagguaaacgcuaguagcagugugguaggaagacguguugaaagaaaucauggaauuaauuacuauuaauucauugaauccagcucucuaaaguuuaugaguggccuugcucacauccuuaaaaagccguacuccaucgagaugcuuggacacccuugacuuucccugggucagaguagucacagugcugcuuuuaagccagucugggucaagcgcccauuuugugagucacacugaacuaaauucuguggaggacgcggaaggaguaaccagggcuugggcuucgucuaagcgggguaaaugugggcuagacacccaccuugucaagcagacacugugccucaugguaagaugggacccuaccuccgugugauacucgaggaggauacaggcaaggcuccagagaguggcacuuauccugaacacguacguguccaggccaggaggcaggagacuugggugugguaguguggcagcagcaggacagcauggcuggagaacagauagggacaguguagccugagaguggaaacagcuggcaguggaggaccugugcuccugagagaaaauggacuggagcagugucucaggcugcggcaugcguggagaauggauugaggcgggccggguaaagccagagcccaccgcugaguaauccuguucagcggauuccaugagaccuagagauccaauuacggugcucaguaagcgauuaucuuccugccugggaauccagcaucggcgucacggaacuuaacuuugaugagggggacagaagcaggaagaacagucaaagcagaggaggagugacugggggccugcuugggggugugggggggagcugagccucaagggugagacuuggaaacaggaucugcuugauaaagaggaggagcagggaagcugcuccaaaaugggagcgaagcuggcaagcccagagccgggcagguggugcauggggccaggauucugugagcacagggacgguggaagggaguguaaaagagugagcauggccggaguguggcucacauugcccugagggacacgugcugcuguggaagagguuucaggaacuucugugucacaguccaaaagaaucauaaaucaaugcauuuuucaaaauacuuggguggggacgccaagugggugggugugcuguugauuuuuugacaacuugaagcaagcgcaaguuuuuucugggaagaagaaaccucaccugagaaaaaugccccuaucacacuggacuguaauugguuaaugauugacgugggaggguucaguccacuggggcagugccaucucugggcaggcugagcaagccauuaagcagcacccuccauggccucggccuucauuccuucccugaguuuccacccugacucccuucaugagggacuggguguagaaagcaaauaaacgguugccugcccgaguugcuuuagucacggugcuucaucucagcaggagaaagcaaacuaggaccuugaguggggggggguggggggugaaaaguggcucucacuucucccuugcuguggguguuacauguugucaggugacguucauuggaaugcugagagaagcuaguuguuagcuaagugaguacacaccgaagguuacacccacuagaugggucuccuaggucaguagagaggcuggggacaaauggcuucugagaccaaagauggcugugggucugcagccauucauguagaugugccgccuuuggggaacuugaguuugcacucccuuuguguagggguucagagcuuggcaggagguggagagaagaagguguagucagaguuuucuaggaaguuggccuggaaggacuuuuuuuuuuuuuuuucuaaauggaaggugacauuuuuauguuaaucagggcagaaagaucagugacaaccugauacauucugugagcagcuugguggcuggcuggauacaucagccauucucuguaacaaugccguuugcaguucuccaggacacaguuccuucucgccaccagugaggccaaaccucccagguugagaacuaguucuggccaaaacagcuauggcugcggacucuaguugcagcuagacacaguugcacacgccuuuauuccuagcacuuagguggcagaggcaggcuggccucugaauuccaagccagccacggugacacagagagaccuggucuacaaaacaaagaaaccaaaaagccaaacuccagucucaaguugaggagucccaggugacucucacuucugagcagcuggcuguaaauccugaggugcccuagccauucaggaugagcaguuggcuaggucgaauccuagaacuccuggacgugcuggacucgaagguggaacaaagauacaggcuagaaccagcugaagggagagaugcagggugguccagagcauucgaaucccaagcauccguugcccuuccuugugagcucagguggaagugcucuccuggcauggcaguguggcagugugagguuugaugccagcaggggcagcucauccaagcucuggauaaacaaguguuuuccuuaggguuacuauugcugggaugaaacacccugaggaaaagcaacuuggggcagaaagggucuaucucagcuuacacuuccaugucacagcgcauccuuaaaggaagccaggccaggaaccuggagguaggaacucaggcagucaguguccauggagggaugagugcuggcuacuggcguacucuccauggcuugcuuacucuccuugcuuuuauuugcccagggguggcucugcucagugaguugaucccucccacacugauaaagaaaauguaccaggcuuucccauaggcuagucugauggggaggggcgcuuccuagucaagguucuacuagacucuagcuggugucaagucaacauaaaaacuagcuggcgugagacucagucacuggccacgggcugaacauaguuugcagccuagagaggucagaguaauaugauaccguguggcucaaagcacuaaccuucuaguuacuggcaaggcugacugacauucugagucaccuuugcagaaaugagaggcccuuucugagucaccagccucgagcugucuuuuggggucacuuaggaacagaggacugagaacagccggguucuugauuucuggggccuagauguuauuuucaaggacaagguuucacuguguagcccaggcuggcucugaacucaugguucucuugucaccacaacccucccuccccccagcugacuuuugauacugaaggcucuuucaaaguagucgugcuaaagauagggaguugaggaagcuggauuuguggcuccgaaggcaggcacuccaucuguguuggaaaacggacauuuuccuauuaccagcuuguagcugugugggugagauuguuucagaaguguguaguagagugggaaaggaggagaagccugggccgucuuucugugccuccgauuccaucugggaagccacacacuggcauauucucuaccagguuucuuccacccaccacccccugucccguggaggcuacaacugagcucagaggcucacugacugcucucgcaaucucucucgcaaucucgcucuucuuuucaagacagggucucacuguguagcucuggcaggccuggaacucacucuguagaccaggcuagccucaaacucaaaaaucugccugccuuugccuccugagugcugagauuaaagguguaggccauuaauccuggcacuaagcuuauuuuuuuuuuuaaugaaaauacucagauuuuugaguacuuggaauuguuaauuauucaaagacuacagauucuuuguaagaucgacagcuuauacauuggguuuuuguuuuccaaaugauuugcugguuacguuuuacuugauuuuaagaugauaucucacuugguaguccaggcuagccuccaaguauugauccucaaccgucagcuuugagugcugggauuccagguaugugccaccaugccccuccucaguagggugugugugugcgcguguguguguguguguguguguguguguguguguguagugugugugguguguuuguuuccuuugaaacacagucucagugcccaacccuggguggcuugaugcuacagucugggugagaaaguugcaggcuaccacacacagaaggccaaguuggaguccuuuauuagcuggcagccaagaguggggucucuugccccaaagcucagggacagagcuuugcuaaaggcaaacaccgcagugacauugcugucagguguaggucaggggaacccggcagcauuuauuuuggcagaacacaugaguuguguuguuuuacacauugggcuguggucagggucauggaaaaucccaacguguuaccccagaacgcacgaucauucgggggugcuuagggcucagcagugccugagccauccaagauuggagucaggguaagcucaggacagaaugccgucaccucagucaccucauuggaacgcugagcauaacccaggcuuaccuugaaugugcgacagugugcuucagagcggucucgggaaugucuuugcaguguuaggauuugaacagcaggaaccuugaaacaccaacgugaagacugaagcaguauagaaagucccucuguacccucucccggccuugcuuauggcuagagucuacuugcuccuguccagccacuguaguuuacuuuccuugccgugaagcuucagauguugcagguuuaagaacacacauccuguguugagugucugcagugugcugguacuuuguuucuuuccuuuuuuccuuccuaaacaccuuggcuuuaaauuggccuuuaaguguagcaugcuuuuucuacuguccuuuaucauaaucaaaacaagccaaaagggcacagugccccacugcccuuaaagcccagcgcauuacuggggcuaaguaaauaagcuuguguuugaagcagggugaacccgugggguuucaggaagggaagggggauggacagguggcugcugagaggaucuguccggagcuggguuggaagaagcagcuuagcuuggcugaggggacaucgcuaguccuggcagguggggcacaggcagugcaguuuaauguuagcugucaguagagaaaggcuacguugccauuaugcuucuauuuauugagcauuuauuauguuuuauuuguuguuguuguuaugcacacuguacugugauggugaaacaggcuuugagaugaaacagugcuuaagacucacuacugcccauugguggccucuuuuuccauuaauugucacuaaaaacagggaagggcacagcaauugguuaucuaaccucaaacaaucauguaaacguacauacaaacauccauacguuauguugauagaagagguuguacuuauguuuaggaauacacauacacgcgcgcgcacacacacacaaacacacacacacuuugguuuuugacagggucucacuguguaaucccggcuggccuagaaguuuaguucagacuggccuugaacucacagagauccacuugucucugccuccugagugcuaggaucaaaggcaugcgccaccacacccagcuucaguacacauuacuuuuaucaaauguuuuuagagcuggcuggacucaggaugcugaggcagagcauuacugaguaaguuuaaagccagcgugggcaacuuaucaagauccuuucuaaauguaaacaaaguaaaaauaggccagagauguaguucagggguagaguauugcuuagacccuggguucagucucgaggcacacacauacacacacacacacacacacagagagagagagagagagagagagagcaugauaagggggaaaacagcugagugcuaaaggugaaagugugguuuaguggcagagcauuugacucaucugugcaugcccggguuucauuucccuucuacuuuucauccugcaugcauaugcauuuuuccuagcaaacccaauguccuacgcuuaauucaccauaucugacauuguaucacaugcuucucacacagacgguuacaccccuuuaccaagcuuggguuuauuagguuaaaaaaaacguaugccuauagaauugagcagacgugacgugaguauacuguuuacuucacucuuugacugugccccaauuuuggaguguuggauuguuucuaauugugucauuaaauucccaaaauuacuuacuuaacuucucacuuuaaaguggcaguaaaaacaugucacuugcuccucaucuugaaauugugucagaacaauuaaggaaauggagagagcuggauucucuuuccugcccucccuccaguucuuccuuauaaggcuugcacguagaaagcauccucuaccacacuacgcccagacucucugucucaggagccuaggaagaucguuagccagacuccaggaaaaucccgugaaggccagggaguguaaaacgugcugagcagagucucuccagcucagccuucaggagaagcuccugaguguagacaggcuugaugugcaggcauguccugagaggcaaagccacccauguccuaauggggacugugggaaugggcacaaagagccacagagcagucuuccugaaagugcuucugugacagaagggagcuaagcagcgugaaaggaguccuacgggucaugcggcgugugguagcacaguuugaauaacccuaucauugccaaucacuguucaguaaacugaggagaaaacuaaagacgucauucuuagagucucaccauauacccuggcuggccugagauucguuauguagaccacagaccuugaccuucucucugccuaugccucugcuuccugagugcugggauuaaaccaccagggcgggcuaagaagucacucuugaaaacaaccucuaucuuaaagccgcuuuugcugacugugucuuccaccucuauuccuaaagccuuuuuggaaggaacuguucaagaaagaauuagucagucauacucagaaugacuaauuacccaaaaggagcuagcagaagguugugcgaugauaccagaagagaaaagggaagaagaaaccagaaaacguuauagcaaacacaucaaaauugaacaaauaccucaggaauagccaggcacagugguacaggccuuuagcccuagcacucaggaggcuaaggcaggaggaggguagaguuuaaggccagccucaacuacacgaugaaacccugccucugaaauaaacuauuugcuaguuugaaagauagauucaaaacagccuuuuaaaaaaauauauauguuuaugaauaagaaugccugccuguauaugugugcaccaccugcaugcaguguccucagaggccagaagggggcaccagauccccuagaacuggaguuacuggugguugugagcucauguaggcacagauccucggcaagagcagcaagcacucuuacuuauugaaccaucucucuauccaacaucuguacuuuuuauaaagagauaagggccacaaagggaaaggauacaugagaaucccacagaaucuagaaaaaagaaaauaggaccaaaccagagucagcacccugcagaugggacugagaaaagcacaggaggaggaggaggaggaggaggaggaggaggaggaggaggaggaggaggaggaggaguuugacaggcuuguaaauggauacaguugagggaaauuaaucaaagauuggcagggagccagggaagacaaagaccagcgaacauggaacgccgggagccagccaaacaggagggaaaggugaagcagaacuguauuucccagagaacugaaggauaaaggggaauuugaguuuacaaacugaaagaacacagcuaauuccaaagaaaguuaaccagcaaaauuauuagcaggauguaacaccacaaaaaugugcugugguggaguggaccuguaaucugggcaauuaagaggaagaggcaggaggaugagagguucaaggucaucuugggcuacauaauggguuugaugcccagccaaggauacaugaaacccuguauguaugcaugcaugcaugcaugcauguguauauguguguaucuguacacacacauuaauucugagccacugagauggccugauguguggcagcacuuugggcauagccugacaaucugaguguguggggaggagagagccaacaugacagagguguucacuucaugcccaugaggugacacguguacaccacuauuguacgcacagaagaauacaaagugaagagcaguguaaguguaagacuuagcacugggguagagcuaagugacagaccgacuuuauaguacacacagccuccaguuucagagagcgagaagagggaagaggucaauugcaggacuuaauaaagaaaucuguuagccgugcgugguggcacaugccuuugaucccagcacuugggaggcagcggcccguggauuucugaguuugaguucaaggccagccuggucuacagagugaguuccaggacagccaccaggguuacacagagaaacccugucucgcaaaaccaaaaaaaaaaaagaaagaaagaaagaaaucucuugccauuacagaucacaugaccuaggaggagagucauagguuacucucaccucaaaauuuuucauaaucacgugugaaaauuggggaucaugauggaauugacuuugguaguacauauaccuguaaugccugcacucaaggcaaaggcaggagggucgugaguuugaagcuaaacuuggccuacaguagagacuuacauauuagucugccacaaaaaauuaauuacuuuuaaaugaugcuuauagaauaagcaauugacaugucaccuuacuucucucacccuauauaaaggcagugucuuagucacuguucuguugcugugaagagacaucacaaccaaggcaacucuuauaagagaaagcauucacuuccuccuacccuuuauaguuucugagguuuaguccauuaccaaggcagggagcauggcucuggaacaguagcuaccuccucaucugaaggccaagaaagagagagaguauagaccaggcaugggcuuuuggaaccuuaaagcccacuccuagugacacacuuccuccaacaaggccacauuuguuccaauccuucuaauccucucaaauaaugccacucccuggugguaagcauucagauacaugagccuaugaaggccuuucuuauucaaaccaccaaaggcauuauacaaacucuuuuuagccugggaaaugauuuucaagcucuguaagaaguugauaggaaauauuuaacccagacuguggacagauuuuuaaacagugacaaauguggggcauggcauugcaugccuuuaaccucaguacucagguggcagaagcagccaacagaagccagacuggucuacauagugaauuccaaaccagccaaggcuauuuagcuagacugcaucucaaaaacaaaacaagcuaacuaacuaaaaaacuagacuagaauagaauuuucuaaaugucagaaaugcugucaguguaacucacauuauuuacuauaggcccaaggauaccuaaugccacagcauaaacuguauuagauauauaacacgggcuuccauguguaauguuggguuguauaaugcaaugaccaaggaaugaugugauuacauaacacaugaaggggaaggagaaaaagaccaaggcaauggagacauccuggauucucuuuuauagcuagaucaaaacauaucuauaaaugugugucuauuucaaaacuaguaaguuggucugggacaggucucaguugauagaguugcuugcauagauaacauauaggaagcccuggguuuauccccaguuuccaaaaaaccauguuguggugcccacccgugaucucggcacugggaucagaguuuaagggcaucuucaauuacaucgagauugaaaccagccugaacucuuuaagagccugucucaaaaacaacaaccugauaaaucaauaaauagaucagugguaugguaauacaugccuggaauucuagcuccuaagaagugcagauaggagaauugagagaucuggguucaugaccaggguaggcuccauagugaagcugucucaaaauggaaagccccauagguguguuuauggaagaaaacuaccccaaagcacagaagggcacacacauggucauacuacucuggccacacuacucauugcagagcaucaguagauaguacagaaagguaaauaaauuguccugggucaucguaguuaagaaagucacccugaauaguucccaaguuaaaagcaggacacacacagagagagagagagagagagagagagagagagagagagagagagagagaaaacacaaagacacaaucacauaugcauucccaaaagcaggacacucgauacaugaacguaacgaugucauauauauccaacaaacuuuuuuuauuuuuuuuuaagcagggucucacuacuccuggguagccuggagcuuauaauguagaccaggcuguccucaaacucacuguuguguacuuccacauccaacuuccaaacuuauuucuaaauuaugaauuaugcauguagaugaguguaugcuuaugugugugcaugcacacaugagugcugugccccaagaggccagaagagggcauuggaucaccuggaacuguagugccagacaauugcgagccugcuggugugggugcuggaaacucaaccugggucagcuacaagugcagaaaguguucuggacugcgagccaaguguguguugguuuuguuugcagaaaaaaauagacuucacucucccaguaaaguaaacacucugguuccugcuucaggauaaugugacaguuuucucauugauuuauucauuccuuuaaauaauaaguuugagcuaacuaaauaugaaacucucuccuaucuguaauuuaccaguuuccaucccgucuccaccccacccacaacaucacucucucuucacuugcagccccgagaaucaaaccugggccuugucugcugcagacgugccugaaaguguuccuuagaguauuuguggaggagaggaaguggauguugaauguuuaaaaauuauaaaugaaaucuagaaaucagagguguguuucaaagcaguaugcagaguuuuauggcuuuaaauaguaugauauagaguaagacugaguaucuagaaaggaauggaguauuccuucaugggauuggaaaguaaagagucugccaaaaggacggauacagcuaaaaagcagauuaauaacuagaaaauaggaaaacacuuggugaaaaugacagccaucagugugaccucauccaccagugcacuaagauggaaguaaugggguaggaauacagaaacuacaaaccagaagccgauugugacaucacaagugccaugucuaugcaaauccauggucuaugaaaaaauggacuuuuuucuaggaaaaugggaauugccauguguugccccagaaaacaaauucuauaguuuuaguggggaauauuucaccauuuauuacccuaaaaauaucagacacuaggaauuuucuuugauuaugacaaguuuuuccugcacuaggggugggucuaagggcuuugcauauaagguaaaugaucuguuucuuagccacaccccuaccacucucuggaggauucuaggcagguguuuuagucuugaccuauagcuuuagcuguccagauucuuaaaaauaguaauaauaauaauaccacuguaggacacauuuuauaaagcugucacagugccaacaucaaaagugcaguugguuuucuugugcugcuaagaauacagugacugagaauacugaacuggucaacgccaaaccauugcuccuagggaaacauguuuaugcgugugugugcuuauguguguguguguguguguguguguguguguguguguguguaucacacauagauuauuaccuggaaucuugaaaccccauccuugucaaccauacauuauuuuaugaaggagaaguugagguucaaaagaauugagugaugugagugaugucaccgauucuccaugccccagcuggaguggaaguggacugaggacaagccugcacaccacaccuggcugguucacguguacacagccagugcugcuggccucccccuaccucugcuaagacccagcacucgacaguaggcacuuuaccuucgcucccuucugggggacacaugcaacaugcccuccuuucuuugagcucuugucucguuuuaauggccuguagucccuguuucucucuuaugguucuuucuggaacccuuuccagucaggcucaagugcauagcuuccccaugaaagcacucagugaaaugcccagugaucucaggaguugcuccugcugcugcaucugagcccuuggguccccuuaaggccacucacuccuugguuucuagccucuucuugaauaagaccccaggucucuucuguccacucucauuucuaaggucaacaugauugugguucccagugaaggccccacucaggauuccuccaaaugaagaccugaguaucagccccuuacuuguccaacuucugguguccaacgggcguuucaggugcagaggccaaagcccuggccugccuuggcuugcccuggccuguccuuguguuucccguaucuguaacucaaagcgucaugucugacuggcguaagccggaaggcauugaaggcucuugcucauucagacccuccauggacucccucagcaaaucccgcuucugagcacauacaauguccaaaagggugacugucucaaggcugugccuuuucucugccugugucacuacagcagacccuugaugcaagccuagcuuguuccccuauuuuuaaaauggguguaaacaguggcauucauuaugagaugugacaccugccugaccuuaaacuugucugcccaccucccgugaccucucuugucccugcucaucuccuucccacuucugcuuucaugacucugucccugcugaaaagcuagauccugcacaugaggaaaacauugucuccauccugucuugcucccuguccuucugguccccuuccucuaucccacauagccagcccuucugcgucugugugucauggguguucuauguuucgaucuucaugugagggaaugcauauacuguuguugaucuuuccaaaccugguuuauuucacccagugguccaguuggaccacucagaacucugcaguuuuguuuauuguuuuaaaaaaaaacuuuaaaaauauaaagcuaaguggcuggggagguaucucagugguuaaaaguacguaguucucuuccagaggaccugaguuugauuuccagugcccaugucaggcagcucacaaccagcuauaacuccagcucccugggaucugacacccucuucuggccacacugggcaucugcaccuuugugguguauacuauauguauuauauaagugugugugugguguguagccaagcaugguggugcaugucuguaauccuagcacgagguagaagcacaaagaucacuucagugauagccagccugggcuaccuagugagaucuucucucaaaauauaaauccccuuugcuuuccaagcuuaacgaauauaaaaacaaacuccuaacuccccucugcacacuccaccauuccaagcucuuaaguuacaggcccggagcccgccucaccuaugggacaaggagaugcgcccucugauacccaccuccugcccuucauaccugcuuccccuguacuucaucugcacucaggcugccacacccuccugguuguucuuccuggugcuccugugaggcuccguaucauugccuuucccucuggaauccacucagccaacagucaccuccagaucucugcccagacaccacuucaccagcauccacacgccauccuuuuuuugagacagggucacacucuacagaccugucuggccaggaacucacagagauccaucugccucagccuccacacccacgcccagaaauguuuuucagauugauuuauuuuaugcgugugaaguguuuuucugcauguguguauaugcaccaaguggugacaguggaaaucagaggacagguuuagauccccuggaacuggacuuagguugugagcugucaugugccuuuuccguuguuuucuauguacugauuuuguuguuuuggguccaggacuggauucuuagaccucuuguuuccacccguucaaagcguguauggcucucccagcuucucccuagucuguuuuucucgggcuucuguuucaccagcaucugcauagguuucauguugcaggauuuucguacuccuucaaagcaaggugucccuggaauaaaugggguuaauccgcagaugcugcugguggcuucugggcaggcccaguggagccgguagagccugcaagacuuaaccuucucaccagccugcuugucagcugucacgugucacagcuuuagucaacucgagggcaggaaucccuccauccuaacagauggaugggaauuuaaccagacaauaaaccauguacgugccauaaauauguuugccaagggcaugguucccagugcggggcucugcacagcugucuucccgugaacuccccgauucuuggugagaugauuuguuaacucugaaacagcauuucagagaguuaaugggucguuggcuucuccauucccagcagccuaauuaucgggagaugggagggaacaguuuuuaccaacaaaaguuauugaugugagauuuuuagaaaugaacuugcuguguuccugagcugagugccauuauccucaaagggccugaaaaccuuucgggcauugccagcaucacgcuugcgugcccucggguacagaucaucaacugugaacaguccucuuacucuccucuuuuaguacuuacaauguuauccaagcugcuacugagauguuuuuagggaugcagaucuuugaaaauacaguucacaaggcuggagagaugggucagagguuaagagcacuuacugcucuucuggaggaccugaguucaguucccagcaccuauacugucagcucauagcugccuggaacucuggcuuccauugcuccaacacccucugccggcucugcaggauugugcgugugaguguguaugcacacauccacacaaaugaacaagaaugcaguucaucugucuuucugcuugcuucuguuauuaucgucagacacauuuuuauucuuccaccaaauacugcuccccauuuaugcaaauuaaaauuagaaguauugguccacuuggcgcucugcagaggguaacuaccacugauguacguuuucauuggcgagauccaccagacaaaguauaaauugcuguagaacuggggaagcguuugaacgaggcagauguucucuuagcaugaagcagauguaaaaccugcgagugucugucuaauaaaggauagcauuugguucuagacagcuggugccaagauuaccaauuaaucauguuugaaugcguucuuuacuaauuagaucccucuuugguuuuuacuguucuggguauaguaaagagggggaagggcacgaagccuuccacucuuuauacuuugaauaaccccucuucuuuuauaagccuuuguuuucccccuuagagcucuauaggaaaugaagcccaaagcugugaaugacugagcuggcucccccccccccccccccccgugacuguagguucagaguuaggaugcucuguuaaaggcaguagcuagcacugugaacgcgcaaaggcagcuggagaaaagaggaguguaauuacacuuaaugugggcuuauuuuuguuuuauuuauuuauuuauugcauggacaaaagcuaguauuugcucaguuaacaucaauaggcagucuccaugguuauuugacugggugagaauuugaacugugcagaagcacaggauagcaguuuggucuuauguuaucaauaagucguguguuugcaaagauuaaagauggcccgguugguguaaugccuaggaaagguugccucuuucugcugugaaugauaagucaguaccacuguagaagccgagaaggagcacuuuccccaucguccuuugcaugaagcggggaugcugagguugauuugggacugguggcuucccauugguuuugucuuuguuuugccuuugugcuaucgugugcaagcuaggcugucuguacuucugggcugcaucuacggcgcucuuccuuguuguucuucauuugcuuuagagacaggguuucucugugcagcccuggcugaccuggaacucccuauguaggccaggcugagcucaaacucagagaucugccugcuucugccuccugagugcugagauugaaugcaugugcuaccaugugcagcacugccagccccuuuaaaacuuugauuuugauaugaagucucacucuguagcccaggcuggacuuuaugauucucccgucuccaccuggauaauggaaguauaggcuugagccaccgugccagcagacccugccuccuuguccuccucuuucucucucccuugccccuccuuccucucccccuuccuccuccacucccuucuucuucaugccucuuacuccucucuuuccuccucuucuuuuuuuuaaaagauuuauuuauuuauuuauuuauuuauuuauuuauuauaugugugcaccauagcugucuucagacacuccagaagagggcaucagauuuuuguuacggaugguugugagccaccaugugguugcuaggauuugaacucaggaccuuuagaagagcagucggcgcucuuaaccgcugagccauuucaccagcccuccuccucuucuuuaaugcuuuuuucuaugaaagaaaguucuguauauaaagcuuguacucacacgguccuagaaggaacaggaccagcuaauaguuugcuggagucaauaguuggauauuuuggcauuguuauaaaauuucuuuuaaguugugcuugugugugcaugugcauguaugcacauguguaucugugugugcaugcgcauggguguggguaugugguaucguggcacaucuguguaggucagcggaccucuugcaggaggccuuucucugcuucagccacgugggcucaggauggaacucagguagucaggcuugacugcaggcuaccugcucaaccgucucaacagcuugugccgagacacucuaguucuuaggaauaucuuuuuaaugauuuuuccacaagcacaugaguggguucuucauguuuuuauauuuuacagaaguuuuucaugugugugugugugugugugugugcacacgcacauucauaugugugcauguauggaccauauauuugccaagacagguguacagaggucagaggucagcuugugggaguuuguucucucuuucuaccaagugggucaugggauggaagucagguugucaggcuuggcagcaaacaccuuuaucaucugagcccacucacuggcccuaauucauagugcuuuaaaggagagaaaaaguaucuaaagggugggagaagaacacgaauuuucaggucggaagauaaauagcccaagugguucuuuuuuuuuuuuuuaaauguuguuuuaacuuuuauauguacaguuauaugccugcauguuuguaaguguagugggcaugcaguaccccagaaggaggcaucagauuccccggggcuggagcaacggaggguugugaguugccacgugcaugcuggggacugaacccauguccacuguaaggucaaccaccucucuagcccaugaaugguucuuuuaguaaaauguuuauuacucuuugcaaaccaaaaucacgcagguaggaaugagcagagacaagcugggaugaggauuuagcagcuuggcagcagaugugagcguuucugaacucucccggcugccugaggucuguggaguauggaucucuguguuagcgagcauauuacaccacuuuuuacacagugugacgucagcucgggggccuggcuuuuggaacacuggaguaaaggggucugugguggcagagaguauagcuuuuuaaaucauuuaugcuuuugaagauagaaguguguauggagucucuuuauugcugagccagucucucaaagcucagagagcugagaacucucaucgcuuagguccaguggugauuuguggauuucucuguaguuguaaguuguaugaaaccaugaacuuugaaauacaccuuaaaugaaacaaguucugucagguuuuaaaaaaauaaaacauuuuauggaaacgcaucuacaagaguagagagaaugaccuggcccaucccccaucgucagccuucuuuugguuguuuugaggcagggucucuccauagagucuccaggucagccuugaacucgugacccuccagucucacccuccagcuggcgggacugcaggcacuagccugcaugccucgcuauguuaagauuucugguaugugcagaguauccucucucuccuaagcucuguaguuccguaucuuguuucuauaguaacagugggcguuucaacaaaaguaggucaaguaaaccaagcaguucucacuuuguuucaggaaguagagcgagagaucucauucaggacggaauguggacuguacuauucuuacuacaagcagaugcugcaggcuccgacccuccugcaagguaaucccggcagcuacugaugugggcaugcugacuccucugcccugcuuccucauccucucccuuccccucuuugcaccugaugcauuguuacgcgugugugugugugugugugugugugugcgcgcacguguuuguuuuguuuugacacagagucuuuuuacaugguccuggcucucauggaacccaugguguagaccaggcugaccuuggauucagagauccacccgccucugccuccugagugcugguaucaccacacccggcucauaauuuuaaauguaugaaugucucaucuucguauaugucuguguaccacauguguuccuggugccuguggaggucagaagaagguguuggguucccuaagacugaguuacagaugguugugagcugccauguuggugcugggaaucagacuguacucacugagccaucucuugagcuuccggagcuucugguuuuauuuuaucagauuauaaucccuuucgugguaugugucuucucacuuuucaaagaggggaugggaauggggggcgcaaaggagacagguaaucugucccaagaaaccagagcaaugaaauucccagcgcuuccaguaccuuccacacacucaccauggggacaccucagaugccgugacccggcaucucuuguguguguuggcccucucuuccugagaguuuaucucaacaguuuuagccucugacucugccuucagcauucuggcuaauucugaaugaaugaaugaaugaaugaaugaaugaaugaaugaauaaauaaauaaauguauguauguauguguguauauauguauauguauauauauauugucaguaucaaagccacaguaucugguuuggcaagagucaggaucccugaaaauuucagguaaccucucgggaugcugagggcaaggguggcgcuguggagcugggucucugcccccucgcugcuggcgugggcgcaggucagggucucgagcaguaguuccucagaauguaccugugacagaagcguguucugacgagagucugccccguccugugagguagcucuuccucccugagccgucugugggcgugacacgggguaguuuuguuucuguaagucccagccuaugagccccugccacguggcaaaaacaacucugaugucacugacaguuggcccaggccuagugguccuguaaugaguaguuuugaagaagaaauucucucauaagaaaugcuuugacaaaucccauguguguauauaaugcuuuuggucacucucaccauccccauuacccacugucauuccccugcauccguuaagccuugcuucauucccagcaagguucccaccuaccuccaugugggguguguguguggggggggggguguuuuguuuuguuucauuuucuuugugacccacugaguucagacaugguugccagcauaaucauuuuuggguauuuacuggagccugggcaacuuugcagugguuauaccauuaaagggaaucaauccccugacuccacuaacauuauugccaauagcuucucaggggaugugcggggggcauucuaauuuucaguggucguuucuaguuuuuugagaugccuccaucuauccuaguucccacagcugcuguccugguuuauacucccaccgggagcuggcaacgguuccucuguccuagaaucgucuccagaacuuguugucauuuucuuucuugaugacggccauucugaccagcacgaaaugagaucucaaguuguuucaguuugcauuucccugauggcuaaugauggcuaacacuuuuuaaaauauuuaucagccauuucuguccuuucuuuugaaaacuguucaacaguucauuagcccauuuauugauuagcaguuuuauuuuuaugauguucaguuuuuacaguuuuuuuuaauguagccuagauauuaaucaccugugugagguguuagcuggcagagauuuucuccgguucuacagguguuuguguccacucugauugucccccugcugggcagaugcuuuuugauuucgugacaucaccuguaucagguuggggugccgccccguugggguucuguucagaaguucauaagugcgccuguguuguggugccagccuuccggguuggcaggcuccgugguucacucugagcuguucugaccacacucugacuggaaugcuagagcagugugucgugccgggugaauggaggaguauacacugguugucauucacucuugguuugucuucacacacccuuagguuuccauggcuuaaucuaugacaauaaaacugaauccaugaggacgaucaaccuccuucaacggaugaacauuuaccaagaaguuuuucucaguguuuuauauagaguucuccccauacagguaugcaguguucucuguccuugaguuuguaggggcugauguagguccaugcugcuaccucagagaggauguuucacuccgggucuccugacuucagcugccucgguagagaaucgucgauaugggcgcuguguuugcuuuguuuguuuguuuaucauuguuguuuuuaauccuauaagauacuguuauuuuauuuuacaaguagagccuccuggcuuauaucauaauuaugcaugcagucuagagcuugagaaaucguuucauuugaaaaaguguaaccauuccucuauguguaaccuguuccucuuguuuuuuguuuuuguuuuuuuuuuuucaagacuggguuucucuguguagcccuggcuguccucucgcucuguagaccagacuggacucccaacacauggagauccuccugccucugccucccaagugcugggauuaaaggcaugccccaccaccgucugucucuaugacuugucuucaugauuuaaaaaaauaugcaugaaaucgucagaucacaaucagcacuucucacaugaaugaggcagaauuaggaaagguuagaccuugcuuugucuggaggucuccuugcaucucaguugaagaaagacagcugcuugcucauaggugcagagcggugaugauccugcugccggggccagcugcaagcucaacauuuccuuccuacagacauguucuauaaggauuucuuuuauuuuagacuauguauauguguguaugugugccugcguagagguuugugcaugugaguguaggugcauacggagaccagagacaauuagagucuccaggaacuggaguuacaagcaguugugagcugccaagcauaggugcuggcaacugaacuaagguccccugcaagauccauaugcacauucaagcacugagccagcucccugagccccuccauguggacugacucacucucuaggccccucugugugaacuggcucccuaggccccucugugugaacuggcucccuaggcccuucugugugaacuggcucccuaggucccucugugugaacuggcucccuaggccccucugugugaacuggcucccuaggccccucugugugaacuggcucccuaggccccucugugugaacuggcucccuaggccccucugugugaacuggcucccuaggucccucugugugaacuggcucccuaggccccucugugugaacuggcucccuaggccccucugugaacuggcucccuaagccccucugugugaacuggcccccuaggccccucugugugagccagcucucuaggcucuaccaugugagccaguuauuucucuaggcuccucugaggccguuccuuaguccucucuguggauauauuuuuuuaaugccaguaaggaggguugggauaucugugacaaacucucauggugugggaaugaaccaagggccuggcguguucgaggcgagguguauguuugaaugcuugauccccauugauagaacugcuugggaagguuaggaagugugcccuuuuuggaguagguauguguuggaugaggguaggcuuuaaggcuucaaaagccaacaccauucccaguuagcucugucucugccuccuguuuguggaucaaguuguaagcucacagguccagcucuagucugccuuucugugcucccgccauaauggucaugaacucgcccucugagacugugagcccccaguaaacacuuucuucuguuggccacuauaucucuucacagcaagagaacaguagcuaagauacuaggcacacgggcuacggcugagcuguguccccagcccugaugaccaguuuuuacuguugucuuuuacagaaauaucuagaaccuguuuauuuuuauaucuacacucuguucgggcuccaagcagucuaugucacggcccuuuauauaaccagcuggcuccuuaguggcaccuggcugucgggacuguuggcagcccucugguacgucaccaacaggugaguugaggcaguucaguucucuuuccuaguuuuaagucaggauaagugacuguuuucuuaugcagaggaugccugugaacaccguacaguuuagguauucccucaacaguagagaggugugugugaaaguaugcaugugaauguaagggugugugaguggguguguaugaaugccuguguguaaaugugugugugugugugugagagagagagagagagagugugugugagagggagagugugugugagagagaaugugugugugugugugugagagagagagagugugugagagagagagagaguguugaauguguuugugaguguaugugagaauguguauaugugaaaguguaugugagugucuauguguguguguguaaauaaaugugggugggugugagagugaguauaugugaaagguuuguauggguuuguggguuuauaugagaauguguaugugaguguguguaugugaaaguguguaugugaaagugugugugaguguguaugaguguguauacguauauaugugagagaguguguaugugugugagugcaugcaugaguguguaugugagaguuuguguguguaugaaagugugugcaugcaugugugugagagagugugugaauaucugugugugagugugcauguaugugugugauaguguuugaguaugugaguuuguguguguguugcccccaggguauuguauuugcucuggaggcauucugcuacuaaacuaugucccaaauuuuccugguaacuuuuaagcugugugacagggucucacuacauugcuaggcugucuuuaaacucccucuguagcucaagcaggguuggaauucagauccuucuaccucugcuuuccuagcugcuaaggccuccccagcacacccagcuucccuguccaucaugacaggauuugcagcaaauacacagugcugugcuauuauguaauucguuuguuauuuagcauuaucaauauauauuuccauauauucaagaguauuagcaggcaagauuauuggcuuauaccguauaauucuagcacucagaaggcuaaggcaggaggguuaccacaagucucagggcacccugaauuauagcaaaucaccaaccagccuggcugggcuacaugagacccuggccuuaaagaaagauauugaauuguugaauugaagaaaauauauauuuucuucuuaaccuuaugaaaaauacuuuuaaauuuaguccuacauauuuaaguguuugccuacauauguauaugcaccaugugugugccugguaccuaugaaggcaggagaaggagguauuagauucucuggaacuagaguuagaaacaguugugagcucucauguaggugcugugaccuaaagcuggacccccugcgagaacagcaagugcuuucuccagcucuacaaaaguuauuuuuuauuauaagucuagcgagugcuuauuaugugcucagcacuuuacaaaaucuauucuauuaacagcccgacauggggcugaguuugguggugugccaaaaauagagacaagcagaucucugaguucgaggccagccuggucuauguagugaguucuaggacagccagggcuacauagagagacccugucugaaaauaaaacaauaaaacaagguagauacuauaaccucuccuuagaggugugaaccuugacucagaagggcgucaccugugcucucacacucugaacggccugucuuuuuuuuuuuuuuuuuuuuuuuuugagguuguuaucaauuacccagucuguacauguguguuucucagaacugauugaauuaaaaagaggugaaagcuuaccuccucuugccuucuggaggaggacuacauuccagugggguaauucauuugaaaaggccaucagcaagccucagugucagacauaaaccacuaagaaggggagagccuuggggacuggagagauggcuugacccuggcugcucuugcagaggaccuagguuugguucucaguacccacacugcagaucaugauggccuguaacuccaguucuaggggaugcagugcccucuucuggccacugcuggcaaaacauucauauacauaaaacaaaaaucuuuaaaagcaaagaaaguguuugccuacagcaucuagagaacagugaggaggagcuuggugugggccuccguggccucgguacccuggcuaacaugggcugguuuccaccacuuagcuaauaaggaacaagggcaggucugaugcuguugguaccaauuucaugccaugaggacaauauugaugaugauugaugaugaugacaguugcuacugagagccaguggcuagaaucugugugucccucaacuaacggcccucuagcuuuccugcuggaauuccuugaggaaauuguugcaaggacaauccuggcuguuauuuuggcugucuguauucucuuccuacagaauagacaccacaagagucgaguuuaccaucccgcugagggagaacugggcucugccuuuuuuugcaauucagauugcagcaauuaccuacuuccugagaccaaauuuacagccucuuucugaaguaaguuucuagaacacuuuaauuacuuguaaguguguguguguguguguguguguguguguguguguguauggauacaugagucugugugagaguguguacaccagcgaaugugugugaguguguaugaguguaaguauaugaguguugguuacaagugaguauguaugagaguguaugcguguguguugucucuguguguguaucuguguguccagguguguugggugccacaugcagcauucagaggaaaaacucaggggaguuauuuuugauccugccaucuguaagacccugagguucuuagugucuccacccaugaagcugucuugccagcucaaaguuucuaggguacuuuuuaaucugcugguuuugucuaagaaaaaauccuacaguccauagggacagcucucaucccauagccagauuuguuauuuuuaaguuaugugugcaugcauguguuuguggauguagguacuuggguccugguacccguggaggucagagaagggcauucauccccucaggccagaguuacagaugguugugagcacccuggaugcugggaacugaacccaugcccugugcaagaacagcaagcacucuugacuguugagccaucucuucacccaguuaagcccucucccucugaacuuuuuccuucuuugccaggaaaaugucaagugaaaaauguccgcuuuacaacccacccucaaguagaugcagggagcucacauuguucugcaaaacugaggguugcuaauccguugcuuuugagaugugguuugcuguauuauggccucgagaucagaguggaaugcacauaccauaugugaauauuuauaugagaauaucacuucgggauauuuggagcucguauuauaaaugcaaagcguuucaaagcaacaguuccugccuccucuacuucguuuauggggauauuggcuacucuggagaaaacuuaagugcacaauugaagacuggagaugagaauccuucaaaggucuguuuucuuuuguucccacagaggcugacacuucuugccauuuucguaucaacuuuucucuuuagccugacauggcaauuuaaccaguucaugaugcugcugcaggcacuggugcuguucauccuggacucccuggacaugcugccggccaugaaggugagcacugccugccuuccgcuccucggugcacacccuugaguggcucugucguaggcugggauggaaacugauacagacuugugacaaagguaaaacuguugaccuguguccucaggcuguggucgccugaagcuacgaacugaugugcagcccaguuugacaauucaacauauuuuuuugacacuuacuauguguguggaugcuuugccugcauauauguaucuuugccacauggugcacacaguauccacagaggccagaagagggcauaggauuccccuggaaccauagucacagaugguuguuagcuaucgugugggugcugggacuugaacuuggguccucugcaagaguaguuagugcucuuaacugcuaagccauuucaccagcccaucaacauuuuuuuaaguuaaauagugccucuagguccuggagagauaacucaucaguuuagagcacuuacugcuccuacagaggaccgguauucauuacuccacacucacauagcagcucauauagaguuacauaccugcaaauccaacuccaggagacccagggcccuuuucugaccuacacaggcacuacacacgcaugauacaccuaaacucauucaggcaaauaauauaaaucaaucaaucaaucaaucaaucauuugcauguacaucuauuuaaguaagacauagugucucagucaguuuccauuuauaacuauggcuuacaauuuaaaauacagccauagcucuugaguuuucuuaauaugggguaccuauuuuuuuaaauauauaacucaacagggcauauauucuuuuggagguguuuauuuugauuuuuuuaaaaaaggauugauuauaauuuuacacauaucaguguuuugcuugcauguauauauguacacccuaugugugccugguaucggcaaagaccagaagagggcuccaaguccccuguaaugaaaguuagggcugguuaugugcugagauguaggugcugagaaccagaccuggagccucugcagaagcagcaagugaucugcugguaccaggacccaaguacccaacugcuaagccaucuugagacagggucuuacccuauaaagcugacccuggagccuucaggaguccucuggccucagccuccucagugcugggauuacagggaugagccaccauuccugaccaaacaauuguuuucuucuauaauauuuuauaauuuuuuauaggcacauucuccuaauacauagaauauguguuuuguuuuguuuuguuuuguuugacuagucaaacacuugauauaaguaaacaaaggcauaucugucuucuagugagugcuguccuuuaaucucgguuuggcuugauaguauucauuucagucauagguacguaacucucagacaagauacuugccauuuuuuuuuaauucaaucuuuuuaaaagagaguuacuggcuagagagauggcucagcaugucagaaugccuacuagcuugcagaggacucaggguuugauucucagcaccuuccugguagcucuaacugccuauagcugccugcagcuuugauugccgagucuucugccguccucgggcuccugcauauaugugcacacacauauccguaagaugaaaguaguuuuugaaagggagagcuggagugcagacaagagagaaugcacacacuucuuguuccagucccaaguacacaaagcaaaugacugaccacagaguuaagaaaggagaugacuagugugguuguuggaaugaaaauggcccccauaggaaguggcacuaguagaagauguguccuuguuggaguaguguggcuuuguuagaaaaagugugucacugggguuaggcuuugagauuucaaaugcucaagucaggccccguaucuuucucuuccugcugccugccgaugcaguuguaggacucucgacuccaucucuagcaccauaucugccugaacgccaccaugcuucccaccaugacgacaaugaaccuguaagccagccccaaauaaaugucuuccuuuauaagaguugcuguugucauggugucuccucacaguaaaacccuaagacagcuagaaacuuccagaccagacggaaaauauggccaugaaucuccuggguuuuccuuuuccuucauagauccaagaguagguauuagaaaacucaaaaacugggggcuggagagguggcucagagguuaagagcacugacuguucuuccaaagguccugaguucaauucccagcaacuacaugguggcucacaaccauccauaaugagaucugacucccucuucuggagugucugaagacaucuacacuguacuuacauauaauaaauaaacaaaucuaaaauuuaaaaaaaaaaaaaaggaagaaagaaagaaaacucaaaaacccagaaauagcaguagaauggcacgaaacucacaugaacaacauucuccuagccaaggaccagaaaagagaaaauuuaggaagacagaauuuaacagcccauagcagccaacaccuuacaaacacgugcagcuccacucccaccugccagcaggggaucaugggaaugccuggauuucuguucucacccuguucucaugccugcuacgugccaaggcagugucagaaaaucuggaauuuucccucucucccgcagaccacacggggaaucugacuucagcccccacuuagcuguggugacaucccuucccuccugccacgguggccucaaagcaugccaacuacaugcuugcccuccacugccaaggucagugggcuaaggagcuuccuagucagaggcacaugugguacugugcucagcccuaaaugggacauccuucucaacccccaucucccagguuggagagcaucauaggaggaggggcagagggaugugagggcuggaggauggggaggagggcugggcagugccaucuucaggacaggcccuggcacugcacccacggcagcucugugccuaggugaggcagcaggcauugcacucaguggagagggcaggaaagggagacaugauaggaaugccugggcuggggggaagaaggagcugggguguaugcauccggcucacacacagaaaauuaaacuuaaaaacuuaagauauuuucaugugauguaauauuaguaacuuuucucacugccgggacagaaaacgguaaauaaauguuuauuuuguccuguggcuucagagagguuucagucugucuuagcaaaggcacggugaugagauggguugguccuaucugugguguccagagccugaggcagccucuuguuagcaucagcaggcaggaagcagaucagagccaagccaggcauagcugcugguggccguaguggcugccuucccugcuggccuuucucccaaagacucggcucuucagccucugucagcugggguugucugcacaagacccacaaaaggucaagccagccuaaauccuggcaucaagucccuaccccuuccucaguagcugcugguaguggauaguugcugagggaggggccauccuguucugaggacguggcccugguaggucuuccacacacugaugggugccucacauaugggcagcacugacuagacuuaauggguuaucaauaacaaaaaccugaauuugggagggagucuauuaggggacaugggauagaaacggaccacauaugaucagauuuacuguguacauguauuaacuccccccaaauuuuuuaagguaccagcagccuucaaaacauaagccuguuuuuggagguguauuucagaaucagaucuucacaguuauguaauguuuugaaguucaaguuuucacagacuacucacuggugugagaaaguuaggcuguauaguaggguaugcaguuuguaugaaauguuaggcuccagugagaacccgcauugccuuucuugggaacuguguuggguuuugacucucggcccugccuuucuaucaauugcuguucuguuuaauguuugucuguguacaguuaggugcaguauacuccuaaaaagcacugucacccugugcccugagcuccuggugacaccaggcagggcaaagccugcaggccucacuucuccaugcucgaagcagacugguuuccucugagguuaaaagcuugcagccgagcugugucagaacugcugcuucacaaaauugccguuuuuuccccccaggucugauaugaguauggaauugaaaaacgaucaauucaguuuuuaaaagaugucaugauguuuaauugcugugaagagacaucuugagccaaggccacucuuauaaaguacauuucgggggcuggcaagauggcucagugguuaagagcgcugacugcucuuccgaagguccugaguucaaaucccagcaaccacaugguggcucacaaccauccguaaugaaaucugaugcccucuucuggagugucugaagacagcuacaguguacuuaaauauaauaaauaaauaaauaaauaaauaaauaaauaaauaaauaaauaaaucuuuaaaaaaaauaaaaaauaaaguacauuucauuggagcuggcuuauaguuucagagguucaguccauuaucgucauggugggaacucaugcucagacucacaugaagaccugcacacacacaugugcauagacaucuuuaaagcuuuuuuucguuguugaaagugaaaaacaaauggaauuuguauaacggggcguccuuuuagagacgacgauucuuggaacuagguuugcuuucugcuuguagccugaggugugaacacugucgggugucucgaucuccuaaugagaucuccaucucuguugcaggccaccuggcuguacgggauacagauaagcugccugcuccucgucugcacgcuucaguucuuuaacuccaugauucugggaucguugcucaucaguuuuaaccuuucaguauuaauuguaagaaaacuucagguaggacuuuuuaauuuuuauaaacgauguuauaagauuuuaauuuuuagcuccccucuuccccccucucuguguguauguaugugugugugugugugugugugugugugagugugugugugugugugugugaguguguguguguguguguguguguguguguguguuuucuaaugugcacaugaguacaguuccuauggagaccugaagaggacaucagauccccuugaccuguaguuacccgcuguugugagcugccucaaguagguacuggggaccaaggguuucucugcaagaauaguacaugauccuaaccgcugagccaucucucuagcccuauaaaaucuauuuuugaguguauggcucacuggaccuuauuuucauuuuuaauucaaaggaaaccugacccaguucccaguagggagggccagcagggugacaguaacuuuuccuuuaaaaggguacuuucacuuuugaagugaaacauuuguuucaagcucucaggucauucuccccuuuuagcagugauggcuucuuaugcaauugaaaccuuaauucaggcaucagccaagggcacuuauuugaauuauguuauuaucugucauagauguaacgccgcaauacaagaaagaaaaagaaacuguauauguaaucuguagugccaguguguccgugacagccuuucaggucuggaucccuugccauccgggauggcgccacccuuuccuggugucaccuucccucuuaguguuacugaaaugaauuaaaauuaacuuuuuaaauuugaaagaauuccaaacaaaaauuuccaagggcauggggcaccuuguaagcuauuaaaauauuguguaaaauucuuuccuguauauuuuuaauucuccgagaauuucacacacguauauuuugaucauaaauacuuccgcuugugugacccuucagucucuccucagaaacccccacacaucccccuuccaacuuugucuuuuauuuauaaaaucaccugcugaauccaauuagugcuaacuuuauacaaauggcuuccgggggcaucaacugcagcauggguagccuagugggagccauagccucugaauuacaucuguccaucucccaucagccaucagcugccaguagcucuucagcuaggggugggccuuacaagccgcucccccagccagacugggaccaugucugacuugaaguugugcugcucuuacgaagguagccacccucuuuuugugaaugggaaugcaugaguacauagcauuucagagcuuuauucucccucucccccacucucacauucuucccacccacucuguccuggcguugucugagccuuggugggggugcgauaccggcgucucauuuaaggauaaacuccuggagucugaauacuucuuaggcagucgugagucucugcauuaaccacugcccacuacaaggagaggcuucuuugaccaagcuugagagcagcacagaugugcagauauaaguguaaauauucagcagauaauuagauaacacgaccauuccacagaacagcagucgaagguuuuccccaagacuaguaaccuccccagccaugugcuguguauuaaguuuacagaaccggucaugacuucccuccuggugaauaguccucaucuaaucagaaagcaauuggcugcucccauaccagccaugcugccaucacaccagugggagccgccuugcccggcaggcacaagggcagugcuggguaagacaccauccugcaccgugaaaacucagcaccgggucacugucccuacaacccacaugugugguaucuucaccaguagggccuucacaugacagucaagggcuuguauugucuuagggucuucuggguguggccuuccuguccaguaacucauagggaggucucccauuuguugauugggauuuccauugcauaaccugugucuucuaggggcagccuuguucauccaugcaggugaccgcuguucagacuccuucuuuauuuaguuacauuucuaaauuacuuuacaaaguaguagauucccacaagauuuuucaaacacccuuagucuucuuaucucaccaguuuacccuucucacccacaucccugcuuagacuguuagccaccaauaucccgcccucugccccauuucagaucacaugaaaaauuauuaaaauaaaggaaaagagaccccaugaaguaggguuuauuuuuuccuauauacauuuaccuguguguguugcaugagccagcauuuuaaaucuucaagcaaucucaaaugcuaugaacuuauaguaacguuaaaguuuauuuaaaugcuaauuuaaaauuaaaauaauuuuuuuaauuucuagaaaaaccugaagacuggauccuuccugacuagaauuuggaaacuacuguugcauuugcuucuaguuuucuguuugacacuuuuucucaacaacauuauuaagguauguuaauaagugagauuuaauccaucucugaaguguguuuaugguauuauaguuaaguuuugaacuuuuaauuaggacuaguucucauuuauaaagcauacuugaaucacugcgagucgugguugaccuagcgagagccacacucagcucuguugguuuuaguucuucaucucuccucccuuucaggaccuaucuauauuaguugcuuuucugucacugugacaaacaucauggccaaagccacuuagagaacaguuuauuuggccuaacaguucaggaggguuacuguucaaaauggugggccaaacaggcugagcuguuuugucaaucuuacaagccaucuuauaaacugggagcucacaaagcccaccuccagcgacagcauacuuccuguaucaagaccacaccuucugagccuccucaaacagugccacuaacucugcagcaaguagggucucuggcaggggguggagccaaacuugcuucuccggcaaacuugcugaaccagcugcaaaugagagggguggggggaguucuaagcuauaacagacugacccaagggcagggcggggagugggggggaacuaaagucuaaugcucagagcuggugcugcugagccagagagcagucguccaggucggccuggaauucucagccucaagagagacacugucuccaacaaacgagggacagggcagcaccaggaguagcucugagcucaagaaauaagaaaucuucucugggaccacgcagauggucacucugaccaagggggaugggacuuaccagaucuggauuaacgagcauggaucuguuguuguuucuagauccgagucauaggguaccaauauugugauuauaaaaagauaaagaguauuaauauauguucuaugggaguguggugagauguggggaaggggaugccucggcaggcccaugccaaggcaucccuuaccccugagagaccagccauacgaugguauagcauagaauagaguuuauuuagggcauggggaggggaguuaagagaguagcagaagcagagaaaggcagagagaaggagagaguagaaaaguagaggccagccaugacagcuuggagagaagggggaagggaaugggggggagaagggaagcaagggggccaagaggcaagggagagaggaaagaauaagagaguaagagagaggggagggggcaagcagccccuuuuuauagugggcuaggccuaccuggcuguugccagguaacuguagggguguaguccagacagaauaucaacaguuugugucugugggugggucugugcauaugagcagugcccauggaggucagaaaaggacgugagauccucugaaguuagaguuacauacaguugugaguuacccuauuugggugcuaggaacccagucugcugcaagagcaguauaggcucuuagccaucucuccagcuccaacuguuuguaguacguggguuuucauaguccauaaguaaaaaauuaaauuauaucaauuaaaauuacaaucacuaaugaugaauacuagagcugggguagguacaucuuagcuuuacuucuguccagaguuauaugugauugagucauuuguguccccagaaccaaaaccugacagccacacgggcuacuuaccugcuugaaauuucaagucauuuugcugauuuucugaucuaaaacuaaaaaaggacaccuuucuuuuaucugcuucccgugcugugcagauguuugaaucaaggggaaccuuuuaaaggggagggaagauaaggcaucucugagucuggggagcugacuguggacuggccuccuucugagccacauucaucacuggugaccaggaaccacgcccaggacacuaagagcucacuuccuucucucucuuccuaauagaaaguucuuaaccugaagucagaugaacacaucuuuaaauuucugaaggccaaauuuggguuuggagcaacaagguaggacuggcgugagagugugcccucaguuucauacgaagccgugggggcuuuaaccuggaguccuggggccuucggcaaugccuggcuuggauguaacuucucgcccugccuuccuuccccagggauuucgaugcaaaucucuaucugugugaggaggccuucggccuccugccucucaacacguuccagaggcucucggagacacugcuuuuuuacgcauacauguuuguccucguggucacagugguuacagcauccguuguagccuuucauaaucucagguaggacuuuaacacuuugaugaaguuguugaugaugggagauguggagggagggagagaaggaggaugaaaauggggacagcagacacagcaucagagcucugcuccucuuuagaaaggacacacccaguuuaggguggacagaacgccuagugggcuggguucuguggagcuggcgugcuugagaaaaccacacuaaguguagaaaaccaagaccuuuguauaggcaucugccaucacuaccuguuguugguauugauucaugagucugguuugguuuuaaugauuagccucaugagggguuuuguuuuuguuuugggucaguguguuagugugagugugugugugugugugugugagagagagagagacagagagacagagagacagagauaucuuuuuaguaacuccaucacacaguucucaacugagaacuuuguauuuggugacacagaccugagagccuaauaacucagaaaauggggacaggaggaucacaaguucaaggucacccugcacuaaaaugaguucagggccaaugugggcaacuuagacucaaaauaacaagggaaaagaaauuagcccaaugguucaucacuugucuagcugcccaaagcccaggguaccagaaaaauaaaguuaauuauuguucauuuguucccucaggucucguuugaaaguucauacauuugguaugagccauaauuaugagcauuuacugacaccuuuaugcauucauugccuguauuuaaaacauagcacaucucccaucuacagaaaagaguaucagggaguaagaggggggguuggcaggcuuguagaauaccucugaucaagcugauggguuuugcauuuaaaaucuguauuccaaugaaagaaaauuaaaaaguugaagcagcugucauccaugagagugugguacggcuccuuuccuguguaguuccacagccauuucaaaugccagugagcugugauuuccaggcaggaaaacuggguagcgugagucuggacgacuuacgcuuauucagaauaaagcagggccuggaagaugcucaguaggaaagaguucuggcugcucuuccggaaaaucugaguucaguucugagcaccuguguggcauggcucccaaccucugugauucccguuccaggggaccuaguggccucuucugccuucccaggaacucacacacagacacauaaauaaaaaccuuucuugaaaggaacuaugaaaauacuucaccagcccugcaguaugcuaagucacggcuccuggaaacaggaaguuggucuggaugacacaguugaugucacugaagugcauaggguaggcaggaccugggcuguauccagguugaccuaucuggugugcuggugugugaauccggggcugauuuguuauaucgcuguagauggaggcauuggggggcccuccucggccugguggagguuugugaggaaaagcccuauguuaauuagguaaugguaguuccuuaaugugugcuagcuaacucagugucagaggcugauuugguuuccgucaucguuguuguugugagggggaagggggaagggguugagguaagauuucugcauccuggauuugcucuguaugccgggcuggccucagacucagaaaugugcauguuucugcagugccugguugguuuguugguuuuguuuguuuguuuguuuguuuguuuguuuuaaaagauuuauuuauuauuuauuuauuuauuauauuuaaguacacuguagcuguccucagacacuccagaagagggagucagaucucguuacgaaugguugugaaccaccaugugguugcugggauuugaacuccugaccuucagaagagcagucgggugcucuuucccacugagccaucucaccagccccuguuuguuuuuuuuuuaagauucuuuuauuuguauggguguucugccuguguguuaugccuguacaacacauuugcaguacccucagaggccggaagagggaucugggucuucuggaaccagaguuaccgaccacugugagcugccauauaggaaacaaacccaucucucuagccccuggguuaugacuuuaaaaaaaaaaaccaaaaaacaaaaagcaaaaacaacuuuuaaaacugaggccaaagggauugaucagaaguuacgagacugguucaguuaccaggacucacguggcagcucacaaccaucuguaaagccaaucccagaggauccagugcccucuuccagacuccagggacaccaggcaugcacacggugcauacacaugcauacaaccaaaacacucacacacauaaaauaaaacaaaaauaaaaacuaaacagaaagguauaaaaacuaacuccuguaccuguagugcuagcacucgugggaaacugaaguggagaauucaugaguucaaauccagccagagcuacagagugagacccuguucaaaaauaaauagguaagggcugcgaagauggcucagagguuaagagcccugacuguucuucuagagguccugaguucaauuuucagcaaccacauggcggcucacaaccaucuggaaugggauccgaugcccucuucuggugucugaagacagcuacaguguacucauauaaaugaaauaaaucuuuuuuuaaauaaauaaauaaauagguaaauaaaauuaauagauaaauaagagcacaauuuagugauguuaagaguuaguguucacgcuauugguguagagguaccguucacacuauugaguuguaucaugagagcacacuuuuaacaaugacaacauucaucuauaggauacaaauaaugaagcauugguaggugacuggccuaccgucuguuaacugaacucaaaguuaauggauacauuuuauuuuaauucuuguuuguuuuuaaaaucuugaaaaaauacuaacagaaauucauaaaaacguucagaaagcucucccaucucuggcaucugcagaggacuuguuccuguuauucuugaucagagaaaugaaucgguuuaaauuuuugcuugaauuacagucguugcucacugccgaggcaguggaguuuauauuacgaucucaaggcucagauuccacgcugauggaugccaguucauuuccucguaggggaaauaacaggguuuaccuuugucagugcuacacauccagauuuaauguugcucauuggcuguuuucuccagugauuccacaagucugaaguccauggaucagacaagaaagcgugcuguugaccugaagccagaagcugcguacaaccugauccauaccauucuguucggggucuuggcguugaguacgaugagguacuuccaucucaucugguuuauuuacaaaacuugacggcucuugaacuagugucaucuagccaguuaguuaucugacagccgccuuugauguuucugcuccuggcgaucugcccuucugcacucucggcgcucucugaagcguuaccgccagggcuuuuccuuagcugcaaacaucccucagggguuuccaugugugaucgcaccuagagagugaucgaauggaugagucacacucuggccgauggcuucugcacagacagggcugacugggugggucacugugugugagcuuccccccucgcuugcucucccgcuggccaggucuucgcacaagcacugaccugugcucuccuguuucaggaugaaguaccuguggaccucccacauguguguguucgcguccuucggccugugcagcucugaagucugggaacugcuacugaggcugguucaucucuguaacccaaagcggguuagugucguccugucugcccguuggaaaugagcucuaagcuuucuuccguguccgcuccuucgggcauuucagugggugccauagagcagauuauuuuuuauaauucauacagguuuucgacaauuucauaccuguauauaauguacucuauuuccuccucaauauucucuucauuuuccucacaccccugaguccucuucugucuuggugugcuuucuguuguugugauaaaacaccaugaccaaaagcaacucuacuuagcuuacaugucccaggucacagucugucacagagagaagucagggcagggacucgaggcaaggucaccaauuacauuuuuuaauucacuuauuuuuuuuucaugucagauacguucacuauauacagaacuuagcaguguaauaaaaagcgaaauuaaaacuuuaaguccguuauccagaauuacaguuauuguauaagacacucucuggcgucuauauguuaaggcugagcagcccgcgaccaagaagaacugcucugcccucuacgcucauuggguagugggauggcagacacagcgugcaugcucagagccagacuuugaggcccaugugaucucaguagagucuuugucccacagaucuggguccugcgcuaccuggugcccguucucacccugcuguaccugugcuauaagguaagguugaucccccauucuucacuuagcagcagaggggcuugcggcaucugcagaggcugccuucaagcccugcugaguuggcauuaauagggagauugggguuuaaaaacccauaguuuuuaggcgugcagcauuagaguaaaggggccauucagaaaagaaaaagaaaucuuuuuuuuuuuuuuaaagccauucuguucauuucaacucuuacuggaagcaagguuuugaaaguguuuucagacauauuuugaaacaaagaaggcagaacgaauuucuccuguugccugguuuaugcagagugagugguuuaaggauagggccagcuuuaaccugcucacuucauuagauacaugucuuccggagggcuggacacauguaauaaacaauguaagguuaauguuguggcagguguggugguacacacccguaaucucuacacacaggcugggaugggaguauccaguagucaaagccagccugggcuucauagugagacccaaacaaaaauuagacaacaacaacaaaaaagacugacccuucccccaacccagagacaaguuacugaagcagugagaaaugucauauucuccuuuaacugaucuugaagugucccaaaacaccccucagagaucacuggccacuuggcaauuugguaauucgggguuuuguuuguuuguuuguuuguuuguuuguuuuuugauuuuucgagacaggguuucucuguguagcccaggcuguccugaaacucacucuguagaacacgcuggccucaaacucagaaauccgccuaccucugccucccgagugcuggaauuaaagguguacaccacuacccugaccauauuuuucauaugucuugugugguuuuaaguuagagcaguagacugcaggccacuguggaguggccccaguuugucagagcagucaggagagaggcagccugcagcucggccuccagacugcugcuguuguaacgcgagguucuguaguccaaaggcuugaggcuugggaacugcaguugauagucaggguucugucagaauagcugcugucacaggcagagccccccagcuccaggaauuucacucucuuauguaaauaagugaaacaagguuaaauggcaaacgagcaacuuggcaacuuccccuuuacauggaauuaugugggucgaaccucaggacgcucaggguuguucuggugucccuacuacagcuguggggacaggguaguacaggacuggggacugacucugugugugugugugugugugugugugugugugugugucuuuuguguauagauguguggaugaauggauggguguguguguaugaauaugugugugugugugugugugugugugugugugugugugucuuuuguggauggauguguagauggauggauggauggauggauggauggguguguguguauguguguguauguuuuguaggcugaguucuuuuaugaugucacuaccuguugaauuucuuuuguaaagcuguuuaaggacuuggggauaagauuuaggaaggcucggagaacaaauaaagcaugaucuagggcuuuggcucuuaaccuuggugaaggcagcagcaguagcgccugugaauuaggaaccgcaagguguggguugccccagaccuccugagucagaagcccauguuucagccaugcaaugaugcggaggcaucaaguuugcaaagccuguugugcuuccuaggacuuuuucccggauaaccaugucccaggcugcuggccugccaggcagauugaguagcaaaguaccuaccuucaaacuccuugaugcugaccgcugcgccccguggcagccugucauuuccagcacguuacauacauucugcccgcugagaacaguccccgcagcucuaaggaccacugcuguaggggaucagggaaagcacuaggaaaacccaacucacugcugccagcggugguccugggguguggcaaggcguugggcagguggccugauuccucuacugauacugcaugaaauccucuagcaacuucaacucaaaaucuucaaaguaaaaccaagcaugguggcucuugcuuuaucccagcauuaggaggcauaggcagagcaucucuuaguuuagcagccagccugggcuacagagugaguuccaggacagccugggcuacagagugaguuccaggacagccugggcuacagagugaguuccaggacagccugggcuacagagugaguuccaggacagccugggcuacagagugaguuucaggacagccugggcuacagagugaguuucaggacagccugggcuacagagggagugagugaggcuuugucuuuuaaagaaagaauuguaaagucucagaccagaaagaauaugaacaauguagacaugaggaguuuccccugacacucaagcuguuuuccaucugggccagccaugaagacuuucugcaaguggcaugaguauuuauucaaagccugacuuaaguuuuacuggcaguuacaguguggaccauguucuuuucucuaggauaauccuguucaaaggggaaggcgugugcuaggcuccucagagccagagauuagaagcauuacucugguuuugauuagcuuauuggauuguugaaaucccagcuaaucuauugcauccuguuaaaaagugacauuuaguucuuauuuucacaucauuuaaggaguuucucacaggaucugcaacuuuaacauuaggaaauuauccaaugcccaaaauaauuggaacauuauauuaaauaaaguguuauaucuuguugaugaucaggugacaggcaccacagauuuaauucccaaaguauuuaguagaguaagccaggaguuugaggcuaaccugggcuacaaaguaauuaucugucucaaaauaagaauuaauggaggaaguggugccugauccaccaucauucaagaagagcuaagauuuaauugguuaaugaacuagaauuugcguuagaugacaggugggaugggaauguuuguuuuauacucagucgguauaaccuuaagugacaugagcugaccaauggccgaaauaauaaagccuaauacauucgaugcuccuggagucugauuuccagccauccuuuccuaucgugacagaauaucuauuaacauguaccaagccauuugcccagaauagucaugacagugcagggagaagcauauagaagcaagucccgaggcacagcucugcuacuuagucagccaccagcagaucugauggugaugcucccagcugcaccaucugucuugugauacccuuggauaauaccccuguauugaaagccuugauccaugugugcgagugccuguaagucugcacuccacaugcaugcaacacccgcagaggccagaagaggacagcggcacaucacugaauuacggucggccugauggguccugggagcugaacauuguggguccugggaacugaacccagguccuucccccuuacaagagcagccacugagccaucucuccagacccaccaggaguagguguugcuguuguugcauacauacagucuuacuuuacauucacaccaucacauaaaagccugucuguacgagcuagcuucgggaguaccuggacguucucgggccucgcgcucaccugugcagacuggcucagagguaaagccauccagggcugcagcugccguuugugugccuccugaguauaucaugcacaguuucucguccucuguuacuuaaccuuagcgacagcuacacgggugcguuuggucuugucugguuuuuccuuucaguccuggccaggagugauggaugaacucucggagcugaaagaauucuacgacccggauacaguggagcugaugaccuggauuaaguaaggggcacuuuuccuucugaacuuugaaacuuugaauguccuucuaaagccaacgguagcucucauuuguuugagaggcaaguuuguuuauuuucucauauuuaagaaacauccuccucaaucaaacuuuucuuuaaaacuaugaauuugaaaggaacucuuccucucaagaacuguuguaacugggcgcagcagcgcacacuuaucaccccagcacacccagacagaggcagaggcagaggccacgaguucaaggccagccuaggccacauaguaagaccucgacuuuaaaggauucucugcagcugccuucccugaaggaaagaaacacucguuugaaguggaaaaugggaucagaaaauaaacuccccaaagcagcagaagcgagagucagguuuuauuuccccaugagacuuagcaguugccagcaugcacugcucuugccaaggacccgagcucagggccuagcgcccacaccuggaggcuugcagccaccuguaauucuaguuucagggcaugcagcaguugcuggccucgccuccccaugcaacugcauucacaugcacacgcuccccacccccacccccacucccagggaugcauacacauauuuaaaaguuugaaaguccccuuuaaucccagcacucggaaggcagaggcaggcggauuucugaguucgaggccagccuggucuacagagugaguuccaggacagccagagcuauacagagaaacccugucucaaaaaacaaaacaaaacaaaacaaaaguuuaaaagucacucacguuucuacuuuuugcugacuuuaucuuuauuauuuucaucugaaucguguucauauuugauguuaauauucacgaacacgugaauauguccguuucagaaucauagcucacugcaggcuucaucaaacucaucucacagagaacauuucaucuuauucuauugaaaacauuuuucuuaacuugacauaggaguacacaccuuuaaucccugcauuuggaagguagaggcagguggaugucugugaauucaaggccagcuucaucuacagaaagacccugucucaauuuuuuaaaaaauuaauuauuaacuaauuagaaaguaaggcauuuuucuuuuuaagauaguuuuaauuauauuuuuauauguauggauguuuugucugcauguuugucgggggcccuuaguacccuagaugguugugaguggucaugugagugugcagaauugaacccagguccucugagagaacaggugcucuucaccacugagucaucucugaagcccauagaacagauuuucacaagcgaaacagcaucagaauacccuggugugauguuguucuuaucagaaugcccugcugaaugugaugucguucuuaucagaaugcccugcugaaugugauguuguucuugguuucagguuugguuuugguggugguaguggugugugguuuuugcguuuuggauucccccugcccccuuuugguuuggguguguuuguuuguuuuuugcuuuccuucuuucuucuuuugcccagccuugguugcuuugccucagccuccagccucaggauggauucaagccucaggauggauuugaagcauagccucagugcugugcuucaaagcuuuguucagggacugcaacuaaaccaacuuaucuaccugaguggcacgcccugcucuguagagcaggcucuccugcuucauaggcacaagucaccugugugccgcaggggacagucaccugcacagcacaggugagccucgaaggcgucaucugcugucuccaccacuuaggguuuuagcagcagccuggaggguaccugccaugcccgugcuuccuggccagcgccggucagcuuggcagcuuagcagcuuuggucuacaaaggaccaugcauggguuguauagagacccaaaugucugugugguuuugucucagugucagacuggauuugacuggacaccaguauaauuuuugacauguuucuaguggggaacagcacuccaucuuuauuuauuaacuuuagucaugauagguaauauuggaguaaacaaugcuuucaguauuuauuguaaauaggaaaagguuauuuauucauauaaagaaaagcuaauuacuuuuguacuagcuaaucaauuagauauuuacaacaggugcaucugaaagcaaggcugacccuuucagucuauauuuuuuaaagauuaauuuugucuuuguuaaaugcauguggggaugugugcuuguguauguggagggggugccuacagaaucuagaaaaggguguuggauccccuggagcuaaaguuauaggguauugugagccgcccaacuuaugugcuaggaaguaugcucagguccucuggaagagcagcaaugcucuuagccacugagccaucuccagccccucccccccucgcccccuccccggccuaccguccuuagcgucuuucccuauauucccugacuuacagaagucacuauaguccagacgauuacaguggaacccagguuucucuaugacucucucagacucaacauguauuuuguaguuuuucucucaaaaaccuauguaaagcaauauuucuggcucugcaaaaguaugggugggaugauaugcagguauagagaaggcagcaucgggcuguuccucccugcuggggacuggccuugguagagcccuggcagcuaacagugcuucucccagggcagccucuuuauuggcaugcucuuuuaacuuguuagcugguuggccuucuucuucuacuacuacuuucuuuuuuuuaauuucucagcaacugaaagauucauauuguucuaaaaauauugguuccauugucaucuaaucuugccuguuuucccuuaaaauugcucaaaucaaagcgauuuuuuuuuuuuguaaaaauagcugcuuggcauguuuguaaauuaagcuuaagugaugaugaauguaugccaaaguagggucuauuuagacacaaaauauguuuguuuaaaucaacauucaaaucaguugcggucggcaggcuugagucucucugucagggaauacauuuaauauucuuacuuuuuuaguacuagagguugagccuaggucuucaugaacacuaggcaaacgucacugaacuacugagugcuggccccagaccucucuuuuacuuuuuauuuugacgaagugucucacucaguugcauaggcuggucuugaacucacucuguauagcccaagcaggcuuugaacuuggcgccucuuaccucagccuucugggaagccagacuuaacaggccugugccaccguaucccacuuaaauauucucuuaaccucugacuucucgugucugcuuuggcuccgcaguggagguuggucacaggguaugcgugcugcugggagaaaagacugcagcugggccucagcacagucacugagggguggggccccugcacccuuaccaugcugacugaucuguccuuggauacuggccugggucagugcagucucgaugguguuggcuaggcaaggcaagggagacuccugguccaggggacacaucuaguggucuuccaugcuagaguaagaagucucuguuacaaaauguggagaggaggcucauucaucagucaccacccucaucccauauguggcucugggagccacauaccugcccuggccuuccuaggcggacugaggucagacacacugaaagcugucaucgccuugguaggaguuagugaaugucucaccuuuccagggagcucagcugugauguucuacaggauagagagagacccgcagggaccuccuucaccguagugcucugggaaggagccuggguccuacggaaacacugagagccuuuagguuacagagccuuuucacagcagacacuauaugcuugcugguacagcucaacugcuucuacaugaaacccguagcacaccacagugcacacccgggacaccaggguacacgcgugaacacuggcaccugcccccucacagcggcagguggggccccccgugccggcucugcugaguaccccgugcucuucgcucaaccucacgguuuguaggagccugacgggugggugugcccgugacguguuugcaauuuaguuuccuaauggaauggacaaugacauuuagaaaccaggccugcaacuacuuggaagacagagucaaggaagaucaacauucaaagcugcaaagugagaucaaggccagccugagccacuuacaagauacaagccuguauucuuggaaguggaaccaggaacagcgacugcccaaggucauccucagccacacagcgaguuggaggucagccagggauguaugagaccucgucucagacaagcaagcgggucuugucuucuugucuuuuuuucccuucccucccuuccuuccagacggggucuuucucuguagcccuggcuuugugucauagcagucaggagauuuuaauuaccuacauuuauauaaaaaccuguuagcucacaaggaccuuuuguggaggccagguccccggauaugccaccccagcagccucccagggcccuuuugagagcuggggggcugccaucucugcucgcuuggagcccaacuagagcaccuggcugucugccgcccagcguguguuugacugccgugugccuuaccuaccaacacuuuccuggcugcagagaucacacuccugaguccugccuguuugugccccucucagccaaagccagguggugccuuaaaggcuuugcaugagacuagaaaguccauuugcuucagcaaggcugacaguagcagcagcccggccaggcuaugcaugcuuugugccagucuauccuggaauaaauguagccuagaaauccucuuaugcaaccgauggagaucugcagaugguaguauuuugagagauggccuuuuauuucuuugccuuuaggagguuuucgcuagaaggacccucuuugcagucaaagagccugccguguugagaauggucucagcacaacugaaaagcacacgcugaauuucuuuugcucugaaucagaguagaaagaauuguuguauguuuuaaagaugauguucucuaaguccagacuuuuaaguuugguccaggauuaguguuaagugcaccucuuacuuauuaaauguuuaugagucuuugccugccuauacauaugugcaccauaccauaugugugcagugccuucagaagccagaagagggcaucagaucccagaacuguaguuacagauguguacucccaugugguugcugggacuugaaccagaguccccuggaaaagcagucagugcucuuaaccacucuagcccccugcccaaaccuuuucuauuuaaugagccuuucuccuaucuucauaauuuuauaaauuuuugaaguucucccuuuugaaguuugcccacuuguucagcuguaauuuaccuguugaagcuuggcaguucaagacuaaaugaaacuggagcugccucuaccuccugcuccaccauacauggaaaccaggcuccuuuuucaguguauucuaaaccuaugucaugcagaagacagucguuaugggcuaauuggcgugguuuauaacauugagaggauccaaggggacugaagaccggccuuucauucauauguauuccuuuuagcaauggugauacggucuaaaauuuagacuuuagcuauaauuuagacucuaaauguaggcuaggaagauagacccgguccaggauuaguguuaaguaaacauuaauugaagaaaacugaauuucccuaaguucuugcccuaaggaauucucuaccuacgcaugccuauauuuaaacccucccauuccuucauagcccucccgcuccucugaccaugcgggaccagugucagacgucccugcaaauugcagggggacaucgcaaaugucuguucuguguucccccaaacgucugucuguuccgugcucccgaaucugcuuguuagagaacugacaagcccaucgggccagccaagcccaugcuuaacuuugucucugucagagugcagauuuuagacuucagugagggcgagggagggugcagacaugucugucaguccuucuucacucauuguaauuccauccgcuuugcucccucgcccgagaagccuuauuggaacgcaguaguagauggaugucaucguuacagagaaaccucgaauuuucuaaaaguaacuuagcucuaagugucaucacucgaagcccggugugucuugccccccgacacccauaggccuuugcuggccugcauccaagcuguauucuuagcguuaaguuggaauacagauaggaaugugaagaggcguccccugagccucaccagcagagcagccugcuccggcuuucuuuuuauauuucaaauagccuucaugauuaccuccaccauuuuagcucaaaucagcaaagccucuuauauuuucucugcuuagguuuuuuguugguggugguuuuugagacaaggccuuccuauguagugauggcuggccaggaacuggcuauuugaaccaggcuggccucgaacucacagagagccaccugccuaccuguccccagagugcugggauuaaaggagugugugcagccauaccagaaccccauacacacacauacaccccuacacacacacacacacacacacacacacacacacacacacacacagagagagagagagagagaaacacacgcuguuucuuaacucaaaaauaaacgugccuugggauguuccuagugagcagcuggaaaaucccccuuuggggcagaggccuggaguccccaauaacagcacccaacguucccccagauagaggggacguaagccagcuacuaaggcucuucauuugacuaacacaucggucagcccauugcccaagaagcugaaacaacaggaugcugaguuugaggcuagccugggcuauauggcaagacuuaguguggaaauuuaaaagaagaagaaaagaugcuuucucuugaaggcugagggaaggacauagcuuccacgcggugucuuccuguguucucccagccugcguucuccgucacagcccacgagagagcuuggugcuccaugggaaauaaguucaugggaugaugucacguaggccuuggcuuuguguguugugucugaggagacagaagagugucucugugucggaagaagcgugcguccucucuuaguaacggacugcucuucggaagcuucuuccguguuaaucaugucagggcuuccuccuuuaaauaucauuuaaagucauacucaguuuuacuguuuuuauaguuuugcuguuuuaaccccaugaaauugagucgugaucaacugcauuuuccuggcuccucgcuuaucuuauuuuuuuuacuuuuuugcguaugaguuucugcauguauguucgugugugugcauguaugcauguaugcaugguacgcauauauguaucguaugcaggcauuacuugagcaauccuccccucuggaaugucgguugugagaugcugagugggugccgggaacugaaccugagucccccacgagaacagccaguguccucuaacacugagccaccucccagacacuucuccuuccucgccuuuacucucagccacaacagcugcuacagccucugagaucuuuguuagacuccaccucucugggcagcagcagcaucagaaucagaagauggcacagagaugcuaggcugccugcuuccugcaacaguccaucuuaaaggccaacccuucucauuggagagcuggaugccccccagccucaguccuagugaacagagaacagauaggaagcaggcugaagcugaggcaggaagaucucgaguuugaggcaagccugggcuacacguaccaugagaaugugucaaauaaauaauuaaagugcgcauaaaacuccuuggauguaagucaguucugcucauccguguggccccccuaacucuucagucgcccccucagagcugagugauucugaggggagagaugucuacuuagaaaucuuaguguuggguuaauucacacucugaaacuuuguagcucuaacacaccaaggaaggcuguguucgcuggaagcaugcaguugcuggcuggagucaagcugugcacaggacggacccuaaccaaccacccacacuaugaagauaaaagucugagagagcggacccaggcgguaaggcccaccuuugccugugcucacaugcccuguacugccagcaagggcagagggcaggucucccgugccaggagaagaggccagagcauaagggcauggggcugucgaauccugauucugccuuuuaagagcuaggugcaagcacaugcuccucuuagguagggaaagggcugagaggauaaacauccugcaguggugggugggaguguuuaagccaaagcccuuggagcuugggguuugggaaggaaagggucggaaauggagacauacugaucguguuucaugaaucagcucugggccauuucugguaaggcagggugauguugggauguuugcuguugcucuuuguucaaauagauaauacagucacauaguucugagcauacagaagggaaaggccugauacauguucaccccaucccuguauccuaacuccccugugccucucaggaggcaaauagcauguuugucugucugugugugucugcgugugcauaugugcccuugaucguggugcccacagaggccagaagagagcaucagcuccccacugaaggugagguuagaaguggucaugagccuccugauguagugcugggaacugaacgugggaucuugaauuacaaaaauaggaagaacgugcgcuuaccacugagcuaucuccccagccccauauucuuagucuucuuacaaagaacuaccauaguccaccuuccuuuuccuugacacuauauucaggagcuaacuauacuagugcagucgcacugucuauagcuggaccucagaugaaaacaagcaaggcuagugagccacacccccccaacccccucaugaccauuuugaaagcuacaaauacuuucuguugugugugcuggguucuauucaguccuuuaggccacuucugucacgcauagaguggucaaguguguaaaccuguauauuuauccuuucuguacagugucuacugauauaucgagucuuagauagguuuuaucuaggcaccuucugaacaggucauuucaguuugcaugcugggccguggugcaggaaggugccugcuaucccuaguccucaagaaugaggauucaguacuggucgggggggcgcagggggugauacagggucucacuuuguagcccaggcuagccucaaacuugugauccuacugccucagccuucugagugcugggauuaugacccuauccuaaugugcccauacuaaccacuacuuuuuaaccuaauuuuuaauuauguguaaaugggguacuuuggaggguugcugguuauagacauguguacaggugcucacaaggccaaaggcaucagauccccuggagcuagaguuacaggcaguugugagccacccaacauggacccugggaacugaacuuuaguccugugcaagaacagcgugcucugagccuucuugcuagccccugcucccuauguuguuaguuuaagagcugagaagguuuugucuggcugagguguuagcagauagacccaugauugguaagacagaaggucccauuaggaguuagccagcaccacuuagccuacagagcuacagacagcucugugccacugccccucagagguaccggguauaaagcccccaaaacugaggucccaaggucaccagugcuggccuucagucaggauucagucuucagaacaccucagccaagaccaccuugcuguccucagcaggugauaaaaacaggucacccucccgucucacgugucccugugagugccucagccuucauuaggcccucacacacagccaaguaucaggaaucaggaccugcugcugggccccaagcuaacguuucccagaagcguugguucagguggcacugugguggacuugaagcaggcauuaaagcccccgggauaggcugcuccuacagauucccugaaauucuccaggggaagugucgagguggagggugaacgcugagccugugggcuuucaaggauacaguguaacagccagaaagcaacagagccugcucuaagccaggccagcagcccuuuccacuugccauugugggaagccaggccuccaucauagauguacacgugcccaaaaggaaccaccagccugcuugcuugucugguagacucagccaugcuuaauaauucuuagaauuauaagaugacucaugcuaaauccaaguccuuuuggcaucuaagcuagauauguucaauucuccacaugucuauaccccccaacuccagacugacuggcaggaugagaguggccugggcagagaggggauuugacccccaugcaguugagggcugugugcacuguuccauuuucaucucauuucgaagguuuaucagaucuaugcgaagaggucgccagaggaagugcacgcacugcugagguccuuuggcacugacuucgugauccuggaggacagcaucugcuacgaacgcaggcaccacaggggcugccggcugcgcgacuugcuggauguggccaacggacaugugagcauguugccucuucauuugguggagcuuucagagagggugaagaaaacccagcacgaaucccaagugauagacaucaccuucuaccauaugugugaaugacauuacaagucagacauuuguagagguccugcucuuuagugacaucggggacugggcuaggggguggaaaagcucuggauucccaguuugacucagguagagcgccccugccuuuggcagguuugcaugauacaucccugcauaaaguuuauuuguaaaggauauuuuuucugcucuauacaacacaccugccuguaaacacacugcuccagggcauccuguuggcacgucucuaagugucaggcagugggccacccucuuccaggccccguggcccacacauccuguuccucuugucccccauccacacacagccucaggagagcuaagcuuguccuccacagcagaacaagccgugucucccuuggagcugagccagcccacauuaaacggggucuuugucccuugcgggcuaugguguaaccgauggugugaaagccgacgguggagacuagccugaauccgaaagcacgccugcggugcugaguuagagucagguuuucgccaaggaaagcaauaagcaguacaugccgugaacucggggugagcaggacacaggccugugagcugugugucacuuuccucacuuaaccucugagcuggagaauuuucuccaguuguaguucuuugcguuuaacguuuguggaggggauaggucauaugcuuccagggacuggguggcucggucagcuuuuuaaugcugugacgaacaccgugauugaaagcaaccuggagaaggaaggaugcgcuucgucucacagcucgcagucugucccaaagggaacugugaaagaguacugcauacuggcaugcucgccauggcuuacuuagccuguguuuuuauaccauccaggaccagcagcccaggaguggcaccauccacaguagccuggucccucccacaucaaccagcagagagccccaucgacuugauuacaggcacucaaaagagcauucucucucagaugauucuaguuuugucaaguugacaaaagacuagccagggcacaggaagaucuugaguuuugguucugucccgccaugaacaguguggcaaaucccaggacacaguucuuuccagccuugauuugcucuuuguaggaggggaguaagguggaccuucugucugaucucugaauggaguugauacugauucuuuuuuggcaguggguguggugacagaugcuuucaguaccagcauucaugaagcuagaguuggaggauuaagaguucuaggccagccgggcaugguggcagaugcuuuuaauuccagcacucaggaggcagaggcagguggauuucugaguuugaggccagccuggucuacaaagugaguuccaggacagccagggcuauacagagaauauacagagaaacccugucucgaaaaaccaaaaaaaaaaaaagaguucuaggccaaccuggcuacauagugagguccuguccccugucccucaaacccagaauaugggcuggauguaguggugcacgccuuuaaucccagcacucaacacagaggcaggcauauauauggaguuccaggauacucagggcuacauagagagacccuguauuaaaauuaaagcgauaaacaaaagccaggauguucaguagauacauagauagauggauggaugggugggugaguggauggauggauugauggauggauagauggauggggcccaccaccaccacucacauuguaucuguuuuguuuuguuuucaggaaauggaugggccaggagagagugacccugacuugagaccugcagaccacccucgcuucugugaagagauuaaaaggaaccugcccuccuaugcagcccacuucacuagaguauuccagaacaagacauuccaugucuacaagcuguccagaaacaaauaaccacagcuguucuuaaaacugcagugcaucuacagcugguggaguucgcgucaggagugggacuugaauacugggguggcagacggccugcaggcaugucccgccaucaucggaaaugccuccugcuaacguuagccuuuucuguccugucucugucuuuucugugaguguucuuagccucacaggugugccugcccaaggcuggcuaggaacuuugucauugagggaauuaugugugacccacuggguggccugggaagugagagccucuuugagaucugaaauacuugugauuuucagugacccugagccagcugugagugaguguaguugacaggccgcacaguucagucacugacauuucuucaccgagaccgcuugguggcuuuuuaacaguuuauuguccugucuuguuaaaauuuuauaacauuuccaguuuaccaugcuuucacaugugugaagaaacaaauuauuuuaggucuuugaaccuuaaauauuccauucaugcucuaagaugucacacacauuuagaguguguguuuguuuugauucugggcacagcagucagggugcuacugggccggcauggugacacacucuuuuaaucccagcacuugaaggcaggggcaggugaaucucugcgaggucgaggccagccuggucuauauagugaguucugggccagccagggcuauguaaagagacccugucucaagaaagcaaagugugucagggcuuauaauagaagucuuugaggggaaucccuucaugcuuuuuaaucucuccugcaaguaaaauaguuuugcuucacuucuuacucauuucaauuaacuggguuugcaaaacuugguaaacuuuuuguguuuuuaaccuuuauauuuuuucagagccuagaaacuugcaaagucugaggcuguuuuagaugcuguuccaugacuccuagaguucuauguggcauuucaugcucuuugacuucuggccuccagucuuccuucucagcccuggagacaucgugucccucccuacaaggugaccaagugccaccacgcagcagagagaggugguguaccugcucggaguuuuugauaauugcuuuuauaauucauuucuaauggugggggcauguaaaagcugcugauacaggcacauuguccacuuaauuaaaucaagagagcuaaugaaauuaacuuuucccucccgcucuugccauuuggaagugauuuaaauguuuucuccccgcgcguuaguguaauaaauccccacgagcacaccggccggagagccccgccgggccgcgccgcagugugguugcugcuuaaguagcauccaaaacuguguuccagugucucaucggguguggggguuuuauguaaaacucacucaaauaagacaucgacagcuagguuauuaaauuaagcccuuagaacuuuggaauccugccuccucuggaccccuaaauagggugggagaccacugcaguuugggcuaacaacacaaggaaacauguucaccagugcuaaaggcuuaaugaggcuguagugccugcugcggcugcccgcacugguggagcguucugggccagugccuuacccuuaagggaaagcaagcacagggauggcacagagcacuggggcccggugaugguuacuuugugggugaguuugcauuuauguuaaacauuccugcgugcauucaucuaaucacuugguguuuggugucuugugauccaagagccguggacuuaaacuuggaugcacauccuuacugugguaacauccaugcuaguuagugcuccgucuccaccgcaccauugcugccaaaccacgaugagaagugccaaaaaccagucuuccccacaggcgcucuccccgagacacugugauauguacaggacauuguuagagcaaauuuuuuucuuuaaaaauaaauuauauauuuaaaaaauuau

SEQ ID NO: 3728 - RNA, 3302 nt, Mus musculus
cagagaggcggguuaaggagagcaaugugagguuucaggaagucagauacagcguaacuaagacgguaucuuagaguguauuccuggcacgcccgcugcagaccagaaucuuccaaaccaggucaaaggcacuaagaaauuucauauuuguuggcucuggacuaagcaagauauuucuccccacccuagugcccaagcccucccuguaagggaugugggagcauuccugggcaugcuauaccccaaaggaacagaguaggguugcggcagccauuggagaaaagugcuccccagaggaggugcuagcaggggcuagugaagacggguaccgagcaggaaaugaguggacagagucaccaaggagauuugauguuucuauaggcaggagggaggaagaggacucagggucugacagagggucuggagccagagggacaccaggucgccucgguuucccguggccccuaggucugcagagaauggagggaggcggccagcaagugaaagcagaaccccuugugcagaugagguuugcgccccugcagagagagcacuuuuccacggaucuguuuuucuuuccgacuuuauaguuaauuuauuuaucugaccacucgggaaaggaaaggaaguacuguuuuaugaguccaggacaaaauaaaaaacaauagcacauuuacgugccuuaauuuuuucugcucacggagauuuauuucuuuuuauuauguuugacagcagccaacaaacagcaaauacacggcagagugcagcucucucagcacaaaaugguuuguauucucugugcucagggucgagaguuuuuaguagauacaucauuugagguuuucagcguugaucccaagggguaacacccaccauccuccugaugcagaugaagaggugcagccaaaucauggcuggggaggguggccccaacaugaggguguggcuccccuugguaggaggagguaucagagaguguaaugggggugggcccuuaguggaggcgcuaggauuugaguuagugagauguuugugcugcggggcaaguuguaugcaugcucacaugugugacacacuggugggucucagcagcaaggaguuacauggucuaauugucuuuccuagcagcuucaugagaaguuauaggccuguggaauccuuguccuaggauguuguccucuguagaaccuggacaaauaggcuccuugggucucugguucagcuggaagcagccaaaguguuacaguacucagaagggaaaccuguacagggcagauagcaggggucccaggccuuguugcagcaccaaugccagcaacaggcagugguggguaguggugggcagcagugguggcagcaguagagguggcagggugugagcuuggucugucaggcagguccaagguucaucaaugaaugcuucaggagagaaaaaucuucuucaaaaguguuauagcccaguaaguagccagauaauucucagugggaaaaaaauaauaccugugcacuuuauuccauguggacagggacuauucaaacauugugagauccagggauagaugcuucccauuggcucaauuucagaugcuagugaugcucuauuuauauggggaaggacuucaggcguuugcccuauguggcugauugucaugguccucucagugaggugucauagguacauguuuggcaggaggugggccuuacucauaccauucucaauucugagauucacagggugugagcucacucaaccuuaccauuucuucugucugguggcaugguccacuugccccacauuagggugauucaaauacuaauucugggaaguguacaacacugucaaacuaggaaggguuacuggcauuaugggagugggcauuggaugcacuguucaucuaagauuagucaagaagacucauagaugcucuaccuauauucagaauuuaaauccuucuuguucuggugccucugauagcucagacuucuagucucccaccuucaacuucagauaguuauuugaaccaguuucuaaagcuuucuuggggugugggcgggugccuuucacuuuguuuggaugcaugggaguauucuauucgacacacacucucuucacacagcaaaugcugugccaccaggcaggagaugggacaggugccucacggacugucugcuuagaguauacaguggagagcaggcuguaaccuuugcagguuuucacugaaggcuugggcacagcaccaggacacguaggugcagaugggcaaauagauauggcuguccacggucgacaagcauggccucugccuugcaagaugucccaagagcuauguagccuuccaccccaccagcauucugccagaugccagcucuguccucuucuccacgagcugugauccacuagugauaguuaguccuaaaugcucaguucuuuguuggcauccccgggucuauaaaggcuagcaucugagagcaauaaagucauucaagauccucuucccaauccauucugaacaaugauuuucuugcuuccagcgugcccuuggcuccugacuacagugaaccccgaauuucccaagaccuuuguaggaauaaucucauccauguauguuauguucaugccccacagguguguggaccuggaagacgacagcuuucugcagaggcauuuucaaauuuccuuuccuuugaggagagaaacuucuggaaacauugugagcaaguaauuccaguguucguuucccccccacuuaaauccuaccaucugaaucuuauuccgugaagccuauagcaacuguauggauguagucaggaauucaauuuuauaaugacauuagcagacacaauaugcucugcagugggccuggcuggcccuugcaguugcagagacaaagagggcacagacucauccuaccaagaugaauuaauuacucagaguauuagagacacgggcauaucuucacagaguccuuuaacagcuguagcaaaugacuaaugcuuggacagaagucccagaagggacaaggaaaugggaggagagauugcccuggguggggaggaaguuauuuuguacuuguuggguuuuacuuugggggaaauaugggguuccugcacaucccugaaauguuagacgcuagauguuuccuggggucuacaagagaagaaaacagguucugaauacuuacuguccuauuuuuuuuuuuugcauuugaaaauaaaaacagagauauggccagacccugggaauaugacuccuuuuugcccugccucugccacuggaaguccugcauuaaaggcugcagccu

SEQ ID NO: 3729 - RNA, 63563 nt, Mus musculus
aauaaguucaugaacauagaaaguguuuaauaacagcacacuuaaguuacacaucugaagauccaacaguuccacaaggaggcuugcaucaggaggagguuagcacaggacgccucucauagggagaaggagcagggugugccuagagucggugugaugggauagucugguugagaguaggugauuggaaagaaaagugguuuuuaaguacaaaauauguguacagaugaucaacaacggcuagaaaaaccgagcuauuauauuuuuaggcagccuuuccaauucaguccccuguucugcauuauccauuaacuagcauggacccuagcauaccauuuuaccauuaaagcauguauuucauaaaacucugacaguggcacugcucuaguuacagcugcgacuuuucuaggacauaauuucacuuuguuuaagcaagaauucauuaaagaagcuauaaauaaccucuaacuauuuagccgugaauagaggguggacugggguugauggcuuauuuuaguacugaugcggaaugcuuuuuaaaagcuacauuuuagcaugcaucaagcuaaugaucaacacuugcacuguaauggucaaccugagacugaaugucucuuuaaggaguuuggcuacaaguaaauauaauauaauauuucuuucuuucuuuuuuuuuacugguaggaaagcauccuugaagaaugaaaaugugaggaagauugaaauguaaaacaaacaaacaaacaaacaaaaggccugugcuuuaacaaaguguuaaagcaucuagacaaacuuuuuccccccaaagaauggugccaaugacaacuguguguauggggagaggaggugcucgugggacuugaaaacuuugaaaaucugugguguggccuauacacaaaucaaagacauuuuauacacaaucuaaaccaggaaguucacaacauuuuagaaaccaaguuucauaaaaauuuuacuuccaaaaaaaaaaaaguuguacaaaauauucuucuucuagucaaauuuucccaaaggguuuguguagcuuuuugccuuaaagauuacaguaugacauucaaaggaagaauuuuucaaagaaccauacagcugugaaaccuacaagaaauguagauuuuuuuaaagugccuuuaaaauguaaaagcaaguaauauaauuguugaaucuauuugagauuuuaaaagugucuuuaacaugguccauauggaaagcacaacaucacagcugguacgaaacugccuguguuuaguugaaaacacacaaacaauauaugacaggauucuuugaaaaguaacucaaaacgcuauuccugcauccuaaggccaauuagacaguagucacagaauuaacgaagccagcagaacauuacagcauucaaacauuuacuuugacuuucccaaugccacugauaaaggugagagagcucugcccagccaagcaggacgccgucccaacuccauggccgaauccgccgcauguccuaaagcgcagcuggagcugcaggcggagcccucuagcuucucugcugcaaucgggcagcucugaacuuugacacccucuuuguggguuccucugauacuucugauggaacuucuuuucgcucuggaaugguggggagggcauggugagcaauggcugaguauggugcuagggagggugauaaaaauucuuuuucuauuacaguuccagaaaaagccuguaagacaaauguguauaugguguuaaauauaacuaagacgcacacaaaaaucuuuacccuucauuuccaagaccuuuuuuuuuaaacuaagguaacaagaauuuuggauaauaaacaucaaaauacuaaugguucaaagaaaccagguaauauuauuuuucuuaaguacaccaucaaauucaaggaguuuuuuaugguugacaccuccagcucucuagaaaacaucagugaacacagaagcgacacgggcacaagaggcgggcuucugcccaggcucccuugcuuccuugcugucugacagucagaagcuucguuucaccaaugcugacaucauuucuuuggggggggagguuauuuauucaagaucuuuauugcacuuugcccccguaaaaacuaaaaaacuagaggugcuaagacuaacgugaaucaaaauagcuuuaaaauucuaggacaaucaauccaaugguacaagucagaugugucacccaaaccaaaaaagcucuuucauuguggcuaaguguuuguggaacuucaucuaaucaaagccaacuauguucaacugaaaugagacuaaaugacauacauaucaccacaaugucuugaugugucuuuauauaucaagaaaaaugaagaccagagagucacuucuuaaaaacuaccuaguauuuggaccgucuccccuccucagaacuuaaacacaagcugagaacuuugaaguguaaagagcaagccugugagauaugccacagagacacagacacacaccucagacacuccugagggcaaaggcuucuuggggugguucucuuggaguucguccaaacugcucccgccggccucgguagccacggccuccucagagcuggugcuccgcaggagcccccgccgguccuccacaucggcagcgcugcucucacuugugucgcugcacacgcuguucucucggcugcgagacuugaggauugacuugcgaggaacauauucuccauucacaacauccacgaagacucuacagcauucaaaaaacaacuccauuuuaagggcuuguaacuguaaauuaaccuacaacuuguuuuuguugagacguuuguuugaggcagggucucaugcaacccaagcucacuuuucaccccugguucugccacccccaccucccaaugcuggaaucacacgucucaccaauuccauucaguuuccuugcuaaaaugucuucucuaaaugucacagucagaguacauuuacaacuacacugaauguaccuuauguuacuuuucaaagcugaauuuuggacccaauaaaauacagcauguuauuuauaugucccaggugagaacagcuugauuugccaaaaagaauuuuauacaccuacuucaaaacaccaggaauuuucaccaguuuguaaauauggguaauaaaaugguaggcauuucaaacuggacaguguaacuguucccugcuaugacaggugaauacgagacaaacucaugacaguugugacagacaagaauaccagcuuccaacucuucagugacaucugaagaggacaaaggaagaaccaccccacaccucgcguggcccgggggcuaugagucucucaguggggccugcagucuuugggaaccuccaagucagcgagccuccugcaaaccgggaaggaaggggaggucugcaggcacuaagaccaucacgcaccuguaaauaucagcaggacucuugauggcaggcagcucguggguagcgugacugccggcaccacucuuucguuuccguuuggcuuccucuuucuucucacugaacuuuaaagugguauuuuucccaguauuuauucgaaccuaaaauuaauucacaagaagaaaaaaaucaaaaacuuucaaaaaaaaaaaaucaaguuccacaguaaagaaauaaaucacaguuaccaucaagagauucuguucgaacuuucuggcacugaaauuauguacauggucaagucugacucuucugucauuuccacaacacuacaucuuccucaacagccgacuccaccaccacugacuuuacuacuguaugcaaagcaaaauacauuucaacuaaaguccacacuaacuauaaacuuugccugaccuucaucuuacauguauuugcgacuuaguccaugugcugcuagccugagucacaagugcaguagcagauaaugcucaacuguguaaacugcuuaaauacugcuaaccucagggagaaaaucagacuaaguaaaagcuaaaggugcucaggacaguaagcuucuucugcgacgauccagcauucaugccacucucucccuaacaguccuucuaacaguguuugcaugucuaagaaaaagccuuuaaaagaaggaagggagggagggagggagggagggagggagggagggagggagggagggagggagggagggagggagggaaaccagcaauccuucacuuucaacuguucccccaaaaauuccaaagacccuuuagcuuaauguauuagaauuaauuaaaaaaagacacauguaauuauuucacuuucuaaaaggguaagaauaacuaaaucauaauaauaaguaaacguuuagaugccuccuuacagaggcccuugguccugugaaggcucuaugccccaguauaggggaaugccaggaccaggaagcaagagaggguggguuggggagcagggggagggaauggggaguuucagaggggaaaccaagaaaagggauaacauuugaaaugcaaauaaagaaaauaucuaauuuuuuuuuaaaaaaaggaaaaaaaugucuccucacacaauaaccaggcacugcagauugcccuacugaccgucaagcagggaaccugauugcugcugaccagcucugccuuauagcccaaccccucagauucccuaaaacauacacccaggccccucagcacagcacacagggaaggaagagggcagggguggacugaugguagcucacccuucacccacaacuagucgacuuuugcccauuuaaaauacuucuacaaucagguauggaagaacaaaagcuuuggauacuaagcaaaguuugaaagcaguggaucacaagagcucuauagucacuaucagcuccaaaaucuaaacucuaaacccauaauuacccaguuuuuaucccucaacccaacuuuuccuugcuguucaggauaacaguacucauuugacaccuacauaaaaagaacaaccugguuccccuugccccaaaauaaccuugucuugaagccauuuucagaucugaaagcaaaccaaaagagagcccuggaaugagggcaggucaaccacagucacugcagucaagaguacauuagugggccuucugagaauggcagacugacuaccaucgcuuacuaauuauuguuuuucuuuuaaggugaagcgguuggauaagagaaaaaggugcuuuuccuguuugauagcauugacaauccuagucaauguuaauguucuuucuaaaauacagcauggaugacauuuaaugacuacaaaguuagaaguauacaaacccuuuuagguucaacaguaugagagaaauauauuguuggaauagaauuaucugcugaaauagcauggucacuuucauuaucgucaucuucaucaucaucaucaucgucaucuucuucuucuucaucaucaucuuuguugcugugguaagaauuugagccauucacugaauaguucagacuauugacuugaccauuagggaguccugcauuuccagcacgccuuuuacagcugcuggcggcagaggagucugucacuggagacaccacauucacaccugugucugcaccuuccuuuuccuccucagaagacacucugucuucuccauuugcaaucacaguaucagguuuacuagaugaugaaagaaaauauggauaagauuaaaaaaauacagacaauagaaauaaccgcucuuacacaucucagcagacuguagcuacucaaaacauaagagcucacaggacacacguagauuuuuaucucugaacauuggccagauguagcaugaaugcaaucuaagaaauuugguaggcaugaugguucucauuuuuaaucccaggucucagaaggcaggaagaucuguguucaaggccagcuuuaucuacagagcagcacaaguuccaggacagccagggccacacagagaaacccugucucaaaaaacaaaacaaaaaacaugaacaccuguucucacacacacacacacacacacacacacacacauacacacacacacacacacacacacacacacacacacacacacgcguuaaaaaagaaaaagaaaugucuaagagggugccugcucuaucugcugagaccacuccuaccugcuacacaagaguucugaccucaugcacucuuucuccccaccaccaccuccuucucucuuucaaguuccaaccuguaaagcuucucuccaaaacuaaaaaagagauuuuuaaaaaauauauguccuauuuuuaagaccagaaauucauccccuauacccacaaaccaugauauacuauuauuuucuaauuuugaccucagaaauuuguguagcaacauggacugggaauucguaagauaaaggauuucugcaugugcauaugaauguauauuuacacacaaaugcacauuuaucacgcuucguuccauaaaggaucugaagaccuuacaaaaauaaccgaacuaaaaaugcaacaaaauugaaaugacaucaugcaaaaauagaaggaaucaugacuaagacucuuaaauccagcauggguuuuaaaaaaaugaaauagcuagaaacaaugaaaaauaugaaauaguuacaucaagacauaggugaagugguagggaaaauucuucugcauuuuacgcccuacuuuucgcaaaaacuauuguauauggcacaucacuuaagcaaaauaucuagggacuucugcaguagccaacuucauacagcacucugacaauugugagugcuaaggccagucucagauagcagucuggugacgcuucucauauacacagaaccaccagacgacauuauaaauugccugcucaauaaacagaaaguuuguaaaugaaauacaaggacaaacauuuucaguaucaaauuuaaauucaaagccauuuuuuuuucuuuuuaacaagucacuggagcauagagcauuauccugaaaacaguauaaaauuauaucauuuaaaauuuguuauuuaggagugguggccauggcacuguagaaugcuugucuuacaggauagaggcauuaguucaauccccaguuccucaaaaaacaaacuuuggucacuuuuaaguucuuuuuuguuguuguuguuguuguuguuagcauuaaugcaaucacugacuaucaaguauaauuguguguguguguguguguguguguguguguguguauaauaugcgagaucugaguaucauggagauugugauuuucaguguaaguauuuacacagaaggaaauauccuacaaaaauguuuauauaagggcaugcugauccuucuacaguuuucugcaauuucuucaaugaguacacaccaucuuauaaaugaggaaagauacauauucccuuggaaagcuaaucugccauuaagcaccuuucaaguucacccagcaguucuucuugucucuccagcucuucaagucgagcccacaguucaucagcaucaaauguauucuuggguuuuacaccauuuucaaaaucugcuucaaaaauaucugaaguuuuugguuuggaaugagguuugugagcaauucguuguuuuccuguuuaaaaaggaaaugccaugacuguuagucuacaugagaccccgucuuuugggaaaaguguugagaaagauagggcccuucacaagugcugcucagcuuccugaacccacucagucacccuguucaaagagccgucaccguagccgucuagaaccucaacaucacacaagcacaaagucacaaugcacccuggcuaccaugcggaacuccacccgaguaacauccacucgccacccaaacucaagagaauccaguuaugagagugauauaaaacguccugccaugggauacuucaaacccuaaggcaccgccaaggaugcuuacuccaggaggaauugauagaggcuaaucucuggaaaguucuauuauaauuuuauauaugaacaauacucucuuuuaaauugcuuuauuuuauuugcaacugucaugugguggcaggagauagaucaaauaugaacgcaaaacuaucugcuuuucauuuaaaaacagauuuuucuuaauaaagcaaauuaaaguuuugaaggcgguaaugagaagucuaaaguacuauccauuaugagauuucguucuaccagauaaccucaacccuaucuaucuuauguuuaaauucccaucucaaaaaacaaauaaaucuuuauguaaaaugugacacauauccagaaauuuucuuuuucuuucuuuuccuuuaaaaaaaaaaaaagacagggucugacuauguagcucuggcuguccuggaacauaucaauaugcaaacuaggcuggccuccgacucacagauccauccugccuccacuucacaagugcugggauuaaaugccuguagcugacugaccugaagguuucuaaauuuaaaaacauugaauuauaugugauugacucauucuuugggcaguacuaauucuacagugguaacaauguuuauguuguagacuuucagcacacauaauucuucacuggucacgcccaacaaaauccuuguccugugcucugauaucuuuuuccucuauuucaccuccugaagcacugccacugccugacaucugugaugcuuuagugcaagcacuaugacuagaaugugguuccugccaggcuucccuuuuaacuagugugaacuugaauaauagaugcugaaaauauucuggcaggcagugguggcacagucuuuaauaacagcacuuaggaggcagaggcaggcagauaguuugaggcugaccugguuuauacagugaauuucaggacagccaaggcuauacaaagaaacccagucuugagccccuacccccccaccccccccucccgcccccacacacacaccaaaaauaaguguucuacaguuguaaauuacaaaucucuuaaacuauucaggaccuuaauacagaacaauuggcgaaggagucacuguuuucacaggauaaucccgaacuuacaauccauccuuggcaaagacguuugacugggcacacacaaaaccacuguagguacuuagaagcacaggcuaaaacaugugcauaguaauucuucaaaaacacuaucuaaagcuuaaagagaaauaccagcagcucgugacggggccacagucaaaggugaaaugaggagcagauucaggcuccugggccuuaaggggcuugagaucauuagacaguucucgagguaggaaacaguugugcaaccuaccaccuaaauauaucagucagaaagcaagcuuuucaucaaaauucauuugcccauuaaguucauguaaaaaauuaauagauuuuuggacugauguacucacaaauuuaaaaaguauacuauauaaaaaugccaaauguuuccaaagacccuuuaaaaaucaauauaauuggcaaauaucuaaauaauuuuauauuuaacaaucucauuacuuaccuuuaaauucaaagucacuuuuaauuucuucucuuaugucaacaaaaucaccugcagccuaauuuuuaaacaaggaaaaugagcauauuaauaauagaaaccucuaacauauuaccaucaaagcagucagacagccuaagaaucauggcuggaagcaaugagacacaaguaacuugcucugacaacaccacauuagaaaaggcaaaagaagaaaaacaauacccacaucacucaucuucugcaaaucuucugugaauucaacucuggauucaaaauuuuucaacacuuuuuuaaaaucaucuauuguuuuucuuacaucugaaaacacaaacauagucuucuguaaguguagcacacacagcuaagaccuguacggcauucugacugcaauacuguaacacugcacauaggagcugacaauuucuuuccaaagucgcaccuuacuguuuguuuucauguuaauagaucgguucaaagcagucauguuguagggguuuguuugcugcuacauaacauaacacuaauaaacugucuaaugucuauucuuuauauuauauaauacaagacuaaaccugugguuacagugcuaccaaguuccuuagacuaagcaacuaauuagacuguuuuagaaaaagcaguauuuccaaaguuuuuccuaaaugacuuuucucugcuggauacaaauagauaauaugaaucgauaucuaaaccaaaaauauucccgaaucagaugacugaaaauauacauaccacucauuuuuacgacauagucaaccauuuuccaagguuaaacuauaaaggcuacgcauaacauguccccucccaauuuccccuaaaugccccucuccuuuguaaguaaguaguuuuaucucaagugaucucuaucuaguacuggccaaaugcaacaaguccguuguuccugggguggaagcugaacccucucagcuaguugucacagcacagggguuuucuggcgacagggguaagcugacagauguccuacuuuucuccaaacaggacucuuuaggcucugauaaacaaugguagagaggcucugagcccccucccuaggucucugugguuucccacuguuuuacagcagacacucaaucaggaagcagaucagaagaggauggaggagaaaaguacacacaguuuccucuauguccaugaugaauggaggucuggcaaaggucuaagcaguuaaaauaucuuuuaaaagaaugaaaauaaggaaggguguuaaaagugaaauaucacccacauucgaggcugcuccaguaguagcccaucucugauacagcacucaggaugugcuaugcuauuuuaaauaacacacaaucacuuaugcucagccaugaauggguuacaaaaaaaagacugcauuaacaaaaugaaaauuacgguguaaacaguucauaaaaucucacagcccugaugucgcucuagaucauuaaauuucugcaacaauuagaccuuuucucacggcagcaaauuggaccgguugccauggcaaaucugagcccuuaagucauauaucuuugauugcagaaaggucagacucagacagccuaauaacucaaggagcuguuugacagauuucauccgagcauggucacauaacagcauaaaacuaugucggcaguuguuaaaagcagggggucagggaaaagguuaagguuauggaauguuuuugcuucaguaaacucagucagauaaugugucuaaccagcuuuagauccaaagaacauuauuuuagguaggaggucaaaucaauaacuuuuuucaggaagacuggaaaauauuaaaaauggcagguagguaagcugaguacauuuuaaaguccagccacaucugaaugcugugcaccuaagcuaaaaggcagcagagaaagcaaucgaaggcuggcgcugucucccacucugacgugcugcaggaccuacucccaucagcuguggugacucugaggaaacgucuccuaagucaugcaugcaagaggcagcugugaauaccucacuguaagaaaccaacaacacugcaggaaagagugggggggaaacgguguauaauuacauguuguucuccuuacaucuagaaagcuuccucaguuucacauuaagauaaacuagcaguguagagaaccaacucacauacugugcauuagaaucucagaaaagacuccaguaacuaagccuauaccaucaugcagauauccacauggaaacacauggacaacugcaaaaaccaaaccuggugcucagagcacuacagaauaauggcaccuauucugguuuuguucaagacaaguaaggcaaaauacaacucaacagguugguuuuaaaaaaaaaaaaaaaaaaacagcaacaaaaacaccaacaaaaccgaccacgaaacacaaagcagcaucucacacggcccagcuccuuucuaucacauguagcucgccuuaguagccacacagcuguacugaguaaagcuggagauuuaaauaaacacauucacuuaacauuucaaaccuaacaggaaaucuaagaaaggcaaacccccaacuauacuugaaucacacgaaacuaggggaggacaugaaaacacagauauggugacaccuauguucacuuucauguccuugucaucauuaaauguuauaaagaaaacaaguuugaaugaacaacaacaacaacaaaaaucugugaagguauacaaaagaagauaccugaagacccgaaauuacaaagugaaagcuaaaacuagagaaaaaaacaaugaguacuuuguggcaaagaggaacaaaaacauguuuucaaccgcugaccauuuuaguuaaauguuauaaguuaaauuuuauaggaccucagaaguauaucagcuguaguuucuauuucuuuaacuaguaaaauuaggcugcauauuauuucuacagaaaccauaauugucacuuuuaaauugucacuaauucugaauuaauaauucaucuaaaaccggcaagaauucuuuacaccagccacaauaaagaaaaugacagcaaaaugaauauguaaauuuuaaagaucacguuuaaauuuaaaagaauuuuuaaaacacuuuuaaguggccauuuuuaucuaaaggauaaauauucuacuuaugaaaaacaaauauuuagaaguauuucauuuauggaauuauauauaugaacagaauaaaauuauagaaguaaaaaaauuauuuacagcgccuaguaaaaaguuacaggcguccauguaaaaugaguggcgugugcugagcagcaucaacaugcaaauacacaucucuucugaguccucugcgaccuuccauucccaaucccgucuuuugugugccaggaguuuucaaguauucucuaagcaguuucaacaggccaugcccccugguggaaacgcuugcaagccuuuuuaagggagugucucuggacuuacacuaugaaauggcacugcaugugugcuuaguguuacuccccgacagaccucagcaaaaucugauuuuucuuuuaaggcaaaacacauaaaggcguugggagaagaaacaaacauaaagggacuaacacgugaauccuggacaaauaauaacugcaggagagaaagcugagcuggcaccuacauaggccaaaggagauggagcaagucacuguggguuauggaccaggaacgguaacuggcuugggaaaaggaaacuaaaaucaagaucuggaaggcauuugaaaggcaccauaagguccaaaauccuugacucugcacacgcaggugacucccugcuucagcaggagacuggcugcuuagagugguaugcagggaaauguuaucuggggaaagagcagaccaggaaagagcucagugaaaaugauuaagcaggcuuuccuucaaggccuccugcuugguucccagaacccagaugaagaucagacuaacacagaagcugcuacuugaagauuguucuagagaaaaguccacaacccccagguuuuuaucagcuucuggggaucugaacucugaauccucucauaaacugagcaauaucuccagccuaagacuuccucaaaguguuuaacugaauugugaaugguuggccaaaaucaacaccccuuggaaaacagucuuuaauauuacugacaguaaaagaaaagagaaaagaugaaggaagaaggugaaaagaaauaacaaaacaaaaaaaaaaaaaaaaaaaagaaaucaaaggugauccaaauauauuuuaggggggaaaaaaugccaggcauaguggugcacgccuuuaucccgccgcuugggaggcagaggcagguacaucucucugagcucaaggacagccuguuccacacgugaaugggaugaguacccggacagccaggcuacacagacccugucucaaaaaaaagacaaaaguuaccaugaagcaagaacaagauggcaggagguucuaacaaaagaacauucaaaaaacaggggggaaacuuuuggaaauaaaagaugauucauuucaaagaucgaguagaaaccacuucaaaucucaaaagagaauucagcacaucucaagcacaaccuuaaagcaaacccuuaauguaaaaauauaacaccuaaaccaguaccaugccaaaaaaaauccuuuaaacuuuccaguuggcagggcuggagagcuaggcaaugguuaagagcacuugcugcucuuccagaggaccugaguucagcucccagcacccaggcggccuaaugaccuucugggccaucuaaugcaucugaggacaccugcccuuaugugugcaugcccacaugcaggcacauacaccuacauauaacuaaagaugauaaaucuuaaaaaagagaaaaaguguauauugacaauagaacacacaaacaaaaccaacuauugaauaauccaaaagagauuaagaaacuaagaaaaaaaaguagaaagaaaaaauaaaucauaagccuguacccaaauauauuaaaaauuacauuaaauauaaacaguccauauauaacuaaaagaaauugucagauuagaaaggaaagcacuauguuguauacaugaaaugcacuuuauuaugccauaauuaucacagaugucagaaugaaaaaacacacacccagcaaacauuaagcaagaaaccuauguagaaagaaucaggaauaaaggagaaaguuauacaaucucgaaggagaaacgucaacugucugcaguaccugaaaauaagccucaaaacacaugcaacaacugacagaacugaaggaagaaauggccacagccacaaugcuauguggagaguucguucucuccacgcugaacacaacaaaugaacagcugcaguagcaaacaccaccaaccacaacacacaagacugcauguugcuuguaccacaacagcaaacauauucuucuccaggacaaagcacucaggaagacugagcccauccuaggcacagcaccaaucuuaauguacucuaaaaaccucccaucuacagacagaaccacaauaaaaccaguaaucagcaacacaaagaaacccucccagcauguaaaauuaaacauguccauuucugggaugcaugaacuguccaagaccagcauguaguuccuuuagauuuugagagccagacuuggucuccaucucauauuacuguuuucccccucucacaauuuuucuuuuauuaauaagcuuacauuuauacauaaaagcuggggucacccagcuauggcccaaagucacagcuuguccucccuaaccuaaacaauuagugagucaauaagcacaucccaagacguaggacuucaguuaacugacagugaaaacacaacgugucaaaacagaccaucgcuccaccaccaacagcagaggacaagcaccacaaaggcaacccuagaacaagcagaacacauucuaauaagcaaaagaggagauuaccaacagagccagaagcugagcuccgagaucaccgagaucaguguaccccuccgucucaccaguaauacgaccauuaaaaucucugugagcuucuaccaauuggguaucaagaacacucaacaccuaccugugauagaaagugucuacugauacaucaucaagcuccuggagaaugagagguauaaaucuaauaccugcccaucugagaaccacuacaucuagcuacacaaaagaacaagaagaagccaggcggugguggcgcacgccuuuaaucccagcacuugcaaggcagaggcaggcggauuucugaguucgaggccagccuggucugcaaagugaguuccaggcuagccagggcuacacagagaaacccugucucaaaaacaaaacaaaacaaaacaaaauaaacaaacaaaaaagaacaagaagacacauguuagcaaaagcaagguuaaaaauaggacugucaccccaaauucauuuuaaaagaaaugaguacuuaaugcuacaaacaauuuuaauagauaaauuuaagaacuuaggugaagucaagcaagucuuuagaagucagaaaacaucacucucccuggggaaaacaauagucuaagcaaugcaauaucuaguaaagaucuugagucuguagucaacucccuucugucuucaagugauuuuauugguaaaugcuaucauauauuucacagcaccaguucuauguuguguguuacaaaaacacagacagaacauuccccaaaucacucuacaaaucaacaaaucauuagcaaaacauuugguaauauacaauaauauagcauggccaaauauguaccauucagaaaaaucaaucaauauaaucuaguauauuaucaaaacaaacacaauaccaacauagcagaaagaaugcauucaagaucuauucauuauuuuuaaaaaacaauuucacaaauuagaaauaaacuuccuuaauauaaaugaaaguacugauuuaaaagaguaacaagccuacaaccaacgucucucguagaaaagaccaaaugccuuccucagcagaaacaugacaagaccagcuucuugugggacgccuaucagcaggagaggggcugccuaugguucguuugccugcuuuuggggcccuuuuccuuaaacuguuggccuuguccagccuugauacaaggggaggugccuaaucacauuguaacuugaugacauauuugguugauauccaugggaagccuucccuuuucggaaaagaaaugaaggaagaguauagauaaggauugggaggagauggcggaggggaacugggaggcaagaagggaggggaaacaggucagaauguaaaaaagauaauaauaauaauacaagcccaggaugcccauucucggcacuuucccucaauuccauacugaaagcucuagccaaugcaguaaggcaagaaaaaggaaauagaagguaugaacauaagaaagugaguuaaaacaugucagcauuuauaaagacacaagugucuacagccaaacuccuagggcauuuauucacugacaaagguuuacaugguuacaugguacaauauaaacugcacagucuuuagaaagucaaagguguccuaaauagcaaguacaguguacagucuuagaagacuuaguauaguuaagaugucaauucuuccuaaacugaugcacagacuuagggaaaugccagucaaauauacccaggauuuguugcagauagaaacaagcuguuucuaaaauguauaugaaaggacaaaggaauugaaaucaccaaauuucagaaagaacaaacuagaacuuacgaaguccuggguuccuaaguccaauaaagcacacagauucacagugacuaaucuuaaaaacacauuacaaaacuacaguaauugaaacauggauggacacauuuuguucagagaaacaaaacagauggacuagaugaaugaacuauacaaagaaaaccaauagccaauuccuucauuuuuuaauaauuuuagugaagauccaguuuacaugguauacaguuugcccacuuaaauguuugacauuugccugcggcugugcaggcaucaucacguauggacauucucacacgugcagcccugaacaguuacacugcccauccuuccucaaaccuuccuagcccucaacagauaagaacucacuuucuagugucuaaaucugcccuacuaaacauggcauagaagaaguugggccuguguaacugguucuuucccuuggaauaauacuuucaagacauguuucucuccauugucaaacuauauuucacugcauggagacaauacauuuuaucuauuucuuagcugauacucaagcuguuuccauuucgaguuaauaugaauaaugcuacaacuagggucugcacaagguuuuuuguagauguacauuuuuauuucguuuauauauaauacuauuucugcuaugucccauaguaaucuagugcuuauguuuugaaaauuucuaauuuucuaauauauaccaguuuacauucuuaccaguagcauacaaagguuguaaauuuuccacacacacacacaaauucuaacuacccugguagggcacuuccugugguuucaaguugccacuucguuucaucaaaguggaaagucaauuguggagaaaggaugcuacuuucaaauacaauguuaaaacaacuaugcacucacucauaagaaaagugaacucugacuuauaaaccacauaccuaaaacaaaaugaacuuaaacaugagaaaaaucauagauacugaagguaggugaaaaacucuuaaauaugaugacaaccacccuaacaagaacggcaacaaagaauuucaagggcuggagagauggcucagugguuaagagcacugacugcucuuccggagguccugaauucaaaucccagcaaccacaugguggcucacaaccauccauaacaagaucuggugcccgcuucuggagugucugaagacagcuacuucguuaaauaaauaaauaaauaaauaaauaaauaaaugaaugaauaaauaaauaaauaaauaaaucuuuaaaagaaagaaaauauauuauaaaaaaaagaauuucaaaauuaaaaacuguucuggagaaacacaaucaacaaagaaugggaaaacaagacauagacaagagaaaacauacgcaaaccauauauucaaaggaagagacagcuucaacauguguaacaaacugucaaaaccuucucaaguuccugaaaagcauaucccuuguggggcuggagagaugacucaguggucgggggcacuggcugcucuuccauugccagcaaccacaugguggcucacaacaccaguugucaggagaaccacgcccucuucuggucucuguggucacaaucugcaugugguguacauauauacaugcagggaaaacacuuauacacauaaaaaucaaucuaaaaacuuauuuuuaaaaaauuacaaccuggggcuggagagauggcucagcgguuaagagcacugacugcucuuccagagguccugaguucaaaucccagcaaccacaugggggcucacaaccaucuguaaugggaucugaugccuucuucugguaugucugaagacugugacaguguacucauauacacaaaauuuaaaaaaauaaaagucugcucaucuuugauaaaguaacacauguuucccaugagacccagcacaagaggugugugcagguuaaagucuauguacgguauuauucuccagcagcuccauucacacuugcugcauguguccuuccaaagcacugagaaggaaaucuaugcaugguaucagaggcuacucagaaacagaauugaauaagcucugauacaaacaauucagauaaagcauuagugcaagugaaaaagccauucuccaaagaaacaaaaagucacuuacaaaacauucuaggaaaaugcaaauuaauaguaauggagaacgaaucagugauugccaagccucagaagcugguguagagugaacccacacacaaguaagcacaaggcaacaugugguaugauccugcauccugaccucaguaccuacgcacacucacaguggugacggcuaagcagaucaacguacaugucacagcucacagaauaguacaccaaacaaaauuuuaaaagaaguaugaaaagauauguucuuauuagaugacaaaaagaaaguuaacacaaagggagggugcugggcuuguggguccugagcugugacugucaaguguacucugucccucacugugauugccuucugggaaguggaagguggcagaaauucaggaccugcccugcuucaaccccucaaauggugggaucauaggccuguaucaagaggacaagcuguaacuucuauaugcaaagaccucuuuccaccuugccauuacuuggucaacaaugaaacccucuacugcaaguuuaaguugcuauuucuugugcuuuaggaaaaaggggagcagccccaccuauguacaguuccgcaucagcuucaguuaccuucaguuaucuuauaugaaauggaaaacuccaggaaauaaaaccaaauccuaaauguuaaauugcaugcaggcugagaagaugaaaucgcuuacugagcaggccacccacgccucccucuguacagaauacuugucaccuagccugcuuggucaucaacucaaauggcauaggauagcuguguucaagcauuccuuguuuuaauaauggcucagagcauaagaauagcaucaccacacaguggaaaggccaaagaggauccacaaaggauuucaguuaagaaaagaaugaauguucaucuuaaauguugaaguuguuaagauuuguaauaucaaaacugcaacaaaaagaaagaaagaaagaaagaaagaaagaaagaaagaaagaaagaaagaaagaaagaaagaaagaaagaaaggaaggaaggaaggaaggaaggaaggaaggaaggaaggaaggaaggaaggaaggauggaugcaaaggaaagcaaaaggaaaggaagagaagagaagagaagagaagagaagagaagagaagagaagagaagagaagagaagagaagagaagagaagagaagagaagagaagagaagagaagagaaagaagagaagagaagagaagagaagagaaacccacacuauuccagaaccacaccucaaccaggaaaauugcaaccaccacucgcucgcgcuaagagccuaguuaagauggaaagcucccagugagagggaucuggaccagccaccagggacuggaucauaugcaccuuuuauuauuaagugucaaguuuaacaauacacguagccauucucuucagcuguuauagauaacccuaacacugugggugagagccucugagccuccuuauccuauuagacuuuauguacuuagauaugugcccugacaauuuagauaaauaucuaucccaauuauaaaccuacacuugauuugcaauuagucucgaacaauaguuuccagaauuucacagaauacaugaugcuuccaacuaguacccacucuuggauaacugaaauuacuucagcuuuagaaaagucagcugaacuuaguauaaugaccucauuuauacaggagaguccucaaauuuauuuucaaauucucauuuacuagaagguugaaagcagauaaggauaauauaucaaauuuacaaauauuauuauaaaaauaauaucagacuagaaauuaaauaagcuuacuaucauaauacaaccacgccagagcucaaagucauguauccagguauauaacagaauaagagacuggguaaaugaaaacaaaauggccguaaaagaugcaacaaggccucaaguuaccuacaaggggcaccuuuccacaucuggucucuuuaaaaaaaugaaugagauuuccuacaaaccaaaaccacauuuaaaauguccuaacuuuuauuaagaggaauuucucugauuucaugacaaagaaaauaaauuacuccugggucccagaguauuaaaagcagaggcaugugaagcaacaagacuacaaacacaaguguaaaaugucccuaacuccugucaggucucuccacagcgcguuguacugccucugcucacaguucauaccuuuggaaacaugucaaaugggaaguauuuccaaccuccauucucaaacacugcuuauccuuaauuaccuauaauccagaacagcacacagccuggacuagcaagucccggcaguugcuuggucagagcauccccagcucuggagccugugaauugaugcaaacacaacagagaacaaaacaucuucccaagagguaccuacguucuuuccgaugcucaacuaaacccacagccugcuuggcugagcacuuugcaaaccaguugucgccaaguaaaacagugacuucauuaguguggacuaguuuuccuggcaugaaggcaagagggccgaaugguaccuauugguuuaaaagaaagauagaaaagcaaaauuuuuaacauacauuuuuacaauauuuagcaugagaaacccuguauuacugaguucuuaccuaagcacuaggaaaaguaaaaugucaauuucccagaauuuaacauuuuauucacauuucaccaggagcuuuugguucuucaccucucuucacgccugguccuuccucucucucugucucucugacucucuguauaucucugucuuucucucucaucucauggcccagcucagcuuagacccuuccagaugucucuggcuguucucucccucguaucuauaauaaaacuagucucaaccauacaccacacacacacaaacccuaccaggaaaaucuauaaaaaacuguauuaggcuaauaaauucauguuaaaacaggaaaauaaaucuacagcaugcuucaaagacagcucuuagaagaaagaagagaguagcacugucuaugaauguuuacauuucauuaauccuuaagucuaaauaaaaccaaaacaguaaugaacuacugucagugaaaacuuuuuuggguaccuaaaacuauguuuugaagauaggaacuaacagcuguauuuaucuaccuagccacaccucauuuaguacagcagaacaaauccuccugaagcacacugauguaguaguggaggcuacagccaagagcucagcagacugugugucacauggaaggucacucaaaaggaaacuaucagcaccucucagagaaaaaccaauguucuaggguuuaauucuaugacuuaccagacauuauggcuugcuauugcuuuggcuaacaggaaauaacugaauaccacacuccuaucauaauucauuuacauauaaaaaauacauuugcauacaaaacaucacguuuuugcuaauaguuguuaauaaaccauaauaauuauauacaaauuauuguauugguuuugucucaagaccuaagaaaacaaaccuucauuacuauagagacacuuuugauggcauaccagcuaacaguuugugaacugucauacacagcaaggggaaauccuauauuucaccauuagacugucuacaacaaacaacauauagcucuaaaaggagcacagugagcauaccaugacgucguaagacagcuugucaggcaagguccucagccucucuugaagagcacuguagucauugucuacuuucucccugaugaggaaaacaccaaacacaaagugagugcauagaucagagucucacuagcugcaaccaacaguuuacaccacuaaaaguuuacgagauccagcaauggcacugccuucccacauucauacauucacacagaaaugaaaacucauucugaaacagaacacucccaucuugacaauuagcuucuuaagguaggagauggccuagucuaauacacugucaaaauuaaggaaaugugaagggggcugauauuuagagggagccaggaacucaaacugagaagacacaucauauauacaccuucugagugaauaaacagauuguacaguagagccuguggacaaaagauggcaucaggugcuucaguccuuaccagaaaacuuaagcuccaaaccuggaguccucaacucuucuaauguggacaagguaagaaauccagucaagaacagaaaaauacgcggcagcaguacugccuaaagcacuucaccucgccucugaagucuguuucagagugugccaaaacucguggugccucaugccugugaccccaaaacuagggaauaggaggcaggagggucagaggucauucuugcugcauagugaguucaaaggcagccugcugaguuacaugagaucccaaagucucaaagaaaauaagggaaaaagggauugggggaauccauuuaaauaacccuaagaugugacucaauuugaccuugcuggagcagagagcagcauguguccaaacugcuccuccacggggcaggcagccgacgggaaucaaugcccuuccugagcugaagccucugccuaugccgaccgucuuuggaagucaagauuccuaagggcuuuuggcuaggauggaggcugcaaacaauucuagaacagcaaacuauccucuuacaagauaacagaaacaauaagcucaccaaguaauuuaaaugaacacauccugucagacuaaaauuuacccuaagugccacguggguaagcacccgucaucgcccaguggcucugcugcagcuguggcauuggccucaguuuacuccuuggcuccacuacagcaguaguagcacaauuaauaaaaauuauccacuccgucuuaaggucucagggaauuucacguguguugcuauguauccuggagaaacaaaaccuccugcaguaaugccacuccacauuuuucucucguacaagguagcacagaaaggaaacaggaaagaagcacugagagagcggaucucuguauccucuugaagcagacacccagcuaaccgaggucgccuuauucucacacaaacucucauuuucuaaaguucagguucucuguauaaacucuccccauaaacugucuacuaugguauuucuucuguguaugccuuuuugagagagugcacaggcacauguggaagcuggagguccacacuggagucugcaaucauuuuccaccauacuuuugagauggggucucaccaauucaggucaacuagcuggcuagcaagcuccagggguauuccugaccccgacuccccagaacuggggcuaugggugcacacccauauuuuuaugugguacugggaaucagaacucaggucuuuccugcuuguaaagcauuuuacugacaaccacguucuuagacccuauuaugggacgggggguuuagggguugguuuuuuugagacaggguuucucuguguagcccuggcuguccagaaacucacucuguagaccauacuggccucaaacucagaaauccaccugccucugccucccaagugcugggauuaaaggugugcauuucuuaaauaauuauccuuuugaguacauuuuuauauggacaagauggcaaaaagccuucaugcacgggacuauacaucaggaccagaccccagaaggaccauagcuuuaaagucaaagcagagagugaaucccagaucucuaacuccacuuacacaaaguagccuuagccuuaccuuuuuccaaguuaaaacuggaaaaauaccuguucacagguucguaaccucagaaauaauuuucagaaaagauuauuaagcacuaagacaaggucccacuuaacuuaguccuucaacuggauagugucacuuccugagagauaagagaacagcugacugucacgggugauucagggacuuuggagacggggucgagaugagcaguaaccaagaagaugcgcuauaguaccaacacaucacagauacucaugaaccuaccucuguggcucagacucagacuaucuauccacuagcuaaugcuucugauuagguccaauuaaaguuagcauucagcaugucuuacauugguaaucacaccuacaaaaagggacuuaaaauaaagaaaucucgugugcccgcagagaacagaaaguucaaccaaggucaugucagcaaucaguauuuccagaugaauacucagcuuuaaccuuccuuaauaauucucucuagaacaaaaauguggacaaacuacaaaaucuaagacuagacuugcuauuucuauauuuugaguuauuuucuaaagcagaaaaggaaaguggaagcugauuucaagugcagcaaugcagaaauacuuuuugaagggaggucagcuauguaccuuaaagaaaucccugaaaaccaucuggacaaaauguccaggaccaagaacuuaacuaaaaugugaucucuacaacccucuaauacacaagaccaacaaucucucuaaaacaucacaugccuaugcaacauauauguaauuugcuuaaauguaagagagucugccuacaauguaugcagugcccaaggaagacaaaaugguuuauaagauccacuggggauagaguugcaagcaguuauaaacuaccauaugcguuuugggagcugaacccaauuccuaugcaagaauagcaagagcuuuuaacugcuaagccuugucgccagccauaaaaauucaaguugucuuucuucccccaacaccccucuuccagacagaguuucucugauuaacagcucuggcuaaucugaaacucacuuuguaaaccacgcuggccucaaacucacagagacccaccugccucucucuuccgagugcugggaucaaagguauuuuuuuaaauauggacauuuugcccucauauaagucugcgcaccacauacaugacugguauucucagaggucagaagaggggacuagaucaccugaacuauaguuacagauaguugugagccagcuugugguuucuggugauugaaccuggguccucuucaagagcaacaagugcucuaaaccacuuagucaucuuucuagccucaauacaaguugucuuaauaacuaauguuaaagauuggagaagaugagcagagucuuuauuuggacuccaaauauuaacagaucucugucaacuuauuuucuugaaaacaucaauuuuagguguuuucgucuuacuaaaauauagcaaccaagagauaauuacccaaaauaacuguuucuucaaauggaaaacaaagccuagguagaguuagagcaugccucucaaacccacuuacuccuauguuugucuucacuauauuugacaaagauuacagucaguacaagcaccacccuuuguccuggcuuuccagauugaaccaaggguuuuaugccugcuaggcaaaggcccuaccacucacucacauuaccagcccucuguuuauuuuuucauuuugaaauugucucacuaaauugcccaggcuggccuugaaccugcuauccuccuaccucagccaccugaguagcugggcugaauggccugugccaccaagauuaccagccuucaauucuaaacuucaagaagccuacuucauaccaaauagcuucaugcaauaguccucaaagaaauaagaacuauaaccugacaggcgugguggcgcacgccuuugaucccagcacucgggaggcagaggcaggcggauuucugaguuccaugccagccuggucuacaaagugaguuccaggacagccagggcuacacagagaaaccuugucucaaaaaaaccaaaaaauaaauaaaaacaacaaaaaaaacuauaaccuaacugaauagcauguuuaaaaaacaaaaaacaagcuucuuuugauccuuccuggccaugucuacaugucucugugaaacaccuuuaguuuuaaaaaggcagcagcaagguauauaaauaguccuaacuuuaaagcauuaagaucaggacagacccuaugggaaauauuuauuuucauggaaguguaacaagucugagagagcaagcuaaagcuaaaugaagugugugugugugugugugugugugugagagagagaccucagaaagaacagauuaaugaguaagacgggugguauauaaucagagcucaccaguauacuccaaucguucuguguaggugaagauuuugauaaccgauuauuuaaagagauacagaauaacaugaaaaaauaguccacaaguuuagucuuucuguuacuggaaaacuacuuuuguaaagaggguguaagcaccacaucccuuguuccaaacaaguggcaggcucucaucuccaccuuuaaaggaugaaaugaaaucucagcuuagaagaguagaaucuuccaacuguacggaaguaguggggaaacuggcagaaauuacuaacuagcacugaacugucuucuuggaggaagccuuccaacauuucuuucccuuuaccuaaccugcuaaacaaacaaaaaagcagaaaacacacauuacugcaaauacauggguuauaaucuauagccaaaagccaaagcuaagaaacaaugaaaccuagcgcuucugaaauauagaggagacaacagaagcuacugaauucaucgucaccacucuagaacuaucccagaagccucuaagaaagccuacucucaauucaguucacuccucugcaacagggcccugggcuauaucagaggccaucacucaaacccagcaggccuuucuaaaauucacaauccaucugcauuaaaguuccacugcccugaagagucccugggccaccucuagaauuaagaaaauaaagaaaaguucaauucaggcaugguacaagcagacagaugaucacugcuaucauaagaaacgacagcuuccuucaguguccugaagucuagggaaguugccaugaacacuguugaagaaggaaccacuguucuugccaacuaguggggaaaggaauucuccucgugcacaacuggaacacaucuguacgaaaucggaggccuugggaccuuuucuuccuaaauggccacggcaaaaugcuuagugacaucacuuaaauaauuaacaucuacccaaaaaaauuaaggcaaaauggagacguauuccuuuuuauaacugcaucauaccuaagaacuagccucaucagaauauguuggcaaucaaacacaugauccuaguguuucaugacuucaugaaucaucagaaaacauuaauaaucuaaaaaaauagccaauaauuuuucaaaaauuaguuuaacaaguuauuaagaggcagauccaacuaccaauccacuagauuccuuccauuuaacuguguacaguggcuccagcacaugggacacacagugaaguugcaaaggacaaugcguucccacguugucucuacagccaccacauggacaugugaccugagauuugucaauuaugcuaaaugcccguuucuuuauucauaauuaauacuuugcucuaagaauacaauuagaugugaauuaaaaguaggaggaugcucuaaaauuacauaaaagcacacuggucuuugaaagaaauccccaaguugccaguuuacauguaauuuuuaugcccuguucauuucccugauuucuuauaacugauauauguuccuguuacgaguuaaagggagaaacauaacagaaaagaaaagaauucucucucaaucugaauaauuguaccagguucuacuagaucuccuuaauucguagccuuugcugcaucaauuuagguuuucuauacuuucaaaaucauuuuaggaaacaaugaucauuauggccaccuuggaguggugauuuuggcugcuguuccuaugacaaacugagaagaacucauuuucuggaguuuacagagaccuucauauacucccacaggucaaagcuccucucagaguuuaaaagagaaaaauaaugucaauacuaguucugaaucuacaaaguauuuuuaaauucucaaaauuaucuuuaacucaaaagugaauaaaaacaacuggaaaaauucaccauuugguugaguuaaugugaauuauuaaaaaauaaacuauagggcuagagagguuaagagcaccgacugcuccuccaaaaguucugaguucaauucccagcaaccacaugguggcucacaaccauccguaauaagaucugauguccucuucugguguguauggaaagagaagugguguacucauauacaucaaauaaauaaauaagccaggcagugguggcacacgccuuuaaucccagcacuggggagguaaaggcaggcggauuucugaauucgaggccagccuggucuacagagugaguuccaggacagccagagcuacacagagaaaccuugucucacaggaauaaauaaauaaauaaaucacuacauuuuuaaaacuaaguaaguaaacuacaaguaugccagucuguacagccuucauuuuccugcacucagcagacaauaguacccucacagaauguaaagaauguuagaaucggacugccgugcuucaaaagcagaagcagagcccuggacuauggggacacagaugugugccaugcacugcaguccuuacacagaaacuguacaaauguuaucaguacuguguguuggguuuuuuuucuuuuuuuuuuuuuaauuagguauuuucuuauuuuacauuucaaaugcuaucccaaaaguccccuguacuggcuaguuuugugucaacuugacacagcuggaguuaucacagagaaaggagcuucaguuaaggaaaugccuccaugagauccaacucuaaggcauuuucucaauuagugaucaagggggaaaggccccuugugggugggaccaucucugggcugguagucuugguucuauaagagagcaggcugagcaagccaggugaggcaagccaguaaagaacaucccuccauggccucugcaucagcuccugcuuccugaccugcuugaguuccaguccugacuuccuuuggugaugaacagcagcauggaaguguaagccgaauaaacccuuuccuccccaacuugcuucuuggucaugauguuugugcaggaauagaaacccugacuuaagacaucccccauacccucccccucuuguuguucuuauuuuuaaagacuacaugaaaaaacaaaaaaacuucaagguguaagcugugguuucuacugauagagaagaaaaauccagacacucucuggacuaagcaaguccccaggagcugugaaccaaagaacuuagaugcuggaaacauaucaucaaagacaguauuccaaaaacuuauaaaggggacuguaaaaaaaauuacuuuuuuguguguacgcaugucaagugacccacaaucaccuguuaacuccaguuccagaagcccaaggccuucagaggcaccaggcacacaggugaugcacauauacauauguaggcacucacacauaaaacaaaagccaucuucucuaaaauacuacauacagaaauccucaaacauaaucgcaaaacuagggcauaggacaggcgguguuugauaauggcaaaaacaacaaccagcaagaaagaaaagaaaagaaaagaaaagaaaagaaaagaaaagaaaagaaaagaaaagaaaagaaaagggaaaagggaaaagaagaggaagagaaagaaagagaaagagaaagagaaagagaaagagaaagagaaagagaaagagaaagagaaagagaaagagaaagagaaagagaaagagaaagagaaagagaaagagaaagagaaagagaaagagaaagagaaagagaaagagaaagagagggagagggagagggagagggagagggagagggagagggagagggagagggagagggagagggagagggagaggaagagagaaggaggagagggagagggaaaaaggaaggaaggaagggagggagggagggagggagggggagagagagagagagagagagagagagaaagaaagaaagaaagaaagaaagaaagaaagaaagaaagaaagaaagaaagaaagaaagaaagaaagaaagaaagaaagaaagaaagaaagaaaaggcuacagacaaaguaagggauguguacucacugugcccacccuuccuccccaucaucccuugggguaguaacugcccaauccaguggcaaaagcacaugauauggcaagauaauuuuaugacuauucucugcuucacucaagggaugaaggggcggggggggggggguggaauaaaaaaaacaaagaagguucuauacaaaauaguaccacaaauauaguccauuaaauaggaacucugaaaaauuagcuucccaauuuaccaaacacagaagaaugaagccaucauugugaauaaguauuucugcaaauauguagaucaguauuucagacaaaauaaauuucauacauacacauauaugaagguuguaggaaaacacuuucagguauucaugggaauuguuauuucagugauacuggauggggcagcuuauacuugaaaucuuaguacuugggaagcugaggcaggaggauaacugggacucugagagcagucuggguuccauggcaagucccacuccaccucgggauaccagguaagacccugucuucaaaaaagggagaguguaaggagucugcaacccuauagguggaacaauaugaacuaaccaguacccccagggcucgugucucuagcugcauauguagcagaagauggccuacucggccaucauugggaagagaggccccuugguauugcaaacuuuauaugccucaguacaggggaaugccagggccaagaagcaggaguggguggauaggggagcagggcggggggugggggggaauagggaacuuucgagauagcauuugaaauuugaaauguauauaaagaaaacaucuaauaaacaaggggaggguguuuguggggcacauucuucccucaacaacaauagacaaacauaugcuuguuacaaauauauauguaugugugcauacaauacaagcauauauaugauguuuccccuuucccuaguaguaaagaggaguuuucucuauuuacauguuuauauuuccuauuaaauacugugaccauaaacuguagcagaagcuaguuucccccaaauuuuguauccacuuuucuuuuaaaaaguaacaaauaucaaccauuuguuuuacaauuuuuuucaaacucacaugcucaaauguuuuugaauuugucaaacuuuaagcuacucuuuccaauauuaaacacauguacaaauagaauacuauauuuucacuuaaguuggcuuuguuuaauuuacuacuagcuuucuuuacuacccaaauccacuuagaagcuuuaaagaaaacaagguguuuuguuuuguuaauuguacauauggugauugugcacaugagugcaggugcccaagaaagcccagggcauuggauauccaacagcuuccuggugugcaugcuggaaucccaacgcaggcccucugcucuaaccacugagcaaucccuucccagccccaagcaagcuauuucuacaccuccauugcauauaauuuauaguuauaaacaagaccucuguacauauuauuugacucugccccauccauaagcacuacuuuauucaagcccauaagcaacacagaguaaugaaucuuucuuguaagaccuagccaauaggaaucauucuuuguucuaccagcagauagcagccauugcuucccguucugaaucuggcugccucuguaaguuccucucaacaccagaauauggccuugcagcuuucaugccauguaaaaggaaaggaugcuaggaacaugccacaaagacagaguaggcagagcuaacaggccuagcccaggaugcccuugaacuugggcuguggaauccugauggcaggccugugcuuaacaaagcuagccuuagacucauuacaaacacugggaguagacagaugcaauauucaaaugaagccauucaaauaaaccaccagcucacugacacuaggugaugggcaccuguaggcugaccauccugcucuacuaccuucuguuuaaaaagcuucaucgaaagccuuauuggagacaggcaugcgcagcucuaagaauacgcugguaaggccaacucucugccuuauucucuucaugacugggcaagguggaauucuacucuaaaauuccagcacucuaggaagcugaggcagaggacugccacaaguuccaggccagccugggacauaguggaaaauaaaacccagacagauaaauaaaauggcacagacauaaaacauucaaaaacauguacaaaacacggagauuucuauuauuuuuccuuauuuauguuacaucucaaacuuuccaaaaagaucucaucuuagcucuugagugacaggcugagaugcacugcagccccgugagucaaugguagcagaacugugugggaaaccuacagguucuuaguguaagugcuccagacugcaaacgacaaaacgcaaaggcaggccuguaacuccaaaagguguacaagaauuuagaaaaaaaagacagaugcaaauaaucccccaacaugauagcuagcucuaaguggaccaaacagaaaaccucauguucauauuuaacaagaaaauaauuguaaagccugugacaucuuguuuuccugugugaaguaaaaauaauaggcacaaaaaggguguugguuugguuugguuuuuuucaagacaggguuucucuguguagcucuggcuguccuagaacucauucuguagaccaggcuggccucaaacucagagauucgccugccucugccucccaaauacuaggauuaaaggugugugccaccacugccaggcuaaagaguuuuauucacuaaaaaacaaaacuuaaaucguggcuaagcugaaaaccauuguuagugcuaacagaaugcuauauaauucuuaccuacuggguucaaauauuuccuuuuuuuucccucuuaucugaacaaauacuauuauuaauuccuuaguucaccagaguccuggaauuuaacuuucuagguaagucuuaagacaguuccagucuuucauuccuauuuuucuacaaauacuuuuacuuuuuguccaacauuaaaagaaaggggaggggggcguauucuaaagugugauguagucugucugucucuaaauaaaagaacccuuuuaaaacaucaacacuucuaagaaaagaauugcauccuuaaaaucauuuauuuagcuuuucuucuuacauuagccgauacccaaaaagaccagagcauaccuaagcugcacuuuagacuggcuaguaucaagagucaaaaaauuaaaagcaacaugcuuuuuaaaauuguaucuaaaggcaugcuuaagaacagcuccaauuucuauuuauuccaguaugcuggccaauuguacacaauaugccuuauuucucugcuuagucucacuaggagccccucuguggcgggguguuuaaguugcaaacaucagcucagccuuguccauggaaggaggucuucuguaagaagguaugagauggaaagauagcacaaugccuaagcuccagaucucuacugccugacuuuuuuaagaaagugaacacuuuuguuucaauuucugaacauagaaaaugaauccagaauuuacuggucauuuagacucuagcaacauuaugauacuaugugcagauccucuuuaaaaagcaagcaaaauacuguuuccuaaauccugucagaagugauucagagcagaaaaauauuuaauaagggaaaaagaauuguuaucuuuaacauauagacaagguacaauaaacuuuaaauuacucuacaggcacaugugccagcagccuucuguaguuuagaagccuuuuagcacacuggaagugagacugagggucugaggcugcucugccaucagaauucugccuguuauuacucucaaaaccuguacacgguggugcuguuuauaaauaaaauaguggagauaaaacaaucacagacuucaccuucacuuauucgacacaagugccuacucugugccaaacacggaaggaaagccuucguggacagaaagauaaaaacauguuuguuauccucaagaacucucucuaccagaggauggaucucacuaagccaccuagaagcaagcugucaguuccagguucguguaugcuggggucuguucagagugaauucauccucuaguuccuaaaccuguuaccaaaaacaagacgcacauguccacagaaugaaacugccucuaaggguuacucauaaauaagucacuuuggccaaaucuacaaaagaaaagccuucucuggccaaggucuugcacacacuucacauuuuaagcugaauugaauacauagugcaaagugaacaguccauuauggaaaugcugacagaccuacaccaccaguggaugcaauuacaaugcugcauuuauugaaaauuaaugaaguccuggauuuuuauuuauaaaguggguauuauuaguuuuagauugguuucugcaagccaauaguccaaauugaauaagaugauggguacagauugcacugaucuucacucuuauccauuccuugcagccuaugugcauuuaaaccaaaaacauuugauauacacuaacuauaaauuauuuccuuggagaucucucaggcaugaagaaaaugccuuuuaaaauaaauuuaaaauauuauaugcuugaugguguauaaccgaagguuuaaucuccccacuaaaggggcaguuaugacgauuuugcaauaacccugcagacaauaaucaggacagcuccuguuguucucucaguaaaaucuucguaaacacagcauggauagacuguaauuugauaucuguaagaucaacagccauaccucaugacaucuccuaauauaggauuuuauucaccauuaaauugagcguuuuccucagaagcgauagaagagaaagcacauuauuuaccaggcauuguccuauuaacuauagauuagcacaucaaaacagacaugcuuucuuuuucucuuuaaaaagagugcaggccauaaagcaggcccuaaacugcagauugaucagcuuuuucaaacuuggaaaaaucuaucugugcccuauuuccaacauuccuuuuuugaacaauugauuccaauuauuuucuacuacaaacauuaagaaauauccucagaguuguuuuuaaagucucaguuucuacuucaaaauuagaauauuacuauucaauuuuuuuaaauuaaaaggugguaaaacuuuagagaauugauaaauauguaacucagagaaggguuaaagacaauguaaauuaguaccaaaggcauucaaaauagagaucaucaaacuucuguugcugcucucugguucucuccccaacacauacauguacacaggcacaugcacacaaacccacacaugcacacacccaccagccccaggacacaucauuauuuaaauacaagugacuuccuccauauuucagaauuauaauaaagcgucuuucacucaccaaugcuggauuuucucuuggcaguuagugaccaccugucaugaaaacagacaacugcucaugaaaacacaaggcuagauacagagauagaaaaucagccagaaaacugcaacagugucuuaacagauucacuaacauccccauguacauuuuuauuugucaagagguacagagauggggauguugguuuuuaagcagugcacuuuaucacagcccucuaacgcaggcugauaacugcagaacaaauuacagcuuuccaauucagacuuugguacaaaaccugcuucauaacuauuaggugacauaugauauaagauaacuagcauuuuguacaaucuacagaccauuuucaauguuacauauuuucuagaacacacaaauauuauaaauaacaagaaaccaaugcaacauccacggcucagcaggaaaaaaaaaugacaguagugaaaauauuuuauuuugucagcuuaucuccaaauguuuucaccugugauuuuuauucugauguauuaaaaaugaacuuauuuuucuacuauguuuucaagaagaaauacuugggauaacaggaugcucugaacagcucauuucccccaccaguaaauuacaauaaaauuauauauacuugacaucuagucuaagcuguuuauaauacuauaagaauggaauuaaacaucaaaguuacuugcuuuccuuuaagauauuucaguaaauucucaaauacuaaaaaaacaaaagucuguuggcaaagaaaaaauaugauuaaaaaauaacacaauuaaauuaacuuuauuuucacaaacugcuaaaucaccuauuuaaaaaaaaauguuaaauacuagagugccauuuuagagacagagaaacuaaggcacaaaagguagaaugaagacagcagcauggccugguugcagcuccaacuccaggcuuucagagccaauauccuuguauacgcaaaauguuucacucaaaaaaaaaaaaaaaaaaucacaauauuuuaaggguagucacuuaauuccucuauuauagcauuuaauuccugaaauaaauguccuugcuuuuggacauuuuaaauacuaaggcaacaauccugagucaaaauacaugcuguaaucagauacccagcuauacugcacauuaacucagcauaaaacgucccuaccgaaugaagaucuacagucaguaucaaucacacagcaacacucaauaacaguggcaauaugaaauagagcacugacuuaacaucuggaagauuccacuaaagccacaucgguccaucucacuguuucugaucaggcaguauuaauuauaaaacacaaacaaaaauaaauguaaauuaaaaaacaaaaacaaauccuugcaaaaacauuuuuuuuaaaguuucuuuuuaaagaucccauuaagaugagacccaaaaacagugaggguguuuccagcccuagcacgaguguuuccaagcaugaagagagccaaaagcauagagaaaaaaaacccugcaacccguaagagcagaguguucauuaaccucuacaugauaauccuuucguagcugcauauuaacuaguuacauauucauaaucauuuacauuauuuaaaggaccuacgaugaaauuuucuaggcuauauccauuagugaugguguuaaagguuauggaagauagucuacuuaauguuuccaggaagccuuuuuaauuaguaaauauguaaauuuggcacacaugcuuuucauguuuaaaaacaagccacugguagcauggcauguguucuugccaucacccucacagcuccucugccugguucuggucacacuuccccucuccccaacccuuuuuuuuccuaagacagucucccuaagcagauauucaaagacagaccagcaacaaaacuccauuucauaauguacacacgacacccucacuaccaaaguacugcuuuacguguagagucuuucuggguuccacauuagcaacaccagaugcacugcacaaacacaaggaggacccuggagaccagaggaaagcuuucaaaggaggcagaugcagaagugcacggaauaacuggguagugagacucuuacggccaaguuuaaauaucuguaagcaucuuuuuaaaauacacaaacacaaacauauuaaauguuauauuuugagauguuuuuaauuuaacugccaaaaggaaaaaaaucuaaauuggagaaaauccauauucaaagcuaaauguaccugaguuuuaaaaacugacuuuucugugacgguaacaccaacuuaauuucuccugccagggaacucaugcucauuucuuaaaauauuaaaugaaugaucauaagauagggaucugauucuguagacaagucuccaaaaacaagcaaacaacaaaagguauuuucaucuuuuugucgaccuccacaaaaguaaggucccuauggaagaacugacgccagcuguuuuguuuuuuaaauauuaaguguccaaacuuauaaauauaucuaaaacgucacuguaauaaaagguuacuugggagaacaguacuacuaaaauaguuaaccuaggaaacucuuuaauaacuacacauguauaaauaugugcuuauacaguaccaauaaggccacaguaaagaaaagggaggcugaccugacccaccaguuuaaacaaauuaucauuaacaacccaaucgguacacagucaucuguacacuuagguacaugccuaagauuuauaacaagauuucguaugacaguccauucaaacacuccaaugacauaggucuuaaccucucuggaaggaaaggaagccuggaaguggccacaugaaaucagcuuuagacuacagcuacccgaccccaagcuccccaucccuuggacaagccugccuccagccuggcagaguguaauggugcaagaagggcugcugcaucugcagucacuaugccacuucuccacguccuccucagcacagcacucacacauucuguuauaaagggucaaaauuauguguuauaaaguguaaggccaugaaacugugcaaaacaaaacaaaauaugguucuccucagaaauuacuuuuuagauguuacuuauaaaggaaugaagguuuaacaugcagugaguaagugagcugagcgcuccugugcuuauuuguguuugugcuauuuauuuugauaauggaccacaagggggcaucaacccauucacucuccaagcacaguaaaguagcagggcagaguuggaccaacagggugcaccugcaguuaccugcaagucuaaccucagauccuucucucaggaagucuuuacuucacuucuaacacugcuuaugcugcccacaaccacagagccuuccuacucggguuaaguaagguaugagagcagucugggaguaacucuccaggcugucuaaauucauuaggucagcuucucucgcuggacugccaguuccaagacauaucuugcaaauaaguugcucagucaccagugcacuggagaugccucagcaguuaagacuacuggcugcucucccaaaagaccuggguucuaauuccagcacccacaaggcaguucacaacugucuguaauuauaguuuguaaugccaucaaacagacauaaauacaggccaaaaaaaugcauaugaaauaaaaauaaaucaauuccacuuuagacauguacccagagugaaacuaucaccaacucucuaaguccaguuaaagaccacagcacuucuuaaaauacuucaauguuaacuuuagcucagaucaaguaaaagggaauaaggauuagccuuaauuuuagcacaguucucuaacccgggacugggagagaucccccucuccucucccucugaugccugcaucacucccuggcuuccuuacccucuuauuagggcuccuuucccucuuaugauuggucacucacaaucccaaguguuuggcuaacacacaccuucuaugguaaacuuugugaaucuuacauguacaaucuguggcauuucuaaggaugaagacguuuuccuaggauucuuuaaauuaggcguguaggaaaacucccacuaccagggguagaggucacauccacagaggcugugcgugcacaacaauccuuuacaacaaguguggcucaccugguggugguggccucccagcacuugggaggcagaggcaggcagaucucuugagcuugaggccagccucaacuacagaguaaguuccaggacagccagagcuacacaggaaaauccuaucucgaaaacaaaacaaaacaacaacaaaaaaaaguguggcucuauucccacaagccaaaaguuucagaaauagauuuuauucacacuuagaguuugguguguuuuagggcauacagaucuaacuugguagaacauuugguagaauggggcccgggaugcaaucaccagcccaacaaugaggacacacaccuguaaucccagcacugggaagaagaaaaucagaaauucaaggucaucuucagcuauaacuaaucuuucauacauaagacccugacuccaaaacagaaaggaauuugauacauuuuaguacucaguauauauacccugucauggaauacuccuauaaauaaaugaagccugauuauuggguggcccauuaugucaacggguggucauuucacagguaacucuguucucaguacuugacagguuuuaugacuacagaggguuaagcuauaccucugcaucggagggcugccuggacagcuugcagaccuaccgucugacuagaaacaucagucauucccuguccacuugcauaccuuccucugggaauacuacuguuuccacuaagaagagacccucgcagaaccccuuuugagcagcuacagcuccaaaguggagaaggcccacgcccgcugcuacccaacccaacugauccauuuggauguaaggaccaaggcacucaggaggggugaggagcuucacaagcaggagccaucugagacagacggacacaaaaacgugcacacaagcaaaacuaacuuccccucuccaccaccccccaacagucaauucuuggagaaauuccuuucaagcauuucugugguuuacaauugacuuaagucaguguagugaaacuugucacacagacuaggauaacaacauggcugugacacucauuagaaacaauuuauuaagcaggaauacaaauaguuaaaacaaaagggggagggucgcucacuaguaauacaaaaacaaaacuaaaucugaaauuucauucugcacuuaaagauacacuacugucagucagacuauaggaauauuaagcucaaaacucacugaaaacuggaaacaccagauaaguagaaaaaaaaauuaaauuaaaggaaucaaacuuuuuuuuuugguuuugauuuuucgagauaggguuuuucuguauagcccaggcuauccuggaacucacuuuguagaccaggcuggccucaaacucagaaauccaccugccucugccuccagagugcugggauuaaaagcgugugucaccaccgcccggcuggaaucauacuuuuacaggcagccaagaguugucaaaguaacagaaaggggaauaggaauuuagagagaacuaggaaaaaaagagcugaccuccaaagcugugguuucucaagcaauucugugccuagacugaguguuauggcaggcccuaagcagacaaccauagcugaagaaagaagcagacaggauaaucugacaaagcagaaaaccaaaaugagcccugagaguauauaugacuaguuucuauccaaagacaccugucaaauucuaaagcuaacuaaaaaggccaaaaagcuaaaccaaaacucugggaggagguuagaauaaaacaaaaacuauauagaguccagaagcuuccaaaaacugugaacaaguuguacucucagacaaaguccagaaagaaccagaacuagcagagcucacuaauggaggcacuucgcccucacuccauucagcaccugccaggaggcuaaccuuggcuggcacacacccugucuaccuaaaggcaagugaggccucucccagaagaagauaccuucagacacauuuaccaucccugcguuuaacccaaaaugacuacaaugccacaaaacagaagcacaugacuaaauacaaguaaaaagaaaagaaacaaaacaaaaaggcuauacaaucuggacacuggugucaauaaacuagaccacugaaauuacaaugcacagguauaagacgguacaagaaaagauacgaaaagacagaaacuuuuuacuggaaaccucuuuuuaaaaaagaaagagaauuuuuuuaaaaaaaaugaaaaugcuuuggcuguggcucuagcucaguggcagaacaccugccaagcaagugcaaagcccuaaauucauuaaccagacagaaaaagaaggaauagagggagggagucaaaaagaagaaaaaccauacaacugaaguuucuaaaauuaccacagccaauauuaaacagacacuaagcacaacauaagucaguauuucugaacaucugggcacagcaaugugguuagaacgcuggguguagcuggaggugcaaggcagagagauggcauauagccuucaaagaagcaacaaagguuauagagcauaaaacgccacacaguggaagacaacagaguagaaucuugaagucuugaaacaagaaacugacgaauccaucauuacuauagccacagcaaacacauccuccaacaugaaagaaaaauggaaagauuuucaacagaugacugagaauuccacugcagauuuucauucuucauuaaaagaaauagacaggcuuucuucagcagcacagcagcacacaugcagaaagaacuccagagcagcugcgacagcgcaggucacagggugggugucaagaugaguaccagccauguacaacaacuaaauacagcauuacaacaagcaaaauacacaccaucaaaauguacugacaauaaucaagauguggugggagccaaggaagccuugcaccuuuaaugccagcacucagaaggcagaggcagguggaucucuucagaguucuaggccagucagaacuauauagugaaacccaaucucaaucaguaaagcaaucaaucaaugaggaggagaaggagggggaaagaaagaaaagacaaacggcugaguaaaugaaugcaugcugaaccugggugguacaagcguaguguaaaugcgcagcacgcugaguauuaagauacacacaguauaguacacauguaguucaauaauuuaucauaaagacguuaaugggcagaaguaacaauaauguuauguuugguuaauccaacaacagacaaaaaggagggaacuggcagagaaacagcaaugacagugagauaccacuucacacauaucaggcuggccaucauuuaaaacacaaaaugggaaauaacgagcauucuuuguacagaggagcuggagccacugagaacucugcuggaagggaaggauguagagucaugcagagguagacagucaugcagcagucccucaaacacuaaacacguacuuuaugaccuagcguuuuaaccugacuacacccaaagcacucaaagcaaacagcauaaauuuugcacacaugcaugucuacaguagcauuauucauagccuucaaaaugaaggcaauguguccacuuacagauaacuauuguauaaaacaauuuuaauacacuugaaugcaauaaaauauuacuuacccuuaaaaaggaauaguucuagaccuggguggcagugauaugcugaggcaggagcaugagucccaggcuauucuaagacacagaacaggccuggagauuggggaacugccuccucagauccuguuuuaaaacccagacaugacuggaauguugguucaauggguaaaagcacuugccauauaaccaugaggaccugggcgugaaugccuagaauccacauaaaauccaaacacacacaaacacacacacacacacacacacacacacacacacacaccucugcaauccuagguucuuacaagauggauggcagagacaggagaaucccuagaaacucaauggucagcuagucuaguggaugcaacagcccacaauagauagacacuaucucaaacacauagaaggcaaggacagacaugugaagucugcacaccacagcauaugcaaagccauauucauaaaacacauaguuacauagaaaugcacacacaagcauacaugcacacacauaaaucauacacaauaaauugggggaauaugauaaauguagcaacaugaaugcuuugaaaauauuacacuaagucaaacaagacaguaaaaacagggcaacuauaugacuguuuacaugagcuaaguggauuagugaauucaugacuguuuuaccuguuuuacauguaaaaacuauaugacuauuuacaugagcuacauggauuagucaaauucagagacaaaaaaagcagggguauuuguugauagauaaguaggauacaaaaagagcuauuguuuaauaccacagucuaguuuuucaagauaaaaaaaagucuuaaacacaaguaugucuuuuuuauaacaaauuuuaaaauacaaaguaaaaucaaauagaagagugauaaauuucuauaguauuuagacauaacugcucuaaaagaagaugucaacuaaaaauuaauaccacaacuacaugcuaucuauaaaaaacauuucaaacacaaauacugaaguuaaaaaugacggaucucaaaaugcauacuaauaucuaguaaagguaacuugaagacaagaacaucuucaaagacgauaaaauaaaaauucaaaugguagaaaggucaacugaccagaacuacaacccuaaacuguacacacaaugaauaccccagccuugcaaccacacugaaugcuaaugcagagcuccagacagcccaguguccuggaaagggacggccuuaaaggaccugaacaacacacucacccagucagagcuagccaaagaaaugcuggacucaagaacuaaagauuaaauugauuugccaaaaaaagaaguauuuauuaaauauauuauaaauauauucagccauaaagcaagaaucaaauuccaauuuucaaauuauauguccuuugauuacaguaaaauuaaauaugggugucagaaacagaaaauacucaauauuuuuaaguuaagaauauaugucuaaguaacucaaaggucaauaaacaccuuacaacagauauuaaggaacaguuuuggggcuggagagauggcucaguuauuaagaggacuaacugcucuuccagagguccugaguucaauucccagcaacuacaugguggcucacaaccaucuguaaugggaucugaugcccucuucuggugugacuaaagacagcuaaaguguacuuacguauaauaaauaaauaaguuuuaacugacaacaaaaacaaccuaaaauauauguaaggcaccuacagcaaugguaagaaaaacucaaaaugcaaaauacguaagaaaaaaguaaauguuaaugaucuuuuaaaacaaggggaaaaaaaaaacguaaagggaaaaaacaauuuaaagcagaauugaugaagaggaaaccauauuuacaaaagagaaaaaucaacaaaaccagaaguugauccuugaaacaauuuuauugccagguaaucuccuaggaaaacaaaugaaaguauaaauaacagcauuuuuuaaaaaccacucucaaauaguaaauauauuuuauauguauacacacauauauaaucacuucccuaaaugacacaauaauagauggaaagcuugaauaguccuuuaaaaacaaauuugucuauguuuuaaauuugcaaugucucagaaacuaugguugguccagaccauccauuaacaaacacgugaaguacuacaaauaggggcuggagagggucucugcaggucagaauacgugcugcuccuccagaaaucucaggucaguuccccaacccccacacuggguggcucacaacugccuacagcuccaguucuagucaauccaacaccuucuucuggcaagggcgccugcauguaugugguacacauggccucaugcaggcacacauacacaaaaaaacaaaggcaguagugcacaccuaccacucuggaggcagagacaggaaaucugugagguaagucuggucuacagaaugaguuccaggacagucaggaauaggcagagaacccugucucaaaaaaacuagagaagagaagagagaggagagaggggagagagaggagagagaggggggagaggagggacggagggagggagggagggagggagggagggagggagggagggagggagcgagggagcgagggagggagggagcgagggaaggaaggaaagagaaggaagguaucaugaagcagcuaugcuuauggcuccagccucugugugcaaaagucaaaagguuugggaaagaaugguaacaaccacagaacagugagcaucccugaaguaaacgcaugguaucauuguguuagacaaaacaggccagauucagacaaauucuacacgguuugguuugauuuuucaaauaaagacuacggacuggggucaagggaagacacaaaagcagaagggagacuauuggggaagaggaaagggauagaagcacgcaacaagaguaaaaugagagugcaucauauauaguuggaaaacaggacagugaaaccuguuaguuuacaauuuuguauaacauuacacauuaauaacaugaaaauuaaaaaguuuaguagcagaaaaugauuaccuacacaguggaguauuagauaauuauaaauuagucuaaaguaucucuagaaacuagaaaauuaccagguauuucacuuaauaagauaaacaaacgaaauagacuaugcuaccuuuuuguguaaggaagcaggguggagaugaaggggcauauacacuucuuaaaggacagaauacaaugagguaaaccagaaauaaauuaaaaauaguuaccuauaauggcagacaggaauagggauagaaauaaauuucuuacauaguugugauuuugagccauguaaauguuuuauguauucgaaaaaauaaagugagauuaagaagcaaauauuaauaaauucaacauaauucaaauguucaccucaaaagaguuaauuagggaagagcuaaagaaacuacagagaaaauccugcauuuuaggcuuucaaggugucucaauggauaaaggugugcuugauaaccaaacguggccacccaaggucaauccccagaauccacagagagaaaagacaccaagaagaaauacucuggccuccaugcacauaccaugcacauaccaugcacauaccaugaccuccaugcacauaccaugcacauaccaugcacauaccauggcacacaugcguauaauaauaaauaaaaacuuuuuaaaaaaauuuaaaacuuuugugcaugaaaggacauuaucagaaagauaagcuaaaaaaaucaagaaaagcacugcaaauuauauauaggaguuuaauauccagauauauagaauucuuguaacucaauaacaaaaugacagaccaauuaaaacauggguaaaggaucugaauagaaauuuucccaagaggauacacaaauggccaacaggcaugagaagaguuaggcaacauccuuagacauuagagaaacagcaaucauaagcgcacuuaagauuccucuucacacuuaugaagacagcuauaacugaaaagacagggcaugcagagaccagaauuuucauauacugcuggugggaauacgauugugcagcuccuauggcuaacaguauaguagcuccuguugcuauaggauucaaccacucuauucccaggccauaugccaaggaacugaaaacagagacucagaugcuuacguaguucagaauagcauuauucauaacaaccaaaaggcagaaagagccuucagacgaaaggcaaaccaaacagcccacagauguacaauggaacauuacucaauauaauaggauaaguucuacuggaaacaaaccuagcgaaggugacaaauaaaauacgucaaagccuuuuuaguacaaaaugccaugaucccaauucaugacagacccagcauacaugaauccuaaaagcgguugcuagagauugcuagagaagcaagguggcaugaagcagcuaugcuuauggcuucagacucuguaugcagcacucaaaagguuuggcaaacaacaauaacaaccacagaauacugaguauuacugaaguauaaaugauuuagauggcaaaauuacccauaagaaauaagaaugucugaauaaagaucucuaaauucuaacaaaaaaaaaaaaaaacccacaggaaacugcagggaauuacuaaggguuuaucuuguaucaccaaguacuagaaaugaccacuccaaugcaggaugcaggaagaacuauagaucuagagauaguggauguuggaaucaagucaccuguccugacugaggaaggggaaaauaacugaguaaacagcaccagccugaggagagaaaggaaggcccacacagucacucagagaagacuucaucccacaguaacgcaggcucacacaccugacuauccuuucuucuaaaaugugcaguagucuuaaauagcuucugcacaaaagucuuguauacuaaaacucagagugcagcugagaagguggcucaguugguaaaauacuugaacaccuaaguuugaggcucaaccccacauuuaaaaaggcacacaccuguacaugcacauauacacaaaaacuaaaaaauuuacuuagcaggccuguaaucccagaacagggaaaacuaagauaaaguauugccguuaguccacggguagccugggcacauaauaagacaagccaaaggcaucucaaagagacaaaacuuuccuacaccuacuuaaaguaaaaauguguguguguguguguguguguguguguguguguguguguguuuaaguauguaaaugggauguaugauaccacucaguucuuagaaaaaugcaaucacaaaauuugcacaaaaauggauggacuuagaaugcaugauauugaaauuacucaaucucagaaggaaaaaaaaauacauucucccucaaauguggaaucuagccaaucuauguguauauguaaacaaaaucuuguaguuacaggauaacaaacagaagagaaaacaaaaaaggcuaaaacacaggggagcagaaaggacuuggugcauaagcaacgugcgucaggaaagaggauaugaagaggcugccuuucuaguuccaacugccacgggguuuuccucccaguccuggauaugcacacacacaaaauacuugauaauuaaaguauaagagccaauacugaacgacagaaaugacucaaagguuaggugugcuggcuggucuuccagaggacccagguuugauucccagaaacuacauggcagcucacaaccaucuguaacuccaguuccaagauacccaaugcuaucuucuggcacaaaccauacauguggugcaccaacaugcacucaggcaaaauacuccuacauaaaaaauauuaaauuuuuuuaaaauuuuaaauccauugugaaaucccacagacucuguaccaaauagcuacucuuaacuauauagaaguucauuuguaaaaucuuuguuuucuguauuuguguacaccugaaugcaguuguuuuuagucuggaaccaaauuccuauguccuaaaaggacaauacacacucuuuuuuuuuuuuuuuuuuuuugguuuuucaagacaggguuucucuguguagcccuggcuguccuagaacucacucuguagaccaggcuggccucgaacucagaaauccgccugccucugccucccaagugcugggauuaaaggcgugugccaccacaccuggcaacaacacacacucuuaauagcugaacacaguccagaccucauuuucaaacacagaugaaaccaaauacaaccaccaaacagauucuaggcaccuccuucacucuguaccuccuacauucuaggccauaaaucaauuuuguucuaaucuagagaagauauagauacaacgagaauggaaguuccccaccuugaaauacugcaucuaacaacucugaauccggggccuagguuaucuuuuaucacggcucacgacuaacauaacacaacgcaccaagaacaacuguuuccaaggaaaacagaacugcaagcaguaaggacugagcuccucccgccuacaaaauguaucucacacugcauagcacauauuuuuacaacucuggcuuccuugaaaauagaagagcuggagagcugguucaauggguaaaaaagcucuuccugguuuugcacaagacccugguucaguucccagcacccucuauuacuucagucccaggggaucugauggccuucuucaucucauugggauuaugcgcacauguaugcaggcaagacacucauaugcauaaaauaagauaaaaucuauuuaaugggagaggaaaauugcugguuaguacagccuccuccacacugggaaggcuuaagaguucuaggccaaucugggcuacaguggaagacccugucucaaaacaaagaaaaaaaaaacuucaacaucggaauuaucaaauaggcuccuuucaauaaguuaccuguaauuuuucaacucagaacaaagcauuuucuaaacuucaauauucaaucauuaaagcucucagaaagcuguuauaaggaaauuucuuuuaucugguaagaagcaaauauaaaccaggcacauugguacaugucucuaauucaccuacuuggcgaagacgggaggacugcaaguuugaaaccauccuggguuagcuaacaaaaucuugccucaaaauagaaaacuaaaaagcacugugggacguaacucaaugugauaaagcucacacaaaacacuugguuagaucuccagcacuacugaaagacaaagagcgggcauauccacaauaaacaucaccucagccuuuaauguuauucuagauaguuauuccugaggaacacuacauaaauuacauuugcucuuacauaaagagccuaauagugccaaaggcaggaaaacaagcaaaagcaaaaugacuuugcaaaacaaggcaaucuugaguaacuccacuaaauauccacuacuagguaucaagagaacuccuugggccaacgagcgagauggcucagcagauuaaaggcauuugccaagcaagccugaccaccugagcucuauucugaaaaugacuguacagguagacagaaccaacuccacaauaguguugaccucacauacacaucaaaacaugcaugugacaacacacacugagcaauaaauaauuugggggaagacaacuuagaaagccauaaugauuacaacagaauaauuuuggcugcaagaauaacaaagccaucagaacaaauuugagaaacaaauacacccaucaccugucauaaccaagaugacaagaaguggggaaaaaaaaaucauccuagugaacuaaaccccuaaauccaaaguaaaacugccucaauuccuaagaguacucaaaucaauaaugaacagacugcuggucucaacgcaagguagcauauuaagaggguaugcccagaacaugaguagaaaugaugucuuaaaaacaggacuggagcgcaguuguaaagcucuugccuacauggggacaauccugaguuccauucccaaucaaacaaacacaaacuaacaacaaaagaaauaaaaucaagaauucaaggucuaguuggcaagauggcucagcaguuaagagcacugacugcucuuccuaagguccugaguucaaaucccagcaaccacauguuggcucacaaccauccaaaaugagaucuggagccgggcgugguggcgcacgccuuuaauccuagcacuugggaggcagaggcaggcggauuucugaguucgaggccagccuggucuacaaagugaguuccaggacagccaggcuauacagagaaacccugucucgaaagaaaaaaaaaaaaaaaaaaaaaaacaaaaaaaaaaacaaaaugagaucugacgcccucuucugcugugucuaagacagcuacaguguacuuauuuauaauaauaaauaaaucuuugggccggagggagcggggcugaccagagcgagcagagguccuaaagucaauucccaacaaccacaugaaggcucacaaccaucuauacagcuacaguuuacucauauacauaaaauaaauaaauaaaucuuuaagggcuggagggauggaucagcaguuaagagcacuggcugcucucccagaggacccggguucaacucccagcacccacauagcagcuugcaacuguaacuucuguuccaggagauuugacacccuaacacaggcagacagacagacaugcaggcaaaguaguaauaagcauaaaauuuuuuagauuuuuuaaaaaguuaaauaaaucuuaaaaaaaaaagaacucaaggccaucaaaggacauuacagaacguuaacucaagccucagaccagcaagaaauuuaagaguccauaacugaaaaugcacucauaucaaaaauauaugaacagcuacuacgaaucaacuagaauaugaaaacuaucccccauagaaaguagaaaagcaaccaguagguuugaaaaaccuuugaaaaagcuaaaagucaaaacugcucaaauacacuugaaaagauaaucaacgucagucaucacuaaacugacuagcaauuaugaaagagauggauaccaccaaagguguuagaguaauuaaaaaugcaaagaugcuggaccguguaccacagcuggcaggcauguaaacugguauaaccacuucugcaaacagcaauguaagcagaaccaaagacagaaauaccccaugagauggaccaggcaaaaacuacaaacagcuccaauuauucaccugggaaacucaagaagacuccaacaucaacuauauaaauauccagcacaaugcuuggccuaaacagaauagacucccuguuaugugagccuggaccucccuucuucacacaugcaggacaaaaggauauuuagaacuuaagucucaaauguguuccaauggguucuccucuugcaaaaauaaaacucaaaacccuuuaguaaagagaccugccagugcucucagccugacucacuccuaucugcauaaaacucuacucaaaaaugucuuccacacaggcucaccuccacuuaacugagguuucugcuuuaaugaaacugcacuacacucugacagguugcuuauauaaggagcaucccccaccaguccuugccuccuguuccuuucugcuuauccuuaucaaucacuuaucaucagacagguaaacgugccuuuugcaugucugcacuccaguggccucuucauuugaaacucugguucagcacaacacacuggcuggcacacucagcaaguguuaagugacugcauccuauggcguggguuccaacuacugcacuagcuggcugacagagcuccuuaaaccaacaggaauuuaccaagacaaaaaugaaaaucuuccauuaagcuaaaguagauguucugcuuuaaaaaaagauuaaaauauuuauuucugccgcauuuaauucuccaagacucugguauaaggagagcauuaacuaguucaaauuccaagagauaauuacuucaggcccucagugguaaagaaauuauccugcugaucuuccccaucguccugcuguccuggaaaugaaccuaaggaagcacacugcacccuaguucuuucagauaauaaauuucacuauagcuccacuagcaaaacauaagaguaucuagagauaugaaucagauagcccagcaauauggccucagccaagaagccaacauuucaacauaaugccaaucgugacagaagucaauuuaacaagacuuucaugcaagaaaccugcacagaguagacugaaauaccucaccagaauuuugucacugaugucugcgggguaggaggcagcauagaggagcccaaauuacuucaucacagucuugucacuagugauagggaggaggggaacccaguccucauaaacuccaugaaguggacaucuuucuaccaaaauguuauauaaguacuucacaacacugaucuacacaguuugguagcagaccugggauuccaguacugaggaagcugaggcaaaaggcuguacuagcaaagcuagccugggcuauauacuaagacccugccucaaaaaacaaaauuaaauauaaaaagcuagucugaguuucucucuuuuuuaucuuuugucggaaaaauuaagcaaaauccuuaaggagggaaggaaaaaauaaaaagaaacuaccugggcaauguuuucgauaaauuuaaugagcacuagaguaacuaagaaauaaaucuaaguaacugguauucaaaaccuaccuaauaguuaauuuucuugcuuagaaacagguuagcaaguaaagauauuaugacaaacuuguuagcacaaaaauuaaguuucaacaccuuuauugaaaaacugaaauuuucuaauuuuauaaacuuuuagguaaaauacuaccaucauccuucuaugguaguuuuuuauauaaaguaaguauuuauauaagugccuaagcaaaacaggacccgcaucacacccuaccuacuguuccacaguuugcaugccugucuaaguuacgcaugauuauuuaaccaacucuccaauguaggacguucagguuuuucccauucuaaccaaaccacaggaacucuucuuacaugucuugccagaucaaaaaaggaugaaggggaaggauaaauacaccauaauaaaauccaucaugacuuugaaugccaacuuaacaguuaaagacucccuggcugcacaugccccuagagauggagacagggggagcaaagccgucucacugacuccgacagggaggcuggggcagcacaaccaggaaggagcucacaccauucuaggucaaggccagcauggcucgugagacauugguuuuugaaaaaaaaaaaagaaaggagggagggagggagggacggacagauggagaggaggaaggaaaaaagaaaaagagggaaagaaauggaaaaagaaaugaacacaaagccaggcagugguggcgcacgccuuuaaccccagcacuugagaggcagagacaggcagaugucugagccagccugaucuacaaagugaguuccaggacagccagggcuauacagagaaacccugucucaaaaaagaaaaaaaaagaaagaaagaaagaaaaaaaagaaaagaaaagaauagaaaaagaaaaaagaaaaaaagaaauaaacaaaaauuuuaacaaaaaaaaaggggggggguaagacuguuucaccacugauuguguagaugaaaaugagaaagugcuaaugaacuugacccugacccuacccauucuccucagaugcugucacucacugcggaugguauacauauuguuuacccuuuucuucaagcugccauaauuuccuucucagagucaguguuccaguaucaagcagaaccaaauaaggagagaccaggauaaaaccuggaccacuuagugggaguucaaggaaacaagggcaacaacaacuaagcauuaucuacaguccuucucaagccagguucuaagccucuaugugaggaacucaggucccuuucugcagcuaaagccagcaaaguagguaccgccaucaaaccaaaaagucauucuguugacaguuuaauucccucucaugaacagggaaaggcuauggcugacaaaggguaguaaguauccacucacacaaagcuacuaugacacuuuuaaugcuucuacuuucauaccacagacugcaggacuguuaaaaugagugggcuuuaaaaccuaaguaaagucccucacaaaauuacuaacucacuauuuacaaagcaaagcucuccugugcaaaacucuaaauaaagcacaggcaucuaaccagggugucuuguuaagcccuugugacucuccugucuaccaaugcagauuuuucuauuauguaaauagucuguuaaguaaauacugaagggcuuucuuauaaacugggaggcauuuuaccuaacccaaacagaaaugcacauuuaauuuguaugccaacuuaacauuaacacaagaugugacugacaaagguauugaaguccacauccacugaaaacacucagucuccuauugaguuuagcacccaagacagguacucgcucaaauauaauacuaaccacaauaagcuguucagaacaccccaaaguacccuucguauuucauucacccuaacaucagaauaaaacccaggcucucccuuuuaaaaaugacacagggaagcaaagaugcugaucagcauuacucacaagcaaaaguguuuuccauaugggcuagaggcagugguaccagcuacccugggacacuucacaauuuggucaaaauuaacaaggaggcaauauguagggcuuuguuuugguuugucuuucuuucuuucuuucuuucuuucuuucuuucuuucuuucuuucuuucuuucuuauuuuccucuauuuuccuuuuuaaaaaucuguuucuccuuuuaaaaaaaaauuaagaugaagucaagucugaugccacagguaaucccaccuacuuagaaggcugaguuuagaggcuuacagcuuuaaguccaggcugggcuacaaugggaguucaaggccagcuugggcaacuuaaaaagaacauguuucaaaaauuaaaaaguugacugauaauauagcucuccuagaaccauaauaaauaaaaauauaaaucaauaaaagcaaauacgucuugugauuuaaauuaaacuagguuaacuuuuaaacucucaucuuuaagaacaaguuuaaaauccaacaguuguauuauguauuagggaaaaacggggaaaaauauauauauauauaaagcagcagcagcaggagcuaaccaaaguaugaaagacuccuacaaucuguuaacaggugguuucuaagccaaaagggauuucuugggaccuaggaaaaacuuucauauaguuaaccucagcaauuuuucuaaccacauuucaugaaaaguuuuacauagguauaugaauaaaaaggaguuuggguuucauagcaaaaauucaagcuuacaugaaauaggagcucccaagauccacccuuaacugaggagcuacuggaaguugacaacagcuaagggacaaagacugacacaugggauuuguggugcccgugcuccuuggaugguucuaucuaacacauaugggcaagcacuagcuggacugagauauuuaaaaaaaaaaaaaaaaaaaaaaaggacaugaaguuggaagggggaugugugggagggaaagggaguuaaguugaagggacgaaauagauuuaacugacugcauguacaauucuccaggaguaaauuccaaauaaauaacauaaaguuuacacgcaaaaauauuuaaauauagaaaaauagagcuucucaaauguuuaugcaacuuccuaaaccuuuauuaauaccucacucuggcaacaggacaugugacguuuaagcaaauuaaaugucgcuuuucaaagaauuucaaggcacgucaggagaaucaacuugaaaaccuacagaauccacaggacaauuucacauuuaacaaucgagcuguaguucuuaacuacauaacauuuccuuauaaaaaaaaauauauaauaauucccauucggagauucuaagcauucuccucuccucugguagaucaaaaaaaaaaaaaaaaaguggggaaagccuuguuuaauaaaggcuugaaguuaaaauuuaacaaaggccuucucucuugucgacuacuaaaccuaagagcuggauugcacaggaagugcaucaucaccaacguagucaaacuuggacgcucaaucaaauaaggauaucucgugugugugugugugugugugugugugugugugugugugugugugcgcacgcgcgcauuguaccaacguuuagauaauaaauagcuaagggguaaaaagagugaccacuucuguucacaguguaauccccgaaccaaaaaggaaaaaaaaaaaaacacguauuuuuauuuagucccaacaauugcucucucaguucagggucaaccgauuauccuauccccugcauccucuguauuccccacauccccgcaucccuuccggggaaggucaaagggccaccgacaaaagacaacaaaugcacgugacaaaaguuucucccgugguccccgcggcccgaggcugcgcagcucgcgcguggggaucucgguuucacgcagagggcuggccgcauuagagguugcucagagugucgcggccacaugcggaagccggccagggccggaaccaagcgcggccuguuaccuuuuccugcuccucgcgaagccgcgccaccucuggugcgcgcagcggagcggcggcugaggccucugcaaggggcuggggcucgggcucggguucggacgggggcuccaugcccggcgccgcagccucagcgaggcgaacaaguccuaaacaaguguuuauggagacggcguggccggcggaugcccagcgcccgcgcgcucgcccucaugcacugcacgccucucucugaagaggccgcgcucacuuucgccgcugccccgggggccgccgcucgcguccgggcuacccgcggccgcaucucacacgcgcauaccgccgccgccgccgccgccgccgccucggagcagcaggcccuacaccaggcgcgccacgcucuucucccgcaaccgggcccagcuuagcgucccgcgacugccgcgccuccgcgcacgccccgccccucgccccgcccgcgcagcacgccgggaagcucucaagcuccgcccuagggggcggggcuauggcggggacagggccuccgggugggguggaggcugagccgcucaggaccccugcacaggaugagaggcggcgggauagugggucccaauucgcuuggcgcugccuguggugguaggaacuuaauaugagcacugagacuguuucauaagcucauuuaauuuuaucaaauucagcuguuucccaugccuuuuaaugaacuaaugugguuuaaugagcuaaaaugcacaauauacaacuauauuuuugcguauguauuaauuacuguacacauuacaauuuuccuuacauauauuaagcugcaguauuaauauuacuauguuacuacguaugcacuguguagcacauuuuucaacaacagcugcugcccuaucccauguauuuuauaauucugguguuuuguuuaacaguggggaccaaaugcauggcuuuggacuugcuagacaagcacucuaccaacugagcuaaauccccaucccuguuccacucaguauuuuaaaaauuggaagcuggagcagggagcacaccuuuaauccccaacaguuugaaggcagaggcaggaggguaucugugaguuugaagccagccugguccacauagcaaguuccaggccagccugagcugaauaaaucucuuggacucacuuccucccccuagcccuuugugcagccucuguuuguggcaguccucuagucuaccuuguggccuuguccuaacucuaucccaagcccggacaauaggcauagauccuauuaccucaguauuguguguauaggaacaggcuggcaggcaccugcagaauucuggcccucugugggucuguuugccccuaucuuccacuucuguuccagcucccaaguccacauccauccuuugaucacuugcaucaagaaagaaaaagcagggacgauuggggaagaugguaaauaugaauuucucucccugcagaugcagcaaccucugaaacacagucaaacucugagcacucaucuugccucccgccaauagcagcaucccugacuccuagggcaccgcagaagcuacuucucuagugcugggcuuugaauaugaacugaccccauguguuucaauacuuggucccuaacagguaguacuaauuuggaaggauacuuaaaaauuaggauguaccaggcagugguggcucacaccuuuaaucccagaaucuggaaggcagaggcaggcagaucucugaguuugaggccagccuggucuacagagugaguuccaggacauccaaggcuacacaaaaaaacccugucuugaaaagugaggggguggggaauuuaguaugucguuuagaauguagaaccuaaguggaggaagucggucagugggguaagucuuugguauagcaucccuggauacuaccugucacucucugccucuuguucagcugugaaguaaacugaggcaggccaugccucccugccauaauacacugaauccucuggaauggcauucccuacagaaagugaucuaggauagauuuguuuauguuugagugcauuuuuagacauguaucaagcaaaagcaaaagaacauguagcaagaagcagauagagaacaaaauaaaucaggcccuuacgacgucuagcagaacuaucuaggguaaccagagcgggaaagcaagcaagaauaaaaucagcagcaaacagcagacagauaacaucaacuugagcacuuacaacaugccccagaaagacugggcugagucuguccaaaaggcuggagcucuguuugggauguuuccagcuagagcagagaguucaccccaccaaugagcuuccuauuucuccuccccaccucgggcagucacaggauagacgauaguaacuuccauuagaaacgguucgccuucuaucuguccucaagggugcuauuauagcuguuuguucuuucucccugucacagaagcacagaggccagccugccccaagaaagugucuccaaggacaugagugauaaacuugggugaaucugagguagggagagucuguccugcucucagcaagcagcacaugcaguuuaccaacagcacuuacaggacaaauggugagccaacuacaggacaaugguaacgucuccucccuuacauuguuucugucagucacagcaacccaaaaguaaaauauauaucugguguggcuugccacuccaccccugaaauguccaaggacagcuccuuacccuccacuccucuuugaugggauuagccccagaucaccacagacccugugcuacagaaggcuggcccccaaucccagcuccagucuacggauaugaauuuguaucuaaagugguugcuauaaagagggcacaucacgcuauacaaauacaggcuuuuggaggcuucaaagaaaguucuccuucguucuaucaauaccuccuuaaagaauccaacccuugagagagcaaguaggcauguauguuuuaggcagcucuucuugucaggggaaggcaugacagaguucauggcagcagaagcaugggauaggaucuucacaucucuacagaucaagaagcagagaaacggaugcuaccuuccagcuggcuucugacuuucucccuuuucauccagucuagaaccccaauccauaggacucuuaguacagaucucucaguuaaaccucucuggaaacuuucucaaacauucacucaaaauugagagucccuugaggcuaaaagagauguugccaaagcuaagagcacuugcuguucuuucaggugacgauuuuggauccuccagcucuagugacucaacaccgucuucacaugcgcaaaacccccacccagaauacacauaauuaaaaaagaaaagcagggcuggagagaugauucagugguuaagagugagccaugaucuuucagggggcccaaauucaguucccagcacccccagacgucauaaaaaagaaaaugaggauuccaaguguagucgaguugacacagcccauugaucuccauuccuaggugguugaaggaccaguuuacucucccuucuuaagccuaggcaucucauucucuugcccuuggacacuggagauccugauucacacugaaauaggccacuggcuggccauccugguucucaggccuaagguagcccaucuuaagacuuuucagcugcagggcggugguggcacacaccuuuaaucccagcacuugggagucagaggcaggcagauuucugaguucgaggucagccuggucuacaaagugaguuccaggacagccaggguuauacagagaaaaucccaucucagaaaaaaacaaaacaaaacaaaagacuuuucagccuuccuaaguuuauaaguuacuuugcaguuuuagaaagaaaggguuggucugggcuccugguugcagggguuucucaguccaucaugaauacacagagacagcucaugcugauagggacaugucgcuacuccaugcugguggaaaagaauccugaagcuuugcucagaguuaaggguagauauaaccgucaaagaccaaguccuggugaacugcuucuaccagccaggcuccaccuccuaaaagcuccagggccuucgaaauacaacuaccaacuagagaccaagccaagaaaucaugagccuaugggagacauuccuaauucaaaccauaaccuuaacuuccugagccaccucccaccgugugccccugcuucugcaugcauuuccauacgcaggacccccaucugucccauguuuuccccuggagaauccuaugugguagcugaacugaaaacucucacaccucaucuguaggagaagcacuagcaaugucaaaugucagcuuaccaagacauacacuggagcccucugaggaucgugacuuuccggaaagaaaauuacaugagcuuggcagaagaguuccgaugagcuagcaaagagcagcagggucguugaaaagaaugug

SEQ ID NO: 3730 - RNA, 63563 nt, Mus musculus
cacauucuuuucaacgacccugcugcucuuugcuagcucaucggaacucuucugccaagcucauguaauuuucuuuccggaaagucacgauccucagagggcuccaguguaugucuugguaagcugacauuugacauugcuagugcuucuccuacagaugaggugugagaguuuucaguucagcuaccacauaggauucuccaggggaaaacaugggacagauggggguccugcguauggaaaugcaugcagaagcaggggcacacggugggagguggcucaggaaguuaagguuaugguuugaauuaggaaugucucccauaggcucaugauuucuuggcuuggucucuaguugguaguuguauuucgaaggcccuggagcuuuuaggagguggagccuggcugguagaagcaguucaccaggacuuggucuuugacgguuauaucuacccuuaacucugagcaaagcuucaggauucuuuuccaccagcauggaguagcgacaugucccuaucagcaugagcugucucuguguauucaugauggacugagaaaccccugcaaccaggagcccagaccaacccuuucuuucuaaaacugcaaaguaacuuauaaacuuaggaaggcugaaaagucuuuuguuuuguuuuguuuuuuucugagaugggauuuucucuguauaacccuggcuguccuggaacucacuuuguagaccaggcugaccucgaacucagaaaucugccugccucugacucccaagugcugggauuaaaggugugugccaccaccgcccugcagcugaaaagucuuaagaugggcuaccuuaggccugagaaccaggauggccagccaguggccuauuucagugugaaucaggaucuccaguguccaagggcaagagaaugagaugccuaggcuuaagaagggagaguaaacugguccuucaaccaccuaggaauggagaucaaugggcugugucaacucgacuacacuuggaauccucauuuucuuuuuuaugacgucugggggugcugggaacugaauuugggcccccugaaagaucauggcucacucuuaaccacugaaucaucucuccagcccugcuuuucuuuuuuaauuauguguauucuggguggggguuuugcgcaugugaagacgguguugagucacuagagcuggaggauccaaaaucgucaccugaaagaacagcaagugcucuuagcuuuggcaacaucucuuuuagccucaagggacucucaauuuugagugaauguuugagaaaguuuccagagagguuuaacugagagaucuguacuaagaguccuauggauugggguucuagacuggaugaaaagggagaaagucagaagccagcuggaagguagcauccguuucucugcuucuugaucuguagagaugugaagauccuaucccaugcuucugcugccaugaacucugucaugccuuccccugacaagaagagcugccuaaaacauacaugccuacuugcucucucaaggguuggauucuuuaaggagguauugauagaacgaaggagaacuuucuuugaagccuccaaaagccuguauuuguauagcgugaugugcccucuuuauagcaaccacuuuagauacaaauucauauccguagacuggagcugggauugggggccagccuucuguagcacagggucuguggugaucuggggcuaaucccaucaaagaggaguggaggguaaggagcuguccuuggacauuucagggguggaguggcaagccacaccagauauauauuuuacuuuuggguugcugugacugacagaaacaauguaagggaggagacguuaccauuguccuguaguuggcucaccauuuguccuguaagugcuguugguaaacugcaugugcugcuugcugagagcaggacagacucucccuaccucagauucacccaaguuuaucacucauguccuuggagacacuuucuuggggcaggcuggccucugugcuucugugacagggagaaagaacaaacagcuauaauagcacccuugaggacagauagaaggcgaaccguuucuaauggaaguuacuaucgucuauccugugacugcccgagguggggaggagaaauaggaagcucauugguggggugaacucucugcucuagcuggaaacaucccaaacagagcuccagccuuuuggacagacucagcccagucuuucuggggcauguuguaagugcucaaguugauguuaucugucugcuguuugcugcugauuuuauucuugcuugcuuucccgcucugguuacccuagauaguucugcuagacgucguaagggccugauuuauuuuguucucuaucugcuucuugcuacauguucuuuugcuuuugcuugauacaugucuaaaaaugcacucaaacauaaacaaaucuauccuagaucacuuucuguagggaaugccauuccagaggauucaguguauuauggcagggaggcauggccugccucaguuuacuucacagcugaacaagaggcagagagugacagguaguauccagggaugcuauaccaaagacuuaccccacugaccgacuuccuccacuuagguucuacauucuaaacgacauacuaaauuccccacccccucacuuuucaagacaggguuuuuuuguguagccuuggauguccuggaacucacucuguagaccaggcuggccucaaacucagagaucugccugccucugccuuccagauucugggauuaaaggugugagccaccacugccugguacauccuaauuuuuaaguauccuuccaaauuaguacuaccuguuagggaccaaguauugaaacacauggggucaguucauauucaaagcccagcacuagagaaguagcuucugcggugcccuaggagucagggaugcugcuauuggcgggaggcaagaugagugcucagaguuugacuguguuucagagguugcugcaucugcagggagagaaauucauauuuaccaucuuccccaaucgucccugcuuuuucuuucuugaugcaagugaucaaaggauggauguggacuugggagcuggaacagaaguggaagauaggggcaaacagacccacagagggccagaauucugcaggugccugccagccuguuccuauacacacaauacugagguaauaggaucuaugccuauuguccgggcuugggauagaguuaggacaaggccacaagguagacuagaggacugccacaaacagaggcugcacaaagggcuagggggaggaagugaguccaagagauuuauucagcucaggcuggccuggaacuugcuauguggaccaggcuggcuucaaacucacagauacccuccugccucugccuucaaacuguuggggauuaaaggugugcucccugcuccagcuuccaauuuuuaaaauacugaguggaacagggauggggauuuagcucaguugguagagugcuugucuagcaaguccaaagccaugcauuugguccccacuguuaaacaaaacaccagaauuauaaaauacaugggauagggcagcagcuguuguugaaaaaugugcuacacagugcauacguaguaacauaguaauauuaauacugcagcuuaauauauguaaggaaaauuguaauguguacaguaauuaauacauacgcaaaaauauaguuguauauugugcauuuuagcucauuaaaccacauuaguucauuaaaaggcaugggaaacagcugaauuugauaaaauuaaaugagcuuaugaaacagucucagugcucauauuaaguuccuaccaccacaggcagcgccaagcgaauugggacccacuaucccgccgccucucauccugugcagggguccugagcggcucagccuccaccccacccggaggcccuguccccgccauagccccgcccccuagggcggagcuugagagcuucccggcgugcugcgcgggcggggcgaggggcggggcgugcgcggaggcgcggcagucgcgggacgcuaagcugggcccgguugcgggagaagagcguggcgcgccugguguagggccugcugcuccgaggcggcggcggcggcggcggcggcgguaugcgcgugugagaugcggccgcggguagcccggacgcgagcggcggcccccggggcagcggcgaaagugagcgcggccucuucagagagaggcgugcagugcaugagggcgagcgcgcgggcgcugggcauccgccggccacgccgucuccauaaacacuuguuuaggacuuguucgccucgcugaggcugcggcgccgggcauggagcccccguccgaacccgagcccgagccccagccccuugcagaggccucagccgccgcuccgcugcgcgcaccagagguggcgcggcuucgcgaggagcaggaaaagguaacaggccgcgcuugguuccggcccuggccggcuuccgcauguggccgcgacacucugagcaaccucuaaugcggccagcccucugcgugaaaccgagauccccacgcgcgagcugcgcagccucgggccgcggggaccacgggagaaacuuuugucacgugcauuuguugucuuuugucgguggcccuuugaccuuccccggaagggaugcggggauguggggaauacagaggaugcaggggauaggauaaucgguugacccugaacugagagagcaauuguugggacuaaauaaaaauacguguuuuuuuuuuuuuccuuuuugguucggggauuacacugugaacagaaguggucacucuuuuuaccccuuagcuauuuauuaucuaaacguugguacaaugcgcgcgugcgcacacacacacacacacacacacacacacacacacacacacacacgagauauccuuauuugauugagcguccaaguuugacuacguuggugaugaugcacuuccugugcaauccagcucuuagguuuaguagucgacaagagagaaggccuuuguuaaauuuuaacuucaagccuuuauuaaacaaggcuuuccccacuuuuuuuuuuuuuuuuugaucuaccagaggagaggagaaugcuuagaaucuccgaaugggaauuauuauauauuuuuuuuuauaaggaaauguuauguaguuaagaacuacagcucgauuguuaaaugugaaauuguccuguggauucuguagguuuucaaguugauucuccugacgugccuugaaauucuuugaaaagcgacauuuaauuugcuuaaacgucacauguccuguugccagagugagguauuaauaaagguuuaggaaguugcauaaacauuugagaagcucuauuuuucuauauuuaaauauuuuugcguguaaacuuuauguuauuuauuuggaauuuacuccuggagaauuguacaugcagucaguuaaaucuauuucgucccuucaacuuaacucccuuucccucccacacaucccccuuccaacuucauguccuuuuuuuuuuuuuuuuuuuuuuuaaauaucucaguccagcuagugcuugcccauauguguuagauagaaccauccaaggagcacgggcaccacaaaucccaugugucagucuuugucccuuagcuguugucaacuuccaguagcuccucaguuaaggguggaucuugggagcuccuauuucauguaagcuugaauuuuugcuaugaaacccaaacuccuuuuuauucauauaccuauguaaaacuuuucaugaaaugugguuagaaaaauugcugagguuaacuauaugaaaguuuuuccuaggucccaagaaaucccuuuuggcuuagaaaccaccuguuaacagauuguaggagucuuucauacuuugguuagcuccugcugcugcugcuuuauauauauauauauuuuuccccguuuuucccuaauacauaauacaacuguuggauuuuaaacuuguucuuaaagaugagaguuuaaaaguuaaccuaguuuaauuuaaaucacaagacguauuugcuuuuauugauuuauauuuuuauuuauuaugguucuaggagagcuauauuaucagucaacuuuuuaauuuuugaaacauguucuuuuuaaguugcccaagcuggccuugaacucccauuguagcccagccuggacuuaaagcuguaagccucuaaacucagccuucuaaguaggugggauuaccuguggcaucagacuugacuucaucuuaauuuuuuuuuaaaaggagaaacagauuuuuaaaaaggaaaauagaggaaaauaagaaagaaagaaagaaagaaagaaagaaagaaagaaagaaagaaagaaagaaagacaaaccaaaacaaagcccuacauauugccuccuuguuaauuuugaccaaauugugaagugucccaggguagcugguaccacugccucuagcccauauggaaaacacuuuugcuugugaguaaugcugaucagcaucuuugcuucccugugucauuuuuaaaagggagagccuggguuuuauucugauguuagggugaaugaaauacgaaggguacuuugggguguucugaacagcuuauugugguuaguauuauauuugagcgaguaccugucuugggugcuaaacucaauaggagacugaguguuuucaguggauguggacuucaauaccuuugucagucacaucuuguguuaauguuaaguuggcauacaaauuaaaugugcauuucuguuuggguuagguaaaaugccucccaguuuauaagaaagcccuucaguauuuacuuaacagacuauuuacauaauagaaaaaucugcauugguagacaggagagucacaagggcuuaacaagacacccugguuagaugccugugcuuuauuuagaguuuugcacaggagagcuuugcuuuguaaauagugaguuaguaauuuugugagggacuuuacuuagguuuuaaagcccacucauuuuaacaguccugcagucugugguaugaaaguagaagcauuaaaagugucauaguagcuuugugugaguggauacuuacuacccuuugucagccauagccuuucccuguucaugagagggaauuaaacugucaacagaaugacuuuuugguuugauggcgguaccuacuuugcuggcuuuagcugcagaaagggaccugaguuccucacauagaggcuuagaaccuggcuugagaaggacuguagauaaugcuuaguuguuguugcccuuguuuccuugaacucccacuaagugguccagguuuuauccuggucucuccuuauuugguucugcuugauacuggaacacugacucugagaaggaaauuauggcagcuugaagaaaaggguaaacaauauguauaccauccgcagugagugacagcaucugaggagaauggguagggucagggucaaguucauuagcacuuucucauuuucaucuacacaaucaguggugaaacagucuuacccccccccuuuuuuuuuguuaaaauuuuuguuuauuucuuuuuuucuuuuuucuuuuucuauucuuuucuuuucuuuuuuuucuuucuuucuuucuuuuuuuuucuuuuuugagacaggguuucucuguauagcccuggcuguccuggaacucacuuuguagaucaggcuggcucagacaucugccugucucugccucucaagugcugggguuaaaggcgugcgccaccacugccuggcuuuguguucauuucuuuuuccauuucuuucccucuuuuucuuuuuuccuuccuccucuccaucuguccgucccucccucccucccuccuuucuuuuuuuuuuuucaaaaaccaaugucucacgagccaugcuggccuugaccuagaauggugugagcuccuuccugguugugcugccccagccucccugucggagucagugagacggcuuugcucccccugucuccaucucuaggggcaugugcagccagggagucuuuaacuguuaaguuggcauucaaagucaugauggauuuuauuaugguguauuuauccuuccccuucauccuuuuuugaucuggcaagacauguaagaagaguuccugugguuugguuagaaugggaaaaaccugaacguccuacauuggagaguugguuaaauaaucaugcguaacuuagacaggcaugcaaacuguggaacaguagguagggugugaugcggguccuguuuugcuuaggcacuuauauaaauacuuacuuuauauaaaaaacuaccauagaaggaugaugguaguauuuuaccuaaaaguuuauaaaauuagaaaauuucaguuuuucaauaaagguguugaaacuuaauuuuugugcuaacaaguuugucauaauaucuuuacuugcuaaccuguuucuaagcaagaaaauuaacuauuagguagguuuugaauaccaguuacuuagauuuauuucuuaguuacucuagugcucauuaaauuuaucgaaaacauugcccagguaguuucuuuuuauuuuuuccuucccuccuuaaggauuuugcuuaauuuuuccgacaaaagauaaaaaagagagaaacucagacuagcuuuuuauauuuaauuuuguuuuuugaggcagggucuuaguauauagcccaggcuagcuuugcuaguacagccuuuugccucagcuuccucaguacuggaaucccaggucugcuaccaaacuguguagaucaguguugugaaguacuuauauaacauuuugguagaaagauguccacuucauggaguuuaugaggacuggguuccccuccucccuaucacuagugacaagacugugaugaaguaauuugggcuccucuaugcugccuccuaccccgcagacaucagugacaaaauucuggugagguauuucagucuacucugugcagguuucuugcaugaaagucuuguuaaauugacuucugucacgauuggcauuauguugaaauguuggcuucuuggcugaggccauauugcugggcuaucugauucauaucucuagauacucuuauguuuugcuaguggagcuauagugaaauuuauuaucugaaagaacuagggugcagugugcuuccuuagguucauuuccaggacagcaggacgauggggaagaucagcaggauaauuucuuuaccacugagggccugaaguaauuaucucuuggaauuugaacuaguuaaugcucuccuuauaccagagucuuggagaauuaaaugcggcagaaauaaauauuuuaaucuuuuuuuaaagcagaacaucuacuuuagcuuaauggaagauuuucauuuuugucuugguaaauuccuguugguuuaaggagcucugucagccagcuagugcaguaguuggaacccacgccauaggaugcagucacuuaacacuugcugagugugccagccaguguguugugcugaaccagaguuucaaaugaagaggccacuggagugcagacaugcaaaaggcacguuuaccugucugaugauaagugauugauaaggauaagcagaaaggaacaggaggcaaggacuggugggggaugcuccuuauauaagcaaccugucagaguguagugcaguuucauuaaagcagaaaccucaguuaaguggaggugagccuguguggaagacauuuuugaguagaguuuuaugcagauaggagugagucaggcugagagcacuggcaggucucuuuacuaaaggguuuugaguuuuauuuuugcaagaggagaacccauuggaacacauuugagacuuaaguucuaaauauccuuuuguccugcaugugugaagaagggagguccaggcucacauaacagggagucuauucuguuuaggccaagcauugugcuggauauuuauauaguugauguuggagucuucuugaguuucccaggugaauaauuggagcuguuuguaguuuuugccugguccaucucaugggguauuucugucuuugguucugcuuacauugcuguuugcagaagugguuauaccaguuuacaugccugccagcugugguacacgguccagcaucuuugcauuuuuaauuacucuaacaccuuuggugguauccaucucuuucauaauugcuagucaguuuagugaugacugacguugauuaucuuuucaaguguauuugagcaguuuugacuuuuagcuuuuucaaagguuuuucaaaccuacugguugcuuuucuacuuucuaugggggauaguuuucauauucuaguugauucguaguagcuguucauauauuuuugauaugagugcauuuucaguuauggacucuuaaauuucuugcuggucugaggcuugaguuaacguucuguaauguccuuugauggccuugaguucuuuuuuuuuuaagauuuauuuaacuuuuuaaaaaaucuaaaaaauuuuaugcuuauuacuacuuugccugcaugucugucugucugccuguguuagggugucaaaucuccuggaacagaaguuacaguugcaagcugcuaugugggugcugggaguugaacccggguccucugggagagcagccagugcucuuaacugcugauccaucccuccagcccuuaaagauuuauuuauuuauuuuauguauaugaguaaacuguagcuguauagaugguugugagccuucaugugguuguugggaauugacuuuaggaccucugcucgcucuggucagccccgcucccuccggcccaaagauuuauuuauuauuauaaauaaguacacuguagcugucuuagacacagcagaagagggcgucagaucucauuuuguuuuuuuuuuuguuuuuuuuuuuuuuuuuuuuuuucuuucgagacaggguuucucuguauagccuggcuguccuggaacucacuuuguagaccaggcuggccucgaacucagaaauccgccugccucugccucccaagugcuaggauuaaaggcgugcgccaccacgcccggcuccagaucucauuuuggaugguugugagccaacaugugguugcugggauuugaacucaggaccuuaggaagagcagucagugcucuuaacugcugagccaucuugccaacuagaccuugaauucuugauuuuauuucuuuuguuguuaguuuguguuuguuugauugggaauggaacucaggauuguccccauguaggcaagagcuuuacaacugcgcuccaguccuguuuuuaagacaucauuucuacucauguucugggcauacccucuuaauaugcuaccuugcguugagaccagcagucuguucauuauugauuugaguacucuuaggaauugaggcaguuuuacuuuggauuuagggguuuaguucacuaggaugauuuuuuuuuccccacuucuugucaucuugguuaugacaggugauggguguauuuguuucucaaauuuguucugauggcuuuguuauucuugcagccaaaauuauucuguuguaaucauuauggcuuucuaaguugucuucccccaaauuauuuauugcucaguguguguugucacaugcauguuuugauguguaugugaggucaacacuauuguggaguugguucugucuaccuguacagucauuuucagaauagagcucagguggucaggcuugcuuggcaaaugccuuuaaucugcugagccaucucgcucguuggcccaaggaguucucuugauaccuaguaguggauauuuaguggaguuacucaagauugccuuguuuugcaaagucauuuugcuuuugcuuguuuuccugccuuuggcacuauuaggcucuuuauguaagagcaaauguaauuuauguaguguuccucaggaauaacuaucuagaauaacauuaaaggcugaggugauguuuauuguggauaugcccgcucuuugucuuucaguagugcuggagaucuaaccaaguguuuugugugagcuuuaucacauugaguuacgucccacagugcuuuuuaguuuucuauuuugaggcaagauuuuguuagcuaacccaggaugguuucaaacuugcaguccucccgucuucgccaaguaggugaauuagagacauguaccaaugugccugguuuauauuugcuucuuaccagauaaaagaaauuuccuuauaacagcuuucugagagcuuuaaugauugaauauugaaguuuagaaaaugcuuuguucugaguugaaaaauuacagguaacuuauugaaaggagccuauuugauaauuccgauguugaaguuuuuuuuuucuuuguuuugagacagggucuuccacuguagcccagauuggccuagaacucuuaagccuucccaguguggaggaggcuguacuaaccagcaauuuuccucucccauuaaauagauuuuaucuuauuuuaugcauaugagugucuugccugcauacaugugcgcauaaucccaaugagaugaagaaggccaucagauccccugggacugaaguaauagagggugcugggaacugaaccagggucuugugcaaaaccaggaagagcuuuuuuacccauugaaccagcucuccagcucuucuauuuucaaggaagccagaguuguaaaaauaugugcuaugcagugugagauacauuuuguaggcgggaggagcucaguccuuacugcuugcaguucuguuuuccuuggaaacaguuguucuuggugcguuguguuauguuagucgugagccgugauaaaagauaaccuaggccccggauucagaguuguuagaugcaguauuucaagguggggaacuuccauucucguuguaucuauaucuucucuagauuagaacaaaauugauuuauggccuagaauguaggagguacagagugaaggaggugccuagaaucuguuuggugguuguauuugguuucaucuguguuugaaaaugaggucuggacuguguucagcuauuaagaguguguguuguugccaggugugguggcacacgccuuuaaucccagcacuugggaggcagaggcaggcggauuucugaguucgaggccagccuggucuacagagugaguucuaggacagccagggcuacacagagaaacccugucuugaaaaaccaaaaaaaaaaaaaaaaaaaaagaguguguauuguccuuuuaggacauaggaauuugguuccagacuaaaaacaacugcauucagguguacacaaauacagaaaacaaagauuuuacaaaugaacuucuauauaguuaagaguagcuauuugguacagagucugugggauuucacaauggauuuaaaauuuuaaaaaaauuuaauauuuuuuauguaggaguauuuugccugagugcauguuggugcaccacauguaugguuugugccagaagauagcauuggguaucuuggaacuggaguuacagaugguugugagcugccauguaguuucugggaaucaaaccuggguccucuggaagaccagccagcacaccuaaccuuugagucauuucugucguucaguauuggcucuuauacuuuaauuaucaaguauuuugugugugugcauauccaggacugggaggaaaaccccguggcaguuggaacuagaaaggcagccucuucauauccucuuuccugacgcacguugcuuaugcaccaaguccuuucugcuccccuguguuuuagccuuuuuuguuuucucuucuguuuguuauccuguaacuacaagauuuuguuuacauauacacauagauuggcuagauuccacauuugagggagaauguauuuuuuuuuccuucugagauugaguaauuucaauaucaugcauucuaaguccauccauuuuugugcaaauuuugugauugcauuuuucuaagaacugagugguaucauacaucccauuuacauacuuaaacacacacacacacacacacacacacacacacacacacacacauuuuuacuuuaaguagguguaggaaaguuuugucucuuugagaugccuuuggcuugucuuauuaugugcccaggcuacccguggacuaacggcaauacuuuaucuuaguuuucccuguucugggauuacaggccugcuaaguaaauuuuuuaguuuuuguguauaugugcauguacaggugugugccuuuuuaaaugugggguugagccucaaacuuagguguucaaguauuuuaccaacugagccaccuucucagcugcacucugaguuuuaguauacaagacuuuugugcagaagcuauuuaagacuacugcacauuuuagaagaaaggauagucaggugugugagccugcguuacugugggaugaagucuucucugagugacugugugggccuuccuuucucuccucaggcuggugcuguuuacucaguuauuuuccccuuccucagucaggacaggugacuugauuccaacauccacuaucucuagaucuauaguucuuccugcauccugcauuggaguggucauuucuaguacuuggugauacaagauaaacccuuaguaauucccugcaguuuccuguggguuuuuuuuuuuuuuuguuagaauuuagagaucuuuauucagacauucuuauuucuuauggguaauuuugccaucuaaaucauuuauacuucaguaauacucaguauucugugguuguuauuguuguuugccaaaccuuuugagugcugcauacagagucugaagccauaagcauagcugcuucaugccaccuugcuucucuagcaaucucuagcaaccgcuuuuaggauucauguaugcugggucugucaugaauugggaucauggcauuuuguacuaaaaaggcuuugacguauuuuauuugucaccuucgcuagguuuguuuccaguagaacuuauccuauuauauugaguaauguuccauuguacaucugugggcuguuugguuugccuuucgucugaaggcucuuucugccuuuugguuguuaugaauaaugcuauucugaacuacguaagcaucugagucucuguuuucaguuccuuggcauauggccugggaauagagugguugaauccuauagcaacaggagcuacuauacuguuagccauaggagcugcacaaucguauucccaccagcaguauaugaaaauucuggucucugcaugcccugucuuuucaguuauagcugucuucauaagugugaagaggaaucuuaagugcgcuuaugauugcuguuucucuaaugucuaaggauguugccuaacucuucucaugccuguuggccauuuguguauccucuugggaaaauuucuauucagauccuuuacccauguuuuaauuggucugucauuuuguuauugaguuacaagaauucuauauaucuggauauuaaacuccuauauauaauuugcagugcuuuucuugauuuuuuuagcuuaucuuucugauaauguccuuucaugcacaaaaguuuuaaauuuuuuuaaaaaguuuuuauuuauuauuauacgcaugugugccaugguaugugcaugguaugugcaugguaugugcauggaggucaugguaugugcaugguaugugcaugguaugugcauggaggccagaguauuucuucuuggugucuuuucucucuguggauucuggggauugaccuuggguggccacguuugguuaucaagcacaccuuuauccauugagacaccuugaaagccuaaaaugcaggauuuucucuguaguuucuuuagcucuucccuaauuaacucuuuugaggugaacauuugaauuauguugaauuuauuaauauuugcuucuuaaucucacuuuauuuuuucgaauacauaaaacauuuacauggcucaaaaucacaacuauguaagaaauuuauuucuaucccuauuccugucugccauuauagguaacuauuuuuaauuuauuucugguuuaccucauuguauucuguccuuuaagaaguguauaugccccuucaucuccacccugcuuccuuacacaaaaagguagcauagucuauuucguuuguuuaucuuauuaagugaaauaccugguaauuuucuaguuucuagagauacuuuagacuaauuuauaauuaucuaauacuccacuguguagguaaucauuuucugcuacuaaacuuuuuaauuuucauguuauuaauguguaauguuauacaaaauuguaaacuaacagguuucacuguccuguuuuccaacuauauaugaugcacucucauuuuacucuuguugcgugcuucuaucccuuuccucuuccccaauagucucccuucugcuuuugugucuucccuugaccccaguccguagucuuuauuugaaaaaucaaaccaaaccguguagaauuugucugaaucuggccuguuuugucuaacacaaugauaccaugcguuuacuucagggaugcucacuguucugugguuguuaccauucuuucccaaaccuuuugacuuuugcacacagaggcuggagccauaagcauagcugcuucaugauaccuuccuucucuuuccuuccuucccucgcucccucccucccucgcucccucgcucccucccucccucccucccucccucccucccucccucccucccuccgucccuccucuccccccucucucuccucucucuccccucucuccucucucuucucuucucuaguuuuuuugagacaggguucucugccuauuccugacuguccuggaacucauucuguagaccagacuuaccucacagauuuccugucucugccuccagagugguaggugugcacuacugccuuuguuuuuuuguguaugugugccugcaugaggccauguguaccacauacaugcaggcgcccuugccagaagaagguguuggauugacuagaacuggagcuguaggcaguugugagccacccaguguggggguuggggaacugaccugagauuucuggaggagcagcacguauucugaccugcagagacccucuccagccccuauuuguaguacuucacguguuuguuaauggauggucuggaccaaccauaguuucugagacauugcaaauuuaaaacauagacaaauuuguuuuuaaaggacuauucaagcuuuccaucuauuauugugucauuuagggaagugauuauauauguguguauacauauaaaauauauuuacuauuugagagugguuuuuaaaaaaugcuguuauuuauacuuucauuuguuuuccuaggagauuaccuggcaauaaaauuguuucaaggaucaacuucugguuuuguugauuuuucucuuuuguaaauaugguuuccucuucaucaauucugcuuuaaauuguuuuuucccuuuacguuuuuuuuuuccccuuguuuuaaaagaucauuaacauuuacuuuuuucuuacguauuuugcauuuugaguuuuucuuaccauugcuguaggugccuuacauauauuuuagguuguuuuuguugucaguuaaaacuuauuuauuuauuauacguaaguacacuuuagcugucuuuagucacaccagaagagggcaucagaucccauuacagaugguugugagccaccauguaguugcugggaauugaacucaggaccucuggaagagcaguuaguccucuuaauaacugagccaucucuccagccccaaaacuguuccuuaauaucuguuguaagguguuuauugaccuuugaguuacuuagacauauauucuuaacuuaaaaauauugaguauuuucuguuucugacacccauauuuaauuuuacuguaaucaaaggacauauaauuugaaaauuggaauuugauucuugcuuuauggcugaauauauuuauaauauauuuaauaaauacuucuuuuuuuggcaaaucaauuuaaucuuuaguucuugaguccagcauuucuuuggcuagcucugacugggugaguguguuguucagguccuuuaaggccgucccuuuccaggacacugggcugucuggagcucugcauuagcauucagugugguugcaaggcugggguauucauuguguguacaguuuaggguuguaguucuggucaguugaccuuucuaccauuugaauuuuuauuuuaucgucuuugaagauguucuugucuucaaguuaccuuuacuagauauuaguaugcauuuugagauccgucauuuuuaacuucaguauuuguguuugaaauguuuuuuauagauagcauguaguugugguauuaauuuuuaguugacaucuucuuuuagagcaguuaugucuaaauacuauagaaauuuaucacucuucuauuugauuuuacuuuguauuuuaaaauuuguuauaaaaaagacauacuuguguuuaagacuuuuuuuuaucuugaaaaacuagacugugguauuaaacaauagcucuuuuuguauccuacuuaucuaucaacaaauaccccugcuuuuuuugucucugaauuugacuaauccauguagcucauguaaauagucauauaguuuuuacauguaaaacagguaaaacagucaugaauucacuaauccacuuagcucauguaaacagucauauaguugcccuguuuuuacugucuuguuugacuuaguguaauauuuucaaagcauucauguugcuacauuuaucauauucccccaauuuauuguguaugauuuaugugugugcauguaugcuugugugugcauuucuauguaacuauguguuuuaugaauauggcuuugcauaugcuguggugugcagacuucacaugucuguccuugccuucuauguguuugagauagugucuaucuauugugggcuguugcauccacuagacuagcugaccauugaguuucuagggauucuccugucucugccauccaucuuguaagaaccuaggauugcagagguguguguguguguguguguguguguguguguguguguuuguguguguuuggauuuuauguggauucuaggcauucacgcccagguccucaugguuauauggcaagugcuuuuacccauugaaccaacauuccagucaugucuggguuuuaaaacaggaucugaggaggcaguuccccaaucuccaggccuguucugugucuuagaauagccugggacucaugcuccugccucagcauaucacugccacccaggucuagaacuauuccuuuuuaaggguaaguaauauuuuauugcauucaaguguauuaaaauuguuuuauacaauaguuaucuguaaguggacacauugccuucauuuugaaggcuaugaauaaugcuacuguagacaugcaugugugcaaaauuuaugcuguuugcuuugagugcuuuggguguagucagguuaaaacgcuaggucauaaaguacguguuuaguguuugagggacugcugcaugacugucuaccucugcaugacucuacauccuucccuuccagcagaguucucaguggcuccagcuccucuguacaaagaaugcucguuauuucccauuuuguguuuuaaaugauggccagccugauaugugugaagugguaucucacugucauugcuguuucucugccaguucccuccuuuuugucuguuguuggauuaaccaaacauaacauuauuguuacuucugcccauuaacgucuuuaugauaaauuauugaacuacauguguacuauacuguguguaucuuaauacucagcgugcugcgcauuuacacuacgcuuguaccacccagguucagcaugcauucauuuacucagccguuugucuuuucuuucuuucccccuccuucuccuccucauugauugauugcuuuacugauugagauuggguuucacuauauaguucugacuggccuagaacucugaagagauccaccugccucugccuucugagugcuggcauuaaaggugcaaggcuuccuuggcucccaccacaucuugauuauugucaguacauuuugaugguguguauuuugcuuguuguaaugcuguauuuaguuguuguacauggcugguacucaucuugacacccacccugugaccugcgcugucgcagcugcucuggaguucuuucugcaugugugcugcugugcugcugaagaaagccugucuauuucuuuuaaugaagaaugaaaaucugcaguggaauucucagucaucuguugaaaaucuuuccauuuuucuuucauguuggaggauguguuugcuguggcuauaguaaugauggauucgucaguuucuuguuucaagacuucaagauucuacucuguugucuuccacuguguggcguuuuaugcucuauaaccuuuguugcuucuuugaaggcuauaugccaucucucugccuugcaccuccagcuacacccagcguucuaaccacauugcugugcccagauguucagaaauacugacuuauguugugcuuagugucuguuuaauauuggcugugguaauuuuagaaacuucaguuguaugguuuuucuucuuuuugacucccucccucuauuccuucuuuuucugucugguuaaugaauuuagggcuuugcacuugcuuggcagguguucugccacugagcuagagccacagccaaagcauuuucauuuuuuuuaaaaaaauucucuuucuuuuuuaaaaagagguuuccaguaaaaaguuucugucuuuucguaucuuuucuuguaccgucuuauaccugugcauuguaauuucaguggucuaguuuauugacaccaguguccagauuguauagccuuuuuguuuuguuucuuuucuuuuuacuuguauuuagucaugugcuucuguuuuguggcauuguagucauuuuggguuaaacgcagggaugguaaaugugucugaagguaucuucuucugggagaggccucacuugccuuuagguagacagggugugugccagccaagguuagccuccuggcaggugcugaauggagugagggcgaagugccuccauuagugagcucugcuaguucugguucuuucuggacuuugucugagaguacaacuuguucacaguuuuuggaagcuucuggacucuauauaguuuuuguuuuauucuaaccuccucccagaguuuugguuuagcuuuuuggccuuuuuaguuagcuuuagaauuugacaggugucuuuggauagaaacuagucauauauacucucagggcucauuuugguuuucugcuuugucagauuauccugucugcuucuuucuucagcuaugguugucugcuuagggccugccauaacacucagucuaggcacagaauugcuugagaaaccacagcuuuggaggucagcucuuuuuuuccuaguucucucuaaauuccuauuccccuuucuguuacuuugacaacucuuggcugccuguaaaaguaugauuccagccgggcgguggugacacacgcuuuuaaucccagcacucuggaggcagaggcagguggauuucugaguuugaggccagccuggucuacaaagugaguuccaggauagccugggcuauacagaaaaacccuaucucgaaaaaucaaaaccaaaaaaaaaaguuugauuccuuuaauuuaauuuuuuuuucuacuuaucugguguuuccaguuuucagugaguuuugagcuuaauauuccuauagucugacugacaguaguguaucuuuaagugcagaaugaaauuucagauuuaguuuuguuuuuguauuacuagugagcgacccucccccuuuuguuuuaacuauuuguauuccugcuuaauaaauuguuucuaaugagugucacagccauguuguuauccuagucugugugacaaguuucacuacacugacuuaagucaauuguaaaccacagaaaugcuugaaaggaauuucuccaagaauugacuguuggggggugguggagaggggaaguuaguuuugcuugugugcacguuuuuguguccgucugucucagauggcuccugcuugugaagcuccucaccccuccugagugccuugguccuuacauccaaauggaucaguuggguuggguagcagcgggcgugggccuucuccacuuuggagcuguagcugcucaaaagggguucugcgagggucucuucuuaguggaaacaguaguauucccagaggaagguaugcaaguggacagggaaugacugauguuucuagucagacgguaggucugcaagcuguccaggcagcccuccgaugcagagguauagcuuaacccucuguagucauaaaaccugucaaguacugagaacagaguuaccugugaaaugaccacccguugacauaaugggccacccaauaaucaggcuucauuuauuuauaggaguauuccaugacaggguauauauacugaguacuaaaauguaucaaauuccuuucuguuuuggagucagggucuuauguaugaaagauuaguuauagcugaagaugaccuugaauuucugauuuucuucuucccagugcugggauuacagguguguguccucauuguugggcuggugauugcaucccgggccccauucuaccaaauguucuaccaaguuagaucuguaugcccuaaaacacaccaaacucuaagugugaauaaaaucuauuucugaaacuuuuggcuugugggaauagagccacacuuuuuuuuguuguuguuuuguuuuguuuucgagauaggauuuuccuguguagcucuggcuguccuggaacuuacucuguaguugaggcuggccucaagcucaagagaucugccugccucugccucccaagugcugggaggccaccaccaccaggugagccacacuuguuguaaaggauuguugugcacgcacagccucuguggaugugaccucuaccccugguagugggaguuuuccuacacgccuaauuuaaagaauccuaggaaaacgucuucauccuuagaaaugccacagauuguacauguaagauucacaaaguuuaccauagaagguguguguuagccaaacacuugggauugugagugaccaaucauaagagggaaaggagcccuaauaagaggguaaggaagccagggagugaugcaggcaucagagggagaggagagggggaucucucccagucccggguuagagaacugugcuaaaauuaaggcuaauccuuauucccuuuuacuugaucugagcuaaaguuaacauugaaguauuuuaagaagugcuguggucuuuaacuggacuuagagaguuggugauaguuucacucuggguacaugucuaaaguggaauugauuuauuuuuauuucauaugcauuuuuuuggccuguauuuaugucuguuugauggcauuacaaacuauaauuacagacaguugugaacugccuugugggugcuggaauuagaacccaggucuuuugggagagcagccaguagucuuaacugcugaggcaucuccagugcacuggugacugagcaacuuauuugcaagauaugucuuggaacuggcaguccagcgagagaagcugaccuaaugaauuuagacagccuggagaguuacucccagacugcucucauaccuuacuuaacccgaguaggaaggcucugugguugugggcagcauaagcaguguuagaagugaaguaaagacuuccugagagaaggaucugagguuagacuugcagguaacugcaggugcacccuguugguccaacucugcccugcuacuuuacugugcuuggagagugaauggguugaugcccccuugugguccauuaucaaaauaaauagcacaaacacaaauaagcacaggagcgcucagcucacuuacucacugcauguuaaaccuucauuccuuuauaaguaacaucuaaaaaguaauuucugaggagaaccauauuuuguuuuguuuugcacaguuucauggccuuacacuuuauaacacauaauuuugacccuuuauaacagaaugugugagugcugugcugaggaggacguggagaaguggcauagugacugcagaugcagcagcccuucuugcaccauuacacucugccaggcuggaggcaggcuuguccaagggauggggagcuuggggucggguagcuguagucuaaagcugauuucauguggccacuuccaggcuuccuuuccuuccagagagguuaagaccuaugucauuggaguguuugaauggacugucauacgaaaucuuguuauaaaucuuaggcauguaccuaaguguacagaugacuguguaccgauuggguuguuaaugauaauuuguuuaaacuggugggucaggucagccucccuuuucuuuacuguggccuuauugguacuguauaagcacauauuuauacauguguaguuauuaaagaguuuccuagguuaacuauuuuaguaguacuguucucccaaguaaccuuuuauuacagugacguuuuagauauauuuauaaguuuggacacuuaauauuuaaaaaacaaaacagcuggcgucaguucuuccauagggaccuuacuuuuguggaggucgacaaaaagaugaaaauaccuuuuguuguuugcuuguuuuuggagacuugucuacagaaucagaucccuaucuuaugaucauucauuuaauauuuuaagaaaugagcaugaguucccuggcaggagaaauuaaguugguguuaccgucacagaaaagucaguuuuuaaaacucagguacauuuagcuuugaauauggauuuucuccaauuuagauuuuuuuccuuuuggcaguuaaauuaaaaacaucucaaaauauaacauuuaauauguuuguguuuguguauuuuaaaaagaugcuuacagauauuuaaacuuggccguaagagucucacuacccaguuauuccgugcacuucugcaucugccuccuuugaaagcuuuccucuggucuccaggguccuccuuguguuugugcagugcaucugguguugcuaauguggaacccagaaagacucuacacguaaagcaguacuuugguagugagggugucguguguacauuaugaaauggaguuuuguugcuggucugucuuugaauaucugcuuagggagacugucuuaggaaaaaaaaggguuggggagaggggaagugugaccagaaccaggcagaggagcugugagggugauggcaagaacacaugccaugcuaccaguggcuuguuuuuaaacaugaaaagcaugugugccaaauuuacauauuuacuaauuaaaaaggcuuccuggaaacauuaaguagacuaucuuccauaaccuuuaacaccaucacuaauggauauagccuagaaaauuucaucguagguccuuuaaauaauguaaaugauuaugaauauguaacuaguuaauaugcagcuacgaaaggauuaucauguagagguuaaugaacacucugcucuuacggguugcaggguuuuuuuucucuaugcuuuuggcucucuucaugcuuggaaacacucgugcuagggcuggaaacacccucacuguuuuugggucucaucuuaaugggaucuuuaaaaagaaacuuuaaaaaaaauguuuuugcaaggauuuguuuuuguuuuuuaauuuacauuuauuuuuguuuguguuuuauaauuaauacugccugaucagaaacagugagauggaccgauguggcuuuaguggaaucuuccagauguuaagucagugcucuauuucauauugccacuguuauugaguguugcugugugauugauacugacuguagaucuucauucgguagggacguuuuaugcugaguuaaugugcaguauagcuggguaucugauuacagcauguauuuugacucaggauuguugccuuaguauuuaaaauguccaaaagcaaggacauuuauuucaggaauuaaaugcuauaauagaggaauuaagugacuacccuuaaaauauugugauuuuuuuuuuuuuuuuuugagugaaacauuuugcguauacaaggauauuggcucugaaagccuggaguuggagcugcaaccaggccaugcugcugucuucauucuaccuuuugugccuuaguuucucugucucuaaaauggcacucuaguauuuaacauuuuuuuuuaaauaggugauuuagcaguuugugaaaauaaaguuaauuuaauuguguuauuuuuuaaucauauuuuuucuuugccaacagacuuuuguuuuuuuaguauuugagaauuuacugaaauaucuuaaaggaaagcaaguaacuuugauguuuaauuccauucuuauaguauuauaaacagcuuagacuagaugucaaguauauauaauuuuauuguaauuuacuggugggggaaaugagcuguucagagcauccuguuaucccaaguauuucuucuugaaaacauaguagaaaaauaaguucauuuuuaauacaucagaauaaaaaucacaggugaaaacauuuggagauaagcugacaaaauaaaauauuuucacuacugucauuuuuuuuuccugcugagccguggauguugcauugguuucuuguuauuuauaauauuuguguguucuagaaaauauguaacauugaaaauggucuguagauuguacaaaaugcuaguuaucuuauaucauaugucaccuaauaguuaugaagcagguuuuguaccaaagucugaauuggaaagcuguaauuuguucugcaguuaucagccugcguuagagggcugugauaaagugcacugcuuaaaaaccaacauccccaucucuguaccucuugacaaauaaaaauguacauggggauguuagugaaucuguuaagacacuguugcaguuuucuggcugauuuucuaucucuguaucuagccuuguguuuucaugagcaguugucuguuuucaugacagguggucacuaacugccaagagaaaauccagcauuggugagugaaagacgcuuuauuauaauucugaaauauggaggaagucacuuguauuuaaauaaugauguguccuggggcuggugggugugugcauguguggguuugugugcaugugccuguguacauguauguguuggggagagaaccagagagcagcaacagaaguuugaugaucucuauuuugaaugccuuugguacuaauuuacauugucuuuaacccuucucugaguuacauauuuaucaauucucuaaaguuuuaccaccuuuuaauuuaaaaaaauugaauaguaauauucuaauuuugaaguagaaacugagacuuuaaaaacaacucugaggauauuucuuaauguuuguaguagaaaauaauuggaaucaauuguucaaaaaaggaauguuggaaauagggcacagauagauuuuuccaaguuugaaaaagcugaucaaucugcaguuuagggccugcuuuauggccugcacucuuuuuaaagagaaaaagaaagcaugucuguuuugaugugcuaaucuauaguuaauaggacaaugccugguaaauaaugugcuuucucuucuaucgcuucugaggaaaacgcucaauuuaauggugaauaaaauccuauauuaggagaugucaugagguauggcuguugaucuuacagauaucaaauuacagucuauccaugcuguguuuacgaagauuuuacugagagaacaacaggagcuguccugauuauugucugcaggguuauugcaaaaucgucauaacugccccuuuaguggggagauuaaaccuucgguuauacaccaucaagcauauaauauuuuaaauuuauuuuaaaaggcauuuucuucaugccugagagaucuccaaggaaauaauuuauaguuaguguauaucaaauguuuuugguuuaaaugcacauaggcugcaaggaauggauaagagugaagaucagugcaaucuguacccaucaucuuauucaauuuggacuauuggcuugcagaaaccaaucuaaaacuaauaauacccacuuuauaaauaaaaauccaggacuucauuaauuuucaauaaaugcagcauuguaauugcauccacuggugguguaggucugucagcauuuccauaauggacuguucacuuugcacuauguauucaauucagcuuaaaaugugaagugugugcaagaccuuggccagagaaggcuuuucuuuuguagauuuggccaaagugacuuauuuaugaguaacccuuagaggcaguuucauucuguggacaugugcgucuuguuuuugguaacagguuuaggaacuagaggaugaauucacucugaacagaccccagcauacacgaaccuggaacugacagcuugcuucuagguggcuuagugagauccauccucugguagagagaguucuugaggauaacaaacauguuuuuaucuuucuguccacgaaggcuuuccuuccguguuuggcacagaguaggcacuugugucgaauaagugaaggugaagucugugauuguuuuaucuccacuauuuuauuuauaaacagcaccaccguguacagguuuugagaguaauaacaggcagaauucugauggcagagcagccucagacccucagucucacuuccagugugcuaaaaggcuucuaaacuacagaaggcugcuggcacaugugccuguagaguaauuuaaaguuuauuguaccuugucuauauguuaaagauaacaauucuuuuucccuuauuaaauauuuuucugcucugaaucacuucugacaggauuuaggaaacaguauuuugcuugcuuuuuaaagaggaucugcacauaguaucauaauguugcuagagucuaaaugaccaguaaauucuggauucauuuucuauguucagaaauugaaacaaaaguguucacuuucuuaaaaaagucaggcaguagagaucuggagcuuaggcauugugcuaucuuuccaucucauaccuucuuacagaagaccuccuuccauggacaaggcugagcugauguuugcaacuuaaacaccccgccacagaggggcuccuagugagacuaagcagagaaauaaggcauauuguguacaauuggccagcauacuggaauaaauagaaauuggagcuguucuuaagcaugccuuuagauacaauuuuaaaaagcauguugcuuuuaauuuuuugacucuugauacuagccagucuaaagugcagcuuagguaugcucuggucuuuuuggguaucggcuaauguaagaagaaaagcuaaauaaaugauuuuaaggaugcaauucuuuucuuagaaguguugauguuuuaaaaggguucuuuuauuuagagacagacagacuacaucacacuuuagaauacgccccccuccccuuucuuuuaauguuggacaaaaaguaaaaguauuuguagaaaaauaggaaugaaagacuggaacugucuuaagacuuaccuagaaaguuaaauuccaggacucuggugaacuaaggaauuaauaauaguauuuguucagauaagagggaaaaaaaaggaaauauuugaacccaguagguaagaauuauauagcauucuguuagcacuaacaaugguuuucagcuuagccacgauuuaaguuuuguuuuuuagugaauaaaacucuuuagccuggcagugguggcacacaccuuuaauccuaguauuugggaggcagaggcaggcgaaucucugaguuugaggccagccuggucuacagaaugaguucuaggacagccagagcuacacagagaaacccugucuugaaaaaaaccaaaccaaaccaacacccuuuuugugccuauuauuuuuacuucacacaggaaaacaagaugucacaggcuuuacaauuauuuucuuguuaaauaugaacaugagguuuucuguuugguccacuuagagcuagcuaucauguugggggauuauuugcaucugucuuuuuuuucuaaauucuuguacaccuuuuggaguuacaggccugccuuugcguuuugucguuugcagucuggagcacuuacacuaagaaccuguagguuucccacacaguucugcuaccauugacucacggggcugcagugcaucucagccugucacucaagagcuaagaugagaucuuuuuggaaaguuugagauguaacauaaauaaggaaaaauaauagaaaucuccguguuuuguacauguuuuugaauguuuuaugucugugccauuuuauuuaucugucuggguuuuauuuuccacuaugucccaggcuggccuggaacuuguggcaguccucugccucagcuuccuagagugcuggaauuuuagaguagaauuccaccuugcccagucaugaagagaauaaggcagagaguuggccuuaccagcguauucuuagagcugcgcaugccugucuccaauaaggcuuucgaugaagcuuuuuaaacagaagguaguagagcaggauggucagccuacaggugcccaucaccuagugucagugagcuggugguuuauuugaauggcuucauuugaauauugcaucugucuacucccaguguuuguaaugagucuaaggcuagcuuuguuaagcacaggccugccaucaggauuccacagcccaaguucaagggcauccugggcuaggccuguuagcucugccuacucugucuuuguggcauguuccuagcauccuuuccuuuuacauggcaugaaagcugcaaggccauauucugguguugagaggaacuuacagaggcagccagauucagaacgggaagcaauggcugcuaucugcugguagaacaaagaaugauuccuauuggcuaggucuuacaagaaagauucauuacucuguguugcuuaugggcuugaauaaaguagugcuuauggauggggcagagucaaauaauauguacagaggucuuguuuauaacuauaaauuauaugcaauggagguguagaaauagcuugcuuggggcugggaagggauugcucagugguuagagcagagggccugcguugggauuccagcaugcacaccaggaagcuguuggauauccaaugcccugggcuuucuugggcaccugcacucaugugcacaaucaccauauguacaauuaacaaaacaaaacaccuuguuuucuuuaaagcuucuaaguggauuuggguaguaaagaaagcuaguaguaaauuaaacaaagccaacuuaagugaaaauauaguauucuauuuguacauguguuuaauauuggaaagaguagcuuaaaguuugacaaauucaaaaacauuugagcaugugaguuugaaaaaaauuguaaaacaaaugguugauauuuguuacuuuuuaaaagaaaaguggauacaaaauuugggggaaacuagcuucugcuacaguuuauggucacaguauuuaauaggaaauauaaacauguaaauagagaaaacuccucuuuacuacuagggaaaggggaaacaucauauauaugcuuguauuguaugcacacauacauauauauuuguaacaagcauauguuugucuauuguuguugagggaagaaugugccccacaaacacccuccccuuguuuauuagauguuuucuuuauauacauuucaaauuucaaaugcuaucucgaaaguucccuauucccccccaccccccgcccugcuccccuauccacccacuccugcuucuuggcccuggcauuccccuguacugaggcauauaaaguuugcaauaccaaggggccucucuucccaaugauggccgaguaggccaucuucugcuacauaugcagcuagagacacgagcccuggggguacugguuaguucauauuguuccaccuauaggguugcagacuccuuacacucucccuuuuuugaagacagggucuuaccugguaucccgagguggagugggacuugccauggaacccagacugcucucagagucccaguuauccuccugccucagcuucccaaguacuaagauuucaaguauaagcugccccauccaguaucacugaaauaacaauucccaugaauaccugaaaguguuuuccuacaaccuucauauauguguauguaugaaauuuauuuugucugaaauacugaucuacauauuugcagaaauacuuauucacaaugauggcuucauucuucuguguuugguaaauugggaagcuaauuuuucagaguuccuauuuaauggacuauauuugugguacuauuuuguauagaaccuucuuuguuuuuuuuauuccacccccccccccccgccccuucaucccuugagugaagcagagaauagucauaaaauuaucuugccauaucaugugcuuuugccacuggauugggcaguuacuaccccaagggaugauggggaggaagggugggcacagugaguacacaucccuuacuuugucuguagccuuuucuuucuuucuuucuuucuuucuuucuuucuuucuuucuuucuuucuuucuuucuuucuuucuuucuuucuuucuuucuuucuuucuuucuuucucucucucucucucucucucucucucccccucccucccucccucccucccuuccuuccuuccuuuuucccucucccucuccuccuucucucuuccucucccucucccucucccucucccucucccucucccucucccucucccucucccucucccucucccucucccucucuuucucuuucucuuucucuuucucuuucucuuucucuuucucuuucucuuucucuuucucuuucucuuucucuuucucuuucucuuucucuuucucuuucucuuucucuuucucuuucucuuucucuuucucuuucucuuucuuucucuuccucuucuuuucccuuuucccuuuucuuuucuuuucuuuucuuuucuuuucuuuucuuuucuuuucuuuucuuuucuuuucuuucuugcugguuguuguuuuugccauuaucaaacaccgccuguccuaugcccuaguuuugcgauuauguuugaggauuucuguauguaguauuuuagagaagauggcuuuuguuuuaugugugagugccuacauauguauaugugcaucaccugugugccuggugccucugaaggccuugggcuucuggaacuggaguuaacaggugauugugggucacuugacaugcguacacacaaaaaaguaauuuuuuuuacaguccccuuuauaaguuuuuggaauacugucuuugaugauauguuuccagcaucuaaguucuuugguucacagcuccuggggacuugcuuaguccagagagugucuggauuuuucuucucuaucaguagaaaccacagcuuacaccuugaaguuuuuuuguuuuuucauguagucuuuaaaaauaagaacaacaagagggggaggguaugggggaugucuuaagucaggguuucuauuccugcacaaacaucaugaccaagaagcaaguuggggaggaaaggguuuauucggcuuacacuuccaugcugcuguucaucaccaaaggaagucaggacuggaacucaagcaggucaggaagcaggagcugaugcagaggccauggagggauguucuuuacuggcuugccucaccuggcuugcucagccugcucucuuauagaaccaagacuaccagcccagagauggucccacccacaaggggccuuucccccuugaucacuaauugagaaaaugccuuagaguuggaucucauggaggcauuuccuuaacugaagcuccuuucucugugauaacuccagcugugucaaguugacacaaaacuagccaguacaggggacuuuugggauagcauuugaaauguaaaauaagaaaauaccuaauuaaaaaaaaaaaaagaaaaaaaacccaacacacaguacugauaacauuuguacaguuucuguguaaggacugcagugcauggcacacaucuguguccccauaguccagggcucugcuucugcuuuugaagcacggcaguccgauucuaacauucuuuacauucugugaggguacuauugucugcugagugcaggaaaaugaaggcuguacagacuggcauacuuguaguuuacuuacuuaguuuuaaaaauguagugauuuauuuauuuauuuauuccugugagacaagguuucucuguguagcucuggcuguccuggaacucacucuguagaccaggcuggccucgaauucagaaauccgccugccuuuaccuccccagugcugggauuaaaggcgugugccaccacugccuggcuuauuuauuuauuugauguauaugaguacaccacuucucuuuccauacacaccagaagaggacaucagaucuuauuacggaugguugugagccaccaugugguugcugggaauugaacucagaacuuuuggaggagcagucggugcucuuaaccucucuagcccuauaguuuauuuuuuaauaauucacauuaacucaaccaaauggugaauuuuuccaguuguuuuuauucacuuuugaguuaaagauaauuuugagaauuuaaaaauacuuuguagauucagaacuaguauugacauuauuuuucucuuuuaaacucugagaggagcuuugaccugugggaguauaugaaggucucuguaaacuccagaaaaugaguucuucucaguuugucauaggaacagcagccaaaaucaccacuccaagguggccauaaugaucauuguuuccuaaaaugauuuugaaaguauagaaaaccuaaauugaugcagcaaaggcuacgaauuaaggagaucuaguagaaccugguacaauuauucagauugagagagaauucuuuucuuuucuguuauguuucucccuuuaacucguaacaggaacauauaucaguuauaagaaaucagggaaaugaacagggcauaaaaauuacauguaaacuggcaacuuggggauuucuuucaaagaccagugugcuuuuauguaauuuuagagcauccuccuacuuuuaauucacaucuaauuguauucuuagagcaaaguauuaauuaugaauaaagaaacgggcauuuagcauaauugacaaaucucaggucacauguccaugugguggcuguagagacaacgugggaacgcauuguccuuugcaacuucacugugugucccaugugcuggagccacuguacacaguuaaauggaaggaaucuaguggauugguaguuggaucugccucuuaauaacuuguuaaacuaauuuuugaaaaauuauuggcuauuuuuuuagauuauuaauguuuucugaugauucaugaagucaugaaacacuaggaucauguguuugauugccaacauauucugaugaggcuaguucuuagguaugaugcaguuauaaaaaggaauacgucuccauuuugccuuaauuuuuuuggguagauguuaauuauuuaagugaugucacuaagcauuuugccguggccauuuaggaagaaaaggucccaaggccuccgauuucguacagauguguuccaguugugcacgaggagaauuccuuuccccacuaguuggcaagaacagugguuccuucuucaacaguguucauggcaacuucccuagacuucaggacacugaaggaagcugucguuucuuaugauagcagugaucaucugucugcuuguaccaugccugaauugaacuuuucuuuauuuucuuaauucuagagguggcccagggacucuucagggcaguggaacuuuaaugcagauggauugugaauuuuagaaaggccugcuggguuugagugauggccucugauauagcccagggcccuguugcagaggagugaacugaauugagaguaggcuuucuuagaggcuucugggauaguucuagaguggugacgaugaauucaguagcuucuguugucuccucuauauuucagaagcgcuagguuucauuguuucuuagcuuuggcuuuuggcuauagauuauaacccauguauuugcaguaauguguguuuucugcuuuuuuguuuguuuagcagguuagguaaagggaaagaaauguuggaaggcuuccuccaagaagacaguucagugcuaguuaguaauuucugccaguuuccccacuacuuccguacaguuggaagauucuacucuucuaagcugagauuucauuucauccuuuaaagguggagaugagagccugccacuuguuuggaacaagggauguggugcuuacacccucuuuacaaaaguaguuuuccaguaacagaaagacuaaacuuguggacuauuuuuucauguuauucuguaucucuuuaaauaaucgguuaucaaaaucuucaccuacacagaacgauuggaguauacuggugagcucugauuauauaccacccgucuuacucauuaaucuguucuuucugaggucucucucucacacacacacacacacacacacacacuucauuuagcuuuagcuugcucucucagacuuguuacacuuccaugaaaauaaauauuucccauagggucuguccugaucuuaaugcuuuaaaguuaggacuauuuauauaccuugcugcugccuuuuuaaaacuaaagguguuucacagagacauguagacauggccaggaaggaucaaaagaagcuuguuuuuuguuuuuuaaacaugcuauucaguuagguuauaguuuuuuuuguuguuuuuauuuauuuuuugguuuuuuugagacaagguuucucuguguagcccuggcuguccuggaacucacuuuguagaccaggcuggcauggaacucagaaauccgccugccucugccucccgagugcugggaucaaaggcgugcgccaccacgccugucagguuauaguucuuauuucuuugaggacuauugcaugaagcuauuugguaugaaguaggcuucuugaaguuuagaauugaaggcugguaaucuugguggcacaggccauucagcccagcuacucagguggcugagguaggaggauagcagguucaaggccagccugggcaauuuagugagacaauuucaaaaugaaaaaauaaacagagggcugguaaugugagugagugguagggccuuugccuagcaggcauaaaacccuugguucaaucuggaaagccaggacaaaggguggugcuuguacugacuguaaucuuugucaaauauagugaagacaaacauaggaguaaguggguuugagaggcaugcucuaacucuaccuaggcuuuguuuuccauuugaagaaacaguuauuuuggguaauuaucucuugguugcuauauuuuaguaagacgaaaacaccuaaaauugauguuuucaagaaaauaaguugacagagaucuguuaauauuuggaguccaaauaaagacucugcucaucuucuccaaucuuuaacauuaguuauuaagacaacuuguauugaggcuagaaagaugacuaagugguuuagagcacuuguugcucuugaagaggacccagguucaaucaccagaaaccacaagcuggcucacaacuaucuguaacuauaguucaggugaucuaguccccucuucugaccucugagaauaccagucauguauguggugcgcagacuuauaugagggcaaaauguccauauuuaaaaaaauaccuuugaucccagcacucggaagagagaggcaggugggucucugugaguuugaggccagcgugguuuacaaagugaguuucagauuagccagagcuguuaaucagagaaacucugucuggaagagggguguugggggaagaaagacaacuugaauuuuuauggcuggcgacaaggcuuagcaguuaaaagcucuugcuauucuugcauaggaauuggguucagcucccaaaacgcauaugguaguuuauaacugcuugcaacucuauccccaguggaucuuauaaaccauuuugucuuccuugggcacugcauacauuguaggcagacucucuuacauuuaagcaaauuacauauauguugcauaggcaugugauguuuuagagagauuguuggucuuguguauuagaggguuguagagaucacauuuuaguuaaguucuugguccuggacauuuuguccagaugguuuucagggauuucuuuaagguacauagcugaccucccuucaaaaaguauuucugcauugcugcacuugaaaucagcuuccacuuuccuuuucugcuuuagaaaauaacucaaaauauagaaauagcaagucuagucuuagauuuuguaguuuguccacauuuuuguucuagagagaauuauuaaggaagguuaaagcugaguauucaucuggaaauacugauugcugacaugaccuugguugaacuuucuguucucugcgggcacacgagauuucuuuauuuuaagucccuuuuuguaggugugauuaccaauguaagacaugcugaaugcuaacuuuaauuggaccuaaucagaagcauuagcuaguggauagauagucugagucugagccacagagguagguucaugaguaucugugauguguugguacuauagcgcaucuucuugguuacugcucaucucgaccccgucuccaaagucccugaaucacccgugacagucagcuguucucuuaucucucaggaagugacacuauccaguugaaggacuaaguuaagugggaccuugucuuagugcuuaauaaucuuuucugaaaauuauuucugagguuacgaaccugugaacagguauuuuuccaguuuuaacuuggaaaaagguaaggcuaaggcuacuuuguguaaguggaguuagagaucugggauucacucucugcuuugacuuuaaagcuaugguccuucuggggucugguccugauguauagucccgugcaugaaggcuuuuugccaucuuguccauauaaaaauguacucaaaaggauaauuauuuaagaaaugcacaccuuuaaucccagcacuugggaggcagaggcagguggauuucugaguuugaggccaguauggucuacagagugaguuucuggacagccagggcuacacagagaaacccugucucaaaaaaaccaaccccuaaaccccccgucccauaauagggucuaagaacgugguugucaguaaaaugcuuuacaagcaggaaagaccugaguucugauucccaguaccacauaaaaauaugggugugcacccauagccccaguucuggggagucggggucaggaauaccccuggagcuugcuagccagcuaguugaccugaauuggugagaccccaucucaaaaguaugguggaaaaugauugcagacuccaguguggaccuccagcuuccacaugugccugugcacucucucaaaaaggcauacacagaagaaauaccauaguagacaguuuauggggagaguuuauacagagaaccugaacuuuagaaaaugagaguuugugugagaauaaggcgaccucgguuagcugggugucugcuucaagaggauacagagauccgcucucucagugcuucuuuccuguuuccuuucugugcuaccuuguacgagagaaaaauguggaguggcauuacugcaggagguuuuguuucuccaggauacauagcaacacacgugaaauucccugagaccuuaagacggaguggauaauuuuuauuaauugugcuacuacugcuguaguggagccaaggaguaaacugaggccaaugccacagcugcagcagagccacugggcgaugacgggugcuuacccacguggcacuuaggguaaauuuuagucugacaggauguguucauuuaaauuacuuggugagcuuauuguuucuguuaucuuguaagaggauaguuugcuguucuagaauuguuugcagccuccauccuagccaaaagcccuuaggaaucuugacuuccaaagacggucggcauaggcagaggcuucagcucaggaagggcauugauucccgucggcugccugccccguggaggagcaguuuggacacaugcugcucucugcuccagcaaggucaaauugagucacaucuuaggguuauuuaaauggauucccccaaucccuuuuucccuuauuuucuuugagacuuugggaucucauguaacucagcaggcugccuuugaacucacuaugcagcaagaaugaccucugacccuccugccuccuauucccuaguuuuggggucacaggcaugaggcaccacgaguuuuggcacacucugaaacagacuucagaggcgaggugaagugcuuuaggcaguacugcugccgcguauuuuucuguucuugacuggauuucuuaccuuguccacauuagaagaguugaggacuccagguuuggagcuuaaguuuucugguaaggacugaagcaccugaugccaucuuuuguccacaggcucuacuguacaaucuguuuauucacucagaagguguauauaugaugugucuucucaguuugaguuccuggcucccucuaaauaucagcccccuucacauuuccuuaauuuugacaguguauuagacuaggccaucuccuaccuuaagaagcuaauugucaagaugggaguguucuguuucagaaugaguuuucauuucugugugaauguaugaaugugggaaggcagugccauugcuggaucucguaaacuuuuagugguguaaacuguugguugcagcuagugagacucugaucuaugcacucacuuuguguuugguguuuuccucaucagggagaaaguagacaaugacuacagugcucuucaagagaggcugaggaccuugccugacaagcugucuuacgacgucaugguaugcucacugugcuccuuuuagagcuauauguuguuuguuguagacagucuaauggugaaauauaggauuuccccuugcuguguaugacaguucacaaacuguuagcugguaugccaucaaaagugucucuauaguaaugaagguuuguuuucuuaggucuugagacaaaaccaauacaauaauuuguauauaauuauuaugguuuauuaacaacuauuagcaaaaacgugauguuuuguaugcaaauguauuuuuuauauguaaaugaauuaugauaggagugugguauucaguuauuuccuguuagccaaagcaauagcaagccauaaugucugguaagucauagaauuaaacccuagaacauugguuuuucucugagaggugcugauaguuuccuuuugagugaccuuccaugugacacacagucugcugagcucuuggcuguagccuccacuacuacaucagugugcuucaggaggauuuguucugcuguacuaaaugagguguggcuagguagauaaauacagcuguuaguuccuaucuucaaaacauaguuuuagguacccaaaaaaguuuucacugacaguaguucauuacuguuuugguuuuauuuagacuuaaggauuaaugaaauguaaacauucauagacagugcuacucucuucuuucuucuaagagcugucuuugaagcaugcuguagauuuauuuuccuguuuuaacaugaauuuauuagccuaauacaguuuuuuauagauuuuccugguaggguuugugugugugugguguaugguugagacuaguuuuauuauagauacgagggagagaacagccagagacaucuggaagggucuaagcugagcugggccaugagaugagagagaaagacagagauauacagagagucagagagacagagagagaggaaggaccaggcgugaagagaggugaagaaccaaaagcuccuggugaaaugugaauaaaauguuaaauucugggaaauugacauuuuacuuuuccuagugcuuagguaagaacucaguaauacaggguuucucaugcuaaauauuguaaaaauguauguuaaaaauuuugcuuuucuaucuuucuuuuaaaccaauagguaccauucggcccucuugccuucaugccaggaaaacuaguccacacuaaugaagucacuguuuuacuuggcgacaacugguuugcaaagugcucagccaagcaggcuguggguuuaguugagcaucggaaagaacguagguaccucuugggaagauguuuuguucucuguuguguuugcaucaauucacaggcuccagagcuggggaugcucugaccaagcaacugccgggacuugcuaguccaggcugugugcuguucuggauuauagguaauuaaggauaagcaguguuugagaauggagguuggaaauacuucccauuugacauguuuccaaagguaugaacugugagcagaggcaguacaacgcgcuguggagagaccugacaggaguuagggacauuuuacacuuguguuuguagucuuguugcuucacaugccucugcuuuuaauacucugggacccaggaguaauuuauuuucuuugucaugaaaucagagaaauuccucuuaauaaaaguuaggacauuuuaaaugugguuuugguuuguaggaaaucucauucauuuuuuuaaagagaccagauguggaaaggugccccuuguagguaacuugaggccuuguugcaucuuuuacggccauuuuguuuucauuuacccagucucuuauucuguuauauaccuggauacaugacuuugagcucuggcgugguuguauuaugauaguaagcuuauuuaauuucuagucugauauuauuuuuauaauaauauuuguaaauuugauauauuauccuuaucugcuuucaaccuucuaguaaaugagaauuugaaaauaaauuugaggacucuccuguauaaaugaggucauuauacuaaguucagcugacuuuucuaaagcugaaguaauuucaguuauccaagaguggguacuaguuggaagcaucauguauucugugaaauucuggaaacuauuguucgagacuaauugcaaaucaaguguagguuuauaauugggauagauauuuaucuaaauugucagggcacauaucuaaguacauaaagucuaauaggauaaggaggcucagaggcucucacccacaguguuaggguuaucuauaacagcugaagagaauggcuacguguauuguuaaacuugacacuuaauaauaaaaggugcauaugauccagucccugguggcugguccagaucccucucacugggagcuuuccaucuuaacuaggcucuuagcgcgagcgaguggugguugcaauuuuccugguugaggugugguucuggaauaguguggguuucucuucucuucucuucucuucucuucuuucucuucucuucucuucucuucucuucucuucucuucucuucucuucucuucucuucucuucucuucucuucucuucucuucucuucucuucucuucucuuccuuuccuuuugcuuuccuuugcauccauccuuccuuccuuccuuccuuccuuccuuccuuccuuccuuccuuccuuccuuccuuucuuucuuucuuucuuucuuucuuucuuucuuucuuucuuucuuucuuucuuucuuucuuucuuucuuuuuguugcaguuuugauauuacaaaucuuaacaacuucaacauuuaagaugaacauucauucuuuucuuaacugaaauccuuuguggauccucuuuggccuuuccacuguguggugaugcuauucuuaugcucugagccauuauuaaaacaaggaaugcuugaacacagcuauccuaugccauuugaguugaugaccaagcaggcuaggugacaaguauucuguacagagggaggcguggguggccugcucaguaagcgauuucaucuucucagccugcaugcaauuuaacauuuaggauuugguuuuauuuccuggaguuuuccauuucauauaagauaacugaagguaacugaagcugaugcggaacuguacauagguggggcugcuccccuuuuuccuaaagcacaagaaauagcaacuuaaacuugcaguagaggguuucauuguugaccaaguaauggcaagguggaaagaggucuuugcauauagaaguuacagcuuguccucuugauacaggccuaugaucccaccauuugagggguugaagcagggcagguccugaauuucugccaccuuccacuucccagaaggcaaucacagugagggacagaguacacuugacagucacagcucaggacccacaagcccagcacccucccuuuguguuaacuuucuuuuugucaucuaauaagaacauaucuuuucauacuucuuuuaaaauuuuguuugguguacuauucugugagcugugacauguacguugaucugcuuagccgucaccacugugagugugcguagguacugaggucaggaugcaggaucauaccacauguugccuugugcuuacuuguguguggguucacucuacaccagcuucugaggcuuggcaaucacugauucguucuccauuacuauuaauuugcauuuuccuagaauguuuuguaagugacuuuuuguuucuuuggagaauggcuuuuucacuugcacuaaugcuuuaucugaauuguuuguaucagagcuuauucaauucuguuucugaguagccucugauaccaugcauagauuuccuucucagugcuuuggaaggacacaugcagcaagugugaauggagcugcuggagaauaauaccguacauagacuuuaaccugcacacaccucuugugcugggucucaugggaaacauguguuacuuuaucaaagaugagcagacuuuuauuuuuuuaaauuuuguguauaugaguacacugucacagucuucagacauaccagaagaaggcaucagaucccauuacagaugguugugagcccccaugugguugcugggauuugaacucaggaccucuggaagagcagucagugcucuuaaccgcugagccaucucuccagccccagguuguaauuuuuuaaaaauaaguuuuuagauugauuuuuauguguauaaguguuuucccugcauguauauauguacaccacaugcagauugugaccacagagaccagaagagggcgugguucuccugacaacugguguugugagccaccaugugguugcuggcaauggaagagcagccagugcccccgaccacugagucaucucuccagccccacaagggauaugcuuuucaggaacuugagaagguuuugacaguuuguuacacauguugaagcugucucuuccuuugaauauaugguuugcguauguuuucucuugucuaugucuuguuuucccauucuuuguugauuguguuucuccagaacaguuuuuaauuuugaaauucuuuuuuuuauaauauauuuucuuucuuuuaaagauuuauuuauuuauuuauuuauucauucauuuauuuauuuauuuauuuauuuauuuauuuaacgaaguagcugucuucagacacuccagaagcgggcaccagaucuuguuauggaugguugugagccaccaugugguugcugggauuugaauucaggaccuccggaagagcagucagugcucuuaaccacugagccaucucuccagcccuugaaauucuuuguugccguucuuguuagggugguugucaucauauuuaagaguuuuucaccuaccuucaguaucuaugauuuuucucauguuuaaguucauuuuguuuuagguaugugguuuauaagucagaguucacuuuucuuaugagugagugcauaguuguuuuaacauuguauuugaaaguagcauccuuucuccacaauugacuuuccacuuugaugaaacgaaguggcaacuugaaaccacaggaagugcccuaccaggguaguuagaauuuguguguguguguggaaaauuuacaaccuuuguaugcuacugguaagaauguaaacugguauauauuagaaaauuagaaauuuucaaaacauaagcacuagauuacuaugggacauagcagaaauaguauuauauauaaacgaaauaaaaauguacaucuacaaaaaaccuugugcagacccuaguuguagcauuauucauauuaacucgaaauggaaacagcuugaguaucagcuaagaaauagauaaaauguauugucuccaugcagugaaauauaguuugacaauggagagaaacaugucuugaaaguauuauuccaagggaaagaaccaguuacacaggcccaacuucuucuaugccauguuuaguagggcagauuuagacacuagaaagugaguucuuaucuguugagggcuaggaagguuugaggaaggaugggcaguguaacuguucagggcugcacgugugagaauguccauacgugaugaugccugcacagccgcaggcaaaugucaaacauuuaagugggcaaacuguauaccauguaaacuggaucuucacuaaaauuauuaaaaaaugaaggaauuggcuauugguuuucuuuguauaguucauucaucuaguccaucuguuuuguuucucugaacaaaauguguccauccauguuucaauuacuguaguuuuguaauguguuuuuaagauuagucacugugaaucugugugcuuuauuggacuuaggaacccaggacuucguaaguucuaguuuguucuuucugaaauuuggugauuucaauuccuuuguccuuucauauacauuuuagaaacagcuuguuucuaucugcaacaaauccuggguauauuugacuggcauuucccuaagucugugcaucaguuuaggaagaauugacaucuuaacuauacuaagucuucuaagacuguacacuguacuugcuauuuaggacaccuuugacuuucuaaagacugugcaguuuauauuguaccauguaaccauguaaaccuuugucagugaauaaaugcccuaggaguuuggcuguagacacuugugucuuuauaaaugcugacauguuuuaacucacuuucuuauguucauaccuucuauuuccuuuuucuugccuuacugcauuggcuagagcuuucaguauggaauugagggaaagugccgagaaugggcauccugggcuuguauuauuauuauuaucuuuuuuacauucugaccuguuuccccucccuucuugccucccaguuccccuccgccaucuccucccaauccuuaucuauacucuuccuucauuucuuuuccgaaaagggaaggcuucccauggauaucaaccaaauaugucaucaaguuacaaugugauuaggcaccuccccuuguaucaaggcuggacaaggccaacaguuuaaggaaaagggccccaaaagcaggcaaacgaaccauaggcagccccucuccugcugauaggcgucccacaagaagcuggucuugucauguuucugcugaggaaggcauuuggucuuuucuacgagagacguugguuguaggcuuguuacucuuuuaaaucaguacuuucauuuauauuaaggaaguuuauuucuaauuugugaaauuguuuuuuaaaaauaaugaauagaucuugaaugcauucuuucugcuauguugguauuguguuuguuuugauaauauacuagauuauauugauugauuuuucugaaugguacauauuuggccaugcuauauuauuguauauuaccaaauguuuugcuaaugauuuguugauuuguagagugauuuggggaauguucugucuguguuuuuguaacacacaacauagaacuggugcugugaaauauaugauagcauuuaccaauaaaaucacuugaagacagaagggaguugacuacagacucaagaucuuuacuagauauugcauugcuuagacuauuguuuuccccagggagagugauguuuucugacuucuaaagacuugcuugacuucaccuaaguucuuaaauuuaucuauuaaaauuguuuguagcauuaaguacucauuucuuuuaaaaugaauuuggggugacaguccuauuuuuaaccuugcuuuugcuaacaugugucuucuuguucuuuuuuguuuguuuauuuuguuuuguuuuguuuuguuuuugagacaggguuucucuguguagcccuggcuagccuggaacucacuuugcagaccaggcuggccucgaacucagaaauccgccugccucugccuugcaagugcugggauuaaaggcgugcgccaccaccgccuggcuucuucuuguucuuuuguguagcuagauguagugguucucagaugggcagguauuagauuuauaccucucauucuccaggagcuugaugauguaucaguagacacuuucuaucacagguagguguugaguguucuugauacccaauugguagaagcucacagagauuuuaauggucguauuacuggugagacggagggguacacugaucucggugaucucggagcucagcuucuggcucuguugguaaucuccucuuuugcuuauuagaauguguucugcuuguucuaggguugccuuuguggugcuuguccucugcuguuggugguggagcgauggucuguuuugacacguuguguuuucacugucaguuaacugaaguccuacgucuugggaugugcuuauugacucacuaauuguuuagguuagggaggacaagcugugacuuugggccauagcugggugaccccagcuuuuauguauaaauguaagcuuauuaauaaaagaaaaauugugagagggggaaaacaguaauaugagauggagaccaagucuggcucucaaaaucuaaaggaacuacaugcuggucuuggacaguucaugcaucccagaaauggacauguuuaauuuuacaugcugggaggguuucuuuguguugcugauuacugguuuuauugugguucugucuguagaugggagguuuuuagaguacauuaagauuggugcugugccuaggaugggcucagucuuccugagugcuuuguccuggagaagaauauguuugcuguugugguacaagcaacaugcagucuuguguguugugguuggugguguuugcuacugcagcuguucauuuguuguguucagcguggagagaacgaacucuccacauagcauuguggcuguggccauuucuuccuucaguucugucaguuguugcauguguuuugaggcuuauuuucagguacugcagacaguugacguuucuccuucgagauuguauaacuuucuccuuuauuccugauucuuucuacauagguuucuugcuuaauguuugcuggguguguguuuuuucauucugacaucugugauaauuauggcauaauaaagugcauuucauguauacaacauagugcuuuccuuucuaaucugacaauuucuuuuaguuauauauggacuguuuauauuuaauguaauuuuuaauauauuuggguacaggcuuaugauuuauuuuuucuuucuacuuuuuuuucuuaguuucuuaaucucuuuuggauuauucaauaguugguuuuguuuguguguucuauugucaauauacacuuuuucucuuuuuuaagauuuaucaucuuuaguuauauguagguguaugugccugcaugugggcaugcacacauaagggcagguguccucagaugcauuagauggcccagaaggucauuaggccgccugggugcugggagcugaacucagguccucuggaagagcagcaagugcucuuaaccauugccuagcucuccagcccugccaacuggaaaguuuaaaggauuuuuuuuggcaugguacugguuuagguguuauauuuuuacauuaaggguuugcuuuaagguugugcuugagaugugcugaauucucuuuugagauuugaagugguuucuacucgaucuuugaaaugaaucaucuuuuauuuccaaaaguuuccccccuguuuuuugaauguucuuuuguuagaaccuccugccaucuuguucuugcuucaugguaacuuuugucuuuuuuuugagacagggucuguguagccuggcuguccggguacucaucccauucacguguggaacaggcuguccuugagcucagagagauguaccugccucugccucccaagcggcgggauaaaggcgugcaccacuaugccuggcauuuuuuccccccuaaaauauauuuggaucaccuuugauuucuuuuuuuuuuuuuuuuuuuuguuuuguuauuucuuuucaccuucuuccuucaucuuuucucuuuucuuuuacugucaguaauauuaaagacuguuuuccaagggguguugauuuuggccaaccauucacaauucaguuaaacacuuugaggaagucuuaggcuggagauauugcucaguuuaugagaggauucagaguucagauccccagaagcugauaaaaaccuggggguuguggacuuuucucuagaacaaucuucaaguagcagcuucuguguuagucugaucuucaucuggguucugggaaccaagcaggaggccuugaaggaaagccugcuuaaucauuuucacugagcucuuuccuggucugcucuuuccccagauaacauuucccugcauaccacucuaagcagccagucuccugcugaagcagggagucaccugcgugugcagagucaaggauuuuggaccuuauggugccuuucaaaugccuuccagaucuugauuuuaguuuccuuuucccaagccaguuaccguuccugguccauaacccacagugacuugcuccaucuccuuuggccuauguaggugccagcucagcuuucucuccugcaguuauuauuuguccaggauucacguguuagucccuuuauguuuguuucuucucccaacgccuuuauguguuuugccuuaaaagaaaaaucagauuuugcugaggucugucggggaguaacacuaagcacacaugcagugccauuucauaguguaaguccagagacacucccuuaaaaaggcuugcaagcguuuccaccagggggcauggccuguugaaacugcuuagagaauacuugaaaacuccuggcacacaaaagacgggauugggaauggaaggucgcagaggacucagaagagauguguauuugcauguugaugcugcucagcacacgccacucauuuuacauggacgccuguaacuuuuuacuaggcgcuguaaauaauuuuuuuacuucuauaauuuuauucuguucauauauauaauuccauaaaugaaauacuucuaaauauuuguuuuucauaaguagaauauuuauccuuuagauaaaaauggccacuuaaaaguguuuuaaaaauucuuuuaaauuuaaacgugaucuuuaaaauuuacauauucauuuugcugucauuuucuuuauuguggcugguguaaagaauucuugccgguuuuagaugaauuauuaauucagaauuagugacaauuuaaaagugacaauuaugguuucuguagaaauaauaugcagccuaauuuuacuaguuaaagaaauagaaacuacagcugauauacuucugagguccuauaaaauuuaacuuauaacauuuaacuaaaauggucagcgguugaaaacauguuuuuguuccucuuugccacaaaguacucauuguuuuuuucucuaguuuuagcuuucacuuuguaauuucgggucuucagguaucuucuuuuguauaccuucacagauuuuuguuguuguuguuguucauucaaacuuguuuucuuuauaacauuuaaugaugacaaggacaugaaagugaacauaggugucaccauaucuguguuuucauguccuccccuaguuucgugugauucaaguauaguuggggguuugccuuucuuagauuuccuguuagguuugaaauguuaagugaauguguuuauuuaaaucuccagcuuuacucaguacagcuguguggcuacuaaggcgagcuacaugugauagaaaggagcugggccgugugagaugcugcuuuguguuucguggucgguuuuguugguguuuuuguugcuguuuuuuuuuuuuuuuuuuuaaaaccaaccuguugaguuguauuuugccuuacuugucuugaacaaaaccagaauaggugccauuauucuguagugcucugagcaccagguuugguuuuugcaguuguccauguguuuccauguggauaucugcaugaugguauaggcuuaguuacuggagucuuuucugagauucuaaugcacaguaugugaguugguucucuacacugcuaguuuaucuuaaugugaaacugaggaagcuuucuagauguaaggagaacaacauguaauuauacaccguuucccccccacucuuuccugcaguguuguugguuucuuacagugagguauucacagcugccucuugcaugcaugacuuaggagacguuuccucagagucaccacagcugaugggaguagguccugcagcacgucagagugggagacagcgccagccuucgauugcuuucucugcugccuuuuagcuuaggugcacagcauucagauguggcuggacuuuaaaauguacucagcuuaccuaccugccauuuuuaauauuuuccagucuuccugaaaaaaguuauugauuugaccuccuaccuaaaauaauguucuuuggaucuaaagcugguuagacacauuaucugacugaguuuacugaagcaaaaacauuccauaaccuuaaccuuuucccugacccccugcuuuuaacaacugccgacauaguuuuaugcuguuaugugaccaugcucggaugaaaucugucaaacagcuccuugaguuauuaggcugucugagucugaccuuucugcaaucaaagauauaugacuuaagggcucagauuugccauggcaaccgguccaauuugcugccgugagaaaaggucuaauuguugcagaaauuuaaugaucuagagcgacaucagggcugugagauuuuaugaacuguuuacaccguaauuuucauuuuguuaaugcagucuuuuuuuuguaacccauucauggcugagcauaagugauuguguguuauuuaaaauagcauagcacauccugagugcuguaucagagaugggcuacuacuggagcagccucgaaugugggugauauuucacuuuuaacacccuuccuuauuuucauucuuuuaaaagauauuuuaacugcuuagaccuuugccagaccuccauucaucauggacauagaggaaacuguguguacuuuucuccuccauccucuucugaucugcuuccugauugagugucugcuguaaaacagugggaaaccacagagaccuagggagggggcucagagccucucuaccauuguuuaucagagccuaaagaguccuguuuggagaaaaguaggacaucugucagcuuaccccugucgccagaaaaccccugugcugugacaacuagcugagaggguucagcuuccaccccaggaacaacggacuuguugcauuuggccaguacuagauagagaucacuugagauaaaacuacuuacuuacaaaggagaggggcauuuaggggaaauugggaggggacauguuaugcguagccuuuauaguuuaaccuuggaaaaugguugacuaugucguaaaaaugagugguauguauauuuucagucaucugauucgggaauauuuuugguuuagauaucgauucauauuaucuauuuguauccagcagagaaaagucauuuaggaaaaacuuuggaaauacugcuuuuucuaaaacagucuaauuaguugcuuagucuaaggaacuugguagcacuguaaccacagguuuagucuuguauuauauaauauaaagaauagacauuagacaguuuauuaguguuauguuauguagcagcaaacaaaccccuacaacaugacugcuuugaaccgaucuauuaacaugaaaacaaacaguaaggugcgacuuuggaaagaaauugucagcuccuaugugcaguguuacaguauugcagucagaaugccguacaggucuuagcugugugugcuacacuuacagaagacuauguuuguguuuucagauguaagaaaaacaauagaugauuuuaaaaaaguguugaaaaauuuugaauccagaguugaauucacagaagauuugcagaagaugagugauguggguauuguuuuucuucuuuugccuuuucuaaugugguguugucagagcaaguuacuugugucucauugcuuccagccaugauucuuaggcugucugacugcuuugaugguaauauguuagagguuucuauuauuaauaugcucauuuuccuuguuuaaaaauuaggcugcaggugauuuuguugacauaagagaagaaauuaaaagugacuuugaauuuaaagguaaguaaugagauuguuaaauauaaaauuauuuagauauuugccaauuauauugauuuuuaaagggucuuuggaaacauuuggcauuuuuauauaguauacuuuuuaaauuugugaguacaucaguccaaaaaucuauuaauuuuuuacaugaacuuaaugggcaaaugaauuuugaugaaaagcuugcuuucugacugauauauuuaggugguagguugcacaacuguuuccuaccucgagaacugucuaaugaucucaagccccuuaaggcccaggagccugaaucugcuccucauuucaccuuugacuguggccccgucacgagcugcugguauuucucuuuaagcuuuagauaguguuuuugaagaauuacuaugcacauguuuuagccugugcuucuaaguaccuacagugguuuugugugugcccagucaaacgucuuugccaaggauggauuguaaguucgggauuauccugugaaaacagugacuccuucgccaauuguucuguauuaagguccugaauaguuuaagagauuuguaauuuacaacuguagaacacuuauuuuuggugugugugugggggcgggagggggggguggggggguaggggcucaagacuggguuucuuuguauagccuuggcuguccugaaauucacuguauaaaccaggucagccucaaacuaucugccugccucugccuccuaagugcuguuauuaaagacugugccaccacugccugccagaauauuuucagcaucuauuauucaaguucacacuaguuaaaagggaagccuggcaggaaccacauucuagucauagugcuugcacuaaagcaucacagaugucaggcaguggcagugcuucaggaggugaaauagaggaaaaagauaucagagcacaggacaaggauuuuguugggcgugaccagugaagaauuaugugugcugaaagucuacaacauaaacauuguuaccacuguagaauuaguacugcccaaagaaugagucaaucacauauaauucaauguuuuuaaauuuagaaaccuucaggucagucagcuacaggcauuuaaucccagcacuugugaaguggaggcaggauggaucugugagucggaggccagccuaguuugcauauugauauguuccaggacagccagagcuacauagucagacccugucuuuuuuuuuuuuuaaaggaaaagaaagaaaaagaaaauuucuggauaugugucacauuuuacauaaagauuuauuuguuuuuugagaugggaauuuaaacauaagauagauaggguugagguuaucugguagaacgaaaucucauaauggauaguacuuuagacuucucauuaccgccuucaaaacuuuaauuugcuuuauuaagaaaaaucuguuuuuaaaugaaaagcagauaguuuugcguucauauuugaucuaucuccugccaccacaugacaguugcaaauaaaauaaagcaauuuaaaagagaguauuguucauauauaaaauuauaauagaacuuuccagagauuagccucuaucaauuccuccuggaguaagcauccuuggcggugccuuaggguuugaaguaucccauggcaggacguuuuauaucacucucauaacuggauucucuugaguuuggguggcgaguggauguuacucggguggaguuccgcaugguagccagggugcauugugacuuugugcuugugugauguugagguucuagacggcuacggugacggcucuuugaacagggugacugaguggguucaggaagcugagcagcacuugugaagggcccuaucuuucucaacacuuuucccaaaagacggggucucauguagacuaacagucauggcauuuccuuuuuaaacaggaaaacaacgaauugcucacaaaccucauuccaaaccaaaaacuucagauauuuuugaagcagauuuugaaaaugguguaaaacccaagaauacauuugaugcugaugaacugugggcucgacuugaagagcuggagagacaagaagaacugcugggugaacuugaaaggugcuuaauggcagauuagcuuuccaagggaauauguaucuuuccucauuuauaagaugguguguacucauugaagaaauugcagaaaacuguagaaggaucagcaugcccuuauauaaacauuuuuguaggauauuuccuucuguguaaauacuuacacugaaaaucacaaucuccaugauacucagaucucgcauauuauacacacacacacacacacacacacacacacacacaauuauacuugauagucagugauugcauuaaugcuaacaacaacaacaacaacaacaaaaaagaacuuaaaagugaccaaaguuuguuuuuugaggaacuggggauugaacuaaugccucuauccuguaagacaagcauucuacagugccauggccaccacuccuaaauaacaaauuuuaaaugauauaauuuuauacuguuuucaggauaaugcucuaugcuccagugacuuguuaaaaagaaaaaaaaauggcuuugaauuuaaauuugauacugaaaauguuuguccuuguauuucauuuacaaacuuucuguuuauugagcaggcaauuuauaaugucgucuggugguucuguguauaugagaagcgucaccagacugcuaucugagacuggccuuagcacucacaauugucagagugcuguaugaaguuggcuacugcagaagucccuagauauuuugcuuaagugaugugccauauacaauaguuuuugcgaaaaguagggcguaaaaugcagaagaauuuucccuaccacuucaccuaugucuugauguaacuauuucauauuuuucauuguuucuagcuauuucauuuuuuuaaaacccaugcuggauuuaagagucuuagucaugauuccuucuauuuuugcaugaugucauuucaauuuuguugcauuuuuaguucgguuauuuuuguaaggucuucagauccuuuauggaacgaagcgugauaaaugugcauuuguguguaaauauacauucauaugcacaugcagaaauccuuuaucuuacgaauucccaguccauguugcuacacaaauuucugaggucaaaauuagaaaauaauaguauaucaugguuuguggguauaggggaugaauuucuggucuuaaaaauaggacauauauuuuuuaaaaaucucuuuuuuaguuuuggagagaagcuuuacagguuggaacuugaaagagagaaggagguggugguggggagaaagagugcaugaggucagaacucuuguguagcagguaggaguggucucagcagauagagcaggcacccucuuagacauuucuuuuucuuuuuuaacgcguguguguguguguguguguguguguguguguguguguguguaugugugugugugugugugugugugugugugugagaacagguguucauguuuuuuguuuuguuuuuugagacaggguuucucuguguggcccuggcuguccuggaacuugugcugcucuguagauaaagcuggccuugaacacagaucuuccugccuucugagaccugggauuaaaaaugagaaccaucaugccuaccaaauuucuuagauugcauucaugcuacaucuggccaauguucagagauaaaaaucuacguguguccugugagcucuuauguuuugaguagcuacagucugcugagauguguaagagcgguuauuucuauugucuguauuuuuuuaaucuuauccauauuuucuuucaucaucuaguaaaccugauacugugauugcaaauggagaagacagagugucuucugaggaggaaaaggaaggugcagacacaggugugaauguggugucuccagugacagacuccucugccgccagcagcuguaaaaggcgugcuggaaaugcaggacucccuaauggucaagucaauagucugaacuauucagugaauggcucaaauucuuaccacagcaacaaagaugaugaugaagaagaagaagaugacgaugaugaugaugaugaagaugacgauaaugaaagugaccaugcuauuucagcagauaauucuauuccaacaauauauuucucucauacuguugaaccuaaaaggguuuguauacuucuaacuuuguagucauuaaaugucauccaugcuguauuuuagaaagaacauuaacauugacuaggauugucaaugcuaucaaacaggaaaagcaccuuuuucucuuauccaaccgcuucaccuuaaaagaaaaacaauaauuaguaagcgaugguagucagucugccauucucagaaggcccacuaauguacucuugacugcagugacugugguugaccugcccucauuccagggcucucuuuugguuugcuuucagaucugaaaauggcuucaagacaagguuauuuuggggcaaggggaaccagguuguucuuuuuauguaggugucaaaugaguacuguuauccugaacagcaaggaaaaguuggguugagggauaaaaacuggguaauuauggguuuagaguuuagauuuuggagcugauagugacuauagagcucuugugauccacugcuuucaaacuuugcuuaguauccaaagcuuuuguucuuccauaccugauuguagaaguauuuuaaaugggcaaaagucgacuaguugugggugaagggugagcuaccaucaguccaccccugcccucuuccuucccugugugcugugcugaggggccuggguguauguuuuagggaaucugagggguugggcuauaaggcagagcuggucagcagcaaucagguucccugcuugacggucaguagggcaaucugcagugccugguuauugugugaggagacauuuuuuuccuuuuuuuaaaaaaaaauuagauauuuucuuuauuugcauuucaaauguuaucccuuuucuugguuuccccucugaaacuccccauucccucccccugcuccccaacccacccucucuugcuuccugguccuggcauuccccuauacuggggcauagagccuucacaggaccaagggccucuguaaggaggcaucuaaacguuuacuuauuauuaugauuuaguuauucuuacccuuuuagaaagugaaauaauuacaugugucuuuuuuuaauuaauucuaauacauuaagcuaaagggucuuuggaauuuuugggggaacaguugaaagugaaggauugcugguuucccucccucccucccucccucccucccucccucccucccucccucccucccucccucccucccucccuuccuucuuuuaaaggcuuuuucuuagacaugcaaacacuguuagaaggacuguuagggagagaguggcaugaaugcuggaucgucgcagaagaagcuuacuguccugagcaccuuuagcuuuuacuuagucugauuuucucccugagguuagcaguauuuaagcaguuuacacaguugagcauuaucugcuacugcacuugugacucaggcuagcagcacauggacuaagucgcaaauacauguaagaugaaggucaggcaaaguuuauaguuaguguggacuuuaguugaaauguauuuugcuuugcauacaguaguaaagucaguggugguggagucggcuguugaggaagauguaguguuguggaaaugacagaagagucagacuugaccauguacauaauuucagugccagaaaguucgaacagaaucucuugaugguaacugugauuuauuucuuuacuguggaacuugauuuuuuuuuuuugaaaguuuuugauuuuuuucuucuugugaauuaauuuuagguucgaauaaauacugggaaaaauaccacuuuaaaguucagugagaagaaagaggaagccaaacggaaacgaaagaguggugccggcagucacgcuacccacgagcugccugccaucaagaguccugcugauauuuacaggugcgugauggucuuagugccugcagaccuccccuuccuucccgguuugcaggaggcucgcugacuuggagguucccaaagacugcaggccccacugagagacucauagcccccgggccacgcgagguguggggugguucuuccuuuguccucuucagaugucacugaagaguuggaagcugguauucuugucugucacaacugucaugaguuugucucguauucaccugucauagcagggaacaguuacacuguccaguuugaaaugccuaccauuuuauuacccauauuuacaaacuggugaaaauuccugguguuuugaaguagguguauaaaauucuuuuuggcaaaucaagcuguucucaccugggacauauaaauaacaugcuguauuuuauuggguccaaaauucagcuuugaaaaguaacauaagguacauucaguguaguuguaaauguacucugacugugacauuuagagaagacauuuuagcaaggaaacugaauggaauuggugagacgugugauuccagcauugggagguggggguggcagaaccaggggugaaaagugagcuuggguugcaugagacccugccucaaacaaacgucucaacaaaaacaaguuguagguuaauuuacaguuacaagcccuuaaaauggaguuguuuuuugaaugcuguagagucuucguggauguugugaauggagaauauguuccucgcaagucaauccucaagucucgcagccgagagaacagcgugugcagcgacacaagugagagcagcgcugccgauguggaggaccggcgggggcuccugcggagcaccagcucugaggaggccguggcuaccgaggccggcgggagcaguuuggacgaacuccaagagaaccaccccaagaagccuuugcccucaggagugucugaggugugugucugugucucuguggcauaucucacaggcuugcucuuuacacuucaaaguucucagcuuguguuuaaguucugaggaggggagacgguccaaauacuagguaguuuuuaagaagugacucucuggucuucauuuuucuugauauauaaagacacaucaagacauuguggugauauguaugucauuuagucucauuucaguugaacauaguuggcuuugauuagaugaaguuccacaaacacuuagccacaaugaaagagcuuuuuugguuugggugacacaucugacuuguaccauuggauugauuguccuagaauuuuaaagcuauuuugauucacguuagucuuagcaccucuaguuuuuuaguuuuuacgggggcaaagugcaauaaagaucuugaauaaauaaccuccccccccaaagaaaugaugucagcauuggugaaacgaagcuucugacugucagacagcaaggaagcaagggagccugggcagaagcccgccucuugugcccgugucgcuucuguguucacugauguuuucuagagagcuggaggugucaaccauaaaaaacuccuugaauuugaugguguacuuaagaaaaauaauauuaccugguuucuuugaaccauuaguauuuugauguuuauuauccaaaauucuuguuaccuuaguuuaaaaaaaaaggucuuggaaaugaaggguaaagauuuuugugugcgucuuaguuauauuuaacaccauauacacauuugucuuacaggcuuuuucuggaacuguaauagaaaaagaauuuuuaucacccucccuagcaccauacucagccauugcucaccaugcccuccccaccauuccagagcgaaaagaaguuccaucagaaguaucagaggaacccacaaagagggugucaaaguucagagcugcccgauugcagcagagaagcuagagggcuccgccugcagcuccagcugcgcuuuaggacaugcggcggauucggccauggaguugggacggcguccugcuuggcugggcagagcucucucaccuuuaucaguggcauugggaaagucaaaguaaauguuugaaugcuguaauguucugcuggcuucguuaauucugugacuacugucuaauuggccuuaggaugcaggaauagcguuuugaguuacuuuucaaagaauccugucauauauuguuuguguguuuucaacuaaacacaggcaguuucguaccagcugugauguugugcuuuccauauggaccauguuaaagacacuuuuaaaaucucaaauagauucaacaauuauauuacuugcuuuuacauuuuaaaggcacuuuaaaaaaaucuacauuucuuguagguuucacagcuguaugguucuuugaaaaauucuuccuuugaaugucauacuguaaucuuuaaggcaaaaagcuacacaaacccuuugggaaaauuugacuagaagaagaauauuuuguacaacuuuuuuuuuuuuggaaguaaaauuuuuaugaaacuugguuucuaaaauguugugaacuuccugguuuagauuguguauaaaaugucuuugauuuguguauaggccacaccacagauuuucaaaguuuucaagucccacgagcaccuccucuccccauacacacaguugucauuggcaccauucuuuggggggaaaaaguuugucuagaugcuuuaacacuuuguuaaagcacaggccuuuuguuuguuuguuuguuuguuuuacauuucaaucuuccucacauuuucauucuucaaggaugcuuuccuaccaguaaaaaaaaagaaagaaagaaauauuauauuauauuuacuuguagccaaacuccuuaaagagacauucagucucagguugaccauuacagugcaaguguugaucauuagcuugaugcaugcuaaaauguagcuuuuaaaaagcauuccgcaucaguacuaaaauaagccaucaaccccaguccacccucuauucacggcuaaauaguuagagguuauuuauagcuucuuuaaugaauucuugcuuaaacaaagugaaauuauguccuagaaaagucgcagcuguaacuagagcagugccacugucagaguuuuaugaaauacaugcuuuaaugguaaaaugguaugcuaggguccaugcuaguuaauggauaaugcagaacaggggacugaauuggaaaggcugccuaaaaauauaauagcucgguuuuucuagccguuguugaucaucuguacacauauuuuguacuuaaaaaccacuuuucuuuccaaucaccuacucucaaccagacuaucccaucacaccgacucuaggcacacccugcuccuucucccuaugagaggcguccugugcuaaccuccuccugaugcaagccuccuuguggaacuguuggaucuucagauguguaacuuaagugugcuguuauuaaacacuuucuauguucaugaacuuauu

SEQ ID NO: 3731 - RNA, 2139 nt, Mus musculus
ugccauggcuucucucaagaauagacuaggaugaagugaaaggcucacuuuucuccccaagugcuuuugcucaugguguuugucacagcaacagaugaucaagcuaaaacauucuuuucauuuucuuuggaugaugcuacccacgcucaagguauguuuuuuuuuuuuuucucuacagcuccuccucucuggaaauaaccucacaaaccccuccagaggugugacuuaccaucuccuacaugaacugaaauccaggcaggucaacaaacaagauuaaucaucacugguauuuaacagacauuuuuuuaaaaaagaugaacaaaaugagccugucacucccaggagaacaacugccaguaccugucacugaugacaaaacgcaagcucucgagcauuacaauuuaggggacccuuuuaucugccacuauaagcuugacagacucucaauauuuaaagacuuuuuggaugauguuaaacauuagcgauguucugaaaagaugugauuaaaauaauucuuuagauuuguuuucacuuuauauuuuacgcauauaacuauuaugccuccauauguaucugcguaccacgaguaugcuugaugcccaagaaggccagaagggguauuagaucuccuggaauuggaguuacagauaguugugagucaccauuuggguucugggagucaaacauggguccuuuacaagaaaaaccacuaagccaucucuccagcccaaggaugccaauuuugauguuaugaaauaaaaaugacucuuggaaacuuuccauagcucuucauuuuccaagugacuagugcauuucucuuaccuuaacagaaagaaagugauggggaagcuauaaaaucaaccuuuucuugaccuuaguggcaaguggaaacuucuuggcaaccaaauggcacaaaaucugaagaccaggugucccuaaagaggaacaggucuggcacuacuuuaccuaugaugucaugagagacuacaggcaccaugcaagcaagaaacauaauagccaguauauauauaugaauacucuaucuguauguccugagugcuagaagagggcauuagaucccauuacagaugguugugagcuaucaugugguugcugagaauugaacucaggaccucugaaagagcugagccaucucuccagcccccuuaaaaauauauuuguaaagcgaauuguuagagucugaguggggcuagcauaggaauccagaacucuggguccugcugacucuaggagagucucccuggauuaccagcaccaauuaugagaaagauuaggggagaccaaacaaauaguccagagaagguucuauacugguacagacaugaggaguuggcuacccacuguguuuguccagguucuguugcuacuucaaauuacccgagacugaagaacuuauagaaaaugaaguuuuguuuuguugguuguuuuuuguuuguuuuuguuuuuuuagaauucacauuucuggacacuuugugaauucaaauucacauuucaacaguauaaugugggcaucggugaagaccucaaugccucaguacauggcuuugggaggcagaggaaguguguuaacaauuuucucugaguucaaaacuuuucuauggacugccacucuuggugggaaguuccucuauccuguugcuguaguaagaaaucuaacuucuucaggauuccaggguagauugaagaccagaagagcuccaggaauucuuucaggacuccagcagcagauuugggcugcagagacauccagccacuggaccugaaaaacuauuggauucuuagcuauucuguagugagauagccagccaucguugggcuacucuguccacagaagguaagccagucuaagaaaucccauacaucuguugucauguccccaucugagcuggguaaacuuuuguucuugucucccuaggaagaguaccacacaagggucuuggagagucucacaucagcugagcugccuggaggagacucugaccaguccagcugccuggaguuuuugugcgcuccucaugcugcggugguguuuuuggugauacaguucacccacacucuuguugauaaccccucacccguacaacuguaaaaaaguccaaaagauucauugcuucacca

SEQ ID NO: 3732 - RNA, 11556 nt, Mus musculus
ggcuagauguagccugcuuuaacugugauggcauucaguggggccuagcugggcguuaaaaacgggcagaucgcagggggcucuggucggcccugugccacccgucggaagucgaaccgggugacgccucgggguugaagugcgugaaaugguaaggagggagagaacguucuaauccgccuggguaggacaauccagucacucuggcggcccggggcucgcccacgcuggguccccgcaggggcugauugcucggcucccuagcuacagaccaagccaaucagcgcgcucgcgccgcgaacagcaggcggcggcccgccaagggcgggcggggugggacagcggggagggcucucggguagcacaccggcgggccaaggcgcccagcucccggaggugcaccgcgggugggcuccgcuggccggggcagcgcucccuuacggucacgggaucacaaggcaucugcugccaucugguggcugcgcuucggcagcugcggcgccaggguuuguaggguuuacagggcucacagggcuugcagaucccugcucauccuuaaaccacgccacauagccaacaguguccacgcugccaccucucguccugcucgggauucucccagcagagugagaaagccagcaucuccgaggaggccguguguaucaguggcggcgcagagagcugggaggcaggcuugguaugacccagcugaguaggaucaccucugugaacucuuuuucauucuucuguaaguuagagcgguuagaugugcaugccuuggggagccuuuguaaugauuaacuggugaauucaagugaagauguaguacguggucagagcgcacacuaacuguuccugagugucuuaaguuagggucacuauugcuaugaugaaaaccaugaccaaaggcaaauuggagaggaaaggguuuauuuggcucacaccuccacaucgaagucuaucacugaaagaagucagggcaggaacucaaacaggacaggagccuagagauagaaacugaugcagccggccauggaggggugcugcuuacuggcuugcucaucguggcuuguucaaccugcuuucuuacagaauccagccccaaugacccaaggauggcaccacccaaaguuggcuggacaucccccaucaaucacuacuuaagaaaaugcccuacagaagaauguuuguuaacggaagcauuuucucaacugagauucccuccuuuuaacuuuagcuuacgucaaguugacauaaaaccagccagcacacuaggauagacugcagaugccaggcaugugcaaggcacaggaugaaacacacacacacacacacacacacacacacacacacacacacacacacacacucacagacaaaugaguucgagaacugaucauguuuuggauucuucacuucugcaucugugaacuggggauaccaaugcuggcuuccacccccaagcuuggguaacuaacacgagucuaccacucccaagauagaucuacuggcuguccugggacuccuaggccuuucuuccaacuguaagucgauuccccaccacucugcaagcucucgaagcuguguccaaaccuggagacucuaccuccugucuuacagaucagacuuguuuuucugucuccaaacccucucuccagggucacagacuaaaagguccaaauauagaacagaucauuuucucugacccuuuucaaugaggcccuacagggacagccaccucacccccucuaauaagacaugguaggaggagucaggugguaacaguacuugccuccaagucugacgaccugagucugauccccaggacccacgugaugcaaggagagaaaggacuuccuuuucugacacacaaagaauaaauauaguaauacaaaauuuaaaaaaagauaugguaaauugaaggguaguaaauaccucuccaaaaaggaaaguugucagaugugauggcacagccugcggucccagcauccaaggcccugaggaucugaggauggaggaggcgagggagggagggagggagggggugagagagagagagagagagagagagaguccugaaagccugcaagcagccacugucccagagacaugcugagcagguggcuucacacaguguccauggcuucucagcaugcagcagcaggagggcugcagagcagggugugacagccagguacaaccuggacaaagugggaugucucaguagugcuagugcucucagccuguggaaacgccggcuccaauucaaagguaucaaauauuugcuuagcuguucaacauuucuucaaauaauauacucacaacuaauucauaucuagacucgacgucuucaucucucuccagccucccuccuggauuagcugucuugucuauucugggagaaaauugcccuacauucuaaaaauaggccuugcagcccggacaccggcauguaccaucagagaaggcuuuauuuauuuaucuugagagcuguccccuggggacagcugcagucgagccuggggacacauucaucaaacagcucagguacauguagggggcugggaccacugagaucagugcugccuucaaaacaggccauggucuguuccugaggaugcucuuugacacucaggcagggaauggguucucagagacaggaccuucucuucuccaaauaugguuccuuuugcucuuggggguuagaagcccaagauccaggacccagaagaagugaaagaaugcuuaugauggauggggucuuggauaguaggggcagacucugguuguaaugggacccuaagucugaaggucagaggcucugaucugaccucuaaaguuggagccuaaggaaugcucacuuccaguuuuugcucuccccagucucuugguauucuccuggcugguuccugauagucugcaaagacuggcugcugugcucccaacucagaggcuuugcccauggccuccugcauuauacagaggggcagacaggcagcuaccuuuagaccucacuccauuccggcuucuucugugucuccuuaucacagagggggauacaaagccuucacuuuauccucugugccuccuccuuucucuugcucuaaaugaaaccacccaggacuucauucccaguuuccaaggcucacugagcacgacuaagaccuuauggugagcuccuacaguguggcuagcuccagaggugacucuugucacuacauacuucagaagggggccuggguuacucaguccaucauucaaccagccagucuugguaauuacuucaccaggucucuggcauugaccccauagccacagagagcuuagccuuugcuuucaacagagcugggcuuugaauugccauccuccugccucaggcuuucauccagcugguguugaauagaacaaaauccccccaaaaugggagugucucuaggaggcauguccacuugugggauaauucccaguaccaguguucacccaguuacaaagacauuucuucccucuuagucucauauacacagucagcuaaugcaaaaugaaauuccaugugauuuuuuuuuuuuuugcuuauuuuuaagaccauugggcacauuguggcugaucgcugcucugacauuuuucuucccucauuaagaaagacgccccuggugaguuaccugcgcuugguucagagcagaaaauaaauaucgcuggcauccacuuuccugugcucucuggguguaauuaagagggaggcaccugccgaagagggaaacagaguggaaagcaggcuaguggguacuguccauaagaucuccugcacugggucaggugggcaagccuucagagagcuauggugugagccagggguucaaaaugucugacuugcaucagucgcucaguccagaucugggagagggagaaaugaagacugucacauagggcuguucauugaacagagccuguggcugaaacagauuuaagagggauaaggagaugcaaggauaggagagucuacagaauacucagcucaucaugcccccgguuuaucuucuggaucuuaaugucuagguggaaucuuauuucccagagauggacugucugcuugucugucccauaucauuuggcauggggcagggcucugaggcgguguagaagugcucauuguugcccacagguaaugucacaggguccccugugcaauguucaauuucaagucggaggcgggagagcgguagacaggguacccgaagaacucuuuggcacucagcucacguggaugcauccaacaggggaaauagcgacuucacaccaagagcucaccacaguugucccugugucauccagaagagaguuuuuggucuuuaggucccaaaauagaugaagggcaggaaugauaggcucagaucccagcacugggacauagcagggagcagugugagaaaaucccucagccauucccaggcucacuggggaacagacauucuaaguacucagcugggugcugaguacuuaguacacacacacacacacacacacacacacacacagacagaaacacacucauaccauacacacucauauacauucaugcacauaaaaacagagaaacauacacacacaaacaccuacacacaaauacauacauccacacauacaaacacacacaaacacacaagaacauacuuucacacacacaaacagaaacacacacauacaaacacacaaaaucucacaaauacucauguacucacacaaccacacacacucacauacauauucacacacagaaacauacacacacucacauacauauacacagagaaucacacacacauugaaacacacacacacacacacacacacacacacacacguacucaggagggcuuuaagaucauacagcacuuggaccaacaguacuuuucuacuuggcugcccaggguggaaggcucaccaccaccucuucaacucuuugccucucucaaaacaucuggcaguugccauaugugcaugguagcagaguacaguuccccccccccccgccccaccuugccuuggguauugcugagguauaaacgggcauccauuagggcugaggauguugcuuggugauagaguauuugccuggcaugcauagggccugggguucuauccagagcacugaaaaacaaacacaaagguaaaucuauuuaauuaugugucagaacugauaggcaccagucaacacucauggaaauagcauaucaucuuguuaacuucugggagcucucugcauccccccucccuuggcaggagaaagaaccuugcacagucuuggggaucccuccaacuggagaauggggaucccagaagcagaucgaauggugcucucacaugcucacacauggcuguuucuggccccuucuucagcagcacaucucagcugaaucugagccugcagggucccccacccucccucagcacccucugagcugccuacuagaugggaguuagugauucacagaggcagcucaguuacucccaccugcagccugcaaaugugggccagcgcuggcaagucaagaagccccagcaagcuuaguuagauaguccugccaccaggagcccauugccuccagucuggagcuaaggagcaaguguugauuuaaaaucauccauuuuuaaccuaucagucaaaucucuguaagugagcugguccagucugccagcuuugcagaagguuuuuuuuuucccucaguaaaaauucaaccucuaacccucaguuagauuaggauuagcuuuuggggggaaauucuccccccaccccacguuaaacuuuauuaaaauacuuuuuuuugguacauuaaagcuaucuuuuuuuuuaauuuaagauuuguuuauuguauaugaguuuuuguuucauuuuuaguuuuguuuucuagaaaguauauauacacaucaugcgcaugccuggucuuugaggauaccagaaaagguuguuggaucccuggaucugaaguuacagaugguugugagccaucgcaugugugcugggaacaguaucaagguccucuccaucagucugugcuucuuuuuguuuuuguuuuucuauuuuuguuuugguuuguuuuuguuuuuguuuuucgagacaggguuuuucuguauagcccuggcuauccuggaacucauucuguagaccaggcuggccucaaacucagaaauccgccugccccugccucccaagugcugggauuaaaggcgugugccaccacugcccggucaaucugugcucuuaaucacuggauucuaaacuuuauuucuuuuaauuuugugaaauaaguuuucucacccuaguccuggcuggcuuugaacucacaaucuuucugccaccaucuccuagaugcuggaauugggagcuuaugcuacuaugccugguuuggaauuaauuguuuuuguuugugaaaacaugcucccuaaaacauggcuucaugcagagaugcacaggacacugagccccaccaagcccuggaugucccaaugcucugagcccuuccugagggcugaccuugccugagagauggcugccuuuggaguuuguucugaugggacauagauaucuuccuuucuuuccucccucuccuuucuuuuuaaaagaacacauugccuccucucaucuucccagcagcaggggagccugguccuugaauaugcauguccucugcuaaaugcuggaaaauaaggcaucauuuuaagaguagcagaggcagagggcaggggagcaaccuaggacugugguuuggcucccagacauucaggcuuggcucugaauuuccuaaggggcucccgcaggccucucugccuccuccuccugcucccaagugaaaggacaacaguaauuccaaaacugguugccagugugaaacucuccaccauggguuggauaaauccugaacuggcuuucuggaucuucaggguggcauagugccaaggguauuguaguguggcuauaaagugucccucaaacugggggccccagcugguggcauuacugagaagugauugaauccuggauuuucugacuuccucaaaguauuaaccugcugguuagcuggauggacuuagguagcagguggggaccaccuagaagaugcucacugggguauauuugaaugguuuaaucuuguuuccaggacuuuaguuuccuuuucucugcuuccuggccucucagaaguggucugcccuaucuuccgcacguuccugucacugugaugugcugccucaccacaggaccuuggcacagagccagcccgccauggaugaagaccucugaagccaugagccuagguaacucuucuucucagcuggucuuuucagagaugaaccgcuaacucacgcacaaaggaaacgcguacacucugaaggcaaccuagcucgaauccuuggcuucccaauguuggucauugugaccuggauagacucacgccucaguugccucaucugcaaaauggacaacuuggauuuuugugagucuuaaacaaguuuuacccauguuggucaggccacauccaaggugguaccccgugcuuaauaccauuagccuaggauauggucuuuaaggugacuuggcuagcccugguccuuuuaucagccaaaguauuuucuccagccccugacuuggucucagaagaguuaggagagucacuucuaauauuuuaucuuuaaaaaaaaguccaaaauuuuagaguaagguacacauuuacggucaacuuaaucuaucacuuacagcauuaacaggugcacauggaagcuucuagaaacccuuaucuacacuggagaauaaucaggacugagcagccuggugccuugcuggacccgauugccaaagucccugcagcucucugaaggugggggauugcagugggcaucugcucugugcagguauguggggagcaggcuguggugcacuggaggccaggcccucuuuguuggguuagccuccugaguggucuuucuucccuggugacaacugguguguguguauguguguauguugugugaugacuugaccguugugguguguguguguguguguguguguguguggugugauaacuuuagauuugucuguuuuaagacagaauguugacacagugccuuagaacccacugaguugcauaggcuagccucagaauugugaucccuaccaccaccaccaccaccaccuuagcuacccaaguguuugaacacucuauuugucuaguuguaauugcagagucuggaguuuuuacauugccaguggcugggcuggaggggugacgcagugcuuuaagagcgcuugcuguucucccagagcacccguucgauucccagugccuacacgacucuucccaacaaccuguaauuucaguuucaaaaaaucugaugccuucuucugaccucuguaggcucugcaagcaugugguucacauacauacacguaggcaaaacacucacacauauaaaauaaacuaaaagccaguggcucgcccauuaucaaccugccuggguccagcccauguucaaggcaugcacauuugaucuucaugaugauucuaaacccagaacagaggucauuccccaaauggucugaagcagagagugaaaucccaguccucuagagcaguaguagaggggacaccaacuuggggacacauguggcaggugacagagauagacagagacucuucacagaacuauccagaugacagcaaacauguggaccuagucaggcugccugcaaacccagcagcuuggacagacaauggccggccaggccuugcuaggacaucagugcuuggacaauguguggaugcauuuugaacgcugcaugaggaagaugcucugcuugccuuacugagccaggcaggugcaccucagagcuccucugcucccuacuugugagcugaaauugauauuuaauuuucaguccagguuagagggucucauacacaaauguacauaauaucgacucuauagaauucagcuauauagguguacaucuauaauccuggcacucagaaggcugaggcaggaggcucauaacauggagaucagccuggguuccacagcaagacucugguuuuguuuuuccuguuguuguugcuaucugaagcugugaggucuaaacacugucuagagguuauccaaagguuuuuuucuuuccugguaucucugguuucacucuguggauccuccuaugaacauuuugguguggacaggcuugagauacucuguaccugguccccugcaugcuguccuaaagucaccugugcuacacuacucuuacucccuguagucuggccauacuuccucccauacuugaauaccguuucaggcucaacuuuccaucugaauguccacccaccagauccuuucuuggcagguugauugucaccuuugaaaucacagcuugaggugacagacccccugacccagaccugaguccccgcaauccccagcuccauuguacuucucacaucuggcaagucuguaccacccucugcuucaagaauauaaaucgacagcaauugcuacaacaacuaccauucuugcugggacaggaccugcuccccauguucuugguagaccccgagugacaguagguuccucugaaagcuaaggauagaguucacagaguuuguaggacugacugcaucugcauggaacccagguaguggaaucugggcugcccuucccuuaucuucugcugucauuguggccucaggugcaacgacccgaccccuuccucugggggacauguaaccauggaaguccccuuugcuuguguguaguaguaggugugggaaaggccaggucacugucucaggcacuuacaucucaccagcaagggagaaacagccuggcucccuugccuugaugucaggauggucaaggccuagucuguuuugugccucagagguuacugcggggaccuacucagucaugcuuggcacaaucuugccagccuucccuguuccaggagacacaucucaugcuccaugugugcaauggccucucagggaugcuacacaaggaaaccguucucucagauuccuuccaccggcugcagauauccugacccggguggaggagaagucauggucuucagcucucacaccaggcugcagggucacaggaauaugagauuccccugcucccugguuccagccccauagaccaauuagacagaacaaggguaccauacucaucacuuggaaaugucuucuggccaaggacugcaggggacuggguaagcccaagaggcacuuggagaaacugaggccagacaaauaguuaacucuucuagaacaagaugcaaaagacagcuaccauaggagcugagaaaaauuucccuacaugucccucuggaagacaugccuuaaaaugcuuuauuuccuugccaauuggcugaaaagaagaagaagaggggggaaaaaaagggaagaaagaauaagaacaauagauucaagcugaaauaauuugcauuuaugaugaacacaaggaauaucuaccuugcauuuuccuaaaaaagaaaaauuaaaccucguuuuuaauuaacugauaaacuauuaaucaaauuuuugcaauguuaggugacacauuauucauuuagauagaaugacugugaacuuaaacuaaucaaaucugauuugcccacauagacuugauugaaauacauuuuaacuagcauauacaaagagaaaaucuuggguuucuuaccuaaucuucagagcguacugcugaguuaauaagggcagcuuuuuuuuuuuaaaugagaccaccauuucuucaucugcauaucaaaaucaagaggaacuuaauugcaaaacacauauuccugaaaucuaaucauuacacugcuuuaggguauuuuauugaagcauguuaaauuauggacagaauauuaaugauggaacuaaucaaacccaauuagucacuucuaacaauagucacauaaauauacaagucagguaccgguacuguagauaugauguaaaaauguuaaaauauuaaauguauggcguaucuaugaaauauucauggugacuuggaagccaaaaaaucacugaguaagucaacuuaaaaaacacaagugggaagcuauccuaugguauuuugauagaauucccaaguuuucacuguuuggguaaaucugaauccaggagauuagggagccuauaaucaaucaaucagcaaauuuuaacaagaugacugcauauucaugacccugugaugugugugugagucuugcaucuagagacuucuuucagucuuuuguuuucugacuuuuccaaggccugugugaagcaggcuggagucuuugggccuggaaaagcugguggguugguggaugaaguuguguggguuuaugaauuuggucuccacagucucccccccccccacuucuagguaaaucaaugaaggacgaagcugucugccuggggagucugugcccacugcucuccuccuugaagcugcagaaagggaaugucugacagcuugguggggcccuggccuuggaggagacuugguccggaacauuacaggccugaa

SEQ ID NO: 3733 - RNA, 15009 nt, Mus musculus
acuuuuucagggaaaaguaauuuauuaguaauuugaugauagucggguaguaguucugaaaggauauagcaugggggauaccuugggguggaacuaucugagguugggauaccccacuucagagacagcauacauuugacuaaaacuauuucaugugaaaacaugucccaaaccuguuugugaaaacugagggaccacauggugcucaagcgaggcucuggguucuagggacaccaggccaaacuccagcuuccguggcuagcagcucagugguuucaaaaagcuuaaaacuggauucuaggucucuccugucacauguuuccuuccuggaggaauuccacaggaagugauuucagaacaauaacuuccaaaaauaccuacugaagucucacauaaagguauuaucucuguaauucccaacacuuggcagugauggaggcuggagaaucaagaguucaaggucgucuuuggcuacauagaguugggggcuagccugggcuacaugagauccugucucaaaacaaaacaaaacacaaacacaaacaaaaaacuaaacaaagaaaaggcaaacaauaagaacuuaaagacuucuaacaacaacaaaacguauuugucuuggcuuggaaaugccugccuguagucuccgaguucaaggggcugaggcaggaagaaagaccaggaguuugaggccaaccagaaucacauggagaaacccagguuuaaaaacccaaaccuagaggagggagauuguuuagccauugaugcccuaauggagggccuggguucaguuccuagcacccacauggcggcucacaauugucaguaacaucguuuccaggagguccagugccuccuguggccucugugggaaccagacacauacaucguacuuauauaaaugcagacaaaacauguaaaauaaauaaguaaagauauaaauaaauaaauaaacaaacaaacagaaagauaugaaauacauagcuuuaaaaauauauauuuauugagugucuaccccacaaaagccauggugccaggcaggagcaagcuggaggcaggagaagugaccgagacacauagcuccugcccucagugagugagcaccuccaaggagggauaaggaggaaguaucaaauacuuaaucaaauggauacaauguuagauguugagcuccagcacugggaccaaccgaccagaccaaagcugagucacucaagggcugggaccaggcugggcgggaaucagcagagaggaggacuaggagcagcgcucagggguggcacuuagccuaugcaaggcccuggcuuccauccacaacacaaggaaaacaaacaagcuaaugucagauuugagccuccgucacuuagggaaauggaggcgaggcuagcccaauccauaaacagccagugucacgggagguuaaucuaguuuucuugcuguuuccacuuucccuugcucgcccuuguccacccucucucuccgucucaccagggcacuugcugccucuugauuccgugacugcaaauaaaagcuaacuaagaagauguguguguccccaccuaucucccggcuuccacaauguccgguuguccuuggauuccugggcccaaggauguucccccuucagcuuuucaauuaucugggaccguggguaugggucugcaccauagcaccuagcuauguuaggaucucugaacucaagucauugguaauuuugucuuuucacacaaaugaauuauagauugcagccagcagacaggagaacacgggagggcuuaggaaaaguagaguggacaacagucuuugagguaaagcuagguaugguggcacaagccuacagucccagcuauguagcuugagcccaggacuucaaggcuagcccaaggaaacauaguaagaagaaaaagaaaacagagcuaaaugaauuuaggcuacgaaaguggagagaacaaaaagaguccagaaucgacauggaaaauaaaauauaaugaagugccaugauuuuucuuaaggaggcagaagaagcuccuacaagcuaaacuaaaguuacucaagagcgucuagggcauagccuguagcagagaauagaaccugccuggcaucuguggcuucacucaaaggagggacaguugucaccaugagaccacugggaaguccuuagccaagggaaggaaacacucagcagguuagcacaauccugacaagagcuggcucugaaccccaagaccccagagucuaaggggauucgauccugugacagguaccuggagguacacuucacagaaagagaagcaucugcuauggucggccagccaacaacaugagaaccuuuuagacccacauggucaucgggaggacuccaagcuguccgugaaugccuacagcaggcacgccuguacccuuccauagcacacacagcccaagaggcauggcugaugccucuccagcaggacgguccaacagaaugcacuagcauggcggcuuacaaucaaugcugguauuagacaaguuucccagaagucaggcuucccccauucccuggucaccuucaaugagccauagaaucaucuaaaaugagagccccacuccccagggggcggggccuaguccucauagcggaucucagccugcagcuccuuggugacauaggucguuagcauggccaagagccucugcugcauggccugguugcucaugaccagagcagucagcugcacugcgucuguccaguccaaguucccgaugauggccauggcuucguuaacaaguuuccgcuguucagcgggggggcagcuccauuaagaucugaggaacgggcuugaacuguccacucgucauccaggcaccuaacaggcccccaacgguccccccuggaaaacaaggaagggcucaauuagucagccucauuccccaacaauggccuuuguuucuugcugagagucaugacaaguggggacauucaccaggucacagcacgcccagcuucugccaggcacucugcagggcaaagguugauguggucucuaguccauuugguccacauaauugauacucaaauugguuguucccaaugccccucacuuacacccucccuaccucagaacugugccaacuaagauccccuucaugacugaggaacacccccccacccccacccgcuguggcucccagagcaauuugucuccauaaaggagaagccgagagggacgugcaucuucuggggaaagccauuugccuggaaaggcugggagccugaaccauuuccacaguguggcggucuuagggguuucuauugcuguaauaaaacaccaugacaauaaacaacuuggaguggaaaggguuaauuucaucuuacaccucagaucauacuccauagcugagggaagucuggggaggagccuggaggcaggagcugaugcagaggccacagaggagcgcuguucacuggcuugcucagccugcuuucuuuuagcacccagaaccgccagcuuaggaauggcaccacccacgaugggccaagcucuuccacaucaaucaucaaucaagaaaauguaccacaggcuugcccacaggccagucuagcaggaggcauuuucucuguugagauuccccauuccaaaauaacucaagcuugugucaaaucgauauaaauucaggggggauaggaauugugcccuugagcuuagggaauuccuagagaacucacauggggaaugacucugguggcaaggcaaguuguucucuuggagauucugucaucccauuccuccaaacaaaccuaacagaauuuacuaguucucuuuccagaggggcuugguuuuacuuucucuuacuuuuuuuuuuuuuuuuuuuuuugauuauagagccaggggcagucuagaacucuugaucccccugccucagcaucucagcugaguaucauaagugugugcgagccuccuugcccagucagaaaacacuauuuuuagauuucugcuuucacuguuuuuccaggugcuugguauugugggagaagcgugggagagcggcucaggggccagccaagcucucuuaauaggcaugcauccugucugucugucugucugucugucugccuuuccauauuuacaucccaaacacccuccugguccccuucacagagucccucccuccuagaaacauuguuuuuaauuuuuauuuuuuuaaauuuuuuuuguuguuguuguuuuucaagacaggguuucucugugugccagacaaccgcugucacugggcacauuagaucuguaucuucaaagccucccaugaacuguacauaucagcaaucagacagucacagaugcagccuggguagacucaguuguucccaagggacagaauaugggguaagaaaccaaaaucgcaaggguggaaaaacucaucacacaugaccuugacuaaguuaccaaggucagccucacuggacaugccacgggaugccguguaucccuggacugauggagaagauacuucaccucaggggcguucccucccaaggcucaggagaagcuccucacacaacugagaauucuauaaaacaccugccagcacccccucucccccauuaucaaggucaggaaaaccaggaagggcuaagaaacugucacgggccagaagagacuacggaaaacgagguuuuaaaagcaaaguguugggcuggagagauggcucagcggauaagagcacugacugcaugcucuucaggagguccugaguucaauuuucagcaaccacaugguggcucacaaccaaccaucuguaaugggaacugaugcccucuucuggugugucugaagacagcugcaaugugguggcccacaccuuuaaucccagcauuuggaggcauuuggaagcagagacaggcagaucucugaguuccaggacagccagugcuagacagagaaacccugucucagaaaaacaaacaaacaaacaauaaaaggugucagcugagcauaggggcccacaccuuuaaucccaguacuugggaggcagaugcagggggaucucugagucuaaagccagccuagucuacauagugaauucuaggacagccagggcuacacagugagaccuagucucaaauuaaaaaaaaaaaaaaaaaguggcaacuggaagaaaaacaaggccacugagcacugacuggucagucacagagaucucacaggauugcaugagugcuggcggcucggucccgaccgggaaacauucccacuaaaacuaaaccugacugagggacacacagggauuuucuguaaaauauuugcaacuucuacauauugcuacuccaaaaugaauuuuuuuuccuucaagaaaaggccuuuaaaaaaaauucaaguaacugcaaacagaaacgcagaugaggagucggaggcuggcaccaauacuggcuaccccuacccuacagaacaaggggaaaagguuuuccuacacacuuuccccauuaaagugggcaccccuccucacucugcuacagcauccaaggggcagggccccauccucccuggugugagguaguccaaaaaccagccuacugcgccccagccccccuuccccuaaaauguuguuggggaggagagugcaggcaaaacggggugggggggggugaccauuuggugcugguaguagcaacaauaguggugucuaagauugaacaucgaccaaaaaucaacacgauuguccagugguucucugugaacagaggaaaagauggaaccagaacccugagggugugcggcagggaggagcaaaaggagagcaaugcuagcuccuuagcgccuccuggaggaagggaacggccuagaguggaagucgggaggcaaguuagcauccugucugccuuagguggaagccagagaaauagaaccucacuuaggagauaggugguuacgucacugcaucaggccccaggugacaacaaggugggcgggucagcaucuuuccuauuuacuguaguccaagaggcuuagccagucucgugcaggaucuggguaagguggggcagaauaacugagaagcccaucugacaguuuggggguggggaggugaaggacaagcugggaucuaagcauccacugcacugaccacacuuucugcugccaggucagccuauggcgcuugucagaauuucugagacggggccccuuagggccaaagaaugcucccaggacccucuaaggggaagccaggaacagcagagcagaagggaccagcaaaacagggcacgcagagagcagugugucuaagggaggugcgcagcaggacaggcuguggcuaaaugggaaguuagccuuggcaggagggggcagguguguguuggaguggaggacgcagggggcgacugagccaaauccugcuccccugguguuucagagccagcagccgggauggcagugcgcugugggagacccggagagcccugggagcacagcuuccggucccaagggaaagcugcucuuggaugguccgggaacagauagcacugcgcaugaucacugcuucuuuuuuuuuuuuuuuuuuuuuaaagauuuauucauuuauuauauguaaauacacuguagcugucuucagacgcaccagaagagggagucagaucuuguuauggaugguuaugagccaccaugugguugcugggauuugaacucaggaccuucggaagagcagucgggugcucuuacccacugagccaucucaccagccccaugaucacugcuucuuuguggacuccccggagaugcccuccucuucgcuucuuuuaauacugggacaccaugauuguaauuccagcacucuggcggcugaggcaugaggaacucaguuuugucuuccuaacaccagugaaccucuugaucugaccauacugcaagcaucuguaccaccucauuaaggaacaucaaucugggauacauaguuucagaccagucugacauucauagagaucaucgcucaaaaacgguagguggggcuggagaguaggcucagugguuaagagcagggcacuggcugcucuugcugagggcuacuguuugauuccuagcacccacaggguggcucacaaccauccuuaacuccaguuccaaacaaccugacgcccucuucuggccucugugaguauugcaugcauauaguuaauggacacgcagguaaaacacccaugcauauaaaauaaaaauacucacuuuauaaauguuucauuaaguaaacagaccacccagcuuaugucagggagaacccacuuguaggcuggacucaggagacagagacugacacccaagcaguguggcucuggaagcagacagcucccuacaaaugggcagcuagauuuggucucuaagggaaagaggcaucccaggaagggauguucauacaagucugacugcacuauuccuccugauaccagugaaccucuugaccugacuguacggcaagcaucuguacuaccuccauacagaacaucaauauuugauuuacaagaguacuuaaugcaguggggauaucaggacaucgaugcacaaguugcuacuagaccuuuggagaaaggagaagcuaugugucuuuuaaagaaaaugaagcacccaccgugaccaggggccagaggcagcaaguccagacagacucuguucuugcucaaccugaauaaaauaugggcugccacaacagaaacaggacaggacauagccauaugauacaacagccccagccaagcguccccaggacacuuagguaggaguggaaggugaaggcaacucuaaggaaacgagaugugggcugucuucuccugucgugggaggaaguugaugucugagcuccugucugggccaucuguguguguucuuccguuucuaugaaauguagcuuucguuuaaugcaaccuucucagaugucaacacugccacugaagggaaguacagaguaagcgggaaggggugucggcaaccugggaaacugaaaccagccucagcacaaaagagccccccucugcccagccugcuaggauauggggacuggaaaccacagcagucagugaagaacugcccagcugcacguggcaggugcccagccuauguggggaugcuaaccauacugugcugaacaguccaucagaggagaaagcaagcacacugagccaagagaagcgggaagcagcaguccguggucucugcuucagcgccugccucuaggcuccugcccugaguuccugcccugucucuccuucaugcugaaauaaacccuuccgaccccaagcugccuuuggucaugguguucucucacagcaggaaaaggcacauaaagacacagccacacucaaggaaggaaguuggcgggcuuagcuucuucucugggucccuucucgggacccagacacccaguacuuuuagacucaaggauagauauaucucuagagaaagggcagaagaauuccaggaaaggguuccuggcauuggaggaaaggugccugcaggcucugagagauacaaacaccaaggccaagagaauucugcauuacacaaaagcucagaagcucagaagcagauggggcauaccauacaaacaggaccaggcaggccaugugacuggcaccauucguacuuaccaggucauucucccauguguucccaaaaccccaaccaugcuggaggccugaaacacacuuuguagcucaggcuauccuugaacuucccauguuccuggaucccaagugcagggaugacaggccugacccuugagcuuuuaugauagccccaaggcuggcuguaccuguaaaaucacccucacucaccaacagcuauuccuggugggccaccaaccaagccaccgacgaaggccauugcccccgcaaccauggcacccuuuccagagugcuugacggccgccuucaucuuccucuccugggaaauggagcacagaagccucaugaugucaucuaccaugaugggcaucucagcagacccuaggagaugauucagagagauagauaggugggcuuugguguuugcucauuuuguguacuuaaaaaaaaaaguauacauguguccugcugcauaugugucugugcccucagaaggcagagacccacuagacuagaguuacaaaccauugugagauaccaugugggugcugggaauugaaccuagguccucuggaacgauagccaguuuucuuaacuucagagucaucucuucggugcauguuugcauuuguuuuuugagauaaagucuugcuacauauuccagaccagucuggacucauaaucauuuucucucagguuuuugagugcugggauaauaggagagauacuaccacuauaccuuauagcugaaaggaagauuuuuuuaauacacuuaugaguauuuuaacccaauguaacacuuuauagcauuuuagaaggagcucccaucuucugggaagaauugcuuggccaugugcaugccagagaggcacgcagcccucugugcuucucugaagccaagagccugggcaugagcuaacaagcuacggaaggaagcagccgaguggaugaaaggucuuuucugccuucugauuaacuucagacuucugacaaaugaggaaacagccucagccacaggcuucacuugcuccuaccaagcuaaccugaccucucacacaaacacacuuccaaaguggcucacgaaaccuucaauguauaaaggcugucaggaacaggaaaagccaaauccagauggccucuugaugugacaagguaucugagccaagcaagaaaguggggaaaggacaagauucugagccacacuggcacuugccugcugagccugaagccaauagucagauacuuagcuuuaauauggagugaaaauggggcugaaaguacaauucuacaugggagacaauauguuuggcaugaacaauacuuagaaaagaaaagaaaagaaaagaaaagaaaagaaaagaaaagaaaagaaaagaaaagaaaagaaagaugaagagagaccauuuauaggcuagguccuuguaaaggaugagcaagagggaugcagagugauugacucugcacuguggacccuguugggacauuacaggcagagacaagagcuaggcaugguaccacaaggcaauacucaguacuugggaagcuaaagcaggaggauuaugagcccguggagagccuggguuagauagcuagacucucuaccaagauaaaaagaauaaugauuacuuaguuaauuaauaauaaagaaaaccaggaacaguauaaacuaccgagaugaaacaaucauagaacaaaauaacugaaagaucuccagaggcuggcugcuuggcaugguggcucauaggcccaauuuuggcacucaggaaguagaagaaaggucagaugagucugaggccagccugggcuacacagugagaucuggcuugccugcccuacagagcaagagaccaugucucaaaacaagagccacccgggggcuugcaagauacaggaaaccaugggcuugcaagauacaggaaaccacaggcagcccugaagaacagugagccuacgagcaguuugcuaggaucaggacgcauugccuugcuggcugggaagugagggauagaggcauugccauaggugagguggacugugccccacagagggaguaguagguaaggagagaccacacgcugagaggccaccucauaaggcugcugagaaaaagcagcagaugugacacuuccaagagacgcuuccugcucccaggaggcugaggccuuagucagcugagggaacuuccugagggagucccaggcuaccaucaacaggcugacauucuccugggcuuugcuugguuuuucuugauacccaagaacuccgcagaauccaaaucucuucauguaaaauugucucugagacucugggaguucugggcccuuauaaggaacccacggagccaccauacugucacaagggcuauuuuaaagaacuucugggggacuggagagaugacucaguaguucagagcauugacugcucuuccagagguccugaguucaauucucagcaaccccaugguggcucacaaccaaccaccuguaaugggauuugaugcccucuucuagugugucugaagacagcaacagugucauauacauaaauaaaucuuaaaaaaaaaacuucuggacauuguauguugugcucuaguccuggaaauguccaauuuugucacccccauccccuuuugagauuucuuuacuuacuauguaacccaggcuaaccuggaacucauggaccuucuguaugggguucccaguacuguaggugugcaccaucaucucugacuuccuuauccaugcugacaaacuuuagaugaauaccuuccuuucaaaagacuaauaccccacccccaaucuguaaaguagcuaagcacuuccuaguuuagcuuuggugcacagccagcuuuuggguuuuuuguuguuguuguuguucaggugcagcccaggucucagaggacugcaggacaccacccauacucggaagcacaaggccugugacauucugguucugagggccagcuucagcaccagcacaggcaccaguccaaaucacagaauaagaaucugcacucucaaaaagguggcuuccuaacaagacaaggcaugugaaggaguuaggacagagaugcacacagcugcccccucauccauaaggaacacacagggagacuccagcagaugcuugaaaguacggucaauccguccagccagccuuuuugcucugguuucuugaccuuguaacuccuaagcuuuggggccauuguuaaauaaaacgagguuacuugagcucaucacuacuacuacuacuacucagaaugaaauuucuaaccauauagaacagcccaugacuuaaaacuugcauagcauuucaaacucaugaacuguucauuucugaauuuuuuuuucacuuacuacuuggcugugaguagccgaaacuacagaauguaaaagugugggcaggguggggggagggagcugggaaugaguacuggacucacccaucuuaccccugauuaccuacucaaagaauuaucuaccuccagauuugcucugaauaacauuaagucaaagcccauggagcagaaaagaaaagguuccaacaugcacaugccauucucaaucucuaccacgcccagacaagccuuugccagaagacaagccaggcuccuuagcaagugucagggggcaggagagccgggcaagaaagguuccgccccagcugggcuucugcagucuccaaggcaaggcaaggcuggccuagguuuccugaagaguaauuccagaaguuauggcagcaacaggcuuuuguggugaaagaaagguuugggaccuggagucuaugugaaagcuuucacuuucugaauucuucaggcucaagaaauugaaagguaacacgccccauucuccucuuuccaggggccaccucugucugucugcgaggaagagauggggggcgcagaagacaggaccuucccacgggagcagaacgacuucaauaaugcuguccucaaaacagguccuguucaccggaaguccaucugccagccauagggaagacaaaagcuaacugggagcccugauguccuauagucacccagacuggagggaagaugacagcagggcucccauacacagaggaggugaaaaacucaaaccuuuggacagcagccugaccugaguccaaucaaguugugaggaacagaggaggaggccucagaguaacagggggcuccauguucuuuauagcaaucuuagacgaagcugggauucaaauccccagaguagagggaggaaaugugucagggguaggggguggguaaggggaggcugcagggagaaacaaacagaaacugaguggaaaacaggucuuuggccaaauagcaauauuugcuccccugucuggaauuccccaguuguacucuguccucugugaaguucaucacccuguucuuccagccuacuaaguuguuuacuuacuugauuguugguauuuaaaaauaagaagauaucgagggugugcuggcucccucccauaaccccagcaugggggaggcuaugguaggacucccagaucaagaccagugaagguuacauagugagacccagucucaaacuaacagcaauaauacaaucuuacauauaucuuagaucuuccuaauuucucuugaaagaucagaaguggucagugguagguucgcuacauagcucgcagaguuaacugacacccaucacucagcagcaccgugcccucugcacccggccaugcaugcaccuuaucuacuuagucauagaagaacguuuuucaacaacagcuccaauuaaucuggcccuuugauccccugacauucauuccuggccaucccuaagcuagagcccagauuuccucccucucugggccaagcacagcaguccgcuaggcagaaggcauaaacugugggaagacaccgcaccgcgcacgcgcacucccaagcauccagguugcggcuggaagcgcacggagcugcugacuacuccaaccucggcgcugcagcuuaggccuucagugucucagguccuuugcauugagaugaacagcucuagcacugggccugacaccguaggguccccgaccggcuucgcagaccccggcuuccccgcgcgcaccuuuaccgagcuggagucugggaccgccaaggcacugaggccggcucugcucugccagcuccagagaggcguucacaggccaccgccacccuggcuccgcccucccaccuuccggcuccgccggccuuccgggucgccgagcucuggguccccaugagucuggguccucaagaugggacaggccuggggaaagaucuugauggcggggcgaggcgucccuuccgcgccccagcgucugauugacugacaccaagacccaggcuaggaagcucugugccugcggaaauggggagcaucugggaggggacucugugucgcgaggacccgcugcccccacuuccucuccgccuggccaccccacucagugcccaaccucacguuuaggaucugggacgguuccuggaagguucuccucgaucgcccuuugcgcuggcugggucugugacuugccggacccuuucucccacaggguccuggaccugggagaugauagaggggcuuggcugucaggagcgacugcugguuaauuaacgcuggggccugcgugggacgcgcaggggcugguauagcuuucagaccuccuaagaccagaacagagcccacuccacuugcagggcaaagggagccacucagaaagagagcagaguaacagaaaaauccagagaggccuagggagcaguccccgcccccuggucccaaggacucuagggcuggccugaaaauaugccaaaucugguaucucucccaauacugaacuuuaacccugagcaaagucuugaguacgcacgguugucagugacaaacuagauacagagggacugggcuagccaaugccacccaaauagagaguguggcgagcgaacuccagucuagguccaaguggccccuagcgcgaucugccagguggggguggagagcugcugcgggcauacagaugaucugugcagggccauauuauuucuucuuuucugucuucuuagaaggccucgaaccccuuuuaacaucaagauucuccuggcuggaguggaaaagucugugcguuuucgaguaggagcuuuugcccgaguuugggugacuuucaagagccaaaguuaacugaggcuaagaauagauuagcuccuugcucucuguggagcuaugaggugaggcgcuucaaugucccccgcgggcagcgcccucugguggcaaggucgagaaccggacucgcuuguuuucuccuuugccuaaauaucagaaguauguagcaaugaugggaacaggaaaguucaguggagaauagagacuaggcuauaagacauccacaccgacgaugaauaaagcccuaaaauuaucacccug

SEQ ID NO: 3734 - RNA, 5879 nt, Mus musculus
uagaauuuucuaaauugauuuaauguugaauaacuauuucuuaaguuuauauucguauggaauauaauaaaaacaaaaucaucacaguuaagagaaacaggauaaacuagccagcuuaacauuauauggcaauuuuacuaacuauuaaaauucauguggguauguuuuugucuaucuaucuauauacuuagucuucuauauuccugcacauguacuuauguauauacauauuuacauauuuuucuuuacuuuuauacaucugcaucagugacuguaucucuucaaguaaaugucgaaaagcacuuuguugcaucaaucuggcgagcucuuacauugcauagccauaauauugagaaauuuccauaucccucucccucugaaggaaaaucugcaguuucccaguagagggguucuugacagcauucucacgcucuuguugggcucuccucuucauggccucccucucuggccucugcucuuuugugauggguugugagacaacuggucccagaaugucgacuuucuuccauggaauggguuggccgcugaagucaugcagcagauauuggguuugagguuugggaggugauggugcauuguuccuggcagcagaaacaagcucucucuggaaugaugugugagaugaugcucuguaugguacaggccucgaggugggcaacuggggcacagcacuagacugguugggguugcuuacauuagguccagugaaacuggaggaaauuggaggagcuggcuuggcagaggcuuuuaaagaugagcucacuggaggugguugggcuggccugagagugguagguugagcugagugagagugaggcugcacaggguaaacugcagugggccugcguaaagccagggaaaggggcuuucuagaagcaggucuggauugaggcuuguccagaguuggaaaaggcagaggaacuaacuugaccuucccagcugggggcagcucauacugggauggagauagacaaucuuuguuaacacugcucucugcucucugaacuuucccugggcuuuugggaggacccuggcccucaccuggcauguuuaacacuguuguaguaauugagccugagccuggaccugaaucuuuguugcuggugaagguucgcagaucucugaaagaugagaugccaguuuucuucucagucuuuuuccccaguggguggaagaccugcacagacuccagcaugugcauugcaagguugguucgaggcuucuugaagcuguuuugacugagcucagguggguuacucuuccucuuggucuuggggauggagggcuucucuugugguuugacucucuuccuugacugcuuaagcuccucuguuuucuuggacuuuuucucugguccacuuguucuuucuugccccuguuuucuagcucuucuguucuuguuggggcgcccuuugggagcuuuuccuucugggugcuuugccauguugucaauagccaugucacuggccccagcaacacccacagcccccucucccuccaccagguaccggugcuggauuuuggacugaggagcccccucaagcaacucaaaggauuuauguuuguucuuccucaccuggucagaugggcuacuggugacucuccaguuuucacaggacugaucuuggucuaugucugugaggguguuuaggaguuggggaaguugaaugucugccccaaaccuagugaugucuuuaaagucgaaauuggauccaaucuccuucucuagcuccacaagcucuuucggaaccaugaagaugcaucccaaaugggcauuaucagaaucaggcuucugacugagguucucagugucagugcagugcagaggcugcugcaagucaggguguuccaaagucaggauuggugugucuugguuuucuuuugugcccucuuuuaucucaggcauguuuuuguccucugguuguuccaggcuuggagcuguaggcaaggccaggaacugugaaggacuguagaugggggcuguuaaugcccuguccccguugacagcugguggccuuaucugggaaaccuggacacugguguugcagaguucuggacucugcagcugacagugugucuggccugaagguggcaaucccagggacgucuccauuugaaccacuggauaagagugaaggaagaagucagugccucggguaaaugagaugcuccccaccccaaccccauuucauagaccacggcauuuggccccugcagcagugggaagacauuccuaugagcucuugaugaagagcuuggaugcuaccucugugggcagaccgauggugacugcucuguuucugcagaccauugcaugucaugcuuucucagagauuauucuuuuccuuccuguuugugugguuuguggaggaaaacccuuauuaggucaguuaccaaauuaccuggacgugugcuccucacuuuccuuucccuugucuuuauuaagagcgucucucauguucguggaacuuuccuacuagguagguuguuugguccauaauuuccaaaaacuuaccugacccuuugaauaauguccuuacucacaugaccccagaaucuuguuuuuuuauguagguuuagguauccaaacccaccuaggcacuccugcaaggcaagcauuuaaacaaccaacgauuuucucccaccccaugucucacaaucuuauaaguggaauggaaaauggaaugagaauuuaaaauuguugggcuugggugagacucaguauuagagaacaugucuacaugauguuauguucuuggacauggguuaccucugcaguacuacagcaaaagaaaaacaaaacaaaacaaacaaacaaauaaaaaaugagcaggcuuagccaaauuagaaaucguaccuugacuaugccauacuuucuauaauuuuaagugucagaaauuuccagaacaggcgcugagaaucugggaggaauucuuccuccaggagagauucugagcuacauugcucuggagguuuucaacucauggaauaucccauguuaccaaaacauuuccucaaugucuucuagacacaaggucaaugauaggucaggaaggggucuauugcaguguauugguggauaagacugauuauucuguauaguuaguuacaugugugacuauggugugcuccacggauaucauuuaauacaggauggaugcuacucacuguggccuugcauucucucuuuugauagagucugaagguggugguggaaagccagagcuauacuuaaccugucaggagacucauucucccucuguguggacuguccacuacuaaaagguagaggucaaauucuuuggcgugcugaucucacuacuucccuccuggaucuguacucaccgggaagacuguugucuggcauggauugagcagauguggaauaggagaaggcagagguaaaaagugguauuuggauauuccuuggcugaaucuccuuuagcaccaucaacaucucugguuggagcacagaggucugacucccaggguaagacacagagccauggggcuguaaacacugcccaaauucuccagcuaucagaggaccuaggauguugugcucauaguaauagaccuggcugccuuccugguaggaaggugccaggcuguauucuugacuuggcaucugcgguggugugaucuggacaaagcuggcaggcaguguuggauaaaaaggaacuaugacauugggaucuaaaauuuuaucacacugguuugucacagccagggaggagaguguauuguccuggucaaugagggucauauugaauuccuggagugcaucuucccuccuaugugugcuuccagugcaaucccacuugagagcaccuggauaggagggugccaagguggaaaucuggcucugcuccguuagcacugucagcaugguagugccagcauguggguuaagauaggcauuacccaugagcggcuggaaagaagugcuggaugcugaugguagaagccaugcugaacucauaucugggguggagacccuggaaaaguuguacaccguuccugcaggcugcauggaguugcucagcagaggcagagaagggugcagagugcuuucugucccaaagaaaagugaacuuugggaacuuucuguagagaggaagaagacagugggaaaauggugagguugauguuuucuagguuacuguggggaacagugcuauauccaguuuguacuggcugugacugacuaagacugaaguuagcuccagcaucccaauugcaauugcucauguugauucuuggcucuagccauaaugacacuccuuugaugagcuaccugauccuucucugugggcauggaauuccugguugaucugguucaaccuuugcuccaacuuagacauauuccuucuuugcccugcuuugucuugcucucauaccugcugugacauugccucaaaacucuguccuacaguagcuguguuuagagguaggagagccuuagauagcuucucaagcuacugccuuuucccuguccugugcacaucuauguagagagacauggacucuuuacuuaagaguaggcuguacuugaaaucacaaaaaccaaccugccucuggaucugacaugcugcuauuauaguugagugccaggaacaccgagccuaucuauacucuguugguauuuuuguuuuuuaaaaauuacauaucagggaguuuguauaugaauauucuauuuacuuaauuuacuuugcuaccuccuccuuugucccucucacuccuguaacugaugauaucuuauauaacucuuaaacaccuguguguuuaugacuuuauguauacaaccuacuggucacauuucaugguguguacuuguguuuacggcugacccuuugggauuugguaaccuauuagaagguugguccaugaauaacauuuacucuuccucuguuccuguuaauugcaugaaacuuuuguacaggggaagccuugugaagauuuuccaccugugucaguuaguguuguacagagaacaacugaguauggaguucucagccccaacugauaguauccaacacaagcagugcauacaagaauuagaaaacucugcacaagaugugguaaaaucugggaaccagagugggauaauauuuucuauauaugacagugaacuugugccgagaggaaucuuaacaauaugguugccuaaacaaggcuugggaaaugaaaaugccuugagccuuuugauuugaaaugugugauucucugcaacauucugucccaaacuaucuuuguguucuuuuaagaucaucucucuagguuugacuccuucuauuucucuguuuucuagcccuucaucuuuaaacuuuggauuuuuuugucccccaguucuugugaaucugucuuucauguaacagcugcaacauuucuuucacuagaagaacuaccuucgcagagucuagcccccucuuagucucucccacauuccuucucuuuuaagauucaacagcaccgagcacagaccauaguaacacuguaaucucucugaggugaauaaagaauccuuugagaguaaacugugucucuaaagucacauucuuaguaagaacaaaaguuaguaugacuuucaacgugagauaucuauauccauguaaucccugguauucuaaagauuugaacauauucuaaaaauuaggagaguugugaucaaaaauauuugaaaguugcuuuccuuaccugacauguuuagggggggcucuguauggggaguaacaguacuccaccccacaauugaaccagauaaaugguagucuuugucugauaugcugaccaaaucagcgaguguguccaguaucaaacagagcucacuggucacuggucacaggguaccuguaaug

SEQ ID NO: 3735 - RNA, 2372 nt, Mus musculus
cgacagacuuucugagguucaggccagaaaaguggcggacuuggccaggaucagagacaagagacugcuaaaacgggacggacagggacagcacaguucuaaggaaggggacuuugaaagaucaucuuaacuugggccuggaaaucuuucagaagggacccucacggacaggaaaagacgccagggaacccaaggggaaaggagacgcgagaggaaaggaggaguccgaguggacagcagagagagcugcgggcgagaguccagaucgcuguuuccccgcgccaaagacacugucccgauccgucccgcggcuacacuacgcgcagucgcgcaguugcagacaaggaccccagcagggaccuggcaucucacagggccagcacccggccucccugcuccucaccgaaugcgcgugaguugcuccacucgacagcgccuucaccgcccgcuugcaaacgccacuaccgacaacucaaucgggagcagggcggagccgaggagagcuaggcagauuccggagugggaggacuuucaggagccccagcguuagcacaggcucuccaacccagaccugggaggguuucaguucucucuaggcagccacuaggaggcucgagaagugggcggggagacuccagucugagucccacaggagugcacuccacuuuucugugcaccuuguugaauccucguaaaccugccuuaaccuuccaagugauuacaggccugugucacccugccuggcuuggguggcuuuauuuucaauuuuaaugaaucucuagguuggagggauuaaaaagagcgguuacacauaacuauaguagaaaaucucuuaucucugugagucuggguuucccccucuguaaaaugcuauucccuuacuccuuugauaggauuauaacauaaucgaucaucaucaucaucaucaaauguugcucauagagggaagucaguggaguuuaagacaugagauaugcauuugauguuggccaucuucugucacuguucuagccagagccuguguccuggcuacucuaaugaaauaaacagccacugccucucauccucccauaaaauaagaguuaaauuaguagugacaaucagccaaguccuggugguacaugccuugccuuaauccuagcacucagaggcaaagacagaugcaucucugugauuucagagccagccugguguacccagcaagauccaggacagccagagcuacaggauagacaccuugccucaaaauuaaauagauaaauaaauauguagugcuuuguauaguaaagccuuuauguguggcuucaagugaagugugucguaaagccuuuguguccagcuuugagugaaauacuucagcagagccuuugcuaugucuggauucauugguagaggcugagaaauugcuuccagggugcuugaaccuugaagaaaugucucccuggagagucuacacuuguuacuacaugagagcuugcagcugcacagacuuugguccuaacacauuccuggccaacuuggaggucuuacuuuugauuauaguuagccauggucaaaaggaacggaaaucuguguggauugucugcucugcucucucaggcagcaaggucaagauaacauugguagcuggaaccuuucccagccuacuuaauuuuguguaagagugaauaaaagucacugguguaagcugguuagggucagucuuuuccaagaaggcuugagccccucugcuccuucagaaaaugaaggcuuugcaucuuagcgagcuucucucuccacuguggcaccuauaaccaucaaucaauauaaauaaguaagggaaagacagaaaaaggauuuauuuaaugugguuacauucggaagagacaugacuaugucccuuaguccaucuucaggguccuacagcaggaugacacuuaaguagaggccagcaauaagcuuaccuaaacaguccagccaaggcaugaggugagguguagcccacccaccucccuaccuucagcucuugucuugacaguauggcgggaaaacagacuuagacaagucucccauauacaagguccuccucugguuuuccucggccuuugcuucuaggaugagauucuuggaaacauucuaauuuguuucaagagucuguuggccagagagaaagauacagaugucucuuuagaauaucauuccugccaggcaggcugaaucacauagacaaugggguggcaugaagaucucagcagggauggcagaaucaggaccaagccaugcugucucuaacagcuagacugcugcuucgggaacuauggaaagaguuuaccuuacuauauuguaaucccauccaugacaccucaggaagcaaccuaugagcucauuuacua

SEQ ID NO: 3736 - RNA, 18084 nt, Mus musculus
cggggaggcgggucuucucugguugcaguguuguguguagguucuccguggcggacacggguacgagugggccccgcuuucggcgcugguaccaggagcucugagaggaacgugggcgagcucggaagcugcgccauggugagcgaggggccucugcccccagagcgggaggggcggcgacugagccccgggagccggugugccgggcgcucuucgggacuggggcggggccgacaugcugcgaagcaaccuaggcccuggaccggcggccucugggcagcuccgccucucggccgcuucugcgcagagcaaggaguagcgaaaggcuccgcccugcgcuggggacgcccggguuggugacgucgcagcugugcgagcgcucagagccuauguucuuuuuugucccgagggccaguugcuagcuaagugaggguagucuauaguuucuucgaguuauagaaguucugacguuuacguuuccugucuaggcuuagaauguacuuuaaauuacuuuugcgaaaguuguaaagucuacccaauauuuggucuauaucugcguguuuguuuuacuaguuuguuaagucacuuacuguauuuuggguuugcuucugacuguuuaaauuguuauuucuuaguuuugaaauacuguacuacuuugauuauugcaguuuuaucgggagucuuaaagucaggcaguguucuguuaaugcuucaguaucguguuaacuuuuuucuuuuucuuuuuuugagacaggaucucggguuucccaaguuggccucaaacuuucucuuagcugaggaggaccuugaacuucugaucccgcuacccaaacccaccuccagagugcugggauuaagggugugugacuauaagccccuuuguguguguguguguguguguguguguguguguguguguguguuucuggggaaggaaccuagggcuucgugguaguagucaaacauucgauccgauucugaguauaucuuacaagauaauguuuagaucaacuuucuguuauuuuuagcauaaauugugaggauuugauguguugaauuuguagaucaaaaugacaacugucauaauuuugaggcuucuucccaaaaccauggaaaucucuccacuuacuaaggucuuugauuguuuuuauauuagaaauguaugauuuuuguguacagauguuaauuacauuaauaugcaaauaugucucacuuuauccuugcuauauaagcuguguggugguuuuaauuuuccauccaaaugccaauguacauacaguuuguauauugaucuugcagcucuacaaguuccuaguuuccuaaauucuuguugguucuuggguuuucuaaagccaaagagaacuuuacuuuuuuuaguuauuuaacacuuucaguaguacuuuuccuucucuggcaguauaggguuguuuuuuuguuuuguuuuguuuugucuacaguuacucguaugguguugugguuuuucuguucugcuucucaguuuggugguuacauuuuaaaaauugguacugaugggggugaaaacagcuauuugcguaaugcuaggcauguguucuaccguggagcuuuguccacagucugaagucugaacugacuuucuguaucugcagugauuccagccugguuucagaucggcuuuuuauuugcagaccaggcugguuucaaacucacaugagaucugucccagcaugccaaaugcugggguuauaggcauauguaaccacacugccucauuuuuaauuauuuuagaaauacacuugaagauuuggauuacugauguuuguugaguuuuuugcauugagcauucuuuaguuguuguuguuuucuuuucuuuuuuuuuccuccuguguuguuuugguguuuugguaauguugccucaaaauuugaaccacaguuuguuugccauuuuagaagauguuuuacugaauuagugccauaucuuaauuguuaaaaauuugauaguugaaauaauuugcaucuuguauaucuuuuuuuugaguuagugauuucauuucuuuagcacauauaggccuacucauauuggccgucucucugucuuucagagaauuuguucauuucuucuaaguuacuaaguauguggucuggaguuguucacaguaugcuuuuaugguucuuuuauguucgugcuaaugauggcccuguauaauucucucacccaaguccugagcaggcauaguccugcuuaguuucccagaucagcuagagcgugagaguaggcgugcucagggugguauggcuguaagucguccguccuccacacucugaucacucaucucuuuaaacccacggcuggagaccuaacaguuuugaaaagcgaagcuuuagagugauugguugucucuugacugccuguuuacaauuuuauucucuaauuguuauuuucccgggcuugauuuauuucuucuuucucuagcuuccuauuacggaaugauuuauuuugcagcugucuuccuuuauaguauagacauuuauuguuuuaaucucucccaaauauuugugcuuuguggcauaaauuuuuguaagauguacuuuugauucuguugaaauauuuaaucucucgagaccucuccuuuaccgaauguuacuuaagacuuugauuucguaucccuguuuuccaauguguugccuuuagcuuagggauucccagugccuaaucauaaaggugccaaaauuaagagugacucucugucugucucuuuuucugucucucucucccucucucauucucccuuuucaucucccuuucccucuuccccuuccccuuucucuaggguggaagugucagguugacuacuccaggauuuauaauaacuuuuaaaaugacuuaauuauuuauuuuuccuuuaagugcauugguguuuugccuauaugcguuccugugagggcgucagguccccuggaggcggacuuacauuuaugagcugccacgugggcaucagggguugaaccuggguccuguggaagaacagccggugcuccuaacugcugagccaucuuucaagccucaggauuuuaaauaaguuuuagugauaccucaaaauauauccuguuucuggguuggaagaaccuuuauuggcucagucaggaggacagaagaguugaacacuuaguguuuuguacuuccuuacaucaucauaaauggccaggacaagccugaugaugcacagcaggagaaaauaacugcaggcagcucuucccauuaccagcauagaaaucugaucuaaaaguuucccuaguuaguuaauguagagacacuaauaauuuucaagggaaaagaagagaggaucaagagaagagaggaucaaggaaucaacaaaguaguaaauguuugagaaaaacuaucauuuggucuuccagcugguguuauguuuaauucugacaauucaguuugucaugguuucuucaggagggagcauuugauguuuguuuguuuguuugguaguggugguaguuguuggggguggggcugcuaagacagggucucuguggaccaugcuggcuuuggacuuagauuugcugccucugcaguugugugccacugugccuguuuuuuguuguuguuuguuuguuuguuuguuuuuguuuuuguuuuuuguuuuuaguuuuaaucaugcuaaguuagggcuggagagauggcucaguggcuaagagcacugacugcucuuccagagguccugaguuuaauuuccagcaaucacaugguggcucacaaccaucuguaaugggauccgaugcccucuucugguguguaugaagacagcaacaguguauucacauacauaaaauaaauaauuaaaaaaaaaaauuaggagcccuagacaaaacuaguaacagguggacaguuuguuuuaauugcaauuuaacucauuuaagagaagaaaugaaagagcuuaagaaagaaugaaagaaaccaguuguggaaacuaucaggauuguuacuaaauucuuaguuuccccucugaugcugugguaaaguacccuaauaauagcgacuuuaggaaggcacggcuuauucugcuaaucauugcagguuacagucccuugaggggaagaaggacaagagcuuuaagcagagggaggaugacuauguucaugcuuacuugugcucagcccccacucuacauggauguaguccagcgacuccugcauaggagcuggugccacuuacuguggaugggucuugcugccuccguuaauauaaucaagacaguucuccauaggcacacccacacgcaaaccugaccuggauuguccccuuacugagacucuaaugaggugcucuguugaguugucucuugagacuaacuaucccacugaugagacauuuacuuucccaaaccaaaaagacccuaguguaauacuagaauaacaguaaaugaauuuguuggucacaaguaagaguuacaguaauuuagacaucaaagggcaaucuuuccuaaacucagaauuagccaugcuacaugggguuauugcuaugggauugagugaaaguggccagaaagaaaauuaaaauuagaagauaaugaauuauuucaagcacuccaaacauuaaaguauuuuuauagaguacuagacaguagggaaccuccagacuuugagucagacucuauuuuggacuuagaagauggcucaguggguaaaaaacaugugcugcuuaauccugaugagcugaguucuaacccauagaauccacauaaaacacagauguguagugcauguauauaaucacauacggugaggugguagagagagacagaagaguccccuggaagcuggucuggcauauguagugcaguggcaauaaugagagauccugccucaaguuggaaagcaagguucaccauugaauguugucuugauagccacauccaugcuauguuaauguguauaucucugaggcaguagcaucuggaacuuaauggccugugaucuggaagguauccauagcaccaaacaguuaagaggggccuuccuacuuauaacaccaccaaucauaaccaguaagcaagaguuagaaaaguuagcuccaagucucuaagagucaucccuccacaauuuauugacaucaugugguuuuagccguuuauauguaucuuuaacaaaagucauaaugauuaaaagugguaacauaacauggcuuuuacaaagagauaaggagccugacagcacagcggcuggaaagaugggaagaaugguagguaucuagcucugaggucuuaggguaaaggaguaacauggguaucauaacuugaaguggguaauauccguggcuguggcauaauuuaaacuuccugaagcagguuuaggauagauccccugaaaugacaucaaaggaauaagaagguagggcuugugcaaucuuagaacucagaaaggugaaagcagaaacacuuggaguugcagguguauagggugaguuuuacuuuggccucguuggaauaggaaauaaaagucuccaaaaggcucacauaaguaagcuucuugaguuuccagggugaaauagguuuaacuguagacagauaagucacggucauagguuauuucuuaauucuuucgugguuggaaaucuuacaggauaucuuaugggucugggaaggcuccuugugccuacugauagaaaaucauuaguagggggauuagugccuuagaaggggaaauuaaaugucucuaugagacuagucugaugagugauaaugguguucugaugugagguaagaggucugauacuacagguuaaaaaaugaucuguguacuaaaagagguuauuucuguaugaaaaugucaaggaagaaagguuuucuuccauggcaaagagguagagggugucccauauguccugaggcaagacacuccaggugagugguuuaauaucuggguuaagugguccugccauuuaaagccaaauaagaacugaaucuggguggauucaaaaacagaaagaaagcauccuuaaaguguaaacgauaaagcuagaugauauuaagaguauauuucuucuuacagugucaggauuaggaccuauggaaagucuggguucacaguugagaaugugucaacaaaaaguuguaacucuucuaaguuuuagguuuuaauugggccuuugaagaaaguuguuaagucuuuagugacaauuuugacagaaggggcuguuagcaucugggauuagagaugccucacacuugaaggggaacuuguuauaagauguagggguccauaguagagauaagggagaauggugcagcucuagacauucuugggccuuuauaggguaggggcuuagggucucagaugugauaaauggcccugccauaaaugggccuggagguuggaugaaaugcccuuuaggaagggaauugggcagcuggguagaaccaaaaaggaaugaaugaaagauguuuaucacacauguugaaagagguuuauaguguucugguuggaguuugccauuaauacuagggaggaagacugaggaagguuaaggacccaaauguuaaauuagaaaggucgucagggaggagaauguaguauagucauagcccuugauauuucuuggaucaucugaggcuuaugcauggaguaccaaggaaaacuugaaccugaauaaccccagggucaugucuuccaaggggaaguaauccccuauuguacaggaccagaguuagggcauugucagcuuucauguuugacccuagcaugagaguuuuagauacaagaugguaagagguggauucuaguggcccuccaguuuuuaacuuagaauggucucauggaagguuuaugauagcuggguugcuuugugcucucacagcugaaauacugugauugaccacagggauaaucagagugguugcuuugucccaaagauaaguuaauucccuuagacugaauggggcgcauuuagauggaaugcuugggcuuccugaaauccucagagaaugagaaguugccacaguaaucccuuuaaucucaugguuuggcuuuucuagccccugaguccccuuaauucuuaaauacaaucuuaaaggcuguaucaggaaaguaggaggaaaggagcuuggggucccuguucugauuuuugaaacuuuugucuaauauuugaagaaguuuuauaaaauacacaaguaaguuuccuuuagccagguuaauguauuggugcaugauuucagccaaccuauauuaaaaugaaaaagaacaguguacuuggaagguuccuucguuuauguucauaucaugacauuguucauggaguugauaguagccuuuuucuuucuaagaaucagggaaucauauuccuaaggguucuuuccccauugucucccauguaggagucuugauaugauauuuggguuuccuguggauacuguaucucuguuaucaggguuaugauuauggcucucaauggcuuagaucccuacugaagacuagguauggaacuucuuugugugcacauagcaagugguuagagugauauaaauagguacuggagagagggcucauuggcugggaacaguggcuacucuuccaaaggacccagguucuauugccagcacccacaugguagcucauaacugccaguccaaggggaucuaguggccaauuauggucuccauaaacacuagguaugcauauggugcaaggcaaauguaggcaaacacacaaaaauaauuuaaaaauaaaacuauauaaaccuguuggccagauuaacucaaaagacuauaauuagaccuuugaauuccuuaaugaagggaguggaaauuuuuggguaaaaugaucacagcuguuagauucgggacaguucagauaggggaagagacgaguaucuggcuagugcugagguccccacuagccaccucacaaauuauauauagauuuguggggguuuuguuuguuuguuuuuguuuuguuuuugagacagguuuucaccauuuaguucuugccuagaacuugcuauguugaccagguuggccucagauucagaaaugggccugauucuaccuccugaguguugggauuagaggauaugcaccaucacacgcaacauaaggaauauuuuucugaaggucagaguguagcuuuuauuugcuuccugaauucucugugucaagcuccugugaacauuuaugugaaaguagaguguaucuggauaagggggaagaguuacaggagacuuaacagggagagagcgauggaguuagagaacgggagaaaugaagucccuaaaaauuguagacuacagcaguuagugguccccucccccaacuccuaugaccuuaacaucaacaaagaauuccucugaccugugccccgucaguuuugaaugagaagcaugucuuucuucgagggugcaaaaggacuuccuucccucauccucugaugggagacaaagcuuuagagucaccuaaaccagguaccuuuagcugaucaucauaaacaccagagguaagaagagagucccuuuguaagucaucagaaugcugggcaaaacaacaccuggaaggccaccagcgacagucagucaaaaggauucucaaaggcacgcacagacagaggucauugaaauacuucaaggaagcaggaggcccacagagggaguugcauagauaauaagggagugagugaaggaugacuugcuuucauaugaugugguccauaucugauaccaagguaaauaucugaauacccuaucuuguggaggaaaauuugcagguuuuuuuuuuuuaaaucuggccauuuuuaugaagugccacuaaaucuucaaaacguggaaauucacuuuuauuucugucucuuugugucuauggaguaguuugaaagucuuugcuguguuuuaggcaaaccaucacuuuauuguuuagaagacuggcaauuucuuagcauuuggaucaauagaaaguugagaaacuaauuacugauaagugugguuuuuaaauuuaaauuuauuuauuuacaucccaaaugcuacucccccagccucuccuuccagacucccucccccauccuccuuccccuucuccucugagaggggggcccuacucuuugucucacccuaaccuggcacaucaagucucuugccagaugaggcacaucucucccccugaggcuagacaaggcagcccuguuggggaauggauaucccaaucaggcuacaguuuuagggagagucuguuuuaguuguugggggacucacauggagacugagcugcacaucugcuacauuugucccacccguguauguucuuugguugcuggcucagucucugagagcuaccagggguccagguuaguugacucuguugguccucuuauggaguuccuauucccuuuagggccugcaguccuuccuucaacucuucuauaagagucccugaccucuguccauguuuggcuguggauaucuguaucucuuucugucagcugcuggguagaaccucucagaggacagguauauuagucuccugucugcaagcaugacagauaucauuaauaaugucagggauuggugcuugcccaugggauggguuucacauuaggucacuuauuagucggccauuccuucagucucuuuuccgucauugucccugcauuucuucuagaugggacagauuuuguguugaugguuuuguggguguguagguguccuuaucccuccacugggaguccugccuugcuacaggaggugaccucuucagguuccaugucccuacuguuaggcaucucugcugaggucauccacuuugacuccugagaaccucccccaccucaggucucugggacuuccuagagacucccccugaccucccacuccugaccacugaagguuuccauucauucuucuggcccucugggcuucucuccuguuacaagucuguucugguuuuuguuuuuguuuuuguuuuuguuuuuuuguuuuucuguuuuuuguuuuuauuucaugugauuuuauaaagguguaauucagaagagaugauauuugaucacacuuauucuucacuaccuucuuccuuccugagauggaagccuugcaauagaguauagccugacuuugaacucuugaaugcaagugauuuuauuuacuagucucccaaguagcagggacuauaagcacaugucaacacucuugacaacauugcauucuuugucaagaauaccauuuaguguuucauuuugcauuucuguuuacuuaauagaugcugguuuuguuguuguuguuaggaucauuagucauucuugcugugguaaauucugcaugguauaaauuacuuuugaggcuucuaaauguuuuuuucuugguguaaucaguuccucacuuaauacgugacaauaugcaugaaguguugucuuccagagaaacucaguagacucauugcccgcaucauugggggugguggggaauuuucuugguaacucuaaauguauagaacauucaaaaagcuaacaguuuagaaaauugcuguguuuauguagucauuuagaauaauaagacugcuguuaccauuuauguuagugggaugucucccaaaaucuuagguucccuaauaccagaaaaaacccacucuuuguguauagaaauguguaaguaaaagcagccucuugacugcuauugcuggcuguuuccuguauaucauucagcagaauucuguuguuauagguagaaaucuacucuaggaagaaaacaugggguggccugcagcacauuuaccucucagcacagucauguggguuccuacuaugcucuuucuuuuuuuuuucuuucucucucucucucucugucucucucucugucucucucucucuuucuucuucuucuucuucuucuucuucuucuucuucuucuucuucuucuucuucuucuucuucuucuucgucuucuucuuccuccuccuccuccuccuccuccuccuccuccuccuccucuuccuccuccucuccucucucucucucucucucucucucucucucucucucucucucuuuauggagucagggucucacuguguaguccuggauguucuagaacucucuguugcugucuucuuuuguaguaucucagggcuggcauuagaauuuucauuuaauuagauaaauuccugaguacacaaacuuauauggacaucuuaucaauugaguguaaaaucucuagaucuguuaguuucaucuguucucuccuguguauauuugggauguuuuaggaguuuuuggccuuugaggauguggcuguggaguucagccaggaagaauggguuuugcuggauccuucucagaagaaacuauacagagaugugaugcuggaaaccugcaauaaccuuucuucaauagguaagaaugccacuguucauuuuguacaagaacaaauguuccuugguucugugauuuggaaaggaaagaaaucaauuaguaaacgggaauggguccagugugugucaaaccaagaaauucauuuuucuguuauuucuaauaauuugugaugggggauuaaaucucgauuuuaggcaucaaaugggaagacaagaacauugacgagcaguacaaacacucuuggagauuccuaagguaauucucauauacauguagaagaaaguuuuccuucagaaacucuuagauauguuaugaaaaguugcaagcagaaagcagagggagcugcagggacggcucagcuuucaugggcaauggcugugcuuccagucaccucaccuaccugauggcucucagccaucuauaucuccauuuccagggcauccagugcucucaucuucucugcagucaccaugcauggguagauguacagacuuacauaugggcaaaacacccgugcauauaaaauaagugauaaaauccaaaaaggaaacaaaagucagagcuuuacaguguauuuaucauuagaaugauuucaucaaaaauguacacuucaguguauccuuuugaaaaaauaguuugcuuggacaacacuuauaugacuagagcuuuuuauauauauaagauuuacuuauauauuucacauacaugaguaugugcagauacaucuacacaccagaagagagcauugaauuacaugggacuacaguuauaagugcugugagccaccauauagauucugggaauuggacucaggaccuagaagaacagccaguucucuuaaccacugagccaucucuccaaccugugugggggcuguuuugguaguagcucuuuggguggauauuguagaaucaucaguucuuuucuuuugagacuauucaaguggcaaaagcauacaguuuccuuaacuuuuaugacuagaguaaacacaacaccuucugguaaauaggcaaucauuagugaagcagacauugcuaacauguuuauaauuuuuuacagaaguugcaugauagaugcaauuuaugagcacagagaagguggucaguuucaagaaaccuuuaccuggauaccagauuuccauaggaguacugacauuucuacugaaguaaaaccauuugaaugugguguguguggaaaaguuuucacgugucauucauccuuuaaugagcacaucaugucucacuuaggggacaaaccaucugaacacaaacaugguaagaaacaauauaaauguagacaauguaaaaaauguugaacucacaaaauauuuaaugauaccuuauggaaaugaaauguuuucaaaaucuuuugauuucccagguucauguggaauacagcaacaaagucagaguguugaaaaauccuauaaacaguguggaauggccuucgcuugccacuguucgcuuucuauagauggaagaaccaacaguaaagauaaauguuacaaaugugaacaauccaguaaagcucugaguucuuccaguucccuccagagucauaaaacaguuuauggugcaggaagaaccuaugagugugaagaguguggaaaauccuuuagacaugagaguuccuuuuuauuacaccaauuaacucacauuggaaggaaauccuaugaauguaaacaaugcgggaaggccuucaggugucacaguuaucuucaguuacaugaaaacuuucauauugaagaaaaccccuacgaauguaaacaguguggaaaaacccucuguucucccaguucccuucgaguucaugaaaggauucacaauggagaaaaacuuuaugcaugcaagcggugugauaaaacuuucaaaugucaaaguuaccuucgaauacaugaaagaacucacacaggagaaaggugcuaugauugugaacaaugugguaaagcuuucagaagucacuguucccuucagagacauaaaauagcucauccuaggaaaaaagccuacgcguguaaacaaugcgguaaguccuucgcuuauccauauuuacuucaaacacaugagagauuucacacaagagaaaaaacguauaaaugucggaucuguaguaaagccuuucuuuguucccccuuucuucagagacacaaaagaacgcacacuugggggaaaccguauaaauguaaacagugugguagagccuucagaagccacaguucccuucgacugcaugcaaggggucacacaguagaagaaucuuacacauguagggucuguaguaaagccuuucuauguccuccuuuccuucagaggcaugaaaaaacucacgcugaggaaaagcccuuugaauguaagcaauguaguaaaaucuucagagauuggaguaccuuccaagugcaugaaagaucucacacucuagaaaagcccuaugcauguaagcuauguaguaaagccuuuuuuuauuccucuucccuggaaagacauaaaaagauucacacuagaaagaaaugcuauccauguaaauccgcaugcgaacaguguggccaguccuuuauuuuucccuguuuacuugagaagcauuuaagaacucacacugaugaaaaacccuaugaauguaaacagugugguaaaacauuuaggagucucacuuaugcucgcauacauaaaagaacucacaccgaagaaagacaguauguauguaaacacugugguaaaagucucaguuguccuaguacucuucaguuacacgaacuaacucauacuggagaaaaacucuaugcaugucaacaauuugauaaaacugucagaagauucaguuauuuucaaauaccugaaagggcucguacugaagaaaaagcuuacaaauguaagcaauguggugcaauauucaguuguucaaauacccuucagcuacaugaaagaauccauacaggagagaaaucccaugaauguaaacaaugugguaaagccuucacaguccucagcaaucuucaaguacaugaacuaucucacacucaugaaaaauccuauggaugcaagcaacaugguaauguuuucagucuuaguaaucuuauacaggaaagaaagaaagcugaagcaaaucucugugaauguaaacagugugguaaaucuuuugugucucgauauuuacuucaaaugcaugaaaggucucauucugcagagaaacgcuacgaauguaagguaugugguaaaagcuucauuuaucccucauuucuucaaagacacgaaagaacgcauacuggagagaaaccuuaugagugcaaacaaugugguaaggccuucagaguucagagcucccuucgauuacaugaaagaacucauucugaggaaaaaccuuaugaauguaaagacugugguaaagccuucuggcggcucccuucucuucaaguacaugaaagaauccauacaggagaaaagcccuuugaguguaaacaaugugauaaaaccuucaggugucacaguucccuucaaagacaugaaagaacucauagucacgaaaaaccauaugaauguacacagugugguaagggcuuuagaugucaccggucccuucaaagacauggaaaaacucacgcugaagaaaaagcccaggaaucuggacagugagcaaaaauuuuuaggcuuuccaguuucuuuuuuauguuugaaaguaacuccugggaagaaguucuggugcuauaaaacaaguggugguggugguuuuaaucguagacuuacugaagaaagaccuaucaguaauaaucagugacuuaagauguucaguuccaagccugauaugguggugaaugccuuuaauccuagcacuggggaggcaaaaguaggcagaucucuuguucaaggucagccuccucugcaaaucaagguacaggacaaccagggcugcacagagaaacccugucucaaaaaacaaaagauguucauuuccguuugaagccuugaacaucucugguggaauaccuuuggaauguauauaauaugaggauaacuaauuuuccauauauccucuugaauacucacaugauaaugcaaauagagguagcucuuauaagaauaagugucagacugaaaauaguuuggaaaguaaaguuuguaaaacuuaccuacacugaaagucaugaagaagacgauuggaaguaaaccauguguauuuugcaauccucaugcaaauucaccuguaaugcucagauuuuuaugaguguauucuuguaagguuagggauauguuguguuugauuugcaauuacuggugaccauagaaggggugguggugcagcccucuagugcuagcuacucagauagcugguggaagagaauuugaagcucaggaccugaccaagcaaugaaagccccauuuugcaaucaaaaguugaagaguacgggguauguugcuaaguagguagaauacuuagcuggcaagcaugagacuguaaauucaauccccaguacucuuacuaaaagaauaaaaaucccaagagaaugaguugccauuucuuucagagaugcauacauuagaaugaaaguuguuaaguauucaacaauagagauaguaugugauagauauguugcuggacaauuuuauaacugaagaucauugugucuucuguuacuuuuccuggugcugugauaaaauguuccaacaaaaacaaguuaggaaggguuuccuuugucacaguuugacauggcacagaaguuagagcaggaguaacaugugacagcuugccacauugcaccuggagucaagaaacagugaugaguggccaugauugccuaccuuucucucuguuauacggucuggaacccaaaccuagggaauaaugccaccaccuucacaaugggucuuccugucucaguuuaaaucccuuacaggcaaacccugaggcucaucuuccaggggauucuagaucuaaagaugauaucaacuaacacaaauauauuacauacugccccaaacacgggcaguauguugauuuaaugcuuauucuaggcaaggauaacuacuuauuuaggaaacugaaaauauuugaugugaauauaugaaagcauaauggcauaaagauaagugcuacacacuuaaugaaggccccauauuuuaaguggagucuucuggacuagcuguuccucuugucagugaguuauuuagucaaugucaagaacauugcuguauacuaagauauuacuaguaacuuuauaaacacuuuagacuuagauuuuauugucuguaaauuuucuuuaguagauuaguucaaaacuuuuucacuuugcaaaauuaaaaauauuugauacuuuucuagacacucauuauugugcaaguaagaauuuaguauaccuuggacuauacuguguuagaaagcuugauuuguaaaauuuucuaacuuaccaaaauguauuuuagaaaguuuuuuuaagugaauuuuaguuuaggauuauuuuguuugggaugauacaauaguuucuaaaaugguucuaaauguacuuuugccauuuuguacuaauuuauaugacgggcacucagcauucaugauucaacucuggacaacuuggcucucuauauuuugcauucuaaaauauuaagccaagguuuuuuugagacaagguagcucugaccuagaacucaguauguagaccaggcugaccuugaauucagagauucaccugccuuggccuccugaguugcuaggauuaaaggcaaaugccacauucagguaagauuuguauguaaaauuaagccucucaucucauuaguuugaaaauuugcuuuaaccuuuaauaaauaguaaaauuauauuuacuaaagaauuuuuaaaauagguuuauuuuuaagaauguuuuaucuuacagucgucuugugugguguguguauaaagagaagccguauagccagaagcugauucaugcagugggaagaguggccaaauaaaauuuugcuucugucauguugauaccuggagguucuguuuucuucuguuuauaggucagaguauauauauagagagaguuaagauuaaagaucaggguuaggauuagaggaauuuaagguaagaggauuuuuacaguuaaggauuaugguaaauaauggugguaaggcuagauguuggguacaaggauuagggguuaaaguucuagauuuacauuuagauuuugcauuagggauuaaugauugguauaugguuaagaguaauguaaagugugguugaauaugagacacuguguuguguaucauuaggguuuggguuggaauuggguauugguugaguuugggguagugauaauauuaacugugguuagaguaggauuaaggauagaauuaggguaauuuagagaauaacauuaggauuagggucagcauuggaauguuaggugauuaguguuagcauuagaguaagagauuaggauuaaaggauuaggauugugaagcagcaacacauucugucuuccaaacaagccuucugucuuaggguuuuauuguugugaagagacaccaugaccaugacaacucuuuaaaaggaaaacauuuaauuagggguggcuuaugguucagaggauuaguccuuuauugucauggcaagaagcauggugacaugcaggcagacauggugcuggagagguucugagaguucuacaucuagauccacagacagcagaaagagacagacacuaggcuugccuugagcugcuagaccuuaaagccugaccccaguuacacauuuccuccaacaacacuacagcuacuc

SEQ ID NO: 3737 - RNA, 3198 nt, Mus musculus
uagagaggucgaccgagcuggagucgucggcuuguggaggaagcagcugggagcuggcgagagcgugagcgagcgggcuggcaggcgaacgagcuagcgcaggcgggagggagcggcgcacggcgcggagcagcggcagcccgggccgcggcggagccucagucggagggcagcccuagcgggcgccucgguccccguccccacucggcggggcagugcccgguguucccccgugcggggggcggcggcugagcggaccccacgggaccgcguggguguugccaccucggccgaggagccggcgaggccgcggggcccugcgagcugggcccggagcccgugacagacgggccaaggaggggagagaggcggcggcggcgcaggcgaccgggaggcagcggcagcggcgacaccaugucaucccccagucccggcaagaggcggauggacacggacguagucaagcucauugaaagcaaacaugagguuacaauccuaggaggacucaaugaauucguugucaaguuuuacggaccacaagaaacaccauaugaaggcgggguguggaaagugagaguggaccuuccugauaaauacccuuucaagucuccaucuauaggauucaugaauaaaauuuuccaucccaacauugaugaagcgucaggaacugugugucuagauguaauuaaucaaacuuggacagcucucuaugaucuuaccaauauauuugaguccuuccugccccaguugcuggccuauccuaaccccauagauccucucaauggugacgcugcagccauguaccuccaccgaccagaagaguacaagcagaaaauuaaagaguacauccacucuagcugcauaugcaucaaaagauggccuagucggccaucacuggaaagagaggcccauuggacacgcaaacuuuauaugccccaguacaggggaacgccagggccauaaaaggggaguggguggguaggggagaggggguggguggcuaugggggacuuuugguauagcauugcaaauguaaaugagcgaaauaccuaauaaaaaauggaaaaaaaaaaaagaguacauccagaaguacgcaacggaagaggcccugaaggaacaggaagagggcacuggcgacagcucaucggagaguucuaugucugacuucucagaagaugaggcccaggacauggaguuguaguagaaaaggcaucugcuuuucagaaagacuauuauuuccuaaccaugagaagcagacucuaauauucauauuuaaacaaagcaauuuuuuuauuacuaaacaagguuuuuaugaauaauagcauugauauauauauauuauauaucacccuuuagaucuugauuucuuggucauuucucaaccugaggugcauagcauauucccacauuccauuuugguagcaauaugcaguccgaaugcaugcauucauaaguccauuuggccaagucagccuaugugcuacugaacugucaaaagauugccacucucauagguaaacaugaggaaaacaggaaaaguuugcuucuuuuuauugaugguuccaaagaaacaaaccaaaucuaccagcucuuggaugaagauagaacagugcuuuuccagagugggaaggaagggguugagacgcgugcuuugagagccugugaggcugcuccguccuugccagcugcucccuaguccugagugguccuuggugaggagcagcaagaugcagcgaguugagugagacuuagggcuuuugauuuuuuuuuuuugacucggauuuaagugcauuuuucuagguagacuccugcccuccuugcuaccagaccugcagccaccuugguuuugccuuggagaacauuuggggagcauuuccugaacccaugucuuuuggggguacagcuugucauccagcagggauuauugagagagcaggacuggaggagacgggaaugaagacacagagugacaucugauccuagcacggggccuguugauccauugccuggacugagcugugaaacuggacgcgguuuugguuuuuuguuuuguguuucuuuuuucuuaauuugugugaauuguaccuagacagguuacagauuuaauuuucaccuaccaagggacagucuccucccuggacaaggcucaguggaccaucagguggaggaagacuggccccauugcuugagccccugugcgacccuugaccuccagccuuaguucuccuggaagcugccaacugcuuacgggaguggguagauugggcgucugagacccagaacauccuaaauuugcaauggguaacagcugaaacaaacggaaguuuuuguaccaaaguggccggagguggggaagaacuacuuucgagaauuguuacggaggcagguugaggggacacuuugacccuccaagguaacagccagucagauggcuugaggugccuggcccaugcugccggcuaacugccauccagugugcccagcaguuucagaccugacucuggagggaauuuggagacaguguagacagcagcucugcucuguauucuuuuugacaaaaccagaacaguagaaguagccaaucguaagaccugaagacauuuugaaugucccacuggacuaaccuuucuuuugauguguguuuuuaguuuagaagugcuauauuccacaaggguuaagucaaugagguuggaagacaccuaucuuuuuuuuuuaauucaaaaagcacaaucagucuuuccuuugaaaauccauauaaaguacaacuuuuagcgugauuauuuuccuaaauacaaagacaaauaauuuacuuauuuuauguuaauuacgggcaugaagcaaaagguuucuuuggggaacaugcaguuuuguagugcugggguugguucauguccucuggcacccuggcuuguugaaagguggcuuuagcugugugcuguguaccugcuuacguggccugcuguccucugugugauuaggaggguuucugcuggcccugcagcuugcuucccugcggauuaguucuuugcucaugcuauagccuucaugugggugcuaccuagagcaggcgugaacugcuggguggugauugugaguucagacaauaaaaaaauguauuuuuuucaauacuguauaaaaauaguauucugauuaccucccccucaauaaaaaaaaaaaaguccagaaaaaaaaaauaac

SEQ ID NO: 3738 - RNA, 768 nt, Mus musculus
auuuuuuucaggugcuucucugccauucgguauuccucaggugagaauucuuuguucagcucugagccccauuuuuuauauaaauguaauuuguuaugauauaagaaaguaaucuaagguagugaaaacuguuucagauuucuuccccucucuauuuuggagguucagaguuuuaauauuguucgaugaaguucugauaagcugauaaggcacuaauuacuauuaucagucacaagcccaagauuuuaaauuugcuuucuaauaauagacuuaaaaagugcuuccugguuuuuuugcuagcaccggaacaauugccggagaguucauccgccagcuuaagagaugccgccgaaggggaaaagugguucuggaaaaggagggaaaggaggugcagccucugggagugacagugcugacaagaagucucaggguccuaaaggugguggcaaugcaguaaaggucagacacauucugugugaaaaacaugggaaaaucauggaagccauggaaaaguuaaagucugggaugagauucagugaaguggccacacaauauagugaagauaaagccagacaagggggugacuuggguuggaugaccagaggauccaugguggggccauuucaagaagcagcguuugccuugccuguaagugggauggauaagccuguguuuacagacccaccaguuaagacaaaauuuggauaucauauuauuaugguagaagggagaaaauaaaaucacaugaaagacuaaaaaaaaaaaaag

SEQ ID NO: 3739 - RNA, 3793 nt, Mus musculus
acagaaaacuuccaaaguucaccuuucuuugggacagaaaguggucuucagcccucucugccuaugaugagcaacucuacaaacucaggaagggugugcaacaccuccaguguuuucaccccagcugugaguuuagcauggcuccugccaccaagcaccaacacuucucuccagcugaucacaggcagagccuaccuuaacccacaugcuggcaugaccaugcugguggagcugacugaccagagccagaucucaaccucugcacucuucuauccagguguucucaagugggaacuaacagaaagcaaagauagugcagaugcacuccaggaauucaauaugaccaucacugaccaagacacuacacucuccucccugucugugacaucccagugugauaaaauuuuagaucccaauaucauagccccuuuccauccaucacuuuuaaccaguuuuguccaaguuacaccaccacagguaccacaucaaggauacagccuggcaccuuccuaccaggauggcauccagguguauuacuacaaccacaaccgcauggaccaucugauacccggagaacugggacagugucugcagcccuacagcucuguguccugcccugugaacaaggauucugcaccucaaccagagaugcugauggugggaaaggagauucagccaagggaugcccuaauaccaaucuccaccucuggcuucuccuauuccacaucuggucaaaauaugccagacaucagucuuccagguaauuacaaacucaggcgguaaaggcacaugaucaagagaccaaggaugcucaagucuacuuuucauaguggauauuccacacagccagagauuaugaguccuuacaaguuaaauagagcucugcuuuucauccccaucuucagacugaauaaugauagagaaugcaaggccacagugagugguaucgaucuugcauucaguguugucaggaacacaccacacucacacaugugacagcacaaguuaaucacuaucacaucccugcacacuguuacugaauccuucaacuacugcucugggguauagaugacaaugaggacuuuuuguuuuggcaccuuuggauuuuucucucaguugaaaucucucuccagagcaaugcaacucaaaaucuguccuggaggaagaauuccucccagaucccagcaccuguccuggcauuuucuuaauuuaaaauuauagaguagggugaagaccauguaccauugguaagguagccaaggcuacuuuccuucuuuuuccaucugauguaguacuucagaggugacccauugacaacaauauaagauuuuguagauguuuucucuaauccagaaucauaaccaagcccaaauauuucauuuccuuaugucaauuugcauaucauuuacaggaagucugugagauacagugcuggaagaaagcuccuuuguucaaaugauugucucaaaggagggccagcuaggucuggauaccuaaacccuagcuagggcccagcuaggucuggauaccuaaacccacauaaaaagccaggcuucugggguuuugaauaaugccuuaaacugaaagaaguugucagagucagguaguuucuuaaaaauuauggcccagacaaccuaccuaauaacaaagcccuaaggauggaaaucacuguaucauuggaaaagggaaggcaagucaggagcauauaucaagaaaauuuuguagccuaaccauagacucuaagccucaagaaccacacaaaccuaaaggaaaacaaaaguaucugagaaaagaugacauggcauaggcagcaaaaacagagcagucaccaucugucugucaaaagagcugcugucugggaugcucaagcacagaucauaggaauagccugcccuccugcagaggcugcgugcuguagugcuacgaaauggggguuggguggggagcacaucacucaucagcacugacuucuuccuugacucuuuuccagugguagacauggagaugucccaaggauugcuacccucgggccagacagucagucuguugcagaguccagaacucugcaauauuuccacugagguuuuccagaugaggacaccaccugucaauggggacagguuauuaacagcccccguguacaguacuucagaauuccugaccuugccucuagcuccaagccuggaagaaagagagaaugaaaacaugcuugagaugaaagcugagcugucaaugccuggggaugccuaugaggacacuaaagaaaaccaaggaccaucacaccuuccuuuacugcacccugacuucccuaauagaagucuaagaccaaagucugcuucugacaaugccagcauggaaggcaucaguguaggucuggaagagcaagagaagcuggagaaugagacuggauccagaaacaacuuugacgacaucacuacacugggagcaggugaucaccuuccccaguucuucaaaaaccucaaagacauagacuggggcccuccccuucagagcuggagagucaugagcagcuccucugaaaaggugacaaagaaugaccuaaaagccucugaccugcucgauggagcuccucaggcuaaaauccagcaccaggaccuggucaggggagagagcagugggggcugugcaaaagacaaggaaagagcuauugacaacaucucaaagcaucuggagggcaaagcucccaaagaggcacccagcaagcacagcagaccuagaaaacaguggcaagaaagaccaagugggccagagaacaacuccaagaaaacagaggagcuuaagcagucaaggaacagagucaaagcagaagagaagcccaccauccccaagaccaagaggaagaggaacccaccuaagcucagucaaaacagcuucaagaagccucgaacccaacuuggcaugcacaugcuggaguccguguaggucuuccacccacucgggaagaagauugagaagaaaacuggcaucucuuccuucgggggucugaguaccuccaacaacaacaaagaucaaggcccaggcccagccaccucugcacugcuagauaugccaccugagggccgggguccugacagaaucccaggcaaagcucagagagcaaagaucagugcucacaaggaguguacaucuacaucccaguaugagcugcccuugccugggaaggucaaguuaguaccuuugccuuucccaacacuggaccaaccucaagccagaccugcuucuagaaagccucucccccuggcuucacacaggcccacugcagcuuacccugugaggcuucauccccacucagcucauccauccaaaccagcuccuguaagcacaucucugauggccucugccaauucagcuccuccaauuuccuucagugcuacacaaccuaauauagccaacaccagucagucuagugcuaugccucaguuggccuacaugaggcuuguacccuacagagcauccucucacacuucauuccagagagagcuuauuucuucugccaggaauaaggcaccaucaccacccaaaccucaaacccaacaucgacugcaagacuucagcugccaaucaauuccauggaggaaagucgacauucugggaccagucaucucacagcccaucacaaaagagcagaggccagagagggaagccaugaagaggcgugcucaacaggagcgugagaaugcugccaaguguagcucuccugggaaacuacagcuuuuccuucacagggaaacugauauggaaauuucucaauauuauggcuaugcaauguagg

SEQ ID NO: 3740 - RNA, 1026 nt, Mus musculus
aauggagggccaugauccaauggaagcagagcagcugaggaagcuguuuauugguggucugagcuuugaaaaaacagaugauagcuuaagagaacauuuugagaaauagggcacacuuacagacugugugguaaugagagauccccaaacaaaacauuccagaggcuuugguuuugugaccuacucuuguguugaagagguggcugcugcaaugugugcuuggccacacaagguugaugggcgugugguggaacagaagagagcuguuucuagaggauucuguaaagucuggugcccauuuaacggugaagaaaauuuucguuggugguauuaaagaggauacggaagaauauaaccugagagacuacuuugaaaaauauggcaagauugaaaccauagagguuauggaagacaggcagagugggaaaaagagaggauuugcuuuuguaacuuuugaugaucaugacacagcugauaaaauuguuguucagaaauaccacacuauuaaugggcauaauugugaagugaaaaaggcccuuucuaaacaagagaugcagccugcuggaucacagagaggucacggaggaggaucugguaacuuuauaggucauggaggaaacuuugguggaagagguggcuauggugguggaggugguggcagcagagguaguuauggagguggugaugguggauauaauggauuuggaggugauauuggcaacuaugguggugguccugguuacaguaguagaggagguuauggaggugguggaccaggauauggaaaccagggugguggauauggugguggaggaggaggcuaugaugguuacaaugaaggaggauauuuugguggagguaacuauaguggugguggaaacuauaaugacuuuggaaacuauacuggacagcaacaaucaaauuauggacccaugaaggggcacaguuuugguggaagaagcucagacaguccccaugguggaucuggaaguggaaaugguggauaugguagcagaagguuuuaaa

SEQ ID NO: 3741 - RNA, 20471 nt, Mus musculus
ugucagucaggagagaaggcgggaccuuccggguuccuugcggcaguuucagcucuauaacggacccugcuggaaaaguucugauuguuuuucucuaagcgcugcugcugggugcugugagggaagcucuagcaaguugcuaauucgcgacauggugagugcagagccacugcccacagagggaaggagcaggcaguuguguagcagaaguugguaugguggcuugucccugggucugggugguaaguguggccagaucugaccaccuguuacuucccuuuuuguccuagucauucccugaacccagcggugggcugugaauaacuucacuaugagggcggcaucugcucaaagcaucuggcucagagacuuguguguggaaacauccuuagcaggaugucaaacucagagaggccuaguuucucuacuucuaaaaguuaacucccccaucauuuaacauuuagcuguaagaccuauuuggaguuaauucuguagaaguuauaaaaggcaucucauguuggguagcacucccauaucaaacugugguguagaagaguagaauugaugauguuaaaggauuuaccaaugcuuaggagauaguuaagcgacagcaaguagaguuuagcugagggaggaaugccucugagacacccuacagauaaguagugugcuaaccagacccguuagagaucaggaugcuaggauagauauauuuguucacuaggauuguccagaaaagugcuccagugcuuaacaaaggaggcuacucugauugacaaccagccacuagggccauccucauagcaaagaacuggcugcucaagggagcguuauagagucccaaucaacauuaaaggcuguuuaucacaaagugcugcuaguuuucuucuugagaaaaagcauaguucugccauauucgcaggagaacaccggcuggcaacucuuugaaaagggaaaacacuguuggguccaggacuggcuugaucaagcaaggcuuucugugaggcccuuauguauagaaaauggcauagcucuuucucaaacccaggaacaugcuugacagagccagguaggcccucauguauugagaguaaaauagaacuuuucuuuuucuuuuuccuuuuuuucuuccuuugucuuuauuauuaguaguaauuauuuuacuuauuuacauucaaauguugucccuuccuggucuccccuccacaaccuccaucccauccccuccccuuugccucuaugaggguuccuacccacucacccacuccugccucacccuucuagcaucccccccuacccccaggggggcaacaagcuuccacaagaccaagcuccuccccucccauugauguuaguuaaggcaguccucugcuacugcuacauauguagcaggagccaugaacccacucauauauacucuuugguuggugguuuaguuccugggggcacugaugggucuuguacuggcuaguuuugugucaacuugacacagcuggaguuaucacagaaaaaggagcuucaguuggggaaaugccuccaugagauccaacuguaaggcauuuucucaauuagugaucaagggggaaaggccccuugugggugggaccaucucugggcugguagucuugguucuguaagagagcaggcugagcaagccaguaaagaacaucccuccauggccucugcaucagcuccugcucccugaccugcuugaguuccagcccugacuuccuuuggugaugaacagcagaauggaaguguaagccgaauaaacccuuuccuccccaacuugcuucuuggucaugauguuugugcaggaauagaaacccugacuaagacaggucugguuaguuaauauuguuguucuuucuauuggacccagccaugggaacccaguggaagaguuaagggaaggacugauggagcugaaggggauuguaacacuauaggaagagucccuuuacuaaagcaaggaacaugcuugggagaggugguaaugaucugaggccaaagccucugggggaagguuacuucagauccugagaaccaaacacuucucaccauaugggguugugguuaucagacccaagaccucuguaggcuuuaagugaugaccuugaaauacccuguguucccuuguacaguauuauuuuauuagagucccccugaguuugucccauuguaugguaguuucuacugacuucauagaaauuucccauuucuuuccauuugccuuuggucaguagaacacaagaugcuauucuuaagaugccuauuuggcauaagacauagcuugcacaagaccuccccuccccagcuuuuaucuuuucuacuuucuacauuuccuaucuuucucauccucuggggccuuccacuuagaacccugucagggcugauuugagucuugguuuaacuccucaucuugguaaaccacccucauauccaccuuguuaggaccccuaauuguucucuugcuauugacauguguacccugcauauugaacaaucuuacagccuucauaaaagagaauaggaacagugcagcugaugguccugugccaacaauaugagacccugaggacaggaccugaagaauaugaauuacuuaccccagaccacugaauuuagcuccaguauuggagcuuguacaagaaaaaagggagaaugagggacccuaagggcuuuuucuauucccacacccuccuuacagcuucccucucccgccuggggucaaggcuaggccaaguuccauucuccacccacaggaauauucuugaguaaaaaauucucagaauguacugaaugauaguacccucuggaaagucccagguagaguucaaauguaugucaugcuugcuagccaauagauuuaauggucaauaugcuuaggcaauaaguuugaacuguaaccuugcugauguaaccugugccccuagaaaguauaaaacugcuuguaauggccauucagggucaccuucuagucacuugagggacuaauugaagaucaacaacaacaugccagaaaauaaacuucuucauuuuguaucgagaaaaaaaaaagaauaauaauaauaaaugacucuguguugcaggauauuuguucucacugugaaccccauguuauucacuggaaaaccuauuuuuaauuaugcuguggcucaacuuuagcccacaccuuuaaucuaugaacuuccugcuugaauuuuguaaacaggauuuaauaaagucacccauagguuaagagucagaguaaguaaccaguuggcaaagguguaauuaggauugauaagaaaaaaacauagccgggcgugguggcacacgcuuuuaaucccagcacucaggaggcagaggcagacagauuucugaguucaaggccagucuggucuacagagugaguuccaggacagccagggcuacacagagaaacccugucucggaaaaaccaaaaaaaaaaaaaaaaaaagaaagaaaaaagaaaaagaaaaaaaaaccauaaagaguaagaaggagucagugagaugaauagagaugcacacauuagaaggauuuuuuacugugguaugagagagcaccauucuugguggagcaucugcugaggagaaaagucagcugguuacuuucucuuccucugauuagcagacuuucaacccagcucuagcuucugggucuucauugguaaaauagagcaauugagauuuaaaaacaaauuaugggaauaucugugcuuuguaaaucucccaucugugaugugaguggccagacuugcagucuauuguccauauuuaaauuguucaaaauauaauauacuauggagacugaaccuaaaagagacuuagguugacagcauauaggaaauaugaaaccuguucucagugcucuacuugagcauuagccagagcugaaugcaugcugucauuaaagacacauuucuuaauuauucuuuuaauuguguuuguauugguuucucccugugaaggcauauuaauucuagaauagcuacaucucuggcucuucccuguccucacauugcuuagggucaugucugcucuggauaacagcucuugggugaguucacugaccuuuuaggagaucagugaaguugucaugagaagggagacaggggacagggaagagaaagggagaaaguuggugcacacauaggauggagaaaaugccaagggagcaaagaaggaagaguuucuuggggcaagagaagcucaucuuagaggaugguguauggcagccaugcccuauaacaguagagagugagggaugcugggagaaccuagaugccaggucuguuuugguguguuaaacaggcaccucagcugcuuguccaggguccgaaacccaacaaaucauacuacagaaaaaaguaaaaaugaggguaagaaucagacugagucuuuuuguuugaauuuuuauaaugacaguaaauuauaauuuaucaaaaauguaauaguccuagacaaauuacacaucucuuuguuuucuaugaugaaauuacccaccuuagaugguaacacuuuugcuuuggaggacauuuuuaaacauuuuuauauaucauuuuguauauguuuaauguauuauauaauuaauauaccucuacuguguuacauuacauauguauuuguauuauuugaauaguuauucaaacauuaccuuucuuuaaagagaaggaagaauucucuuuugguauuaaguguacaggaaccucuguaauuccacaauccaaacuaguggaagauaaugagaaaaugaccuggguuuguuuguuuuauaucuugcaugguauauauuucacacugcugagagcaaaaccucugauuucacagaucuggacagggcccaugaaugagcuuguuaugaauuccugugugauggucacccuuugcacaaacggaaugaaaauuguaucuaucaaaaucaugcuuucccugccuuggcuguuuugcuuuucuuuguucauuauugcuucccuucuuuguauuuucaucuaugcauauugaaugaauuuuuuaauugauauauauauauauauauauucuucucucauacaguauaugcugaccaguguccacuucccccagcuaaccugaaccucuccugucuuccucuuccucagaucuacuucuccaacuccauuucagaauagggcaggccuccaagagagcacaaggaaacaagaacaagauacaaaaagacaaggcaauagacuucauauugacacuguacaaggcaccccgauaagaggaaaagagucuuagaagcagguaagacagacagagcuauaccugcucgcacuguuagaagucccagaaaaacaccaagcuaacagcuguaacagagcaaaagaugaucugguacaaacccauacacaccccaugcuuaccauuuaaaucucugugagaucucuggccuucgagguagaauaggacauggauucuuucucguggagucagccucaaguaaaaucaaacauuggguugacacucaaauacauuuggugccaccgugccucugcacaucuugcaugcaggacagaguuuagguagaggcuuuuuaagcuggguucgcauacagguuucuauuucugaagccuguaggguaccuucucaccccagagagacuagaauauaaggacgaaggcuccaagucugcuuaaccaagcucuugaccauccucugcauucagugagcugugugaaaguuguccugagcaauaggguccugcugucagguuucagagagcaaccuucuguccuagcauaagccaggguucuuuagagaucuucauaggaccuccuuggccaaccacucaaccaaauguagcccagucccaccacugaagcccugccuugcuacaaaggauggccagaucagauuccaaauucuucauuacuaggauuccucaguaacacaccuaaccuagauuguuaugaguaggauggcuguuaauacucuguucauccuacugauccauggacaugagagauuuuuacaucuucugauaauucuucaguuuguuucuugaaagacuuguaguuuuuaaucauacaagucuuucacuugcuuuuuuagaguuacuuuagccuauuuuacauuauuugaggguauugugaaggguguucuuugccugauuucuuucuuacuccauuuguuacuuuaguuuauuuuguuuguuauuuauuuaccaucauaaauuccaagaaguuaccagugcauucaguuucuacacuaacccucaaaugcucacaaaauccagcuguucacuuacugcacucucuccgugucucuaacugaucucucccauuccuguccccauucacccucaguccacccauagaauccauucugguuucccuuuugagagagauccauguuucccccugucuuagucaggguuucuauuccugcacaaacaucaugaccaacaagcacguuggggagggaaggguuuauucagcuuacacuuccaaauugcaguucaucaccaaaggaaaucaggacuggaacucaaguaggucaggaagcaggagcugaugcagaggccuuggagggauauuucuuauagcuugcuuccccuggcuugcucagcuuccuuucuuacagagcccagagaugguacgacccacaagaggcccucccacccuugaucacuaauugagagaaugccuugcaguuggaucucauggaagcauuuccucaccugaagcuccuuucucugugauaacuccagcuugugucaaguugacauaaaaucagccaguacaccccucccccguagagcacuccuuuuuaccuauccucccugggucugaguauuguagcccaacuaucauuuauuuaacaagcaacauccauuuggaagggaaaguauaccauguuuguauuucugggucuuuguuaccucacuuagggugauuuuaguuuuugaguuggcaucuauuuuccuuuaaauuucaugacgucaaauuucaugacauuaguguguacauguaccauguuuucuuuaucccucuucaguuuagagaaaucuagcuuguuuccaguuucuguccuguaaaaauaaagcugcuaugaacauaguugagccauuguccuuuugguaagaugaaguaguuuuuggguauauggccaagagugguauagguggauuuuucaguagaacaauucccaguuuucugaggaaucacaauauugauuuccauagugacuguauuaauucgcccucucaccagcaaaggaggaauguuccccuuucuccacauccuugccagcaugagcucucacuuguguuauugaucuuauccauucugacauguauaaucucaugaaaucucaaaguaguuuucauuuccauuuccaugaugaauuaggauguugaacauuucuuuaacuguuucucagccauuugagauuccucuuauuuuaaauugaacuuuuuauucuuuuuuuuaaauuuuauuuaaucuaucccuuuuacacuauagauuuuauccuucucuugguccaccucuagcuguucccaaucccauaccuccuccucaacccuccccacaccccauguccccagccccuaccccccacccuaccagaacucuaaacucccuggggccuccagucuuuugaggguuagaugcaucuucucugacugaacccagauccgcagugcugugcuguauauguguugggggccucauaucagcuggaguaggcugccugguugguaguccagugucugagagaucucagagguccagguaaauugagacugcugguccucuuacagggucgccuuccucuuuagcuucuuccaacuuuucccuaauucaaccacagggaucagcagcuucuguccauuaguugggugcaaauaucugcaucugacuguuucaggugcuuguugggucuuucggacaguagucaugacaggucccuuucugugagcacucuauagccucaguaauagugucaggccuuggagccuccccuugagcuccaucccuuuugggccugucacuggaccuucuuuuccucaggcuccucuccauuuccaucccugcaguucuuucagacaagaacaauuaugggucagacuuuuaacugugggauggcaaucccaucccucacuugaugcccugucuuucuacuggaggugggcucuauacauucccucucccuacuguaggguauuucaucuaaggucccucccuuugaguccugggagucucucaccucccaugucucugguacauucuggaggguucccccaccuccuaccucccgagguuaccuguuucaauucuuucugcugacccucagggcuucaguccuuuucccuuacccaauaccugaucauguuccccucuuccccaccccaucccucucaaguaggauuaaggaguccucucuugggucauucaucuuguugaccuguuugaguucuauggacuauauuuuggguauucuguacuuuuuuugggcuaauauccucuuacuagugaguacauaccaugcauauccauuugggucugcaugauauuuucuaguuccauacauuugccugcaaaucucaugauauccuuguucuucauaucugaguaguauuccauuauguaaaugaacuacauuuucuguauccauucuuuuguaaugggacaucuggguuguuuccagcuaauggcuaucacaaacaaggcugcuaugaacauaguggaacaagugccccuguggcgugguggggcaucuuuuggggauauuucaaagagugguauaggugggucuucagguagaucuauuucuaguuuucugaggaaccuccagauugauuucuagaguggguuguacugguuugcaaucccaccagcaauggagaaguguucuuucuccacauucuuuccaacauauguuguuaccugagguuuugaucuuagcaacucugauugguguaagguaaaaucucagggucguuuugauagugauuucucugaucacuaaggacuuugaacauuucuuuaggugcuucucagacauucaagauucaagaauucucuguuuaguucuauaccccauuuuuugacuggguuguuuguuuuuuuguuuuuuugugguuagcuucuugaguucauuauauauuuuggauauuacccuucugucggauaugggguuagugaagauuuuuccccaaucuguagguugcugauuuguccuauauggccuuugccuugcagaaacuuuccaguuucauuaggucccauuuaugaauucuugaucuuagagagugagccauuggaguucuguuuagggaauuaaccccugugccaauaaguucaaggcucuuucccacuuugucuuuuauuagauucaguauuuauaguuuuauuuugagguccuugaucugcuugggcuucagcuuuuugcuaguugacaaacauggguguauuuucguuuuucuacauacagucagucaguuagaccaggaccauuuauugaagauucuuucuuuuucccauuguguguguguguguguguguguguguguguguguguguguguauauauauauauauauauauauauauauauauauauauauuugucaaagaucaagugugcauaagugugugauuuuauuucugggucuucaauucuauuccacugacaacaugugugucucuguaccaguaccaugcaguuuuuaucacuauugcucuguaguacaguuugagauuaaggaugaugauucccccaguuguucuauuauuguuaagaauuguuuucacuauuccggguuuuuuuuuuuuuuuuuuuuuuuuuuuugccuuuccaggugaauuugagaauugcucuuuccaugucuuugaagaauuguguugauuuuaauggggauugcauugaaucuguagauugccuuugguaggauggccauuuuuacucuguuaauucugccaauccaugagcgugggagaccucuccauuuucugagauuuucaaauucuuucuuaagagauugaaguuauugucauucagauguccaguuucuuuaucaaggcacuccaugcuaugauuuuuucucuuagcacugcuuucauugugucccauaaguuugaguauguuuuaucaacauuuucauuaaauucauggaagucuuuaauuuauuucuuuguuucuuuccugaccaaguuaucauugaguagacugauguucaguuuccaccuguauguggguuuucuguuguuuuuauuguuauugaagaccaaccuuaggccauggugaucugauaggauaggaugcauaggauuauuucagucuuuuauggguugaggguuguuuugugaccaauuauauuguugauuuuggagaagguaccaugaugugcugaaauguauuauuuuguuuuaggguaaaauguucuguagauaucuguuagauccauuugguucauaaccucucuuaguuucacuaugucucuguuuaguuucuguuucaauaaucuguccauuguugagagugggguauugaagucucccacaauuauuguguggaauucaguguguguuuugagcuuuaguaaaguuuguuuuaugaaugugggugcccuagcauuuggggcauagauguucagaauugagauuuccucuugcuggauuuuccccuuuggugaauaugaacuguccuuccucaucacacuugauaacuuuuguuugaaagucuauuuuauuggauauuagaauggcaacuccagcuuguuucuugggaccauuuucuuggaagacuuuuuuccagucucuuacucugagauaaugucugucuuuguuauucagguguguuucuuguaugcagcaaagugcuauauccuguuugugugugcaguuuguuagcuuaugucuuuuuauagguguuuugaguccauuaauauugagagauauuaaaggcagaugacuguuaguucauguuauguuuguuuuugugggugguauuauuuucaugugguuuucuccuuuuggcuuuguugugagaugaauaauaucuucucuuuucuuugguguagguacccuccuuguguuggaguuuuccaccuagaauccucuguauggcuggauugguagauaaauauuguuugaacuugauuuuuuccuugaauauuuugguuucuccaucuauguugauugagaguuuuguuggguauaguagccugggcuggcauuugugugauauuagggucugcaugaccucugaccaggcgcuucaggcuuuuagugucucuguugaaaaguaugguauaauucugauaggucuaucuuuguauguuacuugccccuuuucccaugcagcucuuaauauucuuucuaugaucugugcacuuaguguuuugguuauuaugugaugauaggauuuucucuucugguccuauuuauuugguguucuagaggcuucuugaaaauuuauggccaucccuuucuuuggguuggagaaguuuuuuuucuaugacuuuauugaagaaguuuccuuguccuuucugcuaggcaucuuuguucuacucuuuuccacuuauuuuuagauuuggucuuuucauuguguccugaauuuccugaauguuuugggccaggagauuuuuauguuuugaacauuuaguuucuuaaguucuuuucaauauauguacuaggugggaauuguucuuucaaagucuauaaacaauuuucuuugaauuuugaugggacuaugcugaaucuguagauuguuuuggauggcucuuauuacucuguuaaucuuucugauucaugaacaugagagacuuuuauaucuucugauauuuuuagaguuacuucaacauauuucccauuauuucaggguauugucaaagcugggaagcuuauaaacaccugcuacuccugcuccaggagaucugacccuuccuuuucuagugugucaccuguacacacaauggagacauucuuucuuacacacacaaauauaaggauagaaauugggauagacuugcuuucauaaguguuuauguaugacuucuaaaacacugcaaaccaaacuauuuagguauauaacauaaacauaguguuucuauaaaaaucugcuugcugaauuuacuuuuuaaaaguuuguauuuccucacacauguguagacuuauauccaauuaucaaucauagggaauaaaaugguuuguaagugaucugaaaagacaucauuuuuuuuaucauaagagaaggacaugcuuuuaauagucaaaacuauuucugugauauugaaccaguuuaugcuggaguugaaucucuccaguugggauagcccuccaaucucaauccauuuucuguuauugguaaaggaaagaagcagagugcacacacagacugagugcuggccagugauuucuuugauuuuuuuauuuugacuauacuccugcccuucuucuuuaaaggacuaugcuauauuuauaggucuaucuuugugucuccuuuuaucagugaugccaucuauguugugugauuuuauuaauuauaauauaaugauauuguuguuuagacauucacaauuuuuuuccucugaaaauguguauauuauauuaugaguuccuugaguuuuucuuaguuuagggacuuuuagggacaguuuaaguuucucuucuugaaccuaaaggcuugccucuccucauuuuuugguaaaucuuuuuuugcaguugcuguagucaucaguguuugggguuuuaauacucacaugauugauacaguuaacacauuuugggguuuuaaaaacuuuuucauauauuauuaugucaucaauagcuuuaguucucaguauuucagaacauccgucaucugagggagccucaucugaggacacaucccccacggaacgguugguugcuaugucugugaggagaguguuaauugaugauugauaugggaaggcucuuccacugagacuagcaauaucccuaaccaaauaggccuggccucgguaagagagcuagcugaucauaaggcagcuaccaagcaagggagcaagccaguaaaaaagguucuuccaugguuuuuacagucauuuucuagcuugcguuuuuaaccuaagcucccaaaaugauggacugugaucugacagaaccauccaaaaaaauccacuuauuacuugagaugguuuugguuggaggauuuaaucacagcagcaaagaagcaaaguagaacaaaaaaaugguaagcaaaaugugauuuugcuccuggacauagccugugaacguucuuauuuggaggaauauggaaaauaucaggguuugagcuggcaaaggcgugugaagcaguacccagagcuuacucagguguccuuugaggaccuggaagauuggaguguugagaguaauacagaggaacucgaggucauaagauuucaguugaaaauagacuccaaaaaaccuuuagcuggagauuauuugugugacauuuugguccaaaaucuuuuugauucugcccaugcucugagauauugaguaaagcagaauuuaaaaagaaagaaagaaagaaagagagagagagagagagagagggagggagggagggagggagggagggagggagggagggagggagauuucuuagaaggaacccugacacuguugguugguuauuacuggugacucuuucaggacuacagugaagaaaagcaauaaguagggcagaaauaaaugcaaaguguguucuguagagaaaaacagcacuagguaauuucagauggcaggcaaauucugaaacagaugcaggaauuuucaaggagguuaucaccauuaaagagaaggcccuugcucuauacuggaagcaaugaagguacccuaaagguaauauucccucuuguaagacuucucuucuggaaagaguaaggaaagugauuccuagucaccagaaggaacuuuauauuuuaaaaccugcugcaauuauaguccaagcagggcaggguccaucccaaguuagaagaaguaaaauguggcauuaucacccauguucuacuaguuccauaagcaagaaagauauacacuuuaacgucauggauuuuuuuuuccguugugguuucaauucaacacuguuccagccaucuguuuggcagagucagagacccagugaggaaacucagaguucauugcaggaggcugugaggauaaagccugaguugaauuuugagaccacagauguugagauucccaagcuaugagaaaucuaauaugaagagaugaauauaaguuaccugucuuagucaggguuucuauuccugcacaaacaucaugacgaagaagcgaguuggggaggaaaggguuuauuuggcuuacacuuccauacugcuguucaucaccaaaggggacuggaacucaagcaggucaggaagcaggagcugauucagaggccauggagggaugcucuuuacuggcuugcuuccacuggcuugcucagccugcucucuuauagaacccaagacuaccagcccagagauggcaccacccacaaggggccuuucccccuugaucacuaauugagaaaaugccuuacaguuggaucucauggaggcauuuccucaacugaagcuccuuucucugugauaacuccagcugugucaaguugacacaaagcuagccaguacauuaccaaaugaaagauggaugagaugucacagggacaagguuguccaaguucuuugaaacugaagcuccauguaucugaaccaaagauaaaggauuugguguuugcccugcuuaguuucuugccuugguucaauccuccaucacuauggggguauucugagccaauuuauuuuggaaagauguaucuuguuuugugauuuugcaagauguggcaaucaagagauuguuuugagugucagaaaagacuuuggacauuugaacagugcaugggcuguuguagacuacugagaucauugaaguuacuaaaugcaguuucaacaugggaugaugcuuuucucuccuuugucuguuucuuuggggaccuuaugggagcgucugugaagcaaccuuucuagauuccuuauuggggauggaauugaagugcccauacacucaacccauucccuguacuuccugucuacuauguugcuguugaaccugaucagucagguucugccucuugcagucuugccuuugacucuaucucuaauucaucuaacauacaauagagggaguugcuauucagugcuaagucauuuugcuaggcugauguuuuuauguuuuuaauuuuguugcuuuuauuuuuaaagauaaaguuucucugcauagcccuggcugcccuuaaaguaacuauguagaccaggcaggucucacacuuuagagauccaucugacucugccucaagaguacaggcauuaaauguggaccaacaugccuggcauguuuuguuuucauauuauuggcugauggaccuggaauuaggauuuuguauacaccacgaauaugcuguucuacuaaucuucauccacaucuugaaauuugaaauuugacaaaguauauucuauuucucagaauagcaucuauuuauggcauuaguacuaccuauugagucauuagauuaaauagucuuuauaccuguuuuuuuaaugaguaugaauauuuugcuucuguacaugaauaugcaucucauugugccagguccucagagcagucagaaccuggccuuagaagacaugaacuaugaauaauggauaguugugaggccaaauguaaccacuguuauggugauugguccuaauuauuaacaugacugacaagagcucuucacuggggagcaaucucuucugcccuauguuucuuauuuaugaucagcauuuacauuugcuuauauugacaucuguccauuucuuuuuaguaagauuuuauuuauguuauaguucaaacuagggcacuguagguuucuggaagaugaauacagaacuggagugcagauacaguuucuuggaggaacuucaguaaaaaccuucugaauucuuucuaucuuuuuaauuuguuugauugauuuuuguacgggagacaucuggcuguccuagaacuuguugcauagaccaccuugacauccaacucaaugaauaccccuaucucugcuuccugugugcuaggauuaaagguacaacccaauacaccuagcuugaccagcaggguuuuuuguuuuuuuuccuuaguaauuguucauacaauuucauugagguucgcuccauucuuuucaucuguuugcuugucucuaucuguuugcuugucucuuuuuauguuuuuuaacugacauuucucuugcaaagcaauauccuauucaaagagcucagaaaugacagagguaaaccucauuauuuaguuuccuucuaaaaugccuuagugauuacauuagaacuacuguaucaggaaauaagucgaggaagcaccagaaugauaugaauauauugcuaaugaaguauacaguuacaguguugucagcaucaugcuuuuuauuuuacacauguaugggauauuuuagaauggaaugaccuaugaugauguccauguaaacuucacugaagaagagugggcuuugcucaguccuucccagaagaggcucuacaaggaugugaugcuggaaaccuacaagaaccucacugcuauagguaagaaagugaauuuaauuugggauuuuaaaauauggggacaacuguuucuuugugauugaugcucuuuuguaauuucaaaugaggguguggaagaauaaggugacuaaaccaaacagauucacugaauauaaagcaaguucaauuuugccuaauuucuaauaauauaucauauaauuucugguacucuauuuuagguuacaauugggaagaccauaauagugaacauuuucaacauucuagaagacauggaagguaauuuucagauguaggcugauaggaauaugccucuuaugaaaauuuuaaagaaaagcaacaguguaaaaaaaaaccugauuuuuaguguaucagugauuauuaaaaauuuucacaaaaccauauacuucaauguaagauauuugauuuguguuugcaaguuauuccucuaagaaagaagacagggaaacagugccuuaaaagauauccccauuugaaucagccccuuagccacuauguuguagucuauuuaaucucauacaauuuagguguugcaaaagguauacacauugaauagugguaaguguauguccaaagccucuaauaaguuacuauuccauaauaaaguuguuguuacuuauauacuuauaguauucuuaaguuuagugaaguggacaguguaugagagucaagaagauuguuauggagaaaccuuaaucucuauacuacauaucugugaagagcaaaacgucaaauuaugcgaaugcaauuuggaaaccuuucauuugauauucuucuuucaauagcuauauggucacaauagaucuaaacuauaugaucauagggauauuaaaauaagcaguguaccucucuuccaguagacuuagaaaauauauaguaauccccaguuucaauagacuuucuaaaugugguaaacguuuacaaugaacuuguuuuccaacuucauugggaauacaaccacaagcucaaacuacagaaaauccccguaugcuaggaauguggaaauucuucuguauauccugguucauucuacguaugcagcaugacucacacuguagggaaauuugugaaugcaaugagugugguaaagcugaguucuucuaguucucuucaaauaugaaaaaaaucucauauagaaaaaggauguuauaaaugugaaccauguaauaaaugcucuuaccaccacagguaucuucaaagagacaaaaguaaccuauaaugaaugggaacaccaugaauguaaacaaugaguuaaaaccuuaagauccgauuccucuuuaucauuagaacacauuguaaaacucauagauauaaagugauucauuaguguaaugaaugcaguaaagcucucacauguuucaauuaucuuugcaggcaugaaagaagucauacuggagaaaaaccuucuguauauacucagugugguaaagucuuugcauaucgcagucauccucagaaucaugauagaaugcauacaggagagaaaagccaugaagguauucaacaugguaaagccuuugcacaucaaagucaccuucaaaggcaugaaagaauucauaccagcaagaaaccuuaugaauguaaucagugugguaaggccuuugcacaucguaguuaccuucgaaagcauaaaagaauucauauugaagagaagcccgaugaauggaaccaauguggucaagguaaucuccaaauacauaaaaggacacauucugcacagaaacccuaugaauguaaucaguguggaaaagccuucaggcggcacaauagucuccaaguacauaauagaacacauacuggagagaaacccuacaaaugugaucaaugugauaaagccuuuacacaacaaggucaucuccgaauucauaauagaacacauacuggagagaaacccuaugaaugcaaucaaugugguaaagccuuugcaguucacaguacucuccaaauacauaaaaggacacauacugcagagacacccuaugaauguaaucagugugguaaagccuuuaggcggcacaauacccuccaaauacauaaaagaacacacacuggagaaaaaccauacaaaugcgaucaaugugauaaagccuuuucacaacaaggucaccucagaauacauaaaagaacacauacuggagagaaaccuuauaaauguagucagugugguaaagcuuuugcacgccauagucaucuucuaauucaugaaagaauucauacuggagagaaaccuuacagauguaaucaauguaauaaagccuuuucacaauaugguggucuucaaauacauaaaagcacacauacugcugagaagcccuaugaauguaaugaaugugguaaaacuuuuucacaacacaguuaucuccgaacacauaaaagaacacauacuagagagaaacccuauaaauaagcaaugugguaaaaccuuuguguguagucuuagaaaucaagagccaauuuauauugcagaggaacccuauaaauauagucaaugugguaaaguuuugcacuucauaauuuguuaaacaacaguaaaaccuuugauguuaucuguuaaugccuuuacacaucacaguaauuuugagugcugauaaaacucauacugaauagauaaaacuuauacugaauggaauuuuugacuauaaaagauuugauaagauuuuuagccaauacauuuacauuaaguuauagaaaauuauuuauucagaggaauaaaccugacaacuuucaacaaaguauucaagaauuaugucccucuguuaugcacugaugaccuggaagaaauauaagauggauugcaucagaaguaucugaagccuuggcacuuuaaagaaauuucagagucccaaaucucuacaaaaugaagaagagugaaaagaaagaucaggagagaaacugacaagucuuaaaaaguggcugagcacuuggccaaugccacaagacaguuuaucucaaaagugguaaaaaaaaaaaaaaaaagagagagcgcugugggagcaagccuacaaggaaauauguacauuguaugccugcuggaguuuguuucccauaaggagagaaagaaauaugcaggggugaagacuggcuugucagaucaggaucguauucugcuucucuggacaccuggacuccuaagacuucaacaggagucagucacucuaagacugggacaaucaugucuuugcaaagagcugugugagguauggaagaaauaugagggcaagagcuuuggauuggaaagccaaaggaccaaaugacuagagggcaacgcucaggguguaccugaggacaagcuggcuccuacugugcucucugcauccccuuagcugucaugggucagccccuccaggucuuccacucuuuccuuauucuuggcaacuacaauguagcugucaguaagagcacugugcuccuucccuggcagaccccacccauucauuaauccuuguaaccugcuucccuggaagacuaaggauauucuaaagagauauuucuuuuccuuuggcuaacaauuagugaaccggugggcugcaugaaauucaaauuuccuggguaaucacauucuggguaagauugaguccuccaucgaagaaggcuuuugcugaagaaauauuugcacauugcaggaaacagaggagcuaagaaugggguaugguuuaagggauggcuggaaaauucuuauacugcuuggauggauuacuuagcaucuaucucuuuccuuccaccuaaauaugucauuacgcccagugauugaauaguuugcuucuaucuuugucauuguuucaacuuaguugcacucaauaaauauguuucuaauuuucaugauaaauuuccuuuuuucu

SEQ ID NO: 3742 - RNA, 18334 nt, Mus musculus
cuuuuguuuucccaugucagccauuuauuguuuuccgaguuccuccauuuccagcugcaguguuuccaucuauucucccaaacuuuuuuugaaaaagaauacaggaggaagaaaaagaaaaaccagaaaaucuucucugggagcagagcaagagacaucccaguggaagcagcugcaauacauuuugugcuggugucucaaaaaaaaaaaaaaaaaaaaacaaggaaaacaaggaugugggggaaagggagcgaugucauuauuagacuauuuccugcuuauuagggguguggagguccugggggcaaguuugaucauugcugucaggaucucuaacugcuuuugguuucuuugcacagacuacauaacaaauggugaccaagagcaaccagcaacccaccaccaacagccucgugucuuggggccccagcauuuauauacccucugaaaaguccccagaauuccaaaugucacguaaucacagaaacaaccugcagcugaaaaaaaccauaccccuccuagaacacaaggcaaaucauaaucaguugcugugacgcagccccauacuccauaucugggagaaaaaugaaaacauauucuuauaauauuuccaucuuuuaaaaauaaaaaaaacuccaaaauuuucaccacauaugaguuuucacauuguuuauauucacagaauucccuucuaacauaacaauuuuuuaaugucguaggaaacaugguucuacuucauuaugaguuauuccauacauuugaaaaggaugauuacuucagaaggcuaucccacuuuauacucauacuguuacauauaaauuuuucucugcaguugauaacuguaaaaagaauuuaucacauuauucaauaucuauucucccaaaugagauuuaccucuccuaaaagaauugugauauggcaaagauuuaaucacauuguuuacauacauaggguucuuucacaaaugugaguucuuucaugccucugaagaaaagaaggauaaaugaagaucuuaccacauuguuugcauucauugaguuuuuguauagcauggauuuguuuaugguuuugaaaugaacuauaacgucugaagauuuuaccacacuguugacacugauaggauuuuuccucaauaugguuucuuucauguucucggagggaacuacgagauuuaaaggccuuaccacauuguuuacaaucauaggguuuuucacuacuaugaguucuuucaugcauucgaaguaaggauggauaaaugaagcacuuaccacauuguuugcauucauagggcuuuuccccacugugaaguuuuuuauggacccgaaaggaacuaugaccucuaaaggcuuucccacacuguuuacauucguaggguuucacaccacugugaauucuuucaugggucuggaguaagcaaggauaaauaaaggaccugccacauuguuuacauucauagggcuuuuccccaguaugguuucuuucauggacccgaagggaacugugagauuuaaaggccuuaccacauuguuuacagcuauaggguuuuucugcacugugaguccuuucauguauucgaaguagagaaggauaaauauaggacuuaccacacuguguacauucauaugguuuucccccagagugcguucuaucauguauuuggaguaaauauggauaaaugaaggaccugucacacuguuuacauucauagagguuuuucccagugugaauuauuuuaugucuuugaagggaauugugauaucugaaggaguuaccacacuguucacauuuauaugguuuuucuccgguaugaguucuauuauguaacugaagggaccucuggcauaugaaggcuuugcuacaguguuuacauacauaagccuuuacgucaguaugaauucuuuuaugucucugaagggaguuguaacuuuugaaggcuucaccacacuguuuacaggcauaggguuuuuccccagugugaguucuuucaugcaguuuaaguaaggagggaaaaaugaaggcuuuaucacauuguuuacauggauagggcuuuuccccagugugagaucucucaugcaauuuaaguaaggagggauaaacgaaggcuuugcugcaaaucuuacacuuauaggguuucucgccaguaugagacuuuugaugcauuuuaagcaaauaccgauuaauaaaagauuuagcgcacugcuuacauucauaagguuuuuccccgguaugaguucuuucauggacucgaaggucacugaggcgccugaacgcuuucccacacuguuuacauccguaggguuucacaccacugugaguucguucaugaaucuggaguaagcagggauaaauaaaggaccugccacauuguuuacauucauagggcuuuuucccaguaugguuucuuucguggacucgaagggaacugugagauuuaaaggccuuaccacauuguuuacagcuauagggcuuuucugcacugugaguucuuucauguguuugaaguagagaaggauaaauaaaggacuuaccacauuguuuacauucauagggcuuuuccccaguaugaacuuuuuuauggcgccaaaaggaacuguuaacucuaaaggcuuucccacacuguuuacauucguaaggcuuuuccccagugugaacucuuauaugugacugaagugaucccugacagaugaacacuuuauuacaauaaugacauuuauaaggcuuuuccucaguaugagcuauuuuauguuuuugaagagaacugaaauuucugaaagcuuuaccacacuguaggcacccguaggguuuuucauuggaaugaguuauuucauguuuuugaaguaaagaaggauacaugaaagauuuacuacacagccuacauucauagggcuuuuuccuuguauuaauucuuccacgacuuucacaggaaccaaaagagcucggagcucuaccaaaugguuuguguucauuaucgaugucugcauugucauucauuucauggauguaaaaugauuuagcugaaggacaguuuuuuaccuucuguucacagugcuguucuccaacaggaguuucuugauaucuuccaaaugagcugggaaaaccaaaggauguggcacaaacguuauaagaccuacucauacugagauuuuguguauauauuggaauacuuguaacagaauucaggucuguuuuccaagucuguucacauuuauauugcaucccgccacuuucaucaagcucagauuuuagaccagggaagauguuugucagaguuggugucuuggugaagauuucuccagauugaucaccuucaguacucucauagagucucucaaacuuacauauucuguuaggauaaugaaacacacauuagcaauagugcuuuugcucacuuuuugauuauuagucagucuuggauauggacuacuccaaaauaaaagaaaauuuaaacauucugguacaggugaaugguuugcaaucaaggggacuugugauuuucugaugugguucccacagaguugucuuaaaauacauuucuuagaauugcuuccaaaugaucuaaagaugacuaaguuuaaucucugcauauuuccuuuucuuuaaauuucacaauauauuaagauuaacucaugaaaccucugccucuauauggaccuuaccuuugacuucuccuaggauuugugugcucaucuuccaugcuuuggucuucccauuuguuuccuaaaaaugaaugucagauaaaucaugaaaaauuauuauauauugcacaaaaacuaucaucuuauacuuucaguguacauuguaacuaugucugguuuauucaccaaauucuauccuuuccacagccacgacacaguagaacauggauaacggaaauacuuguucucuagugaguaaacgaaggaaugaugauucucuuaccgacacaagcaagguuauuguagauuuccagcauuacaucucuguacagaugcuucugagaagaauccagcaaagcccacucuuccucggugaaguucacagccacauccucaaagacaacuaaauccuaaagcacuccaaaaauaugugcaagagaaauugugagauguaaggcacuauacaucuaaauucaacugacaagaaauugaugaauucuguagucuccaaacauuuuaucucguguacagauaggcuacagauaguguugagauuccucuuauaccugggcacagggaguaggauauacugcugggcuacaccaauuuuucucuuuaagauggaucucuaguccuuccauuuuaaaaaaaaaaaucuaucauucuaucaucuauagagcauuguugcugguacuuagaaauuccuaauaaaaaagcuuaagcuuugacgucauaagggaauaauaaguucuaacacagauuucaugcacauaaacuagaagauuaauucacucagccuaaaugauuuaugcaaguauuguagcauuuucugaauuccuguuauccuucucagucuaauacaaacuauaguauuuagaagguccgccuccuugugauuccauguucugcuuccucccuuaguguguccagaagccacuauacaccaggcuggaaggauaaagagcugagaauggguagggucuacagaaucuugguccuccucugaggauuuuaauguuacagcucuccucuuaucaucucucagaugauauucgauguaauggcuuaugugcauacccuuuauucaggguaaaucaaggcuauauauaaaucuuagggugaaguuuuauugugacuuaagguucaggcaauaccucauuugcaugaagagacauuccauaaaucccaggugcuuuaaaaccagauacacuaaaucuaauagaagagaaaguggggcaaauccuugaacacauggacccaggggaaauuucaugaacagaacaacaaugguuuaugcucuaagaccaagaaucaacaaaugggaccucauaaaauuacaaagcuucuguaaguuaaaggauacugucaauaggacaaaacaacaaccaacagauugggaaaagauauuuaccaacccuacauccaauagagagcuaauauccaauauauacaaagaacucaaaauguuagauuccagagaccaaauaacccuauuuaaaaauggggaacggagcuaaacagagaauucucaacugaggagccacguauggcagaggagcacguaaaaaaauguucaacauccuuagucaucagggaaaugcaaaucaaaacaacccugagauuccaccucacaccagaauggcuaagaucaaaaacucaggugacagcagaugcuggugaggauguggagaaagaggaacacuccuccauugcuggugggauuauaaacugguacaaccacucuggaaaucagucuggugguuccucagaaaauuggacauaguacuacuaccugaggacacagcuauaccacuccugggcauauacccagaagaugcucaaacauguaauaaggacacaagcuccacuauguucauaccagccauauuuauaauagccaaaaacuggaaagaacccagaugucccucaacagaggaauggauacagaaaaugugguacauuuacacaauggaguacuacucaacuauuaaaaauaaugacuucaugaaauucacagggaaauugauggaacuugaaauuaucauccugagugagguaacucagucacaaaaaaacagacaugguauacacuuacugauaaguggauauuagccaucugauauacaguugcuauuguggaugcugggaagugcuuguugaagggagucugauagggcugucuccugagaggcucugccagagccugacaaauacagagguggaugugugcagccaaccauuggacugagcucagggucccagauggaggaguuggagaagggacugaaggagcugaggggguuuguagccccauggaaggugcaacagugucaacuggcuagauauccccacucccccccccccccccgagcucccagggacuggaccaccaaccaaagaguacacauggagggacccauagcuccagccucacauguggcagagcauggccuuguuggacaucaguggaaggagagggccuugggccugaggcuguucgaagccccaguguaggggaaugccagagugggaagauaggaauggcgggggggggggggcucccucacagaggcagugggaggggugaugagaugggguuucugaagaggaaaccugggaaggagaaaacauuucaaauguaaacaaagaaaauauccauuuauauauacauacauauguguguguguauacacauauauauguauguauauauaaauuaaaaaaaaaucccaggugcuugcuaagcugauucuuaucuggagggaggaagcugaauguguaauuuugccaaggacucugugacauuccuuagguugggguccugaggcagggaagaggaagucuaacuggccucccucauagaaacuuucacaugucacaucuucuuaaauggaauuugaguauacccuauaugaccacacccagaaaaaauauuuagaagcuccaaaacaguuuauuuuaggcccaaucauaauggaaugauguuugcauuuccauugagaaaugucaaaucagaauaaaauaacuaaaaagauucuauguacuuuuaggaauuugaggccacauauauacgacaagaggcuccucuauaaaacuggguuucacuuuugugagcuagaaaucuucucuucuuugucgaguaccccagccuaagcacuguaugcaaucccuuagggcuaaacaggaggacugcccuaaucuaggacugcucuuugaagggacagugaacucuuaggauccaggaugggucucaugccauccauuccuucucccucacccugugacaccaucauagcgauggggccuaaacuugauaccaacacucuaaaagaaagaacacaguucuacuguauacgugccugaagcauuacacauuaaacaccaugcugaaaguagaucuccuuuguuggucuagaguccuaguuuccuccuaucuaggcuuucacggaaagcuuuaagagaaauaguguuuucuuaauaaagcuucuucacuagcucaucuuccuuaaauccagcccuuaaugauacucuugaaaauccuuuuuuucgacauuuucaagcacaaacucaaacauccuuaacuguugagucucccuccccucuaccuaccaauucagcuacuacccuccccuuucaccccucuuccucuguccuuccuuuuuacauguaaaacuguuuccaaccucugcccuaccuaccuagauacauucauccuaccacauucauucaggaacuucacacagguuagagagaacuauuaaaagucacucugucucauucuuucccuuuacaucaugacuauuggguacccccacaugguagaagggaauaaugguuuccugcaaauuguccuaugaccuguacauggacacuguaaccugcacaaaccuaccaaaccacacauaauuuaaaauuaaaaaaaaucgaaucaaauauccuuacacaaggaaaagacacacuaauuuuauacuuagaugcuuagcaacaguaauaaacuaaagguccuuguucuccagaauuaaaacauucuguucuaagagcagaaaacugaacgaguaauaaaaacaccauuguucauagcaugcaacaaucucagcucugaauguagguguuucaggcaaaauuaccauuuuguaguaagaugguauauauaauauaaacaccccguggcucaugaccaagggugcucagaaaauagcuuagauuuaucacauuugauucugaauuuauggucacugcauauucaggaaacgguuuacuguuguccaauaugacacuaccugcacucagacuguuuaugugacaucauauggagcuauaaccuaauucaagauguugacuacgauauuaggacuguaaacucuacaauuauguuucuauauaagccuagaaagucaggauccuuagcucuuaguaauagcuggcauuacagguuucuggugggccaaaauaucaggugucuucauaccucgacagcaaccaauguuauaccacccaggccaggugugucuugagacccuucucuugacaugugugcuaucuuugucaacuuaauacaggaaagucaucuaagaagagaaaaaucaaaggagaaaaugucaccaucagauuggucuguagacaacucugugggggcauuuuacagauuaaugauuggcauuugaggguucaguucauuugugauuaguaccaguccugggcagauacuucugaguuguauaagaaagcaggcugaguaaggaugagaagcaagauaauuagcaguguuccucucuggucucugcuucagaucaugcuucgagauucuagccuugcucuugcgaagaucacaugccccaguccaggggaacgccagggccaggaagcgggagugggugggauggggagcaggggggugggaggguauaggggacuuuugggauagcauuugaaauguaaaugaagaaaauaucuaauaaaaaauaaaaauaaaaaaauuuuaaaaaaauuuaaaagucagggucuuacuauguacaacugagugucuuggaacucacuaugugccagguuggucucaaacucauagagaucuaccuacuuuuacccgcugagugcuguugcuaaagaugugagccaccacauccaucaaguugugcauucuuaaagauuuuuuauuugagggggaaagggaaaagucuuacaaaagacaguagcagguuuacacagaacguaacuuaugcuuugugauaaggugaaggagcaggauuuuagguuacaugaccagggucacagaaaugcuuuaaguuggggaggcagagcuuuguaaaugugugaguagaguaaaacugccuugauauccaggcaucagaggacuggguauugcccacccuguucauaguucuaucugcuagggcccaguuaccuuagaugguauagacuugacuuuucuuuccuuuucuuuucuccucuuuucuuuucuuuuccucccccaaaacaggauuccucuguguaacagcccuggaugucuuagaauuacuuuguagagcagcugaccuugaacucagauaucugucugccuuugcaucuugaguccugggauuaaagguguguaccaccacauuugguaguugggcuuucuaauauuuccagccuucuuaguuauugaaagaaagaaagaaagaaagaaagaaagaaagaaagaaaggaaggaaggaaggaaggaaggaaggaaggaagaaagaaagaaagaaagaaagaaagaaagaaagaaagaaagaaagaaagaaagaaagaaagaaagaaaagaaagagaagggagagagggagggagggagggagggagggagggaggggggcagagcugugguauuaaugggcaaugaaaucaguuuggcuucuuacugaacugggguggggcuggauuggggugggacucccuguccuaugauagaucaucaaguugguggcccugggguuagaggcuaucuguaauuaaacuucaagagggcacugucuauuuguaaaaccauuuggaguuggauuuguuaaauuauguuuuguugggguauuuucugaacagaaauuuuacuuuuauuaauuccuauaaguugucaaagacaaccugaugaauucuuuugauucaggaauuccauuugggagagucugaaggaugacuaacuacucagagguggaucuguggcugggaagaauacugcagauaaacagugucagccacucuucauucgugauacugacaaaauuugggcagguugaggauaagucucagcaucagucuugcaggaaagaaauggagaggaggaaggaaaauuagaacucuuacaaaguaaaggaagacaacagaaagaagaaaaguaguucuucucccuuacauagggccagagaaccuccuuagcuuguagggcuaucaguuaauuaccacaagcacaagaggaucagagagugagagggaaauaggcagcaaaggaagaaggccuggacagaaaugacuccagagcucuugcaacugugauaaggaaaucaagagaaguagauauuuagauaggugaaacggguaccuauuagggagucuugggacaucaaauacaccugggaaagagagaaaaggaaacaagucucuuugugacuuaaguuccuuuugagguguuggucaaagccacaauagaaacugaagcugacuguagcaccacccccagccccagcauguugaguuggcugaaaagugcacuauccccugagauccauuguccugcccaggcugcccaucugagaccagcuacaccaagaacaucuggguccccuaacaauugaagcaggguuaucucuguugucugccacuggauccccucccccuuucuggauuaccuaucugaaccucagugggagauguccuaguccugcugggccuacaugucccagggugguguaguauccaagagggggugcucauucucugagggaaaagggaauagguaaucaugggagggauggagggugcugagaucaaaauauaaaaagaaauguauauauauauauauauauauauauauauaugugagaaauauauauaaguguguguguguguauauauauaaauauauauauauauauauauauauauauggaaauaaucaaacacagggcuaagaugaaugauuuagaaacaaaagaacaaugcagagaugguucuuuaagaaaaucaacaagauagacaaacccuuagccaaacuaacuaaaaggcagacagucuccaauucacaaaagcagaaaugaaaagggagacagaacaacagacaccgaggaaauccaaagaaucauucagucuuacuuugaaaaccuauacuccacaaacuugguaaaucugaaugaaaugggugauuuucuagauagauaucauaaaaggaagacaggucuuuggucaggagaauaagaguaccugcauuuauuucccuuuuagaaccaccaaacaaguucucaaagaaaaucuaaaauaaaugaaugguuuucuagacagauaacaccaauguuaaaucaagaucagauaagcuaucuaaacaguccuauuaccccuaagaaaauagaaguagauauuaaaagucucacaaccaaaaaaagucuaggggcagauaguuuuagugcagaauucuaccagacuuucgcuagaguguuaauaccaauacuccucaaacuauuccauaaaauagaaagaaaaggaacauuuuugccaaacucauucuaugaggccacagucacccugaaaaacaacauaaaaaaaucaacaaagaaagaugauuuuagaucaauuucuacuauaaacacugauggaaauguacucaauaguggcaaacugauucuaagaacacauaaaaaacuucauccaccauaaucaagucggcuucauuccagggauacagguauaguuuaauauaugaaaauugaucaauguaauccacuauaaaaagaaagugaaagaaaaguuacaugacuaucucauuagauguugaaaaagccuuugacaaaaucuaaaacaccuacaucuaaaacucuuggagaaacauauaaaaaggacacaugcuccacuuuguucauagcagcauuauuuauaauagccagaagcuguaaagaccccauaugucccucaagagaggaauagauaccgaaaaugugauacauuuugucuuagucaggguuucuauuccuggauaaaacaucaugaccaagaagcaaguuggagacaaaaggguuuauuccgcuuacauuuccacacugcuguuaucaccaaaggaugcaggacuggaacucaagcaggucaggaagcaggagcugaugcagaggccauggagggauguuacuuacuggcuugccucuccuggcuugcucagccugcucucuuauagaaccaagacaaccagcccagagauggcaccacccacaauggggccuccucccuugaucacuaauugagaaaaugccuuacagauggaucuuguggcggcauuuccccaacugaaacuccuuucucugugauaacuccagccugugucaaguugacacaaaaccagccaguacacauuuauacaauggaauacuacucagcuauuaaaaacaauaauucauaaaauucuuagccaaauggauggaacuagaaaauaucauccuaagugagguaacccagucacaaaagaacacacaugguaugcacucacugauaaguagauagauauuagcccagaagcucagaauacccaaauacaauucacagaucacaugaagcugaagaagaaggaagaccaaaguauggguacuucaguccuucuuagaaggggaacaaaauacucaugugaggagaugccgagacaaaguguggagcagagacugaaggaaaggccauccagagacugcaccaucuggggauaaaucccauauacagucaccaaacccagacacuauuguggaugccaacaaaugcuuacugacagaagccugauauagcugucuccugagaggcucugccagugccugacaaauacaaagguggauguucucagccaaccauuggacugaacacaaguuccccaaugaaggagcuagagaaaggacuaaaggagcuaaaggagcuugcagccccauagaaggaacaacaguaugaacuaaccaguacccccagagcucccagggauuaaaccaccaaccagaguacacauggagagaucuauggcuccagcugcauauguagcacaggauggccuuguuggacaucaaugggagaagaagcccuugguccugugaagacucuaugccccaguguaggggaaugccauggccaggaagcgggaguggguggguuggugaacagggggaagggggauagguuggggguuuuucggagcagaaaccaggaaaggggauaacauuugaaacguaaauaaagaaaauaucgaauaauuuaaaaguaaaaaaauaaaagucuuggagaaaucagggauacaaagugcauaccuaaacauaacaaaagcaauuuaugcaaaccaacagccaacaucaaauuaaaggaagagaaacagagcaauucgccuuagaugagggucaagacaaggcuguccacucucucccuauccauucaucauagaacuagaaguuauaccuggagcaauaaaacaaguaaaggagauaaggguuacaaaccggaaaggaagaagugaaaauauugcuuuuugcagaugauaugauaguauauaagugaucccaaaauuucuaccagagaaauccuucaggugauaaacacauuuagcaaagugguucaauacaaaauuaacucaaaaucaguagcccuucuuuauacaaaugagaaaagaaauuauggaaauaacacccuuuacaauagccacaaauaauauaaaauaccuugguguaacucuaaccaagcaagugaaagaucuauaugagaagaacuucaagucucugaagauagaaauuaaggaagacauccaaagauggaaagaucucccaaguucauggaucuguagaauuaacauaguaaaaauagccaucucaccaaaagcaaucuacauauucuaugcaauucccaucaaaauuccaauacaauuuuuuuacagaccuuaaaaaugcaauucucaacuucauauggaaaaacaaaaccccaggauaccuaaaacaauccuguacaauaagagaauuucugaaggcaucaccaucccugauuucaaacuacacuacagagcaauacuaauuaaaaugcaugguauucacauaaacacagacaggcugauugauagaauugaagacccaaaaauaaaccuauauacuuaugaacuaugaaugcuugauaguugacaaaggagccaaaaccuuacauuggaaaaaugaaagcaucuucaacaaaugguccugauuuaacuagaugucugcuuguaaaagaaugcaaauagccucaaguggugauuugaauaugcuuggcccaugguaaguggcacuauuaggauuuuggccuuauugaaagaaguaugcccuuauacaggaaguguuucacugugggaauggggucugaggucucuaugcccaaguuccacacaguguggagagagagucuccuccaggcuuccuacagaagagagucuuaaaucaagauaaacuccaggcuccuccugcaucaugucuaccugcaugcuaccauacuuccuaccaugaugauaauggauggaacuucagaaacuguaagucagccccaauaaaauguuuccuuuuaugagaguugccuuggucaugaugucucuucguagcaauggaaacaccaauuaagacaaugcauagcuaucauccugcaaaaaacucaacuccaaguggaucaaagacuucaacauaaaaucaaacacacuaaaaaucuaauagaagagaaaguggggaacugccuugaauacaguagacaaauuccugaacagagcacuaauagcucagguacuaagaucaacaauuaauaagugggaccucaugaaacuggacaguuuuuguaaggcuaaagauaccaucaauaggacaaaauagaagccuacauuaugggaaaauaucuuuacuaauccuacauccaauagaggccuaauauucaaaauauauauauauauauauauauauauauauauacucaagaaauuagauaccaccaaaccaaauaacccaauuaaaauugagguacagaacucaauagagaauucucaacagaggaaucuugaauggccaugaaacacuuaaacaaauguucaauguccuuaguuaucaaaaaaagcaaaucaaagacuccgagauuccaucuuauaagcagucagaauggcuaagaccaaaaacugaagugucagcaccugcugguguggauguguagcaaggagaacaugccuucauugcugguuggaguacagacuuguacuaccacuggaaaucaauuuggugguuucucagaaaacugggaauacuucuaccucaagaccuggcuauccuacuccugggcauauacccaaaagaugcuccauuauaccacaaggauccuugcuuaaccguguucauaacagcuuuauuaaucuagaugccccucaacugaagauuggauuuuaaaaaaauguaguacaucuacuauucagcuacuaaaagcaagagcaucaugaaaacugcaggcaauggaugaaacuugaaaaauauuauucugagugagguaacccagacccagaaagacauguacucacuuauaauuaauuggacauuaacuguaaaguacaggauaccuaugcuacaauccacaaaaccaaagaaacuaacagggcaugcccaagaaggaaugcaugaagaagaaacaaaauagucacuggagguggauaaaaaagagggaacugggugggaaaggaggugaagagagcaguggagauggggaucagguauggcuggagguaggcaggagagugcugggcaaagaaauggaaaugguucuaagacaucucugggacuaacuauagacauggauggaggaggcuucagggagucuaugggggugacccuagcugagguucuuuucuaccagugaaggauauggagauuaaaguggucaccuaguguggccaggcaggacuucuaguggagggagguggacaucaccccaucgacaaaaucuucaacccaguuuguucucccuacaaaagaugcagggauaaaaauggagccgagucugagggaaccaaugacuaccccaacuugagacccaacccaaaugggacacaacccugacacuauuagugaaugcucagcuaugcuuguagacaggagucacaugcagauuuaaacagaugcagacacccauagccaaacaucaggaggagcuuggaagaguaggggauaggauugagcaagaaagaaggaucaaggauaacacaagaagaccuacagaaccaacagaccugggaccaugggggcccacagagacugaaccaccaaccaaaaagcauguaggggcuggaccuauauccccuacacauuuggagcagaugagcagcuuggucuugaucugaguucccuagcaguuagagugggggcugucuuuuacuuaguugccugccccuggaucuccuuccccuaacugaacugccugguugggccucagugggaaaggacgugcuuaguucugcugggacuggaugccccaggaagagaggaggcaacguggggagggauuuguaaagauggaauuggguggagagggggagggagguuuugaucagaauguaaauuuaaugaaugaauuaaugaauuaaugaaaaaauaauuuuauggucgugagucacaagaacaugaggaacuguauuaaaggcuggcauuagagaaguuaagaggaacugccacagaggguuuuggggacucaagcuaggaucucagacuuuccuguaguuccauucagccccaccuagagaaaacuguguaggacagaaaagcucaguacuagggcuuacggauucagacagacgaggauaugaaggacaccucucuccagagaccuuuacacuugucucucaguguccccugaaguacacggagggcuggagagaugacucagcaguugagugugcuauuuuggaaaaccugaguuugguucccagcacucacuucaguggcugaugacagcauuuaacauucauuaccuucaaggccuccgacauccucuucaggccucuguggggaaucacacacauguagcauuuauacugagagacacauacauauacaaaacauaaauaauccuuaaacuaauaauuaggguucugaagagacggcuuagugguuuaaaccacucguugcucuuaaagagaacccaaguuuaauuucuagcacacacguggcaucugaaaagcaucuaaaacuguucuuggagauccaaauccaguucuggccugcacaugcauuugguauauacacacaugcaagcacauacucauacacauaaaauaaaaauaaaccuucaaaaaaguuaaaauaggagagggccuggaaaggcccaguaaagguaacuaucuccaagccugcugcccugaauucaaacccuggggccagcacagugggaaaccuauucucaggaacuauccucugacuuccacaggcacacuggcacacuugccagcccgcaauaaauaaauauggauuuaaaacauggggagugcucucccaaaagauuguaaaaggaaaaaaaaaugaauacguuuuuucuuuuuuuuuuccuuuuuuuuuauuagauauuuucuccauuuacauuuuaaaugcuaucccgaaagccccccuauacccucccacccacccaccccggggggggggaaccuaaaucuaaauacagccugcaccaugcauucagaacaucaagaacauaacacagaaaaccuagagggucuuaagguuagcaguguggugaaacgccaacaacacuaccagugcucacauacagggaacugacgucaccaacaucgaggcacuccucuugcuggacagagcucaucaagucguccccccccccccccaaggcccgcaagggcguggggguggggaguaacucuaaacccacggggagggggaauccugaugccaguaccaaaaggcccgccccaaccccggugaggaugcaccacaucggauccaccccaucuggggacaagggucccuugcucaccauagcgcggcuugcaggcucacccgcucucuucacauaauuugccucauaauuugucacagcggugcacuucguacagagcaacgucuccaacgcgacuaccucagucuuagagcuuggaagguggcauggcggccaagaaaucccgccucccgcuggcacucgauuggacugccuacuuggaagcucugauuggcuagcaauguuugagugauagcauccuuaagcugcacaugacugaagggaccaguacugcuagucacucccagcccugccuucggcccuaugugcggaccugaaugagcuccagugagaucuacauuuacacagaaccuguuucuuccucccagaacuggcucggcugucuucuugcacuuaguuggcacuccuugcuucagagcacagggucgcucaugugcacugcccacuacacaauucugcuuaaaugcaaaucucccuggaucuggaacaggucugcacccuuuagcgaaca

SEQ ID NO: 3743 - RNA, 1307 nt, Mus musculus
acguuuuuuuuuuguuuuguuuuuguuuguuuguuuuucuuuuuuuuugugggugcagugaacuuuauugaugguauguauucaagagaguaggggggcucccuaggccccuccuguuauuaugggggucugggauggaaauugugagggagaugcucaguguugggggccgaguugggauagggccucucucuugcucaguguccuugcuggggugggugguccaggguuucuuacuccuuggaggccauguaggccaugagguccaccacccuguugcuguagccauauucauugucauaccaggaaaugagcuugacaaaguugucauugagagcaaugccagccccgacaucgaagguggaagagugggaguugcuguugaagucgcaggagacaaccugguccucaguguagcccaugaugcccuucagugggcccucagaugccugcuucaccaccuucuugaugucaucauacuuggcagguuucuccaggcggcacgucagauccacgacggacacauuggggguaggaacacagaaggccaugccagugagcuucccguucagcucugagaugaccuugcccacagccuuggcagcaccaguguggaugcagggaugauguucugggcagccccacggccaucaugccacagcuuuccagaggggccauccacagucuucuggguggcagugauggcauggaccguggucaugagcccuuccacaaugccaaaguugucauggaugaccuuggccaggggggcuaagcaguugguggugcaggaugcauugcugacaaucuugagugaguugucauauuucucgugguucacacccaucacaaacaugggggcaucggcagaaggggcagagaugaugacacuuuuggcuccacccuucaagugggcccuggccuucuccaugguggugaagacaccaguagacuccacgacauacucagcaccggccucaccccauuugauguuaguggggccucgcuccuggaagauggugaugggcuucccguugaugacaagcuucccauucucggccuugacugugccguugaacuugccguggguggaaucauacuggaacauguagaccauguaguugaggucaaugaaggggucguugauggcaacaaucuccacuuugccacugcagauggcagcccuggugaccaggcgcccaauacggccaaauccguucacaccgaccuucaccauuuugucuacgggaugaggcuggcacugcacaagaagaugcggcugucucuggaacagggaggagccuuuu

SEQ ID NO: 3744 - RNA, 1307 nt, Mus musculus
aaaaggcuccucccuguuccagagacagccgcaucuucuugugcagugccagccucaucccguagacaaaauggugaaggucggugugaacggauuuggccguauugggcgccuggucaccagggcugccaucugcaguggcaaaguggagauuguugccaucaacgaccccuucauugaccucaacuacauggucuacauguuccaguaugauuccacccacggcaaguucaacggcacagucaaggccgagaaugggaagcuugucaucaacgggaagcccaucaccaucuuccaggagcgaggccccacuaacaucaaauggggugaggccggugcugaguaugucguggagucuacuggugucuucaccaccauggagaaggccagggcccacuugaaggguggagccaaaagugucaucaucucugccccuucugccgaugcccccauguuugugaugggugugaaccacgagaaauaugacaacucacucaagauugucagcaaugcauccugcaccaccaacugcuuagccccccuggccaaggucauccaugacaacuuuggcauuguggaagggcucaugaccacgguccaugccaucacugccacccagaagacuguggauggccccucuggaaagcuguggcaugauggccguggggcugcccagaacaucaucccugcauccacacuggugcugccaaggcugugggcaaggucaucucagagcugaacgggaagcucacuggcauggccuucuguguuccuacccccaauguguccgucguggaucugacgugccgccuggagaaaccugccaaguaugaugacaucaagaagguggugaagcaggcaucugagggcccacugaagggcaucaugggcuacacugaggaccagguugucuccugcgacuucaacagcaacucccacucuuccaccuucgaugucggggcuggcauugcucucaaugacaacuuugucaagcucauuuccugguaugacaaugaauauggcuacagcaacagggugguggaccucauggccuacauggccuccaaggaguaagaaacccuggaccacccaccccagcaaggacacugagcaagagagaggcccuaucccaacucggcccccaacacugagcaucucccucacaauuuccaucccagacccccauaauaacaggaggggccuagggagccccccuacucucuugaauacauaccaucaauaaaguucacugcacccacaaaaaaaaagaaaaacaaacaaacaaaaacaaaacaaaaaaaaaacgu

SEQ ID NO: 3745 - RNA, 938 nt, Mus musculus
uuuaauauuuaacuaaauuuaaauugguacuccuucuugaauuuuuuuuguaccugaugccaagacaggagauuuuuucuggccuuaacaaaauaauguagcacuugggagcaaaauucaauccaaggagugcuauacuggaagccaagauacaaaaaauuuccauagccaccaugaccuuccccuuuguacuaugguagacagggaggaaagugauccaaacacagaagaauaccugcaugcugaaugacaggaacuuggcuucauugaaggugucaggcagauuccuggacaagaaggccaugguguagcucccaagugcuaaggagcagagguaccccaggacaguguggaaggcaacuguugaacccauguugcacacgaugaugaugugaccauguucagcaugaguaucuugaucaaugaaggguggagagguaaccacccagauuccacagauaauuaguuguaucagugugcagaugggaaugaugaaauuaggggcucuugauaccauuaaccaucucaccauucuagcuggaacaguggccuuaaaugcaauaaccacuguaauagcuuuggccaacacuguggagagagccacagugaacaaaauuccaaaugcugucugcugcaagaugcaggugguuguguugggcuggccaaugaaaagcaaggaacugaggaaacugaugaagagugucaguagcaggauguagcugagaguccuguuauuggccuugacaaggggugugucuccgugcuucacaaagacuacaagaaccacagcugugaguagagagaagcacagugcugugauggugagugccauucccaggggcucuucauaggcuaaaaagcucacagauuucuggaggcagugauucuucucugaguuugcauagugacuuucuggacacuucauacauugauccaua

SEQ ID NO: 3746 - RNA, 648 nt, Mus musculus
aaaaagacauacuaggcaggaacccuaugaauauacgcaauguaguaaacacaugaaaucauucauucuggagagaaacaguauugaagguaugaaauaugaugaagucuuugcuuguaacaguggucuguagauacacacacacuaaucauaaugcauaagaccaaccauccaaauauaauugacgugauaaaccauuuuauaaguuuuauaucuuugaauacaucaaagagcacauacugaaaagaaaaccuaugaguauaagcaauaguguggcgccuuuucauauuaagguaaaagaauaaaugcucuggaaaaacccuccaaaagcagucugugugaucaagccauuuuacaucacaaucaucuucaaaagcaugcaaagagucauuguggagagaagccuuaugaauguauuuuaaauuguaaagccuuuggaaauuucuguagccuucaugaucaugaaaguauacauagaggagugaaucucugugaauguaagcaaugugguaaacccuuugcuuacacaucacaguugugaccaaaugcagaaaacaacacauacuggcaagaaaccuuaugaacauauuuaauauuguuuagccuuugcacauuucuguaaucauugucaugacuauuuauauugga

SEQ ID NO: 3747 - RNA, 831 nt, Mus musculus
cuuuccuagcauuucacccacuguucuguuuggccgcuagccucuugucucucucuucagcaauggugaggcggacuccuuuuccucggggaagagagauccaugguuuguuacccuugccaauaacaaaaauguuggacagccgaguggcaaagcuguugccacuggcaucuuucacaugaaccacaucaaaagagccgggaugucucucucuguuggugauuacaccaauucuucccaaguuagcaccuccagucaccauacacagguucccagugucaaacuugaugaagucaguuacuuugccugucuccaaaucaaucugaaugguaucauucaccuugaugaggggaucaggguaccgaauaguacgaccaucaugggucaccagaugcgggauuccuuuuguacccacaaagaucuuucucacuuugcacaacuuguacugggccuccuccaguguaauaugaugaacagcaaagcgacccuuggugucauagaucagacggaaguucucucuguucuugucaaugcugaugacauccauaaacccagcaggguagguuauaucgguccugacuuucccaucaaucuuaaugaaucgcugcacgcaaaucuuuuuuacuucaucuccauucagggcauacuuaagucuguuccuuaggaaaaugaugagaggcaggcauucccucagcuugugaggaccaguggauggaccaggagcaaacacgccagucagcuuauccaguauccaauguuuuggagcagcuacgcgcuucagguguuucuugggaccacgagucauggcugcgcugggaacggaaagagcca

SEQ ID NO: 3748 - RNA, 9748 nt, Mus musculus
aaggauuuaucacauugauuacauuuguaggguuucucuccaguaucuguucuuuuauguauuuggagacuacuaugacaugcaaggacuucacuauguugaaagccuucagaggguuucucuugaguuugaauuccuucaugcuuuugaagaugacuaugguaugugaaggcuuuaucacacaguauguauucauacugguucucuccagcaggauuucuuucgugccugcaauaacaauugggacauguaaaauuuuaucacauucauuacugaugaaucuuuuuuaucugugucaauuaauuuuacaacuuggucuaauuauaaaguagaaucgguuccuaagguuuuaucacauuguuuagccuucacugugaguguuuugcaucauuacagauacugaugaugggaugggucauuuauuacauggcucacuuauaccagacuuuuucuauauaaaguuucucacauauuugaagacaacugcaagaacucagagcuuuaccacucugguugcauucauaauuuucuuucuuuucuuuucuuuuuuguagaacaugauuuuaguauuuuuaacuguuaauauucaaaagacagaauaaguaucuuaagauauguuucguuguuauuucuccauuuucauuucugauuuuacuaauuuggauacugucucugugcacccugguuagucugguuaaggguuuaucuaucuuguugauuuucucaaagaaccagguccugguuuuguugauucuuuguauaguucuuuuuguuucuauuugguugauuucagcccugaguuugauuacuuccugccaucuauuccucuuggguguauuugcuucuuuuuuguucuagagcuuucaggugugcuguuaagcugcuaguguaugcucucuccaguuucuuuuuggaagcacucagagcuaugaguuuuccucuuagcacugcuuucauuguguccaacaagcuuuggaaugaugugucuucauuuucauuaaauucuuuuuuuuuuuuuuuuuuuuuuuuuuuugguuuuucaagacaggguuucucuguauagcccuggcuguccuggaacucacuuuguagaccaggcuggccuugaacucagaaauccgccugccucugccucccgagugcugggauuaaaggugugcaccaccaugccuggcauaaauuuucuuucagugagucauacuauauuugaaaagucaagaaggacaaucaaaguuuccacauuccuaguacucaugggcauuucugcaguaagaguuugugguuuuagucucaaugaaguugaaaaacuaagugauuaaaaacuucagaaagucuccgcaaagugagagacuaccacauaucuucuaguaguucuaagaaaaagauacuuugcuucuuucaaaauuccuauggucauauguccuguauccaguaugauauaugauauacccacuaaaauaacaaauaagagguuuccaagcuggacguaguggcacaugccuuuaaucccagcacuugggaggcagaggcaggcggauuucugaguucgaggucagccuggucuacaaagugaguuccaggacagccagggcuauacagagaaacccugucuugaaaccaccccuccccccaaaaaagagguuuccacaccggauucacaguuugacuuuuuguuccucauagacaugaaguguaggggagggauuaagguuucuccacaacaauucuuaacucucaugaacuaacuucccuucucacugaacuuagaaaauuucagacaaguauaugaguaacaacagcuuuacuauguaguauuugcucaguagaagguuuuggacauacacaugucaccuauucaguguguguagaauuugcaguaucugaguggugugaaaguacaaggaauggcagugcuacaguguagcucuaauggucauaugauccaaauugucacaucaguuacaaauacugucgggcuggagagauagcucagugguuaagagcacugacugcucuuccagagguccugaguucaauuccuagcacccacaucgugguucacaaccaccuaucacgguaucugaugcccucuucugguguaggugaagacagugacaguguacacaauaaauaaauaaauaaauaaauaagaaauacugucauagaggaaugccuuguaagcacaaauuagcuaccugacauagagguccaugacuuuaugagaauuuaauaaccacaaauacaauuaaagccaugcuuauuuacacuguugccgaucuuuaaaauuuccugaacacauuaaauuuuauucagaagcauauuugaaucagguuucaaagaaaguuuaccuuugaguuugaggccagccuggucuacagagugaguuccaggacagccaggacuacacagagaaaccgugucucaaaaaacaaacaaaaacccuuaccuucuauaucuuuuaucacuuugacaaugcucuucaauauuauggucuucccaauuguauccuaaaauguaguaccagaaaauguaugauauauuauuggaaauuaggcaaaauuuaagcuauuaucuucagugaaccauagaaccaugccugcuucacucacuucauucuuccuaauucucauucaagauuacagaagaggaucaauaaccaagaaacaguugcccccuuauuuuaaaacuugaagaagauuuaccuauagcaaugaaguuccuguaggucuccagcauuacaucuuuguaaagucucuucugagauggauccagcaaggaccacuccucuugagugaaguguacaugcacaucaucaaaggucaaugcauccuaaaaucccauacauguguacaacacaaagugugauagugauaacacuguaaugaauacuucacugacaauauauucauuugaucuugauaauccccacacauagcccauaacagagaaauccuaggauaaucaccaaaucauuuuagacgauaaccggauuaugaggugcaccugucuuuguuaugcccuuugaacagcauaucgccuagcaaaagaaaugcugagacagacagagagagagagagagagagagagaggcaacagcggaacaguauugaguauacaucagagaaauuguuugaacaauuacuaaccagaaaaaaaauaaugaauacacuggguaucuaaguucucaucaggcagaggcacauguaucucauuaacuugaauaucaaccuggucuauuaaacaaguuccaggacagauagagguaccuauuaagaccccgucucuuuugcaaaaaaaacaaacaaacaaacaaacaacaacaaaaagaaucaaacaucaaacaaacaagagagauagaaaaaaacucugagguuuuuucuuuuuccugaacuuccuacaaagaauuaaacuuccagauuaguuuaauucucuauucauauuccaggauccugaaauuccccaguuuaaacugugacauuaauaagauguuacuuaaaggcaauggauguuuaaaguuauaaugaacaaauggaaacauuagcaaaguaaauguuuuucauaaauaaacaacacagugcaggagagauggcucauugcuuaauaugucuugcuggucucagacauaggccucacuugccaguacuuaccacggaagcucaguacuauucuauucacuauuccaaguucaggaguucugaggccgucuuuugacuauagggaggaucaagcacacagaggugcauaugcauucauaguuauucaaacauuucaaaucaaagacaacauguaggaagaaugucucacucuuaaaaucaaaugaaucagaagaauaauugugggugaauugcagaauaacagcauaugcuuggcgugugcaaaaacauacauuccaugcccauaggccaauaauauaaaaacggaaaagcaagguauguuuaaccauauauaauccuagcccaagggagccauacaguuggaucucuaaauucuaggacuuucuagucuacacaucaacuuuuaggacaucuagagguacacaggaaacucugucuuuagaaacaaaaacaacagccaggcgugguggcgcacaccuuuaaucccagcacuuaggaggcagaggcaggcggaauuuugaguuugaggccagccuggucuacaaagugaguuccaggacagccaggacuauacagagaaacccugucucgaaaagccaaaaaaaaaaaaaaaaaaaaaccaacaaaauuaaaauuauaaaaaauauuaggauagcaaaauugaguaggacugagugggaauuacuucuaaacuauuguauuuaauuuaggguuagagucuauaauggugacagcacgacagcaugagaaagaagcugacugaucaauuucaaccacacaacaguagauacaaagaacaggaaauagguugggucuauggacacucaaauccuaaccucaaagaggaauuucaccuagaaaagcuccucuuacacagcuuuaauaagcuccucccugcaaacagucagacaucaucccagacggagauuuuucagucaauugacugcauucugacucuggucacuguaaguucauggucaucccaugaugaaaauaauugcuggguaaccucagugauucccauauucugcaacaacuuguacccuguucaaauguccaaggucucuucugacacucaaggcuucccugauacaucuuauaaacucagaaaacaacuuauaucuuuccagcauacagcggcacagaauacauauugucaucccaauagaaaggaauggguacauaaagaagauuaaaccaaagcaagacagaaccccagaaggacaaacacccaauccuguagcugugucucagacucaugcagcuucagguucaaaggacuuagauggcccuacuccuucaacuucucauaaaucuuccucuuugguuacuuccacucccuacacacagcgguccaugcagaugucucaucacucagaugacuuaaauagcaaaaacugaaauauugaaaucugcaauaacuggaaaacauagaugugccaagaaaugaggaaaggcaagucuuuuuuguuuuuuggguuuuuuuuuuguuuguuuuguuuuguuuuuuuugagacaggguuucucuguauagcccuggcuguccuggaacucacuuuguagaccaggcuggccucgaacucagaaauccaccugcgaaaggaaagucuuuaaagucaagaagaguaaacuaaaacuuucucuacagagaguccccaaaucaacaaaaacucaaggaacuaauaaaauaauauagcaaaauuucaaaguaccaaacaaaauaggugaaggucuaucauuuuuucagaggaacaacaauauaauuauaguuaguaaaauaacauaacacaauuagaugaggguggaaauaucccuaauaucauugauaagaggagacacaaagauaggucuauaaaaauaauagugcuuuuagaaaaauaauaauaacaauagaaaaaccacagaaauauaaucaaaaucaaagaaaucacuggccagcauggaccccgugcacucugguucuuuccuuuaccaauuauagauauuguauugaggguagaggaguauccugauugggagagauuuccuuaaagcauucuaauguuucaaaaacuggacgacaacaguuuuuacugcuaaaaguaucucauucucugaugagaaagaaaaggguaucuguuaggaucacuuagaaacccuuuuguuuccuaugauugaugaugauuggauguaagucuacaccagagugaggaaaugcacacuuuucaaaacuaaaugaaagauaacaaauuauucagcuaaagagcuuguuuugcucuuuugaaaacaaguguauccucaauuuucuguuuguauuugugugaaugacagagaaugcuuuccauguguguacaggugacuuaccagagaaguugucggauccuguggauuuggcauagcagguguuugugagccuccucacuugagaguugcuaucugaauucaggucaacuccaagaagaacacucacugagugaccuucccaggccacauaguauuuuuuaucccauaaacaaacaaacaaacaaacaaagauauuguuugaucaauaauagaaaccuaaugaaugaagaaguaaauacaugaucccugggaaccugaugucucaguauuaagauguuggguaugggacaagguaggaugccuccagaucuuccccagucucuguuaccuugggacccaauacucaugguuggcccuagugaugcagcuuccucuccuacuguccaugccucaggcagacaccacagacaaucccaccuuuccacccuguaauggcugugucuguuugucaacuugacuguaucuggaaugaacuacaauccagaauuggaaggcacaccugugaucuugaucuugaggcugggagauacaaguuucugaccuggaucuugacauggagaucuugcggcacagcagccaucaaaagccagcccaugccuguaaucccaagagacugaggcaaggagaucccugaguucaaggucagccugggacaaagcaagccccagauccaggcauggugguacacaccuuuaaucugggacacaccuucugcuggaggccuacaugaggacauuggaagaaggaagauuggcucuucuucaccugcuuacauuuacuugccagcacuuuuguuggaaccgacuucuacagaaaaccagcugaaaaaguaggccuauaaagugcugaggaacuaugagauucuuggacuucccuaucacagcugaccauugguggggaguuggacuaaaaacuguaagucaucacaauaaauuccuucaauauaugagagacauuccauacauucugugccucuagagaauccugacuaauacacaucucuuccugcugaucucuguguccuagcuacaaacuauggucagucacccccugcuuaaccacgggccauacuuaccagaagucugggcagucuguacaaagucuuaucccacuaucauuuaccagugacuauauucuuacauuuacccuuagcacuagaacagaauaccaggggaagcuuccucucccuguuuaugccuucuggagauaauacauaccaucccugcuuacccuuccuauccuaccucaggucuguucaaccacaugucaugcuugccagaagaccagguaggcugcccacagaucuaccaaugcuaucaguuaucccaaacucaaucuucacaguuguccuaagcaauggaccagaacagcagggucaacuucaccacccucuucauauaugaauagaugauauccuauggauagcuaagaucauaucucccuggccucaucuucaucaagccuccaacaccagcaagcauucccacuugaacacaccaggcaagcaggccaauaaaauagccaucauccagccaacacacucuggaaauacaaagggcaaccagaagcccaggaacaaaacucccuugcaagaugaacccagaaaucaaaaccuagaccgauaaucaccccaaacccagaugccuagacacaagcauaggcagauaaucauuaaaacccagggaaacaggugagcaacagagccaaacuauccuaucccaacagauccugaauauuucaacauagcugaaagcacaagaaaaaguccuuaaaaccaacuauaugaagaugauacagguccuuaaaguggcaaugaauacaucccuuaaagaaauccagggaaacacaaucaaacaaucccaugucucagaaaccuaaaaggcugaagaugcaguuguucuagaauugauaugcuuucccagggagaaaucacuacacucacaaugagaacauuaauuaagaaauaucuuagccgggcccacaccuuuaaucccaggcacuggggaggcagaggcaggcugauuucugaguucgaggccagccugcucuacaaagugaguuccaggacagccagggauagaagagaaaaacuugaaaccccccccuuuuuuuggucuugaaaagccaaaaaaaaaaaaaaaaaaaaaaaaaaggaaggaaggaagaaagaaagaaaggaaggaaggaaggaaggaaggaagaaaggaagaaagaaagaaagaaauaucuugugccaggcgcugguggcgcacgccuuuaaucccagcauuugggaggcagaggcaggcggauuucugaguucgaggccagccuggucuacauagugaguuccaggauagccagggcgauacagagaaacccugucucgaaaaaaaagaaaaaagaaauaaagaacuaaauaucucuuugagcacacaugaacugaucccuggcacauauguagcagaggacaaccuugucuugccucauuggaaaaggcugagccuaauccuggagagacccaaugccucagggaagagggauaaagggaaggggguugaugugggaguagggguggaggagagagcaccaucucagaguaaaagaaggggguagggugaagaacuuuuagaagggguacugggaaagggagcaacauuuggaauguaaauaaaugaaaggauuuuaaaaaggaaggaaguaucucuuuaacacuagcaugugucaagcacugguuacugcucagaggagccagccuagaacaggccucgcauuccacagcugccauuauccucagucucauuuauguucagccuccagguuacacuuugaacaauuuagacagggacagaagacugcaagccuagccacuuaggcagaggggagauuuacacaccaaagacaccucagaaguacuucuuaaguccaucagagaccugaaacagugacacaguccuaaguggaagaucccaaaggaagaaaaggacaagaaaauaagagaguaguagggcagugguggcgcacaccuuuagucccagcacuuggcaggcagaggcaggcagauuucugaguucgaggccagccuggucuacagagugaguuccaggacagccagggcuacacagagaaacccugucucgaaaaaauccaaaagaaaaaagaaaaagaaaaagaaaggaaggaaggaugaaaaaaagaagguacaaaguacaaaaguugggaugggaggucucccaccagcuauauuuuauucuuaugccaagucagcuucuuaagaauaauaucaucuuuuauacuccuuccaacaguauaugaagucagcaggcacuauuacacgaugggauaaaguuggagcagucugcacagcuuaauauuggacucaagacaugaggugacguuuacgacuuucucauauuaacuccaaauauaucuuauaucaacacguuaaaacaaagugcaaaaauuguagaagauacuguagaaacuaggcauuucuguguuugccaucuugccaagguuuccacacacaagcccaugcuccaaaggcuugcgagaugcagccccugggcaaaguucaccuugaagcacagggaggacggaaaccacaaacaaccucaaagguugccuuguggagcugcgguucccacccugccccaggaaggacucaccauacucgcuccaguuguucaaucgccugccccuucccauuggaagcagcugccauauacucaccaugucacggguucagagcucgccugaauuccccucacggcacccagcaguagcacacagagcaggacacacaaaccgcucaagccuccucagcuacagca

SEQ ID NO: 3749 - RNA, 17106 nt, Mus musculus
cauguccugccggaaaucuaaaagacaccggaaauagaguggccgugaaaccuuaaauguuguagucauucgaguguuacuucgcuggcggguccgcgaggugguuuggaacuuuuccauccgggacucuucggcuuccgugggcggaagucgccgucaggcgugccgugugcagagcucucggccgggcagugugaggugaguggcggcggcggcggcgcagggggugggaggacgcagugcugugccgagcgcugguuugugcugaaggacugggcugaggcggcugccggggcucgucagauggggugggggucgcguggugcgcuuucacccuguucccgaggguuucccguaucuuggguguuuugucacuucccaaugugcucuccuguggguuuucacgcagucguccaugaaaguugucagcugaggccauuagggggcgggacucagugagugggcgcugcacgcagcggguccccgggugggagucgggagcuuaagggcgaagacuuugagguggccugugccccacucaagccgugauuggcguaggggucagcagaggcagcgauggagccuagggcgggagugggaugcuugugagggcgacucuggucguuaguguuggcguggccagugacuguggcuugauuccgguuagcacuaugugaagaaaaucccgucggcuugaccaaaguagcaagugucaagaccacaggugucggaacugcgagugcucaggcucucacggaugagggagggagagagggagggagggagggggucccacgcuuugcaugcugccuaguuaucuaggcugcugagcucaagagauuucuucuaagguccguaaaaguagggaaucuuguuuuaugggcugcuuuugggucuccuuuuccaacuaauucguuccuaccucuggaugaccagcauuauugaaggaaugaucccaaauauuaaaaacacuuucacucuuuggggcacauuagagucauacuugggaauccuuuggacauuaugugcaucagugcuugccugucuuugggauccuauacagacguuaaagaucacugguuggcaguugaccaaaauaauauugggccguuuuauuuguacccuaauguuuguguugauuuggagugcuuaaaaaacuguguauuggucugagaggaguaaguagcucauaucuuuaaaucccagcacuaauggggcccaggcagugaaaguuaaaggcuagccuggucuacauagcaaguucaggauagccagagcuaaauaauagaccuugucucaaauacagacacacacacacacacacacacacuuacacaugggagcgggggagggggcacacagacagacauggagugggggagugaggauuggauaagccuguuuuucuuaaugugucuguguagacggggaaaugucuagaaacucacgcuacaaucaaaauuggcugucauccugagcgcuuugugcaacaggaaacaggaaugcuguuuuuagaugcugacuacagaagggacugcauagauaugguggccaggguguuccuuagaaugaaaacagcucgaauauguaccccuguucuucuauuuagugaccuacgagcaaaucaagcagaguaguaaugcauauguguagcuaaaaaguuuguuugaaaugcaaucaaaauuaaguuggcaacguacugauuuuuuguaaguauuuuacuuccuuucaggcaggugcugagggcuuagugagccuucccuagcauggcauucuggaucccuacaauaagcaccuauguacucauuuuguaaugacuaaguuaguuagcacauugguuuucuacuaguuaacaugugagugcugcaguguguccuuccuuccuaauggaugguuuuuuaauuuuuuguuuguuuucuuuuguuguuuguuuuagaacccagacuaauaacaagagcagggcuuuuauguauccucuacacugccuacaccuguucuuccauauaggcccucaccaauucauggucagauguuugguuguugucuuuuagugauuuccggugucucugagaccacugcaaucauucaggccuaaggauuuccuucugugccacagcuagcccuucuucaacguccaugacucuugagggauuuggauuugcuacgaagaaaacgucaagaacagaagacagaggggccauggcugcagauccaaauuuccaacagaagagccagccauugggugcagaggagcagccugaguccugugagguaagcaggagugacuucaugauugguucuucgggucuucagggcagacgcaggaagcugcagacuucugagaccaucuuaaucucguuaggaagggacuauauauagcacacacuaaguaauuaccccucacccccuugcccucucuuucuuugauacagggucuuaaugugaggcuggccuggaauucuuucauauagcccaggcugcuaucaaacucaacuuuuucuuuuucuuuccuuucuuuuuuuuuuuuuuuuuuuuuuuuuuuuuuuuuugccucaaccucuccaguagugggauuguuacaugucuauaccacuauagauaaugucucaucuacuuaaugucaaguucuucuuccucuugagcccucuuuuuuuagguuuguuccucuuuuacaucuugccauccucaguucuuuuuucuuuuaaagauuuuauuauguguguguguguguacucuguagcuguuuccagacacaccagaagaaggcaugaucccauuacagaugguugugagccgcccugugguugcugggaauugaacucaggaccucugaaagagcagucagugcucuuaaccacugagccaucucucuagauccaauccccaguucuuaaagcuuuccugcugugcccauuccuguaagaaaugaugcaucugaggagguagaguuuucguuugucaguucuuagucucauggaucuguuuuaaguugcauguucuguuuuagggaaaacagaacaggguaacaaagcagguauccugaaaauccuguaguugcagggaggagggcgauggaggagacuuaagccuuauauacaggcaugaggccagugagccacaguagaaagggacagcuguggguguagcauuuucagagaaacugaggaagcccaguauuucagagaaaucaugcuuaguaugcuuuugaaccagcauccgagaaagagaaggaaaaguuaguuuccguauuagcacucagaaaagccugaagcuuaacagugaagaucugcaagcacuguucugagggagccuguuagggugauaauuauuccucccaacuauuuaccaugucuucagaugaaucuacuuuucugguggcuguccccugcccaaguaaugguagccaggaguugaauuaacucuucuccgaugggacaauaguuuauaaaguucagaucuuuggagcagaucagaaugucccauuuccacccugaacuagauaacagcugagauuucauucuuuuagacagcaggaaguaguuuucccuuaaugagccuuaaugagccucaacgagcuccgagacugacaccuuuuuaaacgguauuuuaaauccgaaagaggaacaguuguguuggucugcggucugguuuuccagggaaagacuuuaaaguuagacuuucaaaggaaagggucagauuucagccucucagauugcuaaucucaauaccuaacugugugugcaauucuuaucagaucccucuuccugacagcuguguccaaagagacuccagcugccuguugguccauacauuuuugcuugaugcacaacuguuuuguuuuuuuuuugaagaguaguguuacggguuagauuuucauugugcuaauauuuucuccaaguguuuguauguccuguugauggaguuagcagcagcggaagcagcagggcuggcuuccugugugcaggcccaguccuaauccucacaggaggcuccugagcugaugcucuugccccagucuaaaaaagagaaguuggggcccaggugacacagccaguugaacucaugugacccagcugccagccuggcagugugcuccagggucuggcugccaaucccauucccuguccccuaaguagacuuccuggccuuggugcucuacacucugcauuguccugcuagcccucuauacugucaucugagaauuauuuuccuuucauguguccaaggcccuuaguccccaaaucacagcugcuuugaauuuuuguugugucucuugcaggaaggagcuccuggggauggguguauaagcaaaagcgcaguaaaucaccagacuagacuccuccaugcauagaaagaaaaggcuauuggggggcaaacuguaguugggggcaggaggagaagaggaaaaaaaaaagagcaggauuuauguuagcaggguggggucuuucaacuaaugcagacuguucccaagugaccaggaggccaagguaguuuuccuuugagggggaagauuaaagaucguuuccaguaaacagagacccacuuuuaaacuaauguuuacccagccaaauucuuuguuuaucucugggacugccguugguagggcacugcugugcucuaaacuggagcuauucagguaaauccuagagacaaacaccauagauuuagguguucacuuuuuuaacuuuuauuucuuuucuuuuuuuuuuuuuuuugucuguuuuuuaagacaguguuucuugguauagcuuuggcuguccugaacucucaauguagaccagcuggccuugaacucagaaaucugcuugucuccuucccaagugcugggacuaaaggugugugccaccacugccuggcuagauuuagguguuuaaguaaauaucagaguuaaugugccuguauuugaauguaucguggaaaugcuauuucacuuuuucuugcauauaucucuggguaggcuuauauugugggcuggaaaucuccuugcucuaaaaccuucugucguuuacucuaccccaaggaugcuaccauucagauguuuuacauauacauugagacaaggucucacuguauaucccuggcugggcuggaacucacuguauaguccaugguuagccuucaacucagagauucaccugccucuuccucccaauuaaagauguguaccaucaugucuaacuaguuuuccauuuaaagcaucuuauuacuugugugugucguaugauuaugugauugccuuuuuugugggcauggagcucagaggacacuuuauagaguuaguucuucuuuuucccuguauguggguuccagugaccaaacuuggggucaggcuugauaggcaagcaccuuuacccacugagucaucucacuaggcccaauuacugcuauuuauugaaugaaaaaugaaauaaaaaguggaggacaugacuucuccuaaaguaugggcaagauuuuuauuguagauacaagggagaaagcaggcagagggaagagaccaggauaaacauggcccacagacuaaaccaugagaggagagagguaggagggagagcaaguuggaagcugccagccagggaaaagaggccaagaaaguguagaguucuguacagauucagcuaggauaagggaaguggaagcccugcugcugggacagagguuuaggauaggaggcaggaggcagaacaagaagugcugggaggagccacagguacugaggagugcugggagaguuggccagcaucugucuuguuguuuuuuaauagauucauuuuauguauacgaguacacuguagcugucuucagacacaucagaucccaguacagaugguugugagccaccaugugcuugcugggaauugaacucaagaccucuagaagagcagucaguuagauggcucuuaacugcugagccaucucucacuccucgaccauuugugguuugagacuauuuauuuauuuagcaagauucuugcuagauagcccuggcuguccuggaacuuguuauguaaaccaaacuggacucaaacuuacaguaauuugccuauaccucccacaugcugacauuaaagguguguucuaccauaccuggcuauuuauuuuuaaagcuuuuaaaaauauuuauguguuggcuggagagauggcuuagcguuuaagagcacugauugcucuuccagagguccugagcucaauuuccagcaaccacaugguggcucacaaccaucuguaauggaauaugaugcccuuuucuggcgugucugaagacugcaacaguguacucacauauaaaauaaguaagucuuugaaaaaaauaaagguuaaaaaauuaaaaaaauauauuuauguguuugugcuugcaugaguuugcacauguacacugugugcaagcaggugccugaggaggccagauaggauguagaauccacugaaacuggagugagcuaccauaugcugggaacuaaaacuaugaccucuuaauugcugagcuaucucuccaauacuuuuuauuuuuaaugugcugcuucccucauucuuuugauaauuuuuaauaucauuauuucuuugucacgugucacaaaguguggaugucagaggacaacuucaguuggaaaucauuucuuccuacucuguggguccugggcauaaaauugucagucuugguggagauaccuuuaucuacugagcugucuuuuagcucaguuacuguucuuuuuuaaaggauucuagguugcuagcgagaugacucagcaguuaagaacacugcuguugagcagacgaagcagguucaguucccagugugguagcucacaacugucuaucauccaguuccaggggaucccauggccucuucuggccuccugugcauacggcacacacauggugcauaugcaugcagaugcaaaacacucauaacauuuaaaaaagucuuuuagggcuggagagauggcucagccauuaaaagcacugacuacucuuccagagguccugaguucaauucccagcaaccacaugguggcucacaaccaucuguauugggaucuuaugcccucuucuggugugucugaagacagcuacaguauacucauauacauaaaauaaauaaauaaauuuuuuaaauaaaucuuuuaaaaagcaggauuucaauuuuuuuguuuguuuguuuuucgagacaggguuucucuguguagcccuggcuguccuggaacucacuuuguagaccaggcuggccucgaacucagaaaugcgccugccucugccucccgagugcugggauuaaaggcgugcgccaccaccaugcccggcuucaaaaauguuuugauguuugauuaguggcacauagaccuguucuugcacuuuuguaguauuuugaaaugugacuuuucugaauggagaguaugaaaauuaggcuuucugugucauuucacuuuauccugugcaaugucugcuggugucuuccauuccuguauugucugggugucaucagcaugucaugguccuuaaccgcuuuguuccccuuccccagucacucccucucguagcucaaaguucuccacucuccucaguguaaauuccuuccuugugagagaggcaaggcacagagugagaaaguuuucuuuuucuuuuugagacaaggucucacuggguagcccuugcugggccagacuuaguucuguagaccagguuguccccgaauucacagaaaucugccugccucuuccuucagaguggcuguauuacuuguaaaagcuuaguccauauaaaauugaaugagcaagggacuuguuugugugguucaggaaacaggaaaagcuaagcuuccuccauggcucccuccaccggaaugucuaaaauuagccacacuaaaaauaucaaguguagaugugccugugucccaaggaagcagaggaaugcucuuggagccacugcugagaguaucacuuaggccaguuuggaaaacugcagucaaguuugugagguguguugugugacacccagcauuuccacugcugggguaaaugcagcgagguagauagagcugugcaggcucagcagucuuacugaucacugcuggucagcucauugagagcagggcauuugcuugcagauuuaauuuauauguucauaauauaugcuugagguuacacucuaguguccauuuacuuuuugagcaucuacuuaccuggucuuucugcuccucacucuuagucgucuuuguuucuugguagggucuuauauaguccaaacuagccucaaacccccugugcaguucacaguugucuugaaucccucauccuucugccuccaccuuccagggcuugggauuauaggcauagaccaccacauauggcuuuuuuucuuuauuuuuuauugcuguuugcuuacauuuuaguauuuguaagggacuuuguugauuuuccuuuaugauaucuuuuuuacuuguuuuuauuguuuacauuauuuuacuguucauuuuuacucuuuauaguuaucaguguuuguuccuucugaguuuuuugauauguuaacuuuuuucuuuauucacuuaaaaaaaauucucaaacuagcuguagagcugaggccagcucugaacucuuguguuuuugagucaaaggcuccccaugcuucucccaguuauuaaggcuuugaagucuuagcauauugguuaucugaaggcuccacugucaugagcugaucaucuguuaaagguagcugugaauuuuggaggugcaugcauucucgggagcuuguuuugguuuugguacagguuuucucucucuuguucuggcugugcugaaacuuacuauguagauccagcuggccucaaacucagagguccaucugccaacugccuuagaagugcugaaauccaaacuguguaccacuaagcccagcugugcaggcauuccauccacaggaugaaauauauugaaaauuguugacuccuccaaaggaaacuucucaugguaauauaauuaauugauauuuucccuauuaggcauuccaauggaauauuucuggaauuauccauuguagucacagugauaugccugacauguuaauguaaggaauuuuaauacagaauauauuuuacacagagaagcagcauguaagugacagugcuuugccuguuggcgggugucacuugugucagacuagaagaucugucaaaaguacuugcagcucagaaagaaauagcacgugcucaguuaugccuguggggaccugaagggugucaguguuguauuauuaagauguucauacauaaguaaaaguagaaugaauuguguuucuaaccccuucuuugaguaacuucagcauauucccauccugcucaucccuuuccauugcuagguuauuggguaaccaaauacuaaaggcuauccuuuucuuuguguguuggaauuuaucccagagaugaucaccuuuuuauauaaccauaaguuauuuuuaacaucacuguuccugcuuauacuaucauaugcauagucucccucaaaagguccagccaagugcccacacauauagagucacuaaaaaguauuuuagucuuuuaaucucuuauuuuuucuccuguguuaauuacuucuuaagaacuuguuauucuaaagaauaacuuggguuauccuuuagauugugacagguuuuagauuuggcucaguuacuuuuuguuggugucacuuacaugcacucugguccuuauaguucugguaagcuggugucuaauauaaacauguacugucuagugugauggugacacauggcaauagcugcuguuggcugagggagacucagagcaacacugugcacuguguaacuugaguccauaucagagggguauuucauuuuguauguaugaugaguguuuuugcuuuuauguuaaugugcacagugugugugccuaaugcuuuuaggaaccagaugagaccaucagauccccuuaaacuggaguuacagaugguugugaggcaccauguaggugcuagaaauugaaccagguacucuguaagaacaaguguucuaaacugcuaggucaucuuuccagcccuguuuuuuguuuuuguuuucccucuucugccuuuuauaguccaagaucucauacccuaagaauggucucuucuguaauuaggacaggucuucccacauuaaguuaacaauuaacagugaccaucacaagcuauagucagguagaccaaggauccugaguugaccuguagaaaauaguuucaagagguguccauaugaacuuaauuuggaguuucugaagccaagggccauaaagacacccaaaaccugugagagcuuuggaagauggagucaagcuuacauuuauuagcacuagcuauauguaagauuuuguggucuuugaaauuaccauguucaagugauguaaucugugucuaagguugguguauuuauuuuugaguauucuuuucgaggugguaugagaagucuuaugagguacauuguacaaguguacagagagcaaggaguguuaagauaaauugcagguacauuucuuacuuuucucaccugggcaaaauacuuaauggaaacaucuugagaaauuauuacacagagcuagaaggauaacugcaguuuuagaccauccugauuuauauaacaaguucugggccagugaguuccaggccagucgggccacagaaugaaacucuguuugaagagaagaggagggaaggagagagagaauuguugauuuuuguacuagggaucaggagguaggaagcuuguuuucauaguugaucgguaagcagcuacauguauaacuaagaagaccuuauuacaagagaggguucuugguuacuucugcuuuaguauacaaccucaagagaaaaaauuaaaguuaaggacaaugaccaaucucuguaucuucaucuuugaaggggauuaggguaguuuagacugguccucuuugaguacuaugugcuaaucuguagaggaagguaggugacccagagucaagaagacagauccagaaugaagucagagaugucagguuucaucuggcauuuaguuuccaagcaagaagucaauacuuaaagcagcuucuaaaugccaauuucauaauguugcauccaguggauccagcauaacuaaccugggauauuguugcuuaauguugugcuguguguucuuucuuagacuauuaaaaagaaauccuuuucuaauguacuuaagaaaugugauugugcccgggcaugguggcgcaugccuuuaaucccagcacuugggaggcagaggcaggcagauuucugaguucgaggccagccuggucuacaaagugaguuccaggacagccagggcuacacagagaaaaccugucucgaaaccccccaacccccccaaaaaagaaagaaagaaaugugguuguguaugauggauggaaggauugguuccuuuauaagcauucucuaucuccccaaauuaaugaaaaguagauauuuugugaaaaauaugugaaauaucauuaaaaacuuaaccuuauauauauaacuuuuccauuugccaaugacgagucauucacagugaacugugguacauuguuacagagauggauguccuuugaggauguaacugugaacuucagccaggaggaguggcagcaucuggacuccgcccagagaugccuguaccaggaggugaugcuggagaucuacagccaccucuuggcagugggugagcacggcuggcuggggacccaggguggaccuuauugaggaaagauguucuuccuucucuuuccaaagcauagugagguaucagaaguguaaucucugucagucucugucucucuuccuuccucccuuccccguccccucugugcauguguaugugugugcgugcaugcguguguauuuacuucauuuguccuggugcuucauuucuuuuguucaccuacuaggauuuauacaaaauaagaguguugacuugguuuucccaaugagguagugcaaagcuucauugcaucaucucuaaaagauaagaaacuaccccaaaacccaauauccuuuugauuaacaggguauuccauucccaguccuggagucaucuuuaggauggaaaaaggaaaggaggcacagacagcaaaggcugaauucccaggccagagaugucaaggugagccauugcuucccaagucggguagauuucaugaugccuuugucaguugucucaccaaguccucagugguggucacuauuagguuguuuucuccuuggaguuuuuauuuuuauaauaaauucaguccauuuaucauugaugugaggcgaugugagacuuucugaaagaugaguuugugggaugagcuugucuguccauggagaggaguaaaccuaaguggacuaccucaggcauuuucuucuuacagugaccgguuauauucccaugcguaugugcacaagaauuauuugcacaucuuguuugugaacaccuggcaaguugguuaauauauugcucaaguaauggggaaagaacugguuguaauuugugucuucuacuaucugacuuuugaauuaguauauugucuuuuggguucuuacugucauuuguguugugucuaugauuugcuuucuguguuugucucugauuucauugauuuucuuuccuagacugguucauuuuuuccaguuaguuguggcaccuuaggcuugguguuaauagguuugccuugaaggcucuguuuauucugaacaagcaguucucauuguuguauuaugauagacuucuuaguccuugagcuuacagucucucaugccuuguuuagauaugugagcacaguuccucuaagauggucccuuuccuucauuuuuggagaucagaaauugggaucuucuucauucaaaucagaaaggccuuuuguuugacuaaucauuuuuuucucuuaugggccucugaacuauuuucucuugauacuuuauuuuguuaucuugcaauuccuacuuguuuuucuuuuugaauacacaauuuuuuuucuacuaauuguuaguuagcaccaucaacaucauuagaaccugauuuaggcauuaauguucaaucucaguccaucuguaugauuuauucauccuccauccuauucacucugcuuauuccuccaucucuuucuguuuguagaaaaaucaggaaaugauaccuuaccacagaaagcaucugggaaaacaucaguuuauagcaauguggcaagugaagugacaagagaugguucaugguguucccuuuuacaagaacuauggcagggugcugacauuacaaagagaggucaacaaaaccagauucuacucuucccuccugguucuuuccucaagaaaacucugagcaaaaauagugaucaugaauaucaaaagcccagggaaaccauuccuuugggacccuaccucauuucaacacaagagggucuuccacaauaucacucacuuccaaaaaguuuggauguaagccuaggagcaaauggucauaaugaaagagaucagcucauugacauuguugcauccagucaacuccuuauaccaggcuccuguaaugcuaacugugugguuacucauggaggagaagaaucauacagaaguacugggaauggagauguucucagccauaaacaaccacugaucuauggaaaccguuuucaggugaaagcagaucaaaguucucagugccaggagguacucuaugccauaucuuugcauaaaccugagaucacucucacuguggacagaccuauuguuuccuacaaugguggaaaggcuuuccuuuaugugucagauucacugagccauccauuccagcugaagguggaccguguaguucauacuggaggagacccuuacaaguguagcagcugugagaaauccuuuuguaaugcagcugcacuccaacagcacgagcaaauucacacagaagagaaacuguauguguguacucuguguggaaaagccuucagugaugggucagcuuucuaugaacaugaauugauucacaagaaucacacaccuuuuaucugugacauuugugggaaggccuucuuacguaaaucagaguugacaucccauaaacaaugucacaauggagagaagccuuacaaaugcaaugacugugagaagucauuuaaauuuccaucccaacugaaggugcaucaucagauucauacgggugagaagccuuaugaaugccgugaaugugggaagucauucaguaaaacagccaaacucaaggugcaucaacggauucacacaggggagaaaccuuauguguguucucaauguggaaaggccuucaaucagaaaucaauacuagaccggcaugagaagcuucacccuggggagaagccuuacaaaugcaaugacugugggaagucauuuaauuacccaucccaacugaaggugcauugccauagucacacaggggagaagccuuacaagugccaugagugugggaaaucauuuaacuuuccaugugaacuaaaggugcauuaucagaaucacacgggagagaagccguacaaaugccgugaauguuggaaacuguucaguaaaaugucccaacugaaggcacauuaucgaguucacacaggagaaagaccuuauaagugcagccacugugggaaagccuucucuacuaaggaacaaguccaagagcaugagcgaauccacacaggagagaaacccuuugugugcacugaauguggaaaagccuucaguagcaggucaucuuuucguaagcaucaguuaauucacacuaaagagaaaccuuuugucucucagaaaugugagacaggccuccaggaggcuacuuugauaccccaucagcaacuucauauuggugagaagccuuacaaaugcccugauugugggaaguuguuuaauuauccaucccaauugaagucacauuaucaaauccacacaggagagaagccuuguaaauguccugacugugggaaaucauuuaguaaaacaucucaacugaaggcacauucucgaauacacacaggggaaaggccuuauguguguucugugugugggaaggccuucaaacaguugucaacauugaguagacaugaaaaaauucacaugguggaaaagccuuacaaauguaguuucugugggaaguccuuuugcucuccaucugaacugaaggugcaucuucuaauucacacaggggagagaccuuauaaaugcagcagcuguuggaaagccuuuuguacuaagguccaacuccaagaacaugagcgaauucacacaggagagagaccuuaugugugcacucauugugggaaagccuuuagaagcaggucaguuuucucuaaacauaaguugauucacaggaaggaaacaccuuuuaucugugagagaugugggaaaguguucuuacagaagucagaguugacaucucaucuacaaacucauauugaagacaaaccuuaaggaaugucaagacuggaaaaugguuuagucagauacacaauagaguguguaucaucaaauucauacaagacgccuuccaaaugcagcaacugggaaagucuuggcuucuaaugcccaacucugacaguaugaacaaaugaguucaucuaggagagaccuuugugcucugaaugugaaaaagucuucaguagcacauuaacuuuauaaaaucaaaugucucauacuagcaugagaccauugucucucacaaugugggucacauuugguauuggguagagaaacucauugaguaggcuuuggaaugucaugacuuggaaauuauuucuguaucagagauuagucccaucaucaguucauagauggggaugcccuaaguguucuaaaugaaggaagguccuuaacaggucacaauucaacauauauauuauacaacucauaccacaauuaguuuuuuacaggugcuguucuacauaacagguuuuacugagaaaugaauuccuagcuuauuagcauauuccaaaaugaaauuucuuuauuuacuugaaguucauuuuaugcugagaucuaauugcacauugccuaauauuacagaaaacaaauuuguuuaaucuauugauuguuuauauagcaaacaugcaugaggaaugucacaaauuaauaaugauaagcacacauuuauauuugucuuguuaaacaugaauuucauuucacauugaccuugacuaguuuuagaaguguuuuuguagaauguaagauaagauacauuuuacuaaaguauuggaaaguuuaaggaaauuuaagucauuaagauauugucauuaauuaagucauuaagauauccccauuuguugugggaguccaguaaaacccuuaagugccagccauguaaaggguguuuuuauaaaugggcauauguauguauguauguauguaugaaauauauauauauauguuuguaaguauauguacacaugugccuguauuuagucagugccuguauggacuuguauguaaucucaaaauuuuguggauuuuucuauagaauuaacugcaaaauagaaagcaguaguuuauuauuaaaagguacauucauuuaucuuguauauauauguauguacaugugcugcuagguauauguggcugucagauaaguacaucaaugagagucauugaucucgcaccauguggauccuggggauugaauuuggauuuauuagacuugguaaagucaucuuuacccaccgagccaucgugcucuguaguuauuuuuauuuaacaguuuccauauugagcuugcaccaucaauuuuuuuauuauauggauuucuuugaauaaaugaggucuuaaggcauucacuguucauauugcuuuuuucuuuugaaauuagcuugggucuaagcagcuuuuuuuccuuucuaucuguagcaugugugauaauauuggaaccaacaauucggucauauuuuuaaaagcuauuugugugugaaugcugguauugugagccauggaguuaagaagacaacuuccaggaguccuugcauacagaaucugucuuuucagacacugcauuucaugguccaagauaguugugugagcgcuuccagaagauacucucucuucuccaccaucuauccaucuugacguaggagugcuuuaaauaaagaugugcaccacagca

SEQ ID NO: 3750 - RNA, 2555 nt, Mus musculus
cgaggcuaaaagccauuccuuuauucugccccaggcaggccgcauucauaggcauaccgggaauccgcugauggcuucggugcucugcaagaucaugucggcaagcagaaagcagaagccuggcaggaagggaguacagagcccggggaaggaaggugggcuauggggcggaugaucuggccugccugggagcuagggauggggguuccaagggcguuuccaucgggugucuuggagugcaggggcggggaagucacuggaaguuauuguggacuuugcuaggaagaauaggugacugggaaguuucuggggaggggaguccucuagagggguagucuccacccucuuccccucgugcugguuacccgcaauaaacaagaaggguaaagccaaccauccgaaaaaguaggaccaggagaagaagacuucuggcuuccaggcauucuuugaaguguauacggccaaggcaaucagcagcagcaacccugggccacgcccacccgucaggugagcguggccagguagaagcugcacccaagcccaccccucagaacugcccuugucucugacuuaucaaaccacgcccagcuucccuuuggcuucaccuucgugggcuucuugcuccuccucuuuucuuuuuuuauuaaaaauagauucuuccuuuauacaaucuaucccgaccacaguuuccucucccucaacgucucccagcuucccucaucuccccucccacacuuccuccucuucagaguagaguaggucuccaagagaggacagucaaacaggacaaaaagagauacaaggagacaaggcaaaagcccacggaggaugggcaagagaacgcaacaggaggcgaagagucccaagagcagaagaaaagagucagaaacauccccacugucagcugcccccuggccccucccauuucuaaccauggcagucaaacucucucggcccaacuccuucagaauugccaccaccaccagcaccaccaccaccccuccuacauaggggugacugccuucucaccgcugaggaaaaguaagacaaugguauucuggcuacgucgugacucugccucucgacacugaauccuuaucccgauccccaaagcuacaauacugaagguugcugccaacaccaugcacgcugcggacacugccacggugucuggagagacaggguagcaucagcuagacgccuuggugccaugaaagaacaucccugggcucuucuggccauccucaccccuacacacacacacacacacacacacacacacacacacacacacacacacaccaugaguaucuagagcucaucugacugcauuuuggaaacagguguuccuaugggaacggaggacuugguagggagaggacagcaaggcaggccuggggagaaagagccuuuggguaaaggacaucugggucugcgccugguauggaaggcccaucuggagcuagggguaggggugggcucuggaguguggucugauauagaggcaggugaaggucucacucuggcaggggauguuggagcauuugccauggguacacuccugccauaggccacugugccccccuugcugucggguccaguaguuggugguaguagacaguacugugaggaugcugcucaagagauuaaguaaauucccuccagucugaaggcucuucuucacccccaugccaaggaggcagcugccaaggacaucacagguacgacuggcucacaccucucguuaggaggaagcucuuccacgccagaaggccucccccccaccccccgccccccaagcacucuugccuggcaaccucaacguccccaacagcagccacuugccugggauccuagccucagugaggcugaggcaagacaucacaagcccaagggcaggccaugaguaauguaaugaguucugggccaggcagacuacagugugagagccuaucucaauuaaaacaagcaaaacaauacaaaauaaaagaggagcaaggaagguagcuuaguaguagagugauugcccagcaugcacacggcccugggcacauuccuuaguuuaauauaaaaccgucaugguggggcacacgugucaucccagcacuugggagauaggggcagaaggauuagaaguucaaggucauuuuucacuuacauagugaauucaaagccagucuggguuaugugagacucucucaaacaaaacaaaaaauuucccaauauccccucaccccaugcuacuggccucuuccucagcuaccuugccuaagaacuuaugaccccccucuaagagacucaguucuccaagugucuccauccccaucuccaccucaggccuagugacuaacuuucaggcauuuucuuccucagugaggaagguggcccuauuggccccagugccccccccagcccuacccguacacauacacaccccagaaaaugacuuacagccugguccccugcgacaaagagcccgcgggguugggggaagggaggaugguucucugugaggcagcagauauuccagaaucuucuccccuagcagccuucua

SEQ ID NO: 3751 - RNA, 6289 nt, Mus musculus
aucuuucgagaaaaaguuuuauuucaacuuacauuuuaggucacacuccauuacugagggaagucagcaggaacugaggcagaggccaugagggaacacuacuacugacuggcuuacucagccugcuuucuuauaguauccaggaucaccugccuagggacuggaccgcccacagugggcugagcccuuccacaucaaucaucaaucagaaaaugccccacaagcuugccuguaggccaaucuuauggaagcauuuucucagaugaccccagccuguguaaaguugacaaaacaaaaccaaaaaauggccagccaggacacuaacucaacaaccaugugaaaacuacaaauuugguucagaaccuaucagcucagcagaccacuggcuuccaaagacccacaagcuaagaaagucaucagauaguuccucagacugacagaagggauuucagcuuugcuauaaccugucuaccugcaguucacaccgacauacuugaccaaugucuugauuaaugacuuucuauuguccuagggcuguaaacguuuguguaacugcucccacggcaguuucccaggcaaccucaauucacauacccgcccauggaaggucccaacugguucagaacaaacuuucuccaguucccguaggugcgagagcugugccuggaugagacggguauagugacgauugugaauauuccuaguacgcaugugacuuuguuuaccugacuugggaaaacagaaaaggagggccagggcucucugagcccacagaggugugcgggaaugcauggguguuggucccuucucucuuagagcugguagcugugccuagagcgcccuauacuucaagguucauguugcucuacagggcccauccuuccaugggguacagguaggacacggggcucagguugcagggcacuggacacuuuaaauaaucugcagggcucaagcgacucugcaggguacagccacuccacacggaaacaggucagucccaaggugccgugcacugaagggaaaucacuucacaguguauagauuacuccacaguugcagggcagugggguacaaucacuuccccggacacagggcaauguagagugcagagcucaggucacuccgccacggggcucaggucacacugcgauacacagguggcuccugcccgguccccuccauucccaaggcucaggucccucugcgauacacagguggcuccugcccgguccucuccauucccggggcucaggucacacugcgauacacagguggcuccugcccgguccccuccauugccgcauggguuggcuuuaucuuucgguugcuugcaggugcaggguccugcuggggccacagggucacuggugacuaggcuuggguucccaggcuguggaggcucaacuugcagcacacggcggcccuugccgauggccaggcgcggcaggccucgguugaggccauccaggagggcacaggccuggcagagcuuguggcuggccagggcuccgcagcgggagcaggugccuggaggagggggcuuugcugccggagccagagcuaggcgcucugccgagugcacgagguccagcacggcugauggucuggccgccuccaggagcuuaagcaggucccgggcaugaccacggaaggccucaggggcauacacgcacuccucggaaaaguagcggagauggcggaagugcgcauacagcaccaccuccuucugcgaggcaaacugcagaggccggcaccugggaagugcgcaccccucgcccguggagcccagcaccccaccccucgccagccucccagcaucaccacgcaggaaguucaugagcaccgucucagccaugucgucagcguuguggccugcgggagaaagagcucaggucaggugaaggauuaggacaaagaagagaagguaaaaagucccagcucauuuccugguuugaaaaguuaccgaaauccaccaaucccugagccugaaaacccagcacucugacuugaaaugucaccaauccccaccuuggaaaucuucacccuguaaacucuuccauguuaaauacucuaagccgguccccugcucaguacuccauggcuucucacugcagcagaggcagccaccuucuugugucacuuucaaucaaucucuugugcgagauuuguuguauggugugacucugugauauuccuuggcuccugacugccaagauaccuuucccccucagagcugugucaccgcacucauagccugcuguugcucuugccaauggccagacucaguaggccccagcugaggcguguguacaagccugguauuuacacgaggaggggggccccaagaagcccuggacaacaggaaaaguggagaagaggccgggaaccccuggagcagaugagaggacccgguagauccucccuaaggagaaaauguaaaagggaccauagagacacuggggccugggagaguggaggugggcguuggaacgaacacucagaacccagagauaaaaaggagggacaguggaaguucucagcaccauaaaggggggggggggaguggagaccccagcccaccccacuaucuugcacuuccuggcacacuacucuuccacacccacaccguuccugcugcacaccagugcucaccugucacaauauguguagcucccacaaggcgcgcacccuccuccagcgcgcgccuccgcagcaccccgcagaaggugcagcaggagcgacugcggccggagccugcggugcugcgggccacggcguccaucguccagcccccgaagagaucuucguaggccacgauggugagcggcagcucccagcgcgccgccugacugcgcacugccuccagcgcggcgucccgguagccgccgaugcccucauccaccgccaccaggugcagggugaugcccaggcggggcgcaagcucacgcagcacgugugccagcacuguggaguccuugccaccagaggcacccacggccacuacagcgcccggcggcagcaggugcccggcaagcacuguauguagcaccucagccucaaaggcagcacagaagcaggagccgcacagcgccugcccagaacgugggcgacggagggcagcacgggucuugugacaggagaagcacgucggggcgggcaucuugaaagagaacugggucgucugagaggucuacacuguggaggagagagaagggagucaucuggggagucuacacugcaggguugacgggagagaagaggggaggggaccacacaagauacccaaaagggaagcugguuauccaggauaucugcauuucagagcugaggggagaaagaaguggaucacacggauagucuguguuguggggaggcuguggagauggcguccuacugaguggcccugacacaggggagcccacgggaagggcagcuucuuccuauaccaagaaaauaaaaacccgacgacaggguuucagggagacagagggggaagccaugcaaaggauagacagaauggaauugugucuguuuuaggaaauggagcacaguuuugcagucacucuugcuacagucucaaucauagacaacuuccagagcugaccagaucccggaagagcuugcuacucggaagcagagggcuccagauguuuggauuuuaguaggggagguaagauacuggaaccccgcaugagguccugauugcuuccccuggaaggcauaguggccucuucuaggcacacagaagcugcgugcaucuccucuacaucaccagcuguaaugaaucaguaaaaucucuccaagcucaggccucucccccagaccaccucaucuccagcguggacuacccgggagcaucccgccuuucagaacaggucaggcugucccugggauuuaccacaaugaccagaaugaucuggcaaauauuuguuuacugucaggaacuuccaugaggucaggaccgguaccacugagcacugcaucucaacuccgaccucccugauuccuuucaccgaaugguguccugcaguggagcucaggucuguccuuccagaugcucagacuagaagcccugaggucuaggaccacucuggucacucauccuguguggggcucaaaauucaaaguccagucuugacuuguucuccaaaggucccuaguccauccucagaacucaugcucagauccccuaaaaggauacagccaauccuucuguggccucagaugccagacacuucccaccuacuccauggccagggcugcaguagaauucuaguaacucgucaggagugguaacgcacgccuuuaaucccagcacuugggaggcagaggcaggcggauuucugagcucaaggccagccuggucuacaaagugagcuccaggacagccagggcuauacagagaaacccugccucgaaaaaccaaaaaaaaaaaaaaaaaaagaauucuaguaaaucgcuguaucuaggguaaacuuuagaaugaaaugguugucuuucaguguaccaagaauagacaucaaaaugaauuguucucuagaaguacuuugaccuugaagacgucaucgcagaagacguagaucauuuucuauugucuaugaaguuguuuucugaaggagcuuuagggccuuggcaugacuugguacaagacaguccugauacauaugcgaugucuugcauuauugaguacagcaaacaguccacaagagggaccaaaguuucaggggugugauguuuccuuugaugaggaguuuugguuugagaaacuuuuuaacccccccccccaaaaaaaacaacuuuugugaagaaaaaaaaagacuaccuccaccuaaaucuucacauauuauuuaacuaugcaaccuaauucuuauuuuauuuuaaaaguuuuucugcugcccagaaguaccuguccuaaaggagacacaaccuaaaguaaacgcuaaauaaaaagaaagagccugacguucaguucauugaggcuggaccuccuugcugccuuggagcccgauuacauucuaaggugacccucauuguuugauuauccugcacaacucagaacacuggcacagccugcuugucugggucacuggucucugccuuggccuccccuccuucacgacaauuugcauauaacaaccugcagauccagcccaguuaccuuuuugacagguccgugaaugaugcuugggaggccccguggcuccuuuccagaaugcucucaaguaucccaggaacacuccuuuccucuggcccaaagaguucuuucugaucacugaacccagcaagcagcccucaagacuccccuaacucuccuggcugagcacugccccuugaacuauccuccucagccuuuguuucuccccuuccucucgcccggauuagguucacaccagucucuccucacuucuccucacgcccugcccagcaagcccuagaaucaucaggcucagaggugccuccaggcuugaccuccuaacgacccacuuaggauccuugcagggcaccuuucaagugcuccccaaaucugucccuucugccuggcuuaucugucuccugagagugcccaccaccuucuacccccgcauuuaugcagaauggcguguaaauacacucucuguucucagucaucuaauccugugaggggguugcuauuguaaggaguagcuuacagacacacgcagaaacagaaaagggggauaccacaucaguaguagcccugagaucauggagggaaccugguugauagauauaucaguagucuuuagcugacggagcgaacagggcuuaugcuaauuaaguaaguaucugggaugaugggggaaagaauuguguacagacuggcggcaaacccccgagguaauaacaggcgugguggugcacgccuuuaaucccaacacucaagaggaaguggcaguugaauuucugcaaguuccaggcuagccugaucuacaaaacaaauuucaggggugccuccggguggccaacucuccuaaagggcagaagaggcgucaccagaacauauuuaacaggggcaagagaaggcagaugaucuguuaccaccaaaugaacaaagcggccuggcaagagaccagacuaggagauccuggccagaacgcgaguugacaaucauaaaagcgagugccaaaucucuagaaagaccuucagcucucccguggcaccauggccccaagcccguaggaaccggaggaagaggaacacuaaccugaguggaacgagcugaguacucugccugccacgcggaagccuggagcggaaaaaugcccug

SEQ ID NO: 3752 - RNA, 4383 nt, Mus musculus
uggaggucagauuugguaguguuuaaucagugauaaccagaugguguucauguuccugugucagugaccauaaacacacacauacacacacacacauauuccaucauggucuccauacaacauauguaagagguagacaauucauuguccccauuuuacagacaaggaaaccaaggcucagagagaguaccaggcuugucccagucacacagaggagggagguagagguugaaugacagguaacuuuucuuagagacuuggggacugcuagcuuccuugggguacuagaacuuucucagccaccauuuucugcauuugugagcagagaacaggaguggacaagggaugaaggaagaggggugggugggcaugagaggaggagaggggcagacggucauuugaaacgaaugacucuucggauccaggggguguauuugcagaucucugaguagacagaugggugcugggcagcaccacauggguaaaugccccacgagaggacgccaugcagggugucaucacacaccagggggccaccggagucacucugcagaugggaggaaggagguaccaugaggaaagagcugccuggagggcuauuguuggguuaggauacggaagacccugggauggggcuggagagauguuagaaguuggggugguaaggagauacacacagaggugaugguggcauggggcgugggggucaaauugggaggugacaauggagaugugauagguuugcagcuggaauuggcucauccaaggugagaagacugagagggaucaagagauggggguuggcagggugaaaagcagauuaagggaguggguugagaaacgggguaaagaguagggagggcuguggauuggggaggaagggaggaaaagcagagacaacucuuucagugucuuagugccccccacccaguccaggagacagacuugcuugcugaucuguccuuaccuggcaagagucuugguuuccgucugccucagcacaaaucaugcuguuggugaucacaccuggguagaaggucucacacugcuucuggcuaaggagaguuaccuuggaacagcucaggcuccuauuguacuucacugagaacagggcagucacagggagaccaguuagcccucucuuccagaccccggaauccagccccaagccuuccuacauacccagggaaccuaaccccaccccuccacccuuaggcacagaaauucaaacccucgugauccucccucggccuccucccugggacccagggugccagccccagccucuucucucagauccaggggucuagaucugagccuucuccucaaaccgagaugucagaccucagcucucuucccccaaccugggagucuagccacgaccuuccucucuuauacccagagguccgugucccagcucucugaccucacaucgaggugucuggacuccagcccucuuccccagauccaggacuacaaacuccaucucucuaaucuuacaaacuccaucucucuaaucuuagauccaagaauccaaccccaaccucugcaguccccugagccagaguucauauucuagccucuucccucggacguagacacccagguuucagccauccucccucagaucuagggucuagcucucacucagcccuuuggacccaggaguccagcccaguucuugccucuucggcuggcugaggucccccagccugagaccugacacucuugcccuggcugagagcagcggaagggcaguugcacgggaugcacguuggacgucagcauuacaggacugcucaguuucagcaucaugaggucguguucaucugagcgauguggcaggauggggccugagcaagccugauacuugggguggaaaacaggugaacucguggaccgcaguugcuccuucuggaaaagcagcaaguggucaucgccaacucgagcucucaguggccugggggaggaagaguagccugaugaaggcaaaaccuucauggagacagagccuaacccuaguccuugggucagagggugaggaagugaagugggauccugagaucagagggucugggagaguagcuggggcugguccccugggacugagggaagaggcuggagacuggacuccugggucugaaggaggagggcucaggacugaaacccugggucugagggaggagaguaagaguuugaggguugaaggcugacuacuacucuuuaguaugcccgucucuccuuucaucuucgugucaccugguccuuugucccugcguugcaggcauaugaggagacuacaggucuuaaauacaacaugcccuggcuggcuucuauggacaggugcgauggacucacagcgccccgcccuggcguugcagcuuggauccugccucucuuguagaauggcugccacccuuaaccuaaccaaagccgagagagugccugggccccauccuccccacuacuacauugcuacuucugagugguuccuuacuuauuucuccagcaaugugcggccgugagcacccaguucugguccaccaggacacccgcacauuggaacuggagguuauggaagagggagaccugccagggaugauagucacgcucgcacugggcgccggaggccucgagguccacgcgcguggcguuucccgggagcagcagagccugcgccgcuggauagagaagcgggacagggggaucagguuucgcccagccaagucacgguuccggguuaauacagcacgucacaggaugggccucuagggggcgcagcugaguaguaagccgugggaaaauuagagaacucugcgaaccaguuacugaggcgugaaagggcaagagggguuagaauagaaugggacuaagacaccccagggcugagacuggaguggggguaggauggggggcggugaggcaaugugcaggaaaggcagggaucuaaccuaccgggcugagaccagaugcgagccuaggcagagcacugugcagagggagugugauagguaagggggcagacaggggguacagaagggcagagacacagugagcaguaagaaggcagaauucugaguucgagccuggucuacaaagugaguuccaggacagccagggcuacacagagaaacccugucucgaaaaaaacaaacaaacaaaaacaaaaaacgaaacaaaaacaaaaaaacaagaaggcagaauacaaagggaagguaaaggcaacagucaacacgguggaggcaauauggagcaggagacagaacgcacaauggggcaaugagaagcagaagacaggagacacagugggccagugaggagcuaauguggcagcgaggaggagacagggacaaggugggacagcaagaaauggggccagagcgccgagaagugcuagacaaaugagaaggggugugcaagagggaaagguaagucuaguccaaggaugggaaguugcuccaacacacagguuagggguacuguagcaccuccuuuaggaagagggagggaugcaacgggucugcaagaggugaggagaaggcaggagaggcuaagaggcgagguaggagaggcagagagguggagaagcugauggggcgaaggggcuggguucuccuaacaguugggugcgguaucuggggucagagcccaccugaggguggauccugcuugggaugucuaugugggugccaggcccccaggaaggcgagcugacuacgguugcaguggcaacauucccuccaccuccgguccuggcccuucccuccugucgcccccggccccaggcucaccccagaguugcaccaucaguagcggcagcagaagcuucaccagggaccaggagccagaggcaguggagaggugaagaagcgggacccucauagcugauacuuggcuugcagaggcuggaguggaggccuaaaacagaugaucggucaagacccccugccucagcgcaucugaaccacuucaaugagguucacuccaaaggcccccagaacuccaguccucgauccuccagaggggaccaauuugugcacccagccuuucuuggccaccagccacacugagcuccagguccauacuccuucguggguggguugggguccugcucagagcccgugggaaccucuuccuaaccucagagcugagggacuuccccaugcugcagggaaaucagggcuaugaaagaguuccugcccguugcccgagggucuccacccauccucucgccauccaccccaauaggguggggugcaacccgcuucaccugggagucgccaguaagaagaaaggagacucagaaguggcucuugcccugcagugugggcugcaaacaguccucugaccagggaccccugggcagaccuucccuuuuaaccc

SEQ ID NO: 3753 - RNA, 4868 nt, Mus musculus
gauuaaucacagggcggccccaacggaggaggaaggaagaucucuauggcuuaccauaaagaaggccaggcgcccaguagcaggccaaaggaccugugcccaaggacaugaagcugggacucaccuuggugcuguucucucugcuggcaggugagaagcccagaccugcacccuccaaccccauguuccccuauaagguguccucacccuuuggacuccccaagaaacuccucccugagcucuccccaaccugcuggcucugaccccugugcccuccaccgcacccuaggccacuguggagcugacacccgugccgucggagcccgggaaugcguacgcaacucucagcccuggcaggcuggccucuucuaccucacccggcagcucuguggagccacgcucaucaaugaucaauggcugcucacagcugcucacugccgaaagccgugaguguccagagcuggccagccccagcugggacugggaaccggggggggggggcggagaggggaaggccuggcuugagguuuugggggcucagaacuggaggcuggagacagcugacauuaaaccagggcucuuagcuaccugcucagagaccugauucuaagacucaauacauacguucuucgggucccacuguguaguaaugauggcuauccugaaacuugcaauguggaccagacugaccuggaacagagauccagagacaucugccuucacagagugcugggcaucugugaauaggcaucccagcccaaucagaaauucaagaucaucuucaguuacauaaguucuaggccagcugaaacccaugcaacucucucaagaaaaacaacaacaacaacaacaaagcaaaagagagaaagaagaaagcaaagagugauugggggaagacaaaagagagaggacgaagagaggaggggaagaaagagugauguaguggagggaagaaagaaagaaggauagagagaaaggaaugaaggaagggaaaauucuacgagccuguagucaggaauuacuagauuuccgaccacaguguuaggaauggacugaugaacauguaagaccugacagguuuaacaucccagaaucccacccuugcagagucuuguggaccaagaauggcucugaacucuggauguuuaauguucucuaaaucaaauauuuaucuggguacuagaucuguaaaacucuugucuuacuguccuagaauacuaggauucuagaaucuuugagcagacaaucuuaaaauccuucaguuuguuuuugagacaggguuuugaauagcccaggcuguucuuaaaccugcuauguagccaaaaguggccuugaacaccuguucuucuaacaaucuccuccucccccucccccuccccuccccucccccuccucccccuccguguuagaaugaugggcuuucacaaccauaggacaaaaaucuuggacuucugacaaaauaagaucuauauggucccuugaguugaacuucccaaucucagaagcacaggaaugagguguuagacucuuagcauucugggauccugauuccaguuguuuuaggguccuggacacuauaaggugaaagaauccucucuaccuuuucuccagacaaggucaccuaggcuuuuccaauauucucucuaggaauuucccaacaugcauccuugcaagaugagcaccaucuugggcugggagaguaauauuuugaaucagcccccaagaucacagggcuguggagagggaggaguuaggagagcuagacagacgaaggggcuagcuuccucauccccggggugucagagaggaguagacacagaaauaacaccucauacuccccaaaccccaaguuuuuaaucaucacccugauguuuccuauugauaguuggaagcuaggggaccuggagaccauagaaaguucccaacugcgcauagcaugaguuuagaccaaagcaaguuugcuggagcugcagcagggaaccuaaggagaaauaccuggguaguaauggauauuacagguggaaguggcuuuuaggauuccuggaaaacuuggaaguuauccauaucccaccccuaaccauacacacguugaaaacacuuaaagccacucccacagaagcuaccagacuugugagagcaggggugggguuguuuuugugugguaggugggguuccuaugcauccacaagguuccagugaaccuaugucaccaguggggccccaggugggauggggaagaagguggcugauuugggaaaguagacuacaaagagcagagcucuggagaggguguguggcugugaaggggcauacaggaccuuggguggaccgagcuccccguccccagccugaucucugaagucugucuucacagguaccuguggguccgccucggggagcaucaucuguggcggugggagggcccugagcagcugcuucuggucacagacuucuucccccauccuggguucaauccagaucucucugccaaugaccacaaugaugauauuaugcugauccggcuaccucggaagguccggcugacuccagcugugcaaccccucaaccucaccgagagccggccaccugugggcacccagugccuuaucucuggcuggggcagugugucaagcuccaaauguauggguuugcccuuaacccuuguucaucucuuaccaccucucgucucuucccuuucucuuccuucucucuucccccucugucuccuccuaaaucucuuccccucuuuccuucucccccccuccauccucuuccuccaucuucuucuuuucucuuccuuccucuccuccuccuuuuuuuccccuucaucccaucuucccccucuucucuucccaggggccccuccucccuaggacuuguuagcucccagccuagcucuagguucagugagagaccuuguguugagugaauauucuauagugucagagcagaagaccugauggccuccuuugccucugugcacaccucccccccccacaugugcauauaccacguauauacacacagacaauucagaacaggauguggugguggguuuaaugugguggguuuuaauccccacauuugggagguaggggcagacagaucucuaggaauuugaagccaaccuaaucuauacagcauuauacacauauacauauauaugggcaaaaaugugcucacacucaaaauagcaucuacuuggcagaaucaauaauacagguuacccccagaguagcaguagagucuacauuucugucugcaacaagagaccaugugccccgaacuguguugucugguuucugauaacaucucucaacccuuuucucugcauggccgccuuguaauuugccucuggcaguggguuucgcuucagggauguuuaucucccucccuggucuuuauucaccccacuccugugacagacagacagacagacagaccuuccuguuucacuuccccccccccucucucucucccuuuggccuucucucccccuuagccaucuauucuccagcccuggguugacugucugggaucucauuucugagucucagccucaugacuccgugggagucccaaggauggaacagcgucagggaagauucuuaggggugcugccucagauucugagaacauccuccauccuucucccccaacaguacaguauccaaugacacugcagugugccaacauuagcauucuggacaacaagcucugccgcugggcauacccgggccacaucucugagaagaugcugugcgcuggccugugggaggguggccgaggcucuugccaggugagccauccccugcaggaggguggaagcacuuuucuagaccucgggguaggagauggcuggaaccacagacuccaggaccuagggauccaggcugaguacuaggagguucugggagcccaggaugcuacauggugggaugggagaugagaucugugaguuuuuauucauggaaaugagggaggagagacuacagaccaggcccuccugggugaugaauggcagaggcuuucucaggaggaagcuuccgaugauucucaugaauagacccagcuaacagcucuguucuucaccaugcacagggugacucugggggaccccuggugugcgaaggaaccuuggcagguauagugucuggaggaucugagccuuguuccagaccccggagacccgcugucuacacuaacgucuuugacuaccuggaguggauugaaagcaccauggaaaaaaacugaguucaugcuaagauggacagacuggagaggaagacggauguagaaugagaggaugcugcaggauuccagagccccagcuucucugaugcgugucaaagcacccccgcacgccccaugaugaaacuccgcccucucagacuucggacccucagacuucacuccuuagucucccccgaagacuccucccacuuaggucaucuucccucuuggggucugcucccaggcaaaacaauuauaauaaaaccacgccccuucaaaaaaaaaaaaaaaaccaacugagacacaccuccuuugcuccuggcccaugcuacaccauuuuaaucaccauucucuggaauagcccaacccucaggaucaccgccaagaaauaucuuucccuaaauagcugcugcaacccuucauauuucacccaauaggauuucuucucuggacuccaucccauuuguccccacuccuagucacgcuaggacugcgccuauucugcgcacguggaccucaaacagcucuggguucugcuccgaguguguuuugggucugacucuugacauaggaugaugggagcauugaucucucuagagcccccaggugaaucagaauaaaccauaggaacgauc

SEQ ID NO: 3754 - RNA, 6252 nt, Mus musculus
gaggagccagccaauggugguguuuauugacaaccccccccacacacacacaccaggaucagucccuguuguccauggucuucuugauccagguaguguagcggcagauuuugguguagacuccagguuucucggguuucccacaggggucugagccccaugaggugaugcccuggagcaucccgucgcacaccagagggccuccugagucacccugaacagaggcagaguuguguuugccuuaaaaugccugcauuuccuuuccuucugcacccacgcagcauuuaaacucuggauuacaucuuacuaucuagugugguacauggagaucagaggucacugcagcgagcuguucucuccuucuacaaggaggguccugggaaucaaacucagguuggugguuugaaaagcaagugguuuuaccugcugagccuccuugcauugaaacccucagcauuuaacuuuugagaaacagucucgcauagcccgagugccucaaacccucuguguaguugagacugacccugaauuucugauccuccugccuccaccuuccaaguacugggaggcgugcaccaccacacccaguuucugcaccacuggggauagaacucgggguuuugugugugguaggcaagcacucuuaacaacugagccacaucuccugguccuaaaaccaauuuuuccacgugguagaaugguuggcuuccuauaggaaaugggaauaagauguggugguccaguggaaggaaguggggucuccagugcagagaagagcucuaaagaugauggucaaauuccugaccaaugagaaaagaaagucauguguccaaaguguaauucauagagaggacaccaggcuuucaaugagggggacucagcucaugacuccaguuggggagcacagaggaaagaaugggauccucauagagauggauggaaagauaccucauucgugcacagggccaaucccuaaggggcaauggagagggucuucguggucucuauggcaggcugcuuugugagugagugaggggaaugacaacauccuuggcaaaugaggaagaaagaucugccuuucagggucuaaucauuagugauguggauggagcuuccaugaaagggucaaagccagaggaaguccuaccgguauagaugcauagcaguugacagggaagagaauauuauaucuguggaaagaucccaugagggcaggaugggaggucaccgaggaagucugauuccacuucguggccaacugagaaggcaaggcugguccccaaggaugcaaugacagaaggaaacuucccuuggaaacccgguggcagaaaccagaccauuuugaagagcuaggagugaagcacugccuaauccuuagcuucagauuguccuccauaccaccuccccauaccuuaccauguacacgaagagugacaaggcuaggacugugaccagcaaagcuccugaguaugccaaccucacucugugaccuucugugcguagcgagcuuucucugaacccugccagcacgacacaacuucucuguccacuacaucuuuugggucacccccauccacaccaagcugugagggagcaauucuggagguugcuuaccuggcacgugucagcuccauugcugcugccagcacagaccaugcccucggugaucuucccuggauaggcucucucacacuuguucugggaauagauuuucacuuccgcacaguugaggguguuuggaaaguucucugagaaagaagaggcaagaagagacaggcaccuuuucucuccaugccauccacacuagacuucccuucugucccuuggcuggacauuccacagagcccacagcuucccagacuagugcaucuuucucugucuagccaggagcccucaagucuuaacgucuguuucuugccuuuaguaaaauuaaaaucuaagaacagaugauggagggggauuucuugucacuagcccaccagguccuuaauuucaucuauauucuccuuuucccaaauauaaucuccuccuagaagcccuuccugaccacucuaauuaaagccuaucaguuuguccauccauuuggggacaagagagagagagagacagagagagacagagagagagagagacacagagagagacagagagagacagacagagagacagacagagagacagacagagagacagagagagacagggagagagagagagagagagagagagagagagagagagagagagagagagagagaaaagaaggaggaggaggaggaggagguggggggauugaauucaaguccucgucauacuaggcaggcacuguaucacugagcuacauccaaauccucuuuuucauucauucauuaauuuuuguuucuuuuaggguguucucauauagcuaagguuagcuucuaacucugcagagcugaguguucuucugauccuccagcuuccacuacucaaguguuggggucauaacugugcaugucacauuauauauacuauugauuuuugagacaugacucucauuaaacugcuuagacuaaccuugaccuugagauccuucugccucagccuccuggguaucugggaugaaagccugagccagcucuggggauuguguauuuguuuauugucuauuucccccaaguggggcaagcaccagaagaacuucacauuugcucaugacuuuaugccugcccccaugcuggccacaguaucuuggucauacugggugcuuaauaaauguuaaugacuggcuguggguauggcucaagguagagcccuugccuagaaucccccaagaaggccuaggggcguggcucagugauagagcaccugccaaacaugagugaggcccucagcucaauaucuaauacugacaaaaaaauuaaagacugaaauuacaauuaacauugcuauuaauccccuuuacggagaagacccagaaucuuccugcucccagucucaugggacccucacaaacgcucuuugaagaggucagggugcacucauucauuuuaucauucauucauccaugcaggguaauuuacaaaacauuuccaggaucccagggaacuuccaagcacacagagcacauccucaagagaacagauagaagugguggcagacaucuuuaacccugacacuugcgggggcagaggcagguggaucccugggaguucaaaaccagacuugucuacauuguuccaggacagguacccacauggugaguuaaaaccaucuauaacaccaguuuuagaacuucuggccucuucaggcacuacguggaccgaguacacacacacauccaugcagacaaacacucauacacauaaaaaauaaaauaaaaaacuaaaaaagaagaacagaugauucucugagagauaucccagugagucaaaccuuaagccugcuggccugauuuugauucuuaggacaucacgguggaaggagagaauuaagucccguagguuguccccaaccuccacccaugcacugugaaacacacacaugcauacacagugaaaugaaaacuaaagaaagcagaacccucuuagagcuuauuaccaguuggaugcugacucccugcacgucacuggagaaagcaaggcugggagacaggaaguggcuccccagggggcuaaugaaaagauccauccaugccucgguaugcauuuccaagccacacugucucaguagaagucaagacguguagggaccugaugacuggcguggucaaugccuggagggccccauuguuuuucugagcugagucccacuuguucucacuaugaaguuacaagcugaggaacauucuagacaugccaacaccccaaagggacuaauguuuggcucacgaauaagaaaggaguuugggcccucuuggaucauggaggcugggugaugacgggucugggcccuagagcgugggaaaaagcagggucugaaggugcuugcugccaagcucacaaccuggguucuagcccccaggagcagaagagugggaggcaacaacugaucccuacagacuguccuccgaccuuugcauguauucuggggcaugcauaugugcacgugcucauacauacacauauacacaaauaaauagauauaauuuaaaaaaacccaaagugcccgugcuucaccacauguauguauugagauggggucugucauugaaccuggaucauuaggcuacgaugguugacugacaaacccuggaacccuccugucuccaccucacagcuggcuuuaacaagguugcuggggaucugaacucaaagccccucacacuugcuaagcaagcacuuuacuuacagucccccuccccuuccccauaacacuuaaugugcucacuuuucucuuucauuaucuucucuuaggguguauggaggucaggguauguuggggaaugaggucugcaauggcuugggguccacuggggugauugccuucucuucacccucuuagguagggggcccagcucuuuaccuugagggcuggugacagugccccagccugauaugaugcacuucuggccaacuuugggacacagauuggccaguuggaccggcuucaccuuguccccgagguuugcugaguucugcagucgaaugagcauuauaucgugacugugaucuucuggguugcuguuguuguagcaaggaugcuggauagacugagccaccuggaucuccugcuccggcugaucucugcucuggaggcuaugaucacccagacgcacggaguacuuccugcacaaggagggguggagggggugaggagugaggguggaucuuggaacccagaaggaaguuggggguacuuggggguucuuuccacuccuucucccucagaacccauucaucuuccaccaagcccaggaguccaggcccuagccugucugccucagauccagcaguccuccuuagcccuccucccucagacccaaguuuuaacuuccuccucuuccucaaacagagcccugagccucuucccuccagguccacccacaugugcccagcccuucacucacuguuuuuugcagugggcugccgugaggacccaucugucuccaaccaggacacccccacagaucagucucucgcccuggaacaaggcugccugccaaggcugggagugggguauacacucucgaccuuccaggaucuuggagcccugagcucuggugagcccugcaucaggaaggagaagggugggucgccacccucgaugucagagccccagccaggaaagccacuguggguucaaauggacacacaggccaguuccucugcggaccgucucuuaugccuucaacagauaaguuuccagcauccauuggaacauggccacauguaaguucacugagaccugagaauaaucaacacuaggcacagcccucaccaugcuuccacgcacgucuacacgaguucuagacauccccacaccaaauucagcuuugucugacaggcaauaagaaucucuuccgcagccaugcaucuaugggaaacucaacccacuuccucaccacugaguugcuaucucuacucgcuaccaagaaagcuccccgguccccaagcccaccacaggcacccacacacccacgugucagaaggaacucacucagaguccaguaaccccuaccccacugaaggcccuggguggugggaccuguuccucucaccugcccacgcucccaugaacagaagcagaaggauccacggcuggauugcacaggguggggggcgucccaugguggccucugaggaagaggguggaacuaagaggaaguccgagggaggagccugagaucuuguugucuggggaacugggggaaggagguguuuccggagcugucuugagucuugcuggaggauggagcuaggggcugagaaagcuagggcagagcucuagauccccgaauuuuagugugggggagagcuugcuguuggggauccagacauuauaaaggaguucuggcccacuugugagauuggagagaaagaucugaggcugugacuccaacguccuggggaagagggagcuuaagagacccgcuugaagauccugagagaaagaaugugagccugggggugggaggguccugggcucagagaaaggggaccucccugcgccugagguccgugucuggggaccucugcgccucaccuuccagaaugcaaggggcggggucacucggacucgguggaagaggcccccggacuucccuucggugugucg

SEQ ID NO: 3755 - RNA, 5096 nt, Mus musculus
guaaaaguuaaaaacaugaagacuacuuuauuugcauuuuaaucugguuuggcguccauauuugugugcagggacacuugugccccagcacacuuggaggucagaggauaacaagcgugcgucaguuguucccuuccacuguguaggcucuagagaugaaacuuaagccaugucaggauuggcagcaaguaccuuuauccacugagccaucuugcuggccuagcuacaauuucuuagccaacucuucuucauagaucuccucccuccaccaucguggcucccagcuuccccaacguuaccuuccagguuaugagcacacacaucaauaucacuuagauuuuauucugucucacuaguauucauuuggcauguucagcccacguccccauuaaacaccacacaacaacagucucucuugcauaaggcuaagcaguacaccuuaagcaacuucacaacuucauaaugagagcaguccaacucccauguaaauaaucuacuauuuugaacauguuaaccguuuccauucuuuucuuccucuaugauaaguacuguaaugaauccaaacuugguucaaucuuuuuuuuuuuuuuuuuugagaaagaacucugcagaaauggaugaccugaguccaaggcaguggaugaaggucucacaguuaccaaccacuuuccaauaaaggacuguaggaaucccuggcucuuguauuggaaagcuuuagccuucuggcaucuuccacagcccucagguuucuuagucucuugccuugauuugcuuuuaggucucugggguucugauugguuuauaaacuuaaccuaguguugagguuuggcuauguccuggaggaaagguaaagccaggcaggacuuuacagggaugccacgauguccuuacuccaugaucauaaccucaaaggcucacagcucggcuccuggcauguuagcgauggguuuucauggucuccaucacccaccguuuguacuugcagacuugaguguagacgccugggucguugggcuggccacaaggguagguaccccaggacaccagaccuuggagggugucguugcacaccaagggccccccugagucacccuauggggaacagagaagguuaguuuuggcuucaaaggaaagcucugugacccccuaagucacccucagacuagaggcuaccuaguuuagucuuugucuugacagucugaauugacuuccauccuaguuaaggagcauggauuugggggaaaccaaagggaaaguaggaauucauacugucauguugaugaccuggguucaucauuagaguuucuuguuggaaaaggguggggcuucugggcauuuacauauaauauccuuacucagaaagucuauugauuaaggcuggugagaaggagagucuucucuagggauuggguagguauucccuugagcagcaggaagcugacuguagccaagggagagggaacuuccugguucucagcaagagaaaugugucuuccaccaaucaacccuucagcauacagcauagcaucuguccugagaggugaggguguuggggaggaagggaguagagagaggggagaaggaggaagauaaagaagagagagaagguggagaggagcaggaggaagagggaugggaggaaggagggaggaagaagaagaaagaagagagaaggagacaagaagaugagaagaaagaaagaaagaaagaaagaaagaaagaaagagagagagagagagaaagcaagaaagcaagaaagcaagaaagcaagaaggaaggaaggaaggaaggaaggaaggaaggaaggaaagaaagaaagaaagaaagaaagaaagaaagaaagaaagaaagaaagaaagaaagaaagaggaaggaaaggagaauggacuagggagauuggagguagcagaagggaaggaggagagggagauagcucagaacggagagauaacaaaaaggcaaagaauaaaauaaaauuaggaaucaaaagaaagcacggaauguguuguccaaagacagaggcuccugacagcugggaagaaagagguggaggagaaaggagagauccauucuugccccaggaccaagaucacaguuaggcaucuggaucagacagaaaaugucaggagucaucauaaacaaaugaguuaaaaaucaagaggcgacugaauaccagcacuccagaggcugagacagaaggaucagagauucaaauccugccucagcuacagagcaaguucaagaccaggcagggcuacauggccuugucucaaaaauaaaaugggccuagagagauguuucagugguuaagagcacugcuugcucuuguagaggacccaggucuaguucccagaauccacaucauagcucacaaacacuuguaacuucaguuccagaggaucugacaccccuuugugcccucuuuggguaccaggguacccacauauacacauacacauauacaacauacuuacauacacucaggcaagacauucacacacaugaaaacauaucuuagaaacaaaauuuaacaagggauguccaguccagugaacugcucaccccuguaagcucugcgcuugggaggcugaggcagguguauucccgugaaucugaggccagccuuggcuaccuaguucuaaguuagcuuugguuauuucaggcuaaccugaguuacagagugagguucagaucagccuggaccacaggggaauacugucucagaagugcaaaaaugaaauaauacuagucacagaguuuggaagcuucuacaaaguuugugcuggagacaggaggcucacucauaauccuacaucccugucuccaucuuucucagcuccacuaaacucccggccccuggcuagugcgauccacgcaugaauggcaguuguugaccaacagaaagugacagagcuaaggaaguaggaucugagccaugaccaggacaggcugggacuagaagcuuugugcugauguggacagacuggggcuugacgggagagugggggcagugagggcucacauugcacguguuggucuuagagucaggaaugccagcacacagcaugguuuuccccagcagguccuuguacaccuucuugcacucccuggaggagaugagcuucacauccgagcacauaagauccgagggaaaggucacugugaggaggagggcuucaguaagguacugggucggguguggagcugaggggcuggcucaagaucagggagcccagggaagaaggcugggaucuggauuucugggguugagggaggagggccugggucugaaccccuuggugugagggagagggcuaugcuggaacccacacugaggcaaucucaccgucugggcugguuguggugccccauccagagacgguacaugacgucccuggggguucacaguguucaggaagcuggacugccuccacuuuggaugacaucuugacuggcucauccaaccucacaagcaugaugucauugacgugggucuuuguggaguagccagggugccggaaugacuuuguagccuugaucuucugggcacucugguccccuauuuuaucacugcccagcuguacuugguacugacugggggaagggaaugacacucagagaagaagggagagagggaaugaggaagggagggagggagggagggagggagggagggagggagggagggagggagggagggaaagugagaggaagagccuggucagaaacccacggagaagaagagaagaacacagaggaaaaucuagagagccaaagagagggcucagaaauacacacagaggggaacacagaacagagagagaggagagugaggacagagacagagacccaaagagacuuacccucccugcccuuucagaaccuaccccauuuugcagugggcugcugugagcacccaguauuuguccaccagcaccccuccacagugaagcugauugccuuugagcagagccaccugccaugggugcgagccuucuuuacauuuguagccaucuauaauccuuucuccuuuauccagcaucagggggagaaugagacaguaaacagggauuuacagucagagaugagucuauaaggcucaggagaaaaggcagaggauaggguggaggaucaugcggaggaugugagaguggguuagggagagagagacuggggaccacucagaaaacccccauaauaggcacagacugcuggagaggcucuagggagucugucugauugaggacacaagaaaagacagcaccagaccgcagagucacaggaucaggucacccggccuugagcugucugggagagggcauucagacucaggcuguuggggacacugagcaagcccucaccuuguccagcgguuuccagggcuaaagacagcagcacaguuaucagggaaaggagccagacucccaucucggcgacaguggcucagggacugccagaugagagagcuaaauguugccagaacaaaggaugaugaaagacgaggcacuaagacagggcccuaccccauccuuggauucaggaguccaagccgcaggucuccucucucugggauucagaaaucuagcuagagcccuccucccgcagaccuugggguuuuagacuccagaccaccucucucuucccuggaguccaauuccagcuguccucucuuagauccaaagguucagacccuggccuucucccucagauccuaggauucagaccccagcucuccucuuucagacccugacccagggcagcaccuaaacuccuuugcuuuuaucuuguggguggauagcuacccucuuuugccccucauggccuccugucuaggacccuggagccccagucuccagggggaauuguguacacccccugaugaaaguuccucucaccugggagugacuuggcgaggcucuguccuugauccggagaccagugucuccagccuucuauagggcuggcccuuuuauaccuccccugcccccgcaccgccuccagcucccuggggcacagguggagcugucucugggugccuucccucugcuuugagcauaggguuaucugaaaucccugaggcaaccccaacaguuggu

SEQ ID NO: 3756 - RNA, 7531 nt, Mus musculus
caguuuagugaaacauccuuucucaauaguugggugucagcucccacucuccuugggacacggaggucuucagcacccacagagggacuuacagguaggugagucagcccugaccccacugaaccugggcagcugguuccagggccucagagauacaaacccaggagaagaagcugcaggauccccagaggauauaggugggguaccuguggaggccggggcaccacuggcuaaccugggaacggggcauuuaguccucagucuuauuaugucacaaauccuacaaauccaaaagcaagaaugagcucccuaaagggaucugcaauccuauagguggaacaacaauaugaacuaaccaguaccccggagcucuugacucuagcugcauauguaucaaaagauggccuagucggccaucacugggaagagaggcccauuggacuugcaaacuuuauaugccccaguacaggggaaugucagggccaaaaagugggaguggguggguaggggagggggggaggguaugggggacuuuugggauagcauuggaaauguaauugagaaaaauauguaauaaaaaaauauauauaaaagaaugagcuccaaucucucucuaccucaguucuaaagguuucagcccaacccuccuauuuauguccagccuuucuccuucagauccaggcgaacagacccauuucuucccucaaaauucagagaucuggggucacuguguuccagagugggucacuggcuucccuguagcuaucuggucaagggucaccagaagcagagcuguggggcagaaggaaugcaugugggcggcuuaggugaagaaaagggcgugacuggcuuccuccuggcucagagacuagaagagagagggguuaaaaaggagcugggagacucugagaacagaguccgccucucucugggaggccacagagccaggaggguuucuggagacagucugcuacuugggacccagcauccaagugccccauauuucaugcaggucggaucauaaggcagccuucugucagucugcucugccccuucccucgaggagcgcccugccuugcugacuuucucugccucuggcuuccugugauagguggugucauuccccuccaaccugagugcuggcagguacacugcuggccaccagcaggugagugaaggguaaggauguaggcaaggugcaaaaggaaagucccacagaggaagaaugucagggaccccuuggacuaacaucucugagaguagaaagggacaccagagcccagggcuggguuucuucccuaaagccacuagaaccaaggacaugguugguccccacacugucuugcauuugcucucagggacccucagauucaaggugcaggcugggaaaugaggaaccaggaagugagaaggggggcaugugcagagauagaacaaaggcaggagagcaggacaagacaguaaagauggagagggugaggaaggagcagggugggguuccugagaugugaacagaggcugagauaugacuaauggaaucguuggcuuacccucucaagaugcccaugaagaugcugacaaugaagaugcuggcccugugcuugguucuugcuaaaucaggugauuuaaggaccauagaagggggaggggcugguagauagauuggcucuguugacagacggugguuuaggacaggacuaugcagcuuugagaugaggaaagcccugagggggcuggcuaaggacaagucuggagguggguuggaggauaaagcgugcuuacgucuuugaggauggagauagcugggcgugguggcacacaccuuugaucccagcacuaggaaggcagaggcaggugaucucugaguuugaguccaaccuggucuacagcgugauuuccaggccagucuggaauacaccaagaaacucaguaucaaaaaggggaagggaggcuggagagauggcucagaugacugcucuuccugagguccugaguucaguucccagcaaccacaugguggcucacaaccauuuuacaauaaggucuguugcccucuucuugcaugcaggcauaugugcaagaaaaacauuguauacauaauaaauaaauaaauaaauaaauaaauaaauaaauaaauaaauaaauaaaucuacaaaaaccucagaggguagagguagagucgaggaagagaagguagauguagaggugacagugagauuagggacccauuugauuacaguucauuucagaaggaucuaggcucuuggagcucuucucugacucagccccuuccucccucagccuggucggaggaacaggagaaggugguucauggaggcccguguuugaaggacucccacccuuuccaggcugcccucuacaccucaggucacuugcuguguggugggguccucauugacccacagugggugcugacagcugcccacugcaaaaaaccgugaguuuccuuggucuuuaagaagcugauguaaggggguccaaagggugccuuguagacuucagaaggggggcagaccugagcauccaucauucugugaacaguucucuucagccagguauccauagguuccgggacccugaagguaucucaagcccuuaaaaaaguaaugcaacauuugcguauaaccuauggauaucuuugcaugaacucuaaguuauaucucuagagcaccugucaacgcagggggaacaauugcucuggguaccaccuccagcaucuccuaaauugggccgggcauucagcacuauagucuuagugaucgagagauggaggcgggagaaucaaaagcacaagcugagccucagcugcacaggaagcuugaggccagcuuggguugcaagagacucccucaaaaaaugggggccaaaaugauagcucagugaucaacuugcuucacaaucauugggacugaaguucaaauccaagcauuggugucacaagccagauaaccccugcaaagugcuuguaacuccaacucagaagguuccaaagccuucuucuggguucugcacaugcauggcuuugcaaaacacacacacacacacacacacacacacacacacacacacucaaaucauuuuuuuaaggugggagagaugggucaacuguuaaaagcacauacugcucuugcagacaggaucuaaguucaguuuccagcaccccuacagcaaguccgaacugucuguaacuccagcgucagaagagcuaauacccuuucuguccuucaugggcaccugcacucaaauguagauacccuauccacacauauauuuaaauacaaaaguaaauaguaaguaaaauuaucuuuaaauguugacuuuauuauucguguugugugggugugcacgugccacagugcaccugugcaguucccaggacaacucuguagagucagguccucucuguccacauucaugcagguagugaggcaugagcucagcguacugggcuugugaggcagucccuuugccugcugacccaucuugccagcuccuccucucuuguugcuugucuuugagucagggucucucuggguugcccuauuggcuuggaauacacucuauagaccagguuggccuagaacucauaggaauuccuccagugucugccuccagagugcuaggacuaaaagugugcaccaccacgcucuggugcugccccaacauuuuuaaccuguggucaauugaaucugcgaaaggagaaccugaaacuaugucgguuggcugucaaguugcguaguagaaaaguuagaaaggcaaaaaucuagaagaaugagauugccuuuuacugagcuggggaagaucaagggaggagggaagaggggaggaggaggguaggugcucucucugggggcuucuggcgaagcccagggacuggaggugaguccuagcugucuucuucccaggaaucugcaggugaucuuggggaaacacaaccuacggcaaacagagacuuuccaaaggcaaaucucaguggacaggacuauuguccauccccgcuacaacccugaaacccacgacaaugacaucaugauggugcaucugaaaaauccagucaaauucucuaaaaagauccagccucugcccuugaagaaugacugcucugaggagaaucccaacugccagauccugggcuggggcaagauggaaaauggucagugaggggagaugguugggagugaucaaagggaccaaagggagagggucuagugauggaggugggaugguaaauagugaaggugggaaagaagauggugggccacaaggagaugcugauggagaggaucaguaggucacucuguuuauggauaaaagacagauggagagaggagaagguugaggaguuggaccaaauguggauaggcuacaaaaugaagggucaaugagaagugagaacucaugggggagguuaugauuagugaggaagucagaccgagaaugauggggaaaggggccauuugggagacagugacaaggaaagcgauccuaagcaugaaagagaaacaaaaugggaauccgcuggaaagaaaugggggugagggggaagggcagugaagacagcuggugaaggcacgaugggaaggggauguguaagccuggcccaucuuccaccuccuaggugacuucccagauaccauucagugugcugauguccaucuggugccccgggagcagugugagcgugccuacccuggcaagaucacccagagcauggugugcgcaggcgacaugaaagaaggcaacgauuccugucagguaagaccgagaccagagaucugaaaucaaccacacacaggaagacagagacacaaaccaaagcagagcugaacagagauugagaaagucagccugagaggacacuggaggacaaaacagaagagaauccaccucacacguguaaagacagauaaggaagaagcagggcagcucggggcugagagguuggcucaaucaguaagauacucaccaugcaaguauggagacccgaguuguagggcauggugaauggcauaugcuuguuauccuagugcuugaggacagaggcaggcauaucucuuggguucauuggccagccagaguaaccuaaugggugagcccaggucagugagaaacccugucucuaaagacuguacagcgagugacuccuaagggaggaugccugugacugcuggucuccaccugcgcauauacauaucugcacacacacacacacacacacacacacacacacacacauacacacaacacacgacacccagcagaaagaagaaguuuagaugcaaagucagggacaccaagagccagagagaugcuaaaauggcuagccaaauaugggugaaccuagcaaaccugaaaguuuaaggaacaaucucaauaaauggccaccuuggugggaguuuugaacaaccggggagauccaagggccagaaagaugcuacagagagcuauccuuccucagagcugcagccgugaaacccaccuggaaauagcuaagcuucagaugaggggccuuccagcugcaaagagggauucuaugcccaucccucaacacgugcaacugagcuccucuggaacucauucacaagccuugucuuguccccagacucacaacaauucuccugcauccgccugugggauacuggaauaacaggcaugcgccaccacaccgcucuaaucuucaguaccuuaccuggaaccucucuaccugucauccuuccagacuccuuuuuaugccagaaugacucuagaccguggagggccaacaucaaccuaccaagaaagcaagggugggguuaugggagaggccaagaaagugaguuaguggcuugggagcaaagcagcuaggcauggcuggccugggaucaagggauggagagcacugaaaguuuguugccuucuucuugagucccugccuucauagccuccucugcugagcuuagcacuuuugucucuacgccccccccccuucuccauugauaaccuuuacuuuuauggaccuugaugucccucuccguacugugacacucucccugcagugaugaucauaaacauguauccaucccagacagagaagcaauaacaaaccaaugaaugacaccaaaguccaacuuggugaaccaaugagcuucauagggguuacucuaaggaguaugggugagggguuacuuacaggagcagaaaugacucaugggcaacugcaucaccaaaagcucacccccgcaugggugacagcucaucaaagccagaauggggagcacacacacugcacagccugcaggcagcucaacaggucggaaagugucucccuuuggcagcugagguagucagagucucuucuuggcaguucaucuugucugagagacucuugguaguccuuacugcuuauauauacuuggggaaggagggaccuagugcaucugcucagcuccaguuccuuccugaagcauuugaguuguuugcuuauugagcuuaaggaucuuugccguggggugcaaaguuucaacucccuuagaacacguuaugucuuaacaaucuucucuccugaauggauggcuuuucuaagcacccucucucucucaccuauaccacgguggaacuugguauccuggagcaccucaucugucucuggcuuuuccugggaauuaagcccaggaucuuaugcuaugcgugcucagcaagcgcucuauuggugaacuagagccccauuccucuuuuacuuugagaaagggucuuccuacauagcacaagcuagccuuaagcuugcaaucuuccauggcauccugaauagguaggucagaugacaggcaugaccaccaauccagccuuuccuccaucuccaaguaucucugacucucuaauuucugccccccacccacccacccaccaccacuucucuuccuacucuugcuucucccccuccuccuccucauucuaugugaguuucugacguuucucuuucucuuccacacagggugauucuggagguccccuaguaugugggggucgccuccgagggcucgugucauggggugacaugcccuguggaucaaaggagaagccaggaguuuacaccgaugucugcacucauaucagauggauccaaaacauccucagaaacaaguggcugugacaugagacauccaguucucccccacgacgccucugacccucgcuggcuccauacucucucucccugaagcccugcccugcucucagagccuucagauguccagcucugacccugguacuuaauaaauguagugacacagagcacagaacacugcuaaaucuacuuugcucaaucguugcauccccagggagacuggaggauacaggcuacaauccuacucuaugggugugguuagcagauggaaucgcagugugcccacuaacagucuggguacccuugggaagugcuuuucuuuagagugugaaugcucucaucuguaaaauugggauacuaacggagcuggagaaaugcucaguggcuaacagcacuuauagcaagaau

SEQ ID NO: 3757 - RNA, 4294 nt, Mus musculus
cucauuuguugcauggugcauuuuauugagaacagcagauaaugugacauucagggguuuuuggccauagugucuuuuauccaggagguaaacuuaauaaguuugguguagauggccggcgcauuggguuuagcgcaugggauagagccccaugaugugauaccuuguagaacaccaucacagaucagugggccuccugagucacccugagagaaggacagggacaggaguaaggaagcaccuggcaguuggauucuuguagacaaccuggaacugacucccagggaggaacacagggacucuaagaggcagcucuggucaguaagugagggaauacugcucuugggagcccagaucuuaugaggacauuggguuguggugagggccucacaggaccauccccuaagcaaaggcacagaggagaaauaguaccagcuacaggauccuccccuucuagggcacaucccuuccauagggaaggaugcaaagagccugccuagucaggguguugaagugggaacccagaaccucaguucucucagcccuucuccucauugcagagagggucugucuuaccgcacaagugucuuugccuccacccaucucuccugcacacagcaugacaucugugacuuuauguauguaggcuuuggcacaauuuucauuaggcaggggcuugaugaacccacacuggagaucauuugggauuugcccuguggaugacagggaaaguggguggugaacagggcccaguccaggccccucugcaccuccccuacaccuagcuauguuucuuggagcagacucacauuucguggguguaaugcugccccagccugaggcuaggcaugugcuccccagcuugggcuccucagugggcaggucgaugggcuucacagcaucugugaugucagcaggcuugcugaggcguaguaacaucaggucauugcuguagucauccucaggaugugggguguggucauucaugaggcucauguuguagucagggugagggaagcuuuugcugaccaaucggugcugagcagaggauucauguuggaauagcuuguuuuugcccagccaaacauuauacuggcugguggcaauggaaggagaugcagggugugagaggggaguaucagggugauuagucagagucagaagagagggaggaagaaaagaggaaggaagggagaguaagggaaagaaacacacagagacagaaauauacacacaccacacacacacacacacacacacacacacacacacacacacacacacacacgaaacaaauacagaaaaacaaacagaaacagaaaggaacauacauacacaaacacauacauacauuuauacauacacacauacauacauacauacauacauacauacauacauacauacauacauacauauugagucagagaggcaggagggacauagaaggaacagaagacaagggaauuggggacagggaguccggacagaccugagagcuuuucaggugaacuuccccagcagguaaggccuggccugcagcccaaggucggaacucucucgacucaucccucaucauccagcucucucuguacucauuaccucacccagcuccaguucugaccagcccuucucuguguguccucagaguggacagaagguccuaaaggcagagcugcucugaggagagugaggacaucucucacagccuacccucagugacaccacucuauccucaggggcccuuuaggucuuucccccacuauggucuguagugauauaagagaacacaugagacccagaaccagaaaggugugccuauugucccaaggcagagacacacagugacagaugaccacggagacacucagacuugaauacagacaggagacagagagauaaaaagacagaaaagaaagaaauaggacucugaacgcaaacuuggaggguguaguaaagagagacccaggaggucauggauagacuuucugccagucccacccaccuggucuucaguaauccaaucuguccuggagucauguucucuggcugccacccugcuuucaugucuccacccuuacucacuugccauagcagugggcagcugugagaacccaguugggguucaacaggacucccccgcauauauauuuguuguagcggaacacagccacaugccaggguugagaauucuucucacaguuaaauccuccaacaauucgagacuggacaggaggugcagcaucugcaaaguggcaaugggggaggggagaguuggcacauguagggaggucaacccuugauggacacaguuaagcacugcugggaucaggggaaauggccaggggaucuagggaagggaccaauauauggcugguccuggauagggagaucuaugcuguggguauagaaagaauuccugaaucagggaucagguauaaugucaggccaguuuagaguuuuauguuaagagauggcauguaagcuucaauuuuaguccaaugagaaugaaauucucugguauggaauuuagaaucuucaaggcuugagaagaagucauggccuuggcuggguuuugggcauucuuaaaaggugaggccucagaaaauuggauuugaaugaauaaaugaaaccaggaaagggagcuuggaguugauuuggggguucuuggauugggcaugaaguggcagcuaggauggagagauugaggaauuuccggguaaaaggagcagggucaaggcuagggcgugggcuccuguuagggucugugguggaauugacaucuaagagguguggggcucccuaagaaaggauuuugaguugagacaagcagugagagaaggaaauucugggggacugugaggaaaaggcucugcuccugugcaggugggcaaguggucugggcauuggauaggaucauuguucucuuggaggcagccccaagacaggaguggaaaaggaauuaaaaccuuuggacagaaauaaaaacagaucaagugaggccacugggaggcagagaggaggauccaauauaugagguacaaggguuaggcauuggggucuuugggguguguugcacagagagagaacuagagcuguguauuggggcucugaugagauaggacaggcaccugcagcucagggagugaggcaugagggggaagagcaggccaaggcacagcauuuggaaacaagaaaucuugggaagccaugcacuguaaccucaggacacagcaggcugaggcugaggcugagggauugccauggacugaagacaagccugggcuacaucaugagacacuaacucagaacuuauucccaagaucugggcuggagauggcuugguugcuacucgauuggucaugcaagcauuaggaccugagcugaaccauccagaacacagggaaaaagucagguaugaugcugugugccuguaaacccagagcugguuagguggaaacaugaggauucccuugaguuuugcuggacagccaucuuagccuuaacagaagucuccauucagugagagccccugccaauguugugaguguuugauaaugauacuuguugaagucugguaucugccaacugaccccuuguccaaaaaugagacuaaaucaaaaagccagcgagaagugacccgggcauucucuccacaccagaaagggagggggaacccaucugacuuuauaagccaauuugagaugaggaaguuuugguagaaacugagcaucuugggaauaugggggaucaguugucaucagguggugaacacagaggaaggcuggcagcucuggacagccuaagguuuuagugggggguuuaggcaagucucugacucaagguuggggcuaugaggcuguaggaaaaacaauguacuguaggaaaauucuuguuuuaaguuugguaagaaguugggauccuuagaaagacuguagaagaacagagauggucaggugucuaagaaagaggagaaaguucuggaaagugggaguggacaggggccuguccugggagcaaggacugugagggaccuggcagugugcagggcagagaaggagcagcagguguugcuucaugauguagcugcgcugaggagagaggggaaaggaaugaucagggccaaaggcagcaggaaagucagggcugugaccccucccuuccccucaucucaccaaucucuccuagggacagggcaaggaacaggaucaggaaccucaugguaacagguguccagguuccgcaggcagugagcuuggagcuguugaagauccucgggagacuuuaaaacccu

SEQ ID NO: 3758 - RNA, 4983 nt, Mus musculus
aaugcagaucuggauuuaguggaggggugaggugggcagcccuggaacuucugccuucgugaguuucuauuaaauggcugguucauugcccucuguagggugugcuguuugauucgguuccggcguggguagaaucugggugaugagcuggguccagagcaggugaggcacaggcgcacuugcccaccuuuggccuguuuccagaggauacuccagcggucuggugaggaaaggugggcuggugggggccagucacagccacuggcuggccuuauccccuaccucagagccugcaauugaucagacccucuaguucaagcuguucuuggauuccaggguaugcuccuuagcuuccuuaggcucuuaggucuugauguaccucccccagauaggaaaccucucaagacagggcuggggggcucuggggaaugaugaacacaaggcaaugggcauggggcuccaggugauggcagugacacaguggcugcugguaggcuguuccuuaguaggaguuaagcccucccucaagugucaccuggggggcuggcaggcucccucaaguggagggaucucuaucucuaucuguucugccaccauaccaggguuagaguugcuuaaggcaauugaguccugugugcucucaggcuacagguucccaccugcacacgugcuuauugugagccccgacaccuguauguacaacaccugauugcaguguccaagcaagcauaaugcuugaggcccacccagccuucauccccacacgcgcaugagcacaguaagugacaagccagagcagcaagugagcacacguguugggauccagugucagcucgggguauuuuugugucuauucauccccccucacacagucccucccagggcccgcaggcaucugggccuccaggccagaagaccaagccccaggcuuagcacggccagcacagccacagcuccggccagcaggggcaccguggcugcaggaagaacauggggguugugaaucccaggccuugggaacuccccacucccaccccagcguagagggcugucaccuggggggcuggcaggcucauaagaaccauggcagggggccccaugggcuggaggccgggcuggagcagucagcugcuggaagcgcccaaguggacagggagcugggcacccagggacccugaguggcaggggugggcgggaggugucauugcgguagaugagagagacagugacauuccuggagguggaaaggacaguagcaucacuaguuccccauccgaagaagagcccauccacccaaugccaagccaucacccauccucacucuccaucuuccuccucggguucccuggagcucccccggaauucaaaggccaugcaggcagcguaaggugggguguucccaucguagaggcccagggcccccuggagggccagcagggugcugucaugcugaagagaauuuccagggauggaagcuaaaucagaaccccagcaccuagauugucuccaguuagaaguaaucccagaccacucccauucacaucauaggcauucuauaaugauuguccaaacgugcaaauugugacugggcaguucccauucuacagucaguccuuucaggacuaaagucuugcuucucugacccccucccucaucuuuacuguguuucuaaugcugcaguacuguacuguaggagaugagggugagccaaggcuggagacugagauugcauaggcacuguagucucaccaccaccaccacaaccccugucacucaugcagcagugccugcccuucccaaggacucacagcugaguacaugaccaucuugaggggcaacccaaggcgcuggguccgggagaaauugcugagaauagcauccagcaggaucccugagggacagacggggaagagaguauguagaugcccccucuccaccugcaaaccagcucccccaagcccacagaccccacaccuuacccccugucagcugggccuuuucugcugcucggggugggccuacaugggcccugauauccagagcagaaaucugugacagaguccucaagacaucuggagaggcccaggauggaaggucaagaccaugggcacgcugagaguggagagagaaagggucucaagugggaguccucagucaacccccccccauuuguuuuggagugugugugugugugugugugcaccuagguuagagguuaccugcauauguuccucaagccuggcccaccucguuuguuugagagccuccccuggccuggaacucaacaaguagaccaaguuggcuggcuacugaaccccaggauuuuccugucaaagccucaucagcaggauuuccgugugagcugcugcacccagcuuuuucauguagguacuagugaucuaaauuccucauguuuguguggcaagcaccuuacagacagccaacccuccagacccuggcccucauucaaaccccucaaagaucaguucagcacaggaugagccagaccaaguaccagaccagaguccuuaccaagcccugugggaccagagaugccuuggaaucugacauucgguuuucuagaaagauccaaugaaaugguaccaggaaaggagauuuuauauauauauauauaugcuaugccaccaucucaucagccugccacuauccccaccacgcagauggggaaaccaggguacgcagagcuaaaucucuugcccugauauuugcauauuugaaauccccagaugggagaggggagaaaaggacucaccuggcagaucaagguauccagaacuuuccaugcucuccggaguggcucuccaaccagggacagcccagugaaguugcccaggcgggucaggaaguccugaguggagauacagggcugggugagccuaccaguuguugcuuggcacccagccacaccagcccacaccagcacucaccguccagcccuccagggccuccugguagucagcugccucuguggacucucguaacagcucaugguaucgaggacagcugcgcauggggaaccucagcaacugggggaaacugaggcucagggaaggcagcagcaagucuggggucucacaguuggccauggggccagggucucuagcccucaacucucccaguuuccccuguuauccagcugugcugggcaggggugucagcuuaccaacucuggacagcuagcucuaccagggauaaccuuucugaucucagcuguucugggcuuccagaaauggauccaccuggcuuggagcugccucuuccccucuccagcucaguacugggcuuuauuuccauccuuuuuuguaugugugguguugguuauagaacccagaaccuuggacaggcuaggaaauccuucuaccucuaagccacaccccccagcuccucccuagguagguaguuuaccacugagccacacuccucccagccccuccucacuagaggauucuaagcugggggguuuaccccuauacuacauuccacuccucuuguuaaacuguuuguuuguuuuuuuuuuuuuucauuuugagaaagucucauuaagguucccagaaugagauuaaacucgauucuucuguuucucccaccagaugaagcccccugaccuuguccucagacacaggcacugugugcacuggaaugggcuuccagucagucucaggacuuccaggggcagccucagggaagagcccagccagguuggcuugugcacucuccaauguccggucaaagucugugcugcggauguacaccugggguggaugagggcagcagagcagguggacaggccaagggucagcagggucucaaaucaaaaacuucagauuuaguuuggagugcguaagguuaaaggucaggaagaggguggggucaaaggacaggcauucagggucaaaacucaaggugaauucaugugucuaacuuucagcuuuggaaguugggaucaaaggucagaguugagugauguguuggacugcuggggucugcugagaucagaucaaggggccugggaguaagaggucaagauguagaaggugggaacugaauaccauggagcuaaauuugauuacacaguccucagagaagucaggggccagccaacggaagugagaagacagaaaaggaaggucaaaaugcugaugguagggagcaaagguuggagguuggaaaugggggugguacccagugguggagggcuugccaagcaugcacagguccagauccuuaccaagaaaccccacccccuaacagacaucaggugggcaaagcaagcaucaaagacagaguuggguucaaaggucaggaggucaggauggggcgguuggaaaucaaggcaaagguugagguccagugaguggaaagacagaucguuugagagaaggucagaggucgguguggauucccuacugacuuagaagcccauaggggugcaggucaaauagauggagaucaaagacaagaggugaagaccaaagggggcucuggggucaaaggucaacaaaguaccucuucucgcuuguacucagggcucaggaaagccuuguaacgccuccucagaaaucggcccaguucuagcugcuggcggauccccuccuagggacagagggggccucagcagacccucaucgccugaccccuagcccucuuucucaccccaucucccuccucaccuuagucaguuggcccaagccucgaggccacaagguggaggcagcuuccuuguguggaucugugggguaggaggccaguggggcccggucgccaugucggaacaccuggggauguuggagaaccaggucaggacugacuuggaagguagagggugggucagguggggucggagggcuucgcaccagagccacaaauaacaggggccccuccggcagggcccgaggcagcaacagcaacagcagcagcagcaaggguccgacgguguggcccugagacccgggcucagccauu

SEQ ID NO: 3759 - RNA, 6269 nt, Mus musculus
caaaguucauucacugucaggccugguacaggggccagcaagcacagcagaucccccacagcaggguaccuuguuaaagaccauggccaccaguacgcucccucaaguuccuuacaagguggggguggugggcuauggccgccugggugaguaagaccuggccuggggucucuuucuaugcccuguuccuaauguuccagaaacauuugcuuccaucuaucuuucaccccagccugccagcccagccugccuucugcccacucacugggccucccucugucucucugugucucucccucugagagaguguuuaucucuggguaucugccucucucuaggucucuguccuuucucugggucuccaaggucugucugucucugucucuccccccccccaccuuccccucuucucucucccaucuucugucugucuuucuucuugcucucaucucugugugugugucugggucuuugugucucugucucuguguguaugugucucuguguauguggggcaucucugucucuccuuucuagguuucuauguauucugucugugugucugucugccucuccucucugggcuucugacuguauucugucucuaggucccugacccccccccacccccaaucucccugacuuaggaggggagggucucucuccuuuccuuggaucccuagcccuccugucucugcaggacagucccuugugucccgccuucuggcucagggaucagaacugggccuagaacuuguuuuuguguggaaccgugacccuggacggauggcagggagugugcccccugcccugcagcuccaagaccucacugcccuugaggaaaggucagcgccccacagaaggagccuccccaaagcugcuuccugccucccugugucagacaacccuuugacccuuucugagucucagugcauauaaagagaaacuagaaugcacccacuaucccacuccccucccucagccaggguaagcagugcuaucccuccaaacccugaggaccugggagacaggagaccugacucuucuccaaggcccucccccuccaugucucucuuccuaggcacccugaccuugugguagaaguggcccaccccaaaauaauccaugaaucuggggcacaaauccuucgccaugcaaaccuccuggugagccuccuugccccucagugagucccucucuguguuggcugcaucccacccuccagcaguaaucugggucuuggccuugccucucucuaccauccgugucccaaggugggaucccccucagcucuggcugaccagaccacagagcagcagcuccuggaggcuucaaagcgcuggggccacacuguguuuguggcccgaggggcccuauggggcagugaagacaucagcagacuggaugcagccggaggccuccaggugaggacugucugggcugccagacggaacauguaagagucucaaucuccugacccugccauugcuuccagagccuucgagucaccauggccacacauccugauggcuuccggcuggagggaccccuggcugcagcccacaguagugggccccgcacagugcucuaugagggcccugugcgugggcucugucccuuggccccccgaaacucuaacaccauggcagcugcugcccuggcugcccccagucuaggcuucgaccgugucauuggggugcuuguggcugaccuuagguaagcacagggcguagguggcacagcuguguacacuccggguggacugacugcacuucucugccggcugcagccucaccgacaugcacgugguggauguggagcugcuaggacccccagggccuucaggucgcagcuuugccgugcacacccacagagagaacccagcccagccuggcgcugucaccggcucugcuacuguuacagccuucuggcacagccuacugggugcggcaggccccuccaagggucccuuggcguuugugcucggcagagcucacauguugggugucccaaccccaguuuucugucuuuucucauucuuaguucucacucccaggcucuaugagccucucuuuccccgccccgcuuucucucagcaucugggucccccucuaggucucuacauccacaugccacaucucuuucugaguauccuccuugacuuguaccacauuaccuuuuccaaaacccacguccaccauggccaccugcaugugucuguguugucauccuaguuuuucauucuccccacaggcugcugucagcucaccuccagaccugggauccaccucugcugagucuccuccccuacuacccuuacugucauauugacaacuaugggucccaguaaacaucagaguucagcccacuguucucuuuggccucuuugguuccuuguccccaccucuaugucgucacgcuucagcuacacacugaguaugacgccauagcagcagcgugcgagcucauacacaaaccagcccccugaaagcuaucgcgagaucacucguuaccacaacucccagaaaccucuaggcagcagugagcccugggagagaacgagaacuggcugcuuuguccgaugggaguuguagucccacgcggcagagcagccccggaggacuuccggacugcgcguccuauuuagacgcccuacggaggccuucgggaaucgcaguucggcgcgcgcaagucgccgggagcuguagucccuuucgccugcucagucagcgugcuaccacccggucgcugccuagggaaugcgaaagcggucggucccggggagcagaaaggccggcggggugagggccaggcgggcgacaagcaaaggcgggugggagugugccugguugccaggugacaggaaaaggugggggcuccuguugcuuaguaacugguagagggccucguugccaggugaagggaggcgagaacccugguuauugaggaggggaagucuuucguugcuaggcgaccagaagagacccuguuacccagagacgggaaaggaggaguccuccauugcuaggugaucagaaaacggaccaggauacccagagggugggguuguucuguugcuugggaacuaaaaagguauuguuuccuagggacagaaggggugguaguccauugcuaggugaugaugaucaggacccuuuugcuuggagacauguagugggggugggucucuauugccaggugagcagaugagagccucuacuccccccacucccaggacugggcucaaaaggugucucugugcucuggagacagccugggaaauagggucagggccucacggccuccuaagcuagccccagugcccaucucaauguccauugcccagggacccaggaaucuagagaaccgaaugagcaagauccuaggugccuaacaccuccuugucccaccccgcagcaggagcugaggagggcaugucucaggcuccggaagcaaggccgaguccacccucaguguaucaugagcggcagcggcuagagcugugugcuguccaugcucucaacaacguccuucaagagcagcucuuuagccaggaggcugccgacgaaaucugcaagaggugacugccauuguuccccgcccuggaagagcagggcucagagaggcacgggagccuuccugggacccuagcagggccaaggcuccgauccaggagcuguugccugcccucccaccugcugcuucucacagccucagccccagcuuuggccucaaccucucuuaucugagccucugucacaaccucccagcugucuguuuuucuucuccuggucguccuacacacagccccacagcugcuugcccccuccucugcuucuaucccucuuugguuccccagaacuccuagggacuagccccgggccuucaggcugaacucaaggccuugugugcucggguccuugccuaccuuucugcagcuucauccuucgauguacuccuaggccuccaacaggcuguucccauguuacacaaggcauuuuuuuccccuucuuggucccuuuguuugcgccucacaauuucaaccaucacuuuuguaagaaacuuucuugaaucucucuccccauucccaccucuaggcugcagggugcuucuaugggcacauagacaccccagccuguaguccuugcccagauccacaggcagcccucaucuguaaacuucagacuuacuuagaacauacgcaucucucuuucuccagcucuuucuccagggacaugcugagcagcucgagcugaggcagaugucacaagggggagaaggcugggagagcugcagacaugaguggcucccucuugacacugcucgccaaggguccaggccuacagaggagcagggccacagagcuggggagagcuagagggaaggcuugggcacagggacaucugggauggguggcugcuaagagcuggugcugaggcuaugcagggccugcuugccacuggaggaggugggcgucuguccugggaugauagggcacuagggaugccucugagcaggguagggcaggguguucccaaaagaaaggggcacucuguauucagauauggcggcaugaaugugacuaucacccagggacucugagcacagucuugggucugaaggcuccucucccagaagaaaugacaucugaagcuggucuggagagagaccgugacgagugggaagaauggaggggcagggacuuuguccagagcacuugggagucacgggagaaguggaaguaggaagggagcagggcaacucaggcuccuggaaguugaagguaggcuagagggagagacuagaggcugggaaggguuucugagugggaaaagauaaagccuuagccagucuaagaguacagggcucagggguggagggagaacaggacgugaggaugauaaacuguguggggguugaagagagacgcgucaaaggccaggcucugggccucuccuaucaugugggaagguggaggccuuuccaggauuucaaaccuuggcucugcccccuccuucccaggcuagccccagauucccggcugaacccccaucgcagucucuugggcaccggcaacuaugaugucaacgugaucauggcugcccugcagggccugggccuggccgcuguguggugggacaggaggagguagggccuaggcugugggcugcacugccucugggcgugugggaugacacagaggguggcuugaagggagccagggaggcuauggcagauggggucugacugaacgaugggcugaacuuauaaacuugguaccaguccaaaggguagccaaaugaguaacuuacgauuaaggugggaaagacagaaguuagucaagaguaguggagccaucuuguuggcccaaggcaggacuaagcgggaagccagccuggacugcauauggagagccugggucaaaagggcaaacaacaaaaaguugagguucugggguuccauuggcagaaggcuuccccgucacauaugaggccaggauuccauccccagcacuccaucaacugcuguaguggugcacaucugggauacccgagacccugccuaaacaaaccaaagcuggaguugacagauaagaggguaaugggucagugagugaauagacgcucauucuggagaaggaagcaggauccaagugccucuguggcccgcaacccagaccucagugacucuggggccucaugcuauaucccuccccuccccagaccccugucccagcuggcccugccccagguacuaggccugaucuugaaccuacccucuccugugucgcuggggcugcugucccugccacugcgccgccgacacuggguggcccugcgacagguagauggcaucuacuauaaucuggacucaaagcuccgggccccugaagcccugggggacgaggauggagucaggugagugguaaagagagugacaggcuggggccaacacuggaacugcccugcaaggagauggacccgccuggacugcugagaccucagucuuccacucucccccucaggaccuuccuggcagcugccuuggcccaaggccugugcgaggugcuauugguggugaccaaggagguggaggaggccggcugcuggcugaacacaagcugaucugcugccugcucccacaguccuaaguguccagugccuggaagggccugcagcuccaggccucaggaggccugcacccugcccuaggguccccacucccccaaccacugcugccucaauaaaucugcucuuuuguuauuugug

SEQ ID NO: 3760 - RNA, 6269 nt, Mus musculus
cacaaauaacaaaagagcagauuuauugaggcagcagugguugggggaguggggacccuagggcagggugcaggccuccugaggccuggagcugcaggcccuuccaggcacuggacacuuaggacugugggagcaggcagcagaucagcuuguguucagccagcagccggccuccuccaccuccuuggucaccaccaauagcaccucgcacaggccuugggccaaggcagcugccaggaagguccugagggggagaguggaagacugaggucucagcaguccaggcggguccaucuccuugcagggcaguuccaguguuggccccagccugucacucucuuuaccacucaccugacuccauccucgucccccagggcuucaggggcccggagcuuugaguccagauuauaguagaugccaucuaccugucgcagggccacccagugucggcggcgcaguggcagggacagcagccccagcgacacaggagaggguagguucaagaucaggccuaguaccuggggcagggccagcugggacaggggucuggggaggggagggauauagcaugaggccccagagucacugaggucuggguugcgggccacagaggcacuuggauccugcuuccuucuccagaaugagcgucuauucacucacugacccauuacccucuuaucugucaacuccagcuuugguuuguuuaggcagggucucggguaucccagaugugcaccacuacagcaguugauggagugcuggggauggaauccuggccucauaugugacggggaagccuucugccaauggaaccccagaaccucaacuuuuuguuguuugcccuuuugacccaggcucuccauaugcaguccaggcuggcuucccgcuuaguccugccuugggccaacaagauggcuccacuacucuugacuaacuucugucuuucccaccuuaaucguaaguuacucauuuggcuacccuuuggacugguaccaaguuuauaaguucagcccaucguucagucagaccccaucugccauagccucccuggcucccuucaagccacccucugugucaucccacacgcccagaggcagugcagcccacagccuaggcccuaccuccuccugucccaccacacagcggccaggcccaggcccugcagggcagccaugaucacguugacaucauaguugccggugcccaagagacugcgauggggguucagccgggaaucuggggcuagccugggaaggagggggcagagccaagguuugaaauccuggaaaggccuccaccuucccacaugauaggagaggcccagagccuggccuuugacgcgucucucuucaacccccacacaguuuaucauccucacguccuguucucccuccaccccugagcccuguacucuuagacuggcuaaggcuuuaucuuuucccacucagaaacccuucccagccucuagucucucccucuagccuaccuucaacuuccaggagccugaguugcccugcucccuuccuacuuccacuucucccgugacucccaagugcucuggacaaagucccugccccuccauucuucccacucgucacggucucucuccagaccagcuucagaugucauuucuucugggagaggagccuucagacccaagacugugcucagagucccugggugauagucacauucaugccgccauaucugaauacagagugccccuuucuuuugggaacacccugcccuacccugcucagaggcaucccuagugcccuaucaucccaggacagacgcccaccuccuccaguggcaagcaggcccugcauagccucagcaccagcucuuagcagccacccaucccagaugucccugugcccaagccuucccucuagcucuccccagcucuguggcccugcuccucuguaggccuggacccuuggcgagcagugucaagagggagccacucaugucugcagcucucccagccuucucccccuugugacaucugccucagcucgagcugcucagcaugucccuggagaaagagcuggagaaagagagaugcguauguucuaaguaagucugaaguuuacagaugagggcugccuguggaucugggcaaggacuacaggcuggggugucuaugugcccauagaagcacccugcagccuagaggugggaauggggagagagauucaagaaaguuucuuacaaaagugaugguugaaauugugaggcgcaaacaaagggaccaagaaggggaaaaaaaugccuuguguaacaugggaacagccuguuggaggccuaggaguacaucgaaggaugaagcugcagaaagguaggcaaggacccgagcacacaaggccuugaguucagccugaaggcccggggcuagucccuaggaguucuggggaaccaaagagggauagaagcagaggagggggcaagcagcuguggggcuguguguaggacgaccaggagaagaaaaacagacagcugggagguugugacagaggcucagauaagagagguugaggccaaagcuggggcugaggcugugagaagcagcaggugggagggcaggcaacagcuccuggaucggagccuuggcccugcuagggucccaggaaggcucccgugccucucugagcccugcucuuccagggcggggaacaauggcagucaccucuugcagauuucgucggcagccuccuggcuaaagagcugcucuugaaggacguuguugagagcauggacagcacacagcucuagccgcugccgcucaugauacacugaggguggacucggccuugcuuccggagccugagacaugcccuccucagcuccugcugcggggugggacaaggagguguuaggcaccuaggaucuugcucauucgguucucuagauuccugggucccugggcaauggacauugagaugggcacuggggcuagcuuaggaggccgugaggcccugacccuauuucccaggcugucuccagagcacagagacaccuuuugagcccaguccugggaguggggggaguagaggcucucaucugcucaccuggcaauagagacccacccccacuacaugucuccaagcaaaaggguccugaucaucaucaccuagcaauggacuaccaccccuucugucccuaggaaacaauaccuuuuuaguucccaagcaacagaacaaccccacccucuggguauccugguccguuuucugaucaccuagcaauggaggacuccuccuuucccgucucuggguaacagggucucuucuggucgccuagcaacgaaagacuuccccuccucaauaaccaggguucucgccucccuucaccuggcaacgaggcccucuaccaguuacuaagcaacaggagcccccaccuuuuccugucaccuggcaaccaggcacacucccacccgccuuugcuugucgcccgccuggcccucaccccgccggccuuucugcuccccgggaccgaccgcuuucgcauucccuaggcagcgaccgggugguagcacgcugacugagcaggcgaaagggacuacagcucccggcgacuugcgcgcgccgaacugcgauucccgaaggccuccguagggcgucuaaauaggacgcgcaguccggaaguccuccggggcugcucugccgcgugggacuacaacucccaucggacaaagcagccaguucucguucucucccagggcucacugcugccuagagguuucugggaguugugguaacgagugaucucgcgauagcuuucagggggcugguuuguguaugagcucgcacgcugcugcuauggcgucauacucaguguguagcugaagcgugacgacauagagguggggacaaggaaccaaagaggccaaagagaacagugggcugaacucugauguuuacugggacccauaguugucaauaugacaguaaggguaguaggggaggagacucagcagagguggaucccaggucuggaggugagcugacagcagccuguggggagaaugaaaaacuaggaugacaacacagacacaugcagguggccaugguggacguggguuuuggaaaagguaaugugguacaagucaaggaggauacucagaaagagauguggcauguggauguagagaccuagagggggacccagaugcugagagaaagcggggcggggaaagagaggcucauagagccugggagugagaacuaagaaugagaaaagacagaaaacugggguugggacacccaacaugugagcucugccgagcacaaacgccaagggacccuuggaggggccugccgcacccaguaggcugugccagaaggcuguaacaguagcagagccggugacagcgccaggcugggcuggguucucucugugggugugcacggcaaagcugcgaccugaaggcccuggggguccuagcagcuccacauccaccacgugcaugucggugaggcugcagccggcagagaagugcagucaguccacccggaguguacacagcugugccaccuacgcccugugcuuaccuaaggucagccacaagcaccccaaugacacggucgaagccuagacugggggcagccagggcagcagcugccaugguguuagaguuucggggggccaagggacagagcccacgcacagggcccucauagagcacugugcggggcccacuacugugggcugcagccaggggucccuccagccggaagccaucaggauguguggccauggugacucgaaggcucuggaagcaauggcagggucaggagauugagacucuuacauguuccgucuggcagcccagacaguccucaccuggaggccuccggcugcauccagucugcugaugucuucacugccccauagggccccucgggccacaaacacaguguggccccagcgcuuugaagccuccaggagcugcugcucuguggucuggucagccagagcugagggggaucccaccuugggacacggaugguagagagaggcaaggccaagacccagauuacugcuggagggugggaugcagccaacacagagagggacucacugaggggcaaggaggcucaccaggagguuugcauggcgaaggauuugugccccagauucauggauuauuuuggggugggccacuucuaccacaaggucagggugccuaggaagagagacauggagggggagggccuuggagaagagucaggucuccugucucccagguccucaggguuuggagggauagcacugcuuacccuggcugagggaggggagugggauagugggugcauucuaguuucucuuuauaugcacugagacucagaaagggucaaaggguugucugacacagggaggcaggaagcagcuuuggggaggcuccuucuguggggcgcugaccuuuccucaagggcagugaggucuuggagcugcagggcagggggcacacucccugccauccguccagggucacgguuccacacaaaaacaaguucuaggcccaguucugaucccugagccagaaggcgggacacaagggacuguccugcagagacaggagggcuagggauccaaggaaaggagagagacccuccccuccuaagucagggagauugggggugggggggggucagggaccuagagacagaauacagucagaagcccagagaggagaggcagacagacacacagacagaauacauagaaaccuagaaaggagagacagagaugccccacauacacagagacacauacacacagagacagagacacaaagacccagacacacacacagagaugagagcaagaagaaagacagacagaagaugggagagagaagaggggaagguggggggggggagagacagagacagacagaccuuggagacccagagaaaggacagagaccuagagagaggcagauacccagagauaaacacucucucagagggagagacacagagagacagagggaggcccagugagugggcagaaggcaggcugggcuggcaggcuggggugaaagauagauggaagcaaauguuucuggaacauuaggaacagggcauagaaagagaccccaggccaggucuuacucacccaggcggccauagcccaccacccccaccuuguaaggaacuugagggagcguacugguggccauggucuuuaacaagguacccugcugugggggaucugcugugcuugcuggccccuguaccaggccugacagugaaugaacuuug

SEQ ID NO: 3761 - RNA, 1346 nt, Mus musculus
cugcuacugugugggcuguaguguggguacaggcacugucacugugcaggcuguaguguggguacaggcacugucacugugcgggcuguaguguggguacaggcaccugccacugugugggcuguaguguggguacaggcaccugccagugugugggcuguaguguggguacaggcaccugccacugugugggcuguaauguggguacaggcaccugccacugugugagcuguaguguggguagaggcacugucacugugagggcuguaguguggguacagacagugucacugugugggcuguaguguagguacagguaccugccacugugagggcuguaguguggguacaggcagugucacugugugggcuguaguguggguacaggcaccugccacugugcaggcuguaguguggguacugggacucaaacucggaucuugcugcuuacauaacaaauacuucaucaacaaaccugucucccauuuauuucucuuccugucuuucuuccauccucuggccuuugaccucucuccuucuucuucucaacuucuuugccuuucuccuccgcacccuccuucccuccccucccuccccaguucucaaugcugagagccucuaaauggguuccucuccugcucuccccagcccccugccuuggugcugugagguccucaggcccugagagggaggugggucaccagcagccacagaaagucauggcaguagguugaucaccggaagcauggcuaagacugaguccagguguggcucaggcuuugugacacucuuuuuuuuuuuuuuuuuuuucuguuugcccuggacacuggcuggaggaaugaggccuggaagcaggaagcaaaagaucagcucggagagaaggaagagugcugccccagacacagcggguaagagccagaacugugugcaauccugggcuggccagcgaugggcucugggacucuugugagauugaugaaggcugaugaggcugcucuguccccugccaggugccccaucuucuucaggcaucagcaaugaaagaccucggcugacuucaguuuuccagaugaaaacaucuguacaccugcaggacacugaaaaccugcagcugcuaggacagaggcuucuuaggacucaccugccuuggaggaccaacacugcccagcaucugccaucuguguguuuggaaaggagcuaaugggacucugucaccaccugcuggcauggaguggaacugcaacccagcuauacuaggcacugcaaacuguucaaagaauggaggagugguggguggguauggaaaauucuguagaaauaaacauguuuacuccuaacacaguaac

SEQ ID NO: 3762 - RNA, 1346 nt, Mus musculus
guuacuguguuaggaguaaacauguuuauuucuacagaauuuuccauacccacccaccacuccuccauucuuugaacaguuugcagugccuaguauagcuggguugcaguuccacuccaugccagcagguggugacagagucccauuagcuccuuuccaaacacacagauggcagaugcugggcaguguugguccuccaaggcaggugaguccuaagaagccucuguccuagcagcugcagguuuucaguguccugcagguguacagauguuuucaucuggaaaacugaagucagccgaggucuuucauugcugaugccugaagaagauggggcaccuggcaggggacagagcagccucaucagccuucaucaaucucacaagagucccagagcccaucgcuggccagcccaggauugcacacaguucuggcucuuacccgcugugucuggggcagcacucuuccuucucuccgagcugaucuuuugcuuccugcuuccaggccucauuccuccagccaguguccagggcaaacagaaaaaaaaaaaaaaaaaaaagagugucacaaagccugagccacaccuggacucagucuuagccaugcuuccggugaucaaccuacugccaugacuuucuguggcugcuggugacccaccucccucucagggccugaggaccucacagcaccaaggcagggggcuggggagagcaggagaggaacccauuuagaggcucucagcauugagaacuggggagggaggggagggaaggagggugcggaggagaaaggcaaagaaguugagaagaagaaggagagaggucaaaggccagaggauggaagaaagacaggaagagaaauaaaugggagacagguuuguugaugaaguauuuguuauguaagcagcaagauccgaguuugagucccaguacccacacuacagccugcacaguggcaggugccuguacccacacuacagcccacacagugacacugccuguacccacacuacagcccucacaguggcagguaccuguaccuacacuacagcccacacagugacacugucuguacccacacuacagcccucacagugacagugccucuacccacacuacagcucacacaguggcaggugccuguacccacauuacagcccacacaguggcaggugccuguacccacacuacagcccacacacuggcaggugccuguacccacacuacagcccacacaguggcaggugccuguacccacacuacagcccgcacagugacagugccuguacccacacuacagccugcacagugacagugccuguacccacacuacagcccacacaguagcag

SEQ ID NO: 3763 - RNA, 2571 nt, Mus musculus
agacucuggaaagauggacacaugauaauuugagcaacaguucuuuaucacagugaucauucuggaaagaugacugccaucccaagaguugcagcgcugguguccggguucugaugacuuauuuagcaggugaugagcugucacuguggcacugcaggagaaaugagaggugggugaggcaggguaagauggacugcaccaugucucuacccaaaauccgccagcagagggagcaagagaguucccauccagcaaacaccaguguagucaugguccucucucucucucucucucucucucucucucucuuucucucucucucucucucucucucccucccucccucccucccucccucccucagcagggcugcauguaaccccagauauccuugaacucaaauauguagcuugaacugcuaguccuccugcuuccaccuucccaaugcugggaugacagucauccaccacuguggccagcuuacagagugcuggggauggagccgaggcuuugugcuagacaaacacugucuccagacccacagaaagagaaagggucucauggcauccaacauuccacauaguugaggcucuugauaucucaagcaccuaagaacuauggcuacagaugugcuuugacaugccgggccuuuuguuuuuaaaauuguuucuaauguuuuaaauuuauuuauuuuauguugagugcauuguaguugucuuuagacacccuagaagagggcaucagauuccauuaaagauggcugugagccaccuugugguugcugggaauugaacucaggaccacaggagcagccaguauucuuaaccacugagccaucccuucagcccuuguucuaaaauuuaaucaguuauuuuauguguguguuuauguucuccaugugcagggccuaaagggggcuuuggagccccuggaacuggugcuaccaauggcugugagccaucauggaguccugggaacugaacucggggccucuugaagagcagccagugcucuuaaccacugagucaucucucuagcccuugauuuuucacuuuauaauguuuugacgggaucauacuauguaacucaggcugacuuagaauucacucuguagcauagguuggcuucaaacucacaucuccuagaucagcuugagcauucuuggguacuggaaugacagaugugcagcacaccccagacaguuuaaaagucauuuuaaaucccaaauggggaugcucugagaaccugccagcugucagaagucagcgggagucugccgugaggaugcaucugagcugacuuagucacccacaagaagaccccagaauagaggguggcucagccugacuccagaaugcagccagugggagggggaggcggggugcucccagaacugucccugaggggcugaagauccuguuugcuaagcugucucagggccagggacaucagcauugucaagugucuccagaucaagcaggggcaugcuaauguguacucugggccaccugaucugccuccuuccacaaugucuuggggacugaauccagcaaaggagaugaggaaguuuucuuggaagaugguucagcauaugccagagaccaagaguagggacauauguagccacuguagucccaccaagacacacgacaccacuguggucccaccaagacacgcgacaccgaauuccaggcuggaaagacuguggugauggugggggaguuugacgaguaggggagcgcuagcucaacucugauuccaggggcgaaggacaggaggaggcuugacagaggagggauugcagguggggcacaagcuagggcuggugcucuccaaccccagggccuuugcaugaccuguauugccuucuugccuggggcaucuggguagguucgccaggggcccuggauuagggucagucagugugggaccauucccuucucaccucggacauccaguuugcauucagccagggcuucccccagcucauugaaggcgcggcaggaauaggucccugcaucaaagggugacggucggcggauguucagugucaggaugcccugguaguugguuaugaggaauuugggaucuucauggauuuccaucuuguucuucauccacaccaccuuuggcuagggaagggaaccagggagaaagcugacuuaaagggauguccuggacagaaaccaugacacuaccugcauggguacacaggagagacagaggaccccaguuggccacuauuccucaucaccucccaccuuuccucccugugcuccaggcacugcuauuuuggggacagacccgaugaugacuucccacccagggcccugggacugucugcucccucucccaacccugcaguuccugccugucccacccuucccuggccagcugcaucccggccagggaugucucucuuacugucuuagcccugccucucguucucugucacgcuuaucaccauucacgguuuuauaucacuugugagacuugagaccagugucauucuuccuccaacacaaaggaacuucuuugucccauuugugaagcacaaauaaaguucaggaa

SEQ ID NO: 3764 - RNA, 6081 nt, Mus musculus
uagccugcucugaaccaccaugcuugcucuggaggcugcacaguaaguggguaacccccaauccuguucuugggacccccaccccacucagcacagcauccucagcuucuguggcacccagaggcaggugauaagggggugaaucuccaucagcucugucuuccuagacaagguuccagagaugguguguucuggagacacccccacuccacaacccgcccugaccccauccugccuagguguucccaggugugccgucuguccuugacaguauugcauggcucauuuucuggcccucugcaccuugaguucugucuguuucuaguuucuucuguccagcguuuccuuugguucuugguucugcccuggcugcccauccuggggcaccagaaaugaacugcuuagcucaccccccccaccccccuuacuguauuccuugcuagccuggcucuuuaguucauugcugcuccuagucucagccagacuuacuaagacacucaaacccaguucucuggccagccuguccccagcugucuggggacuuucuccccuacuuucccugccucccccagcgucugugcaugcaaaucccagggagagugggggacauuugccuggcacccgcccccuacuuccugucccgauaggguugugggggggccuggaggagaaggcugggcgcacacagggacagcccacagacugcagagcuguggugggugaucacagcugccaccaucuccccucugggccccacaaccacuuugagacucagguggcugagggcggcccugacaugccccugugucucucuccugccaggcuggauggcccacacuuaagcuguuuggugaguuggacacccccccccccaccagaguauguggcggcccgguauagcccaugggaacuaaccuuacuuagaucaucuacuucuggccucaguuuccagucucugucucccccgacccccauccccaccacaccuuucuguuauuuuccucaaacuccgggcuacuucugagaccuuguguaccugucuagcccuguauggccucuucuuuggaguuauggaucuuacaccuuuuaacuguaguauuuuggacacuauuuuucccaacauuuuugaacucauaacccaacaaugacuuuuucuauggugguggagaagcccuucugccuugaguuuuguugguuugguuugguuugguuugguuugguuugguuugguuugguaugguuugguuugaacugagacaggauuucuccugucuggcuuucaaacucccuaggcaccccucaguacuggggauauccaggagaggcaccugacucguagguuauuuagaauugacgucuugggugugcaucagugagugccuucaugguguauaccucuguagccauuaccagacccagaucuagaaaauuuuccauuguucuggagucccuuccuaggccgacucaccccauauuuuauacugguucauuugaauguuuaaagugacuuauauuuaggucugugggacaccuggccucuuuccuuccaugguauguuagguaccuguucuuucccuuugcugcauggucuaccgcccaccaaagcggccauaguuuguuuaucccacuugcugagaugcuugugaucuggggucugagcagagcugccugaggaugcucugcgcacacagguuuccauccccgcugcacgaacagcagggguuguucgagagucgaucugcucuaagucuagucuccacugcuucuacaauggcuguggcugaagcagcaugcaguuguugaggugaacugguguccugguuaaagaagguggugaaugcaugucaccccauacucauuggaugaggcuaaacagcugcucuaagcucugggccagccugagcuacagagugaguuucuuggguaccaguugcauacuggacacuaccagguuuccuugagggucagagccuuagcagaugcuagcuucuguguaugucuuauucauggauucagucucugugucucuaucuguuucuguccccaucagcccuucccuucucucaccugucugucagucuuccccaagguaggggagggagugucuccaaggccugagaugacccuguccucacuccgccaguacccagaaggagucuucuacgaccuggacagcugcaagcccuucaguuacccagauucagaugggggccuuggugagugaccccagcuucaugccaccuugggcccaguucacagagggugacuuaaggcucaugggagcuuucccccagcagggcagccccuccccaagccaccuccucccccaccuccugcccaucugcucccccaugcaaauucuggggucagagauuugcacagcuuacaaaggccccucugugugggaccuugagguacgggucuucugaccuccuucagcuacuaacucugaccuuucucccagacucuacauggggcuggacagaggccccgccugcuccugccaucgcucccuaugaagccuucgauccugcuacugcugccuuuagccacucccaaacuguucagcucuguuauagccaugguccuaaccccuccaccuauagccccauggggacccucgacccagcccccagcuuggaggccccagggccuggccuccagguguaccccccagaggacuucaccagccaggugaggagccgggacagcuuagagggagagcucccaccuuacaucucuugcacaaccccugagaugaacuucuggauugggggaagggggagcacaagaacacccuuccaagguagcucaaguguccccugggcuccgcacuguauacaucaguucagaaggcagguccuacccaugccaucuacuggcuguauagcuuggggcaacugccucaaccucucuguguauugggacaagaaccaaggcuaguguccacacuguacaggaagauguacauccaaguagugagagccacagagguggggaggacagagggagugcugugcaugugacccugggcagagguggggaggaccaagagugaugugcaggugacccuggucucccacagacccugggcuccuuggcuuaugcuccguaccccagcccugugcuaucagaggaagaagacauuaugcuggacagccccgcccuggaggucucggacagugagucagacgaggcccucuuggcuggcuccgaggggaggggaucugaggcagguaugugggguggagauuuaguggggaugcugacugggagugggggagaggaugcaagaaccagagcacccuaaacacuaauacuucccaaggaaguucccagauccaugcugcuuguugccugugugaccuuggucaagggcaucgaccuuucugugccuggguuuccguugugcacaaagacacaguaacagccaaaggaaacccaauauauaccuacaauccuccuccccuuaggccucugugucugacaaccuuucaaaccaauuauucucuguuggaccucaauuuuccguaugucaaaccagucaucuuauuuauacucccgcgcucacuggagggauucuaggcacggggcucuaucacugagccaagccucacccucuuacuuuuaaaagacagucucccuaaguuaccuaggcugaucuugaacuuggugaucuuuccucagccucuggaguaguugcagccaaccaggcccaacuccauugugaaaacuaaggguggcgaggggccguagcucuggggguuccuuuaacggacuucccccucuuaacgcugguauccaacacccugcaggugcacgcaagaagcugcgccuguaccaguucuugcugggguugcuccuacgcggggacaugcgcgagugcgugugguggguggagccaggugccggcgucuuccaguucuccuccaagcacaaggaguuguuggcucgccgcuggggccagcagaagggcaaccgcaagcgcaugacguaucagaagcuggcccgagcgcugcgcaacuaugccaagacaggcgaaauccgcaaggucaaacgcaaacucaccuaccaguuugacagcgcgcugcugccagccucccggcaugucugagcacuccgcuaaggaccccuuucuggccccuaagucccauggagccccauaugagggcagucaggguucucagcucucccuagagccuccccagaguuuccugugccguguauaggauuccaaucuaggauggucguguuugagggagcacuggccauucuacacgguuucagaauggcagguuucucgggggggggggggaugggggagcccugaugucgucuacgguuccagaaaccgcaguucuugcgaguccugugagcucacaugacaucucaccagcagguggcgcugucuacagccccccccaaacccuuguuuuguuggccagauaggucggucccucuguacucccccugaagcccuuguuagaucugaggucuaguuauguuuggagcucucugagaacccugugccaccugugugugacuuuucucugcguccguuuaugacuuuuguuuguuugagacagggucucauuauguagcucaggcuggccccccaacuuuuaacaaucguccugccucggccuccugagugcugggaugacaagggugcaccaucacaccagguuuuuuccuuuuuugagagauuuuacuauguaacccgggcugggcuauucucaagcuaguggcaguccucuugccucaggcuccucuugccucaggcaccccuugggacccucugggaccuauguccgagaugaauggcuggguaagguagggugggagguucagugaaccuuauagguugggcccuuccuucugggaucccuugaucauaugggaaguucucuaggcucucagcagcccugcauucacacacugacugaggcgcgaccuguauguuguguuugagggggauguguggcagagguauggcuguggcaaggccggugccuuuuauucuugagauugagucuuauguagcucaggcuggucuugaacucacucucacuguguagcuagggaagaccuugagcccuugccucagccagaaugcucagaugucaggcagcgcaccacgugacuguuucuuuccauugucuugucuuuuuguuguuguuguuuucgagacaggguuucucuguguagcccuggccguucuggaacucacucuguagaccaggcuggccuuaaacucagaaauccaccugccucugccucucaaaugcugggauuaaaggcgugcaccaccacgcccuuuuuccuuuuucuuaagucaaggucuauuuguguagcccaggcuggcuucaagcucaugacacucuuccugccucugcgucuggaacuaugaacauaccuuacuacucugugcuuacccacgccauggguagacagacuucuagacuuggucaacccccacccacaaggcaggcaaauuaagucccugcaggugcuuucuuuggaggaaagcccgcuuucauagugaucugucaagcuagaaagcacucccgccacccagauaucuaagugugaaucuuuggacaacuggugacuucuggccagcuuuucuggggccggccucuguccaggugucugcccaggacccugcucagugccugucugucucacaccagugacuuccucacacccgccuguucaggcccagucuuuuccguucaagugcuacaggccaaguaggcucaaacuguggguuugucuugggcauccacagcagaaucagaacccagagcuuugaagccugagugaggggaggggggcacucaggcuuccgucucucugagaaacagacgaugaagaggcccuuaaaacucuuugcaaccccaugagccuccccaaugagccugugacacaccggaacucaccucuguggguggccgggagggggaacagggucauggaagauccagauguccauguggucaaggcuaaacuguacuaaauaaaauuauuucucaucaccacuauacaugcauaauaaauaaaguguacaucaaaauuaag

SEQ ID NO: 3765 - RNA, 4358 nt, Mus musculus
ucaggaauggcuuguacucaaacuuuauuuuuguuuuuuuauuaaauaaaaggggcagaagagagggccuguggucucccaacuguggggggccaccugcccuaaccucucuccacucaaggugcauggugugguaggcugagguguaagcgugggugggagggcagcugggaacggucagaggcuaggaccugugacccucaccacucuuggaagacucaaugggugggguggggccuucuagugccaacugccgcugaguuugaggcugagcccgagggacugggccgugacaauguccucccaccccaggaggagaggugaagaguccaucuucaagaagacaccaccaaggcuggggcacuuguggcugccccuacucgugcacaucccagaucucggacagcaagggcggcagcuucuuguccuggagucgcaaugcaaagaccugcuccgagugcacggagcugagggugcgcaggcucaccagcuucaugagcaugcgugggaagcggagcugguccugcagggagaggaggcaagucgguccugcuggggcccuguccugcaaagccagcuuugucuggaaagccagcacccugaguggucaggccccaggcucagugugcccaacaugugccacuggaccccaauacugagacugcucauauacaacaggcagcucccguaccugugggcgcuugauccucguguaggagaggagcgccuccacguagggcugcugcagggccuccacacggcugggcuccugcacauuaggccgaucggcugagaagauguugauggcgauaagcaaggcauacucugcaucguccaggcccagccgccgcauggcccgcgagaacucgaagaugggauugaugaauuccaccugcaagccugcaagagcagccccagcccagcuucacaccggacccuggucccagggcacucaaaggggaaggaaggacagccugugacaguuacuccggcuuccgccccacacagacccugugagugccucuuacacgaugcaucuggccucgcuaaacaugaucuuuccuugccagugccugccuggccuggagggccaacggggcagaaaccccaggaccaagucagugccuuccacagaccugcacgguggaagucguccuugcuguaggugaaguccuucaggaacgugaugcauucugucucgugguuguagcgucuggcuguuucuagcaacaugaucuggaggugacaagguacagggcucuucagcugccccagagucaaaugugccaagaccagcaggcugccacccuucugccagguaagacauucuuaacuuuccuuccuucaacucuaucacccacugccccauccaaggccacuaaccccacauuaccgugaggcccaggcuagagguuuaauucuuagcauucagaacucugcacacaguuaacucucaauacuucauuauccuugauuuggcuccaauauccauuccuuuggagucuuugggucauuuuccuguuuaacagcccaucugauauccuccguuauucucuaccucagcccauuucccuuuucucccuggcuggcucucuggaggcuccagauaccuuguuggaugggacccugcagcugacuacaccccacaagggucaggacaugccuguaccauguucagcucuggucucguccuagagccuaguuauuaccucaaugguggacgccuucaggagggcgaucugguccucccggcccaacugcaagaacccuggcaccugcuuggcaaaguccacaaucuccuggaccgagaugauggcuagcucggugaagugggcaaagcguugcugacgggcaucucgggacugagggucugcacccaggggccagggcugggacacaaaagaccacggucacgugggggacucgcacgcccuaggaaaccccucccuagccugggugggcucuguccacagggccgggcagggcgauaccgugacuuugggcuggucggagaaagaucguuuguugcacugcagcugcgcggcaacuaacugcuggaucaucagcuccugagccgcggucagcuggaugcccucuccuuccccggagcccuggcugcuugcuuccgaagugccaggggaggccgcuggccggccugagcugcuggcugcuggcucagaugggggugguggcugcugcuguugcugcuucugaauccuuuucuuccgaaucugcuccucagagagcacgccugcgggaaagccggccucagaggcgggccucagccucacuuacaccuccccuugcaggugacccgcucucccucuagccccaccccuugcuuacacugcucccgcaugccagccuccuugcacuugcgcagccggcagagcuggcacuugcgccgcaugaaggcauccaucuggcagguuccgcugccccgacaggcauagcgcccggccccaccguggaccacacugcgccggaagaagccuuugcagccuucacagcugagcacguuguaguggaagcccgaagccuugucuccgcacacgcggcacagcucauggcccagcaucuucggggccggccccuucuuccgcuugcgcucaggcucauccucuggcucuaagaugacuuggggugagcagaugccaugagagauagcgacaaagagaaacagcagccggggaacgggccaugggaggucccgaagcgagggugagaggacggggcugcaacgccaagggaaagaucugcaggucggcgggcuccggaggacgagucggcggugucagggagaaaaggaagggaaagcggaccaaaagacaggggccaccaucuccccgcccuuccuucacaaagccccacaccccuguuccugucuccccaucucacccacgauguaggcagagcuggacccuucagagccuggaggaggaucagucuccugccccucuuccuuaauagugggugacguggcggagguacugggcugaggagaaccauucccuaggaaaaggaagacaggacagugagcuucuccaacacuguggaaggggcuggcuagggaaagcccgucacucaccaggcacgggaguguccagagaacuugugggggaagacauagugggucacgaagcagccugcugaacauaggggagccagccaauuacagggcauaauaggggugucucuucuuccagugcucacggacucuugagacaugaucucauacagcucaggcuacccgaacuauguggcugaacagcuugaaccaccuccaaaaucuuggaacacacuacucuaggcuguccugggaucuuccgcacuccugccucggccucucaagugcugccauuacaagacugugccacaccucaguguuuuuaacuucuauauugagcccccacucccagcccuaguuccuaauaaacaucacacacuuuaacaugcccaacccggcccacugcuccuuccaccucucuacgaaucaugaccucagagagcccaacaacucuauuccucuucugugagcaccaacugugcucuuaucaugggagauccuaacuuugccccgccucucccaucagggcgcaaccauuacccuucuaccauaggcuccuucaaggcuuuaacgcaccccaauacagaccccagacccuacccaucccaucaagucccuggccccaccccuucccacucuggagcagaaacccaaauuccgccccguuccuccuaggcuccgccccucucauucccccaaagccaauuauaggucuucacugugccacgcccuccaugccucugccccucccaaucccccccaacaguggucuaggccccgccccaagaaucaaaagccuuuaaucacagacuaucuacagcaggccuucugcccaucugugucccgcccccgcccaccaaccauaggcuuucccuacgccccgccccguagagucacgcccaccuuguuccaggccccgccccucuccgugcaccagggggaggcggggcucaugacugcaccggcgaucgggaggggggucgcagggggucuccgacucuguugcccuggaaacggccgugggaggcgagagcugcgaggaaagugagggaaggaugcgcgcgcuaagcgggacccacggcgauccgcguaccgggcucagucccaccugcccggccgcccggcgcacuugccucuguguccgcaccggugauugugccuccacagcacuuuggaaguaacuucagaagccugggaguagcucgaagcaacagcgcuugcugagcgaaaagcaaaaguaacuucgccacuucuuccggcaaccccgcugcgcgucacuuccggaaguagg

SEQ ID NO: 3766 - RNA, 4358 nt, Mus musculus
ccuacuuccggaagugacgcgcagcgggguugccggaagaaguggcgaaguuacuuuugcuuuucgcucagcaagcgcuguugcuucgagcuacucccaggcuucugaaguuacuuccaaagugcuguggaggcacaaucaccggugcggacacagaggcaagugcgccgggcggccgggcaggugggacugagcccgguacgcggaucgccgugggucccgcuuagcgcgcgcauccuucccucacuuuccucgcagcucucgccucccacggccguuuccagggcaacagagucggagacccccugcgaccccccucccgaucgccggugcagucaugagccccgccucccccuggugcacggagaggggcggggccuggaacaaggugggcgugacucuacggggcggggcguagggaaagccuaugguuggugggcgggggcgggacacagaugggcagaaggccugcuguagauagucugugauuaaaggcuuuugauucuuggggcggggccuagaccacuguugggggggauugggaggggcagaggcauggagggcguggcacagugaagaccuauaauuggcuuugggggaaugagaggggcggagccuaggaggaacggggcggaauuuggguuucugcuccagagugggaagggguggggccagggacuugaugggauggguagggucuggggucuguauuggggugcguuaaagccuugaaggagccuaugguagaaggguaaugguugcgcccugaugggagaggcggggcaaaguuaggaucucccaugauaagagcacaguuggugcucacagaagaggaauagaguuguugggcucucugaggucaugauucguagagagguggaaggagcagugggccggguugggcauguuaaagugugugauguuuauuaggaacuagggcugggagugggggcucaauauagaaguuaaaaacacugagguguggcacagucuuguaauggcagcacuugagaggccgaggcaggagugcggaagaucccaggacagccuagaguaguguguuccaagauuuuggaggugguucaagcuguucagccacauaguucggguagccugagcuguaugagaucaugucucaagaguccgugagcacuggaagaagagacaccccuauuaugcccuguaauuggcuggcuccccuauguucagcaggcugcuucgugacccacuaugucuucccccacaaguucucuggacacucccgugccuggugagugacgggcuuucccuagccagccccuuccacaguguuggagaagcucacuguccugucuuccuuuuccuagggaaugguucuccucagcccaguaccuccgccacgucacccacuauuaaggaagaggggcaggagacugauccuccuccaggcucugaaggguccagcucugccuacaucgugggugagauggggagacaggaacagggguguggggcuuugugaaggaagggcggggagaugguggccccugucuuuugguccgcuuucccuuccuuuucucccugacaccgccgacucguccuccggagcccgccgaccugcagaucuuucccuuggcguugcagccccguccucucacccucgcuucgggaccucccauggcccguuccccggcugcuguuucucuuugucgcuaucucucauggcaucugcucaccccaagucaucuuagagccagaggaugagccugagcgcaagcggaagaaggggccggccccgaagaugcugggccaugagcugugccgcgugugcggagacaaggcuucgggcuuccacuacaacgugcucagcugugaaggcugcaaaggcuucuuccggcgcagugugguccacgguggggccgggcgcuaugccugucggggcagcggaaccugccagauggaugccuucaugcggcgcaagugccagcucugccggcugcgcaagugcaaggaggcuggcaugcgggagcaguguaagcaagggguggggcuagagggagagcgggucaccugcaaggggagguguaagugaggcugaggcccgccucugaggccggcuuucccgcaggcgugcucucugaggagcagauucggaagaaaaggauucagaagcagcaacagcagcagccaccacccccaucugagccagcagccagcagcucaggccggccagcggccuccccuggcacuucggaagcaagcagccagggcuccggggaaggagagggcauccagcugaccgcggcucaggagcugaugauccagcaguuaguugccgcgcagcugcagugcaacaaacgaucuuucuccgaccagcccaaagucacgguaucgcccugcccggcccuguggacagagcccacccaggcuagggagggguuuccuagggcgugcgagucccccacgugaccguggucuuuugugucccagcccuggccccugggugcagacccucagucccgagaugcccgucagcaacgcuuugcccacuucaccgagcuagccaucaucucgguccaggagauuguggacuuugccaagcaggugccaggguucuugcaguugggccgggaggaccagaucgcccuccugaaggcguccaccauugagguaauaacuaggcucuaggacgagaccagagcugaacaugguacaggcauguccugacccuugugggguguagucagcugcagggucccauccaacaagguaucuggagccuccagagagccagccagggagaaaagggaaaugggcugagguagagaauaacggaggauaucagaugggcuguuaaacaggaaaaugacccaaagacuccaaaggaauggauauuggagccaaaucaaggauaaugaaguauugagaguuaacugugugcagaguucugaaugcuaagaauuaaaccucuagccugggccucacgguaaugugggguuaguggccuuggauggggcagugggugauagaguugaaggaaggaaaguuaagaaugucuuaccuggcagaaggguggcagccugcuggucuuggcacauuugacucuggggcagcugaagagcccuguaccuugucaccuccagaucauguugcuagaaacagccagacgcuacaaccacgagacagaaugcaucacguuccugaaggacuucaccuacagcaaggacgacuuccaccgugcaggucuguggaaggcacugacuugguccugggguuucugccccguuggcccuccaggccaggcaggcacuggcaaggaaagaucauguuuagcgaggccagaugcaucguguaagaggcacucacagggucuguguggggcggaagccggaguaacugucacaggcuguccuuccuuccccuuugagugcccugggaccaggguccggugugaagcugggcuggggcugcucuugcaggcuugcagguggaauucaucaaucccaucuucgaguucucgcgggccaugcggcggcugggccuggacgaugcagaguaugccuugcuuaucgccaucaacaucuucucagccgaucggccuaaugugcaggagcccagccguguggaggcccugcagcagcccuacguggaggcgcuccucuccuacacgaggaucaagcgcccacagguacgggagcugccuguuguauaugagcagucucaguauugggguccaguggcacauguugggcacacugagccuggggccugaccacucagggugcuggcuuuccagacaaagcuggcuuugcaggacagggccccagcaggaccgacuugccuccucucccugcaggaccagcuccgcuucccacgcaugcucaugaagcuggugagccugcgcacccucagcuccgugcacucggagcaggucuuugcauugcgacuccaggacaagaagcugccgcccuugcuguccgagaucugggaugugcacgaguaggggcagccacaagugccccagccuugguggugucuucuugaagauggacucuucaccucuccuccuggggugggaggacauugucacggcccagucccucgggcucagccucaaacucagcggcaguuggcacuagaaggccccaccccacccauugagucuuccaagaguggugagggucacagguccuagccucugaccguucccagcugcccucccacccacgcuuacaccucagccuaccacaccaugcaccuugaguggagagagguuagggcagguggccccccacaguugggagaccacaggcccucucuucugccccuuuuauuuaauaaaaaaacaaaaauaaaguuugaguacaagccauuccuga

SEQ ID NO: 3767 - RNA, 29105 nt, Mus musculus
gaaaagcccgccccagagaaggccgaauaacggugagcaauuagggggauggacuaaucaggcgugucgcucaggcuucugggaaauggaguuuccagcagggcacagcuuguccggaugcccuguauuagaggaaauaggccgcgucugcucgcugcugucgcacggccggugggggaugcgcgcgcagccccuccuucacccucccuccccggaaguuucugcggggcaacuguaaaggugaguccaaguuucugcuccggaucggagugagaguccgggccgugagaaaccccggcgcccacggcuuuuucacaaguacagugaugaggagccgcucgcccggcagccugugacgucacugccugaggaaggcggaggccgaccaaggcugggguucgggggcgggaguggggggagcacccacuuccucuguuuugcugggaagguguugggcggagccugugaggaaugucagacacuccgccuccgccuccacggguaccucgucacugguuucuuugggauuguggggcccgguccagucucugcuacuuagggaaguguuagucccacaccuguggaauuuagccuuugguacucugcugugcugcguuccugcaacaggagcauagaugguagcaagcugauggucauacguaggauaaaugaacuaaacaaaugggugcauaauaaaagccgacuugaguaucaguagucggaacugaaugugcagccuuagacaggagaccucaacacucaagauccgagcacuuacuguaugcaaggaucugugcaacagacacuuauuguauuauauacccgaacugccaccuccccuaggaguagcucuaaacucagcaauguucuagcacuugggaggcugagucaggaggauuuuugagaauagugaauuccaggacagcccaggauggacuacauaguaaugggcaccucaguuuaauuaaagcuggauguacgcuuggguaaguuucaaaugcugggggaucaaaaguucaaggucggccuaagcuacaugaaacacugucuuuaaaaaaagaauccagcccugccuaaggacuggagaguugguucaauauuugagugcuuacugucuuccggaggacucaaguugguucccaguucaugacugccuguaacccuaguucuagggaauuagggauuggccuucacacggguucauaugcacauaacuguagugaaaauucuggaauuuucauuucuuuaaaaaaaacacagaaauauaagaauauguuuuuguuucaaucccaggaguggggcuauggggcugcuucuccgcagcugacuaagcuuugccuccugcuccagcagcucaugauuuugccagcugcacauaguuucuacaacugugugacguuuggaauucugggaacuucucagagagucuguaaauacuagggccucaacuggguaccgugagaguuguuuggugggggugggggaugggggggguauugcaguuuguuaguaguugugcucaaagaagaaauuagauucagaguucuugaucucucucccucuguccuucuuucucuccuaccuagggauagggggugaaaugggaaggggagaauaaaggcaggaaaaagaacucacaaaguagcaaagaccuuuuacacauacccacaugcaaacacacacauacucaaaauuaaagaucauaaagauggauguuuuuaaauucugcacaacuaguuuacauucuaacguugguugaggugccagacagaaauugcagucaauuguauaauauuuuuuccuaugguaucuuaucuacauguuugcaucuagaaugucuuagaaaaugagagaggcuuucucugcuugcaauuuacauugcaauucagcccacgcuuaccugcccgagcucauuugcugacggcucacccacagggcuguggcuguuuaccaucaucagagauggcguggcacucgucaugggcucuguuuguguauauggcaugaauuugcaagugccagaagagggugucagauccccuggagcugaaguuacaggugaugugagccacccaucagacuggggugcuggagacugaaucuggguccucuggaagaacagugcauucuaaauccccgagaccuccagccuacccucggaacugacuauaacuggaucauugugaccucuguuugguuaacaaaccacagugacaagguguagaggcugauggucauuguaguuaggaugugacugcaguaaagagggggagaugacagccuaggcugugauaggcugaagagauagaggcuaccuggugaaaagccugauguugccagcucagggucaugcugagcaucugcuuccaggugagaaccugcaaggauauuuugaccugaagauaagaagccaauguguuucaucauguugacuguagaagucgcuaccagggugugcuggugucuuagucaggguuucuauuccugcaggaaaccucaugaccaagaagcaaguugaggaggaaagggcuuauuuaccuuacacuuccauacugcuggucaucacuaaaggaagucaggucuggaacucaagcaggucaggaagcaggagcugaugcagagccauggagggauguuccuuacuggcuugcuucccccuggcuugcucagcuugcuuucuuauagaacccaggacuaccagccagggauggcaccacccacaauggacccuccuuccuugaucacuaauugagaaaaugccuugcagcuggauuucauggcgggaggcauuucuucaaggaaggcuccuuucucugugauaacuccagcuugugucaaguugacauacaaaaccagccagaacaauugaccccuugucaacuugacacacaaauacuucacuauuaagccucaacccuuacuuucuuuuguuuuuuuuguuuguuuguuuguuuguuuguuucgagaccggguuucucuguauagcucuggcuguccuagaacucacucuguagaccaggcuagccuggaacucagaaaucgccugcuucugccucccaagugcugggauuaaaggcgugcaccaccaugcccagccucaacccuuacuuucuuauucauccccaagaucuaaauaacuuuaaaagucucacagucuuuacaaauucuuacauauuaaaauuucaaugccuuuaaaauauccaauaucuuuuaaaacuuaaagucuuuuuacaauucaaagucucuuaacugugggcuccacuaaaauacuuuuuucaagaaggaaaaauaucuguagucccaguauuuugggaguaagaacaggaggaucagaguacaaggcuagcccaggcuacgugagacccuaucucaaaacuaaaaugaaggccgggcaugguggcaccuuugaguccagcacuugggaggcagaagcaggugaauuucugaguucgaggccagucuggucuacagagugaguucuaggacagccagggcuacaacagagaaacccugucucaaaaaaacaaaaaaaaaaaaaacaaaacaaaacaaaaauuaaaaugaguuuuaagcuaaaggaugaaugaauaagcauucaaguagcacuugcuggcuauuugcccagugcccaguaucuguuagcuagaacuuuccacuugcggagugauccucagucagugucucccuccuuguucauuuccaggcuggugucgagauggagugucuaacccaguaauccaaggaccagaccccgaggccacaaagguacuguugccucugcagccuauuucccaccaacagcccagcacuacugucuccucucuuacggcugcagguggacuuuuccuuugauccagcaagguguggcaaggcucaccuagucaggcacuuguccuuccaagaggccaucuuuuccucagugacugcugaggaaaaugggcuuaacuugggaugaccaaaguccaccagcaaagcaagcaaggugugguggugacaccuguuaucucaggaucagcagaggacugggguuaugcagcaagacccgauggaacaguuaacuugacuaauaggaucaccugggagacaagccucugagcaugcgugacagggaucagcuaggcuacuguggcuuccaccaugaugaacuguacccuugaacugggagccuuaacuugcuuuuguccagauauuuuaucacagcaaagaaaguaauuaaaacacugucucaaucaaaagacacauauacuacaguuuauagacauaaaaaccuucagggguuuccaaaucacuuuuuauauaagaaguaagucaaguggacuggguuauuuuccagucuaggcuauacagugccacgguggaaacagccccaagucucccuggugccaccuuuggacagcugcccacauccaguuuugauuuggugguuccagagucaucaucuaagcuucaacuuugucacuaccuaaagggagaaggagaaagagacacaaacaaagaaaaauaaaaaucucccagcauuuaugccuuuggaaaacccgaugugguaguuccagugggacacuuccccaacaggcccaugugauugaaugcacuuccccagcugguggugcuguuuuggggccgugagcuguuugggcuugcagcagagcugguagacagaaggccacagacagggagcuucuggacgcggcucuuugcuuccucgucccgaggaaugggaacaaucacagccaugugcucucagugccacagccaugagcugcaagcuuccaccgugcauucccugccuucaugaccugagcuaggagcugaauaacucuuuuuuuuuuucccuuuaugguuuuucgagacaggguuuaucuguguagcacuggcuguccuuccugaccucuggaagagcagucagugcucuuaaccacugagccaccucuccagccccacaucuggauuucuuauauagccuaggaccaucuaaucggcagugaugcugccugcagugagcugggccuccugcaucugucaagacaauccucccacaugcagagcugaucaaacaauuccucaguugaaacauuccugucaacugagucuaguugugaagucgauaauuaaagcuaagacaccauaaagaccuuaggacucacagaaaaaucuggguaugaugguacacaccuauaauccuagccuggggagucagagacaggacuugacaagcuacaggucagugagaggaauugucucaaaaaacaagguagauggugccuagggagcaguacccaagggugacauccgagggugacauccggccuccaucugcuugcacacugccuuugccguuacucucaacucauaguguguugauggugucauucugauuccuguccccucccuuucuguguuucagcaugaucuccuucuguccagucuguggcaaaagugucaagguaucauucaaguucugcccuuacuguggcaaggcccugccuguagaggaggauggaggcacccagucugccgugacgccucaugugucauccguuccagguaagagccaggaagucccgcccuguccugcaguuucuuaagcuccuguguacccaguccugcaguuucuuacagcuccuauaugcccaguccugcagauucuuacagcuucuuguaguuggucaguguugaaaucccugacuaugugacugucagagggugcucucugggucucaugaccacaagaagggaaguuucuguuacaguuaagcaugguucagaagcagagauugaaguggaaacuucuaguuucuuuggaaagucaguuaugucaaaugauguuuugcuggggcauacaugugaaaggaugucuugcaaaaacagacacagggaugaauguuuuccugaagaagacccaggugaaaggauguucugauacaacaaacaugugaaaggaugcuugauggaguauaaauaugaccccacagacagugggagaugagcacugagcauugguuugguuugcucugccucacuauuuuuugcuaacaacaugcaugcauugguucgccuuguaucguggagcauugcugagcuccgcugugguaacauugccauuaaaagaaacucgccaaagaacugcuuaugaguuuccugugacagcuugccucuucagcagcucuuacgguuucuugaggacuggacugaagcugcugguucacauguggugucugccugccuagaggacuggucugcagcugcugagucggauucgguguuugcuacagggcugagcugcugucugagaagauuaaugucacccccaaagaacuauugcuaaacagguucacuucucuguauucuaauagcuuuucucuucuacucuggcaagaggagagguugaacauuuauuaaaguagguugcaaaaaaaauaugccuacaagagguagacauggguccacuuuuucuuuugcaggggucaggaggugacacuuuucuuuagcaaacaguuugacuggacauggugccagcugugucuuagaggauggagaugcagcugaagugagcaggagcacaccaggcugaacucagucaaguguagcccuguccccuccacacagucccagcuccucagcagacuguaaugcauuuauggugcaaggccagaguuggacuauguuggaugccuaucaaaacacugaguguucagugcacauuucuucaagggcacaaauguggcauucagaaggcagcuuacaggaguuuguguucucucucccauguggggccugaggauugaacacucauccuuaggcucaguagcaaguaccuuuacccacugagccaucuugccagguguaggcuuccauuuucacaaccuacuuuaauaaugauucuuaaaugcuuuaaccucccuucuaggcuacgacucaccagaguuaguggaaaagaaagguuaauagggcaaaggagaauguggaccuguagaaauaguucuuuggggcaauuccagucuuuauugucaggacaucagcaguucaguucacaccggucaguggcuguagcucgauccacucgcaaacgcuauucaggaacuagcaacagcagcuggaucccgaggaaaccuugaggcucugccaagucuuuggaagcagcaaaaagccuuuggaacagcucuagaaguucuuugguguguuucuuucuaccaugacaaaugaugaucagcaaaaaaggcaaggcaaccccaagccacagcgccaucacugaagaccagcauuagcaaagaguuccaccagcugcacagaguucccaggggaaccaaugccacagcauccuccacugccuguuggguuagcccuuccaaacaucacauguccucucaagcauccuguccagcaaaacgucacaugcccuuucucuaggcagcuuccagaaaaaccccacaugucuauucucagcaaagcauccuuaccuaagacaguuuccaggaaagugucacgugacacaagugagucaccaaagaagcccagaaauucuacuuuauccauggccucuauggugcuuuucagugaucaucauggcaguugacaacugccaugcuacaggggugugccacuugucauacacauggauuauaaagacguuaaagguggcuggaaucacugaaucacucagaauuaacagcugcaaccaggucugguaaccugcaucaaacacuugggaagcugaggcaggagaaugaccaugaaucugagucugggcuacagagugagauucugucucaaguguaaaacagaaauggagcuggagagauggcucaguuguuuaauauguuugcaggauguaauaagugcuuuaaguacauauuauauaagcauauauguguacauaauuaugcaauaagaaaguaugcuuuaaauggcagacuagacacagcuggagagagaauucaugaaguagauguaggcaaaaauuuuugcaaccuacuuguaauaaggauucacccucuccuguagcccaccaugcugcagaggcaguggaagagaagaguuuaggaugugagggaaguggccuuguucagcaacuguuccuugggggcgagcucgaucuccuugggcagcaguucaguccuguagcaaacaccaaauaugacucagcagcugcagaccaguccucuaggcaggcagacaccaggcagcuguaguucaauccugaagaaacugccaggcuugccugcuggccugaggugagcccucugaagcagcagcugccacaggauccucgugagcagcucuugggcaaguuucucucaguggugguauuaucacaaguugagcuaaacaaugagaaccaauacaugcaugucuuuagggaagaauagugaggcagaacagaccaaaccaaugcucugugcucuucccacugucuguggggacauacauacacuccuucaucacaggcucuuucacaugucuguagcagaacauccuuucaccugggucugcuucaggaaaacagccuuucacauguuugcuuuagcaagacauccuuucaucugugugccccagcaaaccagcauuugacauaacugacuuuccaaagaaguagaaguuuccacuucaaguagaagauagagcuagagaauuuauugaaaagcaugacacaguagcacauauguguaaccccagcccuuaggaggccuaggaaggacaacuguaaccuucuugaguuuaagacuuaucauauaagaaggccuuagcucucuuuuugguuuuuuguuuguuuguuuuuuugggacaggauuuaucuguguagcccuggcuguccuggaacucacucuguagaccaggcuggccucaaacucagagaucuuccugccucuaccucccaagugcugggauuaaaggugugugcccccacugcccugcugaaaaucuuucucuuaaacaaaaccaaauugcugagccagcagaauagaucugaggaugaaagcacuugcugcagaaaccuguagaagaacugagcucagucccuggaagccauagugcagaaaaauaacuggcucucaaaagucgcuguaugaccuccacaaguacaccaugguauuauaaugauacacugcguuaaaguuuucaaaaaaaguugcucagaagacaucagaaugacaggugauggacgaugugaauaaagaggcugggcuaguggaggagagacagcaggaaacgggcuuuuuguuagugggcaacagagaucagagcugcccugcgaaaaucgaaggaaagcauggcuuucgcagugcacagauggcccuucccucagaaugcuaaucugcauuugguucaccuuuaggcuccaggagagaccugaacuccaguuuugaaaccucucccaagaaagugaaaugcucacacacugucacuucucucccacucucccgccacucugacugugacaguucugggucagacaacaccuugacuucuccugacagggccacaggugagagcugggacugguccuugucugggugagacaaagguggaucauuugguaggguggggggcaaagggcuggagagaugguucagcaguuaggcguuugcacucagguucagucuccgguaucuaugucugacaacuccccaccaccuguagcuccagauccuagagauccagugcucugcucuguccuccacagccacgauacuccugcgaaagcacccagcccccacacaaacacagauagacauaauuaaaaauaauaucuaaaaauuaaaacaguguuuuaagaaaauauuacugguauuccaacugaagcaccagccagucacucuugccuugaaccuugucccagcaucuucccagugucccuuuuguccauccccacagaaaccuuucacccccccaaguggaccuauggcccauaguccauggucucugccuugacucuccucacuccacaaacagcaccuaacccaucugcuaacuuuugucauucuguuuguuuucuagaaaauuucauugguugguugguugguugguugguuuguuuguuuguuuguuuguuuguuuguuugagauagguucucacuauauagccuaagcuguccuggaauucauagcaauucuccugcuucagucuuccgaguucugggauuaugggaauaugccauuacauucaguuuuugaguaauuucuucaucucuaucuuuuagcucacaaauucuuucucuagccaugucuagucugacauguaaaccacguugucuuagaguuuccauugcugugaacagaccccauggccaaggcaacccuuauaagacaacauuuaauuggggcuggcuuacagguucagagguucaguccauuaucaucaaggcagggacauggcagcauccaggcaggcauggugugggaggagcugagaguucuacaucuucaucugaaggcugauagaagacuggcuuccaggcagcuaggaggagggucucaaagccuaccccugcagugacauaccuacuccaacuaggcagcaacacauacuguuucugacuccacaucccaguaaacagaaaagccacuugagggacuguccaccucuaaacuguuaaucuauucccucaaaccaguuugccuucaucuccagccugccugccauacucacccacccugaccauuuagaggccugaucucauggagugcuuccugagcaugugggcuucucagaggccucuguugccucuggaagacacgcccucaucgaucuacucaucacucaugucccuugcagccucuuuuccuggccugcauauucuuggaaaggaccauacaggacuccucuguaucuuuccagacaguguuggacaagagagccugucugguggcccuucaagaucaaacccgagucuuaacacauuucugggcauuuuguauagcucaguacauagccaagacccauuucaagacacuuuggaugaaugucuguaaccaauaaaauccuuuucuaaugugcuauccuccaguaagccuccuuugacuucuuccagccaucuaucccucuucuggccccacuaucugccuugaaugcuucaucucagauucaauucugacggguuaugucuaagucacaauccuuaccacacugggaggaguccaaaccugauucaugacagucuccaguauauguggagcaaagauucugcucugugggaagucaggaaaauuccugaacaaaaucaggagcaguguccugggcacuacuucgcuccauucugcuuucucuuuauggggucauuucccugcaggcacccggagcagaccccugacccccaaaggcagcccacuuuccaacaggcagagcccucagacucugaagcggacccgggugaccaccucacuccaggcucuagccacaggaacagagcugacagaccagaaugggaaacacuggacccugggggcccugcagauccgggaugaccaaggcauucucuaugaagguacacacugucccagugcacagggaugcuccaggccaugcagcaccacacggauggaauacgauacccaaguacagcaaguucagggggaaagaugggcucgggagggaggaaccauaaagcagagcagcccagaccacauauccaggaaucagcauucuagggagugaccagggcaagggauggccuucaggggcaugccacaaccauuuccuuccuccagcuuagccccccccccccagugaugccaguauaauugaauccuucaaaggauuaaugcacuguucaggucagagccccgaggacccccuaaucucugaugucaucagagagucaggcagaacugugcuugcacagccucuccucaagcccgucaagcugauggucacagugagggucagagcugggggugugaugaagguggagugucagaacacugccaggaagccacuuucgggagaaggagguacauuuagcccacaguuccaggucauaguaaccugaaaauuaaggcaggaacucaaggggacuagucacagccauaaagaaugaagaaaaauguuggaugcauguuugcuuacuugugaucagcuugucuccacucucuaacagucaggaaacccugccuagggaauggagccaccuacauggacuaaguucucccacaucagauaagacacuuccuuacaggccaaaccaguacaaacaaucccucacugagacuuucuucccacuuaauucuggguugugucaaguugacagaucuaucacacuuggcuaauacaagacucuagauucaacccuuggaacuuugaagagaggaaggaagauagggaggcagaaaacaugaagggcagcugcugagcaccaagugugcacuuccccaugugaaccagagaacugguccuugguugugagcagcucggggauuaggcccugacaccccccuucugcucuaauguuucucucuggccacuccacagcugagccuacuucugccguccccucugaaucaaggacccagaaguggagauucucacucaaacuggugagugguccaggagcaagcagcugagaaaggcaggcagguguggggcuuuucaaauccaugcuugaccucugagcccacccugaaaacagggugcuccuggucugugaauagccgugggacccuggcugggcacauuccuuccucauacuggggagcagaggugaggcuuguccuuacaucugccucugauguuuccugaccguggaacccuguccccugucagcugcaaguuucugcaucaguacagcuagcuuccugugccuaccuguccucugaugcccaccucauacauagagugugauugucacauacuguauuuaucaccuuuuggucacugugacaaaaugucuguaaagcacaucaagggagggaggguuuaucugguuccugguuucagaacuaugagucugucauauggggaaggcauugccaagcagugcagcucucuugucaaucaccugggagggguguagccaagagcagcuccaguuguggcagccaggaagcggagagagugauagcaugagcaagaggauguagggguggacuaugucugugcaggaaccccaagaccuagugccaucugcugcagagcuccugggugacaggccccagcuaagugagccccaugcacugucccuggauucuaucagcaagccuuugagguagcuacuguauuccagacuuaacagauaagaagaaaggaauggagagagguggguagaaagaaagaagaaaggagugagguuggagaugcagcucaggaaguauaguaccugcccagcaugcagagucccaggcuccauucccagcaccacacaagccagguauggugcauuccugucaccccaacacuuagaauguggaggcaggagaaucaggcguugacagucuucagcuacaccagcaguuugaggccagccuuggauacaugaagccauguccuagaagaauuaaggggauguagaggugggagagaaagggaagggaagggagaccagaagagagaaagggagaaggguguuggacagaaaccucgcugugucuaacacuauggucauaagaaccaagggagaaaacaaaaaagccgagcggugguggugcacgccuguaaucccagcccucgggaggcagaggcagccgggaaguugugguacaugccuuuaaucccagcacgcaggaggcagaggcaggcagauuucugaguucgaggccagccuggucugcagagugaguucuaggacagccagggcuacacagagaaauccugucucgaaaaacaaaaauaaaacaaaacaaaacaaaaacaagaacuaaggaagaguacuauguauaacuaaaaaauuaggcuuggcugauucauucauggauggauggauggaaggauggagauguguguguauagauauauaugaaaaagacccaaucuuuaauauauguauuuauuuuauguguaggaguauuuugacugccuguauaucuguaccacuuucauguuuggugcccacaaaggccaagagcgggugccagcuccccuagaacuaggguuacaagugguuguaagcugccugaugauagucucugagaacuaaaccuggguucucugcaagaacaaccugugcucuuaaccacugagcugucucuucagccccugauacguauuuuuguuuguuuguuuuugacagguuuuuaguacauaggcuagguugaucuggaacucccuggaaguucuagucauguccucauuggccagaacuugaucaugaagccaugccucauugaaaaggaggcuagaaaauuaagguuuuagcugagggccacauaucugggggcaaaugcguggauuuugccauaaaauaaucaaagauugcugggcaccaggaagcaaagccugcucggccgugacaguccaggaacuggaucugguguaggacaggaagagacugaaucugaugaaguggcagugaggucuugugggaaucuauggcccuugucuaagggaguugggugugacagucucugcucugcuccccugucauccccaggacuccaaggaugggcgccuuuucaaugagcagaacuucuuucagagaguagccaagccucugcaagguauuccacggggacugggcaggggaguuggguugggugacaggguccucgagguauuuuaugaagugaccaaagaccugagugugcaucucuccugcacacacaagccagcccccaucacccucagaggacagacaggugggccuggccuguagcagcucuuaagaaauauguggugacugucaugaacacugugugcuggcugugacaucauaaauuguuagggaaacuuuuaaccaaauugguuacauucaaaacaaaauuacucacauuuuuuucuguguucugugagccaugcgaucugcguuguauaaaucuguggaaaugcuacucugcaugcucugccccguccagcugcauucaguccuguuguauugcugcccugaaacuggccuggugggaaggauuuaccucauagguaguaguugagaugcuagcccccauggguuucccugcucaccuguaccuggccaggucuacacacacacacacacacacacaggcacacacauacacacacaggcacacacauacacacacaguccucugcaguagcauagggccccagugaugcuguugucagcuuuacuuguaaacucagagaucaccucccuucuuuucuguuuuugagacacagucuccugaaguccuggguucuuugaacuagaaauguagccaaggaagaccuuggacuccugaguaacaggauuaccagugugcuccgccacaguagcuuuuaugcagugcugaggauagaacauuauuuaauguacaagcacucugccaacugagcccaucaaagccccgcccuguugcaauuacccucuuccccucaugccagcuuugugcaugcucgcucagaagucaccuguagacauggaccacagaugugcccaccuguaucccugccucuucucccugacacccacaaggcugucagaccaaggagaaccaauaaagagaccgagagucugguuggguucucucugcuucuggccuaagcagaggcuguuucuuugggacuggcacuggccauggaucugaccccgagucucugccuccugcagugaacaaauggaagaagcaguucuugcucccgcuccuggccauccccaccuguaucggcuuuggcauucaccaggacaaguacaggugagccuccucgcuugcuggccgcccccgcugcucccgccugcuggucacucuguggcauggaugggcauuucucggggacaaagggguugccuucccucaggaugggacugcgccucgugauuagcguagguccagcuggccaaaugcugaguuucuucagcuucacuugcagaacagcagcugaccaaagccccacuguccuguaauugugcuuuuuaaauuuucauuucauuuuucaaucugggcagcagagggaaagggaaaagaagcagcagagggcaggggcuaagaaacaccuaaaaggcuccuugcuugccucgaaccaggaugugggcauuggcaaaaguaaauggacuuguuuacagauuggguaagaacuaaggggugaggcaccucaguccccuuaacugcagcgugagaacuuagaggaaagcgggaggcgcacacagcuguacacuagcacugguggagacuacuguccuagcuugccagcacugcccagucccuauagaauaucuugcagggcuuggcauugcauaucuccagcuccccagguccucuguguucuagguuccuaguauuccccagccuggggaggagccuucagucagcccuggaugacaacccaaagcaugugguaucagagagaugugugcuucagguggccugcaggcugguacguaccucaaaaccaucccacauccucuuuaaaccccaacuuccccaucaggcugauaaagugaucuucagggaugcacagagggcagaaugccaguggucuagcccuggggggugaugaugccucguaagaucagccaggaggucuagccuggaacagagggugcaggccauggcuuugagcuuggacucucgagaugaguggaaaguagcaaggcgcugggacaaggacucgugguguuauggaagagaacuucccaggcuaaggagaucacuugggccaaggcuaucuuaguuacucuucucuuacugugauaagacauugugaccaaggacuguuguguguaguuuuaaaaaaacuaccaccuuugccaugauggacugagcucaggccccucccaccuucccuuuguacugcccaccuuuggcucugggggugacucugcuaccaauccucuccaauuucccugaaccugaggauaaaagacacacacagcuugucauuuuacaacuuaccuucuagacacaauugcugggggcagauaucucccaccuugaaaagagugcccuuuccaguuuauuaucuccgccucuccacuugcccuaaacuuaguggcuagucccacuuagccccugccaagcagccuuggccaccugccuguaguggaguccauaggcccaagcucuccccgagaccucucgugacugcuguguucuucuuccuccaaagcauggcagaaaaagcccccucuccuuccuuccucgcaucugccuuuuuccccugggaccuggaagucccaccuguacuuucugcccagcaauugucccccagccuucuuuaccaacaaaucaagaaccaaucaggaaacaggauguuaguaucaaaaccuccccuuagaaaggaucacuuaagaaagccuccaguuccagagaggugaguccaugauggcagaguggcaguaacagucaucgggcagcugagcagccagcacucauaccuuacagccacagagcacaggcagagugcguauggaaauggcaagagccuuuugaaaccacgaguccaaccccaguaacacccccucccacaaggccacaucuccuaaugcuucucaaacaguugaaccaacuagggaccaaguugucaaauacccaagacuauuuggaggccaucucauucaaaccaccacagcuuguacagcugucacucauucacuuacucccauauccauucauugacucauuugugcucucaguagucaccauauaccaagcuuccccuggcugggguggaacagagggcagccaguccugucuucaugacuucauuugcacaguuaggugguagggcucuggcaaacaguugguuuuuagaaaugacccgugccuaaugaagaaggagucggaucacaucgcuggagugauagaaguaccaagggggugaugcgcuuguugggugagguaaauguuguaguucaguguauaguggggagaggggcgguuggugugugcagagagcagcaagcgacuaucacaggguugcaaguuccagguaaguagcaggggauacugggauccaugagaaaguugggcagaugaggcagaaagacccucaagccaugcagaguugagcuggaguaagaagacuagaggcaagaugaaggcucggcuggaagaagauggguuugcagagcauccuggccaggggagggagagacuagaaaucagaacaagggguacgugauggauggcucagccccagagucaaggaggugucugcagagauaagcaggaugugacugacacccagaugaguccucacggcacuccaaagcuucauguaaaagguggagcugaacagacaggcagaaauuucugggaagggacguagcucaacaccggagcgccuaccuagaacccccagugaggaguuuaaccauuugccuucucucuuagaaaacuuagcagagcucugacagugcagaguacagugcagugcagggugcagugcagugcagcugcaggggaacgucuuaagucagcacaggagguagaggaaaagccacacaccagcugacugcugaguucuucacaggcuugccaccacagugaaugcaacccuagaacuuggcaggguacuccacucacagugauggucccagguugacagcuuugccccuuccccauuugucauugcucugucaucccaccucaauacuuccuuccuccagcuggaugcucuggaguaucuccaugaaaaugaguauguucacgggaaccugacagcugagaaugucuuugugaauccagaggaucugagccaggugagagcgagaccccuccaacacacacacacacacacacacacacacuuuuguggugcuggggauguggcuccauugccuaacauguauaaaacccuggguuccaucucuggcacuacauaaacugggcauaucggcacacagcuaucaucucggcguuuagagaguggagauaggaggaucaggaguucaguuacccuaagcugguugcaauggugcaugccuuaaucccagcacuuggggagcagggccagguuaucucugaguucaaggcuagccuggucuacauagugaguucaaauauacccagggcuguguaaagacccugucucaaacaaaacaaaaauguucagucauccucaaguacauacaguuucagguuagccuggccuucaggggucuccaaaaacaguguuagcauuuggauaugagucucuccaaaggcacaugugcugguggagcuuuaggaccuaaggcagguggagugcuaggaguucaagcaaggucagaacuaagcggcuuauguguugaaagcucaguucccagcuuaguguucagaguugggguuugugugugacuugaucaaagggcucugacuccacacuagacuucuccacuguuggagccaucauuugguggugucuuuacaaggugguaagaauccagaggaguggggcccaagagcaugccuuucaagggugcaucuuuuuuuuucaagaucuauuuauuuuaauuuuaugagcauugauguuucacuugcauguguauauuugugaggguguaggagucccuggaauuggaguuagagacuauugugagcugccaugugggugcugggaauugagcacagagccucugaagaacagccagugcuuguagcugcucaggcaucucuccagcccguggaagaaguuucuugucuucucccugucuccccuccauugcucucuacucuuuagccugcaaugugagcagcccccacuccacacuugguccaccauaguguugcaucucagcugaggcccaaaguagggaugcugcugaauucacgccuggccuccugcagucauagccagccccacccuggccuccugcagucauagccaaccccacgccucccccuucacagcugcugggauuagauaggcagcgauugacacaggcagcuaugccacauuggagucugcagcccuaaccucaggucugugugccuccuccuuguccacaggugacccuggugggcuauggcuucaccuaccgauacugcccagguggcaaacacguggccuacaaagaaggcagcaggaguccacacgauggggacuuggaguucauuagcauggaccugcacaagggaugcggugagagcggcuccaccacgacaugccuccuacaugcuacgcucacacccauggccuccacauucuggaucaugcauaauagacaccagaaguagaggagcauaaaaguccccugguggggacugggacuguggggguguccuggccaugugagggaauuuguucucuucuucagaaccaaggagggcuguaugguggccuuugaguaguaggcauaugggaucuagaacccaggaacgugaacagcugggcaggaaugucauguuuccagagguucagauuucuaaucaggcagaguugggagaugaugagugcuguuuuagggucaccuaggaagggcaguacagaaaugugggccauucacuacuggagcaugagaucuuuguagucuugugggaauuacacacugaacaagaggaucaggcuauccggggaaaaugugcaaagagggcugacagccuuccacaggucccccagccccucuuucugagucugugucaugaccaucccucugccagcacacaugcuuccaucagacuaaggucccugcacaggggcgugccugcacugcaucuuagugcgcagcugucugaagagugaguuaggaggcaaaaggaaagugaccuguucucucuccucuaugaugagguagcucagcaccacaaucuuuucccacuuaacuaugaacgguuugggagaugagaggccgggcugggugcacaggcacccagggcuccuuuauaacuguauuaacagaggaugaacagacagggcaaugggauacuggagugggugacagcagcagaguaugugagagucgugggccauauaagggaagccagggacugagcagugauggcuaagaugguuuucacggcuggaguggagagcuggggguagacccaugaagaggucugacagcuggacuaagcuaccaccucuccccuuucuccccaggacccucccgccgcagcgaucuccagaccuugggcuacuguaugcucaaguggcuuuaugggucccugccauggacaaauugccuucccaacaccgaaaagauaacuaggcagaagcagaagugagugugagggucugcagcacccuguacuagcccaagcucuccucugguaggggaggaguucagaccccugugaggagcagaagggauggguagacagccacucaggagagccccagccuucugcagccucaagugaauucucugccaugcauuccagcaggagacaguuuugagcucuggggccgugccgcccagggucggcuucuggcccacuguuccgggugcugggugaccuucacuucugugagccaugugagcccuguuguucucccacuguagacugcuauguaagcagcacccgagucacaagcauacacaauuagggaguaagcacgcuguacaggguuuaaugcucauugcaugcaacacaccacaacuuauucacaggcuguagucugagggccuacaccuccagucagucacccugccuccauaccuccaggauuaggagguaaagacucagugagccuuuagaucuuggcaguuguacuuggcaguuacacaguuguuaaugauagaaggaagcagugugcuggcguucagcaccgaggacagcuacacacccguguuggugccuccuaacugccauucagcaccuaggauagcggcaggaauuccucuuuggaaaucuaagcacacagaugacuuugaaaggaggcuucagaaccagggacgacuagauguuggucuuagggcuugcucuauugugagaaaauguggcaucugcugggugccugggguauugcuucagcaccaaggacagcagaaaccaauccuggagaagcccugaagguccaggauggccuucacaggagacugaggugcuaacagaggucagacuuccuggcugucuccaggauugguagcuggucccugggaagaugggaucucugagaaaagagugagcaguugagggaacacgcacagaagcaggaagccugaaguagauccauagacaggucaggagccuaguagggacugagaagcaggaggguggggcuugagaacauuuggcugauuguaggagagaucagaugaaugauaggagccagccugaccaucuaaacuagagaagcagagggaaaggggccuugagggaggagccugaaguagugucugucuuuccuaagugggguguguguauguguuuagaggacacuuaaucuuaacacaucacucuccugucccauauguuucucccccgaagguaucuggacagccccgagcgccucgugggacuguguggccgcuggaacaaggccucagguauguccuaaaggaggaggugccagcaagccucguggcuuggaggccuuucuuugccauguuuuucuccuuguuugcccaguugcauguguguuauguaugcuuccuguaggacacaagcaaacauauucaguaaaaauauucagugucuccaaguaguagcaggguugcaaccauuuacacaguucuugaguuguuugaagcugggaacagaaucuagggcuggugcaugccaggcaagcgcucagagcuguuuccccugccuguacacauaguuuauuuuucaguuauuuuaauugaacucuauacauuguauuuauuugauuugauacagggucuccuauaccagccuagacuggccucacacuugcugugguccccaggcuggccuugagggcugggaucacaggcaagcaccaugcuuacauaugcauacuuuuguuuuuuagcuuuuuuuuuuuacuuguacuuauuuuauuuuguguguguauguaugucugucccagcaugaguguggagguaagaagacaacuugggugcucucuccugggcgucugguggguucuggggguccaguucaggccaucaaucaugaugacaagugacuuucccccuagccauguuguuggcucugguauuuuuuaacagaauaauauuagccaguuuagguuccuguuuuuccuuguuugagacagauuguagaaguuucuuacauuaguacuuguaagauguuguuugagacaggauuuguagucaugguuggccuggaacucacagaaauacaccauccucggaugcugagaucaaaggcaucugccagucacuaccucuggccauuuguaggcuuuggucagggcuuuuuguaauuaggaaguacauaauaucuuugcuuuaacacugaauuauaggugguacaggaagguggcccaguugggaagguacacucagcguaagugugagcgccugaguucagauccccugagccuacaugaagcugggugcagugcucccacagcaagaggggaggcagaaagacagcuccugaaguuguguccacagcagcaaaccaagagacccugcuuuccaccagugggaggggaggaccaacacccaggguuaucuggcaccugaccucuaccugcacaugcaccugugugcaccugagcaugcuuacaugcauguacacagaguuuaaaaaacuggggcgguaguuuuguagucaugaauuaauuuagugaaucaacucuggaaguuaagaaaaaaagugguggguuggcucgagagauggcucagugguuaaggauacuuacugcagcugggaaguguggcacacgccaaaaaaacaaaacaaaaaaacugagagagagagagagagagagagagagagagagagagagagagagacagacagagacagagacagagacagaaacagacauacuuacugauuuuccagaggacuaggugcuauucucagaauuguaguccaggggaucaaaugcccucuucuguccucugugggcagugugcacacagguuacacauaaacacacauauaucauaaaugagucauuaacauuuucuaaaaguacagugagaacuguggguguaauuauauaguagcgugcuugaaaagcaagugugaggucccaguaaacuuaaacgcacacgcacaccuccccaaggcccugcuuuccacgauagccuuuguuggugcugacauggagagaauguguacaggaguuauuacuggaacaaggcuaaaaacagauuuuuuuuuauacagcuuuauuuuuguuucuguguaugacuuuguugucugcgugggugucugugcaccacaaguggaauaagaguuauagauggcuguacaccaacaugugagugcuaggcauguaacccacauccugucugcuucacuucuggucuauuuauuucucugugccggguugggugggauauggcucuucagcugggcuucagggacuucagugcagugcagccucaggcuuacggaguuggguaucuuucccuuauguaagucacugggaguuccagggccccagcagauagguuuaucucuacugugcaggaucccaugggccagugcaggagauaggaaguaacacucaguguagggggugggaggagggaaggaugaaugcagggcugggaggagggggugcggggagagcacugucaugccggccuugcucccugcaucuauagcccucucccguucuuauccagcauauuaugaauuugggucucagcacccaugugaaaagccugcacaaccaugugcgcuuacagucccagggcuggaagcagcugagacagguggcucguugggccucaauggccugcuacuccagcuaaaucagugagcuccagguuccugagagagccugucucagaaaacgaguggaggaugacaccugagagggagacagcuccuaucgaccucucauucaacacacagaccugcacauacagagcaguacacacauguaucauaaauacaccugaaaacgguggggcuguuggcauggcucagaggguacaggcacuugcugccaagccugaugacugagauucaacccucaagagccacgugguaagaagaaagaauuacuaugaguugagcucugauguccacacacacaguaaaucauuguuagggaaaaguaccauugggauggagacuucauuagcuaugugcgcuugcugcucuugcagagaucugaguccagcucccacaccuacacugugugacuccaggacacuuccugcucucugagggcacuccacacacucauccggacacauacacacauaaaaaucaauauauuuuuuuacaggugccaucauggcaggagugguggugcacaccuuccaucucagcaucugaaaggcagagacgggugaaucucucugaguucugagccagccagcgcuauauagagacugucucagaaaaacaaaacaaacuguuaaucaugguauuggccuguuucccagcauuugagagacuaaggaauucaagaccagccugugcuacaaaguaaaacuuuuuguuugguuuugguuuugguuugagauaggauuucucuguguaguccuagcuguccuggaacucagagauccgccuaccucugccucccaacuagugggauuaaagacaugugccaccaugcauagccagagugagacucuuuauagacuccucccucuccuaaauuaaauuuacaaagagccguuuucuucuaaccugugugguauaagcaccugcacuuauuuagagggccaaaauuacuuguauaacuggcaagagccuaauccaggcucaguugagcaagacugaagcugugacaacuuuauugaaaguaaucacacuuuuuauacccuuauaagaaaccaaauauaguggcauuugccaggaucuauauaugugcaguugccaggauacaaugguguuugcaagcuauacagaguauaugagauuagcgucugagaccaguugucguggauuccaugcuuccuugccuucuaaggcaacauacagagaagcacaaaguggccugcgugcuuuacugccugagggagagcauugaucccucaggaacuggaaagcaccuugugcccuaggagccauggauucuuaaagacaugaguaugaaaaccaugucguaugucucucaagguagcaagaccaggccaacuccaugguuuccugcaguguagcacaccuguucuucugcugccaugaacuuaaugcuguuuuguguuuuccaaugguugaaaauuuuuuaagggcuggagagagauggccuggcgguuaagagcacuggcugcucuucaugaggaccuggguucaguucccagcguccacaugguagcuuacaacuguugguaaauccaagaucucucauacagacacacuugcaggcaaaacaccagugcucauaaaauaaagauaaauuauuuuaagacagacagacagacagacagacagacagaaagaaagaaagaaagaaaggaagaaagaaagaaagaaauguuuaaagaacaucuaauugcacauggggcuugccugccauucaugccggucggucaccgugaugugaugcccacugcuucccucugcucaguggcuccuucugugcucugugcucagauuccauuccugccucggcuggaaccugcaggcccuguguuagaggugcccauagguuugcucaggaaucuguugggaaguaguacaggaugagcagcgggugagaguuggugauggcuggccgcugagcacucugguguuuaccauuccacugcugcucccuugaugcuucccacaccgacagcagauacaagaacucccaguggcacugagcacagggggcuucgagcaccaccucucgggccucaccugugcuuuugggugucuugaccacagagacccugcgggaguaccugaagguggugauggcccucaauuaugaggagaagccacccuaugccacgcugaggaacagccuagaagcucugcugcaggauaugcgggugucacccuaugacccucuggaccuccagauggugccuuagauggaauccaggugaggagguuguucacuuagccccucaccccacccaagccugugaggggacugggugccccagccccuguuauauacccuugguuuuucaucagcuccugaagucaauucaagagcuggaauucagcugggugaucuacaguaacuagaaaauuuuugggucacccaggugugaugauggugcauaccuguuaucccaacucugagguggaggcaggaggaucagacauucaaugcuaaccuuagcuauauaagacaguguuuuuaaaaagccaaaacaaaacaaaccagugggguuggggcuggggcucaguugguagugcuugccugccaggcuggauccugggcuucaucccucacagcccauaaacuggacauggugucacacagaugcaacccuagcacacaggagguaagggcacagcucagaagcuaggccagacugggcuacccuacacccuaucucagucugucaugaguucuagagaaugucccauagcaagguuguguccccaaguggaagcccccaaggccaugcucucucccagagcaccuguuucucucauugugguugacugcaaagcuuguacagcaugcaugugcagccacacacacacacucgaacauguaggaaugggaaacuaugcauuuggagacauuuuggcuggaaugucccauggcauggagcagcagagaugaggaagcuaacugaacacucugcagggcacagccagccccaccucuacccugacagcaucaucuaccagacaccacuagugucuggugaguguguaaugaguggcacuuccugguaacaggcugucuccuuauacagcaucuuccccucccuggcguccaccagacacuggccuccauagcucucuuggaccuuugcuucugucucaggaccuggggcacugccccucuuuuccuguuuguguguuugagaccaggucccacgaaacucaggcaaugcucaaagucuguggcugaggcagaccuugguucugcuuccucugccccuaccuccagagagcugggauuaccagagccucccucacugucuuagucaggguucuauuccugcacaaacaucaugaccaagaagcaagcuggggaggaaaggguuuauugagcuuacacuuccauacugcuguucaucacucaaagaagucaggacuggaacucaagcaggucagaaagcaggagcugaugcagagaccauggagggauguuacuuacuggcuugcuugcucuggcuugcucagccugcucucuuauagaacccaagacuaccagcccagagauggucccacccacaaggguccuuucccccuugaucacuaauugaggaaaugccuuacaguuggaucucauggaagcauuuccucaacugaagcuccuuucucugugauaacuccagccugagucaaguugacacaaaacuauccaguacacucaccauccuggcauucccugaugccaaucacauucaccucaugucaccugcucucagcccggcccugccuaccaucaacaggaugacuggcucugagugggcgcugucucaggccucaaggcugcuuguccccgaaguuguugguacaucuccagcaccucccagaaauguggcaggagggaggggcugaaagccugcuccuuacagcuguacuucuuguuuuacagagcuuccgacuugcagcuugaaguagaacaugaaguagugugacuggaggccuguuugaacucauagcuccuaaaagaaucccuugaaugugcauucucaccgcucccuuaggacauaugaaucagcacuuguguuggggaaccugagucaugucauguaaugugaaacuccucccugucucagcucuggcagcuguggauggagguaaguggaugcuggcggcggcggcggcagcagccacuccacucccuauggcauuucugugauggcauaauaaacuguuuuuaaucaaag

SEQ ID NO: 3768 - RNA, 688 nt, Mus musculus
ucuagacccuggguccccauaggccccugaccugggacccucccccagccgccagcgcagggagggggcaggccaggcucuggaggagcaguugcagugcagacccucggccucccaggagcaggaggggcuggacaucuggggcaagucuguggaggaggaggagaguggucagcagcugggcccucaucacagauccccagugucccuuuaccuacucacagugcacagaggcucagagagaugcgcugggcacccaguggguucugugcagcacaggugaauucuccuucauguucucucuggaccagaggcagcuccaguaccccaggcucugaagacuggauugggaucagggucugugucacccaagcccaacucacauuggcugggggauugcuauaggugacacagacuaggcacaggcuuuggcccuccaggacugggagggagauggcauuccugaggauuuccaacacugggggagaacagaaggcagaguugccagguggcccaucaacugggaugccucccauuccccacgcagaugcccagcuuccucuguccaucguuucuaccuguccuguuugcuugggaaacagucacucucagguccugugggggaucugcaaugaagacagggaacuggcuccagacaggccagggccuucucccugggcagaacauc

SEQ ID NO: 3769 - RNA, 4405 nt, Mus musculus
gccacaggaaaaucugcauuuuauuugugcccauaaccccuagaggaucagccuccacuagaugcaacccuucccccacacccucacaaaacacugauucucucacagagcuaaaaugaccccuaguuaccaacuacaaucaccccuuccuguccccuaggccaguauaaauucugagguccuggcucccuuuucuugacuggcuucucacuuguguuccaaguccccuccuuaaaacccucccucccugacuagguucucaucugccaucacccagaguggcuuccugcuuuauguucaugccaggccuggcagccucccccuacacccaacuaggacuaccugcaaaaacacacuugcuuuaagacuccagaggccagggaucaggcuggcuccuccuccaguucccugagggccuugcuuucucaguugcacugaagggguacagaaacugacucugccaaauagcccacaguggguuaggcagaggggaagccuagagauggacuggauaggaaaguggaauggagggguagugugacgcuggagacagacguacacgagaccucccucuccagccuggaccuguacccuaggugcugcggguccucuggcuucgggccuuauacaccucaauuagcagguccuucacguacuggaucucccgcuccacugacucagcccucucccucagcucccgguuccgggccuccagccccuggcacucgcccuccagggccucgcccucugcccgcuuccucuggcgguaccugagagcagcugacuuauucuggucucucuucuuuugcuugcgguccccucgugugcuggcaggacuaggauaaggggcugggcgggcgggugaaggcagaggggccagaggaggaggcugcugugggacaggcaggguugacaagccugaaucccccggcccggccucacugcggcaguaaacagccagcagguccaagguauccaggguaggaggcugagggaggucaaaggugggcaagggcaagggcaggggcagagagggugcugcugcuggugguggagguggugguggggagggcggugggagaaguggggcaucaaggaagaagucuuccaucuguuccagcuccuucuugaguagggaugccauggcuuccaggucagggggggccggggaggguggggggagagugccugggggcagaggggccuccagaggaaggagagcugugaaguccacccgcucagucauccaaucagagaagccgucaccugaggauggagggggacauaaaagucccugaggacugugcuuuauccacuucgguguucacucaugucccauucauuaaaugugacaagugaccagccagccaaccaucaaaucuauaggcccaucaauagaccaauaagucagggaagaaaccaaucaagcaaucaaccaaccagcuagcuaguuuacccuucaagcuacuagccaaugaacuaaccaaccaaccaaccaaucaaccagucagccagccauaggauuuacuagcuaaccagccaaccaggcaaucauaccacucagcagccaaccaaccaacaaauucauuaaucuaugaacaagccagucagucaaucagccaaccauaguuuacaaucaacaaacagacccacuaacaaugaaugaggcaaccaaccaaccaaucagccaaucauauaguucaguagccaaccaaguaacccagaaaguaagcagugaaccagugaaccagaguucaccagccaacaaucaacuaaaccaccauguaaccaaugacccagccaaccagccaaucacccaucaguucaccaggccaccugccaaugaacuaaucaacucaccaaccaaucagugaacaagccaaucaaugauucaaaucaaucagccaaccacucagugaagcagucacccaacuaacgguccacccaacaaaggucugcucccacgucuguaauccugcucuguggcugcuugacugcaccccauaccuaugucuucucuccuuuccuugcuuguucaguuauuauuggugauagagacuuguguagacuaggcuggccuuggaccugcuuuguaguccguggcugaggacaaccuuaaacaucugacucucccagagugcuaggacuauucaccacucucucuccucccuuuccugcacguguguguguguguguguguguguguguguguguguaugacucgcuccaucuuuauuuguucuccuuuuccauuucugagauguuugagaauuacguucuugcuaugcugccuaggcuggccugaccucaagaggcugagaagccccuugaacagggggagcugagggcaugugccaccaggcgcagucugggacaaccaucuguuacauagucaaaagagacugugccccaggaucucugagauggagcccccuuccaccuuaucauggcuccuucuccccaucccucagcccucaguucagaugucaucuacuuagaggggcugacuucucaacuaugucuuucaucacuguccacuaagcuuuggucucccacuucugucuccugaugcacccaugagcuuagggaucccuugcucggaacccugcagaccuagaacaguguugggcacacugcaggcccucaguacugaucuugugaaggaauaaauucuuccuuuucuguccacccccacccccagcucaacccaccucucuucuuaaccuguucuuaccugccaggggcucuccccccccuggaagcccgcccuccagggcacccccaaggaccucauaggggcccaggggggcaggggccagggggaguuucccauagucuacgagccagcccagcccgcuagcugggagcagggcccuguccagcuccagucccagggucgccaggagugacauggcugugacacaggcacagggcagcgacggcaauggaggcugcaccaacaauugggaggcagcguggaagauuguucagcugggugaagacaggcaccaaggcgaagguggaggaccugugaggacaaggggacgugggugggauugagucaaagcggcuugacccacaggcuacacaguuuccuucuuuccgaaaauuucagcgcuccacacauucccagggacauuauuggaaacuccccugccccaucuccucccucaacacagaaaccuaguguuuucccaggggaauuaccucuagucccuccuacccaccucaucuuauuccucuucauaaaaauuucaaucccaagggaauuuccuucuagccgugccccuuccgcaucauuagacuauacccccuuuaauccacagggguucccagaauaauucugcaugccugggcccuucaucagugucacacacacagaucccgcucuucccuuaaaaauuuuggugacuucuaaagauucuacgggaagcuccgcccacccuucugucugucacagucaguucccgucccccacuagcaagucccuagaggccccgccccuguagugcuagugcuaacucuuucuuaaagguguuccuaaagccuuuccugucaguuuaagccaguccccgccccagcaggugucugauuggagggaaguugggccugagucggagccucaagcaaaaccccacccuuccucgcugcuggcucgacuagcgacgaggcgcaagcucagucccaggacccgauccauuguuacgccacuacccuccugggggaccagugcgcguguuuagccaaugaccggccgcccgccguaguucaggccggggguggaggggugggggggugggggaauaagacaaugcgcaugcgcaacagguugugggguugucuccuuggaggaaaaggggcagagggucugugaauuagcgcgcaggcgcaacggcgcgcgagccgaccuuaaaagcccccaaauucuccggaagcacgcccuccuccuccccgccccucgcaacucgagccuagugcgcuugcucagcggaugcgccggccgccagcuucccucuucugcgccugcgcgaccgugguuccucacuucgucucccccgcccccaccacgaggcugacccgugaagccccgcgagcucugaaagggcgggaaaggcaguuggcgagggaggggcgagcgguuacucacuccauggcggcgaaaaggcgaggaggcaacggcggcggcggccucggcugaagagacggugugagcggagagugaaggcgcggugagcgcggagacgggggcgggggacacgacggggucgcggcuacagagccauugcgcgggcggaggcggcguggcgggagcguuaagggagacugugcugagaggguugaaaaugaggcggccccggggccuggggacaaauauaccgggggcggcgcagcgcgggcuugccug

SEQ ID NO: 3770 - RNA, 5856 nt, Mus musculus
cgugggaggagccaaauuuucgaacagucuuucccauagcauagaugagcuuuggaaugaauucagaagugacucuaccuauaugcaauccucacugcgcauuggaaccguugugguagcuugggaaacgucgaacccgcccaugggcaaggggcggaauuuccgguguggcucgcauugggaaagcagaacuuccgguggcggguggguugccggcugcugagcaagcuccacugugauucuguuccccuucacagcauccgaggaugucacagcuuggaucccggggccgccuguggcugcagagccccaccggugggccgcccccuauauuccugccgucggauggccaagcccugguccucggucggggaccccugacccaagugacggaccggaagugcucccgaaaccaaggugggcacgggaauggaacugcugcagagugggauuggaaggaagcaggggagccuaugccuagccagaagcaagacgaggcauuaugggagggacagagaggaucugggagauugucaccggaggggagaaggacaacagagagacggucgcugggcaggcuacaucaggcggugaugcaucaagccaugcccaagaccucggucuaccccauguaucucaugggacaaagcagacccuacagauaaaaaaaauaccuguucuggacaaguccgugucucuagcaauccuagggacuccgaaguaccuguuauuauugaggaauaaacuggcucggggggggggggggggggcagacaccccugucauccagagaauugggugguagaggcaugagaaucaguucaagcccagccgcuaguauguagcgaguucaaggcuauccugggcuaccuguguugggggauugaggaaggaagggagaaagugccucucuuacuuaaguccuagggagaaagugccucucuuacuuaaguccuaguaguagacuguaguuggccacgccccuguacgugauguaaacccugacuccacccccuuacccucaguggagcugauugcagacccugaaagccggacaguggcagugaaacagguaccagugucuuggcagcggguagcaaggacuugggagaggggccggguagaugacaacccuucagaaggcuggucagcuuuccgcuuuaacaccgugccagacuagaagccacuaaccuuucaaaguucugacuggccacacgaagugaauaggugggaagauuaaaaauugauugggagcuaagguauuggauuugguggggcgggguggugccaacccuagcuccuccuuugucugcagcuggguguuaacccgucaacuguugggguccaggaguugaagccaggacugucuggcucucuaagcuugggggauguccuuuaucugguuaauggccuauauccccugacccugcguugggaagagcucagcacaucaggaucccagccagaugcuccaccagacacuccuggggauccggaggagggagaggauacugagccucagaaaaagcgaguucggaaauccucucuuggcugggagagcuuaaagaaguuacugguguucacagcgucuggggugaagccccagggcaaggugaggccgccaccccugcugccacccaggcuagccaguuaauguaaaguuuccugugcagcccugagcuagucuuaucaaaguuccugagccucaacuguucugugcagagaagacugagaccccaguggugccgccaccacugagguacaggguacaggucaggcccuguaaucaguggugaccuuucuuggaucacucugaaaugaggccacagaaaauucacggccuaguuuccuguggccacucagccaacagugagguuuguuuuuuuaagaauugauaugaccuggcacucgggaggcagaggcaggcggauuucugaguucgaggccagccuggucuacaaagugaguuccaggacagccagggcuauaaagagaaacccugucucgaaaaaaaaaacaacaacaacaaaaaucaaaaaaaaaaaaaaaaaagaauugauaugagccugcaugauuuucuguguacuguaugcagguggcugcagaggccacagagcauugggugcccuggagcuguaguuacaggcaguuaugggccaucugacauuugugugcuccuaaccacugagucuaaccacugagccaucucuccaacucuuccaacaaagcccuuugcuccuucugggcuguuaguucuccaaggagaugcucagagaaaaaggauuugugagacacugguuccuacuaaaaaaaaaaaaacaaacaaacuggaaguggagggcagaggacacagaaggauaauacugguauuuaaaggcuggugucuccagguacacgccuucagucccuauaccugggaggcagagggaggcagaucucugugaguucaaagccagucuggucuguagagugaguuccaagacagccaaggcuacacagagaaacccuugacuugaaaaggaagacaguaagccuguaaggaaggucagaggugacaguauuguugucccuguuggugauaccagguggcugccuuugaccuagaugggacccucaucaccacccgcucuggaaaggucuuccccacuagcccuagugacuggaggugaggugggacaugggaggcggcugggcugggugcccagaguucuuuagaucacaagucaccugcuacuucccguccaccuuaggauucuguacccagagauuccaaagaagcuccaggagcuggcugcugaaggcuacaaggugugugggugugggagccugugugugcgugugugcgcgugugugugagugugugugugugugugcgcggacacaugcauacacaugccuggguugagacagggcuccagugugucccugucuguccccaguugguaaucuucaccaaccaaaugggcaucgggcgaggcaagcugccagcagagguguucaagggcaagguggaagcuguauuggagaaguuaggggucccauuucagguacggccagaagggacacuuagggacuauaugggacagagacccagagagaacgugccaaugcaucgggggugggcggggggaagccuuggcugggaucaugcugacaggagcuguucucugagaucccaaggggacaggcacuaagaacacuguggccuggcuaccuccauaggugcugguggcaacacaugcaggucuaaaccgaaagccagugaguggcaugugggaccaucugcaggagcaggugagcgcccuccugccuuuuauacugucugucccagccuuccccucaccacacggguggccacuggaaaugccuagaggugcugggggcacgggguaaccagguccagccucugugagguccuaggcaguguuagguaaacagagaugcucagggcuaagggggagggucugguagguagcagggacaugggaaacaggcugagaaggaaguggcccacagauaggagcuuacagauccaggaaggcccaccuugauuagggccacaaguuggaagagcaggcagugugggcugcugcaggaugugcgcccucuggaggcaacugggggagcaagcgagacacucagcagcaaugcccuggugugugguccagccagccccucugcugucccauccugugggcuggacuucucacugccucucucuguaggccaacgagggcauccccaucucgguagaggacagugucuucgugggagguaagaggcgcaggcuucuagggguucaggaacccucucagagcucaguguuggacaggguugcccuucccuuacagaugcagcagggcgccuagccaacugggcaccggggaggaaaaaaaaggauuucucuugugcagaccgccugguaagccuggugucugugccccgcccuguccgugugacacccucacugcaccucugcacccaccuaaccccugcguucccuccucaguucgcccuuaacgucggccugcccuuugccacuccggaagaguuuuuccuuaaguggccggcugcccgcuuugagcuuccagcuuucgacccggugaggcccaaaagagaaggggaugagaggcccuugugagcucccuggucucacgcccccuuuuuguuccccugccagaggacuaucuccagugcugggccccucuaccuuccagaguccagcucucuccugagccccaacccagaggugguggucgcaguaggauucccugggggugagaugccacagccugaccucuggcucccccuggcacucacuuggguccuaggcacuagcugaugacucuacugcccccacagccggcaaguccacuuucauccaggagcaccuagugucagcuggcuacguccaugugaacagggugagugggacugcaccuccccuccccgccaccguucaaggaugggaacuccccagacugacuuguuauuugcccugggucccacaggacacgcugggcucguggcagcgcugugugagcucaugccaggcggcacugaggcaggggaagcgagucgugauugacaacaccaacccagaugucccaagucgggccagguacuggaaacucauggugggcucgggaagcacugcguguacuaggggaacacugcguguacuaggggagcacugaguguacuaggggaacacugcguguacuaggggagcacugcacguacuaggggagcacugcacguacuaggggagcacugcguguacuaggggaguacugaguauacugggggagcacugcacauacuaggggagcacuguguguacuaggggagcacuguguguacuaggggagcacugcguguacuaggggagcacugcguguacuaggggagcacugcguguacuaggggaacacugcguguacuaggggagcacugcauguacuaggggagcacugcguguacuaggggagcacugcguguacuaggggagcacuguguguacuaggcgucagugacagcuguuuugccuccacagguacauccaaugugccaaagaugcaggugugcccugccgcuguuucaacuucugugcuacaauagagcaggcacgccacaacaacagggugagccacucuccaggccccaucccacccuagcccuccccucaucuaagccuugcacccucugacuuuugugccauuuugcaguuucgugagaugaccgacccuucgcaugcaccugugucggacauggucauguuuagcuacagguucggggguucugggguucuggagggggugggggaggugggguacagagccucacacccccaucccgcaggaagcaguuugagccgcccacacuggcugaaggcuuccuggagauccuugagauuccauuccgguuacaggagcaucuggacccggcacugcagcgacuguaccgccaguuuuccgagggcugagcccucaauaaacacuggugccacucugugcacagccaucuugcugggguugugggaggcaaaacaggugccacggcauccugcauugagcuugggcuuccaagugggcucuuguguaucuggcauacuuggccugggggcuugagcagccacagccauuuuguggugugacucaccagccagcaccagguuucagaacccaguugugggacacuggacccgagacuggagucuggggauguuaaauuugaccagguacaggaagauuauaauaaugugucaaagaaaggcugucauguggguaacuagccugaugagccugcuuuuccgucuacuuagagauggucuaacaucacacaucccccgaacuu

SEQ ID NO: 3771 - RNA, 3877 nt, Mus musculus
ugaguugcaaauagagcuguagccguggugcgugcaaccucaggaagucauuugccagcgcuguagcgcggucgaaagcgucgucuccgagcacagggcguacagacucuagguacuacaggcagacgaggaccggagcgucagcgucccgccgccugcccgagaccaccccacuccagggcacgcccaccuugcgcacggucuccugcgccgagggcacuggcugucgcgggagcgcgcguuggaagcugaagagccucgggugccucccggaaaagauucugaccaaugccugcgggacagaggagaggacccaguuggagcaaggaagagggaggacgaagaugauauagggagagggaguaaggaaaugaagggggaaggguggaggagagaugauggggccgagaggauggaggugauggagaagaagagagaacaagaugauggaugggggagggaagagggggaauggagauaaugaagggagagagacggagugaagaacaggaugagaggacagaagugauggagagagaugaaggggagggaggaggggaaugaugcugaaccagaggacagagaugauguacgcuguauggagggagaacgguguauagagauagugagggggguauaggaaaacagcaugaaaagagggagacaaccgaggacaaagugggagccaagacccagagagaacagggguugggugggguauagacacagacacaggaguggugguggaccgagacccagaaacagagacagcugcacguuuguucugagagucuagauccucacauaccagccaggucuucgugggugaggacauggcgccaugagguuccagaagccagccauggugggacagaaggagccucagagccacaugaagggugaagaugagggcuccccacaaacaagaugcaaaaacugcugcugacaagaaccccuggagcugauggugcuguccgccccugggagagaaaugaauagaggguaccccagaagcugugcaguggaccaagccugcagaaugggcacuggcgacaaccacgucugacagacauuuauuuaccuuauaaagugggugugucccucugugggugugcccuuggggaggcaccaagcuucuaaaaucacuuuccugggaccagggaguacaccaggguagaguguuugccuagcaugcgaacgcccuggguucgaugcauaagcugggugugcuggcacaauccugcaaucccagcacuggggaagcagggagaugagcuaaagcccauccuuggcuacauugugaaauggaggacagccuagguuacaugaaacccugccauaaauaagcagccgggcaguggugacgcaugccuuuaaucccagcacuuggaaggcagaggcaggcagauuucugaguucaaggcuagccuggucuacagagugaguuccaggauagucagggcuacacagagaaacccuaacuuggaaaaaaaaaaaggaaauaagaauaauaaguaaggagaccgggaaagcaguggggaggaagcccagagcguggccguguagcaggcccuccccgugggcuccagguuucaagacuauggguccaucacugcucuccaugggaugcccuucucuagacuggaucaugaauauggcuaacaugauccaugucuaauucggggaucugccuuguucagaaaaucugcccauucccacggaaaccuggcccaccucccagaacucagcucaccuaucccugccugguuuccaggcccuuccuaaaggugauaauguuugcuuuguuuguuugguaugagaugggaucugggucuguauuccaggaugccuucguacucacaaaucucugccuggaaagggccuucccauguaagccccgccucugcuaggauuaaagcuuacuuggugagccaccauuccucacccugccucaguucagaacccaguauaggauaagagcuuggcaauccugaaaaccugauguggcaccagagggagguggaucucugugaguccgaggcuaucccacucucaguauaacuagcuuccgggacagcuaguacuacaugcauuaagagacccuaucucaaacaaaacaaaacaaaacaaacaacaaaacaaaagcaaaaacaacccaaaaaacaaaaaaagaaaaacugggcacuccuuuaaucccagcauuugggagguaaaggcaggaggauuuggucuacagugaguuccaggacacacaaagcuacacagggaaacccugucucaaaaauccaaaauagagcuaugaagugaaagaugaagcuccucuuuuggcuguaccucuauuauaaaguaaacuccagaaauaauaauaauaauaauaauaaacccugagucaggguuucucugaguaacauccauggcuguccuggagaacucacuguagaccagaucucuccggggcugggauucaaggccuaugcaccaucacacccggaaauuacauuucuguggcaggcagagcacagaguaucuugggggggggguggguggggagggcagugacuggugaagaggaagguucucaccagucuggcaguaacucuuuaaucuucuccaucaguccuagggaaggguccagcuggaggagacaggcaagcuggauuguacugaagaggaagagccagcugagggggguugcagggaccacaccagcaagaaagucauucuguggugagaaaggagaggcucacucuugggagcuucuagggucucggaugugggcagagcacaggauuccuuuuacugaauguauuuaguaaggaguuggaagcaugguauaacuuuugcuuauuccccaauaaggagcuuaggcugggacagggacucuuccuagaauccacaaugggguguuaguggaggcauggcuuggugguagggaacccuccuggaaucuaccagucaggggaugagagugucauucaagcuguccuagauuguccaaaacccuggauucugaagcuuggcaccaguaaggcagucagucaguaagcagacaaauaaauaaauccaagauaaggagacuauacugaaguuauugggggaggagcugcauggggagggcagcaggggaguggagugagucuggaugcugagcagggcaggccagugggcagcacagagcaucccagaggaagccauaguuaaccguagccugggacuggacauccauaucuucagaaucgguuucaggaagccccgaaaucugaauucccagaaggaaaccagccaauaguucuccucacccagacacgccagagaugccuuuuccaggagcgcagggcacagagguaaauuuccugccacacuggcgagcugagcucuacuucugccccaucggaacucagugaagacagcaagcucgaggccuggugugccucagccauguucccugggccccuuaggagaaagacggagagucauucuccaggaccucggugcuuccccgcccccaagguccaggacuccagaacuuggccccuuccccucagacccacccgugcagacuuugcuuuuacucucagcuguguuggggauggaggagucuggcccccagcccuccucucucagauccggucccuuccuccccacagcaggaccacaggacucagcauacucugcucuaagaaccugaggagcgcugcagcucacaguuggagagggcuuugggaccugacuucauuuaacuggggaucucugaaaguaugaaggcuggcgagcuaccuugagaccuguauuacugagaauucaguacucaauauucggggugggggagggaaauugaugcaggaucaguuguuugaauaaaacacacuaguuuguu

SEQ ID NO: 3772 - RNA, 3877 nt, Mus musculus
aacaaacuaguguguuuuauucaaacaacugauccugcaucaauuucccucccccaccccgaauauugaguacugaauucucaguaauacaggucucaagguagcucgccagccuucauacuuucagagauccccaguuaaaugaagucaggucccaaagcccucuccaacugugagcugcagcgcuccucagguucuuagagcagaguaugcugaguccugugguccugcuguggggaggaagggaccggaucugagagaggagggcugggggccagacuccuccauccccaacacagcugagaguaaaagcaaagucugcacgggugggucugaggggaaggggccaaguucuggaguccuggaccuugggggcggggaagcaccgagguccuggagaaugacucuccgucuuucuccuaaggggcccagggaacauggcugaggcacaccaggccucgagcuugcugucuucacugaguuccgauggggcagaaguagagcucagcucgccaguguggcaggaaauuuaccucugugcccugcgcuccuggaaaaggcaucucuggcgugucugggugaggagaacuauuggcugguuuccuucugggaauucagauuucggggcuuccugaaaccgauucugaagauauggauguccagucccaggcuacgguuaacuauggcuuccucugggaugcucugugcugcccacuggccugcccugcucagcauccagacucacuccacuccccugcugcccuccccaugcagcuccucccccaauaacuucaguauagucuccuuaucuuggauuuauuuauuugucugcuuacugacugacugccuuacuggugccaagcuucagaauccaggguuuuggacaaucuaggacagcuugaaugacacucucauccccugacugguagauuccaggaggguucccuaccaccaagccaugccuccacuaacaccccauuguggauucuaggaagagucccugucccagccuaagcuccuuauuggggaauaagcaaaaguuauaccaugcuuccaacuccuuacuaaauacauucaguaaaaggaauccugugcucugcccacauccgagacccuagaagcucccaagagugagccucuccuuucucaccacagaaugacuuucuugcugguguggucccugcaaccccccucagcuggcucuuccucuucaguacaauccagcuugccugucuccuccagcuggacccuucccuaggacugauggagaagauuaaagaguuacugccagacuggugagaaccuuccucuucaccagucacugcccuccccacccaccccccccccaagauacucugugcucugccugccacagaaauguaauuuccgggugugauggugcauaggccuugaaucccagccccggagagaucuggucuacagugaguucuccaggacagccauggauguuacucagagaaacccugacucaggguuuauuauuauuauuauuauuauuucuggaguuuacuuuauaauagagguacagccaaaagaggagcuucaucuuucacuucauagcucuauuuuggauuuuugagacaggguuucccuguguagcuuuguguguccuggaacucacuguagaccaaauccuccugccuuuaccucccaaaugcugggauuaaaggagugcccaguuuuucuuuuuuuguuuuuuggguuguuuuugcuuuuguuuuguuguuuguuuuguuuuguuuuguuugagauagggucucuuaaugcauguaguacuagcugucccggaagcuaguuauacugagagugggauagccucggacucacagagauccaccucccucuggugccacaucagguuuucaggauugccaagcucuuauccuauacuggguucugaacugaggcagggugaggaaugguggcucaccaaguaagcuuuaauccuagcagaggcggggcuuacaugggaaggcccuuuccaggcagagauuugugaguacgaaggcauccuggaauacagacccagaucccaucucauaccaaacaaacaaagcaaacauuaucaccuuuaggaagggccuggaaaccaggcagggauaggugagcugaguucugggaggugggccagguuuccgugggaaugggcagauuuucugaacaaggcagauccccgaauuagacauggaucauguuagccauauucaugauccagucuagagaagggcaucccauggagagcagugauggacccauagucuugaaaccuggagcccacggggagggccugcuacacggccacgcucugggcuuccuccccacugcuuucccggucuccuuacuuauuauucuuauuuccuuuuuuuuuuuccaaguuaggguuucucuguguagcccugacuauccuggaacucacucuguagaccaggcuagccuugaacucagaaaucugccugccucugccuuccaagugcugggauuaaaggcaugcgucaccacugcccggcugcuuauuuauggcaggguuucauguaaccuaggcuguccuccauuucacaauguagccaaggaugggcuuuagcucaucucccugcuuccccagugcugggauugcaggauugugccagcacacccagcuuaugcaucgaacccagggcguucgcaugcuaggcaaacacucuacccugguguacucccuggucccaggaaagugauuuuagaagcuuggugccuccccaagggcacacccacagagggacacacccacuuuauaagguaaauaaaugucugucagacgugguugucgccagugcccauucugcaggcuugguccacugcacagcuucugggguacccucuauucauuucucucccaggggcggacagcaccaucagcuccagggguucuugucagcagcaguuuuugcaucuuguuuguggggagcccucaucuucacccuucauguggcucugaggcuccuucugucccaccauggcuggcuucuggaaccucauggcgccauguccucacccacgaagaccuggcugguaugugaggaucuagacucucagaacaaacgugcagcugucucuguuucugggucucgguccaccaccacuccugugucugugucuauaccccacccaaccccuguucucucugggucuuggcucccacuuuguccucgguugucucccucuuuucaugcuguuuuccuauaccccccucacuaucucuauacaccguucucccuccauacagcguacaucaucucuguccucugguucagcaucauuccccuccucccuccccuucaucucucuccaucacuucuguccucucauccuguucuucacuccgucucucucccuucauuaucuccauucccccucuucccucccccauccaucaucuuguucucucuucuucuccaucaccuccauccucucggccccaucaucucuccuccacccuucccccuucauuuccuuacucccucucccuauaucaucuucguccucccucuuccuugcuccaacuggguccucuccucugucccgcaggcauuggucagaaucuuuuccgggaggcacccgaggcucuucagcuuccaacgcgcgcucccgcgacagccagugcccucggcgcaggagaccgugcgcaaggugggcgugcccuggagugggguggucucgggcaggcggcgggacgcugacgcuccgguccucgucugccuguaguaccuagagucuguacgcccugugcucggagacgacgcuuucgaccgcgcuacagcgcuggcaaaugacuuccugagguugcacgcaccacggcuacagcucuauuugcaacuca

SEQ ID NO: 3773 - RNA, 10582 nt, Mus musculus
uggugguggugcaggccuuuaaucccagcacuugggaggcagaggcaggcgaauuucugaguuugaggccagccuggucuagagugagcuccaggacagccagggcuacacagagaaaccuugucucagaaaaccaaaaaccaaaacaaaaaaagcccacgcaaacaaacacaaauggcccaguaccacggugcaggccuuuagucacaguacucagaaggcagaggcaggugaaccucugcugcagguuagcauggaucauagcgagcuccaggagagccaaggcuacacagagaaacccugucucaacccccucaucccccccgaaaacaggaacagcacaggaagagcgggagauggaaggcagacucuggggugggggcucaggggcucaggggucugacccgcacugaggacuccucaaccucugcuccaaagaaucucaggaagagcugggcgugguggcgcacgccuuuaaucccagcacuugggaggcagaggcaggcagauuucugaguuccagguuccaggccagccuggucuacagugaguuccagggcagccagggcuacacagagaaacccugucuugaaaaaccaaaaccaaaaccaaaacaacaaaagaaucucaggaaggucugggaauccagccaugauggagccaggaauccuaccuagcuugagguccacaucccuagagcagaaauggacaguccucagggagugauaggcaaaacaguagaacuaccccagccccagggcgagaaguggcauggucagcugaggauuuauuggcauaaacgcaaccauauaaaaacauaaguuaugaaaaacacagucacgauguacccccccaucccccaagcccauccccccgagcccccuucugcaggagggccagccuggcaccuccucagcgcauccgguagucgguggaacaagagagcucacacagcugacccuugaaguccaggucgaugguaaaguccaagucacgcugcagggaaaagagggaaacagagcucaggugggagacagagccaucagccaagggccaggcaagaguguuggcaacgucugccagccagcacacugcacacccugcacccugaccuacugacagcacuaucggccauaugcaccccaugcuccccagccacagucuaaguuucugccaccgagggaaccagcaccagcagcgcuggagugccagcaccacuucagggccccugcaagcauccugaagcccccuccacccauggaucaagagggccaggguuagguguuccuagcaucacacugcgcucuggcacuugccacucuaaccuguaacaggagccaggugauuucagugcccacaggaagggugcugaacaagguuaucacugaacccagcagccacauggggcuuccucggguacccgcuaugcuacccaagcuggcacuguucaacucuacccagaaccugacuuuucugcacacccuccguaucauguuuacucuccaucaggccucacauuguuuuuggcauugggccucauuccaauggugccaaagaucuccucgccagucuucacuguuagguaguccuccauguagaacacagucugcuuccaguguguguacggggacucaggaccugaaaggugggcauggucaguuccagacuuugccugggugucgccaugcuaaaccugccauugcaccccccacaaggucaccaccagcaaggcuuugagggcuagugauccugcaucuugccuguguuuccugaguuacacagggaucagacucagucacucaaugacugacagcagagccugguggaacaguucuucaguguccagcacucccccuuguucuuaacaggacuagugguagaacccagaaccagaauaccauaggcacccgaccacugggccaugccccacccucccagagugacucaaggcucucuauggccccauuucaacucuuccuuuuugaggguuaccacuaacuuucuucaacuuuagagcuuucugcccuguucccgaguagcucuauggcugugauaagccucaggcaugcccgacgcugcucaucacacagaaaccucacugaugaucucggcccccgcccagccccacacagcgcucacugguggagaagccgguccucuuguggcaucgggugaacucgauguugaaguaagccaccagcgcgugcacguagucguuccucuucacuugcaggcagaagggggaggugaaggucagguccuccaccuugacuguguagauguccaccuccugccaaaugggugagcccagucagugcucagagcccacccugcacgagaacugcugccuguuaggccccuucccaucacaguaaaacagcccccccgccuucugaaacggggucucauguauccugggcuggcccucaaaacauuuuuccuuuuaaaaaaaaaaaaacauauuuauuucauguaugaguacacuguagcugucuucacacacaccagaagagggcaccagaucccauuacagaugcuugugagccaccaugugguugcugggaauugaagccaucucucagcacagggcauggcccugaaaacucugauguguggcccaacugcucucccuacaguucuaauggacuggucagggacugggaccccugcuauugcugcccaguuaccuuuaugaggcaggcauuggugaccagcugcuuuggguccaccacguccaccaggggcuccuugauggccacgucuuuaaugcaggacauaucaaagccauacacguucucccacccuggguacagacagggucagaugagcuguggaauccaggcccugcccucgccacccauccugcccucaccacccacuacaaccccagcucacaguggaucuuguagucuuuauauugucgguccucaauggcugucacauacaagguggcccggucugggaagaugaggccaucgggugccugaagggaguuggguaaaagcaaggaccuagcugagugguccaauuguccagcccaccaucacuuuccagagaccccuuagccacccaggccucauccuuuagucuggucccuacucaacagccacagugcacccagagcccuggcaguuccauaauuccuaggagcauggaaacaccccagaaggagacaccuccauuuuguacaguauccuccugaucccuuccccuuccccccaguacgcgcucuccuggcguaaggacucugcacuggccuucuucaagucaguuccucugccauuccuuuggucccuucucccugggaaggccucauccacagaaacacuugguggcacccuauuugcugcucuaacuccuuagccuggggcgcccauccaaggcguauggcucaccagccacuugucccgagcgugcagcacgguguugagcauggacucguagaagaggcaguaacccauccacucgcugaugaugauguccaccuucuccacgggcagcuccaccuccuccaccuugcccuugaugauggucaccacugcacccacaggaauggcaugccagucacggggagggcuggcccagaugguuccagacacccacagaggacucugguccaagggcaggcacccugucucucuuuucaaacugucucacuauguaguccuggaacuugcuauguagaccaggcuggccacaaacccagagaucugccugccucugucccccagcacuggggauaaaagguuaaaacaccagguccguccuaaagcacaaggguagcacagcaacaguuucagguucugucugcgggucuaggaguagcucugcugcgagcccaaguuuaacauucuccaggucuggguuuguuuccuccccuagcagugcucaggugaaauacauuuuucuauucaguaagugaagcaguaaguaauaaugguguagacacaacuguaaaacgaggccaguagguuaggaugcuugcaaccaagugggaugaccugaaucucacccccaggguagaaugagaucuauccucugaccucuacaugugccccacccaauaaaaauagaaagcauuucaaugaaacaaaauaaaacaaaacuaucauagccagccaggccugguggcacaggccugucacuccagcuacuuaggaggcugacacucaaggacugaaguucaaagccuacuugggcuacaauaagaaacccugucuugggcuggagagauggcucagugguuaagagcacugacugcucuuccagagguccugaguucaauucucagcaaacacccagugggucacaaccaucuauaaugggaucugaugccuuguucugguguuucugaggauagacacagcucacuuacacagauaaaauaaacaaauaaaucaaaaagaaaacaaaaaccaaaacaaacaaaaacccuguuucaaauacaaagaaagcuguccaacuggcuuggcgggagggccaaggcuccaaacaagcgugugcuagcucacaggccuguugcuucaguugcagaucaucucuuguuggggcaguacaaaaacuccuacuaaagaaagcacuaucgcccggaugggugccaggccgcaccuucccaugccugccucugcccuuggagacuguggcaccagugcucaucuacucucaacugucuucucacagguuuuccuuuuuuuguagccuguccuggcccucaggcucccagggaugggaugaugggacacaagaccuccagggccuucaguuuagaccugcuccaucuuuuauaaugcuaaguauaaccagguacacaccuuuaaucccagcacuugggaggcacaagcaggaggaucucugaguucaaggccagccuggcuacaugguggguucuaggacagccaaagcuacacagcgaggccuacucuugagaggaaaacaagaguuuaacugcauggaaaacuaguuuguuuaauccaagcacucgggaggcagaggcaggcggauuucugaguucaaggccagccuggucuacaaagugaguuccaggacagccagggcuguacagagaaaccccugucucgaaaaaccaaaaccaagaaaacccccaaaaaccuaguuugguuugaaaugacaccucaggcagacuaaaggccuucaauguguacacauaagcacaggacaaagccuguggugggaccaagugcacaaccuuugugugggaacuguagagcggcaggccugugguaagcaagcuuccagcugcacacccagccgugcggugggugcacgggcagcaguugugggguucucaggaagguaaugccagucaugccagagugggggcugcuggggagaauucuugacaggcccuggaugugacaacugagggaugggaaacccucgcacaagggaagcucuaaucuugagcacagucaccaaagauccccaugcaaaacccuaaaguucgaggcccaacguccugacauccagacucagcguucccgaacgugaaggagccaccaguuguccacuguggucucuuaacucuucacugaggcguccaagaaggugccuguuccuccagacccccccuccugcucaccauggucuaacuuguuggcuuugacaaucuucacagcauaaucggagauacuggaacacucaaucuaaggcaggaagaaggagggugagacagaguccaguccaugcccucuccagcuccuaaccagcccgcccacugcaguaggacuuaccccaauaaccuugcgggcccccgccuuggcagcaaacaugcagaggaugccagugccugagcccacauccagcaccaccuugucuuugaagagaugccgauugugaaacauggaguugcgguaugugagggugcgcaccucauccuucagcaucuccuggacagggaaccagagacagaggaccagagugaggggacacacaaggcacgcaugccaccaccacacugacggugagcaaggcucagaggaccccuuucccuuccgggcgcuucuuuugcagugaacaccuacacuggccagguuuuaucagugccguccuugcccgagccaggggugaaucaggacgcugaaacaggaagguccuggguacaaggccagcccuuagaucaccaaaaugaaccuugguacuggccuggcaggcucacacaaauuaaaauggaguaagcagacagccgaguagcaaggaggucgauugacccuugacaucaccucucagauuccagccaccuuguuuucugacauggugucugagaccuggguagcuggaccauuagguuaggcuaaugagcccagugaucaaccugcuucugccuacucagagcugagcuauacaagcauacaccaccacgcucgguguucuggaaguuaucaugcacgcagcaggaacauggaagucagaagacacuguccauccuccauccagggaucucuuguauggcaagcacuccuuucugcuuguguggcaaguaccuuuacccauugagccacugccaguucuuuuuuuuuuuuuuuuuuuuuuuuuaauuauuuauuuauuuauuauauguaaguacacuguagcugucuucagacacuccagaagagggcgucagaucuuguuacagaugguugugagccaccaugugguugcugggauuugaacuccggaccuucggaagagcagucaggugcucuuacccacugagccaucucaccagcccgccacugccaguucuaaguggguuuuggggauuaaacccugaaacccaaccgggcgugguggcgcaugccuuuaaucccagcacucgggaggcagagguagguggauuucugaguucaaggccagccuggucuacaaagugagcuccaggacagccagagcuauaaagagaaacccugucucgaaaaaccaaaaaaaaaaaaaaaaaaaaaccugaaacccaugcuugcauggcaagcccuuuaauaacugggguacgucccuaggccuccaaaagcucaauuauuuuaugcaaauuuuccaauuuuuuccccauuuaugaugcuggggauggaggccacuauccagcacgugcuaagcaacuacuccgccacuuugccccaaucccagccucuaguaguuuuuuuguuguuguuguuuuuaaagccccauggaaaaaagacgaggauucuuuagaaugucauuugauuugcaccaaguccugucuccuuuaucaaaaaggguuguagugcagcaugagccauggacgcagccccacugccagucacuagagggcgccagagacagacagggccggaccucaucccuaggucugugguacacuggggcaggaagcacuugcacuggcuucuggagagauggaagaauucagucuucaaaaguggaccaggggcagaaagggagcagugaacgugcugagacacucagagcccugucuggucuugugguccuucaguccauacuggcuguagggucagucucuacucaccucguggaugccaaagugggcauaggagucaaaguaguagucuuuggaugucauguccucagcguugggcuucucacuacuuucugcuuggccacaggaaaccuagaagagggggaguggcaaagggucaaagguggguuccccagagucuccucaaccugcaaaaagccccucaucauaccaggacaacccuccagcccccuccagcaucuuucuuccccaggucauguuuccacuuccaggacccacccagagcaccauccagggagcagccgccucgccuaccaucucuccaggcucuauggccugucucuagcucagcccacagcuggggagggagggagagagggcagagccagggcagacacauggaagggcaggggaggagggcuggagauggaguuaaggaagcagccaugguucuggggaagccagcuggggccaggaagggcucuguccuaagggguuagggggcacagcagaggaaacugguuggaagcaagaggacgguuagaccucuuggggagccagauguauagcaaguaagcuuauguggaagugggcugggugggggucucacaaaaggauauuuacuucuucaagaggcggcuggaggcucaucccauuagccaagguggcuacaaaauucuaggagagaguaacagggaaaaaggauuagcuacggggugauuggggaaggccuuuggggcggugagugguuuguagguuggcuuugccugggcaaggaagggagugugugugugagcagggacaagcaaugagggaggcugugaucggguagagaaggauaggaaggagggaagggaaggucuccugucccagcuguuggcugaagagaugguggccugcccccuguuguccuucuuugguccaaugacuggccauacacaccuaccccaucuaggccacaagacccaauacuugccagggcacaugggcacugcccagcuguugcuccccuucacuaccuaauccccccccaagagauuaggugacauuuccugacacacaugccaggcugaagugccaugaauaaacuggagggagggguaggaagggaagggugcugucgccuguccuaagaggauuccauuagagagacguagcacaccaccaaagcagcaggcauaccaccaacucacacccacaccaacacacagaggcaaccugaccucuuugguuucccugccuuucugaggagguaucauauaugccuuggaaaacuggguccagcccauuccccaccucaccuggguucccacacuggaacagccuuuucuuuucucuguccacaagucccagggcccagggucaccauagugacccuguaggcuaacugaucccuauuuauggcagauuucccagcaacugaccuuccccuccagagaacuugaagagguaugggccccaucaaauuaaauaccaucaaugacugccacccaaggcuuccagagaaacgucacaaccuaaccaagcucucagcuccccacagccugggaggugagauucccacgugggccccacuuuuucaauaguacagacggacaccagaagguugacaaaugacugaagagagcuugaaacccaugucuaggaccugccuuacaagccugaugaugagcuacucagaagucaaaagaaaauggcaaguucaaggccauacucagcuacagggugaguucaaggccaagcacauuuuuuuuuuugaggcaggguuucucuguguagcccuggcuguccuggaacucacucuguagaccaggcuguccuucaacucagaaaucugccugccucugccucccaagugcugggaucaaaggcgugcgccaccaccgccaggcucaggcacauuuguuuaauuaaacuaaguaaaaaguagacugaggaauacagcuuaggaucgaacaaucaacgauaagcagguaagcaaggcagaugcuagaauuucauucuguuuuggggggaaauuaggcaaaaaggcggaaauguucaaaaaggggucccuugccacauucaaguugguaaaaauggagcucuguggagguuaaggcccauggccauccgaacuccuuuaucccccaccacugaccucugacuauccauccacccgagggcccucccaugaaggggugggcuugggccacgccccaugaaaaaagacgccccucucacacgcccauagugaccacgagggggugcccggcgacggauccggaucuccucggaugagauuccccaccaucuccuuaaagagaggucacagggcuaugcccauccccccccccccccccccccgcugcacaaggcuaacacagaguuggggaaagggaggcuggggacugauguucucaggccccacgcgggugcaaagagcccgggcugcauggacauccacagccgagccagggagagcggguggcaaccccuggaccccuugagugcagcccaggucaucgggcugggggcggggccuuuguccugcacguggagcccacggggccccucgaggcggcacaccccccuccccacgcuacucugcgagaccacgugcggcccggcuggaagcgcccccggcccgcgaccacgugcgacaguccucggcucggcugcgggucccaaagcaccgaaagccgagaucucucccgucacgaucgaacacaucccccgaugcggaccaacgcgaagccaggcacaucaaaaggccccguccccacaguucaggccgugggccacccgucucgcgccgcccccgggccuaaagagcccagcuacucaccuccaugaugcaguucgcggccucggcugccgccaucuucacccgaguccuccggccuccgagaccccccccucucucuuuucuccccccggcucgaccggggaccgccuuuuaccagaggguccucagcccagcccccgauaccccgccauaaguucucauuggucuguaaagccguccaucugagagcuucauauuucaauuggaugacagacacgccuaucaaacauaaagugcccgccccccuagcguuuaaaggcccgcccccuccuguccgcuaggaagag

SEQ ID NO: 3774 - RNA, 7976 nt, Mus musculus
gagagauggcuccucuggugugucuaacuaaagacaggcucaguguacucauaucuaaauaaaucuuuuaaaaagguaaaaauaaaagugcuugaacacacgaagugcacacauguagcacacacacauacaugcaggcacaaacuuacauguaaaguuuaauauuuuugcuuuuguuuuuugagauguucucacuguccugcccuugcaguccuggaacuauguagaccaggcuggcucuagauucagaguuccacuugguuuugccuccugagugcugagaaaggacuaaaggaguggccuccacacccgguacaaaucccaacacucaagaaucaagaguugcuggauagccaggcuacauagagauguucuguuuuaaaaacaacaaaagagguggguugugauaaagaagaccccaaccguggcgucucaccuucgugcauucacuccagugcaaauguacacacacacacuuucgggcucuaguuaaagaacaaaguuuuuaauacagacacauuuuaaacagucuuuuuggcaaaaaaaaaaacaaaaaacaaacaaacaaaaaauaaaaacauaaaaaagguagggcaaccaccacccuacagcccugaugugugugucgucauauuucagucaucuaugcugggucagaggaaacguucaguccaagggcaaguucaaguccacaggugaggaggccaggaugccugccugcagaggacagagagccccaggcugguaagagggaaagaccccuugagugggacacuuaagugauuccauggcuguucugugcuggccccagucccugcucuaaggacggagguuaagcaacacugaugcccugcaggcugucucccaggcucuucugucaucuaugucaauagaagcagggccgcugagcucuaccugucccuccugucuugccaucugaacuccgucacuccucgccuccccauuccacggaaugcagaaggaacccagcugaugcucacaacaguaccucugaccugguacccacacucagucucggagaaccugcucucucgucagaguccuuucugcugggacugacacccaucuccaggccuuuccuggucuaucuaagaggaugggucuguucacagacuaccaauaucucagaacccccaucucaggguggucaaggacccuucugagcccggcugugucucuagaacacagguuuuuugguuuuuuuccucuccuucugaagugcuggacuaucuccuaaccuccuuuuguuuguguuuugccuaagcugaccgugaaaccucuggagccaaggaugucuuuaaaucuagauggucuugccucagccucucugguacuugagaugacagacuugcaccaccagagacaaucaucccgucccgucccgugucgugucgucccccccccccccuccccguuacaccaccaccccaccugcugugccucagccaucuccaggaucuuacuauguaacccugacuggucuuagaaccccuaggcuggccuugaccuuauagagauccgccugccucugccucccaaggguugggaauuaaaggcgugcgccaccacugcccggcuacagacugauuucuauugcauguguauaagauaacagucagcggccagggaagcccacagagaguugauguguggguacgugggaagagccauggggcacaaacuacuggagacucgagucaccagauaagcacccugcauccuugaaucccauucuccacuccacaaccacccuaaacgacgaggaggaugagacuggggagcugugugagcuauucucacaauugcugguucaagccagagggcaacagaaccgaccuccuuagcacagugucuggcauacagcaggugcucaauaaacacaagauggauugaauguaagagcugggcguucuggaagaaaaccugucaacugucaagaugucaguaggguuaaacagagaccuggcaggguguguguaacuuacccaucccccaugggccuggacccaaggcaggaagcuguguacaugcucaacacugagguuggccaggggacccccaagcccagccacacgccggcucaauuccauggcuagugccaggcgugccagaggauccggggauggcggugggggccccgggcacggcagagacgggcuggagcaauuuggggaggagcugcuuucccggcuagagaagaguuccacaaggcgggcgaaagagccugcggacaggcgggccaguuuacgaugcagagccgggucagaugccagcugaggggcagaggaacaguguaagcuaccaccaagccugugugaccagccugggggccaggccuuuccagcaccaagucccucccacccaagcugccucuauggccuucaccaguagacucccaagaagggguccuagaaucagagccaagaacaguucugaguucuaagcaguggauucuccguuaguccuuaaacccaagcugggcaugguagcacaugcuuuuaaucucagcacuugggaggcagaagcagacauaucucagugcucaauaaguucaagccugaucuacagagugaguuccagcacagccagggcuacacagaggggcacagggggacgaguaccugauaacugcuguuacaguacuguucaguuuucaaagcccaauuccaggaaacucugaggcuaugcccucucaggccggaauuuccucccuauucugagcuguguccuuaggguagucagucagucagucagucaggguucuuugguuuuagagacaggguuuaacucuguagcccuggauggcccugacuucguagagcucugccugcuucugccucccuguugcugggacuaaaggugugugcucucacauuccaccuuguuuuguugaaacaaggucucccaguguggccuuggcggcccuggaacucuucuguggccaggaugacuuugaacuggucuccggccucauacccgagagugcagggaggagggcugagccugcucuacuccaguccaguuuuacacuccugccaggcccuucucucaccuggcucuugguucuggccucuucuuuuguuugcuguccuuuguuuuucaguguuuaacuugggggagagggugauggagacaacguuaagguaaggaccccagccugcugggcaagggcucugucaccaagccaauuccuaaugaagccucugguggcuucuguugccuaggucccacugcuuguugauggcccaugaaggacacugguguuaaguccugcugcggugaggcaucaaggcucuugugaagaugcucugauguuuacuggagcccuggaaccacacccagcaucaaaacaaagcagcgccagcgucugcccccuauuccacaacuguccucuccauagcguggaguagaggcuggucaccuuuugguugaugacuucugccucuuccuccagcaaggcuaccagccgccuuagcagggcuuccuucuccgugggugggggucccuggaacucuggggguggggggcagaagagaauuggacugggaagggcccuggcuuugcuccuaccaucaccccucaccagggcuccucugcugcuuaccugaacugggcggggacuucaguugcuccugcaccaauuguuccagccgcugggcaaccagggcauagaacucggaagaggcugggccugagcagaaagaagcagcgacgcuuucuguuuacagaacacgguauuuauggcgucucuccuaaccaucuugccacacagcaacaauuuccacuucacaaaaggauacaccucggccaugagacguugguaaauaaaagauauuaaaugaacauccucagccuuucuacuuuguugcacccucaaauccaacugagaauauucacgcugagcucuggagaccauugcauccagucaggacagacaugcagcguuccuaccaucacccccuagcccuugugcaguucacaugcagcaacagaccacagggcucguuuuaaguaagccaucuaaccaggcacgccucuuuagaguuauuuucaaguuuuauguguguguucugccugcauaugugucugugaaccacuugggugcccagugccugugaaggccagaaaaacagcaucagaaguuggaggacauaacaguuaagagaaccggcuguucuuccagcaggcuaggguucaauugggugguuuuccugcacaaaugucaugugccaagugcaugccugaugaugcccucagaggccauaaggaggccccuuucccuaaucccuaaugugugcuuuucaugcuccauuuaugugcuguugggaacugaauacaaggcuucaugcaugcuaggcaggcacucgacugacucaacuuuuuguaguccaggucggccuuaaacucacagcaguccuccugccucagccucucucagguguugacugcaacaaugugcuaccacacuuggguuuguugaucaccaaucaaguccaaagaucccuuccuccagccucuuucuguuacuuaaaaaggaggaaggaugcgcccagucagauuaccaacuggccagggaguuacgacugacaacuacacuuccagucucuugugcugggguacuggagcuacaagaagagccagagaagcacccaaaaaggaaaaaagauaaaucacccgaggacggugccaaagcaccucucccgggucaaccacggaauugcucuguagaagucuaagcuggggcuccacuuuauugugcaugccugugauuucaguaugaaguaggcugaggcaggagggcuccagcaaaugugauuaugucucaacgauccuuuuacuguagcccuuaagcagugcaccccaaaauccaucaaagggcuagccagcccuuccuuccagcccuagccuaggaaccaagcaggagcugucaaaauggugguaccacgacauccccucagcauacagccuuggugaaacacgacugcagggggcguccacagugguagcagcaucuccauccucccugagcagcaccgcagagauggcaccucagccaaaacggccugcaaccaaggaggacugacuucucauccuaacccaugggccggcccacugcaggggaaaggcaauggcaaaagcugccaggccccaagcuucccaagcuggacaucucugcccugagaagccacccucuaagaagucccagauaagccccauccuuuguccaauucccugcugucugaucccaggagcagagggcggccagccaugguguccucacuccacucuggacucuccaacaaaucucuuucaugagauuuucugccuggugugacucucucaucggaagaagccaggaagcaaagaaguggagcggugcugaggcucuacucccuugggagccacaaugccucugcugaggagacuuccucucaaagcuguaaggguccuggcccccaugucucaggauaccccuccaucgggacacgucccaccucagcgcuguguggcucuugggcccccagucucaggcaucccuugcacugggaccccuucucccuucagagcugcaugcuucccgggcuuuggagccccaggguaccuccuauccaagcacaaacacuuacacuuacccgcuagaaagaggugugacaaagacuugaaaugguuauggcuugugcugaagcugaaccguguugacuuuauaauggguccugucuggauuuuuuggaaccaaaacuccuagcccugaaaguuucacaagugaccugaauaaaucucuuaccaggcucggaaccauagcaggggcggaggggaaggaaguggggccuagaggacuccguggggggagcuccucuccccaggggacaagggaggcaucuucggaggcggcucaggaaaucuguugucuccucuugggcaggacuccuagggacaagaaccucggaguuaucccgaaggggucugggcaagugaucccuucauccuuucauggaagaucacucuugaaacucagcccaggcacauggaguuaggucugaugggaguagauagguuuggaccacaagacucaggaagaucuucccaucaaaggcugacgcugggggaguggaacucaccuggguggaguugggacaggggacccagcgacuucaccgcgcuuaaggaaggccgucagaaccuucaguguguccucucggagacccaacucuucagagccggccauggggguaccugaggcagaagacagaggaugcacccaagugcagggauaacucaaacuucugaaucacugaaugaagagggcgccuaacuccaaggaaaaggugguuuuuaagggccaguggggcaguugauucaguugaggagaaacggucugaauuacugagucuaagaaaggagguaaaugagugcuugaacucuugcaggaaggagcgggaaggggguuuggaguucccucucagcuagcagcgccaaagaaggcucgaagaccguagagaauagggaacuacuaauccuaguaugcuuugcggcaaacgcugguccgauuuccccacuuuucaccgagcagucugcugggagauguaguuccaauuuuaccucuggcgugcaccgggagaccccgggugcuuggaagucacagcuuggcaggacuggcuguggccuuuccugcaacccuguccccucccuggcacccagcucaccuggcucgcgguuguguccccgucgcacuggcguacacgcuuucucacaauuucuacaaacuuuuacuucggaaguucaacuuucccacgccugcgcacugggccgacacggcaaccgccccaacgucgaagggguggagccuucuuuugcggucauuugcauauggcguucccagcaugccuguaggcggaaggccaaaaaagggcauuugagggaguuaggccugcuaagccgaagugcgcuccgggauuucuugacuuuauuucgucaauguugagaaaaacuuuuuauaucucaaaauaucguuagaaaaggaagucccagcgcucggaggcuuagcugacaaagaaggggguugcguggcugcgagucucagaacuacuguuugggagccccaaaaccacugcuggcacccgcgccgcacgggcgcccaauuccuccccugguagguaacgcggaagagccgggaggguggcggccucagggcgcaggaucgggcaaaccugucgcucagaagcucggcuaccgaaaagcagaauggccacgcguuguagacggaagccugcagucucagcauccaggcuggaggcaguaaagauugcuguaaguucaaggccagugagcuccaggccaggcuggacgacagaaugagcgccagaccaacauggguuaagcgauuugaagaccagccugagcuacugaauaaguuugaggguagccuggguuacagagugcauucgaggccagccagggccacagagugaguugaagaccagccuuggcuacauagcaaguucaaggacagccuaugcuacauacuaagacccugucucaaacauccguaaaaacaauauaggaacaaaaaacaaaaaaacagaagaagcgacagcaccugggaaaagacucuggaaaugaguaaggguuuucugcaagggugaggcgguugugagagcaguuaggauccuuuaaagacgagggaaagaggacuccacucuugaaauagggugccagcuuuggauaauaggaguuuacauuuagaaaagggaaggaaccuauggguagaguucauauagaagacucugggggguaggagaggcggucccguuggauuuggaaaggugggaaggaguuucccguuuguacacaauggugaaggaagaccuguguuguggcgggucggagagguuugagugcauuugccccgugacagacaggcucaggaacuguccuguggugcgcaggcuagagca

SEQ ID NO: 3775 - RNA, 16377 nt, Mus musculus
ugucuguacuucaugaaaucuuuaaugaaauuggagggggcaugacagaagggcuggggcugucgggggcaggcugaagggcuaggucaacgggcaggaacacggcuggguggggggcucuccucuuccucacagcaaccuuccccaucaucccacugggggggggggggcguaguggggaaguggagccauaaauauguccagaaucucagaggcacagggacaggguaaggaucucagagagggggcaggggcaggccugggccacccuugucugggggcccugguuccuuggguggccgaggagguccuggggggucccccggcuugcgaccgugcuugcggaaguagcgguagcgcuggacguaggcccucaccagauugcucaccuugacaggguugaucuccccgcucuugcuguggcagaucugcagaaccaggaacaacugagucccugcagccccagggcaccucaacccugacucaaucuuggccagccuacacuaucccccucuccuggacccagguccccagucaguccccuuggccccaccuuguggacagccuuccucaggauguccuuguacuccuccuuggugaugucuuucuucugguaguauggcuugauggccaacuucaccuccucuacugcccgcuccuguguguggagcuucuucagguacuggugggugagacaaggacagucaagaccaaacaagugcagccccccuuacccuggccugcaguuaccccaggcuaguagacacuuauaggcuagacccuguggcacccuggccuacccaggcccagcauucugcugggagacaaaccagucaaacacuauacuguucuuuuaugcaaugcugggauugaagcugagggcuugucuuuuuuguacaguaucucuaauuucaaguuguccauucuugcccucaacuuuuuuuuaaagauuaauuaauuaauuauauguaaguacacuguagcugucuucagauacuccagaagagggcaucagauuucauuacagaugguugugagccaccaugugguugcugggauuugaacucgggaccuuuggaagagcaguuggggcucuuaaccacugggccaucuugccagcccccuugcccucaacuuuuaaaucuccugccucagccucaaguaguaggaucagaggcgugugccccacccccacucuaccagcuggcucacaccuacuccuaagcagaacauacaggguuauucugaccgcagaccuucuuaagugacagggauaccagcuuagcugcucauagccuguucugguucaggucacaucaccugagcucuggaagaagcacaggaggggcugagugguugagccuaggcagcucaggcugcuaagguggacaucaaaaggggacccagccuuccacccuuggggaacuagaucccgugauucaugaaaaaugggacaccaccaucaaaggagcugugcugggagacugagguuccugggauagccugguguccaugaccacaaggaaagcuagagcugcuuucccaaagcaagugcacgaaggcaggccagagacaaguacaacagagcccaauacacaugcuuugguucauagggcacacaugucccagcuauagggagagacagucuuagcucuaugggccaugagauucucaaguaacacagaagaggggcugccugccaucccauaaaacacuugcuaagaaaagacaaauagcccgagaggccuggcuagcagcacaggaaugugaaccgcucucugagcugaggccaucuguuuccuguucaggccuacucugaggcagagcaguggguagcgcccucagacagugcuguuggagccaugaccaggccaauccagccagauaggauuuaaaggaagcagcucuaaacuguucuuucuuuugacuguaggguccucacuccagcugaggguguccuugucaccaccuccaugcuagaguuacaggccugagucuguacagccagccuggcccuaacuuuuugacaaaccuaugucuccuaguuacauaaagguggggagcaacugagguaauuaaaagaggcauuuauacauacauguauacauauacaaacuagaaguguuuuaaauucuucuacacacuaauucuucauuuuuguuuguuuuguuuuguuuuuuucgagacagcauuucucuguauagcccuggcuguccuggaacucauuuuguagaccaggcuggccucgaacucaaaaauccgccugccucuaccucucaagugcugggauuaaaggcgugcaccaccacugcccggcuuacacuaauucuuuuuuaucuagaauugaggguggaauccggggcuucaugcaugcugggcaagcacucaguaacugagcugcaccuccacccagcacucagccccauucaucuaguccuuugacucucccagucaaucucaccuugucaguguccccacgucccucugagcugcugcugcccucucucuugucagaugcaggggcuagcccaguggggguaggagggguagagccacagccuccuauggggaggcugccaggaaguagguagcuggaggggccugggggcagacccaaggaagugggcacgggagcuggggucaccccaagaguggaugauggcuuccgguggcugagaaucugugagaagagaguaugaugagccaagggagguggaagggaagagggggcuuuguucccccucuguucccucaaauuucccaaugguguagaccaacaggcuccucuucuggccaauaccuugcccuaaggccugcugggaguuguaguuccucuccuaccccgaagcaauggacaaaggaaggggcuguggggacucuuccccaugggagcccaccugguugguggccuggaucagcuccugggccuuugcgcggcuggccagguuggcuucuuccaucuugaacagcagugcagucacugcaguggacagagggaggacaaucaaggcagguaccaggauggagagcagccagguuccucaccugaucucaggacaugcuaugcaaccucagcucagaacagagaaagggaccucaccacugagaaccacucaaggggcuggcugugugacacggaguacaucugcuuacugacccacccaagucccagccgucccccaccuacaggaaaccagcacccuacuuaagcuccucacucucauccuguucuaucuaguucugcacggaccaaucuccucuguuccaauagcucccugcuugccagagcuuggaguagacgcugccuguucuguccauccaacccuaccuacccaucccucuccccacuuccgaagacucacaggccaggacaccacugguaguacaguccacaccagcaggcagguuccagggcauggguggggguagcguuggcagcugggagauccuagcagcuggcccauccucugcgccagagucuccggcuguagacccugcacugggggcagugcuuggggcagcugcagcggugcugguggcugugguaguggcagguugcugcuccuccuccucuuccucuucuuccuccucuuccuccuccuccucugccccuacucggaccccaguguccucacuggcuuccucugguaggaaggagacuucaggggucuugcagcugcuauccacagucugggaguccggggugagugcggguggagguggggccaccuuagguggugggguacugggggccuuggugguccgcuccuccccugaccaugauguuuccucuguccccuuggcacuugcugccugacugcagcugucggccuuggacuucuucagugagccaggcccaccgcuggccgugcuacugccuccgcugcgaaccuucuuccucgucuucgaaggcuucgucuuucccuugguccccuuggcuuucuuggccccagccuuggccuuggccuuggucuuuuugggcuuguugcuacccggggccaccuuggccaccucugcaggagcccgcucauccggcuugaggaauggugagcggcucucacggucacggcugaacuugaccccaauggagcccaggccugaagacgaggaauccuuggcagggguggugcugcugacgcccucucggaugagcacagccaccuuggacugcaguuuuaccuugcgagaggagcaggaggacgaggaggacgaggagccacugcuugggggggcuuugggcaguggcccggagccaggcgucgaguccuuagguggccgcgucuucuuggaugaccuaucccugucucggccccgguccccaucgagggccuuccgucgagacccuuucucccuugaggaugaagaugaggaugcagccccugaacgccuccgguccuugucacucuugccaccccgcucgucagcacucagacccucagagucauacaggaccucccgcuucggggacacagcaggugcuggugaaggugcgcguggcuccgcuuugucggggcgaccuacugugaugguccguuugauggcgaacaggucgugaucugugagguccuggauagaggguggcacggccccucggcgucggcugucacggucagagccugagggaggcacugaugcgggcagcuucuccaaguccccagaacgcuucucugcccgggagcgugagcgcuucuucuucuucuugccaccuucgcgccgcuugccccggugccguucacgucgugaggaggaugaggaagaugcugcuggagguggagaggcugagcgccgucggcgccugcguuucucccgggaacgugagcggugacccccacgucugcggucagcgcugcgggagcgugaucugcggcgagaacgggagcgugaucgacgccgggccguggagugugaaccaagcuugcgcucacgugaacggugcuucuuagcuucccaggagggugaauccgguggugcaggguccccgcugcgcugccgcucccgucuagccuucuuccgagcaggaggugggccuggcgaggcagagcgcuggcgguagcgcucacgucgcuguguuaggaucuugcggcgcagguccaggccgccccagcgggcaucagcggccgguggugcagguggcucaccuagguccacuugcagugcgcccucgccaucagagucagcauguagugacaggaagucaucacccucaggggcacguggugcagaggcugggggcgcagcaggggcggccaccgaagccaagguggcuacagaggcaggaggcugacgaggucgugcagcacggaacagugaaacugccacccugggcuccuccucaggcugcacaaucucgcccuccucuaucuccgggucagucggggguagugguggcagcgaaagcgcuggugcaccagccguuacgacuuccaccgaaaccuugcccucauggcaggccucagccucaggucccaacacaaagacccugcggcgcggggccccuucggcccgaguagagucagccugggguggcgucccuggggcucccagcgucugcggggguggggguucccggcgggggcuaucgucaccugggaaguccuggcucaagcuguugucaucguagaugccagccaggguuucugagaugcggcugaugcucugugacagacccucuucuucuuccuccuccuccucuuccucuucuuccucuggugagggugucccagcugaugagcugggauuggagcccgugggcucaaaggggucauauuuuugcucuggggcuggcggcggggaguaggccucaucggugggguggaagggaucauagaugucgaaucucggggcaggcagagcugggggagguggggguggaggaggaggaggaggagaaggugaagaugaagauggggaaggggaaggggaggaggaggcagaggagggggcaggugguggagcaggcccuccauccccugugcccaaggugaggugacgggaacaggcaggucgagaugcaugggacuguggagaaacugcagagaacagaguagauggaguaauagucagugacggaucacuccucucccagggcagaggccugcacacagaccagcgcugccucaagggcaggagagcacacugggguggugaaguuggggacuggggguguggcucagcugcagaacacuggccaaguguaugaggacaccuacaacagcagaaaauggcccggauguccaccccugagcccaggcggagcacugacuuaaucucacagaccacuggcucaucuacggccaacaaagugccuuaacuaauacagugcuguccccacaggacacaagagccagcugccuccugcucuguggagaggaaucagcuuagaucgugaaaugacagagcuggaggcuuggcagaacaagacaauccuuagaauuucuuuugccaucaaccugcaccugaggucuuagaagcaagagccacuaacccauagggacaucacgacgaaguaccuuccccuucucacaggccaggcucugcaugucuccuuaguuuaccacccaacauccacugcaccugugcucauaacaccacagugaugacugggccuagacucaaaugacuaucugagcacagaaacuaagccccccacccaaaauggcccauugaggacagugccagugccucauagaccgacccagggcauagcacucuacucaugugagcauagguuccuggcucaaccugcugacuucagauuccuucuauaaaaucacugucugcucauuuccuaaauucauguuuaccuguuuuaugucaggcucagcugcagugguaucagaacagcaagcccugccuucagggagcucacucguccugaggacaggguucacacccaggguucacacccuucagggagcucacucguccugaggacaggguucacacccaggguucacacccuucagggagcucacucauccugaagacaggguucacacccaggguucacacccuucagggagcucacucauccugaggacaggguucacacccaggguucacacccuucagggagcucacugguccugaggacaggguucacacccagagcccagagggcacccaugaccaacuccccacuccugcuccuuucuuauuucaacccaggacacacuagagucuggaagcacagggugacaugugacucugguacagaggaaggucaugagcgaucaccguguuccuuuuccugugcucuuaauaucuuccaaaacaaaacaaacaaaaacuaaaaaacaaacaagcaagccgagugugguggcgcacgccuuuaaucucgaaccaaagaggcagaggcaggcagaucucuguaaguacaaggccagucuugucuacaaugaguuccaugacagccagggcuacaaagagaaacacugucuugaaaaagacaaacaaacagaaaugcugaggugggcauuccagcauacaugggaggaagaccaggaguuuuaaggcuagagugagcuacaaagcaagauccaucucucaaaaacaaaacggacuaaggauguagcucaguggcucuaggugugaggccccacguucaaugccagacacacacacacauagagagauaggaggaaagggccagcaacaagaugucacagugaauaaaggcagcugucaccaaaucuaaagacccgacuuagaucccugggacccacuuggcagaggaaaacaaacuccugaaagcugaccuauuuguccagccacaaauguaauuuaaaaacaaacaauaacaacaaaaaaccccaaucacacaacggccuugucaguucaguuuagaaacuaagaaaaacccugagcaagacaaaaccacagugcuaagugucagggaggcacagcgacagccuaagcaaugccacucucuguucccaagcuugucuuuaaaauaucaccacaaagggugguggucaagucuguaaucucagcacaaggaagggcaacgcaggacugucccaaguuccaggccagucuaggcaacaggacaagacccugccucaaaaaaaaaaaaaaaaaaaaaaagucaccaacaaaaccacaccguaauuucagagucccaugagaaugacuggccauuugucugugugcacagguucuauuggaacauuuauccucugcuaccuuguggguugguuuuuggagucaggcucuccugguguugcccacauuagucuuuuuuuuuuuuuuuuuuuuuuuuuuuuuccgagacaggguuucucuguguagcccuggcugucauggaacucacucuguagaccaggcuggccucgaacucagaaauccgccugccucugccucccaagugcugggauuaaaggcgugcgccaccaccgcccggcccacauuagucuugaacuuagggagaggauccacaguuccucuucagccuaccaguuaucugagaugcacagucaaggauacacucauaguuccuccagucagccucaagguaggucauggaaguuggguaccauguccucugagcccaacucacaacugagaagggacaaugugacuguggccugccucaguggagucacaagccauguucuuccaggcacugggacugauggcugccaaagacuaacuguacacaagcccuucccuccacuccacuucuaaagacaugcagagagggagguuaacguguuggggcgucgagucagagcugacgcuggguguccugggagcuucagcuagauggccagcucaugugcccagaaccaaacgccugccuuuccacucagacucaagcugggcaccaggcucaccaauggagcuagcgaggagccgccuccuaagagaugacuccccaacucaaagacacgcaaguccacucugacagcugcuggccagcaugcucgaugcuccuaugugcccccucccuuuugcucuacgaguguaugaacuaauuuguaacuaauauaagcauccuuccuaccuucacuacaaacagcguaagugaugcuagcagcuuagcuugguggcagaaugccugcugaacauaugugagguccccaaaguccaguacccagcaucauacauuaauaccuaaauacaguugacuuucacacaauuucaagaccacccacccaacacagugcaggccaacauaccugucuuuccuguccuccaggcccugaggcggggaaacaggcugggcacagguagaggcauggggucccugucaccgaugcggaccucagccaccagcucuagcauguccucacuucugcaaggcagaggaaauggugagcccuagcagugccauagcucucaggauagggucaccccaccuucagcuguccagguucuuacucgccaggcugaagguccaggcggcugggaacccagguguccgggggauccaggaugcucaccagcuccacaaggaagcuaucugcagcuguguccaauaccuggaaggggccaaguuggacucuguucugugaguacucagcccaaccaccuuccuaguuccagccucucaggacccaccaaucugccacaagaaccuucuggaauccaaccaaccuuaucucacuggucucuaggagccagcuuagucagggaucugguccccagacuccugucacugcccaccagagucacaccagacccagcaguuuagauccccaguuccucugucuugcaggccccagggugaaggcugguggacacucuuacucacaguggccgugucagcagccccugacuccugugaacgaggcucugaccgaggacuccggcagcagcgccuccaucguaggccacgacaccgagcgccaucuggauagacauugaaguaagcugggauuccauguugggcuuugcaaagcacaggaagcaggucaagacguagcguuugcugagggagcaccugccaccucccaguuucugcagcacccugggcucccccaacucaaucugggaugggcucaccaaagggcaugucucugcuuggccugugaacccugcccaguccuggcuaaaugucuccugccucccaagugaccuacuacccugaucaccucuagucagcccaaaagccacacuggguucccugccaacuaggccuuccucuagacaaacccaguacccuggacacugaugacgcuagcacaagagaagcacccaggacaccucagaaagaagaaagauaagagcccagaggaaggcagaagccuaagaggacgagugggccucauaccuuuaucauuaggcaggucucccugaagggagcuucccacagccugcugaauggcccgcugcaaaaggggaaaaaacaaaaaucagggccaagaccucucuaacuucugcuguuuggaaagcacauuccaggcacccggcagccagaguccacaaagaaccccaauucuuccugaaggccugguucagggccugaacccccagcccauacuucagagcaugagaaccuaggccuccaggccucacugcacccagcuuucuuaccaaaauaaaggcagaaggagaaagggcaggaucucugucagguggaccgucuccccgauccucucccgacuccucuguuuuaccucgagacucaucuuccuccuccauggucaccugggguugaggcaacaguuugaagugaaggcugagggaggcaggucagaggugaaggaagaccucaagggcccccagugcauccugcuuuagugucccucucuuccgccucauuccugaugaccuuguccguggucccacgcugaccugcagggacuagagccauucuuauccuucuucuggauuucggcugccuccccaucaaugggaggaccgcucagccaccugcuccaacaccuggcccuccacugcccacagcuucccaaugcuccuaggcaaaccuccaauuaauuacccaacccagucaaauagaugcaaacucaacccugacuucgggugucaugauuuuaagagcgucgugcuucagucucagaaagccaccuuccccacagcggggaaugugccgacaugcucagggguacucuguaacagguaccguagguucacacagcauucauuauccuccaugaugaggagcccaagagcuuuauuuacagccacgagauacaacuaugauaguaugaucuacauaaccaccacaccgcuuuuaaaacaaaaaugccaaguuucagaaaggcaugcuguccucccagccccauugggacacuugccuaucacccagcugccuguccuguggaagcauggccaaagccucggugaugucacgggaauucugagcuuugagugcccagucagguaguugaaagagcauccuucagacugguggaugucuugauugaggcuucagaaaacaugaacaucacagcuguaaaccuccccacagcugucaaaccugcuacucugaaaacaccuaaucuuggaauuccuaaaagcccuaggcucccuaaaccacacuagcgcuuaucugaaaauggcaaaauaguaguaucucucacacugguuuccacauauaaauggcuggauacacauuagcaauaauucuaucaguagcccuucgaccagguuucgccuuuuggccucagcccuggucucaguccuacucugaaacuauaccuuggccuccacaaccccccccagcuccagcucuccaaaccuucagcuucuuccugauucccucaggcauaccuuacugauggccccccuaccauauccaagcuucucuaagcuaacauucaagacuuuccuacccuguauagcaauaauucccagcucugaggaugcucucucacagucugauacacaucuuauccaaagcacugacugucacagaaaagaaauuguaccaagagauccuggcugcagauuuggagauccccaaaaccauagaccuuguaaggcucugcagaccaugugagaucggugaucccucaauuacagggcucugggagcaauuuagugauucacaaacagcucauuacacaaaguacauaaaacauaauggaaaauacuuuccaaguuucaaauggaaccaugaguuugcaggacuggaguaauauuaguaaaauacauauguuggcaugcacuuaaucucaucgaauaaugcauuuuuucccuuccuaucaaggucaaguugcagagcacugcacuagaugaucccagacagcucuacagacccucaggaaugauucuaacuccucagcauggggacaacacagguucuuuuuuguuugaaaccauuuucuuuuuaauuacuuucugaaaggcaaguacauuugagcuggauaaaauucccagcguuuucuguuauuauucucuacacauuuaucuacucuucaaaagcacuugaauuuccuccaagacauagacuguauucuugcaaucauuggacgauucuaguuccuucaaacuaccccacccuaccccacccaccccuaucuccgagucacccccacauaaaacacuucccagaccuuagcgacucauuuaugccucugggcacaucacaaagcuugcuucccucucccuaggugggaguacaucucuuucuuccagguggaccuuaacacuuccuaguccuugaagagagcuuccaggccucauaaauggucccagauccauguagaugagccgaaugcagaggccagcaugaggagagacuucccagcccuaacaaauacaccccagugaacuaggugacucugcagacccccuuaacuccugggggagugaagaucucaagauggccccaaaagccucucaacagacccuagccuacggucgcacauaaaaaccaucuacggcgccugcagacguguccaggcucagcaaugggaaggagggccggccuagucgcgguccaggccauacgaaagcccucuggcacccacgggcgcguccggggcccuaagaaggcccccuacucagagacugccuuggccgcugcagccggguccgaaggugccacgcuacgcucuccaggccccguggcauacgggcgacacucggagacgacuagcgacccgacuccgccccgcccaccccgauaggcccgagccccgcggcccggaccgccgccgccaucuuaccccgccgcucgggcugcggcuccggucccggcgcggggcggggcggaauggggcggggcucgcgauuugagcuggggaagggcggaaccaaauugccgcggcgcuugccgggauuucaaguacccagcuggguuuccgaaaggccggcagcaccggaggcgacuccguuucccagaaaucaaugcgucacauggagguggagugcgcgcgcuggaugccgggagauguaguccgugugaagacuccgucacgcgggggacaguguacggggugagaggugaagugggcggggcugcuggagcgcgcgguacgaccccccucaguguccugcgugcgcggggaaaaaggcggcggaucaggaagugauguaaaaaaggcgcuccguuguugagauccaugggaauuguaguucaauuaagauggacgcuaccccgcccauggucguccuuucugaauaugaaacccuucuaauuuuuuucuccuauaaauccuaagaagauuuuuuugagacgcugucuuauguaucucagacgggcuuggaacuugcugcugucuuucugcuucuguuuccccagugcugggacucgucaguuaucaugcccagcuucuaaaauuauuuauuggggggggggaacuagagauugaauuuaaaugcucauacaugguagacaaacguucuauguuaucacuaaacuauaucuauaguccucuuuucguuuguuuguuuugagauaaguucauucuaagauguccagaauaggcuuuaacuuaaaauaaucuccauuaaauucagaacucaggagucaaaccagagcuccuuuacucaggacaggaaaauccaaacucugagucuucugguucagagcagaugagugaagacucauuucccucuuccuugggacucuggaauuucaauccucuucccuuucaggacgucaauaccauaucuuacauaaauguaagugcuaaauucuuccacaacccucccggagcacucaugcccucgaacucagaauucuggguccccagacucuccauccuuuggccccaugaguccagacucccagcuuucccaguaguaguaaggagccccucccgacccccuggaccggagucggaccggagaaaucuaagucucuaacucaauacucucguaggaaccagugucugagcuaucaaccgcauccuuccaaagcccagaaauccuggcugucggcccuucuagacccggacuucccgacuaggaugaacuggcucauggauuaggaauguggugaucucacagcccguccugcccaguuacccugcugucccccuccagggccccagcuccccucccagucuaucuuccguuuggcugggacagcgggaaccggaagccuaaguccauagacaggccgagacgccagccucuagaacgaagcuggggcagagaacuuggcgacaaucccagggaggaggcggagauuaauuuugagaccugugcuguccuaagaucucccuauauacggcccugagaaggagccccaagccacaccuaccagaaacagugguccuuagauaauaacuaccgcaacauuuaauuugcauauccccgccccgaagaaaacuuuuucgcccaaagaugggguuuauuagcauagcuccucccaaaggcggacugcaggaggagagcucguggcugugcuuaggguggacacagggucauuagcauauccccaccccucuuggaauuccccguuuuugcaaccuuguuuccccuacccuuauuagucuagcuccucccucacucuggccucgccuccuccagaagcauccggagacucguguccucuggccaaagcucauguuuaugcaguauuauuagcauaacccaccccuuggucucuccugacucccccuaggcgguagcggcggcagcagcagcgguggcgacaugagcagcggggcggcguccgggacugggcgggggcggccccggggcggggggccgggacccagggaccccccgcccggcgagacucacaagcugguggucguaggcggcggcggcgugggcaagagcgcgcugaccauccaguucauccagguagugggcccucaccggggaggguuuccccgagaucgagacuuugagcccuuuggguucccugaaacuuucgcuucucccagaaccaucauuaagacccuccuaagaggaucucuaacccucugauugcgacuccaaaugcccagggccuccacccccuucaugaggggaagcuuucuccuaauauguccugggacaaaucacccuccuagagguaccugagagcccucauccuagucugucuagccccgcucaccaacugggaguacccuaaauuccaaacaguugcuccauucagaccccaagcacuccccgaggcucuaaucuccugaucauugcccagacuuugauucuaagacucagcugggaccacucuguccuaaaacaggcacccuguaaccccugcuugaagaggauuucccuucagaccugagauuucagaaagauccugcuacaugaccauccugggaaaacaccaauaucuggcauaccccauucugcuaaaugcagccccccauccuacccccaaggaaaaccaaccauuucuccauccuaaguuccccacucaaacuccuuacccucaacccugaaaacucuaaguagcucccaugucaucuccagauuuaaaaagaaaagcauagaacucagguuuuucacagccuccagagaccuguuacuuggaagguucuaggucccauaaauagaccucuccuacaucaggaaccaacccuccaggcuguucucacccuugggcaucuauuuacuuugggguccuaaucauccccccacacacaccaaaccucauccucuccauuccuugcaccccuuuuagccucagcccuuagcaagcacucuagagaggaagccaccuucagccucagcagccaaguucagaaaauccagcccagccccggaaaccuccacccaguucccacggggagccuccccacaucagggcaacacuaggaaagugagggcccacuugcuguuguagaaguuccugggugauggacauucacagacuaggagccuccggcaaugccguugagaaaccuacagugggaagaaagaguccaaauuugagccccuagcaccaagggccaaaccuggagauggccagaggccugguuggaaguagcaggacacagucag

SEQ ID NO: 3776 - RNA, 3708 nt, Mus musculus
uauuagcauaacccaccccuuggucucuccugacucccccuaggcgguagcggcggcagcagcagcgguggcgacaugagcagcggggcggcguccgggacugggcgggggcggccccggggcggggggccgggacccagggaccccccgcccggcgagacucacaagcugguggucguaggcggcggcggcgugggcaagagcgcgcugaccauccaguucauccagguagugggcccucaccggggaggguuuccccgagaucgagacuuugagcccuuuggguucccugaaacuuucgcuucucccagaaccaucauuaagacccuccuaagaggaucucuaacccucugauugcgacuccaaaugcccagggccuccacccccuucaugaggggaagcuuucuccuaauauguccugggacaaaucacccuccuagagguaccugagagcccucauccuagucugucuagccccgcucaccaacugggaguacccuaaauuccaaacaguugcuccauucagaccccaagcacuccccgaggcucuaaucuccugaucauugcccagacuuugauucuaagacucagcugggaccacucuguccuaaaacaggcacccuguaaccccugcuugaagaggauuucccuucagaccugagauuucagaaagauccugcuacaugaccauccugggaaaacaccaauaucuggcauaccccauucugcuaaaugcagccccccauccuacccccaaggaaaaccaaccauuucuccauccuaaguuccccacucaaacuccuuacccucaacccugaaaacucuaaguagcucccaugucaucuccagauuuaaaaagaaaagcauagaacucagguuuuucacagccuccagagaccuguuacuuggaagguucuaggucccauaaauagaccucuccuacaucaggaaccaacccuccaggcuguucucacccuugggcaucuauuuacuuugggguccuaaucauccccccacacacaccaaaccucauccucuccauuccuugcaccccuuuuagccucagcccuuagcaagcacucuagagaggaagccaccuucagccucagcagccaaguucagaaaauccagcccagccccggaaaccuccacccaguucccacggggagccuccccacaucagggcaacacuaggaaagugagggcccacuugcuguuguagaaguuccugggugauggacauucacagacuaggagccuccggcaaugccguugagaaaccuacagugggaagaaagaguccaaauuugagccccuagcaccaagggccaaaccuggagauggccagaggccugguuggaaguagcaggacacagucaggaagggagaggcggggauaaggguggggcugccucucugaagcaggauuggaaccuagaccuucccaggggaggagacacuggaggcugcuuauggaggagggagcaagaggagggaaggaauggggggagggggggagaggaagggaagagagagacagcaagaucggcagcuacuuugcucaaccagaauucucagaagcuggucgcugaccgguaccaggucaaguguuaaguguugagcagggaauccuugccaaucaaaacuguuagaugguauagugucuucauccucgauucuccaagugacgaaacagccucggagacagaaagugauuuguucaaagugaugcagcugguguaaugaugacaaaggcugaagaagacagaggggcuaagagaggaaaacgggggcgggcaucggugacagggacccacaaccugacaccuggaaagguggaaacagcaccgccaggagcagguuagagauccagagagaaaggggguggacagaaacccagagaggggagagggaaagagaugggaccggcaaagacagagagaucagagauuggggggggggggguguugcugagacaucaagagggagagagaccaagagaaaaagacagagacauugagacucaggaggggccagggagagaaagacagagacacagagagaggggggacagagacuuggagaagauaugggacaggacucacacacacacacacacacagauugcuucggugacagugaccuucucuaccccccaguccuacuuugugucugacuaugaucccaccauugaagauuccuacacaaagaucugcacuguggacggcaucccugcacggcuggacagugaggaugggauggcugggcuuggaagggaggcagggggcaagacucagaggauuugugaacaugcccaggacaaccuggggggacccacacguuucucucucugucuccacaguccuggacacugcggggcaagaggaauuuggugccaugcgggagcaguacaugcgugcuggcaacggcuuccugcugguguuugccauuaacgacaggcagaggugagggggaugcuggugggccuggcugagcacggggcagguuccugcuaagguggugccucaugcuacugacuucucuugcaguuucaaugaggugggcaagcucuucacacagauccucagagucaaggaccgggaugauuuccccauuguguugguugggaacaaggcagaucuggagaaccagcgccagguuugagaugcccccuccccuggucacccccauuuggaccuaggaagcucucucaggugaccaucuccuacucuggaucccuggucccucuauugucacaacuuucacuuaagagaugaccccccaagaggaaucgcccaucacugagccacaccccuggccaucacugagggauucuaaccaggaccccuagcacugagccacgguccuggcccuuauacuaauccguugauacugguuccccuguccugaacaagaacacccuuacuucuugccugccugccuuccaguuaccuaaaacaccuucauaaucuuccugacaucucacugauaucacuucaacccuccaguagccuccucuggggucuuucuagaacuuucuaucuugagccugcugcaguuauacagucgagcacaccuugcggcggcuuucagcaucuccucucuccgacgccucccuuuguccuccucccucugucuuucuccagguccuccggucugaagccuccucuuucagugcuucccaccacaugacuuacuuugaggccucagccaaacugcgucugaaugucgaugaggcauuugagcagcuggugcgcgcuguccgguaagcccgguauccccuuccugaccucccggucaucagcccugcaucacacacucacagacugcuucccacaggaaauaccaggaacaagaacucccuccuagcccaccuagugcucccaggaagaaggauggaggaugucccuguguccugcuguagccaaauagccucaagugaccagcacaagcucucgggaccagcugccucacacuuacuguguggaccaaggcucgcucuagcugagccucuguuucauccucuggguuccccaggacacacuacacccucuuacuuuuacuuccuggccuccuggggcuaccacugugugccuucugucaauaccuccuccuuuccccacaagacccuguagguggggggagcaucuugucacugcuguauauaagccccaucuuucagaaaaauaaauaucacugccaacaacu

SEQ ID NO: 3777 - RNA, 628 nt, Mus musculus
ccccagagguaccaccugcagagcgucauccggacuagugccagucuggaugagggugccacggccgcccuggaguugggccuggggaggaugaaggacaagaagaaggggccagaacgggguggcgaaacucccgagggacuagccaccucagucguucacuauggagccggugccaaggagcugggagccuucuugcagaagagcccaccucccccaccacccucggcccaggcaacccagccagcgccccauggccuccucuuggaggcuggagguccugaccuucccauggugcugccuccaccuccuccccagcuccucccuucugugcucagccaugcccccagccccucaccuagcgcccccaaagucggcguccaccuccuugagccagccacccgggauggggcgccccagccgccgcccccacccccaccaccuaugccucugcagcuugaagcccaccuccgcggccacggccuggagcccacagccccaagcccucgcuuacgacccgaggagagucuggagccuccuggagccaugcaagaacugcucggggcucuggaaccauugccgucagggccuggggacccuggugugggaccaccuaacucggagggca

SEQ ID NO: 3778 - RNA, 9312 nt, Mus musculus
cagagcaggggaccccagcaacagcuuuuauugcuccuaggcaggacagguuagcuugugcuguugacauucagaguucaaauugcgguuaggucaggauguggccccgcgucagugcugggaugcuaucagugggugucacuuaucuuugagugccugaguauccugggcagguuggggggucccaggguuggugacaggggucucagggagagaaggugacugagggcccaagaaccaggaacaccagagcugagucuguguccugggggcggggcuggcugcaguggccccgcgguugucccccauguggucauguggucggaagucugagagacauggggaucagagcucaucauggugccuugucagguccucaccguaguugguggccuggcugcccacaaacauguuccaguugcucaagaucucagcuuugcucagccggccauccugugggcagaguggucagcaggaggcagggcccacgggggacauccccaccaggcugucccuagggccccuccucugccuggcuucucuccucuaggccucggcccccaucuguuucuccggaucugucucuaggucucuuuccguuucucucucuguuuccggacccaccugcgugcaggcaguaguagcccaggcucaccuuguccgugucgcucucaugcagcaggugguuggccuccaccaggggcugguccugggauggaggcagcacccaguaaccgacuucacugccauccagucgcccguccuuguucagaucccggaacucucggaacugcugccgcucugucugcacccaggcagguuccuccuccccaggcuccucggaguacagguccgcugaaggggaugugggggugggggagaugagggcuagggcaggcccgggagccugggagaccuuaguccugcaucccaaaagccauccucgcgguacccacacgccucccuccgcacucuucccucuccaucccaucugcacacacacacccacacacgggccaccagaccccuuggucauucauccuacaucugucaaauuuguuucagggauaaaacauguuauuuaaaaagacuuagaggagccgggcuugguggcucacaccuauaaucccagcacuugggaggcagaggcagguggauuucugaauucgaggccagccuggucuacagagugaguuccaggacagccaggacuacacagagaaacacugucucggaaaaaaacaaaaacaagcaaacaaacaaaagauuuagaaagaaaacccgggggaaaaauaaggcacucauuucuuauaaauccuugcauauugguugcauggaauacuucauauauaaaccuuucaaacucaaaaaaucccaugagucggggcuaaagacguagcgagguugguggagucccuguuuaaaacaaagccccggguucugucccagcacugucuaagcagggcaaggcugcagugccauggacccagcucuguggagguggaaguauggggaucaggaauugaagguguccuucacuucauagcaaguucaaggccagccugaguuacugaagacuuagcucaaaaaaaaauuuuuuuuuaagccagcaaaaucauauuuuauccucauuagcaccucccugagucaaacagcccgaggccuagcacagggcuggcuggccaggcggaaacacuucaaauggcccuaaacaggucaacuggagagagacacuguuauggaaacaagacaaaucuugagucugguucaaccagcaaagccccugagcuauugugagccccaggcuauccccaaaggguccucucucucuggugcuuucugcaguaaguuccuaauggaugcucccugggcucggcaugcaguagauucugcacacaguggggcuuuauccaugcagcuugaagggugaggaccucugcucuccuuggugccaggagauggcaggccucaggugggaacaggcuuugcucaccgauauacucuuccaccugcacguagccaucuuuguucuugucaagguccuccagggucuccuggggagaggcauuggagugaagggucaguguaccuacagcugagcacugcccacggggaggagaggcggggccuugggauguuacugggaugggauguacuuguguccaguggaaggcagccaggaacccccauguccaauccugcccagcuuugucugguuuuaugagauaggcucucacuguguaguccuggugggaauauaacucaaggcuggcuuugaacucacagaccugccugcucccgagugcugggauuaaaggcaucugccaccacugccaggcucauggaugauguauuuuuauguauauggauauuuugcuugcaugcuguguaccacaugcaugcagucccuccaaggcaaauaaggccgucagacccugcagaacuggaguuauucuggggcugagaagagaaccccaacuuuugccagaacagcaagugcucuuaagccaucucucuggcacauggaccauuuuuuggcacauacaccaacacggcuacucuucaugcuaucuguccuaauuuaaaaaaaaugguuucuggggcuggagagauggcucagugguuaagagcaccaacugcacuuccgaagguccugaguucaaaucccagcaaccacaugguggcucacaaccaucuguaaugagaucugaugcccucuucuguugcaucugaagacagcuacaauguacuuagauauaauaauaaauaagucuuuuuaaaaaaugguuucugccugggcagugguggugcacaccuuuaguuccagugcuagcaagaucagcaaacucugugaguucaaggucugcccgaucuacaaagugacuuccaggacagccagggcuacacagagaaacccugccucagaaacccagauagauggauagauagauagauagauagauagauagauagauagacagacagacaaacagacagacuccacuuccucaaguucaagagcucaaugcucaucacgauuagcaguggaccccaagagacaaagcaaacauacaagaucccuguagcuaccacauaggcaugaagaccugaauugcauuacucaacaccugcauaagaugggcuagugggacacacuuauaaucccagagccggggaggcagagacaggaggaugccuugggagagcuggucagccaggcuaaucugaccagcaagccccacauccuggucaauacccaguuucaaggaacaaauagcaaccagaaguggagccauggcccagcggugaagaguaugugcuaucucacagagggccugagugcaguucccagcacccagugggcagcucaugaccaccuguagcuccagguccaggugguucagcgcccucuuguggccucuacagcaccugcacgcccagccaucuuuccaguaaguacauuccaugucugguaucugagauaugauuagaucacagcguguuacaugugcauuucaaauaaacuguguucuccugggccuggacacaauugguguucacaugagucucuucuuaggauaugguugccuggggacaggcuggagauuggacaccuaauggaacacaggaaggucugauaaagaggugccaggcacuggauggggacuagacauggugggggcccggaauccuugugaaggaugcugggacccaggacagguuugggaaacauguucugcacaauguuacucacugcuaccacgaugucccgcaugugagggaacuccuccggaugcagaaaggccgucagcucuucccgaguagccauggagucgccaucuuggucggcuacccggaaucgccgcucaucccgagccagcaucuucuuguaggucucggcauccuccacaucaugaaacuccucuccuggggagggcagaugugggugaauguguggucacagaggcgagaucugggacuuaggaaacagaaggacccagcuaguggaaggacugccacagaguguaagaagggacaugugucagccacaucaugggugugugggcaggucugucauucacgauacuuaaaagacugaagcaagggaauugcaaguucaaggucagccuggguaacuaagcaagacugucagcccagcagggagccccugccuagaaucccccagugaggggcugggguguggcucagccuuuccuaucucuggguucagucccuagagauguagaauaauaauuuucauguguaauauacucaguuuccuguaucggcuaugacacagucaguggcgucacagacuaacuccgcagcccugagaauguccucaauagucuucaucuacaaucuuuuguuuuuaugaugggguuucacuauguagcccagacuaacauggagcucacuggguagcccguuaguucacugagaccugccugccucucccuccacgugcugagauuaaaggggagcugcaccauccccacuccccagucugcuuucuguccugucaccuacaauguuccacuugauccucacacaaagccagaucauggccuuuuccauuuguccacucuucugaauguacaaugacauugacugggaguggacacuggccugguuagccccgaagcucuuuucugauacaguaagugacuggcucugacuccaugacagacagcagggaagggcuuuucuccggaggaggaacagcauauguaaagugcagagaacugaggaacugaggagaucuggacuccacagaagaaaguuuugggguagaaacccuaucaacacaacacugaaggugggagagacuaauaaugagguagaugucugucuccuaaggucccuggaggauggacagagucaccugugcuaugccuauccuugagcucugggcuaucccccugccuccaccucucaagugcugagacugaggaagacugcuaaccaggugugcuggcuaauuuuaugucaacuugacagaggucagggucaucugagaggagggaaccccaacugagaggacgcuucccuaagacugggccauagguaaggcuguuauggucucuuuccuaaugcugcuacccucuaauacagcccaguaaguucuggugacccccauaaaauuauuguguugcuacuucauaacuauaacuuugcuacuguuaugacuuguaguguaacuaucugaaacacaguaucucugacacaguaucucacaaagggguugugacccacugguggggaaccagugcuauagggaauucuucagugauggaccgcagacguagaagcguaagccaagcaaacccuuuccucucccacuugcuuuuggucacagugucucaucauagcaauauuaacccuagcuaagacaccagugccacauaugggucuggauaacaggguuaaacauuaaguauuccugccacgaaugugaagucuccagucaacuugucacauagauuggauuucagaaggaagagcaaaugacauuugaaauggagggaagguaucagggauaagauccuaaaagcgaggucaaagggcaaaggcgaggugggcauaccgggcucauaauggccauagguggcauugcgcaacuccucccaacccacgcgcccgucgcgguccgugucguaggugugccaggcugcgcucaccgagucacggaugugccgcugcugugugugcgcgauccacgcgcggagcucagcuaaggacacccagccgucgcuguccccagcaagauccaugcggucuacgauccgccugcgaggggaaugaaugucagucucuggcucugcccaaugaggcccugccccuacaguuagagacgcagucaaucucaacccugaccccgcccaccuaggccccucccugucauauauagaguuacccuuguaccuauauaagacaaaaauggggacuuggugauggcucagcgguuaagaacccuggcugcucuuguaggaaccuggguuugauucccaugagccccacgaggcaggucacaagcaucucuaacucuagaugcaggaacccauuauccucuuuuggcccuugugggcacaagacauguuaaugguuaauggacacacaugaaaaauacccacacaaaaaaagaaaaagaaggcuggagauagggcucagugguuaagagcacuaacuacucuuccagggguccugaguuccuucaauuuccacauggugguucacaaccaucugcaaugagaucugacacccucuucuggugugucugaagacagcuacaguguacuuagauauaauaauaaaucuuuagaaaaagaaaaaaaauacccacacucauauaaauaaaucuuuuuuaauuagaugaugaugaugauaauaauaauaauaauaauaauaauaauaauaauaauaauaaagagcagagcauaguuguguagaccuuuaaucucagcacuugggauguauaggcaggcagaucucugugaguucaagauuaaccuagucuacaagacagcaaggacuauuuagauaaacugucucaaaaaagaaaaaaaauaauaaaagaaaaauaaggaagcugaagaaacagcucuguaguuagaagcgcugggugcuccuuuaggguacccagguucaacuccagcacccaugacuaucuguaacuccaguuccaggggauccauggcaccaggcaugcguguggugcacacacaugucaugcaggccaaauauccauauacuuaaauaaaaugaaacaauuauuuagaaauaaagauagaaaaacaaaaacaaaaaaagagcugggcaugguggugcacgccuuuaaucccagcacuugggaggcagaggcaggcagauuucugaguucgaggccagccuggucuacagcgugaauuccaggacagccagggcuacacagagaaacccugucucaaaaaaccaaaaaagaaaaagagagagagagagagagagagagagagagagagagagagagaaauaaagauagagggcuggagagauggcucaaagguuaagagcacugacugcucuuccagggguccugaguucaaaacccagcaaccacaugguggcucacaaccaucaguaaugagaucugacgcccuuuucuggucugaagacagcuuacaguguacuuacauauaauaauaaaucuuaaaaagaaagaaagaaagauaagggagaaaaaugucacccaaggucugcaagcaaacuggggugggacuccaaaugaacccaggagaggaacugucuguuuucuguuugguagauuucaacguauuauugggggguuuuguuugagagaggggguaucauuauguacuccugguuagcuugaaacuuacucuguagaccagacugguccugaacucacggagauccgccugccucugccuuccaaguccugggauuaaaacugugagccagugcaggaccaggagaagcuuuaccguugauagguuucacccaccccuaggucuuugccaacccugacuccgccccuugcccuagccacgccccucagagacaugggugcacaggcuaggaaagaguagaaaugcuaggugaacugagggagcugcaucuauuaaucuuaguaccaggcccaucuaaaagccuagccuguccccuacaggaguccuagaggaguuaguuggauuagcaccugacacaaaucaagacccucuacucuagccccgaccucuaagcgcugcacagacccuagcuggacuugagcuuaagugugaacagggugucuggccucuaacuuuaccccaauccuagagugccacugucucuauuaaccuugaagcuccgccucucaccaucucagggcccgccccucuuucaagugcagucugcccacuucccuagaugggcugaucaauuuggggcuccucucucuccagcucugcccugcuacuauuugcccaguuuaaaauuagaaauugccaucacauuaaagacgcagaucuuuaaucucagcacucgggaggcagaggcagacggauuucugaauucaggaccagucucgucuacagagugaauuucagacuagcuaguuccacaaaugaaauucgaucucaaaguacuaauaacaaugaaaauaaucaagcauauuugcacgaguggccuucuugucccgggcccaugcugacuguaucugucaccuagaaacggggcaagcccguccaguccaguuggcaucacucaucccaggucaaccugaucucugaccuuggcaucuuccucaaaucccuugucuucagucucuaccgagagucggcgucccguuuagaagagagaagagggaaguccagacagaggcauaggggggacugagguagaggggaacccagggguuggugacgcaggucccccacagccucagguuuagcuccgccuucucccaggaggugagugccacaguuuugucuuuucaguuaacuucucucuccccaccucccacuucugccccgcucccccgccauccuccuacccaagucgggccuggcuuuccucugggcugaguuugucaaauuccuuggccacgucucgucccaggaacgccucauggucguacuggaaauucccgugggcgucaucguggggggccucgcucagggggguuccaugauggacccuauccuggccaugagguccugcaucaggggauggcuucccgagggcccagugccucagcaguaagagaagcaacagaaacgaccaucgccacaucaucgguuccugaggagaggugaggaccagcggucagggauaagacugggggcggggggugucugaaccagagauaaugugggagaacuuugaagggggcggaguagaggaggcugccuaaggcagggccgauaaaagcgcaggcugcaaaaaguuuugggcucaagaaaagucggcaaaaagaauagagaauuuaaaggcaaaacaaccucuggggguggaauccgagccucagaggagucucagagcagaaaggggguauuucaguuagagacguggcgcaugucccacccaaaguucagggcauggugguggccgaaagcaucaugcaggcuccucugugcugcccccaggcuggaccgcgacccccacccuuccacccaccccaccuucaccccaccaucaccccaccacaccucuguuacccggccugaguuagcucccuacgcugagcucugcuuucgcacaaagaugcccaaccuggccagguuccaguuaagcuccuccaccagccguccagaggcugccgcccucugaccaaug

SEQ ID NO: 3779 - RNA, 9312 nt, Mus musculus
cauuggucagagggcggcagccucuggacggcugguggaggagcuuaacuggaaccuggccagguugggcaucuuugugcgaaagcagagcucagcguagggagcuaacucaggccggguaacagaggugugguggggugaugguggggugaaggugggguggguggaagggugggggucgcgguccagccugggggcagcacagaggagccugcaugaugcuuucggccaccaccaugcccugaacuuugggugggacaugcgccacgucucuaacugaaauacccccuuucugcucugagacuccucugaggcucggauuccacccccagagguuguuuugccuuuaaauucucuauucuuuuugccgacuuuucuugagcccaaaacuuuuugcagccugcgcuuuuaucggcccugccuuaggcagccuccucuacuccgcccccuucaaaguucucccacauuaucucugguucagacaccccccgcccccagucuuaucccugaccgcugguccucaccucuccucaggaaccgaugauguggcgauggucguuucuguugcuucucuuacugcugaggcacugggcccucgggaagccauccccugaugcaggaccucauggccaggauaggguccaucauggaaccccccugagcgaggccccccacgaugacgcccacgggaauuuccaguacgaccaugaggcguuccugggacgagacguggccaaggaauuugacaaacucagcccagaggaaagccaggcccgacuuggguaggaggauggcgggggagcggggcagaagugggagguggggagagagaaguuaacugaaaagacaaaacuguggcacucaccuccugggagaaggcggagcuaaaccugaggcugugggggaccugcgucaccaaccccuggguuccccucuaccucaguccccccuaugccucugucuggacuucccucuucucucuucuaaacgggacgccgacucucgguagagacugaagacaagggauuugaggaagaugccaaggucagagaucagguugaccugggaugagugaugccaacuggacuggacgggcuugccccguuucuaggugacagauacagucagcaugggcccgggacaagaaggccacucgugcaaauaugcuugauuauuuucauuguuauuaguacuuugagaucgaauuucauuuguggaacuagcuagucugaaauucacucuguagacgagacugguccugaauucagaaauccgucugccucugccucccgagugcugagauuaaagaucugcgucuuuaaugugauggcaauuucuaauuuuaaacugggcaaauaguagcagggcagagcuggagagagaggagccccaaauugaucagcccaucuagggaagugggcagacugcacuugaaagaggggcgggcccugagauggugagaggcggagcuucaagguuaauagagacaguggcacucuaggauugggguaaaguuagaggccagacacccuguucacacuuaagcucaaguccagcuagggucugugcagcgcuuagaggucggggcuagaguagagggucuugauuugugucaggugcuaauccaacuaacuccucuaggacuccuguaggggacaggcuaggcuuuuagaugggccugguacuaagauuaauagaugcagcucccucaguucaccuagcauuucuacucuuuccuagccugugcacccaugucucugaggggcguggcuagggcaaggggcggagucaggguuggcaaagaccuaggggugggugaaaccuaucaacgguaaagcuucuccugguccugcacuggcucacaguuuuaaucccaggacuuggaaggcagaggcaggcggaucuccgugaguucaggaccagucuggucuacagaguaaguuucaagcuaaccaggaguacauaaugauacccccucucucaaacaaaaccccccaauaauacguugaaaucuaccaaacagaaaacagacaguuccucuccuggguucauuuggagucccaccccaguuugcuugcagaccuugggugacauuuuucucccuuaucuuucuuucuuucuuuuuaagauuuauuauuauauguaaguacacuguaagcugucuucagaccagaaaagggcgucagaucucauuacugaugguugugagccaccaugugguugcuggguuuugaacucaggaccccuggaagagcagucagugcucuuaaccuuugagccaucucuccagcccucuaucuuuauuucucucucucucucucucucucucucucucucucucucucucuuuuucuuuuuugguuuuuugagacaggguuucucuguguagcccuggcuguccuggaauucacgcuguagaccaggcuggccucgaacucagaaaucugccugccucugccucccaagugcugggauuaaaggcgugcaccaccaugcccagcucuuuuuuuguuuuuguuuuucuaucuuuauuucuaaauaauuguuucauuuuauuuaaguauauggauauuuggccugcaugacaugugugugcaccacacgcaugccuggugccauggauccccuggaacuggaguuacagauagucaugggugcuggaguugaaccuggguacccuaaaggagcacccagcgcuucuaacuacagagcuguuucuucagcuuccuuauuuuucuuuuauuauuuuuuuucuuuuuugagacaguuuaucuaaauaguccuugcugucuuguagacuagguuaaucuugaacucacagagaucugccugccuauacaucccaagugcugagauuaaaggucuacacaacuaugcucugcucuuuauuauuauuauuauuauuauuauuauuauuauuauuauuaucaucaucaucaucuaauuaaaaaagauuuauuuauaugaguguggguauuuuuuuucuuuuucuaaagauuuauuauuauaucuaaguacacuguagcugucuucagacacaccagaagagggugucagaucucauugcagaugguugugaaccaccauguggaaauugaaggaacucaggaccccuggaagaguaguuagugcucuuaaccacugagcccuaucuccagccuucuuuuucuuuuuuuguguggguauuuuucauguguguccauuaaccauuaacaugucuugugcccacaagggccaaaagaggauaauggguuccugcaucuagaguuagagaugcuugugaccugccucguggggcucaugggaaucaaacccagguuccuacaagagcagccaggguucuuaaccgcugagccaucaccaaguccccauuuuugucuuauauagguacaaggguaacucuauauaugacagggaggggccuaggugggcggggucaggguugagauugacugcgucucuaacuguaggggcagggccucauugggcagagccagagacugacauucauuccccucgcaggcggaucguagaccgcauggaucuugcuggggacagcgacggcuggguguccuuagcugagcuccgcgcguggaucgcgcacacacagcagcggcacauccgugacucggugagcgcagccuggcacaccuacgacacggaccgcgacgggcgcguggguugggaggaguugcgcaaugccaccuauggccauuaugagcccgguaugcccaccucgccuuugcccuuugaccucgcuuuuaggaucuuaucccugauaccuucccuccauuucaaaugucauuugcucuuccuucugaaauccaaucuaugugacaaguugacuggagacuucacauucguggcaggaauacuuaauguuuaacccuguuauccagacccauauguggcacuggugucuuagcuaggguuaauauugcuaugaugagacacugugaccaaaagcaagugggagaggaaaggguuugcuuggcuuacgcuucuacgucugcgguccaucacugaagaauucccuauagcacugguuccccaccagugggucacaaccccuuugugagauacugugucagagauacuguguuucagauaguuacacuacaagucauaacaguagcaaaguuauaguuaugaaguagcaacacaauaauuuuaugggggucaccagaacuuacugggcuguauuagaggguagcagcauuaggaaagagaccauaacagccuuaccuauggcccagucuuagggaagcguccucucaguugggguucccuccucucagaugacccugaccucugucaaguugacauaaaauuagccagcacaccugguuagcagucuuccucagucucagcacuugagagguggaggcagggggauagcccagagcucaaggauaggcauagcacaggugacucuguccauccuccagggaccuuaggagacagacaucuaccucauuauuagucucucccaccuucaguguuguguugauaggguuucuaccccaaaacuuucuucuguggaguccagaucuccucaguuccucaguucucugcacuuuacauaugcuguuccuccuccggagaaaagcccuucccugcugucugucauggagucagagccagucacuuacuguaucagaaaagagcuucggggcuaaccaggccaguguccacucccagucaaugucauuguacauucagaagaguggacaaauggaaaaggccaugaucuggcuuugugugaggaucaaguggaacauuguaggugacaggacagaaagcagacuggggaguggggauggugcagcuccccuuuaaucucagcacguggagggagaggcaggcaggucucagugaacuaacgggcuacccagugagcuccauguuagucugggcuacauagugaaaccccaucauaaaaacaaaagauuguagaugaagacuauugaggacauucucagggcugcggaguuagucugugacgccacugacugugucauagccgauacaggaaacugaguauauuacacaugaaaauuauuauucuacaucucuagggacugaacccagagauaggaaaggcugagccacaccccagccccucacugggggauucuaggcaggggcucccugcugggcugacagucuugcuuaguuacccaggcugaccuugaacuugcaauucccuugcuucagucuuuuaaguaucgugaaugacagaccugcccacacacccaugauguggcugacacaugucccuucuuacacucuguggcaguccuuccacuagcuggguccuucuguuuccuaagucccagaucucgccucugugaccacacauucacccacaucugcccuccccaggagaggaguuucaugauguggaggaugccgagaccuacaagaagaugcuggcucgggaugagcggcgauuccggguagccgaccaagauggcgacuccauggcuacucgggaagagcugacggccuuucugcauccggaggaguucccucacaugcgggacaucgugguagcagugaguaacauugugcagaacauguuucccaaaccuguccugggucccagcauccuucacaaggauuccgggcccccaccaugucuaguccccauccagugccuggcaccucuuuaucagaccuuccuguguuccauuagguguccaaucuccagccuguccccaggcaaccauauccuaagaagagacucaugugaacaccaauuguguccaggcccaggagaacacaguuuauuugaaaugcacauguaacacgcugugaucuaaucauaucucagauaccagacauggaauguacuuacuggaaagauggcugggcgugcaggugcuguagaggccacaagagggcgcugaaccaccuggaccuggagcuacagguggucaugagcugcccacugggugcugggaacugcacucaggcccucugugagauagcacauacucuucaccgcugggccauggcuccacuucugguugcuauuuguuccuugaaacuggguauugaccaggauguggggcuugcuggucagauuagccuggcugaccagcucucccaaggcauccuccugucucugccuccccggcucugggauuauaagugugucccacuagcccaucuuaugcagguguugaguaaugcaauucaggucuucaugccuaugugguagcuacagggaucuuguauguuugcuuugucucuugggguccacugcuaaucgugaugagcauugagcucuugaacuugaggaaguggagucugucuguuugucugucugucuaucuaucuaucuaucuaucuaucuaucuaucuauccaucuaucuggguuucugaggcaggguuucucuguguagcccuggcuguccuggaagucacuuuguagaucgggcagaccuugaacucacagaguuugcugaucuugcuagcacuggaacuaaaggugugcaccaccacugcccaggcagaaaccauuuuuuaaaaagacuuauuuauuauuauaucuaaguacauuguagcugucuucagaugcaacagaagagggcaucagaucucauuacagaugguugugagccaccaugugguugcugggauuugaacucaggaccuucggaagugcaguuggugcucuuaaccacugagccaucucuccagccccagaaaccauuuuuuuuaaauuaggacagauagcaugaagaguagccguguugguguaugugccaaaaaaugguccaugugccagagagauggcuuaagagcacuugcuguucuggcaaaaguugggguucucuucucagccccagaauaacuccaguucugcagggucugacggccuuauuugccuuggagggacugcaugcaugugguacacagcaugcaagcaaaauauccauauacauaaaaauacaucauccaugagccuggcagugguggcagaugccuuuaaucccagcacucgggagcaggcaggucugugaguucaaagccagccuugaguuauauucccaccaggacuacacagugagagccuaucucauaaaaccagacaaagcugggcaggauuggacauggggguuccuggcugccuuccacuggacacaaguacaucccaucccaguaacaucccaaggccccgccucuccuccccgugggcagugcucagcuguagguacacugacccuucacuccaaugccucuccccaggagacccuggaggaccuugacaagaacaaagauggcuacgugcagguggaagaguauaucggugagcaaagccuguucccaccugaggccugccaucuccuggcaccaaggagagcagagguccucacccuucaagcugcauggauaaagccccacugugugcagaaucuacugcaugccgagcccagggagcauccauuaggaacuuacugcagaaagcaccagagagagaggacccuuuggggauagccuggggcucacaauagcucaggggcuuugcugguugaaccagacucaagauuugucuuguuuccauaacagugucucucuccaguugaccuguuuagggccauuugaaguguuuccgccuggccagccagcccugugcuaggccucgggcuguuugacucagggaggugcuaaugaggauaaaauaugauuuugcuggcuuaaaaaaaaauuuuuuuuugagcuaagucuucaguaacucaggcuggccuugaacuugcuaugaagugaaggacaccuucaauuccugauccccauacuuccaccuccacagagcuggguccauggcacugcagccuugcccugcuuagacagugcugggacagaacccggggcuuuguuuuaaacagggacuccaccaaccucgcuacgucuuuagccccgacucaugggauuuuuugaguuugaaagguuuauauaugaaguauuccaugcaaccaauaugcaaggauuuauaagaaaugagugccuuauuuuucccccggguuuucuuucuaaaucuuuuguuuguuugcuuguuuuuguuuuuuuccgagacaguguuucucuguguaguccuggcuguccuggaacucacucuguagaccaggcuggccucgaauucagaaauccaccugccucugccucccaagugcugggauuauaggugugagccaccaagcccggcuccucuaagucuuuuuaaauaacauguuuuaucccugaaacaaauuugacagauguaggaugaaugaccaaggggucugguggcccgugugugggugugugugugcagaugggauggagagggaagagugcggagggaggcguguggguaccgcgaggauggcuuuugggaugcaggacuaaggucucccaggcucccgggccugcccuagcccucaucucccccacccccacauccccuucagcggaccuguacuccgaggagccuggggaggaggaaccugccugggugcagacagagcggcagcaguuccgagaguuccgggaucugaacaaggacgggcgacuggauggcagugaagucgguuacugggugcugccuccaucccaggaccagccccugguggaggccaaccaccugcugcaugagagcgacacggacaaggugagccugggcuacuacugccugcacgcagguggguccggaaacagagagagaaacggaaagagaccuagagacagauccggagaaacagaugggggccgaggccuagaggagagaagccaggcagaggaggggcccuagggacagccugguggggaugucccccgugggcccugccuccugcugaccacucugcccacaggauggccggcugagcaaagcugagaucuugagcaacuggaacauguuugugggcagccaggccaccaacuacggugaggaccugacaaggcaccaugaugagcucugauccccaugucucucagacuuccgaccacaugaccacaugggggacaaccgcggggccacugcagccagccccgcccccaggacacagacucagcucugguguuccugguucuugggcccucagucaccuucucucccugagaccccugucaccaacccugggaccccccaaccugcccaggauacucaggcacucaaagauaagugacacccacugauagcaucccagcacugacgcggggccacauccugaccuaaccgcaauuugaacucugaaugucaacagcacaagcuaaccuguccugccuaggagcaauaaaagcuguugcugggguccccugcucug

SEQ ID NO: 3780 - RNA, 6915 nt, Mus musculus
cacuucugccccgcucccccgccauccuccuacccaagucgggccuggcuuuccucugggcugaguuugucaaauuccuuggccacgucucgucccaggaacgccucauggucguacuggaaauucccgugggcgucaucguggggggccucgcucagggggguuccaugauggacccuauccuggccaugagguccugcaucaggggauggcuucccgagggcccagugccucagcaguaagagaagcaacagaaacgaccaucgccacaucaucgguuccugaggagaggugaggaccagcggucagggauaagacugggggcggggggugucugaaccagagauaaugugggagaacuuugaagggggcggaguagaggaggcugccuaaggcagggccgauaaaagcgcaggcugcaaaaaguuuugggcucaagaaaagucggcaaaaagaauagagaauuuaaaggcaaaacaaccucuggggguggaauccgagccucagaggagucucagagcagaaaggggguauuucaguuagagacguggcgcaugucccacccaaaguucagggcauggugguggccgaaagcaucaugcaggcuccucugugcugcccccaggcuggaccgcgacccccacccuuccacccaccccaccuucaccccaccaucaccccaccacaccucuguuacccggccugaguuagcucccuacgcugagcucugcuuucgcacaaagaugcccaaccuggccagguuccaguuaagcuccuccaccagccguccagaggcugccgcccucugaccaaugacugcgcaggaaagccucaggggcggagccaaugacgacccccuugccacguccacaaggccgagcuccagacccgaaggcguggugggcgauaaggcugauauugaacuacaacucccagcaaacauaugggccgacuugcacgaccaccuccagagucucuggccccaggggauuaaggggaauguauuuuuuaaaaacucuuuccauuucuuagauccguuucagaaaagaggaggucggguuugguuggcucacuugggagacagaagcagucugucucuaugaguuugccgccagccaggacgacguagagagacccuugucuuuaaaaaaaaaagggggggguggggggggagcgcggcuggagagauggcucugcaauuaagagcacugacuguucuuccagaggaccagaguucaagucccagcaaccacaugguggcuaaccaucuguaauggaauccaaugcccucuucuggugugucugaagacagcugcaguguacucagauacauaaaauaaauaaauguuaaaaaaaaaaaaaaagaaagaaggaaggaaagaaagaaagaaagaaagaaagaaagaaagaaagaaaagaaggaaaagaaagaaaggaaggaaggaaggaaggaaggaaggaaggaaggaaggaaggaaggaagaaaaagaagagaagcaaugccugguacaguguagguaucacauacacaacucggucuauaaaauggccaggcugcacgauagcaaucaagaggugucuauaugaucuuucccagacgcguucaauuuauuccagcugcuugaaacuugagaauaacgaugcacacacagauuuggggccaaauuuauguggagauggaaaacaaccauguacauuaagaagggaaacugaagcaggccacaaaagcagggauccaugggaggacaucgggcccaggcucccucaggaggcucggagacaguucaggaggucacacagcccgaaaggcugcagugggcagggggcccgagucugcaucaggaaguggcuggaaaggcauuugcaccuugagguucagcuucugggggcaaguucccaccaggcaacaggucaccagagucaucgccgcugagagaaagccauggggcugagagagaggaacagaggucagcacaaguaucuaaggucucacccacccaacacaccugacagggucacgcuauggucucuguucccaucucuuuucccaggguggucagggacucuuuugucucuauuaucucucugccuccccucuuucuuucugagucgcuacuuccugccacgacccccaauccugcacacggccccucccuuccccaauccugcacacagcuacgccccuccccaauccugcacacggccccuucccuccccuccccaauccugcacacggccacgccccucccucauucugcacacggccacgccccaccccaauccugcacacggccccgccccucccucauccugcacaaggccacucccacccaauccugcacacggccccgccccucccccauccugcauauaccuggcagaccgcugcgcauccugccccacaacagcacaccgccugcgauggccacuaccaccagcaauaaaccaagaacgauuccaaccacaggcacagaagaucuggcugaugaaucugcagccagaaaguaucaugaagacagggaagaaaggaguugaugauuucucggagacccccggaagcauguauuugaggguggguguaugcggagaaaaggcccugggccucauguguuuccucacugaauauaagaaccggccacacaguggugacacaccucuuaaucccagcacuugggaggcagaggcacacagaucuauggguuagaggccagacuccucuacauugugaguuccaggacagccagagcucuacagagaaacccugucucaaaaacaaaaacaaaaagaaagaaaaaagagaaaaaaagagucagccacugugcuggagagacggcuugcagcucuuccggaggaccagaguuugguucccagaacucgugucgaauuccaggagaccugagcccgacccuccauaaaucuaggcugucagagguucaaggagugaaggcauugccuuugccauaaagcccggugaccuaaguuugagccccaaggcugacaaccacaaguuguccucugucgccacaaguaucccauggcacagacucaccucugcucuccccucucacacaaagaaagugggaaaauuaaauacauauggauacacuuagauauaaaucugaagaaggaggaggaggaggagaaggagggagaggaggaggaggaaggggagagggggaggaaguaggagggaggaggagggauggaaggaggaggagaaagaaaaggaauaggaggaggaggaagaggaggaggagaccuauacugagaggacacagccacacugugacagaacuaggugagaacccaacagaggaaggcggagcagucacaggacagucaacaaaguuggugcuuuaccaaagccauggcaagaacugucagaggcaaaagugaauggucaaacaccaugaagaccaguagcagcaagacucaucauggucagacucagggggaacuggccacagagcuaauggagaaucagaagccaggagcagaaacaaagaagacaauggggcuggagagagagauggcucagcgguuaagagcaccgccugcucuucuagagguccugaauucaauucccagcaaccacaugguggcucacaacugucuguaauaggaucugaugcucucuucuggugugucugaagacagcgacaguguacucacauacaugaaauaaauaaauacaucuuuuaaaaaaacaaaaaaaaacaaagaagacacugaggcuggaggggcagccucaccuagguccacagugagaggcugugccagccccucaugcuccacuugacauugauaauggugcucaucuccacguuugaccuccagcaaugaccaugcguggaaagagccaucuccauugggaccagugcugcaauucccggagccugaggcuagcccauugcgcaggaaucggaacuugagcuccgguggguagaaggagaaagcagcacaggucagcacggaggagccagaguugccaggacgggccuucaggcgcauagacggcggcucugcagggacacaggcaaugggaugggccagcaguuaggcuaggcuaugaccucacccacccaccccacccccaccaaggcuugggugaagcuugccauggacagacuccacuucccuguaucagcacugugcugacuuggagggcuucccagagugacagacaccccacccugcugaccccaccacugcacccccuuauuuugguguguguggcaugugcaugggucaaggccacaggucaauugcaggcuccuuccucuuucgcucuuugcauuuuuuccccuuuauauauuuuucacucugugugucugggugcuuuuuagcaugugugucucugcaccacaugcaugcagugucuguggaggccagaugaggacaucagagccccuggaaauggaguuacagaugguggugaguuacccuaugggagcuaggaauuaaauccugguccucugcaagaacagggaguguuccuaaccacugagccaucucuccccacauccacuuuuuuuuguuguuguuuuuugggguuuuguuuguuuguuuguuuguuuuuucgagacaggguuucucuguguagcccuggcuguccaggaacucacuuuguagaccaggcuggccucgaacucagaaaucugccugugucugccucccaagugcugggauuaaaggcgugcgccaccacgccgggcucacuuauuuuuugagacagagccucuccaugaaccugggguccucccuuucagccaugccaguggcuggugaggcuccgucucugccagacccaucccugcagcuacagacacgcagcaguacgcccagccuuugcaaggggaccuggggaccagaacccaggucuucaucacagcaaacucggcgcucacagcgccucuucucgcgcacauuuguuuguuucacucucagcccagaccagucuugaacuuauuauauagauacagaugacuuugaauuccugauuuuccuucuuccacuugcuaaaagcugagagacagcaggugugugccgccauacugguuuaugcagugccagugguggagcccauuuaagcaagcuuucuaccagcugagccccaacuccuccaucuaccuguuucuaaacggagacuuagugcacaucucucuagugccgugaccuauucguggcccugggaacacauuaguguauauauagagcaaagagacaugacuguccuagcugggugggauggugcaugcccacacaagugaucccagcaccugaggaacuguugccggaaaaucaugaguuccaaaugaguuggaugcucuugcaaaaacugagaccugugggugggguguguaguacaucuugaaucccagcauucagggagcagaggcaaguugaucucuguggauaccagggcaaccuggucuacauagcaguuccaggcuagccaaggcuacauagugacauagugagaccaaggaaagaaagaaaggaagaaagagagagagagagagagagagagagagagagagagagagagagagagagagaaagaaagaaagaaagaaagaaagaaagaagugggcggugguagcgcacgccuuuaaucccagcacuugggaggcagaggcaggcggauuucugaguucgaggccagccuggucuacaaagugaguuccaggacagccagggcuauacagagaaacccugucucagaaaaaagaaacagagagagagagagacagagagacagagagacagagagagagagagagauauuauggcuggggauguggcccaguuuccggugugaaguccuggguuccuagguuugauccccggcacacugacauuggucaugcaugcuggcguacaccuguaaucucagcacuccagacuggaggucagaggaucaggaguucaagguuacuuugaugaaauaggaaguuuggggccagccugggcuacacaagacccugaaucaacagcaauaaaccccuagacaaaaugaaguccauggggaucugagaccccagaaaggcugugcauggcagaggcguucccucugucuagggugggucucacaaucuugguucugcucugguucucagcagaaaauaagcugacaacuucuuaggaagaggaagcuaacgagcuuccccgaaagaggggccucacuggcaucuaggaagaccugaggcaccggcucucugccacagaggaccggaccucagucagcacuucuguguccugccuugugcuugcuauuguuuuccagugaggaugacuuccuguggguagcugagagacacccucgguucuccuguuuuccaguucugacccugaggguucggagagucagcccagccuuggcuucuguuuaacagaagaagaagaagaagaaaaaaaaaaggaagcaccuuugccccagaaauguaaccuggguggccaaggcagaggugcuacaggcucaccaguuaagccacagauugagcugggaguuagcuugggaaacuuagugagaccaugucucaaaauaaaaagucaagggguuggggauuuaguucagugguagagugcuugccuagcaagcccaaggcccuggguucgggccucagcuccagaaaaaaaaaaaaaaagaaaagaaaaaagaaaaaagaaaaagucaaaagagggccagugaagcgcccgagagacacagcuuagccgcuagagcguuuucuguucucucuacagaacugagcucaauucucagcaccaacugggcgacacuuaaccaccuauaacuaacuccagcugcagacgaccugauccuccuucuggcaucuguggucacuugcaccauauauguacacacacauccacagaaauuaacaauaaaauaaauauagucagaaaaagguuuag

SEQ ID NO: 3781 - RNA, 6915 nt, Mus musculus
cuaaaccuuuuucugacuauauuuauuuuauuguuaauuucuguggauguguguguacauauauggugcaagugaccacagaugccagaaggaggaucaggucgucugcagcuggaguuaguuauaggugguuaagugucgcccaguuggugcugagaauugagcucaguucuguagagagaacagaaaacgcucuagcggcuaagcugugucucucgggcgcuucacuggcccucuuuugacuuuuucuuuuuucuuuuuucuuuucuuuuuuuuuuuuuuucuggagcugaggcccgaacccagggccuugggcuugcuaggcaagcacucuaccacugaacuaaauccccaaccccuugacuuuuuauuuugagacauggucucacuaaguuucccaagcuaacucccagcucaaucuguggcuuaacuggugagccuguagcaccucugccuuggccacccagguuacauuucuggggcaaaggugcuuccuuuuuuuuuucuucuucuucuucuucuguuaaacagaagccaaggcugggcugacucuccgaacccucagggucagaacuggaaaacaggagaaccgagggugucucucagcuacccacaggaagucauccucacuggaaaacaauagcaagcacaaggcaggacacagaagugcugacugagguccgguccucuguggcagagagccggugccucaggucuuccuagaugccagugaggccccucuuucggggaagcucguuagcuuccucuuccuaagaaguugucagcuuauuuucugcugagaaccagagcagaaccaagauugugagacccacccuagacagagggaacgccucugccaugcacagccuuucuggggucucagauccccauggacuucauuuugucuagggguuuauugcuguugauucagggucuuguguagcccaggcuggccccaaacuuccuauuucaucaaaguaaccuugaacuccugauccucugaccuccagucuggagugcugagauuacagguguacgccagcaugcaugaccaaugucagugugccggggaucaaaccuaggaacccaggacuucacaccggaaacugggccacauccccagccauaauaucucucucucucucucugucucucugucucucugucucucucucucucuguuucuuuuuucugagacaggguuucucuguauagcccuggcuguccuggaacucacuuuguagaccaggcuggccucgaacucagaaauccgccugccucugccucccaagugcugggauuaaaggcgugcgcuaccaccgcccacuucuuucuuucuuucuuucuuucuuucuuucucucucucucucucucucucucucucucucucucucucucucucucucucuuucuuccuuucuuucuuuccuuggucucacuaugucacuauguagccuuggcuagccuggaacugcuauguagaccagguugcccugguauccacagagaucaacuugccucugcucccugaaugcugggauucaagauguacuacacaccccacccacaggucucaguuuuugcaagagcauccaacucauuuggaacucaugauuuuccggcaacaguuccucaggugcugggaucacuugugugggcaugcaccaucccacccagcuaggacagucaugucucuuugcucuauauauacacuaauguguucccagggccacgaauaggucacggcacuagagagaugugcacuaagucuccguuuagaaacagguagauggaggaguuggggcucagcugguagaaagcuugcuuaaaugggcuccaccacuggcacugcauaaaccaguauggcggcacacaccugcugucucucagcuuuuagcaaguggaagaaggaaaaucaggaauucaaagucaucuguaucuauauaauaaguucaagacuggucugggcugagagugaaacaaacaaaugugcgcgagaagaggcgcugugagcgccgaguuugcugugaugaagaccuggguucugguccccagguccccuugcaaaggcugggcguacugcugcgugucuguagcugcagggaugggucuggcagagacggagccucaccagccacuggcauggcugaaagggaggaccccagguucauggagaggcucugucucaaaaaauaagugagcccggcgugguggcgcacgccuuuaaucccagcacuugggaggcagacacaggcagauuucugaguucgaggccagccuggucuacaaagugaguuccuggacagccagggcuacacagagaaacccugucucgaaaaaacaaacaaacaaacaaacaaaaccccaaaaaacaacaacaaaaaaaaguggauguggggagagauggcucagugguuaggaacacucccuguucuugcagaggaccaggauuuaauuccuagcucccauaggguaacucaccaccaucuguaacuccauuuccaggggcucugauguccucaucuggccuccacagacacugcaugcauguggugcagagacacacaugcuaaaaagcacccagacacacagagugaaaaauauauaaaggggaaaaaaugcaaagagcgaaagaggaaggagccugcaauugaccuguggccuugacccaugcacaugccacacacaccaaaauaagggggugcagugguggggucagcaggguggggugucugucacucugggaagcccuccaagucagcacagugcugauacagggaaguggagucuguccauggcaagcuucacccaagccuugguggggguggggugggugggugaggucauagccuagccuaacugcuggcccaucccauugccugugucccugcagagccgccgucuaugcgccugaaggcccguccuggcaacucuggcuccuccgugcugaccugugcugcuuucuccuucuacccaccggagcucaaguuccgauuccugcgcaaugggcuagccucaggcuccgggaauugcagcacuggucccaauggagauggcucuuuccacgcauggucauugcuggaggucaaacguggagaugagcaccauuaucaaugucaaguggagcaugaggggcuggcacagccucucacuguggaccuaggugaggcugccccuccagccucagugucuucuuuguuuuuuuuuguuuuuuuaaaagauguauuuauuuauuucauguaugugaguacacugucgcugucuucagacacaccagaagagagcaucagauccuauuacagacaguugugagccaccaugugguugcugggaauugaauucaggaccucuagaagagcaggcggugcucuuaaccgcugagccaucucucucuccagccccauugucuucuuuguuucugcuccuggcuucugauucuccauuagcucuguggccaguucccccugagucugaccaugaugagucuugcugcuacuggucuucaugguguuugaccauucacuuuugccucugacaguucuugccauggcuuugguaaagcaccaacuuuguugacuguccugugacugcuccgccuuccucuguuggguucucaccuaguucugucacaguguggcuguguccucucaguauaggucuccuccuccucuuccuccuccuccuauuccuuuucuuucuccuccuccuuccaucccuccuccucccuccuacuuccucccccucuccccuuccuccuccuccucucccuccuucuccuccuccuccuccuucuucagauuuauaucuaaguguauccauauguauuuaauuuucccacuuucuuugugugagaggggagagcagaggugagucugugccaugggauacuuguggcgacagaggacaacuugugguugucagccuuggggcucaaacuuaggucaccgggcuuuauggcaaaggcaaugccuucacuccuugaaccucugacagccuagauuuauggagggucgggcucaggucuccuggaauucgacacgaguucugggaaccaaacucugguccuccggaagagcugcaagccgucucuccagcacaguggcugacucuuuuuuucucuuuuuucuuucuuuuuguuuuuguuuuugagacaggguuucucuguagagcucuggcuguccuggaacucacaauguagaggagucuggccucuaacccauagaucugugugccucugccucccaagugcugggauuaagaggugugucaccacuguguggccgguucuuauauucagugaggaaacacaugaggcccagggccuuuucuccgcauacacccacccucaaauacaugcuuccgggggucuccgagaaaucaucaacuccuuucuucccugucuucaugauacuuucuggcugcagauucaucagccagaucuucugugccugugguuggaaucguucuugguuuauugcuggugguaguggccaucgcaggcggugugcuguuguggggcaggaugcgcagcggucugccagguauaugcaggaugggggaggggcggggccgugugcaggauugggugggaguggccuugugcaggaugagggaggggcggggccgugugcaggauugggguggggcguggccgugugcagaaugagggaggggcguggccgugugcaggauuggggaggggagggaaggggccgugugcaggauuggggaggggcguagcugugugcaggauuggggaagggaggggccgugugcaggauugggggucguggcaggaaguagcgacucagaaagaaagaggggaggcagagagauaauagagacaaaagagucccugaccacccugggaaaagagaugggaacagagaccauagcgugacccugucagguguguugggugggugagaccuuagauacuugugcugaccucuguuccucucucucagccccauggcuuucucucagcggcgaugacucuggugaccuguugccuggugggaacuugcccccagaagcugaaccucaaggugcaaaugccuuuccagccacuuccugaugcagacucgggcccccugcccacugcagccuuucgggcugugugaccuccugaacugucuccgagccuccugagggagccugggcccgauguccucccauggaucccugcuuuuguggccugcuucaguuucccuucuuaauguacaugguuguuuuccaucuccacauaaauuuggccccaaaucugugugugcaucguuauucucaaguuucaagcagcuggaauaaauugaacgcgucugggaaagaucauauagacaccucuugauugcuaucgugcagccuggccauuuuauagaccgaguuguguaugugauaccuacacuguaccaggcauugcuucucuucuuuuucuuccuuccuuccuuccuuccuuccuuccuuccuuccuuccuuccuuccuuucuuucuuuuccuucuuuucuuucuuucuuucuuucuuucuuucuuucuuucuuuccuuccuucuuucuuuuuuuuuuuuuuuaacauuuauuuauuuuauguaucugaguacacugcagcugucuucagacacaccagaagagggcauuggauuccauuacagaugguuagccaccaugugguugcugggacuugaacucugguccucuggaagaacagucagugcucuuaauugcagagccaucucuccagccgcgcuccccccccaccccccccuuuuuuuuuuaaagacaagggucucucuacgucguccuggcuggcggcaaacucauagagacagacugcuucugucucccaagugagccaaccaaacccgaccuccucuuuucugaaacggaucuaagaaauggaaagaguuuuuaaaaaauacauuccccuuaauccccuggggccagagacucuggagguggucgugcaagucggcccauauguuugcugggaguuguaguucaauaucagccuuaucgcccaccacgccuucgggucuggagcucggccuuguggacguggcaagggggucgucauuggcuccgccccugaggcuuuccugcgcagucauuggucagagggcggcagccucuggacggcugguggaggagcuuaacuggaaccuggccagguugggcaucuuugugcgaaagcagagcucagcguagggagcuaacucaggccggguaacagaggugugguggggugaugguggggugaaggugggguggguggaagggugggggucgcgguccagccugggggcagcacagaggagccugcaugaugcuuucggccaccaccaugcccugaacuuugggugggacaugcgccacgucucuaacugaaauacccccuuucugcucugagacuccucugaggcucggauuccacccccagagguuguuuugccuuuaaauucucuauucuuuuugccgacuuuucuugagcccaaaacuuuuugcagccugcgcuuuuaucggcccugccuuaggcagccuccucuacuccgcccccuucaaaguucucccacauuaucucugguucagacaccccccgcccccagucuuaucccugaccgcugguccucaccucuccucaggaaccgaugauguggcgauggucguuucuguugcuucucuuacugcugaggcacugggcccucgggaagccauccccugaugcaggaccucauggccaggauaggguccaucauggaaccccccugagcgaggccccccacgaugacgcccacgggaauuuccaguacgaccaugaggcguuccugggacgagacguggccaaggaauuugacaaacucagcccagaggaaagccaggcccgacuuggguaggaggauggcgggggagcggggcagaagug

SEQ ID NO: 3782 - RNA, 10866 nt, Mus musculus
cuauaugaucuuucccagacgcguucaauuuauuccagcugcuugaaacuugagaauaacgaugcacacacagauuuggggccaaauuuauguggagauggaaaacaaccauguacauuaagaagggaaacugaagcaggccacaaaagcagggauccaugggaggacaucgggcccaggcucccucaggaggcucggagacaguucaggaggucacacagcccgaaaggcugcagugggcagggggcccgagucugcaucaggaaguggcuggaaaggcauuugcaccuugagguucagcuucugggggcaaguucccaccaggcaacaggucaccagagucaucgccgcugagagaaagccauggggcugagagagaggaacagaggucagcacaaguaucuaaggucucacccacccaacacaccugacagggucacgcuauggucucuguucccaucucuuuucccaggguggucagggacucuuuugucucuauuaucucucugccuccccucuuucuuucugagucgcuacuuccugccacgacccccaauccugcacacggccccucccuuccccaauccugcacacagcuacgccccuccccaauccugcacacggccccuucccuccccuccccaauccugcacacggccacgccccucccucauucugcacacggccacgccccaccccaauccugcacacggccccgccccucccucauccugcacaaggccacucccacccaauccugcacacggccccgccccucccccauccugcauauaccuggcagaccgcugcgcauccugccccacaacagcacaccgccugcgauggccacuaccaccagcaauaaaccaagaacgauuccaaccacaggcacagaagaucuggcugaugaaucugcagccagaaaguaucaugaagacagggaagaaaggaguugaugauuucucggagacccccggaagcauguauuugaggguggguguaugcggagaaaaggcccugggccucauguguuuccucacugaauauaagaaccggccacacaguggugacacaccucuuaaucccagcacuugggaggcagaggcacacagaucuauggguuagaggccagacuccucuacauugugaguuccaggacagccagagcucuacagagaaacccugucucaaaaacaaaaacaaaaagaaagaaaaaagagaaaaaaagagucagccacugugcuggagagacggcuugcagcucuuccggaggaccagaguuugguucccagaacucgugucgaauuccaggagaccugagcccgacccuccauaaaucuaggcugucagagguucaaggagugaaggcauugccuuugccauaaagcccggugaccuaaguuugagccccaaggcugacaaccacaaguuguccucugucgccacaaguaucccauggcacagacucaccucugcucuccccucucacacaaagaaagugggaaaauuaaauacauauggauacacuuagauauaaaucugaagaaggaggaggaggaggagaaggagggagaggaggaggaggaaggggagagggggaggaaguaggagggaggaggagggauggaaggaggaggagaaagaaaaggaauaggaggaggaggaagaggaggaggagaccuauacugagaggacacagccacacugugacagaacuaggugagaacccaacagaggaaggcggagcagucacaggacagucaacaaaguuggugcuuuaccaaagccauggcaagaacugucagaggcaaaagugaauggucaaacaccaugaagaccaguagcagcaagacucaucauggucagacucagggggaacuggccacagagcuaauggagaaucagaagccaggagcagaaacaaagaagacaauggggcuggagagagagauggcucagcgguuaagagcaccgccugcucuucuagagguccugaauucaauucccagcaaccacaugguggcucacaacugucuguaauaggaucugaugcucucuucuggugugucugaagacagcgacaguguacucacauacaugaaauaaauaaauacaucuuuuaaaaaaacaaaaaaaaacaaagaagacacugaggcuggaggggcagccucaccuagguccacagugagaggcugugccagccccucaugcuccacuugacauugauaauggugcucaucuccacguuugaccuccagcaaugaccaugcguggaaagagccaucuccauugggaccagugcugcaauucccggagccugaggcuagcccauugcgcaggaaucggaacuugagcuccgguggguagaaggagaaagcagcacaggucagcacggaggagccagaguugccaggacgggccuucaggcgcauagacggcggcucugcagggacacaggcaaugggaugggccagcaguuaggcuaggcuaugaccucacccacccaccccacccccaccaaggcuugggugaagcuugccauggacagacuccacuucccuguaucagcacugugcugacuuggagggcuucccagagugacagacaccccacccugcugaccccaccacugcacccccuuauuuugguguguguggcaugugcaugggucaaggccacaggucaauugcaggcuccuuccucuuucgcucuuugcauuuuuuccccuuuauauauuuuucacucugugugucugggugcuuuuuagcaugugugucucugcaccacaugcaugcagugucuguggaggccagaugaggacaucagagccccuggaaauggaguuacagaugguggugaguuacccuaugggagcuaggaauuaaauccugguccucugcaagaacagggaguguuccuaaccacugagccaucucuccccacauccacuuuuuuuuguuguuguuuuuugggguuuuguuuguuuguuuguuuguuuuuucgagacaggguuucucuguguagcccuggcuguccaggaacucacuuuguagaccaggcuggccucgaacucagaaaucugccugugucugccucccaagugcugggauuaaaggcgugcgccaccacgccgggcucacuuauuuuuugagacagagccucuccaugaaccugggguccucccuuucagccaugccaguggcuggugaggcuccgucucugccagacccaucccugcagcuacagacacgcagcaguacgcccagccuuugcaaggggaccuggggaccagaacccaggucuucaucacagcaaacucggcgcucacagcgccucuucucgcgcacauuuguuuguuucacucucagcccagaccagucuugaacuuauuauauagauacagaugacuuugaauuccugauuuuccuucuuccacuugcuaaaagcugagagacagcaggugugugccgccauacugguuuaugcagugccagugguggagcccauuuaagcaagcuuucuaccagcugagccccaacuccuccaucuaccuguuucuaaacggagacuuagugcacaucucucuagugccgugaccuauucguggcccugggaacacauuaguguauauauagagcaaagagacaugacuguccuagcugggugggauggugcaugcccacacaagugaucccagcaccugaggaacuguugccggaaaaucaugaguuccaaaugaguuggaugcucuugcaaaaacugagaccugugggugggguguguaguacaucuugaaucccagcauucagggagcagaggcaaguugaucucuguggauaccagggcaaccuggucuacauagcaguuccaggcuagccaaggcuacauagugacauagugagaccaaggaaagaaagaaaggaagaaagagagagagagagagagagagagagagagagagagagagagagagagagagaaagaaagaaagaaagaaagaaagaaagaagugggcggugguagcgcacgccuuuaaucccagcacuugggaggcagaggcaggcggauuucugaguucgaggccagccuggucuacaaagugaguuccaggacagccagggcuauacagagaaacccugucucagaaaaaagaaacagagagagagagagacagagagacagagagacagagagagagagagagauauuauggcuggggauguggcccaguuuccggugugaaguccuggguuccuagguuugauccccggcacacugacauuggucaugcaugcuggcguacaccuguaaucucagcacuccagacuggaggucagaggaucaggaguucaagguuacuuugaugaaauaggaaguuuggggccagccugggcuacacaagacccugaaucaacagcaauaaaccccuagacaaaaugaaguccauggggaucugagaccccagaaaggcugugcauggcagaggcguucccucugucuagggugggucucacaaucuugguucugcucugguucucagcagaaaauaagcugacaacuucuuaggaagaggaagcuaacgagcuuccccgaaagaggggccucacuggcaucuaggaagaccugaggcaccggcucucugccacagaggaccggaccucagucagcacuucuguguccugccuugugcuugcuauuguuuuccagugaggaugacuuccuguggguagcugagagacacccucgguucuccuguuuuccaguucugacccugaggguucggagagucagcccagccuuggcuucuguuuaacagaagaagaagaagaagaaaaaaaaaaggaagcaccuuugccccagaaauguaaccuggguggccaaggcagaggugcuacaggcucaccaguuaagccacagauugagcugggaguuagcuugggaaacuuagugagaccaugucucaaaauaaaaagucaagggguuggggauuuaguucagugguagagugcuugccuagcaagcccaaggcccuggguucgggccucagcuccagaaaaaaaaaaaaaaagaaaagaaaaaagaaaaaagaaaaagucaaaagagggccagugaagcgcccgagagacacagcuuagccgcuagagcguuuucuguucucucuacagaacugagcucaauucucagcaccaacugggcgacacuuaaccaccuauaacuaacuccagcugcagacgaccugauccuccuucuggcaucuguggucacuugcaccauauauguacacacacauccacagaaauuaacaauaaaauaaauauagucagaaaaagguuuagaaaaauacaagagggcuggugacgugacguaaagacaccugcggacaagccugaugaccugaguuccaucccuagaaucuacauggcaaaaggagagauccaacucaccaaguucucugaccuaucuacacacacacacacacacacacacacgcacgcacgcacgcgcgcgcgcgcgcgcacgcacgcgcacacacacacacacacacgcacacacgcacacacauaugcacacucauucacaaguaaguaaccuuaauaauaaguguaaccuuaaaaauauuuuaagucaaaugagcgucaaugguaugcucaauguuagagccucgaauuccccagugaagggcuggggcguggcucagugguagagccccugccuuguuuguauguuuggaaggaaacaguaacacaaccuaacaccugguaccagaagccuguuaagaagaacaaaaucacacauagacacaauguagcaacuguagucaguacccguggaaccuggaccgguugucaaggggagugcagguagugcagagacuaccugucccugccuccggagugcuagcauuaaagacauguauccccacacaggccaccaugguuuuccaugguaaaugagcucagagcuagagaagugacucagcggguaaaauuagucaaguagugaguggcagcuccuccagaggacucagguucaagucagagcacccauguggugaacaacuccuaaccaucuguaacuccagcaccaggggaccugacgcccuccucuggccucugugaguacugcaugcacauggugcacagacauacauggaagcaaaaaacauaauaaaaauuuuuuuucuuguuuaauggaguuagcuauccuauuuguggacacuuauccagaaguugguaucaaaauuuuagggaugggcagugguggcacaugccuuuaaucccagaacuugggaggcagaggcagacagauuucugaguucaaggccauacuggucuacagagugaguuccaggacagccugagcuauucagagaaacccugucucaaaaaaccaaaaauaaaaaaauaaaguaaauauaguaaaagcaaaacaaaauuucagggaaacacuggccacuauccugcauuguagaaacaucaaaacagccaaacaggacugaagagauggcucagugguuaagagcauugacgucuuuuccaaagguccugaguucaaauccuagcaaccacaugguggcucacaaccauccguaaugagaucugaugccuucuucuggagugucugaagacagcauacuuacauauaauaaauaaauaaaucucuaacaaacaaaaaaacagccaaacuacagaaacaauguagacacccucagcagauaaaggaagauagcaugcaggcuucuagaauggaguacuauuuagccauaauuaggggaauggcucagcaugaaaaaguguuuauuacacaagcaugaggacccaaguucaaauucuuagcacuuaugucaaaacuuaaacauaucuucauaacuguaacccuggcgcugaggauaggggcagaggaaagaggaccaguaggggccuggcugguugccugcguagcuucaggcucaucaagagaaucugggugaagaacauacgauggaaagagacagaggagccaccuucucuggcuucugagcauguggacagaugcucaccccauacacagcacagguauauaucacauaugaaacacacacacacacacacacacacacacacacacacacacaccaccuccaccaccaccacucacacacgcuaaaucacagauaaauaaguaaagguaaguuuuaaaaccuaaaacauggccagccggucggcggugacgcaugccucugaucuccagagcuuaggaggcagagauggaugggucuuugaggucaaggccagccuggucuacagauugaguuccaacacagagaaacccugucucgaaaaaccaaaaaccaaaaucaaaaaccaaccuuaaagauugcucaguggcagagcucuuacuuggcaagagaaaggaccugagugcaaucccaaacugagccaacuaagugagagggacagaguaaaaaucucacaggggcuggggcuggagagguggcucagggacuaagggcuugcugcuacuuaaagaugccucaaauucaguuccagcacccacacugggcauguuauaacuaacuguaacuccagcuacaggggauggaacgcccucuucugacacucacgugcacauacaaauauacaugugcacauauaaaaucccugugugcucucaaccacugagcugaguccagccugaagauuuguuuuucagaaaaagaugucauaaauacaacacucgaggcugugcucuggucuccacccacaugagcacacacacaacucagauccagacaggcugaaacuuggauggagaaaugacagaccuucuucacauacaauuuguuagacagaaaagcaagaggaucuauacauagaauggaaagcuauaaaacuccuccaaauacacacagagaccuaggucauccugggcugggcaugaccuccaagcaagauauacuaacaaaaacacagcccucaaaagaggacuggggacuggagagauggcuuagcagucaagagcacuggcugcucuuuuagagguccuaaguucaagucccagcaaccacauggcaucuuacaagcaccugaaaugggaucugaugcccucuucuggugugcagcaggcauacaugcaauccgaacacuuauauacaaaacuaaauaaucuuaaaaaaaaaaaaaaaaaaagccgggcgugguggcacacaccuuuaaucccagcacucaggaggcagaggcaggcggauuucugaguucgaagccagccuggucuacaaagugaguuccaggacagccagggcuacacagagaaacccugucucgaaaaaacaaaacaaaaagauuugaagauaacuuuaaaagaaugaaaggaaaacagucaaggaaaguguguuugaaacacuuauuuggugaagauuuggguccacaauauauaaagaacucuuagacguuaacaagaagaaaaagacauggaaaauccuagcacuugggaggcugagaccaagaggaugacaaguuugaggucacguggucuacauugggagagucugucuaacuauaacaacaacaaaaaaagaaaaagaaaaagaaaaagcagccugguacagcagcacacuccuuuugucccagcacucaagagaucucucugaguucaaagucagccugagacccugucucacaaacaagaacaauuagcuggguguggcaacacacuuaagucaaaucagcacuuggaaugggcuaagaggaucaggaauccaagaccauccucagcuacacgaugagcucauggcuagcuugagcuacgugagagcuagccugggcuacaugagaccuuaucuuaaagaagauccacugggauaggcgagagggguuguacugaugcugggugggcuuugagcauggcuguggagaucuagaggagggacaggagaugggcucacccuuccacuccagguuccgucggccccucuccagguggccuagcagucgcuccggacaagaguuuagcaggaacucgcucuccuuccuggccgcaucaggcugcuucauccacagauuagcaacgauuuccgucucaggccacuccccaguccaauugccgauucuuggguugaauuucauaaacuccucaccauugagggcaaacacagccgugggcacugaggaauuauccgaggccaguucacagcccagcaggcccugcaguguguaggucccuagaugccaacacgcaggcaagcagacucaggagcaagggccagccuuccucucuucuccucccucggaccuugagguccagaucccaaccuucccccuuauuccuaggguucagaccuaauccucccacuucaggccuagggcuccagccuccuuccuugacccaggaauccagacccauuauccuuccucaaacccagccuacugaagcucaccccucuucugaccauuuaauaucuucuccagggucuugagggccuccaagaagagcuguucuuugcuuuugaggucuguggucuccuucucccaauaccaagacaccugauuuucccacauccaggccccacaggggucagcuuccugccgcaggcuguuguaggucagauacugcugaggacccaaccagccuguagcccagaaagagggaagccccguagauggguuugacacagccgugagaugauacaucaguggggggcgggucucugcagagcaaacaggagagucucgggucacggacugcaccgugccccacagaggugcagaaugaaaacuggacccgaucugaagugccaugauccuccagagagaaggggacagacacccagaaaggaagcaagacggacagacggacacagagacgagccugagauugucaaguguauuugacucagaugcacagagaaguuacccacagugagauuuccaugaaggcuaggacaucauggaaaaaguggacuuauugucccucuuccacucuuuggcucuucuuccuguccccuuccugacacacuccagguccugguggccucuuaccugagccccaggucugaggcaggaggaccaacaagaggcugagggcccagggcaguggcauccccauuccgacagggugacccggaguggaagggacacgugacuccucuggaccccgccuuguugauucuucacaaggucccuguggacucuucguagaccaggacgcuggauggugggauggagacccaguccaagacgacagacaggaguguuccucugugaacuuucaccuucucauuugauccacuuuaguuaauuaauuacagagcuagacagaccaaaauuugucucagacuucuguuauuuccuuuuucuccucccucagaccagaggauccaggccuucuccuccucccucauucccaggggcucagauuucagccucaggagcccucaaacccaagccaggaguccaguuccaccucccucagauccaggaguccaguuccaagaucuuuccucaaacccaaaacccuaggcuccggcuucaucccucagacucaggugcccgggguccugcucuccuuccucagaccccagccuccucucucccccucaggucauaacacuccucccucagaccuggagcuccaggccccaacccucuuuccucuuggggugcuggucccucauaccuagagaaccaggccugggccuccuccucugacgcucagccuguuccucacagaggcccucuucccucugccugcagccgauggauccucugcuuagagccuccaguucuucucuuacauccugucuguacacaguuaggacuggagaacucugagggcauccaacuccacccacuagcuccuaagcacaccccuugggccucuguccagccu

SEQ ID NO: 3783 - RNA, 10866 nt, Mus musculus
aggcuggacagaggcccaaggggugugcuuaggagcuaguggguggaguuggaugcccucagaguucuccaguccuaacuguguacagacaggauguaagagaagaacuggaggcucuaagcagaggauccaucggcugcaggcagagggaagagggccucugugaggaacaggcugagcgucagaggaggaggcccaggccugguucucuagguaugagggaccagcaccccaagaggaaagaggguuggggccuggagcuccaggucugagggaggaguguuaugaccugagggggagagaggaggcuggggucugaggaaggagagcaggaccccgggcaccugagucugagggaugaagccggagccuaggguuuuggguuugaggaaagaucuuggaacuggacuccuggaucugagggagguggaacuggacuccuggcuuggguuugagggcuccugaggcugaaaucugagccccugggaaugagggaggaggagaaggccuggauccucuggucugagggaggagaaaaaggaaauaacagaagucugagacaaauuuuggucugucuagcucuguaauuaauuaacuaaaguggaucaaaugagaaggugaaaguucacagaggaacacuccugucugucgucuuggacugggucuccaucccaccauccagcguccuggucuacgaagaguccacagggaccuugugaagaaucaacaaggcgggguccagaggagucacgugucccuuccacuccgggucacccugucggaauggggaugccacugcccugggcccucagccucuuguugguccuccugccucagaccuggggcucagguaagaggccaccaggaccuggagugugucaggaaggggacaggaagaagagccaaagaguggaagagggacaauaaguccacuuuuuccaugauguccuagccuucauggaaaucucacuguggguaacuucucugugcaucugagucaaauacacuugacaaucucaggcucgucucuguguccgucuguccgucuugcuuccuuucugggugucuguccccuucucucuggaggaucauggcacuucagaucggguccaguuuucauucugcaccucuguggggcacggugcaguccgugacccgagacucuccuguuugcucugcagagacccgccccccacugauguaucaucucacggcugugucaaacccaucuacggggcuucccucuuucugggcuacaggcugguuggguccucagcaguaucugaccuacaacagccugcggcaggaagcugaccccuguggggccuggaugugggaaaaucaggugucuugguauugggagaaggagaccacagaccucaaaagcaaagaacagcucuucuuggaggcccucaagacccuggagaagauauuaaauggucagaagaggggugagcuucaguaggcuggguuugaggaaggauaaugggucuggauuccugggucaaggaaggaggcuggagcccuaggccugaagugggaggauuaggucugaacccuaggaauaagggggaagguugggaucuggaccucaagguccgagggaggagaagagaggaaggcuggcccuugcuccugagucugcuugccugcguguuggcaucuagggaccuacacacugcagggccugcugggcugugaacuggccucggauaauuccucagugcccacggcuguguuugcccucaauggugaggaguuuaugaaauucaacccaagaaucggcaauuggacuggggaguggccugagacggaaaucguugcuaaucuguggaugaagcagccugaugcggccaggaaggagagcgaguuccugcuaaacucuuguccggagcgacugcuaggccaccuggagaggggccgacggaaccuggaguggaagggugagcccaucuccugucccuccucuagaucuccacagccaugcucaaagcccacccagcaucaguacaaccccucucgccuaucccaguggaucuucuuuaagauaaggucucauguagcccaggcuagcucucacguagcucaagcuagccaugagcucaucguguagcugaggauggucuuggauuccugauccucuuagcccauuccaagugcugauuugacuuaaguguguugccacacccagcuaauuguucuuguuugugagacagggucucaggcugacuuugaacucagagagaucucuugagugcugggacaaaaggagugugcugcuguaccaggcugcuuuuucuuuuucuuuuucuuuuuuuguuguuguuauaguuagacagacucucccaauguagaccacgugaccucaaacuugucauccucuuggucucagccucccaagugcuaggauuuuccaugucuuuuucuucuuguuaacgucuaagaguucuuuauauauuguggacccaaaucuucaccaaauaaguguuucaaacacacuuuccuugacuguuuuccuuucauucuuuuaaaguuaucuucaaaucuuuuuguuuuguuuuuucgagacaggguuucucuguguagcccuggcuguccuggaacucacuuuguagaccaggcuggcuucgaacucagaaauccgccugccucugccuccugagugcugggauuaaaggugugugccaccacgcccggcuuuuuuuuuuuuuuuuuuuaagauuauuuaguuuuguauauaaguguucggauugcauguaugccugcugcacaccagaagagggcaucagaucccauuucaggugcuuguaagaugccaugugguugcugggacuugaacuuaggaccucuaaaagagcagccagugcucuugacugcuaagccaucucuccaguccccaguccucuuuugagggcuguguuuuuguuaguauaucuugcuuggaggucaugcccagcccaggaugaccuaggucucuguguguauuuggaggaguuuuauagcuuuccauucuauguauagauccucuugcuuuucugucuaacaaauuguaugugaagaaggucugucauuucuccauccaaguuucagccugucuggaucugaguugugugugugcucauguggguggagaccagagcacagccucgaguguuguauuuaugacaucuuuuucugaaaaacaaaucuucaggcuggacucagcucagugguugagagcacacagggauuuuauaugugcacauguauauuuguaugugcacgugagugucagaagagggcguuccauccccuguagcuggaguuacaguuaguuauaacaugcccagugugggugcuggaacugaauuugaggcaucuuuaaguagcagcaagcccuuagucccugagccaccucuccagccccagccccugugagauuuuuacucugucccucucacuuaguuggcucaguuugggauugcacucagguccuuucucuugccaaguaagagcucugccacugagcaaucuuuaagguugguuuuugauuuugguuuuugguuuuucgagacaggguuucucuguguuggaacucaaucuguagaccaggcuggccuugaccucaaagacccauccaucucugccuccuaagcucuggagaucagaggcaugcgucaccgccgaccggcuggccauguuuuagguuuuaaaacuuaccuuuacuuauuuaucugugauuuagcgugugugagugguggugguggaggugguguguguguguguguguguguguguguguguguguguguguuucauaugugauauauaccugugcuguguauggggugagcaucuguccacaugcucagaagccagagaagguggcuccucugucucuuuccaucguauguucuucacccagauucucuugaugagccugaagcuacgcaggcaaccagccaggccccuacugguccucuuuccucugccccuauccucagcgccaggguuacaguuaugaagauauguuuaaguuuugacauaagugcuaagaauuugaacuuggguccucaugcuuguguaauaaacacuuuuucaugcugagccauuccccuaauuauggcuaaauaguacuccauucuagaagccugcaugcuaucuuccuuuaucugcugagggugucuacauuguuucuguaguuuggcuguuuuuuuguuuguuagagauuuauuuauuuauuauauguaaguaugcugucuucagacacuccagaagaaggcaucagaucucauuacggaugguugugagccaccaugugguugcuaggauuugaacucaggaccuuuggaaaagacgucaaugcucuuaaccacugagccaucucuucaguccuguuuggcuguuuugauguuucuacaaugcaggauaguggccaguguuucccugaaauuuuguuuugcuuuuacuauauuuacuuuauuuuuuuauuuuugguuuuuugagacaggguuucucugaauagcucaggcuguccuggaacucacucuguagaccaguauggccuugaacucagaaaucugucugccucugccucccaaguucugggauuaaaggcaugugccaccacugcccaucccuaaaauuuugauaccaacuucuggauaaguguccacaaauaggauagcuaacuccauuaaacaagaaaaaaaauuuuuauuauguuuuuugcuuccauguaugucugugcaccaugugcaugcaguacucacagaggccagaggagggcgucagguccccuggugcuggaguuacagaugguuaggaguuguucaccacaugggugcucugacuugaaccugaguccucuggaggagcugccacucacuacuugacuaauuuuacccgcugagucacuucucuagcucugagcucauuuaccauggaaaaccaugguggccuguguggggauacaugucuuuaaugcuagcacuccggaggcagggacagguagucucugcacuaccugcacuccccuugacaaccgguccagguuccacggguacugacuacaguugcuacauugugucuaugugugauuuuguucuucuuaacaggcuucugguaccagguguuagguuguguuacuguuuccuuccaaacauacaaacaaggcaggggcucuaccacugagccacgccccagcccuucacuggggaauucgaggcucuaacauugagcauaccauugacgcucauuugacuuaaaauauuuuuaagguuacacuuauuauuaagguuacuuacuugugaaugagugugcauaugugugugcgugugugcgugugugugugugugugugcgcgugcgugcgcgcgcgcgcgcgcgugcgugcgugcguguguguguguguguguguguguguagauaggucagagaacuuggugaguuggaucucuccuuuugccauguagauucuagggauggaacucaggucaucaggcuuguccgcaggugucuuuacgucacgucaccagcccucuuguauuuuucuaaaccuuuuucugacuauauuuauuuuauuguuaauuucuguggauguguguguacauauauggugcaagugaccacagaugccagaaggaggaucaggucgucugcagcuggaguuaguuauaggugguuaagugucgcccaguuggugcugagaauugagcucaguucuguagagagaacagaaaacgcucuagcggcuaagcugugucucucgggcgcuucacuggcccucuuuugacuuuuucuuuuuucuuuuuucuuuucuuuuuuuuuuuuuuucuggagcugaggcccgaacccagggccuugggcuugcuaggcaagcacucuaccacugaacuaaauccccaaccccuugacuuuuuauuuugagacauggucucacuaaguuucccaagcuaacucccagcucaaucuguggcuuaacuggugagccuguagcaccucugccuuggccacccagguuacauuucuggggcaaaggugcuuccuuuuuuuuuucuucuucuucuucuucuguuaaacagaagccaaggcugggcugacucuccgaacccucagggucagaacuggaaaacaggagaaccgagggugucucucagcuacccacaggaagucauccucacuggaaaacaauagcaagcacaaggcaggacacagaagugcugacugagguccgguccucuguggcagagagccggugccucaggucuuccuagaugccagugaggccccucuuucggggaagcucguuagcuuccucuuccuaagaaguugucagcuuauuuucugcugagaaccagagcagaaccaagauugugagacccacccuagacagagggaacgccucugccaugcacagccuuucuggggucucagauccccauggacuucauuuugucuagggguuuauugcuguugauucagggucuuguguagcccaggcuggccccaaacuuccuauuucaucaaaguaaccuugaacuccugauccucugaccuccagucuggagugcugagauuacagguguacgccagcaugcaugaccaaugucagugugccggggaucaaaccuaggaacccaggacuucacaccggaaacugggccacauccccagccauaauaucucucucucucucucugucucucugucucucugucucucucucucucuguuucuuuuuucugagacaggguuucucuguauagcccuggcuguccuggaacucacuuuguagaccaggcuggccucgaacucagaaauccgccugccucugccucccaagugcugggauuaaaggcgugcgcuaccaccgcccacuucuuucuuucuuucuuucuuucuuucuuucucucucucucucucucucucucucucucucucucucucucucucucucucuuucuuccuuucuuucuuuccuuggucucacuaugucacuauguagccuuggcuagccuggaacugcuauguagaccagguugcccugguauccacagagaucaacuugccucugcucccugaaugcugggauucaagauguacuacacaccccacccacaggucucaguuuuugcaagagcauccaacucauuuggaacucaugauuuuccggcaacaguuccucaggugcugggaucacuugugugggcaugcaccaucccacccagcuaggacagucaugucucuuugcucuauauauacacuaauguguucccagggccacgaauaggucacggcacuagagagaugugcacuaagucuccguuuagaaacagguagauggaggaguuggggcucagcugguagaaagcuugcuuaaaugggcuccaccacuggcacugcauaaaccaguauggcggcacacaccugcugucucucagcuuuuagcaaguggaagaaggaaaaucaggaauucaaagucaucuguaucuauauaauaaguucaagacuggucugggcugagagugaaacaaacaaaugugcgcgagaagaggcgcugugagcgccgaguuugcugugaugaagaccuggguucugguccccagguccccuugcaaaggcugggcguacugcugcgugucuguagcugcagggaugggucuggcagagacggagccucaccagccacuggcauggcugaaagggaggaccccagguucauggagaggcucugucucaaaaaauaagugagcccggcgugguggcgcacgccuuuaaucccagcacuugggaggcagacacaggcagauuucugaguucgaggccagccuggucuacaaagugaguuccuggacagccagggcuacacagagaaacccugucucgaaaaaacaaacaaacaaacaaacaaaaccccaaaaaacaacaacaaaaaaaaguggauguggggagagauggcucagugguuaggaacacucccuguucuugcagaggaccaggauuuaauuccuagcucccauaggguaacucaccaccaucuguaacuccauuuccaggggcucugauguccucaucuggccuccacagacacugcaugcauguggugcagagacacacaugcuaaaaagcacccagacacacagagugaaaaauauauaaaggggaaaaaaugcaaagagcgaaagaggaaggagccugcaauugaccuguggccuugacccaugcacaugccacacacaccaaaauaagggggugcagugguggggucagcaggguggggugucugucacucugggaagcccuccaagucagcacagugcugauacagggaaguggagucuguccauggcaagcuucacccaagccuugguggggguggggugggugggugaggucauagccuagccuaacugcuggcccaucccauugccugugucccugcagagccgccgucuaugcgccugaaggcccguccuggcaacucuggcuccuccgugcugaccugugcugcuuucuccuucuacccaccggagcucaaguuccgauuccugcgcaaugggcuagccucaggcuccgggaauugcagcacuggucccaauggagauggcucuuuccacgcauggucauugcuggaggucaaacguggagaugagcaccauuaucaaugucaaguggagcaugaggggcuggcacagccucucacuguggaccuaggugaggcugccccuccagccucagugucuucuuuguuuuuuuuuguuuuuuuaaaagauguauuuauuuauuucauguaugugaguacacugucgcugucuucagacacaccagaagagagcaucagauccuauuacagacaguugugagccaccaugugguugcugggaauugaauucaggaccucuagaagagcaggcggugcucuuaaccgcugagccaucucucucuccagccccauugucuucuuuguuucugcuccuggcuucugauucuccauuagcucuguggccaguucccccugagucugaccaugaugagucuugcugcuacuggucuucaugguguuugaccauucacuuuugccucugacaguucuugccauggcuuugguaaagcaccaacuuuguugacuguccugugacugcuccgccuuccucuguuggguucucaccuaguucugucacaguguggcuguguccucucaguauaggucuccuccuccucuuccuccuccuccuauuccuuuucuuucuccuccuccuuccaucccuccuccucccuccuacuuccucccccucuccccuuccuccuccuccucucccuccuucuccuccuccuccuccuucuucagauuuauaucuaaguguauccauauguauuuaauuuucccacuuucuuugugugagaggggagagcagaggugagucugugccaugggauacuuguggcgacagaggacaacuugugguugucagccuuggggcucaaacuuaggucaccgggcuuuauggcaaaggcaaugccuucacuccuugaaccucugacagccuagauuuauggagggucgggcucaggucuccuggaauucgacacgaguucugggaaccaaacucugguccuccggaagagcugcaagccgucucuccagcacaguggcugacucuuuuuuucucuuuuuucuuucuuuuuguuuuuguuuuugagacaggguuucucuguagagcucuggcuguccuggaacucacaauguagaggagucuggccucuaacccauagaucugugugccucugccucccaagugcugggauuaagaggugugucaccacuguguggccgguucuuauauucagugaggaaacacaugaggcccagggccuuuucuccgcauacacccacccucaaauacaugcuuccgggggucuccgagaaaucaucaacuccuuucuucccugucuucaugauacuuucuggcugcagauucaucagccagaucuucugugccugugguuggaaucguucuugguuuauugcuggugguaguggccaucgcaggcggugugcuguuguggggcaggaugcgcagcggucugccagguauaugcaggaugggggaggggcggggccgugugcaggauugggugggaguggccuugugcaggaugagggaggggcggggccgugugcaggauugggguggggcguggccgugugcagaaugagggaggggcguggccgugugcaggauuggggaggggagggaaggggccgugugcaggauuggggaggggcguagcugugugcaggauuggggaagggaggggccgugugcaggauugggggucguggcaggaaguagcgacucagaaagaaagaggggaggcagagagauaauagagacaaaagagucccugaccacccugggaaaagagaugggaacagagaccauagcgugacccugucagguguguugggugggugagaccuuagauacuugugcugaccucuguuccucucucucagccccauggcuuucucucagcggcgaugacucuggugaccuguugccuggugggaacuugcccccagaagcugaaccucaaggugcaaaugccuuuccagccacuuccugaugcagacucgggcccccugcccacugcagccuuucgggcugugugaccuccugaacugucuccgagccuccugagggagccugggcccgauguccucccauggaucccugcuuuuguggccugcuucaguuucccuucuuaauguacaugguuguuuuccaucuccacauaaauuuggccccaaaucugugugugcaucguuauucucaaguuucaagcagcuggaauaaauugaacgcgucugggaaagaucauauag

SEQ ID NO: 3784 - RNA, 2920 nt, Mus musculus
ccagcuucucccuccagccaagggacuuuuccccagguuuggccuacauacaggggaugccuugggucccuuccuaaguggguguucccaucacuccaacauccauccuggacaaccuggggccuucuucucaucucacugcugaaggguuccuguccuuguuggcccugucccuggacauaagccagaggggaggcaguggcuacagggguucaagcagaucaugauacucaaguuggagaacuugccccuuccuaggugucuucaccugcaaggugaguaugggaagaccagagacccaggugguucccagggacacugaagagcucagaccuaaacuaaggucagaggcuccacccuuacuuccuccugagaggcaggcagagcaggggcugccugcaccagguagcugacccuggguguucuacuugguuaccaagauuuagaggcucauaaaugcagcagauaccuccagcucaggaaagcccuggcaaucuuugcucugucccaggacacaugagacuccaagccuguucuguacguuggaaaauaacuuuauuuguucuagggcauuggccagaguccccuuagaacuucugaaacugcuucuuggugccagcagccuuggugaccuugagcacauugaaucgcacagucuugcucaggggccugcacucuccaacugugacaaugucuccgaucuguacaucccuguggggucagacaaggagucuucaggaggggccuccccagcaauuccuucauccagacaggccaaaggggugggggccacccuugcuccacccaaccagucaccaucuacgcaguugcuaagacuaacaaacuacaacuucuaguucccagacguucacacagcagucuacacacuccuggaccccacacugcucugcccaugggacaccuccagccuagccagugacugucuugucuagagucauuaucccaagcuaccagagucaccugaaacagggggacaggugcacagacauguucuugugacgcuucucaaagcgauuguacuuucggauguaauggagauagucccggcggaugacaaugguccucugcaucuucaucuucgucacgacaccugggagaguaacagaaagguguuagcagguaggagucaguugaacggggcucccaagaagcuccauuuauggcaucagcuuugucaacuggcugucucagcagugcccuagaggacaucugaagaccaucgugagaacagacaucacuugccagcgccccuggacgcaggaaccuagaaccacccuuccaacaucccacucaccagacaggauccgaccucggauggagacguuaccagugaaggggcauuucuugucuauguagguacccucaauagccugcaaaguuaagaaagugggguuuagauuaccacuuccuaaacagaaccaaggaugacgccucagggcccauacuacaauucccaggggcccaugggaagccacugugaagggggcgggguggcugugcucccacacgugcagggcagcagggaucucaucugcuggaggguccuguaccucuuuaggcgucuugaagccuagaccgauauucuuguaguaccgagggaguuuuuccuugccgguuucucccagcagaacccgcuucuuguuuugaaagaucguaggcugcuuuugguaagcacgcuccgucuguagggaugagaauuuggugagguugcagguaaaguucaaggaaaucagagacaauauuucuuccuuccuaccuucaaccuuauuugccccaaucgccaaaaccggcuggucagggcucuccaaccaccccaagucuaguuuagcucacacacugcgucccaucuaacaccuccacagccugcagaacucacggcugagaucaaaaagagcuuuucagccagacuggaccuccaaaacauacaaauccacucauucgggauucaagcuuauguccacguagccgagccuggugggccggaucugucaucccgguugagguugaggcaggauggcaaguuuaagacaagccuaagcucaucgaggccagagcugcgcucacacugaaaacuacagcgaggucgggaccgcagcccugccguagagcgcacgagguccgggccucagucuccaucaaggggaaaaaaccugcuuuacccaguguccccggcucugccgccgcaggacucccgcgccgcaggaugcccuccucccgccacaaucccucacccguuaagcucugagcuuuaagaaccaacucccgaagcgccagggaccccauuacugcguagagcccggauuuccgagccgccugagacgaaggcauucgcaggcauccucgcuucagcuaaugcguaagacaacgaggacgccaagggauacgcuccacaccgaagcgucgggggaaagcaacuaaacgcucgaaccugaauguccgccaucuucccggccgccggagaaagggagaggcagggccgcucccggcuuccuuauucaccacgcgaggucggggcggaagugacgcgggguuauccucacggaggugggagguacuuccggcgagagcccgcguuccugggacuguccguacgccgccaugacgggggaggacuaaggggcgggaagauccuaucaucucgcgagauuucaggagcacgauguggaggaaacgugcaucaugugguacggcgaggcuuagggcggagaaggcgugccguacggguugggaaacacgugcugggauucaguuuccagagagaagcggccgugcagagcgggucucaagaaaggggugaaccgcuuuacagcagaguaucugccauacgaugucaggagcagccagcgucgaccgaauagucaaccuuucuuccuuuuauuaaaggccgacgucaccaagg

SEQ ID NO: 3785 - RNA, 5765 nt, Mus musculus
cgagaaggccgcaguggaugacgggagcccgcgcgccccaagcggccgagaggacucggaggcagcagcggccgcggggcaagcccucaccagugcgcaugcguggcucuccggcaccgguccguacuccagcgucgugaaaaucucccggguacugggcuguacacgcguagccgccaucgcucucccggagccuuccgcgagggauugcuggacggucuaccuagaggaacuuggagguccgaagggcggcaccgcccacuccaaucaaaggggcggggccaaccguagggcccggaagcgagcuauauaggacgugacccgccuacuuuagagccgcgcgaugcggccuaugggcggaugcugggaaauguaguuucggggagaacagacaugguuggguggguggguggggucccgcacuggcagaaggccuucggcuauugucacuuugacucuuuagaaaaaauagauuuucguuguuuuguuuuauuuuguuuuucagacagagucucacugugagcucuggaggcccuggaucuaacuauguagacccggcuggcuucaacucacagacccaccuaucuccgccucccgagugcugguauuagaggcgugugccagcacacuuggcuaaaaaaauauuuaucuuucuuuguauguacucuguguagcccuggcucuccuggaacucacuuuguagaccaggcuggccucgaacucagaaauccgccugccucugcuuccggagugcugggauuaaaggcgugcgccaccacgcccagcccugagguaugucuuugcacuaugugucugcagugccuguggagcccagaagagggcgaugcagccgcugggcuggagagagccucaugacaguuguggcuguuuggagcuuaaccccagacaucuccaaaaauaacauguguucuuaauugcugagccuucucuccaccccaaaugcuuuucuuucuuuaaaagaagcaaacaaagauuauuguuaugugcaugaguauuuugccugcuugucugugcaucauguacaugcaguuccccaggaggccagaagaggaggcgacagaucccccuagaacuggaguuacagggcuuuguuagucgcaaucuggguguugggaaucgaacucuccucuucuggaagagcagucagcacucugccguuuaacuaucucuccagccuccucugccucuauaacuucuuuauaagcaaaaacauuaauuauguucaaaaaagggcgauuaauagcauugagacuggguguguguugagugggaucagacccagagccuaacucaugauagacaagagcaggagauacuaaaguucucagaguggcaauccuuucuguacuguaaccucugagguuugggaagggcagauauguagguuuuauugauucaggaagugugucauuucgcaggccuccucaguccuuacuuuugauugguuggcuaggagggcguggcuucagcucuuucauacaaguggucccuguaggugccugcuuuggaugaagggcgcugaggugggcuuaacgguggcuacuucaguuccuuaguuauacagacgccggaaguguggcuuucauuuaugcauuggccaaacaggaccuaucaagauacccagccgacuugagaacggagccuucaucguaauggaacuguagaccauucucaggacaaauuuugggauucuggguggaggccuggguguacucacugguccuggucgggagguaauggugcaugccuuuaaucccagcacuuuggaggcauaggcaggauucgaggccagccuggucuacaaagcauuccagggcagccaggaaaggcugcacagagaagcccuauaucgaacacacacacacacacacacacacacacacacacacacgcaaacgaaucagcugugacccuacaguaggcuagcuucgcuuaucugcgaaacguucuucacguuuuuggacgccuaggacuuuuuccuagggccauggcggacucgacguuuuuggcaccagaacuaagcgacacagagucgaugggugaagagacggugcgguuucaggagcugcugcugaaggugcgggcugacuagacuggugggaaccuggguauuuaagaaucuauuauuaauuggcacucagagauguggcuucaguucccagagugccccauggcagcagugaggccuguggggauuguaguuguuugccucagguuuccuagguucuaaaugaaauggaguuggggugaucuugggaguucuuguaaaaauaaaagggggcauagacugcauaguaccccaugugaucgagccugagcuguccugaguucuccuacugacguuugaggagcagaggaagggguugacuuugcagauacauccuggaugguuuacuuuuguccccacaggcuuccaaagagcuccagcaagcccagacagccaggccagacucuacacagauccagccaaagccuggugagaaacagauguagacaggaaugucugugucuagguagguagguaggaaggaaggaugucucagggaggaugggagacccugagagagggucaguagaagcugaaggcaagagacacagaggaugaaggugacagaucauaacuggguacaaaggccuagaaguaguuaugugaaaggacaggcagacaggaagaucacugacaaacacugggccacagggagcagaguggggaguggagauucaaaauaagaaagaggagcagaaagccgggcgugguggcgcacaccuuuaguccuaauacuggggaggcagagacagguggauuucugaguucgaggccagccuggucuacaaagugaguuccaggacagccagggcuacacagagaaacccugucuugaaaaacaaacaaacaaacaaaaaaagaaagaaagaaaagagaaagagagaaagaaagaggagcagagagcacuggaaggcgggaaggcagaggcaaagugugaaagcagggccaugcguagcggguagaggugcuugucacuaagccuggugacccaggagagcugccaucacacauuccagccauggugugcuugcacauaugcacacacacgcagaagaggugcauguaguuaaaagaggggaagaaaugaaugccugugaucuaaggaggcagaagugucccaagucuggggccagccugagcauagagugagagaccucgucucagaagagggagagggugggugagaacgcgacagcccagggacagauggccaagacaacuguacucgugcagguuucugugugaagaccaacucaucggaaggaaagguuuucaucaacaucugccacucucccuccaucccucccccggccgacgugacugaggacgagcugcugcagaugcuggaggaggaccaggcuggcuuccgaauccccaugagccugggagagccgcacgcggagcuggaugcaagucagugcccucggaagacacagagucugcucccccaacauugcuuuucucaggagcuuccagucagcacugggagcuagggggguccagugugagugguccaggacuggagggcaugucccgggcucaucacugaggcugaagaaggcuucagagaggguuauguggaggagcgccagucugauuugaagaguuacucaggcagaaacaaaagagcgucguaggcagagaugacaagugagcugggcaugguugcucacucuuccaaucuuagcucuuaggaugcugaggcaggagaauugcugagagcuagaggccagccugggcuaccuagaaagaggacaagggcuggugucuggaggauacagugaucugguugauggacagacuggaagucuggacagccaggggucuagaguaaaaaggagcauuugcuagagugggugggauagagugagggguccuuggagcugcuggggaggagcagagacagcuuuggugacgugagccagagccaagaaggaccuugucugaguugaccugaaaguguaugcugccucucacuuccugugucuugggucucugguccacgggcaaguuuuccuuacggguguucuauggagguugugcagaccucauuccuuguuugucuccacagaaggccagggcuguacugccuaugacgucgcugucaauagcaacuucuaccugaggaugcaggugggguuugguggauaagagcugggcagugcucuuccuccagcuccacccccaccaucauaucucaucuuucucucaccucagaacagugauuucuugcgggaacugguggucaccaucgccagggagggccuugaggacaaguauggccuacagcuaaauccuggugaggaacaggaaggaacaggaauggcuugggugcuacacugggagaggugaauccagugugucgggcauuuccuugacuagcuuucaggacgggugacguuucuuagaaugaggguggagccaagaagguuccaggccaggagcuugcagggugugugaguguguguuuguguaacaguagagcuaagguggguaggggccgcuagagucaagcuugcuauggucagcaggagguauccaggaaggcggcccagccucuguggacuugggagcacucccugaggguucaccucagugaucuuugacucugcaccuucagaauggcgcauguugaaguaccggucuuuccugggcuccaucucacagcagaacauccguucucagcagcgaccucggauccaggagcuggggacccuggaugccaguggcucacugggaaccugucauggguaagcuguugugcacaucugggcacaucugggcugaugacuguccuggggcugagaccuggcuggguggaggaaaaaaaggacaguaagccaaguagagggucacccucagucugcccuuguucccacacagcccagaacggccucaccugaaccuuugguuggaagccccugaccugcucuuggcugaaguugaccuuccuaaacuggugagugcaggcucuuuagucagggagaagagccaguggacacccuggugcugaggcaggaagucuaggggcaaaucccugcaucugaaggaagacacuggggccuggacuccuggucuggguccgaucucuugagacagugaugcaguuccagucuuggcccagaaaccggacagguguagccgcugcuauccugggcuugaguuccuugagacuuagaauuauuguccuuuggguuuuuuucccauuguuuuggugcugggauugaagccacacccugcuugcuaggaccuuguggacauagcuuguggacagugcuaagggauaugggcugacuguaccucaucaccaggacggcgcacaagggcuggcacuggaaauaggagagaaccgccuggugauaggaggcccccagcaacuguaucaucuggaugccacuguuccccugaggaucaacagugaggcaagcagggcugcuuuucaccgcaggaggaagguaccuggaggggcuuccacaagugcugggauguagggaccuggagcccugggugggggaggagagccagcguuugcagcucuggguccugaauccacauucucucuccuuucucagcaacugaugguguccaugccccuccugacagcgucuucuugaccagagugcccugguuuuccagauguggagaagauguuggugucuucucuaagugaaauaaacagguuuccaguucuccccag

SEQ ID NO: 3786 - RNA, 12224 nt, Mus musculus
ugaguccgcuacagccccgggcagcgggcacucgcagccugguucccccccgagcggagcugcggggccgggccgggccggggcggaccccgggaucccggacgcggccgcccgggcccgcgggcggggggauuggcaggggacccgcgugggcacagccaccauggaguuccggcaggaggaguuucggaagcuggcggggcgcgcccuggggaggcugcaccggugagccuggugggguuccugggaggguaaggaugaggaugcccccuuuccaucugagagcaacugacagagggagaagagaggcgacacccaggcacaauguggggaggcccacccaucuguucaggauuccguccugucagugcuguccuuccacucugccuaguucaucaucgcuucccccuccccccuggucccccgcaccucgggcucgacuuuucuuugggauugugugucccucccuauucucuggaucucuguccaccugucuucucggucuuuuacuuuagauauguccucucucuggguucuucuucccacugggugucuguccccucucucugauuaggagccaaugcgggcgcccacuagcuguccaucaguccugacucugacucuuguauuccccuuccucucuucuucccuggaccucugguccccacuuugaucugucucucucagcaucucugacuguucacccgcuaucuccccacccuggcucucuccaccucucuccucuuucucagguucauucccuagaggcuuuuaaucuggagcuaaagcggauuggggcuguuaguucuuguccuugagggggguuaaucugagagggaaaaacugggguauccuagguucugggggugagggggaugaagggaguuucaggccacaaaaccaaauuaaucuugcggguaauauggacuucccaagggauauaagcuagaacugggcgauauuugcucccaccaagggccaugauucuagugaccccagugucccuugagguagccuggacaccucccagccucucacccccaaccccagcucuggcuccaagucagagaaauuacucagcucuugagaggccuaaaaauaucuauccacagugcggggaggagauggccucgugggcauagugcccuccacacagggcccuaguccaccuuuacauguuccucaguccaucuuacugggccacccgaggauuaugcuagugaugguccagcuugcuguaccucaccuccuagauccaaaguuaaccccaaccucuaguaacaugagagggaugagguggacagaggaaggcaggaaggugcaguguguguauguggcggcggggggugggggggaggcgagcuguggaggggggagcugagacagcuucaccucuucauuuuccaauucccagccccuccccacccuuuuuucucgccuccuuucacgaguuucucaaaauacaccagcgugaagucaggggagcuagagaaagaugugcugguggagggggcugggaggggggugacagcaggagacagguguuccucaggcccccucccuuagccucucuaucuccccucugggucuccagucucaccuucucuuucugaauucagaaaccccagagacaggagaagcagcagaacauugggaaggggggcaagcaguuauuugcaaacaaaaucccgaguuuacuuugacagugggggguauuauugguacacaggucauucuccuucccaagucccaaaugagagcucagagcgauagaugcuccuggagaugagugcugcuagcuuagcggggagggggggucucuuggaccagguaacccagggugacuugggacaacgcggaggagccagggguccuugcuucuuacagccaggcuccggcacgguauugcuggaggccaggagcagaucagguccgcagaagagugugaccuuggaccugggagcucugcuuuuggagucuccguuuccuaccguaggagaccagcaaacugccaaggcauaggaagacagagacgcaggcaguggacagauaccuagggagcaguugagacacagucuuccuuuggggaaacuccgccuaacccaagggacgaauucccucaccagauccuuggccuaguuggggucauccagagaggagaugggaguuuucugugacucuugcuauuugagacaggaucuccugaagcccaggcuggccuugaacucuugaucaucuugccucugucucccaagugguaggaugacaggcucacaccaccaggccacacuugaacuuccuggcuuuuuuuauuuuuuuauuuuuuuauuuuuuuaucuuguaugagacucagaauccuguuugaaaagcuugcauggcuuagagaaaucugacaucaaauauaaauaacaaauaucaaaauucagggguuacacucacaccuauaguuucagagucagucaaauaucagaaaucaacccaggucagucuccagucucacuggcuaaugcuguauagaggggagcaagggggggggaggguguccuucacuccugugggguuuacucugagggcuuugagucccagcuccugggcuguguucccucuaccuuucuuccuucuuucucuugguuacugucuaaccccucuccuucuauccuuggggacucccccccuuuuuugagagaggcucuggcccauuagcccuggcuggccuagaacucacggagauccugccucuuccuuaaaguacugugguuaaaggugagcagcaccauacugcuuguuuuguuuccuugagacaaagucugguguaucccaggcuggcuucaaauucacuauauagccaagcugaccuugaacuccugauccucccgccgcuguuaugaucacagaugugugcuaauauaccuggcuuauggaguguuggggacggaacucagaccuuccuauaugcuaggcaaacauucuaccaacuggguuaaaucucugccccgcccccucacuugucucacucuguagcccaggcuggucuugaaauugcagcaauccuccugccucagccucccuggguagcuguggcuguccuggaacucucuguagaccaggcuagccucaaauucagagauccaccugccucugccuccagagugccaggauggggaucaaagggugugccaccaccaccgcccgacuccaccccauuucuuuucuuccccuccccaccuccuuaagucucaguauggggcugucgguuguguucuuuggcccuccccccacccccagcccgucuggcuguucucuccucccccguccccaucucccucgccuccaucuguucucgccccuuccugggaggcagcccgauccccugccugccugccuacccgccucagaggggccacacagaacacgaaauguccccacacucaggcacuucauggccucagaucauuuguccucaguguguccucaucucuccauuuucuagcaucagaggcgcucuccacucuccucucuccgcucuccucaaggcacagcugugucucuugcugccugucugucaguuccuguguucucgccccugagucucuaccucucuuuuuucucauucucuggcccucucucccuaggucucugucaucuucccacucugccuuuccuacucccugggucaccaucuuuugauuucucucucucucucucucucucucucucucucucucucucucucucucucucucucaucuucacuaggucuccccgccccagucucuggcuacuccccaugguucugccccacucuucacagcucuuugucuuucauccgcacaauuuccccaccucucuggucucuuuccuccugccuccaggucaggcucucccgucuccagcagccucccucaggcugggcggcagccccuccaugagcccuauccaucaucacagacucaauccuggaugcagaucgggcggaggcgagagucacgcuggggaaugaaugcgccaaucucccuaccagggccaucugucccuugccaggacaccagcuaucacucccccuccuugcccccuaggcugagucugaacuccagauuccccagggauggauacuuaagccagacagcuggauucggcaccccgugagggaguccccaaaccacgucugugggaaugggcuucaggcggcguuagcuggacuucaaccccacaucuggggccuagaagcagggcaaggcaaccacagggggagauggaagggggagggggucgauauauauagccgagauggcucggaagcaucugcucuguugacaccuuugcgcagggcucuccuuuguaccuuugcugacucaaauagacucggaucugcaucugcuggagggggcuggggacagucuuggagccuugcggugggggcuagcaggcaccuccucuuugauucuaaggguuguguagaaucuauaacucccuaguggggagagaugagagagggcuggggagaagucgacugaagaucuugaccccagaguugaggcaggagagagccgauggccuggacucccgggacuggaaggaauucggacucagauucugggucuggcaaaagacguggguuuugccgugcacuccugugucacggggaagagagggaacucugaguucuuggacagagggagggaaacacagauccagaguugccugcaucauagugagggcagccaagcaagguuaagccuaggaccccuguugucaccgggaggagucugagucuuugcuucucgcuucccugcagguuacuggagaagcggcaggaaggcgcggagacacuggagcugagugccgacgggcggccagugaccacgcacacucgggacccgccugugguggacugcaccugcuuuggccucccucgucgcuacaucaucgccaucaugagcggucuggguuucuguaucagcuuuggcauccgcugcaaccugggcguggccaucguguccauggucaacaacagcacaacccaccgugggggccacgugguggugcagguagcugcuuuggcgagcccugcucacuguccguggucuaggucgcacuccuucccaguuacuauccuuugguccugccuuuccgugccucccuacagaucucaucccacuccaggcuuccucagccccgcccuuauauaauggaagcuccgccuccuuuccaucccagauuguggaaaagacaacacuagcauuagguuugcuacuguggcugcuuugagaccuucuagcccuuuuacuuccggcucugcccccacguuuauguucccggaucacacuugaauaauuucacugcuaucucaagcucuuuuccaaauucaccucugccuauguccaccugauuaguucuggcccacaucuaaagccucguccaagcucagauuuauguuauuucaacuuggauauuacacaagcuauguccuugacuggaaaaagaaaaaaaggaaaaaucuugguuuggucuguggcuuaccugaaacccuguccuuugcucuauuguaauugggaacacaccuaauuuagcugcuucuuggcccugccuagaccccauacaggucuguccacaaacaggaggcagucaccccuacacuuggggauauucagggaggggauacugagguaagcaagcaaguagaacugagcuucuaggcagcagcgccuguagcuaaagugguagggcaggcccuagcaacauagaaggguggagcuccacugagcucugauugguagauuugggcagagggcggggcaucuuguugcugauuggcuaaggagcuaagucuaugggugcugauugguagaggguagagucuggggggcaucuaguuugauguguauuuugacccacagaaagcccaguucaacugggauccagagacugucggccucauacauggcuccuuuuucuggggcuacauugucacucagauuccuggaggauuuaucugccaaaaauucgcagccaacagguaccguuguagugucucaagguggcagaaauuggaguugugugugguggagcuagaggguguggccuuggguuuggcucugggaaauugggaggguccuuguuugagggcauaucuuggaggcagccucuaguucuguuauacacagggccugauguaggcagggaggggaaaauccuaggagcagcgggaaggcuggauggcuagcgccacacgaacaccucacuauaacuggcauggcuagacucuuuuuuucccccaccuuucucaacagggucuuuggcuuugccauuguggcuaccuccacccuaaacauguugaucccuucagcagcccgcguucacuauggcugugucaucuucgugaggauccuucagggauugguggagguaaagccugccccauuaacccugcuucucucucugaucauaccucuucuuguugaccucugugcucccucccuagggggucacauacccugcuugccauggcaucuggagcaaaugggccccucccuuagaacggagucggcuggcaacgacagccuuuugcggugagaggaaggggcuggggagcagcucuugugcgaggagggcugagcugggagcugggagcugggaucucaauguaggugcagcagagauuucagggcugaggggcugcucuccuggaucuaggaaagaccugggacuaggucuguucucuacccucguucucuccucagguuccuaugcuggggcggugguugccaugcccuuggcugggguccuugugcaguauucaggauggaguucugucuucuaugucuauggugagggacccagaugcaugauucuggguggcacucaggcuggcugagcaagucuggaugucacccuacacccauaucccugcugaccccccccccucaggcagcuucgggaucuuuugguaccuguucugguugcuugucuccuaugagucaccggcacugcaccccagcaucucugaggaggagcgcaaauacauugaggaugccaucggggagagcgccaagcucaugaacccuguuacgguugguacagggcuacaugacucugugugugugugugugugugcucaaaccugugcaaagacucagagaagauagaacugccaagcaaaaggcuggggguggggggcgaggcaggaggauugugaguucaaggucaggcuauaaaaugaguucaaggccaggccagguauuuccugaagcuuuguuucucaccuggguuagagguuuagcucagugguccauccaucguuugcccagaauccccuagugaggggcugcggguguuuuacaaugaaagagcaucugccuagcaugcauuccuacuacugaaaaaaaacgaagagaaaaaaagaaagaaagaaaauagcugggcuagauuccauauuaggugggauggaguuuaggaauggcggguacuaggugggugauuuagagccacccauaaggccuuguuggcaacagcagagaggauuagaaugugaauuuuugcuagcuauugcugugggugugucuagacuuugggggagugagugauugaauagacguuuuaccggacucgccauuuauggguuaucaugaaaccucaggcaucucugggagucaggacccauccuucaucuuugcaaugcaaccugaaggcugcaguuuuagaauuccuaaguccucagaagaaacguguggcccauucuggcccauucucgaggcuucugugaaguaucuuggggucccuagugggacacaaaguucucaauccugguaucagucuuagcaugccugcucugcccuccccuccccgccccccacagaaguuuaacacacccuggaggcgcuucuuuacguccaugcccgucuaugccaucaucguugcgaacuuuugccgcagcuggaccuucuaccugcuccucaucucucagcccgccuacuuugaagaaguguucggcuuugagaucagcaaggugggggugcaggaguaggggacucgaugggggugagggacagggugccugcgucccgaggcggggauggaggaggagguggggggucacccaaucacaucuggcgugaaugcccauucaccugcucucucagguggggcuggugucggcgcugccucaccuugucaugaccaucaucguacccauuggaggccagaucgcugacuuuuugcgcagucgucacauaauguccacuaccaacgugcgaaagcucaugaacugcgggggugaguggguggagcagaguacaaaggggagggcugauggguggggcgaagguggggucaagggcguggcugaccagacccaacccuagugaggaagggcagugugcaacaguuuuaccaagucagguuugcagaccaccauguggaaggguaggcagacccggaugguguagagaagacgccgaacuggaaggauggggcccucacgagucuaguuggaaccagacuuaaacuaggcugggaguugggagggcuguggaugggggaccugaggagacaggcgacugggaaacaggccaugggugcggacuugggaacaccaggcugugaguggggacuuagcacguucagcugagagugggguucagaagcgauggagacaugaguggggucuugagcuuccuuaugagaagugucucuugaggguucagagaugagguauuggguccuuacugaguggccuagucagaaggcggggucauaguggacgcuuuggaggcagagcaccaaagggcaugaaucagguugggucuuggggaaacaggacccagucuaguuugguggaaccagggucaauucugcugcaggucagaaugaguagaaggggucaguagaagggggucggggugagaucaagacugucauuggcgagguggccaacggagucacaacgggcacuugggagacaugacccuuuucagguuucgggauggaagccacgcugcugcugguggucggauacucgcacuccaagggcguggccaucuccuuccugguccuggcugugggcuucaguggcuuugccaucucuggugagaaccucagauaggcaguuugggguacuggagucagcucgggcccugggaacuagagaaaugccucagcaguuaaaacccuugcugcucuugcaaaggaccugaguuggguuuccagcaucuaccauauuuccaauaacuccagcucuggcggaucaggcgcccucuucuggacuuuauggggacugcaggcacacguucacuuccccgccucacccccuauacacauuaguaaauauaaauuuuugaaaaaaacgagugucucagaagagcaggggaugggguggguguagcacuucaguggguuaucugaguugggacuugcuaugauguuugcuacuuugauaccccaccaggguuuaacgugaaccacuuggacaucgccccucgcuaugccagcaucuugaugggcauuuccaauggcgugggcacacugucugggauggugugccccaucaucgugggugcaaugaccaagcacaagguuagcacagcccucccggagaaugccuguuccuuaguuccuuacucuucuuccucucucucucucucucucucucucucucucucucucucuuugguuuuucgagacaguguuucucuguguagcccuagcuguccugcaacucacuuuguagaccaggcuggccucgaacucagaaaucugccugccucugccucccaagugcugggauuaaaggcgugcgccaccaugcccggcuucuuucuuucucuuucuuccuuucuuucuuucuuucuuucuuucuuucuuucuuucuuucuuucuuucuuucuuucuuucuuucuuucuuucucucucucucucucucucucucucucucucucucucucucucucuuccuuccuuccuuccuuucuuuuuaaagauuuauuuauuuauuauguauauagugucugucugcauauaugcuuggaggccagaagagggcaccagaucucauuacagaucaugagccaccuugugguugcugggaauugaacucaggaccucuggcaagagcagccaguguucuuaacugaugagccaacucucugagccccucuucccuuucuuuuaucuauccuuuuuuuuuucuuucgagacaggguuucucuguguaucccuggcuguccuggaacucacucuguagaccaggcuggccuugagcucagagauuuucuuuuagcucuuaaagaaaaucuaugcuuauuaauuuauuuauuuuuauuaacuuaaugugugugagcuaauuuguggcaugggauguguguagaggucaggacaacuguugguuugcuuuucccaucauugugucccaaggaaagagcucagacaguaggguuggcagcucuguuccugccgagucaucucaccaacuccauucccccccccccuugggucagagucucacucuguagaccaggcugacccugaacucacagagauccaccugccuccgcuuccuggcuucguauuaguucuaaauguauguauaugcaugugagugcugagccuacagaggugacugugagcagccucguuuggaugcugggaaccgaacuugggucuccugcaaaagcaagcaguaagaccucuuuaagcucugagccaccuuucaggccccaauauauguauuuuucaagacguguagcccaugcuggcuacccuccggccucacccuacagagccccugaacugacaggugugcauccaucccucucugaucugccuugucugcccccagacgcgggaggaguggcaguacguguuccucauagccucccuggugcacuacggcggugucaucuucuauggggucuuugcuucgggagagaagcagccgugggcagagccggaggagaugagcgaggagaaguguggcuuuguuggccacgaccagcuggcuggcagugacgaaagugaaauggaggacgaggcugagcccccaggggcgccccccgcgccgccuccguccuacggggccacacacagcacagugcagccuccgaggcccccgcccccuguccgggacuacugaccacgggccucccacuguggggcaguuuccaggacuuccacuccauacaccucuagccugagcggcagugucgaggaaccccacuccuccccugccucaggcuuaagaugcaaguccucccuuguucccagugcuguccgaccagcccucuuucccucucaacugccuccugcggggggugaagcugcacacuagcaguuucaaggauacccagacuccccugaaagucguucuccgcuuguuucugccugugugggcucaaaucuccccuuugagggcuuuauuuggagggacaguucaaccucuuccucucuugugguuuugagguuucaccccuucccccaagaccccagggauucucaggcuaccccgagauuauucaggugguccccuacucagaagacuucauggucguccucuauuaguuucaaggcucgccuaaccaauucuacauuuuuccaagcugguuuaaccuaaccaccaaugccgccguucccaggacugauucucaccagcguuucugagggaaaauggcgguuucaaguccccccaccccccuuuucuucccucguccccucaccagcacacuuugccgggccuugaccuuagcuuaguacaaucauuguccagggaaauggccaaaauggcucugcucaccccgugcucuuuuucugacucaguuuucaggucucaguaguggcugcccaaagcuauuaauucagcggcucgaggccaccucuuccuccccguggugguuucaggaucccccucgcccccccccccccaaauccuugcacuuuauucuccugggugguuccaggccgcccucgguuucucaguggccauuuguugugugucccucaggggcuaaaugauuccaaaucuggggugcuuccccucauagacaccccucucucaacguagaaaucugggugggggugaggugugugagagaaguuacagaaucccaggaaagggagcggggcugggaggagaggguuguuccuggggcagggucgugucuuggugucugucucugugacguaaauccugcccugccccaccccacucccaauaaacgcucugguguacggaucag

SEQ ID NO: 3787 - RNA, 4823 nt, Mus musculus
auggugggcgaggugguuuauugggaaguucugccuggcucuggggucccucuaaggcauugaagcugggccgggucugcggcgcgguccucagaagaaguugggggacagugcggcgggcgacagggcuuccaggcgcugcggcccgcgaggcggagggggcagcuugggcggcagcgggggcguggaagguggaggcugcguggcgaugugggagggcacccacgcaucgggggcguagaaguagagauccagcggguccuucggggcaucgaggugcaagacugcaaggacgagggacucgucagguggcuggccaugggagggcuugcaauguccgugcgugcaggcgcauggggggggggagguggugguggugguggugggcgagccucgauggggugugugguacacaauuaggcggggcuuaacugagcagagaggguguguggguauggggggaauuuaggcucagagagggaguguaguuagugugugugugugugugugugugugugugugugugugugugugucuugggaaucugagcuuugagaucccaucucagaggaggaggaagugggaggaggaagaggaauaauuucagauguaacgggcugggaccagaccaugguggggucagccuuauacuuaccuuggacagggguguguguucuuuagaaggguguucuaaguccccuguaaggccuggauaaggucuuucucgggcgagcaagcacucaccugguucaucuccgcugucccggagccgguggugggcaaaggaccugugucuggaggcucggcgguagaggcaccacagcagcaggaagaugccaaucagcagcccuguccccgcgaagaacaggcacagagccccaccgacggagccucgugggcggcugaccagagucaccccugaggaacgacacagccaucuaaccugagcugaggacuuuccucccucaaacacggggguccagacccagcccucaucccucagacccaggagucccagccucacucccucacaccagggauccaaacccagcccuucucugucagacccaacucuccucccuuaguuccagacucccccauuucauacccagggauucagaucuaccccuccucccucagcccuagggcuccagucucagcccucaggccccucacccgucuccuucacucgcuccaccacgaugauaguguugacugugucuccucggcugugucucugaggggcaggugcuaccugauuggggugcuccagaggagcggggggcccugcaauccuugcugagggaagagggauaucuggcccuuuagggucugaguucugggguacgugcagcucuuuggucccuggggaaucugagguggacaggccagggguggcaacucgggugacugcaggggcuucugggcugggacucaagccuggcucacugggagugguggcuuccucccugaagguuguuggcugggugggaagacuagagcuggguuccaagucagagguccuagccguuucuguuacauuuuggcugggggauguggggaauuggguuugggggacaacagugggauuagaguugugaguggugagaaagacugacuguggacuuucuguagggucagggugggugguugguuccagugcagaauuuaggugucucguggcacuggggucguaggucucuagggauuuggagcugaggaauugggugggucugggacuugguaucuuagacucuucaccaggugagaguuuggggguaucucuuuuggagauuucaggggauucaugguguagaguugguguggggucaguguauacagacucaggagacucugggggugagguguuggagggguuagguuuugggguuucuggagagucagacggggaaauuccaguugggucagguuugggggucucagaagguuuaccaaguguugcucuggagggacucauuugugaaguacccugagauucugcuacugaugugagcuggucagguaugggagucucuagagaaagaaaggggcuggggcuaggggucucccuuaagauuuuuguggagaugugaggggaagcugaggguggugucucggagugcucaggaggauggcuugcagaggauccugggguagguugaucucuaguaagauuuucuagaguaccagugggcaucccagagggcuggagcauccccuggaggucagcgaccacaggcugcccuggugagggagcugcccuggaacucagaccauuaaggagaaagaggagguggaagaagauggggcugaagggcugcaugguucugagacgcuuacagcuguggaaggaguauguaggaaacagucaaggccaaagcaucuagagccacgcccacccaaacgccacacccacucccagaggccacacccaccggcucccaggagguccagaucuguccagggacccuggcaaaagccaacagcaacuccuuggaggcugugggaugguaaccggucaccaaggauacaggacuucagggauucuugggagugguagugcguuuuccaguggggucccugaaaaauugggacaggaugacaccuuuucaagaucccacaaauauuagauuccaccuucagagggugucagauggccaaggggacauaggacaaccuucucccaaggcucuuaagaggccaggacugcaaaggcuuuaacaccugaggaugaugagaaugaagagcuggggcccaaacucagugggaggaggaagacuccacaguccugagaugcaaacuguugggcucugagucuaugucucugguucuuggcagaaauuggguacuuagagauuuugaauauuggggccuacaagcaggggugaaggguuacagggggaaggacaugggaucccuggaccacgggcuagaugaugucuggaucuuagaguuccagggcuuuaagaaauagggaugugagguguggacuccucaaccugauggggaugcagacaggacagugggcucacaccccuguuuacagagcuagggauccaguaacuccagugguggacuggagaugcaggagugagugaguugggaugggacagggucauccggagucaagggggcucuuaccugcucggugguaucaaagacaacagcaggugaucagcgcugaacaaagagauaggcagggagugcagccgaauggcgcuggaaggaacaggcaguagggucccagaggcacacaggugacaggugacgcaccugacccccucccuggggaauccugagagcauagcaacaggcugggauucuuaaagggacagagacauaggaucucaucgauaagguagaaaaggaaguuagaauuggaccaagcugugaucucuuugcagugaggguuuggcauggugugaugauacaggccugggaucccugcucgcagaaggcacaggcaagaggauuaugaguucaaagcaagcuugggugacuuagugagacccaggacagccugagcuacagaaacucuaaaacaaaaauaaaacccaaccagucaaauauacacacacagaacaaaacuaucaacccaacagacacaaaauccagcuggguggugguggagcacaccuuuaauccuagcacuugggagacagaggccaguggaucuggguucuaggccagccuggccuacagagcaaguuccagggcagccagggcuacacagagaaaccuugucccaaaauacaaaguaaguaaaaaugaguucuauguccucucccacuccccacucaaaucuaaggaucugagucccugguaccuuuuuagucuaaccucaccaggccauacugcucucuucagacugaagaauccaggaauccaggcuuucggaacauagaaguggggggcccugucuggaccaccuuucuguuugggauuccaaguuuggcuccucaucucuguggagguaggaauccagggccuguucccuugcccaugauacgggaagaggguguugcucuuuacccccaccccaccccucuuuaagacagucuuaauauguagcauacacaggccucaaaucugcagugguuguuucugccuccugaguguacggcaccauaggguggccuugggagcccccuugaaacaugccagguaugaaugguuggcccuaaucuucaccauacccccaugucccuuguagggagggaaagacuuuucccaguggaagcccagggccuccugugucccauuucacgguggugacuucaccuguuugcacacuaccaccgccugccucucucucugucucugucucucucugucucucuuucucucugucucucucuugucccuggcucucuccugaccagcuccuuuccacacccucucuucucagccuuccucucuuccuucuugcuuuucccuuccuaggcaucuugucuuugcccuucugucuggagguuauuucuuuucugucuuucucccuugugucccucugcucucuuuccugccucucucuuguguucucgacuugugcucugauggucccccucuccagucucuauuuuuaucccucugacacaccccuuguguccaccucucugucuguaccaccacccccccuucuucaguacuagcucugggucccaauuaguugguguuggccacggcagcgcagggccccaccaggcuucucauuaccgcuggcggcuccuaaugagcgugggguggagugaccccgcgcccccagcccggccugcgucacugccgccgcgggggcugugaggguauauaaaaggggcgugagcaua

SEQ ID NO: 3788 - RNA, 846 nt, Mus musculus
cacacacccacaagagaguggcgcagcaaagaggcgcagucgcagugcgacaggcucuuuauuaggcucagggcgcguccaguagcaacagcuucugcauguaagaguccagccagcggcggcgcuccagggcggccagcaggcgcgcgcgcucccgaaaggccgcgucgucagcuagcgccaggcugcgccgagacagggggcuacccaagcccgcccaggcacgacccggggcgcggaggcugggggaagagagaugugauugcgcgcuaggccccacaggccaccgcggguccccacugcaguccgacgcuaagcaccccugcccuccccaacuccccgcaugcgguaucuugccuuccuuuggggcgggggguccucuccucccuucuuuggguguccgggaccucacaccuaccugaacacaccagcgaggggcagggcaacaccugaggcagggccagugccccagggcacaagcaguagcagcagcaaaagcagcaacagccgcucucgggggcuccuggacaucuggcaggucuccaucaccuguggauacaggggccagaaucucaaugucaucaucccgcccagaagccuagggcccacaauccaacccugccaccagccuccuacaggacccccuaccgugcagugggcucaggcagcuaugcucacgccccuuuuauauacccucacagcccccgcggcggcagugacgcaggccgggcugggggcgcggggucacuccaccccacgcucauuaggagccgccagcgguaaugagaagccugguggggcccugcgcugccguggccaacaccaacuaauugggacccagagcua

SEQ ID NO: 3789 - RNA, 5486 nt, Mus musculus
aaaaaagccaaaaacccaaaggggauuuauuugaggugucaugugggagguggcagacagaugguguggggaggagggagccaggaagggaaggaagcugggcacaaaagucccuggccauguggggaaagugaaggcugucgauagggcagacagcuggguccccaggggaugaggccugaggcaugggcuccaagccugugaccaaccaggaaggaaacauuuccugacugcauggaggugcgugggugccgaugggugggcuggggccuagcgguaccgggccagccggucauagacgugauccagauuucuacacaggaauauugagagcgucaugaagccgagcugggaaaaaaggagauacuucaggguuggagaaagggugguacucaaagggagaggcaaagaaugggcauacauaacaucugugcgugauuggcagcguugagagcgaaagcucagcagcagucugcaaaagagaaagcucaaggcaagccuagcuaggguccuuuauucuggaggcuccgcaacagccuccgucugugccucgaccuccucagcacccacacucucggucucaaguggcuccuccucugcaucccacaaggaccagggccccagcgccauggguagcuugccuuguggagccuuggccccccaugucgggcaggcacccgccaugccccagcugccccacggggugcugcugcguccgcugccgcugcuuagaccgccccagcgcccgcugcugccuucagaguucagcccugggguaggguucgaacccucggcuccugacagcggcagcacgugcucucuagcgagagcucggcgcuguagcugcagacacagcgccaucccgcucaccugcgggagaggggaggaggcagcacugcgaguacagccauucagaguuuagagaagccaggccuccgccccaccccaugcuauugcuugauaaauaacgccuccgcuaaguaugcgcguuaccucggcaauggggaaacaucuacaauagacaaaucacucauggggacggggucaagucaccucaagaagaccgacucccagacagauucccacuauggagaugauauuguugugcagccacuucuggaggcucugcgcgcagcccuggggaugcagaagacguguaguggcugcguugcuucugcaacucacccuuaagccaagggaacccuuggaucccuuuuuagguacccaaugccuagauauccacccaggucuuauccaagccuugcccugggccagcguuccaggugccacccuuauuuagaucaugccucucacccucagaggacuccgccccuuccauaacuaccuuucuaguagcccaguccagcuuaggaucugcuggcauacuaugccccugaguaggucacgccuacauauaagggacugcccuuucagucucggucuuuuauccuggccuuacccucccaaggccugccuucugacgccacgccacguguaggucuggaacacaucaguuguccccugaacucucuccgcccccgcccaucuuucugcucuggacuccugaagcuuguguggccacacucaucucccagauucugguuuuguuuuuguuuuuuucccuacccuugguccugaagccacgccucugauuauagccgcacccuccaaacccugcccacucucuuaagauuccaccucuuaaaagucccucccaccagacggcuccagccccaggcccacacguccagagcuacuggcuaccgcuagucccaccucacgguagaugugagcuuuugcagggagugcacauaugucagcagucugccucagcuucgcccgcggccccaaccggcuuagcugggagaaaaagagcuuaucaaagacgguggagucauuggucgccguggaguuguagcaggagcagggcacaaagggcuccucagacucguucgcuuucagcaucugggccuuguuccagucccgcggagauugccagccgcagcagcgcagcugauggggaaggggacagagucaggggcccguugucaccgguguaggugugcagccaggccugcgaugauggguguguaaaugggcuggagguaugauggggccuagggacuaagaacauggcuuagagugagccugagauuuuggacggugugguugucucgggauaaguggauagggagcgggacuauaugugucuaggggcgggaguccaaaaaauagaaacguugggauugggguggagcaaccccagggucuaggaucugggaacuuaguuacaugagggcagaaaugcugccauuuggggcugcucaagcaguuuggcaaguguggggaugaggaaauaguugaccugcagcccacaggcacgcaaggcgaagcugagacguuagagcccagagccuaaggaauaguaacuaaugguuuugagacgacaggagacugugagacaggagacacgagcucacacaccuggaacugugcauagucccaacucuccucggcugcugucucauccggauucgugcgguagcucuggaucguccucaacaccaauuccugcacccuucgcuccagcugagagcauguagaugaggcugggcucagucacccugccugccccagccaccucccauggcguucaccccaggaccauaacuuugccacucuuggguuuuuuuccugauggcagugacucucuuccucagaaucucagaaguguuucuaagggacuuugggucuccauugcaucuucuuuuuaaaaauuaucauuuaaaaauaaauuuaaaauuaauuuucuguagcucacaucuggucugguacuccugaucccccugucucuaucuugaguguugggauuacagauaccaaguguugggggucgaaccaacaaacacucagccagcugaauaaaugcuaccaaguggaagucaguucgugucugucucuacccuccccucucucuccagggucucucuauguaaccucaccuguccuggaauuuauuguaugggccuaucugaccucauggagaucugccugccucuuccuucagagcaguggaauuaaaggggugugccaucacacaugacccccccuuuuuuuuuuagucgaugugaccuccuuggucuguuaugcuaauaugauucuccaccucagccuguggggauugagcacaagcaacacuacuucaccuuuccccuucagucaccacaugccucuguacuucuguguccgugugucuuucucuguguguuguucuacagcccagcuuccugguugagagcagcgcccaccugccuuucucucuccccgccccagacccuccaagccugggguaaugauguuaguaaacucacccggacccgcugaguggaaaugaggaugcccaggguaaucuguguggcaaacaggagcagcagcauuccaaaauacugaggacagaguggagggggaguucagccccucgggucucccaggggcuggcccgaaacgggggguggggaaugccacucaccaggcccaggagacagcgcagcuccuuuagagcccccacacagcccaggagagccagggccauggugaggacaccugagacagccaggaccuuggaccaagucugcaguggcacgaaggacaaaccugagguggugacaagcagugagaguggguggaggagaggacagcagcuccacucggccacccaggaaggccgugacucuuggauccccgugucccuuccucugaaucugccugggugggccucugcuucugccccacgcugaggugcuuucuccucucucucucucucucucucucucucucucucucucucucucucucucuuucucucucucucucagagaagauuucucuguguaacagcccuggccuuccuggaacucuguacucuagguggccuugaacucacagagaucugcccaccucugccucccaaguguugggacuaaagacaugugccaccaugcccagcugaauccauuucuuaaacuuuuugagggcaaagaaauaaaggaucgauuuccuggacuuuccuuuccuuuccuuuccuuuccuuuccuuuccuuuccuuuuuucuuuuuucuugagacagagucucagguaacucaggcuggccucggacucaguagccagggguaaccuggaaccuugugaucuucccaccuacaccuccccaugcuggaaugucaggugugggccaccacauauauccuagaauuguucugagcgagguucgaaugaaaacgcuguucaauucagcggucaauguggugagucugaguugcuaugguuuugguguccccuccuuaaaugguuuccuuguuauuauuacuuuauuuuugcucuuccccuuccuggcugugugacacccagcaaaagacuucccuucucugaaccucaacaagggagagucucugaguuccaguccaaaaugagacacaggaaguauuugagaaauagcuauuauuucuguuauuacuguuccuaaccgcgaccucauggugcugugguuguuuuggaggcaggaccucauuauccagccugggcuccaacccacuguguagucuaggauggccuggaacuccugaucucccaccuccugcgugcugggaugacaggcaugaccggcuacaucugcuuuacacuuccuacuuaccagcacacauccagcuuacuggcagugccaguggggugccagucagagcuggagcccuaccugggaagauaguagcuauugagggccuccccagggcgagugagauaucaggagaugccuuggggugggauucuggguucaaguccaaagacccuccccuacugcgcagccccccucacccacaaaggacacgaagcuggucuugucaaugaggauccaggugccgaagcagaaaaucaggccgccuaguaccuaggggaagagaagaaaugaggcuagggcggaucaagggccacuguggcccuggaaccccggcuggguagccaugaguagacucacaaagaagaagagguugaaaacgaagaggaaguacuugaugaggcugaggcaacucucuugggcggacaucuucgccuagauggggaaugacccacucgagaaacccagacagaagagguguuggccgcaggggggaaggggaauagugggcaaagaaagacagagacugagaggcacaaaggaaaccggcagagaaagaggaaguuccggggggguggagcuccaccccgcccuguucauuuagugacugucagcgggggcccuaucuucuucaggguuccaucgagugcacagcaguaccugaggguccuuggaauaugugggugccagggacacaauggguuccucgcagguguccauagcucaggcagggcgcacaggggcuucugauggacuuccacucacguggguccugggacuucaagguuguuucugcagaguucaaccucacagacac

SEQ ID NO: 3790 - RNA, 5486 nt, Mus musculus
gugucugugagguugaacucugcagaaacaaccuugaagucccaggacccacgugaguggaaguccaucagaagccccugugcgcccugccugagcuauggacaccugcgaggaacccauugugucccuggcacccacauauuccaaggacccucagguacugcugugcacucgauggaacccugaagaagauagggcccccgcugacagucacuaaaugaacagggcgggguggagcuccacccccccggaacuuccucuuucucugccgguuuccuuugugccucucagucucugucuuucuuugcccacuauuccccuuccccccugcggccaacaccucuucugucuggguuucucgagugggucauuccccaucuaggcgaagauguccgcccaagagaguugccucagccucaucaaguacuuccucuucguuuucaaccucuucuucuuugugagucuacucauggcuacccagccgggguuccagggccacaguggcccuugauccgcccuagccucauuucuucucuuccccuagguacuaggcggccugauuuucugcuucggcaccuggauccucauugacaagaccagcuucguguccuuugugggugaggggggcugcgcaguaggggagggucuuuggacuugaacccagaaucccaccccaaggcaucuccugauaucucacucgcccuggggaggcccucaauagcuacuaucuucccagguagggcuccagcucugacuggcaccccacuggcacugccaguaagcuggaugugugcugguaaguaggaaguguaaagcagauguagccggucaugccugucaucccagcacgcaggaggugggagaucaggaguuccaggccauccuagacuacacaguggguuggagcccaggcuggauaaugagguccugccuccaaaacaaccacagcaccaugaggucgcgguuaggaacaguaauaacagaaauaauagcuauuucucaaauacuuccugugucucauuuuggacuggaacucagagacucucccuuguugagguucagagaagggaagucuuuugcugggugucacacagccaggaaggggaagagcaaaaauaaaguaauaauaacaaggaaaccauuuaaggaggggacaccaaaaccauagcaacucagacucaccacauugaccgcugaauugaacagcguuuucauucgaaccucgcucagaacaauucuaggauauaugugguggcccacaccugacauuccagcauggggagguguaggugggaagaucacaagguuccagguuaccccuggcuacugaguccgaggccagccugaguuaccugagacucugucucaagaaaaaagaaaaaaggaaaggaaaggaaaggaaaggaaaggaaaggaaaggaaaguccaggaaaucgauccuuuauuucuuugcccucaaaaaguuuaagaaauggauucagcugggcaugguggcacaugucuuuagucccaacacuugggaggcagaggugggcagaucucugugaguucaaggccaccuagaguacagaguuccaggaaggccagggcuguuacacagagaaaucuucucugagagagagagagaaagagagagagagagagagagagagagagagagagagagagagagagagaggagaaagcaccucagcguggggcagaagcagaggcccacccaggcagauucagaggaagggacacggggauccaagagucacggccuuccuggguggccgaguggagcugcuguccucuccuccacccacucucacugcuugucaccaccucagguuuguccuucgugccacugcagacuugguccaagguccuggcugucucagguguccucaccauggcccuggcucuccugggcugugugggggcucuaaaggagcugcgcugucuccugggccuggugaguggcauuccccaccccccguuucgggccagccccugggagacccgaggggcugaacucccccuccacucuguccucaguauuuuggaaugcugcugcuccuguuugccacacagauuacccugggcauccucauuuccacucagcggguccgggugaguuuacuaacaucauuaccccaggcuuggagggucuggggcggggagagagaaaggcaggugggcgcugcucucaaccaggaagcugggcuguagaacaacacacagagaaagacacacggacacagaaguacagaggcauguggugacugaaggggaaaggugaaguaguguugcuugugcucaauccccacaggcugagguggagaaucauauuagcauaacagaccaaggaggucacaucgacuaaaaaaaaaagggggggucaugugugauggcacaccccuuuaauuccacugcucugaaggaagaggcaggcagaucuccaugaggucagauaggcccauacaauaaauuccaggacaggugagguuacauagagagacccuggagagagaggggaggguagagacagacacgaacugacuuccacuugguagcauuuauucagcuggcugaguguuuguugguucgacccccaacacuugguaucuguaaucccaacacucaagauagagacagggggaucaggaguaccagaccagaugugagcuacagaaaauuaauuuuaaauuuauuuuuaaaugauaauuuuuaaaaagaagaugcaauggagacccaaagucccuuagaaacacuucugagauucugaggaagagagucacugccaucaggaaaaaaacccaagaguggcaaaguuaugguccuggggugaacgccaugggagguggcuggggcaggcagggugacugagcccagccucaucuacaugcucucagcuggagcgaagggugcaggaauugguguugaggacgauccagagcuaccgcacgaauccggaugagacagcagccgaggagaguugggacuaugcacaguuccaggugugugagcucgugucuccugucucacagucuccugucgucucaaaaccauuaguuacuauuccuuaggcucugggcucuaacgucucagcuucgccuugcgugccugugggcugcaggucaacuauuuccucauccccacacuugccaaacugcuugagcagccccaaauggcagcauuucugcccucauguaacuaaguucccagauccuagacccugggguugcuccaccccaaucccaacguuucuauuuuuuggacucccgccccuagacacauauagucccgcucccuauccacuuaucccgagacaaccacaccguccaaaaucucaggcucacucuaagccauguucuuagucccuaggccccaucauaccuccagcccauuuacacacccaucaucgcaggccuggcugcacaccuacaccggugacaacgggccccugacucuguccccuuccccaucagcugcgcugcugcggcuggcaaucuccgcgggacuggaacaaggcccagaugcugaaagcgaacgagucugaggagcccuuugugcccugcuccugcuacaacuccacggcgaccaaugacuccaccgucuuugauaagcucuuuuucucccagcuaagccgguuggggccgcgggcgaagcugaggcagacugcugacauaugugcacucccugcaaaagcucacaucuaccgugaggugggacuagcgguagccaguagcucuggacgugugggccuggggcuggagccgucuggugggagggacuuuuaagagguggaaucuuaagagagugggcaggguuuggagggugcggcuauaaucagaggcguggcuucaggaccaaggguagggaaaaaaacaaaaacaaaaccagaaucugggagaugaguguggccacacaagcuucaggaguccagagcagaaagaugggcgggggcggagagaguucaggggacaacugauguguuccagaccuacacguggcguggcgucagaaggcaggccuugggaggguaaggccaggauaaaagaccgagacugaaagggcagucccuuauauguaggcgugaccuacucaggggcauaguaugccagcagauccuaagcuggacugggcuacuagaaagguaguuauggaaggggcggaguccucugagggugagaggcaugaucuaaauaaggguggcaccuggaacgcuggcccagggcaaggcuuggauaagaccuggguggauaucuaggcauuggguaccuaaaaagggauccaaggguucccuuggcuuaagggugaguugcagaagcaacgcagccacuacacgucuucugcauccccagggcugcgcgcagagccuccagaaguggcugcacaacaauaucaucuccauagugggaaucugucugggagucggucuucuugaggugacuugaccccguccccaugagugauuugucuauuguagauguuuccccauugccgagguaacgcgcauacuuagcggaggcguuauuuaucaagcaauagcaugggguggggcggaggccuggcuucucuaaacucugaauggcuguacucgcagugcugccuccuccccucucccgcaggugagcgggauggcgcugugucugcagcuacagcgccgagcucucgcuagagagcacgugcugccgcugucaggagccgaggguucgaacccuaccccagggcugaacucugaaggcagcagcgggcgcuggggcggucuaagcagcggcagcggacgcagcagcaccccguggggcagcuggggcauggcgggugccugcccgacauggggggccaaggcuccacaaggcaagcuacccauggcgcuggggcccugguccuugugggaugcagaggaggagccacuugagaccgagagugugggugcugaggaggucgaggcacagacggaggcuguugcggagccuccagaauaaaggacccuagcuaggcuugccuugagcuuucucuuuugcagacugcugcugagcuuucgcucucaacgcugccaaucacgcacagauguuauguaugcccauucuuugccucucccuuugaguaccacccuuucuccaacccugaaguaucuccuuuuuucccagcucggcuucaugacgcucucaauauuccuguguagaaaucuggaucacgucuaugaccggcuggcccgguaccgcuaggccccagcccacccaucggcacccacgcaccuccaugcagucaggaaauguuuccuuccugguuggucacaggcuuggagcccaugccucaggccucauccccuggggacccagcugucugcccuaucgacagccuucacuuuccccacauggccagggacuuuugugcccagcuuccuucccuuccuggcucccuccuccccacaccaucugucugccaccucccacaugacaccucaaauaaauccccuuuggguuuuuggcuuuuuu

SEQ ID NO: 3791 - RNA, 2892 nt, Mus musculus
gagcgggauccuucuuccuagugcaggcagguccuaggggcugcccuggcacccuuacuggggcccccaaaggaagcucaucaugaucuucacuguucuagcacgcuagacgauccaugcuccuggcugguggcugaagcuauaauuauugacuauagguuugccuauagcagggaaaaugcccaaauccaauugaugaggcucacagugggaaaggacugccaguggagccgcccggcuuuccguugucauggaagcguggcaugagcggcuguugcagaggcuucuauuuccuggguaccaggggauccuccaggucaggaacugcucuuugcucccaugcuaccugaaaaaucuggaaccccacagagaagaaggaaaaggcagcuuuggugucuucaccuucagggaauccuuuagaugccgcuuuccaucacaacagcgccaccugccagaugcaucugcgagcacaugcauuuggagaauggccucuaucauucucuagagauccuugcagagucaggcuggagcccagagacuuugauuucccuaucucacacccccguuucaggauuaguuaguggaaaacugacuacuacaaggcugggaacugcugaauguaaguucugugcucaagaacucaccauguccaguccucggacuauuucaggacguuuguuuauuuuuauuuauuuaugagauaaggccuugcuauguagcuaaggcuggccucuaacucaucacucuucaucuucagccacccaaaagcugggauuauaggcauacaccuucgccacacucccacaacuaggucaucucgguuuggcaugaaaaaguagcaacuaccccuuugucccuuugaauaaaaucuuagccaccuccucaccccccacauugcugguuccucaauucacagacauccuaccccuugaaugacugguugggacugugguaagggcugauguguucgcuagguggcagcauccaccagucucuguugaagguuucucuacacuaugugaccaccaccagcaacaggaauagacuggccaaaacucagcugagaagaacuggaacuccacuugccucaauucugggcucacgcagcuuaugccauuuguuaaugcguguggccacccccaggaaacuucauaucuucuugguuguguuuugcauaguaacagaccaaagcagggggagagcuauauaaaccguuugaaaauuccagguccugcugccuguuguuucuuggggcugaugugccuuuacucacugaacacccugacagagaagucgguucagucuacugaggugucgcagcccucaggggcugagggagauuauucugggcuauggaaugaauucaagggucagccugggcaacuuagugaagcuauuucaaaguuaaaauaacaacaacaaaacaacaaauaagacuggggagguaacucaggggggagauuuccugccuagguuagcugcaugagggguugggggugugacucagggguagagccccugccuagagucgcccagugagcaugaaccagacauuuaguucaguccuauguaucaaccccccacccaccacacacacacacacacuuuggucgagucauaguuuuccuuaaacucacauggcucuagaucagcaaaggacugacugggauaaauuuggccagucaccugguccacaagcuaacauguauuuguaccuaaugugaauauacaguaaaggccauauguccugcagaacugaaauuuuuuugaccuuuuaggucuuagcccguacugcuugcugaggguguucacagcuuaauaugcaagucuccaaaaacaaaguggagugacuagcuagguggaacugguaccugucuuuaaccccagcacucaggaggcagaggcaggaggaucucugugacuuugagugaguuccaggagagccagggcuguguagugaugugucgcaugacgaugcugagugggcaggugguggugaugaugucacaggugaacacgaagcucacaguggcugauggggucucuuuggaucuacugcuuccuggagucaccccaguggccucugauggguggcacagagguuggcagcacaugugacaugccccuaagauggguucuaguaacugggagcuaaagauaguggucaagggagggagagucugccauaguccuucugggggauuugggugaggccugucuccacagagaguaaaaaaguccccggggcguaaacgauauccacucccagcuuucuggacaggaaaguaggcauucucuccuuugagaaaacaccccugugugauuaacauuccuuaugaaucucucccuggugaucugugggcaaaaagaccuucgugccccagccuuaacagcacagccgggguuguucagagagagaagcaggccccuccuuucuucucccugcugcaauuuuuaagacaguucccuagucuguugcccagucuggccugcaacuuuuauaucacuuagacugcugaccucagcuucauggugaugcccacgcuuuaauaucuuuguuagguacaaaggagacuccaguucccucaaacuccaaauguccagaaacgggcucaaccuuggaguauaggaggauuucuagugguuagauaaaagccaccaacauccuccaggaacuugugaagccaggucccucuagcaaaaagugucauucccccuuccucgagcagaagggacaaauggcugucuguggugccuguuaucauacucaagcucaugccggccuccagguucucucagcaucacgaguaccuguuauccauuucagaguccagguuaguucuucucaccuccagcucacuggcuuccuuugcccggcuuaguccuucuccu

SEQ ID NO: 3792 - RNA, 3708 nt, Mus musculus
cagagggucauccaagaccugaggaagauagagaggcagagagugggagcuauaccacgacaaaagggacaaucugaaagucaaagccaaaaaggcacaaggacccaucagaggcagcugaagccagccuggucagacgcucagcugcuaaacguccccaugggcuuccaggggccaugguugcacacuugucuccuuugggccacaguggccauccugcuggucccuccaguggugacccaggaguugagaggggccggucugggccugggcaacuggaacaacaaugcaggcaucccuggguccucagaggaccuaucaacugaguuuggucaccacauccaccggggauaucaaggugagaaggacagaggccacagagaagagggugaagacuucuccagggaauauggccacaggguccaagaccacagguacccuggccgcgagguuggagaggagaaugucucugaagaggucuucagagggcauguuagacagcuccacgggcaccgggaacaugacaaugaagauuuaggagacucggcagagaaccaccuccccagacagaggagccacagccacgaagaugaggauggcauugucuccagugaguaucaccgucacguccccaggcaugcccaccauggccacggagaggaagaugaugacgaugauggaggagaggaggaggagaggguggaugugauggaggacucugaugauaaugaacaccagguccauggucaccagagccacucaaaggagagagaugaacuccaucaugcccacagccacaggcaccaaggccacagugaugaugacgaugacgauggugucucuacugagcauggacaccaagcucacagauaucaggaucaugaggaggaagacgauggggacucagaugaagacagucacacccacagaguucaaggccgagaagaugaaaaugaugaugaagacggugacucuggugaauacagacaccauacccaggaccaccaaggccacaacgaagagcaagaugacgaugaugaugaugaugaugaugaugaagauaaagaagacuccacugagcaccggcaccagacccaaggccacaggaaggaagaagaugaggaugagucagaugaagaugaucaucaugucuccaggcauggacgccaaggcuaugaagaagaagaagaugaugaugaugaugauggagaugaugacucuacugagcaugugcaucaagcccacagacacagagaccaugagcacaaagaugaugaggaugacucagaagaagacuaccaucauguccccagccauggccgccaaagccaccaaaaugaggaagaggaagaugaggcuguauccacugaacacuggcaccagucuccuagacaugcucaccaugaucuuggacgugagagugaagaagagguagcagucaaguacagccaccauguugcaagccaccguccccaaggccacaaugcugacagggaggaggacucucuagaagaacacaugaaugaagucccaggccaucaccaccacagagccuccaggggugaugaugaggacauuucuacugaguuuggccacaaggcccccagccacaggcuacaagaucaagaugaaagggcgaggcagggucacagagagccuguucagggagagauugcucaucagccccugcaacccacaggacccaguucaagagaaucaaggaaggaaggugaccacagcucucaagagggagaugaagacccagagcagaggcaagcccauagugaggaggagaaggaggaggaggaggaggaggaggaggaggaggaggaggagaaagaggggggccauagccuccccaugagccaggaagaugaugaagaggaagaaaaagaugagaaagaaagcaagguagacagggcugcaguuucagcuccacugagccaucauaggaagcagggggaggaagaggaggaggaagaggaggaggaagaggaggagauccuggaggaaaaccuacuaccuuucaccauuaucccaaacccacucgcugggagagagguggccagagaagguuccagugaagaggagagccgugaggucacagguaagugaccuggcuccacgggugaggcugggggagggaggcagagcuggccagcucgagucacuguugcccuccuguccccacaggucagcaggaugcccaggaguacgaaaauuaccagccagggucuuuguguggcuacuguucuuucugcaacguaggucccuagcccagagcugcucagcacacccuggggugccaugggggccugagagccugggagugggaggagcaaagcuggggguggggccacuggggaaauaagguuaaggucuccaggugagggucacaggguggcaggcaggugucugugugagcacucacaggucccaaacuccagugaacgggucacaugggcuugggguugucuugggaugggaaaccagggugggugguguccccagagaagagggggacucugaguucagacauggaggucaacagcugaagugauuuucucccgagggguuuggggcuaggggucccucuaaccaggcgcuuccuauucccagcgauguaccgaaugugaaagcugucacugugaugaggagaacaugggggaacacugugaccagugucaggugagaccuucccagagccccuaagcucaggucccaagcuggcagggaccaccggagugcccaaggcauaauccuguccuuacaucacuucaugccuccuucccgugugacccuccaccuggccuuagacccugggugguccuuccucgucuuugucccugacucagucccuugaccaggcucucucccuguccucagcacugucaauucugcuaccucuguccgcuggugugugacacgcucugcacuccaggugagcagcaaacagggagaggcauccacccacagagggggcggggcuagcauagugaggcacccacccacagagggggcgggcccagcaaaaugaggcacccacccacaaaggggacugcgcccaacaaagugaauccuagugggguuggagccaagccgagaugugaaccgagacuguggucugagguuaaaugggugggauaggagguguggccaugacaaaggucaugugggcagaaucugaucucucaggcuaagauugaggugauguugaugggcagcccuagaagugagugggugggaccaaaguaaauagacucugaggggcggagcugcuggaggguccaaagcaagaagggcugggauugaauuugaggcuggaauuagaagggggcugggcaccacauuuccgcacugcccugacuguuugcccauccuggaggucccucaaaccuuuucucucucugcucccucacaggaagcuacguugacuauuucuccuccucucuguaucaguaagugugugggggcugggccgggagaugaugccguucaagggacccguuuagagaaggguugacccacugugaguuaaagagacagccuggacuccauggucaggcucaguggcugcacguugacuaacuaaccuuccugcucuccuguccagagcccuggcugacauguuggagacuccagagcccugaccuggccgccuggcaagagcugcaucuauuucuuugaauaaaugugcuccuagaaaca

SEQ ID NO: 3793 - RNA, 20238 nt, Mus musculus
acuaagcaagacuuggccaguugguuuauuaguuuccagucuguauuccacagaccuuuuuaaaauuaucuccucagaaaagacuauauacuuggcauacauuugacagcuuaaggauagcuucauccucauucaucauuucugaggguuaaguccauagcuacuuggccccauauacuuagcaggaaccuguggcauugcuucucaucacaggaugagaagaaacagcacaaccccaccccauaaccauccccuaaugagcuauuuccucccaguccuaccucuuaaaaucuauccaaaugacacuagcaguuugagacagaugucaaauguggcacaugaaggcaauguuaaacaucaauuccugucucuaaugccugucacaaguuuucauugccccaagauuucuacagcaagaugcucuuaguaaaaccauaagccuaccugcaaauguggcaaacacaggaaugagugaaguucccuuucaggaccagcuaucugugcucucaugauguagaugcuucucagcucucuggugguaucuguccuugguuauauguaaagacuuauaagccuuaagcagcagauuggaguacuaucauucagcccucaaugggacuaccuucagccuuucuucaggacugugccaggcuggccccagcuuccucagggcccaccauacucaaagcucucccagcugccuuccauccagaaauguguggguaccaacugcugauggcuggcauccugccucuuugccugcuguucucucacuuaaagaugcagccuguuaugagagccagggcuucccucucacuuguaaagcagcuacagugccugggagaacagccucuacuucagguuauaacacgugcaguauaccaaagggaguugagcaguaggaaguggccuuuuggaaagacagcaagugcaguaagacaucacaugcccacuaucaacagaaaauuaauuuuauuuuuaaauccaagggaccggauuaaaaaaaaaaaucuacccucagaggcaagccaagguggaaaaggcuaggaaggcagacagcaagauuaggagcauguccacuacaggccucuucauucgggcgcugccuccaucagauauccauucucuggggccauguacccaucaccacccucugccuccauguacaugucucgaccaucacuaccuagcccuuccagcccauuguccugaccgcugccacccccaccccgggccucaucccugccccgcucacugccccgcuccccacgcuugugcucucgaucccgaucacggucucggucccgacgacguucccucucacuccggugacuacgucgccucucccggucucgaucccggcccuucuccucugggccaucagggccuucagggccaagcucuccaggaggcccaucaucaggagcuccaucaccagcuucagaggguucagccaugucgccgccgccaccaccaccacugccaccaccgccaccaccuccuccaccucgaagcuccucuuuucgcucccguucccugcgugcucgcucccggcuccgacugcuucgucgcuuucggucucgguccuuguccuugcuacgcucccuggaccgucgccgcucauccuugucucgacuccgggagcgccuccuccggucccgagagcgggagcgucuccuuucucucuccuugucucguucucggcuucuuucucugcgcucccgcucgcggucccggucccggucucuguguggaagcggggaggggcccggccuauaugagguuagcacuguguggcagggcaccccuugugacugcccuaucccaagaaaccagaugcccaaucuuaccucucaucauaucgggaagugucaucucggcccgaaugccugauauucacaucugccccaccucuucugguaccaccaaggccaccuccuacgggcaaaggaacacaaggucaguggaaacaguacaaaggggaaaaucuuaaaggggccuaugcagcugacaaaaaaacaagcaccccuacuaacugccauggggcauaaucuccugccaaucacuuccauguccacugguuguaggauagccauguuauccacaagacuuuuacaaagugcuagagcugaggacaccccaacaagaaccuucuugacucccaagcuguccaucuuaccugaggcuugagguuuuauuuaggcuaguccacuaccaauuuguacuuugagcauaaaguccaaagugugaacucauagaaaagcugaaagaagcuagguuugggauuguaccccuuuaaucucauacuuuggagcagaggcagccuggcccacagugagcuucaggucagccacuacguggugagacgaaacaaaacaaacccagaaguuggaacaccugccacaccuagauucccaggguacacuacauuuccagccuucucagcugccucgugcuccccaccuuagccauguaacauuuaccuucugaggagugagcucaccuuccuugucucuguaccuucuacuucccugucagucucaaagcaccaacucagacccugcccugcucaucacacuauagcacgcuccaacgaacuguuagaggccaucaguaccuccccaacuguucaaagaaagcacuaccacaccuccccagauucugaugugccacgaauacuucaaacuugcagauucaauacguggucuauaaaggugauuuucacccaaccaauagcacaagggagcaggugacagucuuaucuuucagacagggaucuacuaaugagccacuugccccagugacuuggcaaggagggucaugucucagaaucccaucugccuguggugguuuccugcaccauccaccugaagguuuagugagguggggcuguguuucacacaggagcacaggcaaagcgaagaggucagccacaugcuaggcuguuaaacuagguauagauaacagguuggacuacugcaaagcaggacccagacuuccagcugcuggaucacagucuaacaaugagcuaggccauuaucaauacaagaaaaugucuauaguaagaguucuguaauuuggguugcuuaaaaaaaacaaaacaaaacaaacaaacaaaaaaaacaggaaacagcugcgcagugguggcgcacgccuuuaaucccagcacucgggaggcagaggcaggcagauuucugaggccagccuggucuacagagugaguuccaggacagccaggcuacauagagaaacccuaucucgaaaaaaccaaaaaaacccacagaaauauuauaagaacauguuuuuguuuucaucccaggugugggcauaugggacugcuuugaaucagcggguuugcuucaugccuauaagaggcaugguuuugccagcugcggauaguuacugugauuguguggcauuuggaauucugagaacuuuucagaggguauacgcauccuggauuguacaagaggguagguuguugguuucuuaaguagucagguacaaauaagagacaacaagaagaaauuacauauccuaauggugaagaucaaacuugccccaaggaacucaaugccccuaaucugcagguagucuccuuuucaauccgauuguauucaggggucucuuuccacuccucucuauucuuuucccccuccucucuuauguauuacagagaugaaaggguggaagaauaggguugaaaaaagaacccacaaaguggccaaagacagcuacaaugucaacaguuuucaaaauaaacacucacuuccugcacccuaaguagacuccgucccuccaucacucuucauaucuaacugucacaagucuaaaagcaacagaaauaguuaacucagucugaaacuucagaaacugagagaaaacaaacaucuuguucauuaaagguugaggcaggaggaucaccaagagccugaggcuacccugggcuucacaguuaagaccauaucucagauccucacacaaauaguaacaaauaccuuuaugcacaugggcaaaaaugcugcccaaagucucaccuaggcuaagugucuguccaugggagugaagcgggcucauaccuuacuauauuaauaucaacaaaucuguaaccacaacaacugucuuguuucugagacuucauucagcacagcagucagccuaaaggauccaccuuuuuuaaaaaagaaaaaaggggcuggagagauggcucagugguuaagaacauugacugcucuuccgaaaguccugaguucaaaucccagcaaccacaugguggcucacaaccaucuguaaugagaucugacgcccucuucuggagugucugaagucagcuacaguguacuuacauauaacaauaaauaaaucuuuaaaauaaauaaauaaauaaauaaauaaauaaaagacuuggaggucccuggggguugggaugguaggucaccucugcacaggugcacaggugaaagcagagccaggcaauacugccuaagacagagugaagcuacucacacaaaagaccuaaacccagccagggccuaauuugaggcaucagcaaauagcuuagagagugacaccuguugacagagugagcagcaaacucuccaaguccagucucaaggucuuggugaggaucuauugaugauaucacaaucaugggacugaaacaagagccuggcaucaguaggcaccucuauuccuuaugcuuuaagacccucagauauauuucaagacuugccacaacaacccccauggagacagcccacaaccaccagaaaggccaggagggucagaugcaaggucagagcacaggcugcugcuuucuugcuucagaugugaagccaggaauugggcuggugacucagcuagagagugaaugaagaagccacucagugagagcaagagcaaagcuagagccagugauacccuccaacccagcccaugauaccaaguauaugggcauaagguggcugaggucagugcugaaguuacccacacugcacaagaacugcugcuggucaaucacucaugcaggaaagaccaggguaugcuugggugcucauguguaggugucugugugcaccaguguccaaagccaugaagaugaugagaagacaagcuggaaauggagaggaacaggcguauggguuggggagacugaaggaagaauaaucucuaaucacaggcccaggcacccagaaggaauacugcacucaccuaggcgccggggccuccagcccuucacaguccggccccucuccacauccacgaggacccuccugccaucuaucuucuugccaucugcgugcuuguaagcggcugcaacagaugugggggagggggaauuccccagaagguccucuagucagacaaggcuccauacaacagcaucccugccccucaaaccccaucugcacacauacacucacacucccaccagucagccaggcaaccaacagccagaccgcccucuccccacccugaagggccugcuccauccggugcuugauuccuuuuuggcacccccaagugcuauuggggggguaaaacauuuacucuggccucccccagcuuucacaugauggagcagcccccuccugccagggcggccaaauugcugcaaagaaacuggagguuagcugaaugcuggccucugcuguggggagggcuccuccacacccaggcaugcacccuagacaccaugcugggcaggaggcuggcuaggcuccuccacacccaggcaugcacccuagacaccaugcugaggcaggaggcccacugggccccaccacauccagaccacaccagauuauuuuuuuguuuuuuuguuuuuguuuuucuguguguuuuuauaggggaggucagugugaggaaagagacaucagaacagaaaugaacaggaguggaaagaccuucaggaacuggcagggauauaggugggugcugagcuccccagggaccuccaaggacccuggcuggacucaaagggacauguaccgugcuacucaaaaucccugccuuaccugagccgacugacccugccaccaccuagccuggccagcucuguccuccaagccgaggucaauggccagcagggcaugcagcccugccugaacccucagggaaguugaggagcauaagacauagugggaaggcccagagcccaggccugugaucaggcagggcuguuaagaaggccaaaaagucccuguccaggucccagcccuggccuaaggggcugugcucaccaaccacaauacccugccccaccccugcccacucccccccaauaacaaccagaggaagagaaaaaggugccauuuaccgaugccggccuugcggguguccaaaccgagcgggauggggggggccggcaacuccugggggccuggcgaggaggcgggcuucccgggggugggguggggguugggacacgggacugcuuaccuggagaccccaagcuuaccugaacacucacacaaccccacacccaccaccacaggggcaacuaaagcuacagggaacccugagagggagacacuacauuucccacaucaucuagagacaaguggaugaaggaaaaaagggagccucugaaugucagaggaauguuugcgcccgggcugggagaccuggaucuaucuauccugcccaaccuaaacagugggccucaaggccucaaaagcaccuacugcucaccacugccucaguuacgcuccacuagguacaggcccagcacucaguccuggggucaggcuuuccaccuggauccauaugcccucccacuaguggcaacaggccugaggccaguacacaggggauacaccugggauccaaaagaaugcuccccaugcuccaggaggggccgaucggccccuaaccccagaacagcuugagagggucagucaauacaggaacccugcucagguuccccaucccaaaccccgggagagguccaacccagaaaacagcaagaccauguaauugugucauucuaggcuucucucucucucuuucccucucuuccaccucugugcagauuuaguaaaaacuaccacaccuuuaguuguuuuaaagccugcuccaccccucccauacccugaaccccaauccaugcacuuuggggagcucaggcacuggacaucacagcugccuucuaaggagacucccaccacaccaaggaagacaggagggacacaauaccccaagcuagaaaccagagacuuuccaagaccacuauggugacaacuccacagaagucauagggcagggaggguugggcugaagggcuccacauagagcccuggucccaggacaccccagcuuuaggguugccaauaugacccaggugucagaggcuggguggagcccgacuauagauggaggcaaaugccuuucccaucgagguccacccuuccccuugggaucagcgagauuaccagagagcauguggaugggggcaagaggggcaaagggcacccaaaugaggagagggcugugggugaagggauacugaaaggugacuagggugggaagggaagccucacuguuccuaagcugccuggcuaagcugggcuggugugcggugcugugaucuuacccaugauacaaacccuuauaccaaccauacacugagguguuguaaggggagcguaagcaucagcugcaagccagcugcgugguggcugcagugacaauaagaacagucaauuaauacggcggccccuggacacgccgcagcccugcccacccccacccacccagcccuacccaaauggacgccgccgcauagccucaauggggcuuuguagcugugggggugggugcuaaacaugcccaccauuucacugcuugaugaggacuggguggagguuggaguggggagguggagggucggguggcccagcccaguucuacuggggggaagagagggcugguucaaaggccagcucacuccaaccuaguggcccccaccuccagugggggccuaauggggagaagcucccccaaauccgaccccuccccccaccuccagcuggccccauacccuacccagugcucuccuggccccugagguucaacgugugacacuuaccucccugggcucacacacacguugugggggauuuguuuuugauuuuuaaaaaacacauauauaaauauauaaaaaaaagauauaucagaaacagagggagaagagacaauucuaaagucagguauggcaggggagggaacagacgucgggggugaggccgggcagcagagguagagggucagaaggaagggcagaggcacaguacucacagugcaugucucguucaugcucauacucgaugaaggcauaaccacgggguuuuccagagcguuuacuguauaccauguggaucugcagggcaggcaggaggcagucagcuccacaaguuacagggcugccccacccacccugucacauaacuuauaacacaggccuuggacugggggacaccauuaacaaaguuauccuucaaacgucccaagggacucacucucacucuaguaaaagucagaguccaguggaaaccagaggggcacagaggcaacaugugggagacccagcauccuauaaagcaggcuaggauggagaaggcuguggauacagcucuauggaaacugagcauucugaugguggauauccccaggaggcuacaaggcagacaggcauuaagugcacccaaagcaagccaggugugaagaaugaacaagguaaacagaauaaagggccacugcggauagcccacgugcagagccugucugccgugugcaagcaaagcccaauauauggcaaggcaaggagacuaagaggagccagugcacuuaagagccucuguaggacagaacagggaugagggagccugugaccaaauaggccauguaaggucaggaugaagcuucugagcccucucuccauaugucagggacauagaggcuuaagcacugagaaacgggauucacaaagaaaugcugggacacgggagguagagcauaacaguaagacuucugggagauaacacuauuugcuugggcuacggaggaaugacuggccuucuaugcacaucacuaucugcccacacuuggauggacauggucuuaagcuugcucaggaacccuaggacuuuaacucuacaaccugaacucuucaaaagccaacugagauuccaagcugauaugacagagccagguuccacugggcuuuggggagugggaggcaacauuuccugagacccaggauucaggaaaaggucagacagcccagccaaugucucgccccaggcuuguguccgucacgagcgccaggucuuacuuugucucccagcagagaaaaauaagacacagagcaguuaaguuuuaugccaaaacuuugcucagcaacuaucuuucuugcuuuuuuguacaaaccugucuguggcccuggcuagucuuaaccuuauacaaauguuacugacucagucucuccagggcgaggauuacagcuaugagccaccauauuuaaaguuagcauguuuucuuuuauuucuuuuauucuguccaguauuuccuaucuuaaauaauuucuugagauuauaauuacuuuauuuucucccuccaaacccucucauguucuuucaaauucauugcuucuuucuaauuuuuaauugcugguacagaugugugacugugcaucccuaaauacaacuugcucgguccacgaacaccugcacauauguuuucagggcugaccauuugguacuggauaaccauuagugucuuuuccuaguucccuucuguuucuccuguguuccauagcucgagacugcuccccaacauccccaacccccguuggagacagauuuuacuaaccuugguuauucugaacuuggauguagaccaagcuggccuagaacucaaaagagcugcaccugccucuaagcuccugagugcugggauuaaaggaauguguauccuggcagcaugucuccagcaaagggucagaagcaaguaccucagacucagggccacauagcagauuacaugaaaacuaaccaguuuccuuaacuaucaguaaguucaaggccaguuuggagaacucagcaacacauuucaaaguaaaacugggaggaacuggauaaauggcuccucagagcaccugccguucuugcugaaauccuaguuccauuuguaccauccacaggacggcugaacaacagucuauacagaacuacagcuccaggcggagggaggacacugugugcacuugguacacacacacaaguaaaucuuaaacccaaaaaaaaaaaaaaaaaaaaaaaaaaaaggaaaaaaggaaagaaaaaaagaggccuauuuggacuagucagucccugucuuaaauaaaugggggaaaaaaaaucugugaaggggcuggggaauguggcuuaguugguagaauaauaacccaacaugcaugaagcccuguauucaaucccuaaaacaucaaaacaucaaaauuuaaggccauccucucuaugaugaacucaaggccagccuggacuaugugggacaauccuaaaagauaagaggcagugaaauggccaaguuugaucucuaggaucauacccaggaagaaaauccgcuuuacagauugcuccacacaggacaauccuauccuccuucccaauguaaucaauaaggcagugcagaggacccaaguucgguuccuaacaucuacauggcagcucagucauguguaauuccagauccaggggauccaaugcccccuucugggcuccaaggacacugcacucaugugacuacacauauacacaggcugucaggaacauaaaagaaaccuuuaauuuaaaacagacuucuaaagaaauaggucagugguuaagagcauuugauacucuugaagugggcaugggcuugcuuccccucacccacaugguagcuuacaaucaauccuguguaacccguuccaggcaauuuagcaaucuacucuggauuccuugugcaccaggcaccaguguauuaauacacuuagaugcacgcaggcaaaggacacucacauacauaaaacaaagaaucuuuaaaucuauaaugcagcaauaauagaagaacuggggauauagguaaagugcuugcuuagcauauauacaucuacccugggcuuaagcccuaauccugggggcagaauagaaagaaauaacuaauuuaggaggucuugggcaauaauuugcauuaaguuuuagacaaauacaaauuauuuaaaaaaaaaaaaaaaaaaucgccgggcagugguggugcaugccuuuaaucccagcacuugggaggcagaggcaggcggauuucugaguucgaggccaaccuggucuacaaagugaguuccaggacugccagggcuauacagagaaacccugucucaaaaaaccaaaaaaaaaaaaaaaaaaaaaaaucaaccaacugaccaaguacccaaacacaaccuaaccuuagugggccugacugacugcacacauaccaacuuacagcaagcugaaccuugcaaacccacgcuuuaaauccacaaggacucaccauuuccaaugcuacuucugacauuaaagcuauacuaauaaaggaaauaaauuaaacccaggcccagaugugaccuuccccugggauggggacccagcauucuuucucuccuuaggcuacuguucccuccuccaaguucccccaacucaacucuccagcuggacacacuuacucuuuugauggguccauacaccucaaacucucuccgaagcuuagauucuguugugucauaguucuacaagacauaaagcggaguuauaugagaagcacacuguucuaaagcccuugaaccacucaggacaggaacugaguacucaccacucuagccacgaacagagucuugaaggcaucgcccugagcauugggaucauugugaggguccccuguacaaggagaagaaaaucuuuaaaguagacagugcucacaauuuuggguagaagagugaugggaagagacugaauacaugaagauggaaccuagugccccacccccaccccagaaaagcucagugacuuaguaagcgugaguacauguuucaggucugguuucacuaaaguucaauggcuuuuucuagauugauugacagaugacgacaacaggcugcucugauaaaaaugacgucaaaccgauggcugugacaaaccuaaaagccacuuuagaacuauauacuuuggcuagccauaugcagugcaaggugaacugagcaguaacugaauucaugcaaucucucuggagggaugacuugagcuagcuuguggcaaacugacugaaaccaaagcacagggagaagccugauagcaaacagucucagaccucagacuaggaaccagagucuaggauagguggggugugauggccuauguacuaagggggcagaacucagcuuggccuacauagugaaacccugucucaaaaaggaaggaagacaguuaaggauacauuuucucuuccauacccuauagucuaaagcagggacccugggcuagugcuaaaagcaaaugaccaagaucaacugguacagagaacuaucaaaacccuguuccguuuggacaccaaguauuaagucuucagaaaaagaccaagaaucuauuaagcaauccuaauggggugugggguuacuggaagcuauaccccagugcuacacauucugugaccaucuuauuagcuguccuggcucucucauucauuuaauccuuagaauauagcugcaagugucaaauaaaagagaucauagaagagauagaaaaaguuuaagugggaaaaaggcgaaugcuaagauuuugaggacagccugaacuacagaaugcaaugcugaaaauuuuaaaauaaggggggaggggcacacaggggaagcuaaagagauggcucagcaguuagcugcucuuccagagguccugaguucaaugcccagcaacuacauagugguucacaaccaccuguaauggaaucuagaugcccucuucuaguguacauaaauaaaucuuuaaaaaaguaaaauaaagaucuuggccuuucucaagaucauagcaauuuagaagaauaucaggcaugccuagggucuuugagccagaaaguaggacuauuuuuucugccucccauuggcagccaaagcaaugccuauacuuaagcagucuagucaaaugguccuuguuacagauugcuuaucauauggacacaucacaggcauugauauuuugcagguuucuucaguuaucaguugugacuuuacuaccaacaggcaaacuagauccaaagaaucagccaugauggugguccuuucuaucauaagggcauggcuguuaauacagugacagaagagagcucuucaagacauuaagacuuucaacugcaccucuacucaagagaugccccucaacauugccgaccucaucccaggaguugucccacuaacugucccgaggcaggguucaauccuaggguccccuuuuccuuucucuuuacagucagugccuaagugugcaugugugucaagguugaacuuaggacucgcuugucaggacccuaacacagaacuagacacaggaagccucaaagcuagaaaacuucacuaggcuucccguuaguuggcacgaaaucucaaaacuuccccuuuuuauaagauacucuacaacucgacaaggcaagccuacuuguuuuucauuuugcaaacaggaauaaucauuccugcugcacacagaagucaccaggaguucauaacaugaaggacuucaagugcucagcaaagggauucuccuuuaauagaagcggucuuuugacaggggacagcaagcuucuacagucagugagcacagacagauacccuacugcacgugauccauccucuguucuauuuuggacaguacaaugaaccugcuucaauuaccaacauggggccuaacuugguugaucucuacauuccccaaucuaacuugggaauuucagucacaucucagagcuugcuauguugaucuucaauacauuucaauaaauugaaaccacaauaccaucguuaaugacuaauuucuaacuucaucuacaaucccucaacuggggcuuuaucagaaugauacuuaaauacaccacacauuuaaacuccaauccaaucaaacucaauguuuugcuugguugaugaguccccuucugcuaccccuuuuuguuuaagauaagguuucucccacuuucuucaacuggugcaaggcacaccuggaucagcagaacgagacuagcauuaugcugaggguaggagggagaaaugaguacuugucuuuagaaagcuccuuaagaaaauuugggcuggggagacaagugaacaagacagacacaauacuaaagcacugucuaagcuaagagggcccuggacaugaaacuucuugcuuuaugacauuuagcaaguaacagggacaagucuuugugacaagcugggcggaaaaaauaaaugguauugggauggcuaaucuuaguugacaacuuucauuaaucuggaaucaacuaaaacccagaagccggacaugccuuugaggacuucugaauuuaaucauuugagguaagaaaacccaacuuaaaucugggucauacuuuuuguuggcaaccuucacaaaaccaugaaugaaggaagcuuucuaccugccugccugcccaccccgagucuccugccaggcguauccacccugaugcugaggcauucuuucacugguauuagagccuacuucuucaggauuccaacauagacuuuacaauuaacaaauucuuagccuuccuguugaaaaaagucauuguuugacuagccagaccacagccuguaagacagacagacacagacacacacaccauuucuaucagugcuguuccuuuagagaacccuagcucaggugcaaaagacaaacugaguaacaacauauggaaacaccuugcacaucugaaaagccaugucuuagggaagacaaaaucccauagaaauuaggagaggugcuuugaugguuugaauaugggaguaugagauaucugagaaaacacacagacucaguacaguacaagagcuagagcuucgugcauuaucuuaucgugugcacuaaguacucuugagaaaaucucuaaguucuaaaauacaguuuagaaaagaaugauucaacaaggcuacagacaauagauggagauaaaccucauccucugaugagucuucuaccuaccaagaucugauacuuuugugagucugauuaccaaguacuacuuaaauccuccauaucuggaggguguagcaucuccaauuccaagaucagagaacuagggaaacagucaggaccaaccagccagaucaccucauaccuuaccugaaaacacaguggaauauggucuuuuaaaagucucccacauguuaaaagccuaaaccaacuggagauggcaagauggcucaacaguuaagagcacugguugcucuuccagaaggcuggaguuugauucccagcugcugcaaaacaagucauaacuguccaacugcaguuacagggaauucuaugcccuuuucuaauacucucauacauauauaagaaaaauuaauaaaacauacaagaaauguaaaaaggggggcuggagagaugguucaacagguaagaguacugaaugcucuuccgaaggucuugaguucaaaucccaguaaccacaugguggcucacaaccauccguaaugaguucugacacacucuucuggggugugugaagacagauacaguguaccuguauacauaaaauaaauaaaucuuuuuuuuuuuaaagaaagaaaugggggcuggagagauggcucagugguuaagagcgccgacugcucuucugaagguccagaguucaaaucccagcaaccacaugguggcucacaaccauccguaacgaaaucugaugcccucuucuggagugucugaagacagcuacaguguacuuacauauaauaaauaaauaaauaaauaaaucuuaaaaaaaauguaaaaaggaaacccugguguuguuauaauuucugaccccaauaagcugguauacaauccaguucuuauaauuauaagcuauaagccuagaucaggcagaccuaacacuacacuaacuuguuccccagguuuaagaccccucacuacuggcaauauauggcucugcuccaucauagcuuccuccucuucuucaguccucguccucuuuuccucucuaccugcccccaccgucaaagaccucccaucccaccuuucuccucaacugcccaaucacaggcucuagccuuuacugacuaguuaaagcuggggagaagguucacaagagaucaauugcuuguaggggaaaaagaauuaacaucaaaauacaaaucaccaggacaacccacaaaggccaauccaagugcagugcaagugguugcuaggaaagugaccccaacucugcuucucaagcucccaagagaagagccccacaagugaccugggaagaggaugaaaaugagacugaaggggaagauugcuaggagggagaaccuuacacauuuucagcucugucuccacuuccugcugucgccguucaauuuuuucccgucucugccaguagaaaaaagaaguaaaguaaguguacccagaaguaucuucauuucagggaccaucuggaaaaaaguagcuaaaaaaauacaacaagccaacccaaaagacucagagguaaaaacagcauaccuuucucuccaugcguucuucccggguuucugcucuuguuggaggaggagcaucucgaggguccuagaaacaagaaaggugacagggaaggaaugcugauggaauagcaaggcguaccacaacaaagacucucucauacaccuucccaacacaaaugccagaaguucccuauaaaggggaggagugguccagauuggguauacuccaaggaccaaugcugaccaggcugccgcacaccugcggcauagucacagagacaccuccaguguucagaaacuucugcccaguccaaguaacuuuaugucuacuacgcauaauuuuuaaaaaaccaacaaacaaacaaaccugucugauuuuugaaggucuuuaaaaaaaaaauaaacagaaacaauuucuuuguauuuaccaaaagcaucaauuucugggcaaugguagcacacaccuuuaccagcacuugagagaacuggcaggcugaucucugaaugggaguccagccuggucuacagagcaagcucaggacaggguaaaaaaaaaaaaaagaacaucagucuaaaugccuauagccauuugacaugauguagaugucauagcuguaaaauauaauaccaaagcugcauaguuccuuccauagccaagaauccugucacuuuccacaguuccaaauaugauuuacagacagccaaaagcuagaaauaugccugaaauaaugguggacagggcagaccuccaaagcaagacaaucugcaaagacauagcaagucauaaaaugauaccucuccaggcuaucauuaaaugcuaauuggcacaugaccugcaaaaaggguaccccugagcuauauccauuaaauuaaauauuuauuguauaauaacauuucucaaguagagguuuaccaagguaggcagacaaauauuacuaaagaaucaccuuucuguuaucuaguaaauucugcuuuuccuacucaauaucagaauguuccuccuaagacuugugguuauauggcaguauuccuuagguuugcucugaaggugggcaugacaaacuuucugcauaaaagaacugacuccaagaagcucaagugacucagauuaagucauauguacucagcaaguagagccaaaccccuagcucccagcugugagcacugcaagaugcuauaguguucagcacuaguaaacacuauccucuucuaaaaauaaccuuacuuuuacauuauuuauuuaucuguuuguuuauuuagcuaaggauguaugugcguaucacugugcacauagagaucagaggacagcaugcuagagcauacccucuccuuccauauuguggauucuaggaacagaacucggauuucuuggcagcaaucaccuuuuacugcuaaaucauauugucuacgcaaccuuguccucuuaaagacaaaaaaacaguaacuacauugacaagcauugauauuuacugccuuauuccaaacccuuuaacauaaauucugugacucagcucucuacugguuucaucuuacugcuaccucuugcuaaaggccaaccuaaccaaugcguuaaacauuauguuuucuggguuaguggcagauacuuauaauucuaacucuuugaguacaguaagcaucaagaguucaaguuuagccuuagugacaaggagaaaucuacaagaccaugaaagaauguauuccccccaccccccagccaaagagucaaaacaacaacaacccacaaacaaaacaaaaucgacagagguggaucaccuaacccuggagaggcaaaggcaagcagaucucuugaguuugaggccagccuggucuacagagugaguuccagaacagccagggcuacacagagaaacccugucuggggacuuaggagucaggguggagacacaauugccaauguaaccaauuuggccaaucacuugggcuagggacuaccacauccauacaaaagauauucuuaacccuacaaggaaaugagccgcuccuggaagcacacacccauuacaugcagcauuuacaugacugagaaaggacugccauaagaucuaagcuacacagcaaaaccguaucucaaaacucaacgaaaagagguuagcacuaugguucugcaggcuaaggcucuugcagccacgccugacaaccuaggcuucaucucuuggacccacaagauggagagaauggccucuuucaagcuguccuccgacauucacagauuugcacauacacccacauauacaaaaguauaauuaaaaaaauuaaaaugcacacaaaagcacaaaacaugaucagaaaacguaaaagccacaugugugaaccacacaacuaaaacuguuuugaagccgaaugccucaggguagccugccccauccagagcuaaacccucccucccaacaugcucaccucaaacucucggauguauggugcaaugccacaguaagguugguuaugguguuuuucauguggcagcuuuuccagggguggcagguaugggaugggaucucggggugcaaaaagggccagaagguugggaggcagaaacugugucaucuugccaaaucuaagaccagaaacguuauguuagcauacuuuacuuagcacugcuuucuuuuaggcccccuucacccaaaacaaacaaacaaacaaacaaacaggugugagauuuggagacggaugcugcuauccuggucaagggagugaccaacaucugcuugaagaaaagcucuugguaagagcugaaaaacuuaaggcugguaacagaaaacaaaggggaaaaggaguaggaggugugggacccaggucgaagccucgcgcucuagagguugcucgcuucauaccuuuaagauuaugaaguagggauuucaagggaggccauaaggauaauauccaggaagccaggggccucugcguaaaauaucuaggagccgagagacgaaaggaauuauggguagagguccaggaugcgaccaaaaaaaaaaaaaaaaaaaaaggcgagaaaaaaaggcaacacacaaaccgcaagggccuguggguaggggaccgcaggagauugggggagggggauccugagggaaagaaggcuggagugcccagagaacucuggguaaaggaugggggacgcagagggagaagucaaaggcacuaacccgggaaacgggccacagcagcggggaaaggguucgggaaccccgcaagggcuuguggguagcggccccacuccccguuaaggccucucauucacccacucacucaccgcgcggcgcucuccucagccugacguuagccucaggccucgcggccgcccuucacaaacaaaaacucccgcuccgacuuccacuucggcggcgcccgcgucagguagcuucggugguccgcgcagcgcgcgcaaaccagaccucuccucacaacccgcgcggccucagcucgcgaccagaacugggaguggagacgacucgaaucccuccgccuuucgcaaugcgcaugcgccg

SEQ ID NO: 3794 - RNA, 1359 nt, Mus musculus
caguagcagcggcuacgggcgcgagccccgggucaucgcggucgucgcggaagucuggcagugucucgaggcaaaagaccacgauggagaccaggaugacgaguacggagaccacggcgagcacgcgcgcagccugcgagcucucaggaaauucgaagagcagccagagcugacgcgcaaaggcgcggcggggcagcggccgcucgggcggcaccgcgcagcccucguccucccgcagccgcgccagcgccgccgcgcccagcccguagaaggacaccuccuccaggaagacgucgaggggcacgugcgccggccgucucagccggccgcccgacugguaguaguagagcaccgcaucgaagcugggccggugucggucgaagaaauacucgcggcgcgcgccgucguagaagcggcugcggcgcaccgggucccccagcagcguguccgggaagcggccgagcgugcgcgcgcgggucucgaagcgcaacccggccacguugagcaccagccgcucgcagcagccgcagggcggcgggcaccguggcuccauggcgcgcacagcccgggcgaccggugaacggacguguggccccgacgccgcagccaccccagucggguguccggugucggcggguaaaaauagcauggaaaguccggccagggcgcgggggagggggcgguguuacccccgcggggcuaggggcgcccucugccguucccacaccuguggaaacacugccacccggcgcuuuuccguggaucucuugagcuuucccuuguagucaucuauuuuauuuguuuggcuuuuggauucaugacccgaggucuuauguagcugaacugaccuugaauuuaugauccuccugccuccaccucccaaaugcugggauugcaggcguauggcaucauggcuauuuauuuguuuguuuguuauuuagacagucuccucagccugucauuuaagcugaccgcgaacuuguggcaauccucugccucauccuucggauugcccgggugacagucaugagccacccgagacuaucugcagcaucaguuucccuuuuccauuuccagucuuucugucucuuguccauccuccuggagggugggggguguauccccuuaaccaguuguccacaucuugcucucugcugggagccucuguaucucucugccuuuuauuauuuuuuuccagacacuggguuuggguauguaugucagacuggcucaguauugcaguacucuugcuucugccucccgauugcugggaugacagauguguaccaccacaucuggauuuguugcuggcuuucuuucucuccuaguaccuuucaaugaaugaacaucguuuugugu

SEQ ID NO: 3795 - RNA, 4829 nt, Mus musculus
gggacgcucagccuucauggaaaagagcugucuggaaacuguuaccccgaggugggcaggccuggcaaugcgagagccagggacccuaugggaaaggggcguuuaguuccucuccccgagucagccugucugucucugugucugcuguauucccucaccucaccucccguuuccuuucuccuccucuguugggagucuccacccuucccuacuuuucuguuuccucuccgacccuccucucuaaaaguccuaguuggggguuccccuagcccuccacacgccauuggcuggguucagagugggcagguucuguuaccaggggcaacggucacaacaagccgguuucuuggcuucccagagaaggugaggaccauggcaggucgaacccuagcucuucgauaugggcccccuuggucucccauuucugaaacugagguacuuggaaccuggcccaacuggcaucucaccagcagcgggguugcccaccacuggaucccaccggcguccuuuccucugccuacucuccaggugagaggguggagggugagauagggaaagggggcagcucacaaacuugugugccaggaggaaagaagacuaggguuagguuccugucugaagguggaggggucugggagccuggauaccaggaguuggaggaaggaaaggggaugguuucgugggucuuuuggcugaucuaugcgccuucacaucagucuauggucaaggcaccccugccugcagucucgaaagucaucagcagaugggaaaccaccucacagucuacauacacccccaagacacaugguggccccugugcucagcccaaggcaccagagcacaaggaccccaggcggacacuuggcaucaagucuuuggcagaaaagguaggguucugggauccagaaaucugggggugagaagguuggacauuggagccccugcucccuuaccuugaaucuuugggcucccuucuuguagcuaagaagacaugagggacggggugucccccugaacacaaaaugccagaucagugagacgaaggcacaguacaagggcuggccagauguggaucagagugccccccucuuugcagagccccagcccccagagcucgcugaccaccaucgcgggggaccuucucagguagagccggcuacaccggcaccgugggaaggcacaccggcacugcaggaaggagccugggcugucuagguuagggaggagacugagccucugggcuggaggaagcuugcauucuaugggguaguuauaugguauggaagugggggucaggguacugaaucuugaacuguggggagagagagagcuggaaggucuggaaguugccucuuggggcugugggcugcuggugcagugagcuaagcuaguuagguaguugcuccccagagcugcacuacaauacucugagaaguuugguuagcagaugguagguuuacucagcaagaagcagucagguaggauugucauccaagauuacuuaauauccagagucaggguaacuguuuugacuaggggaggggggggggacuagaaaggaguguggcugcagccagaguuugguuucuuggccacuaaguguuuggauagggugcaggguuuaaggcacuaagacuaguguggagguggggaagggcuuugaacaggguacacagucuuucuuguucacuaccuuucccaauauuucucaggcccucauccccuggacgaagaacccugagauggcuggccaacccuucacagugaacaagaugggcauccuggaucggcuucaacccuaucagaccauuacugcaagugacuucacaaggugagccugugcccagcaggcgcuggugaguaaaccccucuccuugggaguuccagcuguguaugcagaaaccacagaacugacccaagcugaacucuucagauccucagagccucuuccaaggcagcaacaaaccaguucuagacccccuugaguccccuggaaucugaacucugcugcacuuggaccuccucaccugcugccccgcccacaggaacgugucuggauauccccaccagaaaccggugaugggccugagcuggccgaggaaggcaucccaccgggaucgggcaaguuuaccgagggugcgcccagcccggccacgcccaucgcagccguaccugggagcccugucucugacccgggaguccuacggacccuuggugcacccgcucuguggaauggaccgaauuugcccaguacaugcaucguggggcagcccccaucggaagccagugcugggccuuuacaguguacccaaggccuacugcacugagaauucccgcuaugggagugccagggcggagcugcugugagccggugaagcccacccaccacgcaaacuccaucauuggacuugugggcgggccaacccggacacaccccuuacuuccagaguuccuccaggcgcaauuuacugaucaagaaguuuuauagcugaaaccacaccuauuuuuggacccaauccaggcauccugauuaggggcugggagacgguggugcaccaccucugguuggauugaaagcaaauuuggaggcccacucgucagaaccuaagguugaagcugugcccuccuauuuaguuguacccaaccaucagagugggucugauggacguuuacuccagcaaucuggggguucagcgagcagccugcaguggccuccccuuuaccuuguuucccgugcuuccaaugucagcuaagcccugacaccugggccgagugugaggccaauucacugggacacuggagcuagucccuggcuucccugaccuugucugugucucgcccccaaagagauuagugucuagguuacccaagccuguagccacuacuuaguggccuugccacccccacaacccgcagguauaaagccaggugcccaagguagggaagguaucaagaauggagaggcuccagguaagaugguagggcccaggguacuucccaaucccaccaaacccauagauggacagccuugugaccuggggguuggaggagggagaggagggggucuccuagcugguggacuucaaacaggagauaaacagauuucauggcuggugaugggucuugaaggacaguuucuguauuauacugagugggugcagaaccugggauggaaaaaccaggucagggguagagugagacacuggcuaugucccaggggcugcugcuguggcugcugcugagcccaaguguggugugggccuccaggggcccccuucggccacugugccggccugucaacgcaacucuggccgcagagaaugaguucugcccagucugcaucaccuucaccaccagcaucugugccggcuacuguccuagcauggugagcgggccaaauggggugggguacagcgagacggcuccugggcagggaucauagcuacugugggggucugaagggccgggugggcauuccaccuagagcggggcuggggcagggacacucagaagagggcuuuuuccaccccgcacucagguccgaguacugccggcugcuuugccuccugugccucagccagugugcaccuaccgggagcugcgcuucgcaucuguccgccucccuggcugcccaccggguguagaccccauagucuccuuuccuguagcccucagcugccgcugugggcccugccggcucaguagcucugacugugggggucccaggacucaaccaauggccugugaccucccccaccuccccggccuccuccuccucugaggcccaccccuucaccaccagcagguguucuaaucaucccucccucccuccuucccaauaaaggcuuuccaacugcgcuuccauguucuuuaguaggcucugaggacacagcagagguccaguuuucaauaauuuuauauaaagucacaguguuagaacuuguagaaaauggggugggaagggcuggggugucaggucagcucaggagguguccauuguuucgccuucugcagagagagggagccagcgugagugagcugagcgcucccgcacagcccucucccacagcacuagcagccagggugacacucacugagcucauugaagaggaaggcaucuugguacuccuucauguacuguguggagcgggauucauccaggaagagggaguauacacgcuuaaugucaucgaccugcaccucggugcccugagagccggugggacucagaucagagcagcagagggccaccccacccccagcuuuuuccucgaaaauaacugggcaccuacuguguucuuaguccccacucaauauccauguaccauggcccacgggcuaccccaggggccaucccucauuccuccaggcuaaucugcuggcugaccuuucguuuccggcacaccaggcuggccgcugugaugagcuggauggcauagcgcagggaggucucgagcccaaugcgggucagcacuguguaggcguccucacucaucuccacaucuuccuccucacagcugugggcaggcaggaacggcauauuaccccacccaucccacaguacaaacagacacuggggucucacaaccacagaugaugaggcuaaaagagccaaggcacaggaagggccuccccacccccacccccacugccggucucccccgcucagaggccugggugaaggccgcaccggaugcgcagaaucugcuugguauccuucucacuguagggugacguugauacaaugagcaagcgguccagcaggucgauggggaugccguggggacucugguagcuggugccucggauccugggggucagggaagacu

SEQ ID NO: 3796 - RNA, 4829 nt, Mus musculus
agucuucccugacccccaggauccgaggcaccagcuaccagaguccccacggcauccccaucgaccugcuggaccgcuugcucauuguaucaacgucacccuacagugagaaggauaccaagcagauucugcgcauccggugcggccuucacccaggccucugagcgggggagaccggcaguggggguggggguggggaggcccuuccugugccuuggcucuuuuagccucaucaucugugguugugagaccccagugucuguuuguacugugggaugggugggguaauaugccguuccugccugcccacagcugugaggaggaagauguggagaugagugaggacgccuacacagugcugacccgcauugggcucgagaccucccugcgcuaugccauccagcucaucacagcggccagccuggugugccggaaacgaaaggucagccagcagauuagccuggaggaaugagggauggccccugggguagcccgugggccaugguacauggauauugaguggggacuaagaacacaguaggugcccaguuauuuucgaggaaaaagcugggggugggguggcccucugcugcucugaucugagucccaccggcucucagggcaccgaggugcaggucgaugacauuaagcguguauacucccucuuccuggaugaaucccgcuccacacaguacaugaaggaguaccaagaugccuuccucuucaaugagcucagugagugucacccuggcugcuagugcugugggagagggcugugcgggagcgcucagcucacucacgcuggcucccucucucugcagaaggcgaaacaauggacaccuccugagcugaccugacaccccagcccuucccaccccauuuucuacaaguucuaacacugugacuuuauauaaaauuauugaaaacuggaccucugcuguguccucagagccuacuaaagaacauggaagcgcaguuggaaagccuuuauugggaaggagggagggagggaugauuagaacaccugcugguggugaaggggugggccucagaggaggaggaggccggggaggugggggaggucacaggccauugguugaguccugggacccccacagucagagcuacugagccggcagggcccacagcggcagcugagggcuacaggaaaggagacuauggggucuacacccggugggcagccagggaggcggacagaugcgaagcgcagcucccgguaggugcacacuggcugaggcacaggaggcaaagcagccggcaguacucggaccugagugcgggguggaaaaagcccucuucugagugucccugccccagccccgcucuagguggaaugcccacccggcccuucagacccccacaguagcuaugaucccugcccaggagccgucucgcuguaccccaccccauuuggcccgcucaccaugcuaggacaguagccggcacagaugcugguggugaaggugaugcagacugggcagaacucauucucugcggccagaguugcguugacaggccggcacaguggccgaagggggccccuggaggcccacaccacacuugggcucagcagcagccacagcagcagccccugggacauagccagugucucacucuaccccugaccugguuuuuccaucccagguucugcacccacucaguauaauacagaaacuguccuucaagacccaucaccagccaugaaaucuguuuaucuccuguuugaaguccaccagcuaggagacccccuccucucccuccuccaacccccaggucacaaggcuguccaucuauggguuuggugggauugggaaguacccugggcccuaccaucuuaccuggagccucuccauucuugauaccuucccuaccuugggcaccuggcuuuauaccugcggguuguggggguggcaaggccacuaaguaguggcuacaggcuuggguaaccuagacacuaaucucuuugggggcgagacacagacaaggucagggaagccagggacuagcuccagugucccagugaauuggccucacacucggcccaggugucagggcuuagcugacauuggaagcacgggaaacaagguaaaggggaggccacugcaggcugcucgcugaacccccagauugcuggaguaaacguccaucagacccacucugaugguuggguacaacuaaauaggagggcacagcuucaaccuuagguucugacgagugggccuccaaauuugcuuucaauccaaccagagguggugcaccaccgucucccagccccuaaucaggaugccuggauuggguccaaaaauaggugugguuucagcuauaaaacuucuugaucaguaaauugcgccuggaggaacucuggaaguaagggguguguccggguuggcccgcccacaaguccaaugauggaguuugcguggugggugggcuucaccggcucacagcagcuccgcccuggcacucccauagcgggaauucucagugcaguaggccuuggguacacuguaaaggcccagcacuggcuuccgaugggggcugccccacgaugcauguacugggcaaauucgguccauuccacagagcgggugcaccaaggguccguaggacucccgggucagagacagggcucccagguacggcugcgaugggcguggccgggcugggcgcacccucgguaaacuugcccgaucccggugggaugccuuccucggccagcucaggcccaucaccgguuucugguggggauauccagacacguuccugugggcggggcagcaggugaggagguccaagugcagcagaguucagauuccaggggacucaagggggucuagaacugguuuguugcugccuuggaagaggcucugaggaucugaagaguucagcuugggucaguucugugguuucugcauacacagcuggaacucccaaggagagggguuuacucaccagcgccugcugggcacaggcucaccuugugaagucacuugcaguaauggucugauaggguugaagccgauccaggaugcccaucuuguucacugugaaggguuggccagccaucucaggguucuucguccaggggaugagggccugagaaauauugggaaagguagugaacaagaaagacuguguacccuguucaaagcccuuccccaccuccacacuagucuuagugccuuaaacccugcacccuauccaaacacuuaguggccaagaaaccaaacucuggcugcagccacacuccuuucuaguccccccccccuccccuagucaaaacaguuacccugacucuggauauuaaguaaucuuggaugacaauccuaccugacugcuucuugcugaguaaaccuaccaucugcuaaccaaacuucucagaguauuguagugcagcucuggggagcaacuaccuaacuagcuuagcucacugcaccagcagcccacagccccaagaggcaacuuccagaccuuccagcucucucucuccccacaguucaagauucaguacccugacccccacuuccauaccauauaacuaccccauagaaugcaagcuuccuccagcccagaggcucagucuccucccuaaccuagacagcccaggcuccuuccugcagugccggugugccuucccacggugccgguguagccggcucuaccugagaaggucccccgcgaugguggucagcgagcucugggggcuggggcucugcaaagaggggggcacucugauccacaucuggccagcccuuguacugugccuucgucucacugaucuggcauuuuguguucagggggacaccccgucccucaugucuucuuagcuacaagaagggagcccaaagauucaagguaagggagcaggggcuccaauguccaaccuucucacccccagauuucuggaucccagaacccuaccuuuucugccaaagacuugaugccaaguguccgccugggguccuugugcucuggugccuugggcugagcacaggggccaccaugugucuuggggguguauguagacugugaggugguuucccaucugcugaugacuuucgagacugcaggcaggggugccuugaccauagacugaugugaaggcgcauagaucagccaaaagacccacgaaaccauccccuuuccuuccuccaacuccugguauccaggcucccagaccccuccaccuucagacaggaaccuaacccuagucuucuuuccuccuggcacacaaguuugugagcugcccccuuucccuaucucacccuccacccucucaccuggagaguaggcagaggaaaggacgccggugggauccaguggugggcaaccccgcugcuggugagaugccaguugggccagguuccaaguaccucaguuucagaaaugggagaccaagggggcccauaucgaagagcuaggguucgaccugccaugguccucaccuucucugggaagccaagaaaccggcuuguugugaccguugccccugguaacagaaccugcccacucugaacccagccaauggcguguggagggcuaggggaacccccaacuaggacuuuuagagaggagggucggagaggaaacagaaaaguagggaaggguggagacucccaacagaggaggagaaaggaaacgggaggugaggugagggaauacagcagacacagagacagacaggcugacucggggagaggaacuaaacgccccuuucccauagggucccuggcucucgcauugccaggccugcccaccucgggguaacaguuuccagacagcucuuuuccaugaaggcugagcguccc

SEQ ID NO: 3797 - RNA, 17149 nt, Mus musculus
gggagaggcaaagggaggcucagaagaccuggcccgcauuccucgccggcuuacauccccagccugguaacugagcucagcugucucacguuccccucacccacggccucaucuguggcccucuguaaccccucccacuaccuuucuccucuccccauuggccuguuuugucaccugugucacgugucuaucagccaggacuguacuuuccuaccaauugccaccuuccuaaaacucgauguucuauuucaguccccauuagccauucuccuccggagaccacagguauggcuccaggccauugaucuaacucugucccaaccuggcuucgucuggccagggccucacuggagcaccccucccccucccagcuguugucugcccuuuugcugggaggggggggucuauuauuaggaacagcuguccugggggagggauguggccacucuggggucucauagggacauggucuggccugacuggaugcuggaacccaaccccgaacacaggcugugacuagguggagccucugcacuugucuuuccaucugcaucucuucuaggguucuuccaucucaccuucccucucuucuggcuuucuccuuguauuucuuuggcggggguggggguggggggagggggagacggacagggcuucucugccuaguccuggcuguccuggaacuuacucuguaguguugggaccaacaggcuucuguuugugguucuuaggaugaaacccacgggccaugcuaggcagggguucuaccgcugagcuauaaccccagaccccuacagggagauucuaggcaaggacucugccacugggccacaccccuagccccucauugggggauucuaggcaggggcucugccucugagccacgccccuuccucguuaguucauggaucugcucaccgcagacucuuuuccccugguucuccucucuucaucucuauuccaucuuuuugucugccuggcuacucaucuuuauuuuauuuacugugagacagagccuucuugugguccagacuggcuuagaacacaccgagauccuccugccuaggccuccguaguccugggauugcaggugugcacagaacacauagcuuugacuaucuuucugccuagcuccagcuuguuuguagucucugggucugaggaucucugcugagauucaucuccauccaucuggccuuucugacacccgguacccacuggccuacuucaccagauccuauacccgucuaucgcuuucuucccuaggccugcugggaaaguucugacuacaccuccugccuccauuccaccuucucuucaccucuugcuagggccccugcuggcaguucccacucccaccccccuggguagggcugugucccaccuuacaacccuugcuguucauggaauccaaaguccucuucaguuccggaguugggggcuccaggagcucuaccugcguccucacacccugcuccguguauggucccaccagauaguaguugucaccccauucauccccugucaccuucgccuucgucugcagcacaguguagaugccacccacugugggccaaagugcaaaaggacagacaaccccaccauugguccauagcuuugagaccuggcagguaaugggauguauguggguaguauugggguagaaaaugggcaggaaccuauaauugggaaucaggggagguugggacuggaggguaggggucguggaaaagcaaaccugaggauagcccucuugaguuuauggagagaggggacugaaaucaggaugcugagggaggagcaggcuccaguuagacuccuggucaugacacaggaagcacucuuuagucuccuaauucuuagagaauuaggagcaggaaggcucuaaagcucuugacuuucagaugcagugggaaaaaugguacauggcccuauccagcuacccaguuaccugagggaagcuugacuuauuauuccacaccuucagggccccuaacgaugcuagcccugggcugggacacagggacugcugggcccugcuccuccugugaccccaccucagauuuaggaaucuggguccucagccuucucaccugaaacugguacccugguaguacacagcauugagucugccaucucccaacaugcugagagaccuagucucuuucuccccaggauccagaaaaggaaauguucagauccacaaggcccagcugcugggauucccagcccagccuucucaugagcgagaagcuagugaucucccauacauacuguggguggguuccucccauccuagggcccagcuccugaccaacuuaggacuuccagcuuucccaguccacagggagggaggcaccucacuacauaggaagccaggacuuaggcccugggcuccuucaaacucgacauucaaguucccaacucuuucccaccuuguaucuaagaauuugagucuccaagccccucuuggcuuuacacugguucagguccgcuaugcccccugaaaaauccaugaaucccaaccuuuaggaacaccccaacuccacagucacguccucuggaccacagacccaaaagcuccaguguuccuugggcuuagaugcacuaacuccuuccacuuuuagaucucaggucucucggcccucgaaaaccucccuucaagacccaggaaucuuucucugagugcccucuucccuagauugcagaaccugaagccuccuuccaucuuaagaguagucucuugucccuuccccccagggccuaggacgccuacuccagccccuucacaaggacacagaagucacaggcgcuuuucccaggacccaagacuccuccacguaacucuuuucccgucugaaacggaguuucggggccccauccucgccugcccuucuuggucaagggaccaacgcugacguucucacccuuguuggccaccucccaggccaccucgaaaagcacugcguucucggggucgaauucauccucccagucuuccaauccuggaagcgaggacacagagagacugcggcugagaggcauggcuacugcgggcaggggacuucgagcaccaaaacuggaaaccagagagaucggcugggaacgcagcagacuuggugaccgguagaguuagcgggugucccaggggaagcuugcaaggcgcuccgcuuccuauugcacgaccgcacccccgccccagagcgcuccgacucagguagggugagcugagacacugaaucgggcgggcagcugcagugaagccucguggccgccaggaggcacugcccacccugcuggucuagcacgauuggucggcggcuggggggcgggggcuauugcgucuacuuauuggcggauagaauccaguuuccuuggccagaggcuccuggggagcugcgggggcggggcuuguuucuacgcagcauggaagugauuggugaacagagcugucaaucucagcuguaggcccaauuuggugaggaagguuggacagagagggaagggaucguggaggacgugugguugcuacaaaaugugcucagaauuuugcaaucggacuuagcaguugcagggcgggggggaaggaggggggaggaggcuagguaagaggaggaggagcaagagacgucaggaacccacccgggauucagaacaccggcuuuccaauuuagccucgcgggcugggcgcggccuaguguacgcccccuacaggaauuuuauauaucuuaugggccauagagaugacuggaugaccgggagccuagagaggauaaagaccgcgcuccuagccgauuuccguuuccgcugaggcauuggcgguuggugugcaucauggcaaccgugguaaguguugggugcauguggaggaccgacaaugacccuucuuagagagucugaaggagggagcuggagaggacucuuguaucugagggaggagugauaaggaagaugccugguuugacggaggaggucuggggaguacucccgagucagagggaggaugcugaggacaccgagucugagcaauggauacagaggagaaugcaugugucuaaaggaagagagcagaggagaaugcaugaaucugacggaagggggcugaggaagucgccaaggagggcuugggaggacacauggaucugugggaaguguugggaggagaggauaccagggucugagggaagcaggcuggugugugcaccuuuguguuugagguaggcaggcuagagccugaaucccuagaucggagggacgaucacaguggaugaggccugguuuggaggaggaggagggcuagggagggugccugggccuaauagaagagggcuggaccuggacuccuggauguggaggaaguguauugaccacugaggaaggagcuucauuguggcuuuagaagcuaguagagaaggcaacaauguauucagaauccuagaugucaggcaugguagugaaagccugcacuugggaggcagaggcagguggaucucugugagucugaggauagccuggucuacagagccaguuccaggacagccaaggguuacacagagaaacaacaacagaaagaauccugggucugauggaagagucauguagacacucagauuucucugugaaugagugacuagccagagccuggagugacagagucgugguucaucccacaaugcguucuggaaacuucgucugccucuugauguagucagugaccaguuccaaagucucaucccaguguccugcgaggucugagacugguacccuggucuucuggggaagauuaguaagugggaaguuguguugugugcuugagagcacaggucacaggaaaguguguccgaagccaggagugugacagugaggaagagaaauagagucuggguucagagcauggggucuuguccagagacuguauuuuucagaaccucaccuagggcacgugucugugccaucgcacaguuaguugaauguuacagugagcgaauaaagcccaggaagugagaccgggcauauugggccuggcacuagcuccucagacuucccagugaagaaaucuuguggccuugugguguccuugauucugggguugggcccaggcaaguuguagggaggucaguggcgucuguugcuguuaccauggugaggaagggccugccuuugcuugccugugugugacaguaguuugggggucucaugcuccugcaguccacacaaucuccuacaaaaagaggaaggugaaggcucccacagcaagagacaggcaguaaaugguccugggcugugggcuauccuggaaggccuuguuccauuccaggaggaggcauccugagcugugguugagggccgcuuagcuuugugguuucuuagguucguaaaaaauaggaaaagauguucaaggguccaccgccuggauuuaucggucucuuguuuucacccuuuagcuugggcuagcuccagacucgaggcacucuuucugacucagccuccccaguggcugcagaagugcauccuagcaggcacccuccaguguccccacaccucccuccccgagccuuuggcaaccacuagucuaccuuguauuucuggcaucucuuuuggauacuucauauaagaacccuucaacccaagcugggcagugguggcgcaugccuuuaaucccagcacuugggaggcagaggcagguggauuucuaaguucaaggccagccagggcuaccuacacugagaaacccugucucgaaaaaaaccaaagcaacaacaacaaaaaagaauccuucaacgugaggguuuauucaccauguuuucuguguauggguguuuucccuccggauacgucuaugccugaggaggccagaagaagguauuggaucuccggaaccagaguuagagucagcugugagccaccacaugugugcagucaguuuagccucgguccccuggaaggaagaccggccaagaguccuccacccuucucuccagccccugcgugcagucuuuauuaugugggagcccacucgcucagcaccucucaguggucuuccuggguguguuggggucagagcuucacucuuuuuuccugccugaguaauaguccauauuugaauagaccgaguaauaguccauauuugaauagaccguauaccggacacaugguugugaguggccuuuggcuguuauacacauuggcgugcucgcuuuguggggacuccagugccucaaacauuccaggagguguuuacucauaucuuucuccugugaggggagacagugcuagcugcuucuucaggaggcccuuggauauguuuauugaaugagcucagcacucuaguguguugaacuucaaacauggaguccaaggugggccggagagguguggccuguucccuuggugagacacguaggugccuaaugggagccagagcacuggucuaagagucucccugccauccucccagagcucagaauggggacaggaggguuuccucucugcacuaggucaugccagagcucuggggggugugacacgaagccuguuucccugggccccgugguggggcugaucacugccauuagugauugauggcccagaggguggugguggcugcuguuguguugccugccugugcaguggggggcuccuggugggcagcaggaccuugagggagcagaugaaacugugacaacugggaaccuucuuacacgucaucguccucaccugcaggcagccaccaccaaagucccugagauccgagaugugacaagaaucgagcgaaucggugagugagcagggucaggaccaagggagacaccacugcuuagugcccagacagacagagaaggaugcaauggggccuuagucccaggcuaugcugccauacgccuagcaugccuccacgggguuucuggaacuuugaggaacauuggaaccauguguccggcacacaagugcauguuggucacaugcucucugagggugcaccaggccuuccucuuaccuggugugccucaggccucaagccaucagauucaugagugcuggaaguggugcuggaagucuccugugaccuugggagguggagagucagucauccuauccccauugaggagaccagcucucagagcagcuguguaggaagcuucgcucaccaccuguagcaaggugggcagggcagggcggcucccaggaggaggaugccagcugugcaagaggccacacccacuuguucagcugucacucagcaccucuaagacacaguagaggacuaugggcuccaacugcaggcccuugguggacgcugaucuuucuacuuggcuagacuaaguagaccugccuguguagaccagauuggcuucuaacucgcagggauccccuugccucugccuuccgagugcugugcaccaccgugccuggccuuguuuuucuucuccaggcaguuuccuauaggcuggcccugaacuuaccguguagcuaagcaugacuuuuaacucguccuccucccaaagugcugugaucacaggcacggaucccugugucuggcugaugaauucuaccuuuuugaaaggaagcacccucucacuucagugcuugaguuagaacccaaggucacaugcagucccugugcugagucucaugucuuccagaggggacacagcucacuguaagaguguggugucguggaggcaguggguggugggugggccugguaccugugccccucugagguuuauugcagagccacuagcugcuguaccagggugcuguccuuaccuuuuccuggauggccucuaggcucggcccuaaccugucucuccgcaucccuguggcugggccccaggcugggagaaugggagcagcaagcucuggcuugucagugugauguggaaaggcagcaccugggugccaaguccuuguguccucccacagcgcgguccguuagcucuugagcucagugccuggggcuuugguagcgucauccagcucuuggaugccacgcacguaacggugcucuggcaucuuccugccuucguuugaccaagagagcagccugagcucagcagccacacggugcugcuuagaccagccagugcugccuagaccagccguaacucugcuucccuuccuccaaugcaggcgcucacucccacauccgggggcugggacuggaugaugcccuggagccaagacagguagagccauggggcugggcacgugggcuguuccugccaggcaggucuucgggccucuugauuccauacugaaccaccucagacgggaggcagaggcacuuggaucucuaugaguucaaggccagccuggucuaaagagugagaccccaucucagaaagaagagaaagucaguacuguuuuguuuaguuuuguuuuguuuauuuuguuuuguuuuguuuuccagcagguggggugugugccaggauguggugggacugcagggguggcucugcagacagucaccuucauguccucucaccuuccacccuccaggcuucccagggaaugguggggcagcuagcugcccggcgugcagcuggcguggugcuggagaugauccgagaagggaagauugcagggcgggccguccucauugcaggccagccaggcacugggaagacagccauugccauggguaagaggccucaagaggcagacguuuuccucugugccggggaaccccuccucuagcagucagggacaggcuaacuguauuuaacagucacauggaagcaucaggaaguggcugucuagggagccgcagaggcuguuuugucuugggguuuuuggagacaggucuuuauguagucuucgugggcucugccucccaagugcugggaucagaggugugcaccgcugcauccugcauuguuuuauaguuuuugauuuggcucauuuggguucugggaaugagagagagaggguggacacugggcuuggcagccagccuucucugcggcaguccacuggugacuuagggucacagcugccccuaagacucuccugacccgcccaucgucucacucccgccucugcuaagacugugggaccggguggggagagccaacguucugccaggaaucaguucagaaguagugcucaccuagggauggggccaugucacccugccugcaaggugacucguacuaagacagaagaguacaggaugcggggacuaaauggcucauucggccgggcauggggcagaggcauggaugguuuagaggaugucuggaaacaugggccaccacugugucagggaccuggggccagcagccacaacugccugaccucugguucccauaggcauggcccaggcacugggccccgacacaccauucacagccaucgcaggcagugagaucuuuucucuggagaugagcaagacugaggcucuaacgcaagccuuccgccguuccauugguguccggaucaagugagugcccuguaggagauccacuccgcuugcccauguccuggucagagaaccagggugucccgggccagccugacccagacugugcugucugucugucccaccagggaggagacagagaucauugaaggggaggugguagagauccagauugaccggccagccacaggcacggugagugucccagcaccgaugucacccaugcucgcggcuaaacccccuccagccaaaaggcaaggguggggccgguggagggugcuauggggacuaaggggggcgucacggagccgauggagauuuucuuaugaaaagagaagcaagugaagggagugugugggcugaugaguuacuguggacaccuggguccagacugccccuucccccaggacuccugaggcccucccagguggccugccuccccacgcuuucugcuuccggugucagcuagccgugucuauuaggucugccugguuguagggaguuucuguuucuauuugcugugcugggucaaaccuaaggcccauuguguguuaagcaagcugcccaguuguuuuauuuccugcgggucucagguccaacccccagaacccacaggauggaagagaguuaaccucucacugguuguccccugaccuauauuugugcacaugcaccauguauguaaauaaaaguaauuuuacuuuguauuuauuuauagaauagguagucuaguggguuugccucacccuguuuuacaguugguccgcaaucuccucucugagcacugagaguguacagggcagaugcgcugagucuaggggcccugggaguuucucuguuguaggaguugcuggggccuucucgagccaugugugugagcccuccacagccaagcucuuaugucagcuguuugaugacgauguacucugcagcgguccugcagccguccucuaugcuaucugguuguagaacuuuccauugucccuugagaaaauugugccuguauacuaacacgccagccacgugaucucuucuugcugcuggacuugcagguucuggaugcuuuguacgagugggacuguagggcagugggugaucugguuuugaaauuuuguguuagagcugggcuugguuuuauuacuggcacuuggaaagcagagacaggugaauaucugaguuugaggcuagccuggucuacaaagggaguucuaggacagccagggcuacggagagaaacccugucuucaacaacuaaaacccaccuguuuugaugguucuuugugugauguuucagcuguuacugaaaugccugggaaaagggguguugcagcaugccauaacuuucucuugccuauuugagggcgcucuucucucucacacacacauacacacacaccccguguuugagaaagggucugccuccugaguugcugagguugaaggagugagccaccuugcccagcccagguguaccuguauguuguaugagaauuuguugacacagacagagacuagauguuggguuuccugcuuugucgcaguguuuuguaucuuugggacagggucucuuucugaaucuggaacuaggcuggcagccagacuuuccagugauccuuucuucauccccaacagcacuggccuuacaggccugcguguagcugugccugaugguggugguggugaggauaaugggacaccagugcugguguccaaauuuaggcccucaugcuugcacggcaaggucucuucucugcugagccaucucucuaguccucucaccaggaucucucucucucucucucucucucucucucucucucucucucuggaugcagcgucucauguagccuagacuggcuuugaccuuguuauguaacuaaggauggcuuugaguuccugaugccccaccucuugagugcacgcccagguugugugaugcuagggaaggaccugggucuugagcaugauaggcgagcacuccggggagccacuucccugacccuguggcgcuugaguuggaucucacccaggcugcauucaguguccuaaggucugggauuacaggcgcgaaccagcacucucaguuuguguuuugagacaaucuuuuuuuuuuuuaaauaggcagcccauacuggcuggggguccuccaccucccacuuuuuaguacucagauuauaggauuuacagccacaaccagguuauucuucauuguuaauggacguggauuuagcauagguaugcugcccaguaauuuuaauaauuguaaauaaaguucuaaauuaguucaaucuauuaguaauuaaauuuuagauuuuuuagauaugguaagaauauuguggguaaagcuuuuccccaaaaaaaugucuuuuuuuggcggggguuggguggggguggaggucgggauucaagacaggguuucucuguguagcccuggcuguccuggaacucacucuguaggccaggcuggccucgaaccuagaaaucugccugccucugccucccaaguguugagauuaaaggcaugcacaaccgcugcccaguacgaaaugucuuuaagguguguguguguguguguguguguguguguguguucuuuagaggcucagugguuaagaaccuauaccgcucugaagaggacccagguuuaguuccuagcauccacauuaggcagcucccugacaccuguaaggacauuuucagggagcuagugcccucuucugccuuuuguggguuccugugcucacgugcacaaacccacacauagacacucaugaauaaaauguuaaaguauauguauacagauaaucccaucugccccuuacccuccuuuacccugccuccuuuugggacuaaaaggagagagcucauuugugccaggauccagauacagacagccgacucccgcagccaggcccgaggguaucaauugugcuugcuucaggaggggaaugugugggcuuugugugcagucagaggacacguggugggaguagggucuccuacuguguaggucccaaggucauuaggaucgguuuccugugcucuacccauguccauggcccaguuuaguugucuuuuuauuuacugcuuugauuuuguaauuaacaaaaaugcuguuuuucuucuguggucagacacucaggaggcagaggcaggaggucucuugaaccucugugaggaugcacagcucagugguagagggcuggccugcuuagaauccacgugagagcauaggggugugccuuggugguucagugcugggcccaggguucuagccauguuaaauuugacaccuccuccccacuccccauccucuugugacccggcucauggugacaugacacaccucccaacgccaccuauuugaagccgugccacacagggaugaaguccucugagcauuuacuuguguguuacccucagggauccaaggugggcaaacugacccucaagaccacggagauggagaccaucuacgaccuggguaccaagaugaucgagucccugaccaaggacaagguccaggccgggugagccgcaggaccacaguaguggcugggaggugaggggaguggccugggcggugaggggaguggcacccuccuuacacuuuguuguuguuccuucagagacgucaucaccauugacaaggccaccggcaagaucuccaagcugggccgcucuuucacacgugcacgggacuacgacgccaugggcucccaggugcuccgcucuucccucacccucaucccacacugggauguuucuguaucuucaugggguccggaugcugcauuacuucccaguguggggcugcggggagggaccugugccuuggcugcccucacaccugcccuuggcccuguagaccaaguuugugcagugcccagacggagagcugcagaaacgcaaggagguggugcacaccgugucccuccaugagauugacgucaucaacucccguacucagggcuuccuggcccucuucucaggucagcugcccuuccccaagcaguccccaaggccuugaaugcuuuggugcacccuucuuugucccccucugcaaagcccaccccuagcuuuucugcccuuuucuuaacagaccugcugcuugccuuguguucuccgucugaguguguccuuuccugcacugcccucaaguccucccuugggucucugccucuguccuuucugcccugcugcugcagcccagaacccuccuccccaguguuccucuuucucuggguugguccuggacccagucucuaacucuaacugacaccccgucucugguaggagacacaggggagaucaagucagaaguccgagaacagaucaaugcaaagguggcugaguggagagaggagggcaaggcagagaucauuccuggggugaguggugccagcccaggugggcguguuuagaccuggggcauuggguggaggggaccuugaccuggguccucacggcuuccaggugcuguucaucgacgagguccacaugcuggacauugagaguuucucuuuccucaaccgggcccuggagagcgacauggcgccuguccucaucauggccaccaaccgagggaucacccggugaguaagcagcuuuagaggucucuggggggaagcgcguucugggccagggguugaugguggguggccucaagguaaauggauugucuugcugggcuugccuccaauguggcccucacacaguguggcccucacaguccugggcagacccugugcugagcacagggcuaucuccuagauaugucacaaacugccuaugaucaauuugucacucagaccccgccacucaaucaucacagcccacaaguauugaccuaaagaugcuguggacacugggcaugucgcuaccaaccauagucguagugcuguguaggcugagacaggaggaguuugaguucuaggcuagccugggcuacauacaugagacccagauuaagagagcacacaaacccaaguguggggagccaaacucccuuugaugguggcuccugggcuucaucaagcacaucacccugccucguguggucuuagcaugacaucuuuuuuguuguuguugugugaaggugggggaggugauacuugcaagcaugaauguaagugugggcagaguccaaaauaguauggcagauccccugcagguagacuuagcagcaggugugagcuaccagguguggguccucuuacagaacaguguguauucuaaccaucucuccagccccuucucugauuuacuuuuaugugugugucuauguuauguguacacacguaugugguacccacagaugccacaagaagucuccagguccccuggaacuagaguuagguguaguuguggugaaggcagauggcagacaggccuaacaggcugggaccuggcuaccuucccugcacuucaccuuacuacucccacuucacagaguaggccagcaaagcuggacagcuugcucaaggccauagauuugaagguggaggggaggcagcccuaaggaccccuuugcuagcugauguucaccuggaauuccccaguacgugaaugguaggcuagacucugcccgcuggccugagccaccccuggagaacaguauucucuuauuuauggcuaaacucccuuccucugccuggaauaaauugccacgggccccauugcccaccaagaacugucuggguuugccagggcagcaggggacaggauagccacuagcacagcuggagugaacugugcuuacaggugacaagagccugugcucacaguuuuucuaaguucccaagugggcuaugguagaguguauguuuuccugaaauauccacuaacagucuucccugacccccaggauccgaggcaccagcuaccagaguccccacggcauccccaucgaccugcuggaccgcuugcucauuguaucaacgucacccuacagugagaaggauaccaagcagauucugcgcauccggugcggccuucacccaggccucugagcgggggagaccggcaguggggguggggguggggaggcccuuccugugccuuggcucuuuuagccucaucaucugugguugugagaccccagugucuguuuguacugugggaugggugggguaauaugccguuccugccugcccacagcugugaggaggaagauguggagaugagugaggacgccuacacagugcugacccgcauugggcucgagaccucccugcgcuaugccauccagcucaucacagcggccagccuggugugccggaaacgaaaggucagccagcagauuagccuggaggaaugagggauggccccugggguagcccgugggccaugguacauggauauugaguggggacuaagaacacaguaggugcccaguuauuuucgaggaaaaagcugggggugggguggcccucugcugcucugaucugagucccaccggcucucagggcaccgaggugcaggucgaugacauuaagcguguauacucccucuuccuggaugaaucccgcuccacacaguacaugaaggaguaccaagaugccuuccucuucaaugagcucagugagugucacccuggcugcuagugcugugggagagggcugugcgggagcgcucagcucacucacgcuggcucccucucucugcagaaggcgaaacaauggacaccuccugagcugaccugacaccccagcccuucccaccccauuuucuacaaguucuaacacugugacuuuauauaaaauuauugaaaacuggaccucugcuguguccucagagccuacuaaagaacauggaagcgcaguuggaaagccuuuauugggaaggagggagggagggaugauuagaacaccugcugguggugaaggggugggccucagaggaggaggaggccggggaggugggggaggucacaggccauugguugaguccugggacccccacagucagagcuacugagccggcagggcccacagcggcagcugagggcuacaggaaaggagacuauggggucuacacccggugggcagccagggaggcggacagaugcgaagcgcagcucccgguaggugcacacuggcugaggcacaggaggcaaagcagccggcaguacucggaccugagugcgggguggaaaaagcccucuucugagugucccugccccagccccgcucuagguggaaugcccacccggcccuucagacccccacaguagcuaugaucccugcccaggagccgucucgcuguaccccaccccauuuggcccgcucaccaugcuaggacaguagccggcacagaugcugguggugaaggugaugcagacugggcagaacucauucucugcggccagaguugcguugacaggccggcacaguggccgaagggggccccuggaggcccacaccacacuugggcucagcagcagccacagcagcagccccugggacauagccagugucucacucuaccccugaccugguuuuuccaucccagguucugcacccacucaguauaauacagaaacuguccuucaagacccaucaccagccaugaaaucuguuuaucuccuguuugaaguccaccagcuaggagacccccuccucucccuccuccaacccccaggucacaaggcuguccaucuauggguuuggugggauugggaaguacccugggcccuaccaucuuaccuggagccucuccauucuu

SEQ ID NO: 3798 - RNA, 22186 nt, Mus musculus
gguccuuugaccugugcauuugugauuuccccaagggucccccaugucggccaccgucuacccaaggucacuggggccaguguuugccacuuggaucucaaaucuaagcagucagauguaccuuuccuaacaacagcacggggaccucagaacaguaacccagaucugcacagaguagaagucuauggagcucguaagagcagaaccaaaaucugggggaagcuggcacuccugguaaugccagcucuugagaggcugagauaggacugcugugaauuugaaccaucugggggggggggggcaaggcaagauccuaucuguaaaaacuaaaauacaggacuggggaagcaagagagacccaccacaccacaagagcuuauguccagccacaguuggcauucuuaaauacagguguauuuucuuuuuuuuuuuuucaucucuagacacacuccaaucacacaccuucugcccucccccucccaaaugcaaaccaaaggcacugggccagacacagcacacgugaggaggggcccgcccauucacugaagcuugcaggcagaaaggccucgagguacauguggggcuucaagaagccggugggcucgguuuuguaucaggaaaggggaccggggugcagcacagugacaaaagacuccugauucagccacugggacccagaacccagugguuucacagugggcugagcacuugugggguugacagacauucugcccucaauggaggcauucccuagaggggacacuggaccaaggaaaagaaggucugguccagaaaaaaggcagaaaggugucugguccaacuccgcaugcuccuuugaagaacacacccagggaggccaaccuugcagcaugucccagcaucgcagucguggguugaaauggaggaccgugagcauuccaccaccuuuacuuugcuuuugagacagugucucauguugcccaguuuggccuugaacucccuauguagcagaggaugauggccuuuaacucuugauccgucuaccucuaccuaccgagugcugggauuacagauguguaucaccgcaccagguuuaugagguucuagaguuagaucccagggcuucgggcaugcuagacaagcaaucugucgacagagcuacugagcuaccuugcaggcugauuuucaauuauguuaaucccugaaauguccuaacucugaacuuggcugauucgggaagccacacagaauccaacaugagguggucccagaggcaggccugagcaaagcauacucuguaugauuauaggaucaaacgaagaagccacagccuggaagccaauaaaccagguguccuaaaaccucuggcauugaaaaacaauggcagaugccuggccucugggacccagucuaagccuggagacuccagaucagugcacaaagaaugcauccugcaauccaagaaaggcacggcggcguggagugcgggaacuccaagauuggagcucaagggcuggagugucugaaacagagguuaggcuauggaccacacuggguaggggucccacucaagagucuggagugggguucaggcacccucccaucugcauaggcccucugcgagaggagcacuggacaggcagggaaugggaugggggugggagcuuaguugcgcuccucacccagggaacugguaggacucaggggcucagugggugugcugagugagcuggagggcccaguguccaccgaguugcuucucuugcugccaccuguggaggaggaacaggaggcccugcguggccacucaggugcccggauguugcggcgguccuuggcagccuccucuuccucaucauaacgcucacugucuucccccagggguccaucccguggcucuuccucauccucacucuggugugggcuggagugucgagacagugagggcgacggcgggacggaggcuggucguggguaccgguaccccugggucugcauacccagagcaggcacaaaccaaaaugaaugggugccauuuaagucccuagagguguccacuaacugucaaccccaaaccagccugccccagcccuucacuccuggcccagcgucgaucccggcuccacuuaccgcaucuaccucaugggguucauaggugaaguggucuggaaaggccuuggccagagccauguggcgcgcagacauguaguacuagacagggagggcagacagcgucaaggacagaggcuacacaccuggcuucaggcagauaaacccccagcacuuuuuuguuuguuuguuuguuugucugguuugcuuuuugagaguuucuuuguguaaguccuggcugucauagaacucuguagaucaggcugaccucaaaaucacagagaucugccugccucugccuccccagugcuugggauuuauucaaggccaucaauguccagccacauuuuuucuacacaagcccagccacacaccccucauuacugguggacacgaggcagggucucuaccacugaaccacuucucugguggauuauaguuaagggucuaaaaccuaaaggcacgcccagcuccccugcuccaccacugagccaugcucuccacccgucacugcuggaguccccagcaaucuucacuugguaacacuggugacuuuccugccucauccuuccaaguagcuggaugacaaaccugggcugguggguaccgauggccacaccuucuuguauuuucuguuuugcguugggaauguuacuacguguccccuagcuggcuuugaacuuugagccaggcuccaauugcuauaccuuuauacagaugagcacacugggcaaaguuaucucaucucuccuaugcaaauguuccugugcaaaugugaauguuccaagugaacuaggcauggaccaugcucuagucauaccuuccuacagggcaggugaauucucaaauacucuuuuggucacacaaaugagaacucuauccagaugcuauuucuagauuuuuuuaucuuuuauuuauuuauucauuuauguauuuauuuuuuguuuuugagacuggaucuauguacucuuggcuguuacagaccuggcaauguaaaagaagcuggccucaaacucacagagacccaccugucuccugucucugucuccaagugcuuagacugaaggugggcacucuaacaccuugcucucuuuucauuuuugauguauguaugugcguauguaugugcauguauguguguauguaugugcauguauguguguguguauaugugucuauauacagaggccagagaacaacuucagaugucauuucucaggcaaaauucauccugaauuuuguuuuguaagauuuauuuauguauaugaacauaugaugugugcugucaugugccuguguguggggacuagaagaugacauucagucuuuugcagcuggaauuccaaguguuucugagaugccagguuaugugagugcugccugaucucuuccuaaacacacugagccaucucuccagcuucucugucucucugucugucugucugucucucucucuguuuccuuuuuuccuugaggcaaggucuugcuauguagacuaggauggcuuugcacucacagucuaugccuguaaagugcugggauuaaaggcagacaaccccacaccuggcuuucaccuuguuucuugaggcggggacuugccauaaauaggaugcuggcuguccagugaaucccagguaccccuuuuuucuuucuuucuuucuuucuuucuuucuuucuuucuuucuuucuuucuuccuuccuuccuuccuuucuuucuuucaguuuuucgagacaggguuucucuguguagucuuagcuguccuggaacucacuuuauagaccaggcuggccuugaacucagaaauccaccugccucugccucucaagugcugcgauuaaaggcgugcgccaacacgccuagcucuuucuuucuuuuuuauuuauuuguuugcugagacagagcuucuugccuucuagccuugccugucacugaacucacuauguagaucaggcuggccuugaacucagagauuugcuuccagagugcuagguaccaccacugccuggccccaaguauccucuuuuucuucuuuuaaaagacuuauuuauuuauuauguaugaguacacuauaagagggcaucagaucucauuacagaugguugugagccaccaugugguugcugggauuugaacucaggaccucuggaagaacagucagugcucuuaaccucugggccaucucgacagcuccuccagguauucucuuaucuuuaccuuccagugcuaaaaucacagggaucaucauauugggauuuaaaaaaaaauauguguguaugaguguuuuaucugcauguguucuagguaucagaaguaugucugguacccacagaagccaagaggauaucaaaucugcuggaaguggaauuacagauguuugugagccaccaugugggugcuggaacugaacccuagucuucuggaagagcagccaaugcugugucucuagcucugacaacaguuucuuuuuugcuuguuuguuuguuuguuuguuuguuuugugcauugguguuuugacagugugugugucugugugagagugucagaucuuggaguuacacauaguuaugagcugccaugugggugcugggauuugaaccauugagcugucuucuucagccucacaucacuugcuuaaagagacaacaacuacaauaagcaggaaacuuugaucuauuuccagccucuuuguuucucuauguagcucuggcuguccuggaacuuacuuuguauccagguugccucugucuccugagcucuguaccaccacaucaggcuaucuccaucuucucucucuuuuuugauuuuucaagauaggguuucuuuguguaacagaguccuagcuguccuggauucccucuguagaucaggcugcccaggaacucacagaaauccaucugccucugccuucugagggcugagauuaaagcaugcagcaccacgcccagcccuaucucaauucuuuaaggcuacagaaccagaggaggccuaggaaaggaaaucagucauacccggcccagguacuuccaaucuagcaaguccgacaaccguucugugcgguuccgcuggaugaugcgcugucgccggcucugcuggcagaagcuguacaggaaggaggugagcugugagcaugaaucauccaggcugcggaaccuccgauccagaauguaaaugccuacagaggcaggaaucaggauuuguuaacgauaacaagagucugaaauggggaccagcgcccgccauguucuguccucccucugcacugaccguaagcugagggaucugcgauguguuccuccauaaagcagccaaagccggagagguugguggagaugcuggggaugcccaugacagugcacuccgcugaggaaccaaaggugggaggggaaaaaaggcuacucaguagccugcccuguuagagauggcucuacaucgccaccugcuggcaacuaaaccaaccgcgccuggcuacacccgcaaggggccucccccauuucuaggaaccaaagagccuuagaaaagugaaucugcggaaaccugugauaaagaggauacuuauuuauggaacgcuaaccaaugcuggcucacagaaauaacuuuacuuaaccaucacggcguuaagauucguaucugugugugugcucgugugugcaugacacggcuuuagauuaugacaugaucaugagguugguuguaguuauuguuuuaagauuuauuaauuuuggggcuggagagauggcucagcgguuaagagcacugacugcucuuccgaagguccugaguucaaaucccagcaaccauaugguggcucacaaccaccuguaaugagaucuggcgcugucuucuggagugucugaagacagcuagaguauacuuacauauaauaaauaaauaaaucuuuuaaaaaaagauuuauuaauuuugaagccgggcgugguggcgcaugccuuuaaucccagcacucgggaggcagaggcaggcagauuucugaguucgaggccagccuggucuacaaagugaguuccaggauagccagggcuauacagagaaacccugucuugauaaaccaaaaccaaaaacaaaaacaaaaacaaaacaaacaaacaaacaaagauuuauuaauuuuuaauuuuuauggguaugggugauuugccuacauacaugcgccauguguaugaagcaccuguggaggccagaagaguguuggauccccuggaaguacaguuagacuguuagcagccauaugggugcuaggaauugaaucuggguuuuuuauggcuguuuuauuuuauuuuuggcuuuguuuuuuuguuuguuuguuuuggggggaguugagacaggguuucucuguauagcccuggggcuguccuggaacucacucuguagaccaggcuggccucgaacucagaaauccgccugccucugccucccgagugcugggauuaaaggcaugcaccaccaugcccggcuuguuuguuuuaaaagauuuauuuauuuuauguaugugagcacacugucacugucuucacacaccagaagaggguaucagcucccauuacaaccccaccaugggguugcugggaauugaacucaggaccucuggaagaacagucaauucucuuaacggcugagccaccucaccagcccuuauuuuugucuuucuugagacaaggucuuacuauauagcucuggcuguccuggagcccacuguguagaccaggcuuggccuugaacucacagaggcccaccugccucugccuccuggguacagggaucaaaggcaugugcaacuauacccagcaaaucuagguccucuagaacacaguauucuuaguugcuaagccaucucuccagccccacccccuuuuuaaagacagaaucuuauguagcucaggauggcccugagcccacuauguagccaaagaugaccuugaacuccuaaucuuccuccucugcaucccaucaguuaucauuagaggugcacaugcucuuugguugguuugcuuuugagacagggucuuacuguguagcucagucagccuguggaaugauagauaacucuccugccucggcuuccccaguaugccuccacacccagcucacagcccguguccacuggugguaaggaaagaucugagugagauacaauggcagcagcgugugauuccaagguucagggagcuaagguaaggacugccaggugcucagcuuggcagacagagaccccaugguaguuucccaaacauuaucaacuuuuuuuuuuuuuuuuucugagacaugguuucucuauguaccccuggcuguccuggaacucacucuguagaccaggcugaccucgaacucauggaccugccugccucuuccucccaagugcuggaauuaaaggcgugcaccaccaccaccuggcucuauuaucauuuuaaccagagcaaaaugauuugcaagugacucucaaaaccaagaccugcuuguuaaugucccccucauaggagugggggcggggcggggagcagcaauugggauguaaagucaauaaauaaauuaauaaagauuuagaaaaugaaugaauaaacauaauaaugaacuaaaaaagaaguggggguggggacguuagaccuucucuggagguucuagccacuccucccaacaucuccuucccacauucaccccucacacaagcucuguaaggaaacuuaauuaacuuacugugugugugugugagugugugugugugugugugugugugugugucugugugugaguguguguguguguguaugugugugugugucagugugucugucuguguaugugugucugugugugugugugugucagugugucugucugugugugugagugugugcucgggagugcagaauugaagaauaugucuagaauacaaggaaagguagaggcagggaggucaagaguucaaggucacccucagacaccugugagcuggaggccagcuuggguaucagaaaacaagcgggccuaaaaaacaaaaauaaggaggaaaagccccacaggauccucucggugaaggagaauuacacacaagcaauucuaacucgaagcucagggcugaagagaggugaggagaggaagagguugagcagcacuagggaccaggaggagaagcucagaggguagagggcuugccuggcaggcacagagccccagcuucuacagcccgcacugcacaaacagaucacagugguguagcacuccgaaucuggaaacaagaucaggaguucaagaccagucugggcuacauagcaagucugagagacaccggggaaggccugguucaugugcaacuccaacaucagcaaauuggagcugagguuaucagugucgacgaccggaaaugaacaucagucaucuagucugagcucuguagccuucugugagacaaacaugugacacauggauacaggaugggucacuaccaucaucuugaaacagaggaaccguguugcagguucaugccagaacugaacaggacccagcaauccgccaccccucaccuccuguacucaccugguguguagccccagggcucauaguaggaggggaagaccccaaggugacagccgcggacaaauuccucauaauccacggggaggagagggcuuguggaagaaaggaauucugggugaaaaaucaccugucgacagaggagaagggcugagcuacuucuagccaccuagaguagcccagagaggguacauuucucuagaaacacacagcaaguccacaacaagcuaaagacuuaaacugaauucauuuggcuucagaagccaggguucuuucuaaacaguacaauugacagacuagguagaggagaagcaugauauccaagaacccuuuccccagccacaccccaccaaccucgggccagcccugaccuucacacggucggcacugcuguugaaaaggccaauucggcggaugguggucaagauggggucugaggagucguccagcauguugugggugcacacuggugggaaagacugccgcuguagacaggagacaugagggaggggucaggggagggagggcggucacagggcucugaagaagcuaccagcagaggucagcauacuccugacuggagcccgacuuuuaacuaucacaagcaaagcuaaaccaaaccaacaaaaaaaucccagcuaaacagaggcacuccacaucuugugaggaaaugucuguguuuaguuauauagucuugcccgucaauaacaaaaacucaaagaaccuuaccaagauggaagcaaccacguaacuugaaccaaaaugacaucagaauguugacuccacuccucccuccccucugccggugguggggggguggggaggaguuggggguggggagcucuaaagaacuguaccuaccccagccaaguguauagcuaugucuauuugauaacaagccacaaggacagcugggaguuguaguuuucuuuuuuuuuuuuaaaaaagauuuuuuuuuuuuaauauguaaguacucucugucuucagacacagcagaggagggcgucagaucucauuacagaugguugugagccaccacugcccggcuggaauugaacucuugaccucugaaaaagcagccagugcucuuaaccacugcgccaucucuccaggcccaaguuguaguuuucuuaugaaaauccacacccuaccaucaccaccaucacuuccaaccccacugcccuacccccucagggaagguaagcacaauuucagaagucaccgcugcaacacaaagacagacaggaaaucccagcccccucuuuuuuuuuuuaaaagacauuucuucuucuuuuuuuuuuaauuaauuuuuuauuauauguaaguacacuguagcugucuucagacgcaccagaagagggcgucagauuucauuacagaugauuaugagccaccaugugguugcugggauuugaacucaggaccuucagaagagcagucaaugcucuuaacugcugagccaucucuccagccccccagcccucucuuuuaugacaaguucuuuacaacuguuccaucauuauguuauuaaugggcccacuccugggugguaugagggugaaaaacuacaacucccagcagccccauguaaaaggcuucuucaugaguaaagcuggcugcuuaacuucaaaaauauuuugcccaaaaacacauucuaccucauuaauccaugcuggcugucuagaucccaaaacucagccucauuaaugccaaacauaggcaccagccccuugacccacaggaaaaaaaaaagaacucuaacucccaaaagccucaggggccaaggucaauauaauacaaaauacuaugggaguuguaguuuucauuuugugagccacaucucccuaauguuuccuguccuuuuaacuccaaccccaggaaucagaggguucugugagagguaagacacagccacggagcugggcuugguagugcaugccuuuaauauugguacucggaaagcagagguaggcagaucucaguuacaggcuagccugcucuacagagugaguucuaggacggcgaauaguggcugaugagcauucaguguucuccagaaaacacuagguguauugacuugccugacuccuaucuccuaaaggccccuuaaacugcuacccuuaacacgccccaggggcagcagaaacagaaguugucaccugggggcuucugaacguucaauaaacuaugaaguccccaaaaagaaauguaccuuaacagagaacaaccuucugcaaggcugacugacuguggagaugcuggaauguggcagguagagagucuaauuagacucugucucauaaaaauaagggcaggugggguggcacacacaccagcacuccaaaggcagaaacagguggaucucugaguucaaagccaaccuggucuacagagacaguuucaggacagccagggcuacacagagaaacccugucugcaaaggcaaaacaaaccaacaaacaacaacaacaaaacaccaccaacaacaacaacaacaaaaauugaucuuggucuaguucagugcuccugaaucgcccgccacucuuugcuaccugucucuaauaagggcugugacuuaaaaccuuuaggggugcaggaacuuaaagaaacccuaguuuuaagccgggcagugguggugcacgcuucuuuaaucccagcacuugggaggcagaggcaggcugauuucugaguucgaggccagccuggucuacaaagugaguuccaggacagccagggcuacacagagaaacccugucucgaaaaaccaaaaaaaaaaaaaaaaagaaacccuaguuuucaccaagacuggaaaugcccccagacauagagcugagguucccccuuucugugccccuucucagccugaugucuccagcagucucucucucuuuuuuuaaaagauuuauuuauuuauauguaaguauacuguagcugucuucagacgcaccaggagagggcaucagaucuuauuauggaugguugugagccaccaugugguugcugggauuugaacucacgaccuucagaagagcaguuggcgcucuuaaccacugagccaucucuccagccccagcagugucucuuuaaaauuaauuuauuuguucacuuuacaucccaauaucagcccccucuccucccauucuccccucaucaucucucccucaccccuucuccucugagaaggggacccccugguauccccuccagcaauguauuuuaacaaggccuucauucauuacugucaguguucuguuaucauaaaaagccacacgaucgucacuguguuggaacacuguaaccggaaucuguguucccaauccaugcuuauacuugguuccggaauaaaccaucuuacccuuugugaugugguggguguguuuuacuaucgguauuucucuggauuucagaacuggacccucuguaaagggccaccaaagagaacagaacucccagaaaccuuugcagcaagaggccucagcaaaugccagaacuggccagcacuuugcucagggguaaagaccauaccugaguggcaaagauggcucucuucaucauagugaaguccuccuuguccagcaucuuguucauguccgggaggcucccccugcaaggggagggggaggcauuucagaaugaagugacgggaugggucagggcaaucaugggagaagagcuaggggcugacacucacacuaaaagggauucguagagcuuccucccaaauuucuccuugacuguauuggcugugucccuggaacggagagaaacaaugucacaucacagccacuauguucugucaggcauugugggcaccagagaaacuuccgucuggguucagaauccacaccccgggggaccucaaacuggaagauggggaccuggagacugcuugaguuccuugagguggcugggaaugguggccuuuccucuccaacgucagugacuccucuuguagaugaguguaaaaauagagucaaccucaggugguugcagaggaguccgagaggucagggaaagcccagcacacagagagccuuccagaaaugucagcuauuauuaggguuagaaugagucuuggacagagcacugcuaggcccugucuuauaaacaggaggaauaauauucugagaggaacacccuggcacacaaguucggaaagacugucacccuacugucucaugacuuacgauccucccagggacaugccgacccaaccacaccagucucuucucucucucucuaacugccuccuggcucaguaugcugcccaguaugaccuugaccuuuugacccuccagccuccacuccccaaguauuagaauuaagagaaauggaccaucacacccacuuuaugccgugccggggcuugugagugcugaacgcccuaccaugagcuacauuuucagcucuuccucauuucuuaaacaugcaucugcuguucccagggcuuagaacagugccugccucgugguagauauucagagccuggugggcagugaacggguggguuucagagagcaggaaacaggcuccgugaggauucggugguucagcaagauaacaaggagucaggucaccucacugugugauggcugcccugauuacgcgcucacacuugucugccccgccacaugcuuuaagagaggaguucacuaggaauccugaucaugucagagauagccagagagagauaagauauggcgacugcagguacgaagcccacaggguccuggacaaggauugcugaccauaguuguuugcgcacggcuuggcccuucaggguuuccacguugaaauuauugguccgggccggcaugaugaagaaugcgacaacuguuugcucacugccauucaccuggggacggggaugagagggacaucaggguuguggacucaaucaugccuuugcugcuaagaaugaugggacuuccgauuuucuuuuucauaauaauauaggggauuaaaaucaaaucucuagaauacguaggcgcuuuaccacugagccacucuccugcccccucacugggcgauucuaggcaggggaucuaccacugagccacacugccagacugguuuuuauuuugauacagcgucucaaaauugcccaggucaaccuugaacucauucuauagacaaaagcugaccuugaaguuuugauccuucugcuucagccucccaggugcugggauaacagguacaggccaccagaucucacuucugaucuuucugggacucuauacucugccaaggguuuccacagccaucucucgggucucuguucuccccaucuaggcacacacuucccccuccggcuccccacccacugucccaccgagcaggccuuacucugagcagauaguugagccgggccaaugccuccaggaacacaucagcucccuuguuggaaaacucauagcggccagcgauaaagaaauacaaagucuugucuagguugaaguccaggugccuaaagaagccacaggggagugagugugaggcccaagcgccuaacccugugcugaagccaucaaaccccagaagucacagagccaaaggaaguuuuuauagugcacagguaucagagggaugcaugcaauugcagaauuucuccuuagaugaguauuuacccuaauacccaucccauggcuccagauaucaggaaauaauggagaccauugcuguccaggacugaggaccaaggaauccucacucucuucccugagacucgggagucuucucuccgcagagcucaggguccuaaccacagcccuccuccucagacgcaggaaucucaccucucccccgcccccauccaccucucuucacugucuggcucacauacccauaaaaauggccacgcacaaauuccuggauucgugcuuugcucugagcaugaagguucuggaauucgugcauagcagagaacuucuucacauucagcccguugggggucacaauaucuaggauugggagagacaggccgggcccaugcuucauuucuuucuuuuuuuuuuuuuuaagauuuauuuauuuauuauauguaaguacacuguagcugucuucagacacaccagaagagggagucagaucucauuacggaugguugugagccaccaugugguugcugggauuugaacuucggaccuucagaagagcagucgggugcucuuacccacugagccaucucaccagccccaugcuucauuucuuuauugugaucaacuucacaggcaaaaaccgaaggggaggugacuucccuuucuuucuuuuuuuuuuuuuuguuuguuuguuuguuuuucgagacaggguuucucuguguagcccuggcuggccucaaacucagaaauccgccugccuccagaaugcugggauuaaaggcgugcaccaccacgcccggcugaauucccuuucauaaugucacaguuuuauaauggcccuuuagugaucucagcuccacgggggacugauucaacaccgcuacuugacccuucauacucuguuuuagauuuuuuucuuguauuuuauguguauggugguuuugccugcaugcaugacuguguaacauauaugugccuguugccuguggaggcaagaagagguggucaggucuccaggaauuggaacacacagaugguuauaagccaccauguguguucucagaauuaaaccuggauuucccagaaaaguaaccaguguuuauacacucagacucgcacacaugcacacacacaugcgugccauacacacgcacacacauacauaaaaacaaauauuuuuuaaaaguauaugaggggagaaaggguugagucccuaaaagagacauaaagacagauggugcacugugagccaaguaugacagagcguguuaaucaagaugacccugagcuacauagugagacccuggcucagagagagagagagagagagagagagagagggagagagagggagagagagggagagagggagagggagagggagagagagagaggggaguggauauccuggagaagcagagcagugguauuuucagucccugugucagaaugggagaaggacagauggaaaacugcaccucccagaguuccugaguauaucaggccccauggcacuauccauggcacuauccauggcacuacccauggcacuauccauggcacuacccaucucuaggagcugagguauggagaguaaugcauaugaaaauagaagcguuuauaaaguuuauuuaaaaaaagacccaagaucagaccuaccacauucaauaaaagcugggcauggcuaaauucgccuauaauccuagugugggggugggggaagagaggugggcccugggagcuuacgaggccucaccaaaauggugaacuucagguucaaugagacacccugucuuacaagagcuguugggucugaugaaccggcucugcagucaaaugagcuuacugcugcucuugcagcacgcagacggggugguuaacaguacuuguaacugcagcugaagauuaggauauaagcccucuuccgcccccugugaacacacacacaccacacaugcacauacacaccaugcaugugugcauguacccacacaaggaugcgcgcgcgcgcacacacacauauacauaaauaaaaauaacaaacaccucuuuaaaaaauuagguggagagucacagagagaagacccccuacauucuccucugguuucuacacacacacacacauacacacacacacacacacacacacgcacgcacacgcacacacgcgcacacacgcacacgcacgcacacacacacgcacacguacacacacacacgcacacacacacacgcacacacacacacacgcacacacacacgcgcacacacgcgcacgcgcacacacacacgcgcacacacacacgcacacgcacgcgcacacacacgcacacgcacacgcacacacacacacacacacacacacacacgcacgcacgauuacaacaaaucaacccucaucaggaccuagggccaagacuuaggagcacgugaggcaggaucaguaaaccaaguuccuagcuaguuccacuuuauucaaaaauaaagcccgccauauuugcauuucuuucagaagaucaguauuuauauuaguuacucauaaaauuaggaugaaugagacuauagcuccuauuauccuucaggauacagagucagccagcuucauuuacgaguuaccaucucaauccaggacuuagggaaguuguucuacucucuggaguaaaauggcauugguguugagugugacauagagccucuuaccucagccacauguagggaccacagcucagacccuaccugguuuucucuuaaggagguguugagccucgauugcggugaucugggauacgguagugaagacaugggcacagugagcugcugcacgcuccaugcaguaccggugauagaucugccucucuccugcuuccuugucuacauugaacuggguaggaagggagaaaagucagcguuaaaaggaccaggguaagacuagggacuggacuggggucuuagggagguugggauuggcagcugcgcucugagaggcaggucugagggaggauggccaggaugggggggggggggggcaugucugaugguggaagggcugggagccugcacucuuaggagcacgauucccugccagggcuuugggcugucucacaauacaaucgcagcucacauucuccagguuguuguagaaguccacagcgccagcacacagguagcgccccagcagcguggcaugaguggugaagaugguugccaccggcaagcgccgggcacggcacagacacagaccaacgccagccaaccauucguggaagugggcaaccacauacggcuucucuucguucugggccaggaacuauggggcaacagggacagggagggucacuguguuuccacacggcccaaaaggaaccagcagcaauccccaucacggaugaagaagcaggggagagguaagcccgccauuaugcagagcaggcauuggucgcacaaagggccaaaacccaaguuaggccaaccggcugaccuuguccccagagguuaaugagauuuuuuuuuuuuuuuuuuuuuuuuuggcaagguaugaauucuggcaacgcggaacuggaaggaucaacaccccaagcccuggucacuacugcagggacuuggucuuuuuuuguuuguuuguuugguuuuuuuuuuuguuuuuuuuuuugguuuuuugagacaggguuucucuguauagcccuggcuguccuggaacucacucuguagaccaggcuggccucgaacucagaaaucugccugccucugccucuggagugcugggauuaaaggcgugggccacuacugcccggcuucuuuugguuuuucaagacagauuuucucuguguaauagcacuggcuguccuggaaaucacuuuguagaacaggcuugcccugaacucagggaucugcuugucucuaccucccgagauuaaagguacaugccaccaccacccggcuaagacucagcauuucaaucagcgguaguagaacuuuuaugggcacaaaacaggaccaaaacucccagauuuccuugaacgcacguguagcucuuuuuuguccuaaggcaucccaauuaagucuccuaaaaacuucucuuaaaaauucuagaauggguuugggguggggaaagcccagauuucugguucugaaaccaacucaagguugguaaguaucaaaaguuacccugagugcuuaacgguaauggauauuaaaguagacagcaacucccagaauuccugggacccaacccucuucuggcaggacucccuggaaacaaugucgcaguguguuuacaccuggauauagaggaaaugaaacugagguugacacuucuggucucugagaaaagcagcuagacucuuuucagagacgauccuuggauuaaaagaguggauggacaauucccagaauucccaggggaagcccacucucuggcccaagcggugaugaugaugaugaugguuucaagucuggguaggaaggcugagguggggucuguaguaccgccuaccucacccaggaaccagguggugaggaagccgaacaggacagcgucauuggccucgcggucguaccaggguaccccgauguugcaggugucccaaagcucacccuuccagcgcuccagggcccaagcugaggcuccuacauccaggagcaccacuagggguccccccucgaucagccaacgcccaaaauacaccugagggagaggcaaagggaggcucagaagaccuggcccgcauuccucgccggcuuacauccccagccugguaacugagcucagcugucucacguuccccucacccacggccucaucuguggcccucuguaaccccucccacuaccuuucuccucuccccauuggccuguuuugucaccugugucacgugucuaucagccaggacuguacuuuccuaccaauugccaccuuccuaaaacucgauguucuauuucaguccccauuagccauucuccuccggagaccacagguauggcuccaggccauugaucuaacucugucccaaccuggcuucgucuggccagggccucacuggagcaccccucccccucccagcuguugucugcccuuuugcugggaggggggggucuauuauuaggaacagcuguccugggggagggauguggccacucuggggucucauagggacauggucuggccugacuggaugcuggaacccaaccccgaacacaggcugugacuagguggagccucugcacuugucuuuccaucugcaucucuucuaggguucuuccaucucaccuucccucucuucuggcuuucuccuuguauuucuuuggcggggguggggguggggggagggggagacggacagggcuucucugccuaguccuggcuguccuggaacuuacucuguaguguugggaccaacaggcuucuguuugugguucuuaggaugaaacccacgggccaugcuaggcagggguucuaccgcugagcuauaaccccagaccccuacagggagauucuaggcaaggacucugccacugggccacaccccuagccccucauugggggauucuaggcaggggcucugccucugagccacgccccuuccucguuaguucauggaucugcucaccgcagacucuuuuccccugguucuccucucuucaucucuauuccaucuuuuugucugccuggcuacucaucuuuauuuuauuuacugugagacagagccuucuugugguccagacuggcuuagaacacaccgagauccuccugccuaggccuccguaguccugggauugcaggugugcacagaacacauagcuuugacuaucuuucugccuagcuccagcuuguuuguagucucugggucugaggaucucugcugagauucaucuccauccaucuggccuuucugacacccgguacccacuggccuacuucaccagauccuauacccgucuaucgcuuucuucccuaggccugcugggaaaguucugacuacaccuccugccuccauuccaccuucucuucaccucuugcuagggccccugcuggcaguucccacucccaccccccuggguagggcugugucccaccuuacaacccuugcuguucauggaauccaaaguccucuucaguuccggaguugggggcuccaggagcucuaccugcguccucacacccugcuccguguauggucccaccagauaguaguugucaccccauucauccccugucaccuucgccuucgucugcagcacaguguagaugccacccacugugggccaaagugcaaaaggacagacaaccccaccauugguccauagcuuugagaccuggcagguaaugggauguauguggguaguauugggguagaaaaugggcaggaaccuauaauugggaaucaggggagguugggacuggaggguaggggucguggaaaagcaaaccugaggauagcccucuugaguuuauggagagaggggacugaaaucaggaugcugagggaggagcaggcuccaguuagacuccuggucaugacacaggaagcacucuuuagucuccuaauucuuagagaauuaggagcaggaaggcucuaaagcucuugacuuucagaugcagugggaaaaaugguacauggcccuauccagcuacccaguuaccugagggaagcuugacuuauuauuccacaccuucagggccccuaacgaugcuagcccugggcugggacacagggacugcugggcccugcuccuccugugaccccaccucagauuuaggaaucuggguccucagccuucucaccugaaacugguacccugguaguacacagcauugagucugccaucucccaacaugcugagagaccuagucucuuucuccccaggauccagaaaaggaaauguucagauccacaaggcccagcugcugggauucccagcccagccuucucaugagcgagaagcuagugaucucccauacauacuguggguggguuccucccauccuagggcccagcuccugaccaacuuaggacuuccagcuuucccaguccacagggagggaggcaccucacuacauaggaagccaggacuuaggcccugggcuccuucaaacucgacauucaaguucccaacucuuucccaccuuguaucuaagaauuugagucuccaagccccucuuggcuuuacacugguucagguccgcuaugcccccugaaaaauccaugaaucccaaccuuuaggaacaccccaacuccacagucacguccucuggaccacagacccaaaagcuccaguguuccuugggcuuagaugcacuaacuccuuccacuuuuagaucucaggucucucggcccucgaaaaccucccuucaagacccaggaaucuuucucugagugcccucuucccuagauugcagaaccugaagccuccuuccaucuuaagaguagucucuugucccuuccccccagggccuaggacgccuacuccagccccuucacaaggacacagaagucacaggcgcuuuucccaggacccaagacuccuccacguaacucuuuucccgucugaaacggaguuucggggccccauccucgccugcccuucuuggucaagggaccaacgcugacguucucacccuuguuggccaccucccaggccaccucgaaaagcacugcguucucggggucgaauucauccucccagucuuccaauccuggaagcgaggacacagagagacugcggcugagaggcauggcuacugcgggcaggggacuucgagcaccaaaacuggaaaccagagagaucggcugggaacgcagcagacuuggugaccgguagaguuagcgggugucccaggggaagcuugcaaggcgcuccgcuuccuauugcacgaccgcacccccgccccagagcgcuccgacucagguagggugagcugagacacugaaucgggcgggcagcugcagugaagccucguggc

SEQ ID NO: 3799 - RNA, 41760 nt, Mus musculus
cuagguccagcagaccaccuccggcuugguuccagucuguggcccgggguauaugacuuaaaucaaauccgaauucugcccgggccacucguaggucuccgauaguuccuugaacuaaaacuucccucagagccuccauggcaggaaaaaaucggcuccaaauggccugcagaccagagacgugagcccaaggaaauggaggcaucaguacugagguaaucagcugcaccucccuuagcauccuagucuugagggauauccacugcuccccauaccccaaacacauaguucuuuccauaguaagaacccccaauacaagguccuucuugaccuuccccacugggccaucaccccagguuucauguaccaacugucucugucccauacacacuuuuuuaaaaagacagaauauuaugcagcccaggcugucuucaaacacuuguguagcagaagugagucucaacggagaagaugccuagauuagauagcccuguggguaugucuugggggaggaggugccuugauuuuaauugcuggaggagggcccagcacacuguaggcagcacuauuccuugggcagguggaccugaacccagagccuugaaacaacucuagcccuuuaaaaacuacacugguggauauagcagugcaugccuuuacccacugcacucaggagacauacuggggacagaauaccaugacagggacuuccagcagcaggcucaaauggagaugucucacaagcucacagcagcuccuuguaaaaaaggauggcaucugggaccuugagaagcaagagacacaugccucgaggggaccugccaucugaaauaaaggacugccuguaguaggucgggauggauacaucucaguagcccacagcagaucuuuguaaaaaacauuuguuccuaucucuccuaaccuuugcccuggaaaagggcugcauagauuucauuguguguggcugcuuuucaguuggccuugguguucauaauuauucuauuauaucugacuuucuuacuucuuucuccugcucuggugaauucugugaaacuagauguuccuuaauguaaugauuuuuuuaaauuuuauuuuauuuacaugaguacacuguagcugucuucagacacaccaaaaaagacaucagaucccauuauagaugauugugagcuacuauguaguugcugcugggaauuggacucaggaccucuggaagagcaguuagugguuuuuuuuguuguuguuuuuccaagauaggguuucucuguguagcccuggcuguccuggaacucacuauguugaccaggcuggccucaaacucagaaauccaccugccucugcaucccaagugcugggauuaaaggcguaagccaccaccgcccagcucaguuagugcucuuaaccgcugagccauuucuccaguccccgauguaaugauuuuuaaccaauuaaaaauugaggcauggggcacagcacagcacaguccuaauggcccaggugcaugccgugugcucucaucuuggaaacaacgcaauaacugcacaaugguaguuccggauuaaugcuugauuugcaaagaacguuugaagaaauuaguagaaaaugaaauagagccaacauuggggcacugggaaaaaaaaaaacuauugaaguuaugaaauaaguuuuguacaacauuugagaguaguuccuagauaagcaaguauagaaugcauaaaauaauacacuuguaaaacuaagucaaaacacugguacucuuaggagagucauugugugcaguauacagaagcagaaagcuagcagaacugcuggguuaaggguuaacuugauucuuucuggccacugccuggcagcuuugcccaugucauugaucauuagagcuucacagaaaacugcagguagcugaccuuggagcucugagcucugaaguauaguaagacaaaaguuaaaaaaaaaaaaaauguauacagagaaacccugucucgaaaaacaaaacaaaacaaagcaaaacaaagcaaaacaaaaaaaguuaaaguuuaaauaacgauaaauuugcaauuaguauuguuuugggccgggugugguggugcacgccuuuaaucuuagcacuugggaggcagaggcaggcggauuuuugaguucgaggccagccuggucuacaaagugaguuccaggacacccagggcuacacagagaaacccugucucaaaaaaaccaaaaaaauaacccaaaaaacaaaaaaagaaguauuguuuuggccacaggccugggaauagggaagcuugaaacuuuggggagcgauuguaauucuugauucuuugugggaugugguuauucuuuugaauuugauuuggcaaugauuauacaaugucuuuuuuucuaccugcuuuuggaguaucaauaaaagacuggggcaagagaaaggugagagagcgagugaggaggaguggagagcaaguggggugcucauaaggugugugugaggugaguguggagugaguggagaaaaugugagagaguguguaugugugagugagugagagugcauguggucugugugugugaggugugugugagguguguguaggagugugggaguucaagaaaagaaacgugggcugggcagugguggcgcacgccuuuaaucccagcacuugggaggcagaggcaggcggauuucugaguucgaggccagccuggucuacagagugaguuccaggacagccaggguuacacagagaaacccugucucgaaaaaccaaagaaaaaaaagaaaaagaaaaagaaaagaaagagaaagaaaagaaaaagaaaaaaagaagaaagaagaaaagagauucuucuuucucucucuccucucuuuccccuaaaaucuaacauggaggcuaaagcaugccccacagagucugagcaaguucugcuacauuugcuaaggauuacgacagcaucguccuugggcagccccugcugacuucacuuuggguugauuucuuuuaucuucugagaaagggaccuuuuuuuuuuuuuuuuuuuagagauuuauuuauuauuauacauaaguacacuguagcugucuucagacacaccagaagaagaugucagagcucauuacaggugguugugugagccaccaugugguugcugggauuugaacucaggaccuuuggaagagcagucagugcucuuacccgcugagucaucucgccagccagccccaaccuugcacuuuucaacuaaguuuuauuuuauuugugaaucuguguauacacacguucauacuuccaaagaucagaagaggaugucaaaaccccugaaacugggcuggcgagauggcucaacaguuaagagcacugacugcucuuccgaaggucaugaguucaaaucccagcaaccacaugguggcucacaaccacacugcuucauaugaugcugggcauggaacccugggcuuccugcaugccaggcaagugcucuauccacugaguuacauaccagcaucucuucaauaccucucauuuggucaccugcuugccugccuucuuuccuuccuuccuuccuuccuuccuuccuuccuuccuuccuucuuucuucuuccuuuuugagacaaggccucacuguguagcccuagcuauguagaccaggcuggacucagauucagagacaaccaccugccucugccuccugaggacucgagcugaacaugugaucucuucuugguugacuguagaaacagucgcugauuuuaggggccggagagaacaucucugugcuuaagagcgcuuguucuuguagaggacccagguuugccuccuaccagucagccucaugauacucccaaucccuucaguucuggcgggucugacaccaacuucuagccucuguggucaucaaauauacacauggaaaauuaaaucaaaugaacaacucuaauauaaauggguucuuaaucauauauauauauauauguguguguguguguguguguauauauguguguguauguauauauauguguguguguguguauauauauauauauauauaauguuuaugaguacacuguagcugucuucaugcacaccagaagagagcacuggauuccuuuacagaugcuugugagccaccaugugguugcugggauuugaacucaggaccucuggaagagcagucagugcucuuaaucacugagccaucucucuagcccuuuuagucacuauuuugagggucguacaguuuggugguaaaauuugagucccccguuagcuuuucuguagaugacuggagcccuggaaugaguuaaagacucccuucuucggauguuaccucccuguauuggggguggaguucugagaaaguagccuuucauuaucuccugauaucuccuguucuccgggagaaggaagcuuuuugugugccugugucuagcucuuccugggaguagacgcugcagaggcugagccucuguucuuaucugugggcuccuuagguccacagagcaagcgguaaccugcaguaacuaugagugcaucuggaaagcugagcuccuggaugccacgggacucuccugagcugcugcucggccucacacgccuccccaccacucccuagguaaguaagucuugcacuagcaaucccuaagcaaaauggccucugucuucuuugguuuucuugcuuucuaaauaaguacuuuuccuucaaguggggagaaaugaacuugaguuugugacuagaugcuggauucacccuggccaacacagauucugauccuuuuguguguguguguggugggggggguugacugugggcaaaccugggcaaccauguuuagcaccguauggaugugagagcggccucuccaggcuuaccuccauaaggaagacgccuugagaacgggcuuuggcaaccaucucccgaacuucugcugcauucacgcccauggguuucucacaaaggacagccuugccugcugccaggcagaggaguacggcuggcuugugcugggggugcuggguggcgauguaggccaccucuaggggaggagggaggagagagggauggucagcagcacggccagcaagagggccuggccgccaacguucagaggcaaggcugugaauacaguucuaggguucucauugaggggagacuaccaagcuuuuguguagugacaauuuggaaauuuugguuucuuuaaaaaaaaaacagaaacauaagaauauguuuucguuucagucccagcugugggauauggacuguccacagcagcugacuaugauuugccuugugcccuagcagaggugugguuuggccagcugcagagaguuucugcgauugugugacuuuuggaauucuggcgacuuuucagaggucuauaaaugcuagagucccagagguggauuguuggucagggcuugugaaggaguuauguacaaagaagaaacaaggagaaauuagauauucugacagggaagaucaaacuugcccauaaucagcagucuccgauuaacauccccccaaacucccuuucugaccccuggcuuuacucaggggucuccuuucuucccucucuuuucuucuuauguaguguuaggggguugaaaggguggaagaacccacaaaguagcaaaagacaguuacacuuuugggaggcugaggcaggaggacagccaauuggaggcuaugugugaggucuaucucaaaagcccaaguggccaagcaugcuugccuacaccuuuaaucccagugcuuacaaacuggaagccaaggcagguggaucucugagaaucugaagccagccuggucuacauaauaaaguuucaggccagccagggcuauacagugagugagaccgucucucaaaauaaaauaaaagugugggauucagcucggcggagcuuuugccuaaugugugagaggccuuggguuccauauccaguaucgcaaaauaaacaaguaaauaaauucuuaccagauuuucuagccuugggagaaacuuaaaacuuagccuuggcuaagcacagauuaauauuguucagccagucucgggucacguguaagccuauuaacugucuccuaaccaggccgagccugagccuuuccaaagaccaccccugcagcccagugcaucuguaggcaagaagcagugccuagcucugcccccaccucccugguccaggccacucacccacguuuggguccuuggccaguuccucauaagagccauaggccuuggggauguugaauuucugugcgaacuccucggcccgguucaggucccucgcagcuaccgcuaccaccuagcgugggauucaaaggguugagauguggaagacaaaguagacgagcuauggaggaggcugcaguggggagcaucuagccuccuccaagauggcuagggaagguauuacugguggggaggggaagcagauugggggggggggcagacuuaggcugugcuugguacauggcaagacugaauagagaggaaaggggagucuguaagcaagcccaggauccuccccgacugccccauggcuucgccucccagcagcugauaccuacccccugcaaaccgcgagccccucagacuggggcgcauaggaggugugagcugaaaacaaaucucuuauggccuuggggaccagaaggguccccuucucuucucagagucacugccuuagaccuagggacucuccucccucacacucggggcucccucguuccucggacuagggacucuuucuuagacccucggcuccacuccucccucggacccagugucuuccaagggacgugcaccuggugcuccgaggaaggcagugagcucagcacggugguaaagucguuggcaauuaagccagccgacacgaugccccagcgcagcgccauuuugcacgucuucugccugcgggggccggaggcggggccaacgccaccccgcgcugcaagccgcccgcuucccuuugacccucaggacacgaccucaggacgugaaaccgcaaucucuccacccgucuccuccuuccccuccucccugcgcccgcccuucucccucccuccuucuccuucuccuucuucucagugccuaacucuugcccaagcuggccugcaauucacaauauauauauauagccaaggcugcuugcugaccauaaacucaaggcaauccuccugccucagcuccuugagugcagcaauacaggcauacaccaccgugccugucuuucaaguugccuuuuuacuuuuuauuuugagauggggauuugcuauuguuaucaauuagucuguggggcccgggcgugguggcgcacgccuuugaucccagcacucuggaggcagaagccggcgaauuucugaguucgaggccagccuggucuacagagugaguuccaggacugccagggcuacacagagaaacccuaucucgaaaaaaaagccaauaaaauaaaauaaaauaaaauagucuguggucucaagaaaaugaccacaggauccaaaguauuucugacaaagcaaacguuuuacuucuggagaggacccaaguucuguccacuuggcagcucgaaaccaucuuccaggauauccagugccgccuucuguccucugagggcaccaggcaugcacauggugggcaugcaugcauacagacaaaacucuucaacgcauaaaauaaauuaggaaggaaggaaggaagaaaaagaaaauauggaggaggaggauuccuuggaaccagaguugcagguggcugugagccguucauuauauagaugcugggaagaacaguagaugcucuuaaccugagcccucucuccaccccccagauuaugucuuuacaagucucuuuaaugauggaacuugauuuaucucacuugccgucgagaggggaaagaaugugcaccuuacugauaauagcuccucuucacuuacagcccaguuucauucucucucgucugauccacugaacacugacugacugugcccagguguucacaagucuccuauuuaguaaggcauaggaggcuaaucaguuauugugcuuaacugauugaacuaaguggcggcgaggcaacagggacuuucagcacuggagcgagggaagccagggcugaggucaccuucuccucccaucuucacguaagccuuugccaggaaagaccguucccugucacaggcgccacagguacacgugcuuaagauagcaauccuccugccucagcuucccaagcagcucguacggacaggccuggaucacaggccucagagcugguccuguguccugugaccccuggaguuagggacagaguugucuuccauguccuucuguuucuucuuggcuuagcccuggaccucucugggggucacuuuucuguucuggagacugaaguccccacaguuucuacuuagaagaaagucuuaagaggauuaacugaguucuauggccuauuauguaaauauacucaaccgguuggcaaagucuaccuucaccaagacuccaauuucccuugccuguaagaccuugguagcuggaggcggugcccagauuguaaaaaccccaaagagaucaccaggaaucacaaccugcuguaauugcagggucuuuauucaaguuugagcuuagguccccaaccuucuugauggaacaggaaagagugaagccucuaagugaagggggguuauaaaggaaaaaaccccacaagcaggguuuucaagccguggcauuacaggagaggauaaaggaaugccgcccucaaaccuguaacauuucuucagacgggggugggggguagggggguggggggggaucagaacggcacagcuggaaagggaccuuucugaccugggaaaaguaacuugugcuguuagaagcuggugcaguuuuacagcuggccacagcugucugggaacacuuaauugucucuuuuucaucaucaaagagugggcuauuaucauugcaaggguauuggcuuauuuuuuuuucaagggcaggagccaucugcacuggagaaauguugguuguuaaucaaaugagugugaguuucaguaaccuggaggcuaggguaugcugccuguucccaaggcuggcauuugcacucgcgcgcgcgcacacacacacacacacacacacacacacacacacgagggggggugucaaggggagggagugcuaacugcucugacuccucauggggucaggagaguguaggauuugauguguagguuucuucagcuggcgggaugacucaguaguuaagaacaugugcugcuccuacagagaaccugcauuugguuuccagcguguauccacauugcucacaaucaacuguaacuccggcuccuggggaucugaugcccucucugaauucugcggacuccugcauucuuauggcauacacacaaaaacacacacauacucagaacuaaaaguaaaccuuuuuuaaaaaaggcuuaaugcaggcaggacuugguggcacacacuuuuaaucauaggaugcaauuggcagguagauuucagugaguugaaggccagccugguccacagaguuccaaggucgcuggagcugcacagugacagccugccucggaaaacaaaaagcaaaacaaacagaaugggccuuggugugggaggagccgaaaagccccaccccuccugaggcucucuaggcaguuguuacugagagagagaguaguauguauaucuuuuuucucagauguaauucuuguuuuuuuguuuguuuuugagacaggguuucucuguauagcccuggcucuccuggaacucacuuuguagaccagguuggccucgaacucagaaaccugccugccucugccucccgagugcugggauuaaaggcaugcaccaccuguagcuauuguguuguaugguggguuuuauuguuuuguuuuucucucuaaaucacguauguggugccaucuuggguaauaagaauauauuuacucagaagccauggcugcuaaccagggguagccaggucuaagguaaugagccuacaagcacuuccagguagauaaaaaagggaagagccacaagacugguuccuaagacuccagccauuacuccuuucugugaaaccacagcuucaggugaucuugggagauucaagauaauauggagagugggagauaagggaugcacagcuccugugacaucaacgugauguggugagacuuggucugggugcagcuguuuaugcccuuauguaaaugaaggccuccuaauuucuucagagacuguccccauccaagaugaggacaaagcaccacagguagccaccauccugguguucucauggccacgggaggccucaagaccaaugggacuugagugggaagccgcaugggcaugugcuuuggggagcagucucccacugacaaaaaagucuggauguuggugcagucuggaguugucacagcuaugugggaucauggaguuaugucccaguaacugacacagaagauaggagacugggacauuuccuguaauccuggcgcugucgcgcugcacacacugugcaggucagagcacauguugagacagaaccugugguugaggcuugaauugugaucccaggguguggccugcuucugccucccuguugcuggggucauaaguaauaccugggugacaagaauccaaacugagcuccucaugccugcacgagcacuuuuccaacugagccaucuccauggccccuaaacaugucuggcuugaacucaaaggacccacccacaucucucagccucccugccugguguuuggucauuuuuuuguuguuuuugucuuugggcacagggcuucauauagucuagguuggcuuugaacuuauaacacagccuaggaugacaaugaacuccugaucuuccugccucuaccucccaagcacuaggauuacgggcauuuaucccuguaccccaguuacguggacugugggauacagggccuccgucaugcuaggcacacauuaugccaacugagccacagacccuuaauaauauauauuuuuaauuauuuaagauaguaaacuuuuuuuuuucaagcucagguuuagguuuucuguucccauggcaaaaaugaagcagcgaggcccuuguggcaagagcacacagaaagccgccuggcaagucuccuggcagggaaagucaugugcccuaggauaccagggaggugagcagguggcgugcgugcaggcagggcuuggaagagggcaggauauucacacagauacacuaauguuuauuugugccgggcuauauuuggauggaacuggggcacagagcaggacacagcaguguggccugaagccagggaaguuggugaaccaauuuucaggagcccugagcaggguuggaccucagcuagggguguagccauaucuggguaccuccuggggccaugggguagguauugagccugggaguuaggguaggcugaugggguggugguaaaggccaggagucccaggcagagcugauagcuacuugaagaacaccccacauccugguggccucuagccaccaaaaggaauugagaucauuggcuccacagaaggcagagucagagacacuaagccaagguccugugauccagugacacuagguacaggaagcagagaggcugagccuggaacagagaagagcaaaguaggcaggugggcaggccuggagugugcacuccaggugaggugagcgagcucuccugcaacuucagcuccuguaguuaaucccugacaguggagggagggagcgagagagggaggcagaaccuggacccagaggcugagagcagagaaugguagaccagcagaagcacaucugaggaacaggguagccccuguucugcucccaggaggccaugagggcguugguccccagggaggcugcaaggccacuucaucuggcuuccacacugucugugggaaccugagggcuggggucucugaggaguuauaaaugcugggaauccagcuguggcagcucagggggcugcucugggaccuucuucucagaagcaggcacaucuuucuggucaccugcuggagcugggacaggagcgucaucugcagaggaaacaggagaaugauguuagauaaaauuccucaacacgggaaacaggauucucaggccuccuuccucagccugagacucagucacgaauccccugcuucugucuuaggggccugggacccggucuuccuccuucaguguccagggcacagagccguaccugugucugcacggaacugcagcugcccgucagguuuggaaggcggagcgcucuguucuugcaguugcugcuuccucugcuccaucugcagaacagccugcaggaggcagaugcacagucaggagguuauggccccaggaagaugcuaucuauagccaacugcuaaggggccacagucccuuuucuuccccauggccuuggcuccucgucacugagcugggauccacacuaguuaggauuccauugucuccugucguggcucaggugcucccacacugaacucuaggcuccccucacugccucauguaaaauggcugccaugcacagucaggcauggaaaauccucugccccuuuaaugacggcagcuaucaccugcauguauguaucuaagauuccuaacauggcagcuacaggccaucccacccugaagauacccauuuggauaaagaaaaggguccuaagagaaccagagaaugggcccgaauucccccacuggucaccugcugcagcucucucuucugugccuccaggcgguccugggagcgccccagggccucugucuccuggcugaggcgcugggcccuggcauucagcucagcuucccgggcagccagcuccucuucaaaacgcuucagcuccuccucuguguaggcuggggacauuuccacugucugcagggcacaggacagggucaggcgaucaguuagggcaagcucagccucacugagcgggagaggggcggaggcuggggugcaugugugugcuaccugacuggaaacagaguguuugcuaaagacuacagaaagaagaacaggggucuagauagggaauggcagaauucggaaccagaaggaagggcaggagagagccagaggugcugaaggaaaggcuggacccgggagacacuaaggucugaggguuucccguguccucaccuuccaccccuccccaguguccccgaacuccuuccucuggguggaugccaggaacuccuccagggucacaagccgguccugguugguguccaccuggggagccagaccaagguuagugacugugcugagccuguuguccacugcccacccuccgcauggcgucucucacauucuucaucacgugcucccgcaugcgaagccguucuuccuccaucucucucaugucauccuccucauucuucgggucauacaccuucuccagcugcagggugaagggagaagcgugacacgcugaggggcgcagaacaccgccacucuugggggacuuaccccccccccagaggaccaguggcgccugcuucacuauucauggcuucuuugucucuaggggcugcugggacuuacaguuuuuccugcacccucacugacaggaaagcagaggauagguuagggcguaagaggcugaaguaugucucgcucacaaagcuuccauuacacucaccuccuugguaaagagagcuuccaguucuugcucaucuaggacaccaucacuguugaugucuagggaugagaagagauauguuagcgacagggcugcaugagucuggcccuaagggagaagcuagagaagggauugugggagggcgugaggucucucagcagaggacaaugguggccauggccuguaggccagcaggaccuguucuuaucagcaugcauucuggcugggcaugguggcauacccuuuuaaucccagccucucugaguuacagccaggcagaaaucuugaguuucaggcuagccuggucuacagagugaguuucaggagagccagggcuacauagugucccugucuuaaacacaaaaccaaaaccacaaacaacccaaacaccaacaaaccaaaaccauucuuuagcaaacagggacccaagaauggaauccaggggccuugugaccucugcccucugagaaccagguccaaauucacuccagugacuagggaggccugagcaucaugggauagauaguccuugccugcccgcgugacccucaaagccauggcagacuuagacccacuucaguccccucccuacaagccagccaccagcauuucuggccacucacaaggcucuuaggucuggccuuugccugacugucuggaacaguccagagauucugucaacccuucaaggugacggucugcuccuaauccucucugugcgccacagcccuggaagucuggggagcacucucgggugccugcuucucuugcccguguggcagcaggcucugcccaucagucuggaacucccuuucugucuucucaauggcacugaagacugcacgggggccuugugcgggccacaacugcaccacacagcucugucaccccccuuuacccucccuuuuuccaugugucucugggacuacaccuuccaacugagcggccacuggucacacggggggacuaaaguugcaauggcauuaacuccaguggcauagacuguguuuacguaggggaacuggagccaaaaucacagacaggaagcacaauggcagaugccaauauggaauggagggguugagaugggggcugaacgaggagcugccugggagugcaggucuaguugcauuauuauuguuauuauuuuauuauuauuaaacuuuuucagauaggguuucucuguguaucccuggucgucuuagaacuuguucuauagaccaggcugaccuggaacucauagaucugccugcuucugccucccgagugcugggauuaacggugugcacugggaugcuuuugaggcugggucucacggugagggugaacuccuaaaccgcucacugggaccugggucgcccaggugcuccaccggcuccacuguacauggcucgagguuccaguuuuacaauaguaguauuuuuuuuuaaguaaaaaauuuagauuaugugcaugcgucugcacauaggugugugcauagaagugcgcugccuucagggccagaggcacgggaucccuugcagcuggugaguuacagguguuugugagcugcugggugugugugcugcgugugcacuugugugggugugaaugcaagcaugcacagcacagcucaguggucagaagaccucacacgucccuguccuuguuuucuuccagagagggucucucuggaacugcaggaaguggggucagcuagcuggccuaugagcuucgagggaccugccugucucugcccuuggcuucaccgucacugggaguauagggagucacuaccuuaccugguuuaccuggguucugagggucugaacgcgguucuuugaacuuguaaggcaagugcuuaaccaacugaaccauuuccuuauucccuaaaccugaaaacccuuacaacauggguguaguggcacacaccaguaaccgggagccagagacagacagaucucugugaguucaaggccagccuggcuuacagaguaaguucuaggacagccagggcuacauagagaaacccugucucaaaaaaaucaaagccaaaccaaaccaacaacaaaaacaaaaaccccaaaacaaaaccaaaauguuauauuuuguuuagcuugaaugcauuugugagccuagguaugggugcacuuggaacacaacucaagcauagaggucacaggucaacaugggacuugguccucuccuucugucauguauguuccacacaucaaacucagguugccaggcagggcucucggggccccaggcuucuggcuacuauggcagccaacagacuucauucucugaagccuaaaagcuucgaacccaacagcccaguggcaggguuauuuaaaaguguguguguguguguguguguguguguauguguguguguguguacacccacacguauauauuguguauggauauuuugccuacuuguaucauguguaucauaugugugcuuagugccuucagaggucaagagggcaucggauccccugagcuggaauuagauagcugugaggaccgugugaguacagggguccucuggaagaguagccaucuuuccaggcaguuucccccuaccucccacggcaguuucacauaggcaccaagauuuuuugucuccauggcucuugggaguuguaguucuuuauguacuccucaagccaggucugcucaguuagaggacauggccguuccuuagaauacagaggaaaaaaauauugaagagaaaugcuuggccaugggagaucucaggccuaccaacacggaggggcaggauauuuggccagucaggcuaugaaccaucagaaccugucacaucagcccgggucuggaaccccccucccccccuuaccaugcaguaugaagaaggucuugggguugaaccuguugggguccaauccauccaacuccucccacaccuccuucaacugggcuuggcugcccuguggagaagaacaggcgcuugugaacagugagucugagagccacuguaucaggguagacagcccuaggugcccauccaauaaacuuuaguucccucaagccagaacuacaauucccagcacucagguagguggacuuuuugccuuaaggacucuugggaguuguaguucugcaucugcacucauuuucugcuuaggaguuggacaugguaaaacauacauggggguccuuacaggaacauugacuuugggguguucccggugucugcgcuguugcucuuggagcuuccucucggccuccuuccgcugcuccucucccagagacuccagguaucgucuccucucauguuccuugagcaucucguagcguuugaacucuucauggugugcagcgucauacugggcgaggucucggguggccuguggagaggcaagagggucacauuccuccuguccuuagacaccugcaugaccucacuuccuuggucuccgugguugggucuguccacagcaaacccuggggugcuuucccaaaguagcggcuuggaugugaaucuuucgagucccccgcgagcucagcauuucaggaaugagcagggaugguaugugaaguaggcuuaauacagaaagcagcauggcuugggcagccaagaaaaaucccagcacucaggaaggugaggcaggagaauggcaaaagcauuuuuuuaaaaauuuguauuuccugugcauuuguguuuugccugcauguaugcuugugugaaggugucagauccccuggaacuacaguuauagacaaaugugaacugccaugugguugcugggaauugaaccugggucuucuggaagagcagcaggugcucuuaaccacugagccaucucucagaucccgaguauggcaaauuccaagccagccugggcuacauaucaagacacuggcucagagcaacucuuauaagacaaugaauucauacuuucucaagcuacuuaguaacgauaauugcagcaacaagggacuaacacaguugcuauggggacagcugcacuccccagguggcuguacaccaagggccaguugucaaccccagacuaguuuuuccuuguuacaucagauggaagucuuaggcauuaguggauaaagcccaggacugcucuaagcacccuacaaugcagagaacagauuccaucacauagcccuagccacccuguuuuucuguagaaaagcagagaugugcugagcuagcccagcccagcaccacugcccucuaccaggaggcaggacccaguucugcucacccgcucacccucacccaccgucuggaucagcagcucuaggucccgagccucaaacgugugcugguucugaggguccaggugcucaaacugcuucaggagguucaugugguccaccugcaagucuggguaagggaaaggcaaaccaacaccacccaucacgucacggcuuuucugucagaguuccuaacugagagcaggaaugcagagaggagagccacagaggccacgcaggcaaaaaggauggcacaugggccuggaggaugucugaggaccugagccugccacugacucuggugcuaaaaauaacaguaaccacaaugacagcaaugccaggcccugccucgacacuacagccuaaugacacgggcuccaugauuagcccugauugguuuguguagcaauggaggugaguguguguaugucucugaucaggcugcuaccaagccuuggcagcaagugccuuacaggcugcgccgucuugccaagugcugaacccacucauuuacagcauacaauuugauggcguuuuagaauguucacaguuacacacaaacuccaucaccaugacuuuuaggguacuguugucaucccuaaaagaaccaugcccuuuuucucuccccagcccacuggggacauuccaugugcuuuacagccuaggucccagcuuuggacagcauccuguuucccagguuuauuuccacuauucugcaugccaguuucucagaccuuuuuuagagcucacuaauguuucauggugcagguagagcacauuuuauuuauccacgccacagcuggcagacguuuaagcuacugguuccuuuagccauugugcaguuuucauuagcuuuguguuaugcuaugguaucugcugagacaggucuucuccaguaccaggcauaaggacuugccccauguagguggggaugguacaggcuugucauccagcuacucgguaggcugagacggauuguacguucugggcuugucuggguacagaguaaguuuuaaaagggggcugcggggcguggguggguucgugagcagggggagagggggagggauagaggauuuucaggggggaaaccagggggcagggcugcaguggagcgccugccuagaguccacucguaaggggcuggcagugugauuaggcagcguacuguuguuacucgguuuauaugugugugcgccuaugugugugugcaugcaugugcacacggguguacagagaguuuaugugaaggucagaggucaacucuauggaguggguugucuccuccccagcauauguggauacgagcucaggucaccaggcuugggggcccaucucccaggcccuuacuguaguguacuaaagauauuucaagggagaagcaggaacaugugguggcucuauaccagcacucagagguggaugcagaaggacccggcgucuaaagucaucuuuggcugcacaguaagacugaggcuagccugacuguaugagacccuguuucagaaaggcaaacucuccaccaccccucccccaauaaacaaaaaggcgggagaagcagagagaauaaugucaaugugaaagugugccagagccgagcagcaguggcgcacgccuuuaaucccagcacuugggaggcagaggccagccuggucuacagagugaguuccaggacagccagggcuacacagagaaacccugucuuggaaaaccaaaaaauaaaauaaaauaaauaaaaaagagaaagugugccagaaggaaaagaacgccaggccccacccagguacccccagccacccacgcucacugggcuccugcuuugcauccaucuuggccuugagcagcauccgcagccucgacaccuccugucgcuugagcucauccagcuugguucggacguuguggcugacgaaguccagcucuuggcucagcuuuccacucuucaaggacagaggggggggucccccagucaggcggacaccaagggggugugcugggcagcccacugugcacccuacaccccaaaccacucaacuccaguguuccugaagcuccauuaugcucauguuuuuccugcuuguggccugcccugguaccugggagcccagaugagcaggauggagccugagcuuugcugagaggcccugcucaccucagacccgguacugacugggagcgcucacacucacaagucuguucucaccauagggccacuagugcucuccugacaccucuuucaaaucaguucguucguucguucuuucuuucuuucuuccuuccuuccuuucucucucucucucucucucucucucucucuuucuuucuuucuuucuuuuuuguuuuuugagacaggguuucucuguauagcccuggcugucuuggaacucacucuguagaucaggcuggccucaaacucagaaauccgccugccucugccucucgagugcugggauuaaaggugugcgcgccuccaugcucagccaauuccugucuuucaauacucaacagagacaacacguccaccuuaggacgcaucuccaggcgucaccaucaccuacccacccacccacgagugcuaagcuuggugcuuucucgggccaugcccaaucucauccguuccaccaucagagcugacccuggccuccacugcucacagcacuccagggcucaccagcgucucugcuggguacaaggcccugcaacacugccugcccaucagccccaaggggcuaccagcaaacagcugaaggcaguaagagagcuucuuuuguaacccagaucugucaucggggaugcugacacccugcgcccacucccaucaugcacaucccugcugauggugaaggauguaagcuugacaaagccuagaauucucuagaggacaaacgugugagcauaucuaagagggaguuucuagacaggguuaauuaaggugugacgccccucccuccaugcuggcggcacuaucccauaagcugggcuccagaacugaaugaaaagaaggguagaugagcaucagcaggcauccaucucugacuggggauccaacacagcccacugccuggcccgcccccugcaaacucugccuaugaggccuuugaacugugaacaaggguaaagccucccauaagcugcuucuguugacaguuuugucacagcaaaaaaauaacuaaauagaagccaaucagaugagucagagaagaacuuaagaagggaacauggcuacaucuucacuggagagaaacugaggcacagcaaauggacauccccuagcugauagauggcagagcagagagcucauguccagguuuaaacacaucuugaggaguucccagacucccucccagcugugccccacaagcucccucgagcauagccccucauagcccaaccccagcgcaccuuaauguccucagcguuggcagccugcagcuucucccggaagugcccaucugucucuagcacguugaugaccuccuggagguaccggugguaguacaggcccguguccugagggggaagggagggcauggcaacaccugccucaucuucuaaguuucccccagccaggaccacagcucagcucccaacuugcagcagauacaccuuccacacacaacaggaggccugcaucacuuacuggccgaguccucaagagccagccagagccagccuguccaggcuccaacccuugaccuucugcuguguccaccgccugggagguucuauggcacuuaagaaaugaaaaucccagggggcgggagggcugaagagauguugaaggguaaaaugcucucugcauaagcaugggggccugagcuggagucagacuuaggacgaagagcccagcacccaacuccuguggcucacaaccaucaugcuaccugcaggggaccugaagcccucgccuggccucuguaccuacacacauggcacaaauacauacauacacacacacacacacacacacacacacaccauaaauacauacacacacacacaaauaacuuuuaaauaaaaguuuuagaagaaaguaaaaacuaaaucuuguuaggaaagccaaaugugccagugccugcuggccgugccagcuguagagcagggacagaugcaucucuuggggcucgcuggagccacagcuugaccuacugugugaaucccaggucccaguaaagcaccugaggaaggacaccagaggucccccuguggccucuccgugugugugacaugcauguguaccuauacacacaugaacaugcauaaaaaccugaacacacaugccuccacaaagaugaaaagaaaacucuaaggagaagccaggucuggugggacaugcuugugaucuuagcacuggggggcugaggcaggaggacugccucaaguucaagcccaguuuugggcuauagggugagaucuucccuuuaaaacaaucacaaaaauccaaacuaaagcaguggagauccucaggccuggagaugaauggagaggggccucagcugcagggacuccacagaguaucaggugcggacagacccucacuguuggggcugagguuucuggguucucacuaaaaaccauuaacuuuugggguggaaagacagcuugauaaugaagaaaacauacugcucuggcaaagaacccacaggaggucccucacaacugccugcaacuccagugcaggagacucgaugcccucucugggcuuccccaagugccuacacucacaugcacacacgcacacacacacacacacacacacacacacacacacacacaauuaaaaacacagccaggugugauaacacacaccuuuaucucagcacucaggaggcagaggcagaaggaccucugugaccuaaagcucaggcugguccacaaagugaguuccaggacaaccagaggacacagagagacccugucucucacacacacucuggcucagagcauguacugcugucccagaggcccagaguucaguucccagccucucgucagauggcuuacaaccgccuguaacuccaguccaggggaccugaugcccacucuggccuccuacgguaccgauggcguuagcauccucuuccuuuucuccagcucccuucucccagaagcugcuggguuuuguuuuguuuuguuuagauuuauuuuacauguagaaguguugugcccacauguaugugagugccugguacccagagaggucagaaggcaucagauccccuggaacuggaguuauaggugguugugagcugcacugugggugcugggaaccaagccugguacuuuucaacagcagcuaccaucucugcagcauacccccaagauaaagauuuuacuuuuaccaacaagaggaagaacacucaaaagaaaacccugauuacccagaaacccaucugacaacauggaagggacucacuaagaagggacucacuaagcuugucuggggggggggggcaacacucugugacucaggcgagguccuucccauagcucacagggcacagccccaccuccuuuggccucugcuaagguucccacuggagaauccccaggcuuuggcuuucucuuucaucccagguccauaagcccccgcccuuaguacccuuccuuccuggaauaaagaagccucugucucacaccucucuuagccucugucugaggggcagugaugggacaagacaugagcuuucuuuuuuuuuuuuuuuuuuaagauuuauuuauuuauuauauguaaguacacuguagcugucuucagacacaccagaagagggaaucagaucuuguuauagaugguugugagccaccaugugguugcugggauuugaacuaaggaccuuuggaagagcagucgggugcucuuaccugcugagccaucucaccagcccgacaugagcuuucuuuuuaacauucuuucacuaugugccauuauggcucaugaccaugggaggggaaccaaaucucugacuagaaugcaagguguuuguuuggggcagcaggauggcucagcaaggaagggugacugugccaacucugacaaccugacauugauucuuggcacugacguggaagaggaaagaggaagacaugauuccuacaaguuguccucugaccuccacacauacugguuuaccuccauauaugcacacaagauauguaaaugcauguaaaauggaggcccuggcccugccuugcaccaugugugcccugguaugagaucccaggguccccagacaguugccuuaacucuaaaugugguggagaugccauuugaggcugcugaggugucaaaucaagauuaacuuguuacuuagguucugagggccuugacugacccucuguaacccauguugcccucacagggggcacacaccagaggacacaugucccucccaguuccuccauguggucccacaacagcaguacugacacauauugggcccauuuucuuuucuuuuuuaaagauguauuuugcagguggugaugacgcacucacacagugaucgcaguacucaggaggcagagacagaucucugugagugugcguuugagcccugccucaucuauagaauaaguucuaggacagccagggauacacagagaaagccugucucaaaaaaacaaacaaaaaagaaaaaaaguuauuuguauuuuuucugugugugugccugguguaugucaugagugugaaggugccaguggaggccagaagaggccaucagacccccuggagcugaacuuacaggcaggugucagcaguccagucagggugcugggaacuaaacucuuccucuggaagagcagcagcccucuugccucugagcuaccucuccagcccaggcccacugucucaaccugucccaucaacaccauauaaaaccaagauguaggagcagaggaagggucaaaagacccaaguggcaccuucuggcauucgugguuacaaauggaguuucuuccuuuucucuagcaagccuugggcugccccccugagggcugagaacauugcacuggcugguuuugugugucaacuugacccaagcuagaguuaucagagaggaaggacccucagccgaggaaaugccuaggugagauccagcuguaagucagcagcgcgccccuccacagccuccgccuuggcuccugccuccagguuccugccccguuugaguuccuguccuggcuucccacagugaugaacagugcuguggaagguguaagccagauaaacccuuuccuccccgacuugcuucuugguccuggaguuuugucacagcaacaggaacucugaggaagacagacguggaacucugucuuccgagacagggcuucucuuucuaaccgcucuccucuaaaggauggucuccuuuuauucuuuauuuuuuuuuaauuuuuugaggcaggguuucuccauguggaguuugugagugcuaguaaucaaacucagggccucuggaagaacagucagugcucauaagcacagagccaucucuccagcccaauuuaaguuuugcuuugguugguugguuuuauuuuguuuuguuuuucuucaagacaggguucucuguguaguucuggauguccuagaacuagcucuguagaccaggcuggccuugaacuuaagagauccaccugccucugcaucccaagugcugggauuaaagacgugccuggcccccaauuugaguuuuaauugcuucucacaacuaaaucuauuuuguaaaaagcaaaaaccaaccauaugugcacuguguccagucugauguaacugacuuccuggucguuuaauaaccaaacuugggaaucagagccaaggaggcuacagggacacccugguaaacuucaauugucaaaaugacacagccuagcauagccucaacugaggaaccguguagaucaggcugaccugagaggccugucuugauuguuaacugacucagaagggcccagcccaucaugggaugcaccauucccuggacagguguccuggacugcauaaggaaguuagcugagcaugaacuggcugccagccagcaggcagcacccuccacaguuccugcugcaccucucggcuguaaagugaguuccuggguuggagguaacacuguguggaacagcaagcaggccugcugucguaggguuuuacaucuguggacggacaccaugaccaaggcaacacucggugguuuucuucuuuccucacgaggaucccagggauugaacacaggcaggccuggcaagccaguggcuuugaccaacggagccaucucauuggcaccuccaaucuuugcgcaaagagcuuuggaaugaaaucuauggggaucuucauaguaaaaaugguuugugucuauuguagccuagggaguggucccauuaaccuuuagcuauuucaucccaagcugccaccuuaauuuuaucuuccauccuuuucaguuaggccaccuucagaugacagucuaauuccaucuaacuguccccuuugaucuuacugcaaggacugaaacugacugagugggacccccacuucagcugugaauaguuagaucaacucaacacuuaaaaacacuauaaccuccuccauaguuuuagggucucaacucuccugggggaauguuagacagcacaggcaggcuuaagggucucugaggauuaaccccucccucaucaucaucagcuuugcaucuccugaaaauugaaaauuccccacaaaagggaggagaucgaagacaucugagcuguguugaggcccacuaaagggaagcuacuuccuucuggucgaccgaguacaaucugaauuuguccuaaacagccccaaacauuauauacuauuaauguccccucccuuaagagccuucggacuaauccuucagucaugugacuaagaauccacugcccaagaaagcugacucaccucaagaugugcuaagggauaggggguguggccaucuucuuaaugagauaagguacuuccaggccagaagccccucccuagggguagcugauggcugcucuccauugcugaaacugccacuuuuucagauaucucauuucaaaagcauaaggcuuccuucccucccuuucucugaguaucaccccaaaucguacgcaugcuuaucccaacccccaggacgcucucaauuccgcagaaccccaucuggauacauagcugcuuaacgacccauagugcucaacgucucuacuuuucccaugucucaaacagccugguuuucucuuccaucucccuccuggaaccugcaaaaacuuacaacuugucugcucuauuauuuuccucugauacaaugguuuucaggcuucaagauuucacagaguugaguacuaacgccuggcaggaggccucgcuacacaggagcugggaacaaccugucucaggagguaacaacagcuuguauugcuagggagagcuacaggaagaaccaggccauaaaucagggaccuggaguuugaaaguuuggacucucugggagcaaagauuucacagagcucaauaauacuggcaugaguaaaccagcaguucccguguccuuuucccacuuaaacuacacugcucgugagcuccgugaagcaagaaugcccugcuaggugguagcauccagcugcugacggugcuacugggaaaugugguuuucagguuuucuucauuccuuguuaaagagggucuuaacgaucagaggggaaaguuuagaugagggugugacacagguuuucauuugggaucugucuugauuuccacaucucaaaggucacugcccccaggucugcuugcaagucucacacacucacuauggcaaaggaaggcggguaaacgacacgccucagcguaucaaacaggggaucccuuggaguuuucuccagggcccuggggauggcaagcaccacugcaaagacgccagcgaccagggcagggcuacucaccggggucucaguggccuggcuguccuccugaggaggugcugcgcgguccacgggcacugccagcacagcagacagcaucaguagaggugguaggagaagaaaaggggccccgcggggcaccgagguaggcaucguggcuggucugugaggagagauggagaaugagguuuuuuucuuguuuugcuacgguuuucugagcuguguauuaaguagccuaaguuggccuugaauuccugacccuccugacucucccuuccaagcgcuggaauuacaggcguguaguacuaucccuggcuaaggaugucccaaccccguauccgguuggggaagcgagugugcacgccacccgauuugcaaaaaugaagacuccaagcguuuagucaccuggaacccaggaugccaggccucuaacaaccccggacgccaggccuccagccucccuuuccuggagcgcaauccgcagacccucauuccggcucccugaguaggggaauccucccccgaaccgugauuccaggccccuaaccuccccuucugccgggaccgccgaggccugacacuggacaaguaucacgcgcuccagccccucuugcccacggcuucugaaccccccucaccucuccagugcugagggcguuuuuuaaggccagcaaccuccgccagguuucuggcgauuucucuccuaagucacgcccacuuuuccacccgcagagagcccgcccccagaauacugauugguccacgcugacucugagcuuccgcccgcguuaacggccccgccccuuuccgaugagguuuccuuaucuuugaaaaucuuuccgguuuucuuggacgcucacagucuucaacgcaacauuuccugcguccguuuucaaguaaaacucaaagcccugcaugcccagggauugggggagggggugagacaggacaacuuuugcggacaucuugccgcggugucucuugggaguuguaguuuucucguuuaauuucgcuccacaaguuccugcaaguguuaggaaacuacauagcauaugaucauuauuuuuuaaacagagucucacugcauaucccuagauggagcucuguguaaaccaggauggccuagaggucacagagauccuugugcugagaauaaaaguagguaauacacacaaaugaaagugaagaagcugcgaauaccugauucugucuccuaguuuuccacuugcaaucauauacuuagguaccuuuaaaaaaaaaaaucuuugaagguaacuuuuuuguuuguuuguuuuucuuuuuuuuaaguuaaaaaaaaaaagauuuauuuauaugugaguacacugucuucagacacaccagaagagggcaacuaaucccauuacaaaugguugugagccaucaugugguugcugggaauugaacucagguccucuggaggagcagucacagcucuuaaccgcugagccaucucaucaguccugaggguaauuuaaaaaaaaaaaaaaaagauuuauuugcuuauuuuacauauacaaguacacuauagcugucuucagacacaucagaagagagcaucagaucccauuacaggcagucguggccacuaugugguugcuggaaauugaacucaggacugcuaguagagcaaugagugcucuuaaccacugagccaucucaccagccccuacuuugguaucuuuugacuccauggaaaagauaucugucuuagucacgcagccucuuugugauuucagaaaacacuucccagaagaugucaccucaauggugcuggucucuucuuaaucacagauaacuuuuuagcuccagcuaacaagcaucaauagucccaguaaugcaaaguuuucgcuuuaguaguucugguaucuuguuaaucacagcugauucuucagccccagcuaaccagaaccacagaagcuucacaaucaaaauagcaguggcccugauaagagucuuuaauuuucccucugaaauuucacaagccaggccuccaucuucugcacuauucucaacauuaucuuccaagcuccuacacaacaucucacagagcucuuaacacugaauggaucuucuggcccaaaguuccaaaguccuuccacagucuuuuccaaaacauggucagguugucacaggaauaccccacuccugguaccaauuugucuuagucagaguuucuauuccuggacaaaacaucaugaccaagaagcaaguuggggaggaaaggguuuauucagcuuacacuuuccacauugcuguugaucaccaaaggaugucaagacuggaacucaaacaggucagggagcaggagcugaugcagaggccauggagggauguuacuuacuggcuugccuccccuggcuugcucagccugcucucuuauagaaccaagacuaccagcccagagauugcaucaccugcaaggggaccuccccccuugaucacuaguugagaaaaugccuuacagcuggaucucauggaggcaucucccuaacugaagcuccuuugucugugauaacuccagcauguuucaaguugauacaaaacuagccaguacaauaucuaacauucaaaacuacucacaggaaaaagagggaaaaaaaaaacuuuuuuuuuuuuugaaaaugaaguuuuccccacauaguggucucuuaagcauauucucugaauauguggugugcuagcuggauaucuuuuggcauaauuguuacacacuuggcauggggagcacacacauugguauuuucaaaaaggccaaccagauaggucucccuagccuccugcaaagcacuaauaccugcacucuggaagugcaggucuguuuugaaguccugagcaguuucucaccccagacuuuggaaggagcauauggguaguucuccacuuuuguguguguguaugugugugugugugugugugugugugugugugugugugugugugugaauuuuaaaaauagaugcaagauauaaagcauuaaugcaagcaaaauauuucagugaacacauuucaacacuucaacuuuaugacaauuauaaauaaaucuguuaaaauuuucuggacaauuccagcauuagauuuuuuuaaaaaauuuauuuauuuacuuaauuuaucugaguacacugucgcugucuucagacacuccagaagagggcaucagaucccauugugagccauuaugagguugcugggauuugaacucaggaggaggagcagucagugcucuuaaccauugagccaucucuccagcccccucgauuuguuaaaaaaaaaaaaaaaaaguuuuuguauugacggcaacuaaaugguauugguagcauuuuuaucauacaguagauucuauccguucacuauauguugacugucuucugugcugauccuguuaguuugcuauuaaaauacauaauaaaaaagaguaaauuaccaagacugccagcccccccuccuucuuuaagauuuuauuuauuuuauguuaguacacugucauugucuucagagacaccagaucccauuacagaugguugugagccaccaugugguuccugggaauugaacucaggaccucugaaagagcagucagugcuuuuuucuugguuuuuugagacaggguuucccuguguagcccuggcuguccuggaacucacucuguagaccaggcuagucucgaacucagaaaucugccugccucugccucccgaguguugggauuaaaggcaugugccaccacgcccagcucagucagugcucuuaaccgcugagccauuuccccagcccccucuguuuuuauauaacugauuuauuuauuuucugaagugccuuuauagauucuaagcucuaacuuccaagcagcuguccccaccucccaagugcuggaacuacaggcacuggccccugggcauugagcuuguucauuucuuaaguacucucccuagagagcuauauagccagccugggucccuuuaaggaauguugacucuugguuccaauucagaauccccagaacaagggauccgccugccccagugcccugggagcauuacucuguuggacauggaccgugaggggccaagagggccaagaagugggcaagugccugugggaaccccuuucagagaaaggguccagauaaguuuagaguacaggcuucacuguuaggccgugagaugaccaaguugucuccagggaggguggacgccucugagauugcagauagguggacuccgaggguuugggauuuguggcccuaagccuccaguccccaaaacucaggaacaggacaagccuuggcuagguauuugguggagagcuggauuguugugcuuaaagcucucuacacaagcugcuaacucgcagggaggagcugggauuuggguugcuaaggccaaugaaggccgaggucagguaguagaggguggucucuuuugagauguggggucuagaucuugauugugccuuccuaauccucuagagcgucucaggagaaugaacaguggaagaaagagugaguggggaaaccuaaggggcaguguguucacgggagaggaaggacuuaggcgcgcaccguagggauccgcccagcuuggggguccgcccagcuugggacuccauuuucaggcucaccaccaucaacuuuguaggaaugugaggggggggggugccuggacgguucuguccuuuugaaauagguacagaugaaaacacuuaggucugugagaggaaggagcuaaggaccucugagucucccaugcuggcaaaaaccuggcaucucagcuaggguccuaaaauggggaggggcccugggagaaaaagcagauaaauggccuaaaaaguucaggucccuugccuacugugacaucacaggugcucagaacccaaauuggucaaggggcgggggcucuugaacaggcgagcugcccuugcuaguuguggccacuaguuuguguuucucucaggacccuggaggaugaauucucuggcgugaggcugcagaagcuagaacaacagguacggccuggaaccccacgcuuccaucuucccaaccaaccuuuccagaagguugcucagaguccccaaucauguguucguuuucucugaacuucggguucucucauuaagaaauaagaaaaaaauaggaauucagcuuuauuuugagacaggacuuugcggccuggcccuggcucucaaacgugcagcuugagugcuagaguuacagugagccuuccaguuuauuguguuuguuuauuuuugguuuuaaauuacauucauuugggguagaguacacgaaccccauggcauguguguggagacaacuugcaggggcagguucuuuccugugacaacauuaggacucgaacucagcuggugacgauaagauggcucgcccauuuaccaaccuagcccucucucgggccuaauuagucauuuucugagauggccuuacucuguagucuuuauaccggccuuuguauuuugaaacagggacuaaguugugagucuggaaauugcaacccucaagccucugccagaauggcugaggaaaaauuuuaaggaauaaaaguucuagagucuuuggaggaggaggugaaaguagaccagaucugacaggacaggacuggagggacuggauaccugggccuccuguggaggaaggguacccggacucucccaggccaaccuccccccugucugugucugguuuccuccuugcuucugcagcgacagcuauuugagaagaagcagcgcaggaaacgccaggagccccucaugguucaggccaauccugaugcuacccugaggcaccggcgaccaaggcgcggggaggagcgcuuccagagugacagcagcuggggccuuggucugguggaccggguuuaggcgcgcuugagggcagggccuagugaauccuagaggguggaacuuagccccagggagggaacucgguggcaucagcgguggggaaccuauaagagguccucuuugaggauagagauggggcuguaagucaggucucuaacauaucagggcggagccuauggauuccuagggguggagcuuaggacggagguuggaagagcauaugguagagcauaggggcguggcuuauuugagcguggggcuccuggaaucucucuacacaagauugauuggguuauggguuucuuaggagcccuugagauuaucugguccugugguaauacccaggcagagcaaagagauacuggagggcgaaaccuaagagauuccagcgacugggucugucugagggaccugggacuauccagagucagaguccuuccaguaaagcagggguuucacauuguuuucuuucuguaguaauaaggaucaaaccuggggugacacccaggcaguacaaguggcuuauuacugaguuuuuggcuuggguuggggagcggggugcgaugcauuccaugcuagcacaggcuauccuggaaguuguuacgcauugcaggauuuggggcaaucuuucuuacucuguagauccuuuucaaaugguccucucuguucuuugcucccagguguugggagcccuuuccuccaggagaacguuccgcaggcacaucugcccucaggggcgcacagugcccuugucaccaugagcuaugucgcagaugggaguggugagcgggccccccuacugucaccccgaggagcagguaaccuugggccauuggcauuuagaacguguccccuuagaaguuccugauugcacacuccccucccccugacaaccggagucacacccugagccucgugcaccagaggauccuaaaucuaaaccucuucuuucuccaguauacacucggggcaacggcccugcgguccgucaucaucuuugcuggcuuccagacagcuccgauucagacguggaggaagugaccauggaagacauccccgucaucucccgaccuccccagacgaaucuggcaaaccuacgcaggggcugguuagccuccccaggacccgguaauuugggggaagggaauaaaaucuggccccugguucacauggcagguugucacccuugauuuggcaacagguuuauauaggacaucauaacuccuaggacucauauuccauccguaagggugucuagucuguuauaguggauucagauguaaaaacaucagcacuucaaauguauuuauuuuaauacauuuggggaagcaaacaucuugaccucacagagaucgcuggccucugccuccuuccugagauuaacggugugcuguuuguaccacguccaguuuauuacaauuuuuuuuaagauuuuuauuuauuuauuuauuauuauaaguacacuguagcugucuucagaugcaccagaagagggcgccagauuccauuaugggugguugugagccaccaugugguugucggaauuugaacucaggaccuucagaagagcagucagugcucuuacccacugauccaucucaccugcccccuuacaauucuuuuuagcuaugugugugugugugugugugugugugugugugugugugugugugugugugugugugugugugaaugcaguucccacggaggccaaaagaggaauucagacccacugaaguuagaggcauuugugagccaucagauuugagcacuuagaaccaaacucggguucucuacaagagcaauauguguucuugauguuaaucuaucucuccagccucucuacucauguguuuuucgaaaguuuuuuuuuuuuuccuuuuggagggggcagaaguugugacacccuuaaucccuggggaagcaaaggcaggugaucucugaguucaaagcaagccuagucuacaaaucuaguuucaggucagccagggcuccacagugagacucugacucuggucucucccuaugcguucugagggagaucaggagguaggucuuaguccuugugugucccaugugcauaggaagugcagagaaugucgccacugagagagacggguaaggcagcugagaacucgaguucuggucuuaucuagcuggcaacgauccucuccucaccaggacccagauguccugaccuguagcugcuucugccccuuagggaucagucaagaagaaaaagaagaagagguuggauccacggaugccagaguugaagacaagacacccagcccagacccagacccagacccuaccgugaacucugacggagaucauggagaccuggcacccugcaagguggaagaaaacacagcccagaagaauacagaaacagccucuggcaucgggguagggugguacaaagaaccugcagcacagucugcagggcguuuugagugagguagcaacaacauccaaggugaaagccuacagcacugcuaguauuccuagcagucaggaggcugacagaggcagugggaguucaaggccaaccugagauacauaaggagacucucuccccuaaaaccaauaccccuuggucagauaccgacucauagagacuacagggcaugauucggaaggcucauuuuguagucaauaugaugucaugguugcuaggcaaguguucuuaccacugagcaacaccugagccccaccaugggauucuaggccagagguaguacugcuuagcaaugccccagcaaucucaugucauguuuuggcaggcauauguuugcauguucuuagugggacggucuuacacagauuauccuauggcucuguggucuacgagguuguaaacuugaccagucaacagaugugccaacuggaucaggcggguuagcugaugggcuugacuaauaagaagccuugggucuucaaaggucaucccugaccuggaauagccaacuggcccacaaggccaagcccaacugcuucucagcuugugauuugcacuugaauuaggaugaagaccgggagaagggagaggucacagagucuacagagacaaacuaugccccaguggcauccaagguuuugcaaggcgacgauggugacgccagcaaccacaaugccuggaacaugaccugcccccagccucgcauucccggcccucggcucggggaggacauggaagcauacguguugcucccugcaccccgagaccacauggugcagugccgcaucguccgaaacaagcacggcauggacaaggggauguucccuuccuacuaccucuaccuggaggccgaggaugguguagcaguacgcuccagcccuuuggggguggguaggccucacuccagaggggacagaucagagaaacaaaccccaaaucguaggaagauggcuccucuuggacaagguuaaagguuucuggagccagauguggugguauacaaagaauucuaguccuugggaaauagaggcaggggaggagcaguagaggccagccucggcucuaaaggaguucaaggccagccuccugagcuaacaugacacccuguuuccaaaacaaaacaaaacaaaaccuacaagaagggccagagggagguggugcaugccuuugaucccaccacacuaguuaaacagaggaaagcagaccucugaguuggaagucagcccugucuaaauaucggguuccaggucagccagggcaaagacaugagacccuugaaacaaagugauuauucuggaccaugucacacaguuaggacucaucagcuccuaguccugcccacuucagaauuucaaacuuugaaaacaucgugacuuggguccuccccacucuauagccaagucuuauccauuccugaguuaguccauaucugccucaccucccucccccuuaggauauaucgaucccuugggccucccauggcagucuccauggcagucaagccccacccaauccagcuauaaaccaggcuggcuugaagccuuccauucacuggcuaagccacaccccucuccaucugaccagccgccuucccaguguggccuccaucuccuccagaaaaagccuuuccuguauguugagaaguguucaggacccugguucuagacagguguuggaaaucaauguugaagccuguuccucugaucugcagcauuuccuucuggcugggcggaaaaggaaaagaagcaaaacuucaaauuaucucaucucccuggaccccaaagacaugucucgcaaugggagcaacuuuguaggcaaaguuagguagguaaagccuucuucgucugugguggggcaacagguggcaggaagccgggcgaaagacaagcaaauggacuacauuucccagcaggccucaaaacacaacacagcacuggcacuaaagccugaugaguuuuguaguucugcagguuguauuuccacaguuggggaggaaaaagaugaaaguuuuggaugccaugaauacagacuagcauuuaugauguauagguuggguuuuuguuuuuguuuuuuuauaggcaggggccugggaucccuaagucccuguggggaaugaagcccagagugugugaguuuuuaucuccuagguggaagaggguucuuagagagucaacgugggcuaggauaacucaccaaaaaaacagggagcugggacuguggauuuuuuuuuuuaaagauuuauuuuucuauuuuuuuuuauuauauguaaguacacuauagcugucuucagacacuccagaagagggagucagaucucauuauggaugguugugagccaccaugugguugcugggauuugaacuccagaccuucagaagagcaguggggugcucuuacccacugagccaucucaccagcccacuguggaauuuuuuuagaggauggguuaaaguacuuaaagaauaaucaggggggggcuagaaaguuuggcucagugguuaagagcacuggcugcucuuccagagguccugaguucagaucccagcaaccacaugguggcucacaaccacagcaauggaaucugaugcccucuucugguguguuugaggacagugauggugugcucacauacauaaaauaaaaucuuuauuaaaaaaaaaaaaagaagaagaagaaucacaaacaugauugucacucuguccaccacccuccuggagcagauccaaugucuugggcacgaaauucaccaucuucgauaauggggugaacccugagcggaguuacuggguuccagacagugcccggaucagagaggagcugggagucgucuguuauguaaguccucgggcaggggcagaauaggggugccaguagauaggaaagcacagggucagaccaacugcaaugcaaacuaucuugccaggagaccaaugucuugggauucagggggccucggaaaaugacugugauccuuccaggaauggacagccggaagcagaggaugaaaguccagccacaaaaugugagguuuuguuuuuguuuguuuuuggguuuuuuugaguuugaguuuuuaaaguuugaauucucaacgcuaagagagaacuccaucauagaucucaggugggacaacggcuaucaggucaugugugaaucuugaauggcuuugccagaguuccaucccagaaacuuccugagacucaaaacuucugaggcuagggcuggagagauggcucagugauuagcaaagcauguauuacucccuaguuggagaggaaaggccgaccucuuaaauuggagacuagucccaucuaaauuacgaguuccaggccagccaggguuauacagugagaccuugucuuaaaauaaauaaauaaauaaaucuaucucaggacucggggaggagguaggagugggggcagagggcaggcagaucucugucuacagaguaaguuccaggacacagagcuacacagaaaaaauucugucucaagaaacaaaaaguaggggcugaagagauggcucagccguuaagagcacugacugcucuucugaagguugaguucaaaucccagcaaccacaugauggcucacaaccaucuguaaugagaucugacacccucuacuggugucuaaagacaucuauaguguacuuauauauaauaaauaaauaaaucuuuaaagaaaaaaaaaagaaacaaaaaguaaaccuggcaaucuagagaaacugauucucaaacaaacaaaacaaauaacauauaugcacauggacuaaaaaucgggcuucuggugggcuaacaaacgaugcccccuacuguaucuucaaggaucaggauuccauauugagucgcguacagaagggcgcuggacacgggcugcuucuacugcagaacaaggccccaucguggagcgacgaaagcggcgcauacguacucaauuuucacggucgcgucacgcgggcuucagucaagaacuuccagauagugcacccggaugaacgugagcugcuagcaacccgaagaaagaugggggaugggggcggaagggggcacucaaguacaacuaagcaggguggcugccucacggucgcacggccucuugggaaauguaguuuauugaguuccuugcguucccuagcuugguaaggguaccgcgagugcgguguaacaaaaaagaauuuuaacuaguuccugguuugcuccucagccgaccaccuggugcuccaguuuggccguguggccccaaacauauucacgauggauuuccgauauccucuuugcccgcuccaagccuucgccaucugcuuauccaguuucgaugggaaacuggcgugugaguaacugaauaaaauaccaucccucaccaacucuguucugugcguuuggagaaagcuucacggcaugccuccuccuuucuuuuuuaguuuuuugauacucagucuggucuccaacaacuauguagcugaggcuugccuugaacauccgcuccuccugcuuccaccccugaaguacugggaugacaaagcacgcgcaccuuugugccuggccuugucuuuuaacaauaaaucuuuugacuauucuuuuuuuaguuaguguacaaaauaaugggcuucguuauaacauagaugucgucguugcaccuuguguauauaugccacccuuccuugucccuucaauuuuuuugagacagccacacuauguuaugcuugucuuggaacccaagccagucuccugccucagcuucccagugcggagauuacuuguggcaccuuacauaaggaagucccuuacacaggacuguguuuuaagagggucucacuagaucaaguuggucuuaaacuaaaguuuggacaccauuuuuagccuccccggaagcuaccaauaaagaacacacguaagaguuuaucacuacaaauuaaaaggcuuuauuucuuauucaaauaaauaaauaaauaaauaauaggaaacuacucaggcuuagccccgccucccucccaaguacaggcugggcgaagggguuucacugggaaggggagaggguguggucacaucuugggucaagggaguggccucagaggaagagcgaggcucggacuguggaagagauggguuucuaaggcgugcccaugcucuggcccuggaaucagggguaagguagggacccagcuucuccucugccugggcaaugcgucgagcaaagcggcuucgaucucgugcaaacugcucccagggaccucgacgggcagcuugggcugguccugcccagacagcaaggaaauggacugugacuuucucagcgaaguguaccuggggacggggacaauaaauaaaaaagucugucacgcaaaaauguuugguauuugaauagucaccugccugccccucugauucacucuaagacacagauguccaggccacaacuaccacucucccugccucuuacaggagauugcaagagagugaacacagccuucccagcagaguucauaugcaagaagucgcaacccauggcuucccuggagucuccgccuccaacacacuuccuuagggauuuucaggucccagacucuuccuccucccgacucagaaucuaggcccuuugaauaaauuauauauuaaa

SEQ ID NO: 3800 - RNA, 19463 nt, Mus musculus
uuugcacucgcgcgcgcgcacacacacacacacacacacacacacacacacacgagggggggugucaaggggagggagugcuaacugcucugacuccucauggggucaggagaguguaggauuugauguguagguuucuucagcuggcgggaugacucaguaguuaagaacaugugcugcuccuacagagaaccugcauuugguuuccagcguguauccacauugcucacaaucaacuguaacuccggcuccuggggaucugaugcccucucugaauucugcggacuccugcauucuuauggcauacacacaaaaacacacacauacucagaacuaaaaguaaaccuuuuuuaaaaaaggcuuaaugcaggcaggacuugguggcacacacuuuuaaucauaggaugcaauuggcagguagauuucagugaguugaaggccagccugguccacagaguuccaaggucgcuggagcugcacagugacagccugccucggaaaacaaaaagcaaaacaaacagaaugggccuuggugugggaggagccgaaaagccccaccccuccugaggcucucuaggcaguuguuacugagagagagaguaguauguauaucuuuuuucucagauguaauucuuguuuuuuuguuuguuuuugagacaggguuucucuguauagcccuggcucuccuggaacucacuuuguagaccagguuggccucgaacucagaaaccugccugccucugccucccgagugcugggauuaaaggcaugcaccaccuguagcuauuguguuguaugguggguuuuauuguuuuguuuuucucucuaaaucacguauguggugccaucuuggguaauaagaauauauuuacucagaagccauggcugcuaaccagggguagccaggucuaagguaaugagccuacaagcacuuccagguagauaaaaaagggaagagccacaagacugguuccuaagacuccagccauuacuccuuucugugaaaccacagcuucaggugaucuugggagauucaagauaauauggagagugggagauaagggaugcacagcuccugugacaucaacgugauguggugagacuuggucugggugcagcuguuuaugcccuuauguaaaugaaggccuccuaauuucuucagagacuguccccauccaagaugaggacaaagcaccacagguagccaccauccugguguucucauggccacgggaggccucaagaccaaugggacuugagugggaagccgcaugggcaugugcuuuggggagcagucucccacugacaaaaaagucuggauguuggugcagucuggaguugucacagcuaugugggaucauggaguuaugucccaguaacugacacagaagauaggagacugggacauuuccuguaauccuggcgcugucgcgcugcacacacugugcaggucagagcacauguugagacagaaccugugguugaggcuugaauugugaucccaggguguggccugcuucugccucccuguugcuggggucauaaguaauaccugggugacaagaauccaaacugagcuccucaugccugcacgagcacuuuuccaacugagccaucuccauggccccuaaacaugucuggcuugaacucaaaggacccacccacaucucucagccucccugccugguguuuggucauuuuuuuguuguuuuugucuuugggcacagggcuucauauagucuagguuggcuuugaacuuauaacacagccuaggaugacaaugaacuccugaucuuccugccucuaccucccaagcacuaggauuacgggcauuuaucccuguaccccaguuacguggacugugggauacagggccuccgucaugcuaggcacacauuaugccaacugagccacagacccuuaauaauauauauuuuuaauuauuuaagauaguaaacuuuuuuuuuucaagcucagguuuagguuuucuguucccauggcaaaaaugaagcagcgaggcccuuguggcaagagcacacagaaagccgccuggcaagucuccuggcagggaaagucaugugcccuaggauaccagggaggugagcagguggcgugcgugcaggcagggcuuggaagagggcaggauauucacacagauacacuaauguuuauuugugccgggcuauauuuggauggaacuggggcacagagcaggacacagcaguguggccugaagccagggaaguuggugaaccaauuuucaggagcccugagcaggguuggaccucagcuagggguguagccauaucuggguaccuccuggggccaugggguagguauugagccugggaguuaggguaggcugaugggguggugguaaaggccaggagucccaggcagagcugauagcuacuugaagaacaccccacauccugguggccucuagccaccaaaaggaauugagaucauuggcuccacagaaggcagagucagagacacuaagccaagguccugugauccagugacacuagguacaggaagcagagaggcugagccuggaacagagaagagcaaaguaggcaggugggcaggccuggagugugcacuccaggugaggugagcgagcucuccugcaacuucagcuccuguaguuaaucccugacaguggagggagggagcgagagagggaggcagaaccuggacccagaggcugagagcagagaaugguagaccagcagaagcacaucugaggaacaggguagccccuguucugcucccaggaggccaugagggcguugguccccagggaggcugcaaggccacuucaucuggcuuccacacugucugugggaaccugagggcuggggucucugaggaguuauaaaugcugggaauccagcuguggcagcucagggggcugcucugggaccuucuucucagaagcaggcacaucuuucuggucaccugcuggagcugggacaggagcgucaucugcagaggaaacaggagaaugauguuagauaaaauuccucaacacgggaaacaggauucucaggccuccuuccucagccugagacucagucacgaauccccugcuucugucuuaggggccugggacccggucuuccuccuucaguguccagggcacagagccguaccugugucugcacggaacugcagcugcccgucagguuuggaaggcggagcgcucuguucuugcaguugcugcuuccucugcuccaucugcagaacagccugcaggaggcagaugcacagucaggagguuauggccccaggaagaugcuaucuauagccaacugcuaaggggccacagucccuuuucuuccccauggccuuggcuccucgucacugagcugggauccacacuaguuaggauuccauugucuccugucguggcucaggugcucccacacugaacucuaggcuccccucacugccucauguaaaauggcugccaugcacagucaggcauggaaaauccucugccccuuuaaugacggcagcuaucaccugcauguauguaucuaagauuccuaacauggcagcuacaggccaucccacccugaagauacccauuuggauaaagaaaaggguccuaagagaaccagagaaugggcccgaauucccccacuggucaccugcugcagcucucucuucugugccuccaggcgguccugggagcgccccagggccucugucuccuggcugaggcgcugggcccuggcauucagcucagcuucccgggcagccagcuccucuucaaaacgcuucagcuccuccucuguguaggcuggggacauuuccacugucugcagggcacaggacagggucaggcgaucaguuagggcaagcucagccucacugagcgggagaggggcggaggcuggggugcaugugugugcuaccugacuggaaacagaguguuugcuaaagacuacagaaagaagaacaggggucuagauagggaauggcagaauucggaaccagaaggaagggcaggagagagccagaggugcugaaggaaaggcuggacccgggagacacuaaggucugaggguuucccguguccucaccuuccaccccuccccaguguccccgaacuccuuccucuggguggaugccaggaacuccuccagggucacaagccgguccugguugguguccaccuggggagccagaccaagguuagugacugugcugagccuguuguccacugcccacccuccgcauggcgucucucacauucuucaucacgugcucccgcaugcgaagccguucuuccuccaucucucucaugucauccuccucauucuucgggucauacaccuucuccagcugcagggugaagggagaagcgugacacgcugaggggcgcagaacaccgccacucuugggggacuuaccccccccccagaggaccaguggcgccugcuucacuauucauggcuucuuugucucuaggggcugcugggacuuacaguuuuuccugcacccucacugacaggaaagcagaggauagguuagggcguaagaggcugaaguaugucucgcucacaaagcuuccauuacacucaccuccuugguaaagagagcuuccaguucuugcucaucuaggacaccaucacuguugaugucuagggaugagaagagauauguuagcgacagggcugcaugagucuggcccuaagggagaagcuagagaagggauugugggagggcgugaggucucucagcagaggacaaugguggccauggccuguaggccagcaggaccuguucuuaucagcaugcauucuggcugggcaugguggcauacccuuuuaaucccagccucucugaguuacagccaggcagaaaucuugaguuucaggcuagccuggucuacagagugaguuucaggagagccagggcuacauagugucccugucuuaaacacaaaaccaaaaccacaaacaacccaaacaccaacaaaccaaaaccauucuuuagcaaacagggacccaagaauggaauccaggggccuugugaccucugcccucugagaaccagguccaaauucacuccagugacuagggaggccugagcaucaugggauagauaguccuugccugcccgcgugacccucaaagccauggcagacuuagacccacuucaguccccucccuacaagccagccaccagcauuucuggccacucacaaggcucuuaggucuggccuuugccugacugucuggaacaguccagagauucugucaacccuucaaggugacggucugcuccuaauccucucugugcgccacagcccuggaagucuggggagcacucucgggugccugcuucucuugcccguguggcagcaggcucugcccaucagucuggaacucccuuucugucuucucaauggcacugaagacugcacgggggccuugugcgggccacaacugcaccacacagcucugucaccccccuuuacccucccuuuuuccaugugucucugggacuacaccuuccaacugagcggccacuggucacacggggggacuaaaguugcaauggcauuaacuccaguggcauagacuguguuuacguaggggaacuggagccaaaaucacagacaggaagcacaauggcagaugccaauauggaauggagggguugagaugggggcugaacgaggagcugccugggagugcaggucuaguugcauuauuauuguuauuauuuuauuauuauuaaacuuuuucagauaggguuucucuguguaucccuggucgucuuagaacuuguucuauagaccaggcugaccuggaacucauagaucugccugcuucugccucccgagugcugggauuaacggugugcacugggaugcuuuugaggcugggucucacggugagggugaacuccuaaaccgcucacugggaccugggucgcccaggugcuccaccggcuccacuguacauggcucgagguuccaguuuuacaauaguaguauuuuuuuuuaaguaaaaaauuuagauuaugugcaugcgucugcacauaggugugugcauagaagugcgcugccuucagggccagaggcacgggaucccuugcagcuggugaguuacagguguuugugagcugcugggugugugugcugcgugugcacuugugugggugugaaugcaagcaugcacagcacagcucaguggucagaagaccucacacgucccuguccuuguuuucuuccagagagggucucucuggaacugcaggaaguggggucagcuagcuggccuaugagcuucgagggaccugccugucucugcccuuggcuucaccgucacugggaguauagggagucacuaccuuaccugguuuaccuggguucugagggucugaacgcgguucuuugaacuuguaaggcaagugcuuaaccaacugaaccauuuccuuauucccuaaaccugaaaacccuuacaacauggguguaguggcacacaccaguaaccgggagccagagacagacagaucucugugaguucaaggccagccuggcuuacagaguaaguucuaggacagccagggcuacauagagaaacccugucucaaaaaaaucaaagccaaaccaaaccaacaacaaaaacaaaaaccccaaaacaaaaccaaaauguuauauuuuguuuagcuugaaugcauuugugagccuagguaugggugcacuuggaacacaacucaagcauagaggucacaggucaacaugggacuugguccucuccuucugucauguauguuccacacaucaaacucagguugccaggcagggcucucggggccccaggcuucuggcuacuauggcagccaacagacuucauucucugaagccuaaaagcuucgaacccaacagcccaguggcaggguuauuuaaaaguguguguguguguguguguguguguguauguguguguguguguacacccacacguauauauuguguauggauauuuugccuacuuguaucauguguaucauaugugugcuuagugccuucagaggucaagagggcaucggauccccugagcuggaauuagauagcugugaggaccgugugaguacagggguccucuggaagaguagccaucuuuccaggcaguuucccccuaccucccacggcaguuucacauaggcaccaagauuuuuugucuccauggcucuugggaguuguaguucuuuauguacuccucaagccaggucugcucaguuagaggacauggccguuccuuagaauacagaggaaaaaaauauugaagagaaaugcuuggccaugggagaucucaggccuaccaacacggaggggcaggauauuuggccagucaggcuaugaaccaucagaaccugucacaucagcccgggucuggaaccccccucccccccuuaccaugcaguaugaagaaggucuugggguugaaccuguugggguccaauccauccaacuccucccacaccuccuucaacugggcuuggcugcccuguggagaagaacaggcgcuugugaacagugagucugagagccacuguaucaggguagacagcccuaggugcccauccaauaaacuuuaguucccucaagccagaacuacaauucccagcacucagguagguggacuuuuugccuuaaggacucuugggaguuguaguucugcaucugcacucauuuucugcuuaggaguuggacaugguaaaacauacauggggguccuuacaggaacauugacuuugggguguucccggugucugcgcuguugcucuuggagcuuccucucggccuccuuccgcugcuccucucccagagacuccagguaucgucuccucucauguuccuugagcaucucguagcguuugaacucuucauggugugcagcgucauacugggcgaggucucggguggccuguggagaggcaagagggucacauuccuccuguccuuagacaccugcaugaccucacuuccuuggucuccgugguugggucuguccacagcaaacccuggggugcuuucccaaaguagcggcuuggaugugaaucuuucgagucccccgcgagcucagcauuucaggaaugagcagggaugguaugugaaguaggcuuaauacagaaagcagcauggcuugggcagccaagaaaaaucccagcacucaggaaggugaggcaggagaauggcaaaagcauuuuuuuaaaaauuuguauuuccugugcauuuguguuuugccugcauguaugcuugugugaaggugucagauccccuggaacuacaguuauagacaaaugugaacugccaugugguugcugggaauugaaccugggucuucuggaagagcagcaggugcucuuaaccacugagccaucucucagaucccgaguauggcaaauuccaagccagccugggcuacauaucaagacacuggcucagagcaacucuuauaagacaaugaauucauacuuucucaagcuacuuaguaacgauaauugcagcaacaagggacuaacacaguugcuauggggacagcugcacuccccagguggcuguacaccaagggccaguugucaaccccagacuaguuuuuccuuguuacaucagauggaagucuuaggcauuaguggauaaagcccaggacugcucuaagcacccuacaaugcagagaacagauuccaucacauagcccuagccacccuguuuuucuguagaaaagcagagaugugcugagcuagcccagcccagcaccacugcccucuaccaggaggcaggacccaguucugcucacccgcucacccucacccaccgucuggaucagcagcucuaggucccgagccucaaacgugugcugguucugaggguccaggugcucaaacugcuucaggagguucaugugguccaccugcaagucuggguaagggaaaggcaaaccaacaccacccaucacgucacggcuuuucugucagaguuccuaacugagagcaggaaugcagagaggagagccacagaggccacgcaggcaaaaaggauggcacaugggccuggaggaugucugaggaccugagccugccacugacucuggugcuaaaaauaacaguaaccacaaugacagcaaugccaggcccugccucgacacuacagccuaaugacacgggcuccaugauuagcccugauugguuuguguagcaauggaggugaguguguguaugucucugaucaggcugcuaccaagccuuggcagcaagugccuuacaggcugcgccgucuugccaagugcugaacccacucauuuacagcauacaauuugauggcguuuuagaauguucacaguuacacacaaacuccaucaccaugacuuuuaggguacuguugucaucccuaaaagaaccaugcccuuuuucucuccccagcccacuggggacauuccaugugcuuuacagccuaggucccagcuuuggacagcauccuguuucccagguuuauuuccacuauucugcaugccaguuucucagaccuuuuuuagagcucacuaauguuucauggugcagguagagcacauuuuauuuauccacgccacagcuggcagacguuuaagcuacugguuccuuuagccauugugcaguuuucauuagcuuuguguuaugcuaugguaucugcugagacaggucuucuccaguaccaggcauaaggacuugccccauguagguggggaugguacaggcuugucauccagcuacucgguaggcugagacggauuguacguucugggcuugucuggguacagaguaaguuuuaaaagggggcugcggggcguggguggguucgugagcagggggagagggggagggauagaggauuuucaggggggaaaccagggggcagggcugcaguggagcgccugccuagaguccacucguaaggggcuggcagugugauuaggcagcguacuguuguuacucgguuuauaugugugugcgccuaugugugugugcaugcaugugcacacggguguacagagaguuuaugugaaggucagaggucaacucuauggaguggguugucuccuccccagcauauguggauacgagcucaggucaccaggcuugggggcccaucucccaggcccuuacuguaguguacuaaagauauuucaagggagaagcaggaacaugugguggcucuauaccagcacucagagguggaugcagaaggacccggcgucuaaagucaucuuuggcugcacaguaagacugaggcuagccugacuguaugagacccuguuucagaaaggcaaacucuccaccaccccucccccaauaaacaaaaaggcgggagaagcagagagaauaaugucaaugugaaagugugccagagccgagcagcaguggcgcacgccuuuaaucccagcacuugggaggcagaggccagccuggucuacagagugaguuccaggacagccagggcuacacagagaaacccugucuuggaaaaccaaaaaauaaaauaaaauaaauaaaaaagagaaagugugccagaaggaaaagaacgccaggccccacccagguacccccagccacccacgcucacugggcuccugcuuugcauccaucuuggccuugagcagcauccgcagccucgacaccuccugucgcuugagcucauccagcuugguucggacguuguggcugacgaaguccagcucuuggcucagcuuuccacucuucaaggacagaggggggggucccccagucaggcggacaccaagggggugugcugggcagcccacugugcacccuacaccccaaaccacucaacuccaguguuccugaagcuccauuaugcucauguuuuuccugcuuguggccugcccugguaccugggagcccagaugagcaggauggagccugagcuuugcugagaggcccugcucaccucagacccgguacugacugggagcgcucacacucacaagucuguucucaccauagggccacuagugcucuccugacaccucuuucaaaucaguucguucguucguucuuucuuucuuucuuccuuccuuccuuucucucucucucucucucucucucucucucuuucuuucuuucuuucuuuuuuguuuuuugagacaggguuucucuguauagcccuggcugucuuggaacucacucuguagaucaggcuggccucaaacucagaaauccgccugccucugccucucgagugcugggauuaaaggugugcgcgccuccaugcucagccaauuccugucuuucaauacucaacagagacaacacguccaccuuaggacgcaucuccaggcgucaccaucaccuacccacccacccacgagugcuaagcuuggugcuuucucgggccaugcccaaucucauccguuccaccaucagagcugacccuggccuccacugcucacagcacuccagggcucaccagcgucucugcuggguacaaggcccugcaacacugccugcccaucagccccaaggggcuaccagcaaacagcugaaggcaguaagagagcuucuuuuguaacccagaucugucaucggggaugcugacacccugcgcccacucccaucaugcacaucccugcugauggugaaggauguaagcuugacaaagccuagaauucucuagaggacaaacgugugagcauaucuaagagggaguuucuagacaggguuaauuaaggugugacgccccucccuccaugcuggcggcacuaucccauaagcugggcuccagaacugaaugaaaagaaggguagaugagcaucagcaggcauccaucucugacuggggauccaacacagcccacugccuggcccgcccccugcaaacucugccuaugaggccuuugaacugugaacaaggguaaagccucccauaagcugcuucuguugacaguuuugucacagcaaaaaaauaacuaaauagaagccaaucagaugagucagagaagaacuuaagaagggaacauggcuacaucuucacuggagagaaacugaggcacagcaaauggacauccccuagcugauagauggcagagcagagagcucauguccagguuuaaacacaucuugaggaguucccagacucccucccagcugugccccacaagcucccucgagcauagccccucauagcccaaccccagcgcaccuuaauguccucagcguuggcagccugcagcuucucccggaagugcccaucugucucuagcacguugaugaccuccuggagguaccggugguaguacaggcccguguccugagggggaagggagggcauggcaacaccugccucaucuucuaaguuucccccagccaggaccacagcucagcucccaacuugcagcagauacaccuuccacacacaacaggaggccugcaucacuuacuggccgaguccucaagagccagccagagccagccuguccaggcuccaacccuugaccuucugcuguguccaccgccugggagguucuauggcacuuaagaaaugaaaaucccagggggcgggagggcugaagagauguugaaggguaaaaugcucucugcauaagcaugggggccugagcuggagucagacuuaggacgaagagcccagcacccaacuccuguggcucacaaccaucaugcuaccugcaggggaccugaagcccucgccuggccucuguaccuacacacauggcacaaauacauacauacacacacacacacacacacacacacacaccauaaauacauacacacacacacaaauaacuuuuaaauaaaaguuuuagaagaaaguaaaaacuaaaucuuguuaggaaagccaaaugugccagugccugcuggccgugccagcuguagagcagggacagaugcaucucuuggggcucgcuggagccacagcuugaccuacugugugaaucccaggucccaguaaagcaccugaggaaggacaccagaggucccccuguggccucuccgugugugugacaugcauguguaccuauacacacaugaacaugcauaaaaaccugaacacacaugccuccacaaagaugaaaagaaaacucuaaggagaagccaggucuggugggacaugcuugugaucuuagcacuggggggcugaggcaggaggacugccucaaguucaagcccaguuuugggcuauagggugagaucuucccuuuaaaacaaucacaaaaauccaaacuaaagcaguggagauccucaggccuggagaugaauggagaggggccucagcugcagggacuccacagaguaucaggugcggacagacccucacuguuggggcugagguuucuggguucucacuaaaaaccauuaacuuuugggguggaaagacagcuugauaaugaagaaaacauacugcucuggcaaagaacccacaggaggucccucacaacugccugcaacuccagugcaggagacucgaugcccucucugggcuuccccaagugccuacacucacaugcacacacgcacacacacacacacacacacacacacacacacacacacaauuaaaaacacagccaggugugauaacacacaccuuuaucucagcacucaggaggcagaggcagaaggaccucugugaccuaaagcucaggcugguccacaaagugaguuccaggacaaccagaggacacagagagacccugucucucacacacacucuggcucagagcauguacugcugucccagaggcccagaguucaguucccagccucucgucagauggcuuacaaccgccuguaacuccaguccaggggaccugaugcccacucuggccuccuacgguaccgauggcguuagcauccucuuccuuuucuccagcucccuucucccagaagcugcuggguuuuguuuuguuuuguuuagauuuauuuuacauguagaaguguugugcccacauguaugugagugccugguacccagagaggucagaaggcaucagauccccuggaacuggaguuauaggugguugugagcugcacugugggugcugggaaccaagccugguacuuuucaacagcagcuaccaucucugcagcauacccccaagauaaagauuuuacuuuuaccaacaagaggaagaacacucaaaagaaaacccugauuacccagaaacccaucugacaacauggaagggacucacuaagaagggacucacuaagcuugucuggggggggggggcaacacucugugacucaggcgagguccuucccauagcucacagggcacagccccaccuccuuuggccucugcuaagguucccacuggagaauccccaggcuuuggcuuucucuuucaucccagguccauaagcccccgcccuuaguacccuuccuuccuggaauaaagaagccucugucucacaccucucuuagccucugucugaggggcagugaugggacaagacaugagcuuucuuuuuuuuuuuuuuuuuuaagauuuauuuauuuauuauauguaaguacacuguagcugucuucagacacaccagaagagggaaucagaucuuguuauagaugguugugagccaccaugugguugcugggauuugaacuaaggaccuuuggaagagcagucgggugcucuuaccugcugagccaucucaccagcccgacaugagcuuucuuuuuaacauucuuucacuaugugccauuauggcucaugaccaugggaggggaaccaaaucucugacuagaaugcaagguguuuguuuggggcagcaggauggcucagcaaggaagggugacugugccaacucugacaaccugacauugauucuuggcacugacguggaagaggaaagaggaagacaugauuccuacaaguuguccucugaccuccacacauacugguuuaccuccauauaugcacacaagauauguaaaugcauguaaaauggaggcccuggcccugccuugcaccaugugugcccugguaugagaucccaggguccccagacaguugccuuaacucuaaaugugguggagaugccauuugaggcugcugaggugucaaaucaagauuaacuuguuacuuagguucugagggccuugacugacccucuguaacccauguugcccucacagggggcacacaccagaggacacaugucccucccaguuccuccauguggucccacaacagcaguacugacacauauugggcccauuuucuuuucuuuuuuaaagauguauuuugcagguggugaugacgcacucacacagugaucgcaguacucaggaggcagagacagaucucugugagugugcguuugagcccugccucaucuauagaauaaguucuaggacagccagggauacacagagaaagccugucucaaaaaaacaaacaaaaaagaaaaaaaguuauuuguauuuuuucugugugugugccugguguaugucaugagugugaaggugccaguggaggccagaagaggccaucagacccccuggagcugaacuuacaggcaggugucagcaguccagucagggugcugggaacuaaacucuuccucuggaagagcagcagcccucuugccucugagcuaccucuccagcccaggcccacugucucaaccugucccaucaacaccauauaaaaccaagauguaggagcagaggaagggucaaaagacccaaguggcaccuucuggcauucgugguuacaaauggaguuucuuccuuuucucuagcaagccuugggcugccccccugagggcugagaacauugcacuggcugguuuugugugucaacuugacccaagcuagaguuaucagagaggaaggacccucagccgaggaaaugccuaggugagauccagcuguaagucagcagcgcgccccuccacagccuccgccuuggcuccugccuccagguuccugccccguuugaguuccuguccuggcuucccacagugaugaacagugcuguggaagguguaagccagauaaacccuuuccuccccgacuugcuucuugguccuggaguuuugucacagcaacaggaacucugaggaagacagacguggaacucugucuuccgagacagggcuucucuuucuaaccgcucuccucuaaaggauggucuccuuuuauucuuuauuuuuuuuuaauuuuuugaggcaggguuucuccauguggaguuugugagugcuaguaaucaaacucagggccucuggaagaacagucagugcucauaagcacagagccaucucuccagcccaauuuaaguuuugcuuugguugguugguuuuauuuuguuuuguuuuucuucaagacaggguucucuguguaguucuggauguccuagaacuagcucuguagaccaggcuggccuugaacuuaagagauccaccugccucugcaucccaagugcugggauuaaagacgugccuggcccccaauuugaguuuuaauugcuucucacaacuaaaucuauuuuguaaaaagcaaaaaccaaccauaugugcacuguguccagucugauguaacugacuuccuggucguuuaauaaccaaacuugggaaucagagccaaggaggcuacagggacacccugguaaacuucaauugucaaaaugacacagccuagcauagccucaacugaggaaccguguagaucaggcugaccugagaggccugucuugauuguuaacugacucagaagggcccagcccaucaugggaugcaccauucccuggacagguguccuggacugcauaaggaaguuagcugagcaugaacuggcugccagccagcaggcagcacccuccacaguuccugcugcaccucucggcuguaaagugaguuccuggguuggagguaacacuguguggaacagcaagcaggccugcugucguaggguuuuacaucuguggacggacaccaugaccaaggcaacacucggugguuuucuucuuuccucacgaggaucccagggauugaacacaggcaggccuggcaagccaguggcuuugaccaacggagccaucucauuggcaccuccaaucuuugcgcaaagagcuuuggaaugaaaucuauggggaucuucauaguaaaaaugguuugugucuauuguagccuagggaguggucccauuaaccuuuagcuauuucaucccaagcugccaccuuaauuuuaucuuccauccuuuucaguuaggccaccuucagaugacagucuaauuccaucuaacuguccccuuugaucuuacugcaaggacugaaacugacugagugggacccccacuucagcugugaauaguuagaucaacucaacacuuaaaaacacuauaaccuccuccauaguuuuagggucucaacucuccugggggaauguuagacagcacaggcaggcuuaagggucucugaggauuaaccccucccucaucaucaucagcuuugcaucuccugaaaauugaaaauuccccacaaaagggaggagaucgaagacaucugagcuguguugaggcccacuaaagggaagcuacuuccuucuggucgaccgaguacaaucugaauuuguccuaaacagccccaaacauuauauacuauuaauguccccucccuuaagagccuucggacuaauccuucagucaugugacuaagaauccacugcccaagaaagcugacucaccucaagaugugcuaagggauaggggguguggccaucuucuuaaugagauaagguacuuccaggccagaagccccucccuagggguagcugauggcugcucuccauugcugaaacugccacuuuuucagauaucucauuucaaaagcauaaggcuuccuucccucccuuucucugaguaucaccccaaaucguacgcaugcuuaucccaacccccaggacgcucucaauuccgcagaaccccaucuggauacauagcugcuuaacgacccauagugcucaacgucucuacuuuucccaugucucaaacagccugguuuucucuuccaucucccuccuggaaccugcaaaaacuuacaacuugucugcucuauuauuuuccucugauacaaugguuuucaggcuucaagauuucacagaguugaguacuaacgccuggcaggaggccucgcuacacaggagcugggaacaaccugucucaggagguaacaacagcuuguauugcuagggagagcuacaggaagaaccaggccauaaaucagggaccuggaguuugaaaguuuggacucucugggagcaaagauuucacagagcucaauaauacuggcaugaguaaaccagcaguucccguguccuuuucccacuuaaacuacacugcucgugagcuccgugaagcaagaaugcccugcuaggugguagcauccagcugcugacggugcuacugggaaaugugguuuucagguuuucuucauuccuuguuaaagagggucuuaacgaucagaggggaaaguuuagaugagggugugacacagguuuucauuugggaucugucuugauuuccacaucucaaaggucacugcccccaggucugcuugcaagucucacacacucacuauggcaaaggaaggcggguaaacgacacgccucagcguaucaaacaggggaucccuuggaguuuucuccagggcccuggggauggcaagcaccacugcaaagacgccagcgaccagggcagggcuacucaccggggucucaguggccuggcuguccuccugaggaggugcugcgcgguccacgggcacugccagcacagcagacagcaucaguagaggugguaggagaagaaaaggggccccgcggggcaccgagguaggcaucguggcuggucugugaggagagauggagaaugagguuuuuuucuuguuuugcuacgguuuucugagcuguguauuaaguagccuaaguuggccuugaauuccugacccuccugacucucccuuccaagcgcuggaauuacaggcguguaguacuaucccuggcuaaggaugucccaaccccguauccgguuggggaagcgagugugcacgccacccgauuugcaaaaaugaagacuccaagcguuuagucaccuggaacccaggaugccaggccucuaacaaccccggacgccaggccuccagccucccuuuccuggagcgcaauccgcagacccucauuccggcucccugaguaggggaauccucccccgaaccgugauuccaggccccuaaccuccccuucugccgggaccgccgaggccugacacuggacaaguaucacgcgcuccagccccucuugcccacggcuucugaaccccccucaccucuccagugcugagggcguuuuuuaaggccagcaaccuccgccagguuucuggcgauuucucuccuaagucacgcccacuuuuccacccgcagagagc

SEQ ID NO: 3801 - RNA, 19463 nt, Mus musculus
gcucucugcggguggaaaagugggcgugacuuaggagagaaaucgccagaaaccuggcggagguugcuggccuuaaaaaacgcccucagcacuggagaggugagggggguucagaagccgugggcaagaggggcuggagcgcgugauacuuguccagugucaggccucggcggucccggcagaaggggagguuaggggccuggaaucacgguucgggggaggauuccccuacucagggagccggaaugagggucugcggauugcgcuccaggaaagggaggcuggaggccuggcguccgggguuguuagaggccuggcauccuggguuccaggugacuaaacgcuuggagucuucauuuuugcaaaucggguggcgugcacacucgcuuccccaaccggauacgggguugggacauccuuagccagggauaguacuacacgccuguaauuccagcgcuuggaagggagagucaggagggucaggaauucaaggccaacuuaggcuacuuaauacacagcucagaaaaccguagcaaaacaagaaaaaaaccucauucuccaucucuccucacagaccagccacgaugccuaccucggugccccgcggggccccuuuucuucuccuaccaccucuacugaugcugucugcugugcuggcagugcccguggaccgcgcagcaccuccucaggaggacagccaggccacugagaccccggugaguagcccugcccuggucgcuggcgucuuugcaguggugcuugccauccccagggcccuggagaaaacuccaagggauccccuguuugauacgcugaggcgugucguuuacccgccuuccuuugccauagugagugugugagacuugcaagcagaccugggggcagugaccuuugagauguggaaaucaagacagaucccaaaugaaaaccugugucacacccucaucuaaacuuuccccucugaucguuaagacccucuuuaacaaggaaugaagaaaaccugaaaaccacauuucccaguagcaccgucagcagcuggaugcuaccaccuagcagggcauucuugcuucacggagcucacgagcaguguaguuuaagugggaaaaggacacgggaacugcugguuuacucaugccaguauuauugagcucugugaaaucuuugcucccagagaguccaaacuuucaaacuccaggucccugauuuauggccugguucuuccuguagcucucccuagcaauacaagcuguuguuaccuccugagacagguuguucccagcuccuguguagcgaggccuccugccaggcguuaguacucaacucugugaaaucuugaagccugaaaaccauuguaucagaggaaaauaauagagcagacaaguuguaaguuuuugcagguuccaggagggagauggaagagaaaaccaggcuguuugagacaugggaaaaguagagacguugagcacuaugggucguuaagcagcuauguauccagaugggguucugcggaauugagagcguccuggggguugggauaagcaugcguacgauuuggggugauacucagagaaagggagggaaggaagccuuaugcuuuugaaaugagauaucugaaaaaguggcaguuucagcaauggagagcagccaucagcuaccccuagggaggggcuucuggccuggaaguaccuuaucucauuaagaagauggccacacccccuaucccuuagcacaucuugaggugagucagcuuucuugggcaguggauucuuagucacaugacugaaggauuaguccgaaggcucuuaagggaggggacauuaauaguauauaauguuuggggcuguuuaggacaaauucagauuguacucggucgaccagaaggaaguagcuucccuuuagugggccucaacacagcucagaugucuucgaucuccucccuuuuguggggaauuuucaauuuucaggagaugcaaagcugaugaugaugagggagggguuaauccucagagacccuuaagccugccugugcugucuaacauucccccaggagaguugagacccuaaaacuauggaggagguuauaguguuuuuaaguguugaguugaucuaacuauucacagcugaagugggggucccacucagucaguuucaguccuugcaguaagaucaaaggggacaguuagauggaauuagacugucaucugaagguggccuaacugaaaaggauggaagauaaaauuaagguggcagcuugggaugaaauagcuaaagguuaaugggaccacucccuaggcuacaauagacacaaaccauuuuuacuaugaagauccccauagauuucauuccaaagcucuuugcgcaaagauuggaggugccaaugagauggcuccguuggucaaagccacuggcuugccaggccugccuguguucaaucccugggauccucgugaggaaagaagaaaaccaccgaguguugccuuggucaugguguccguccacagauguaaaacccuacgacagcaggccugcuugcuguuccacacaguguuaccuccaacccaggaacucacuuuacagccgagaggugcagcaggaacuguggagggugcugccugcuggcuggcagccaguucaugcucagcuaacuuccuuaugcaguccaggacaccuguccagggaauggugcaucccaugaugggcugggcccuucugagucaguuaacaaucaagacaggccucucaggucagccugaucuacacgguuccucaguugaggcuaugcuaggcugugucauuuugacaauugaaguuuaccagggugucccuguagccuccuuggcucugauucccaaguuugguuauuaaacgaccaggaagucaguuacaucagacuggacacagugcacauaugguugguuuuugcuuuuuacaaaauagauuuaguugugagaagcaauuaaaacucaaauugggggccaggcacgucuuuaaucccagcacuugggaugcagaggcagguggaucucuuaaguucaaggccagccuggucuacagagcuaguucuaggacauccagaacuacacagagaacccugucuugaagaaaaacaaaacaaaauaaaaccaaccaaccaaagcaaaacuuaaauugggcuggagagauggcucugugcuuaugagcacugacuguucuuccagaggcccugaguuugauuacuagcacucacaaacuccacauggagaaacccugccucaaaaaauuaaaaaaaaauaaagaauaaaaggagaccauccuuuagaggagagcgguuagaaagagaagcccugucucggaagacagaguuccacgucugucuuccucagaguuccuguugcugugacaaaacuccaggaccaagaagcaagucggggaggaaaggguuuaucuggcuuacaccuuccacagcacuguucaucacugugggaagccaggacaggaacucaaacggggcaggaaccuggaggcaggagccaaggcggaggcuguggaggggcgcgcugcugacuuacagcuggaucucaccuaggcauuuccucggcugaggguccuuccucucugauaacucuagcuugggucaaguugacacacaaaaccagccagugcaauguucucagcccucaggggggcagcccaaggcuugcuagagaaaaggaagaaacuccauuuguaaccacgaaugccagaaggugccacuugggucuuuugacccuuccucugcuccuacaucuugguuuuauaugguguugaugggacagguugagacagugggccugggcuggagagguagcucagaggcaagagggcugcugcucuuccagaggaagaguuuaguucccagcacccugacuggacugcugacaccugccuguaaguucagcuccagggggucugauggccucuucuggccuccacuggcaccuucacacucaugacauacaccaggcacacacacagaaaaaauacaaauaacuuuuuuucuuuuuuguuuguuuuuuugagacaggcuuucucuguguaucccuggcuguccuagaacuuauucuauagaugaggcagggcucaaacgcacacucacagagaucugucucugccuccugaguacugcgaucacugugugagugcgucaucaccaccugcaaaauacaucuuuaaaaaagaaaagaaaaugggcccaauaugugucaguacugcuguugugggaccacauggaggaacugggagggacauguguccucuggugugugcccccugugagggcaacauggguuacagagggucagucaaggcccucagaaccuaaguaacaaguuaaucuugauuugacaccucagcagccucaaauggcaucuccaccacauuuagaguuaaggcaacugucuggggacccugggaucucauaccagggcacacauggugcaaggcagggccagggccuccauuuuacaugcauuuacauaucuugugugcauauauggagguaaaccaguauguguggaggucagaggacaacuuguaggaaucaugucuuccucuuuccucuuccacgucagugccaagaaucaaugucagguugucagaguuggcacagucacccuuccuugcugagccauccugcugccccaaacaaacaccuugcauucuagucagagauuugguuccccucccauggucaugagccauaauggcacauagugaaagaauguuaaaaagaaagcucaugucgggcuggugagauggcucagcagguaagagcacccgacugcucuuccaaagguccuuaguucaaaucccagcaaccacaugguggcucacaaccaucuauaacaagaucugauucccucuucuggugugucugaagacagcuacaguguacuuacauauaauaaauaaauaaaucuuaaaaaaaaaaaaaaaaaagaaagcucaugucuugucccaucacugccccucagacagaggcuaagagaggugugagacagaggcuucuuuauuccaggaaggaaggguacuaagggcgggggcuuauggaccugggaugaaagagaaagccaaagccuggggauucuccagugggaaccuuagcagaggccaaaggagguggggcugugcccugugagcuaugggaaggaccucgccugagucacagaguguugccccccccccccagacaagcuuagugagucccuucuuagugagucccuuccauguugucagauggguuucuggguaaucaggguuuucuuuugaguguucuuccucuuguugguaaaaguaaaaucuuuaucuuggggguaugcugcagagaugguagcugcuguugaaaaguaccaggcuugguucccagcacccacagugcagcucacaaccaccuauaacuccaguuccaggggaucugaugccuucugaccucucuggguaccaggcacucacauacaugugggcacaacacuucuacauguaaaauaaaucuaaacaaaacaaaacaaaacccagcagcuucugggagaagggagcuggagaaaaggaagaggaugcuaacgccaucgguaccguaggaggccagagugggcaucagguccccuggacuggaguuacaggcgguuguaagccaucugacgagaggcugggaacugaacucugggccucugggacagcaguacaugcucugagccagagugugugugagagacagggucucucuguguccucugguuguccuggaacucacuuuguggaccagccugagcuuuaggucacagagguccuucugccucugccuccugagugcugagauaaagguguguguuaucacaccuggcuguguuuuuaauugugugugugugugugugugugugugugugugugugugugcgugugugcaugugaguguaggcacuuggggaagcccagagagggcaucgagucuccugcacuggaguugcaggcaguugugagggaccuccuguggguucuuugccagagcaguauguuuucuucauuaucaagcugucuuuccaccccaaaaguuaaugguuuuuagugagaacccagaaaccucagccccaacagugagggucuguccgcaccugauacucuguggagucccugcagcugaggccccucuccauucaucuccaggccugaggaucuccacugcuuuaguuuggauuuuugugauuguuuuaaagggaagaucucacccuauagcccaaaacugggcuugaacuugaggcaguccuccugccucagccccccagugcuaagaucacaagcaugucccaccagaccuggcuucuccuuagaguuuucuuuucaucuuuguggaggcauguguguucagguuuuuaugcauguucauguguguauagguacacaugcaugucacacacacggagaggccacagggggaccucugguguccuuccucaggugcuuuacugggaccugggauucacacaguaggucaagcuguggcuccagcgagccccaagagaugcaucugucccugcucuacagcuggcacggccagcaggcacuggcacauuuggcuuuccuaacaagauuuaguuuuuacuuucuucuaaaacuuuuauuuaaaaguuauuuguguguguguguauguauuuaugguguguguguguguguguguguguguguguauguauguauuugugccauguguguagguacagaggccaggcgagggcuucagguccccugcagguagcaugaugguugugagccacaggaguugggugcugggcucuucguccuaagucugacuccagcucaggcccccaugcuuaugcagagagcauuuuacccuucaacaucucuucagcccucccgcccccugggauuuucauuucuuaagugccauagaaccucccaggcgguggacacagcagaaggucaaggguuggagccuggacaggcuggcucuggcuggcucuugaggacucggccaguaagugaugcaggccuccuguuguguguggaagguguaucugcugcaaguugggagcugagcugugguccuggcugggggaaacuuagaagaugaggcagguguugccaugcccucccuucccccucaggacacgggccuguacuaccaccgguaccuccaggaggucaucaacgugcuagagacagaugggcacuuccgggagaagcugcaggcugccaacgcugaggacauuaaggugcgcugggguugggcuaugaggggcuaugcucgagggagcuuguggggcacagcugggagggagucugggaacuccucaagauguguuuaaaccuggacaugagcucucugcucugccaucuaucagcuaggggauguccauuugcugugccucaguuucucuccagugaagauguagccauguucccuucuuaaguucuucucugacucaucugauuggcuucuauuuaguuauuuuuuugcugugacaaaacugucaacagaagcagcuuaugggaggcuuuacccuuguucacaguucaaaggccucauaggcagaguuugcagggggcgggccaggcagugggcuguguuggauccccagucagagauggaugccugcugaugcucaucuacccuucuuuucauucaguucuggagcccagcuuaugggauagugccgccagcauggagggaggggcgucacaccuuaauuaacccugucuagaaacucccucuuagauaugcucacacguuuguccucuagagaauucuaggcuuugucaagcuuacauccuucaccaucagcagggaugugcaugaugggagugggcgcagggugucagcauccccgaugacagaucuggguuacaaaagaagcucucuuacugccuucagcuguuugcugguagccccuuggggcugaugggcaggcaguguugcagggccuuguacccagcagagacgcuggugagcccuggagugcugugagcaguggaggccagggucagcucugaugguggaacggaugagauugggcauggcccgagaaagcaccaagcuuagcacucguggguggguggguaggugauggugacgccuggagaugcguccuaagguggacguguugucucuguugaguauugaaagacaggaauuggcugagcauggaggcgcgcacaccuuuaaucccagcacucgagaggcagaggcaggcggauuucugaguuugaggccagccugaucuacagagugaguuccaagacagccagggcuauacagagaaacccugucucaaaaaacaaaaaagaaagaaagaaagaaagagagagagagagagagagagagagagagaaaggaaggaaggaagaaagaaagaaagaacgaacgaacgaacugauuugaaagaggugucaggagagcacuaguggcccuauggugagaacagacuugugagugugagcgcucccagucaguaccgggucugaggugagcagggccucucagcaaagcucaggcuccauccugcucaucugggcucccagguaccagggcaggccacaagcaggaaaaacaugagcauaauggagcuucaggaacacuggaguugagugguuugggguguagggugcacagugggcugcccagcacacccccuugguguccgccugacugggggaccccccccucuguccuugaagaguggaaagcugagccaagagcuggacuucgucagccacaacguccgaaccaagcuggaugagcucaagcgacaggaggugucgaggcugcggaugcugcucaaggccaagauggaugcaaagcaggagcccagugagcguggguggcuggggguaccuggguggggccuggcguucuuuuccuucuggcacacuuucucuuuuuuauuuauuuuauuuuauuuuuugguuuuccaagacaggguuucucuguguagcccuggcuguccuggaacucacucuguagaccaggcuggccucugccucccaagugcugggauuaaaggcgugcgccacugcugcucggcucuggcacacuuucacauugacauuauucucucugcuucucccgccuuuuuguuuauugggggaggggugguggagaguuugccuuucugaaacagggucucauacagucaggcuagccucagucuuacugugcagccaaagaugacuuuagacgccggguccuucugcauccaccucugagugcugguauagagccaccacauguuccugcuucucccuugaaauaucuuuaguacacuacaguaagggccugggagaugggcccccaagccuggugaccugagcucguauccacauaugcuggggaggagacaacccacuccauagaguugaccucugaccuucacauaaacucucuguacacccgugugcacaugcaugcacacacacauaggcgcacacacauauaaaccgaguaacaacaguacgcugccuaaucacacugccagccccuuacgaguggacucuaggcaggcgcuccacugcagcccugcccccugguuuccccccugaaaauccucuaucccucccccucucccccugcucacgaacccacccacgccccgcagcccccuuuuaaaacuuacucuguacccagacaagcccagaacguacaauccgucucagccuaccgaguagcuggaugacaagccuguaccauccccaccuacauggggcaaguccuuaugccugguacuggagaagaccugucucagcagauaccauagcauaacacaaagcuaaugaaaacugcacaauggcuaaaggaaccaguagcuuaaacgucugccagcuguggcguggauaaauaaaaugugcucuaccugcaccaugaaacauuagugagcucuaaaaaaggucugagaaacuggcaugcagaauaguggaaauaaaccugggaaacaggaugcuguccaaagcugggaccuaggcuguaaagcacauggaauguccccagugggcuggggagagaaaaagggcaugguucuuuuagggaugacaacaguacccuaaaagucauggugauggaguuuguguguaacugugaacauucuaaaacgccaucaaauuguaugcuguaaaugaguggguucagcacuuggcaagacggcgcagccuguaaggcacuugcugccaaggcuugguagcagccugaucagagacauacacacacucaccuccauugcuacacaaaccaaucagggcuaaucauggagcccgugucauuaggcuguagugucgaggcagggccuggcauugcugucauugugguuacuguuauuuuuagcaccagagucaguggcaggcucagguccucagacauccuccaggcccaugugccauccuuuuugccugcguggccucuguggcucuccucucugcauuccugcucucaguuaggaacucugacagaaaagccgugacgugaugggugguguugguuugccuuucccuuacccagacuugcagguggaccacaugaaccuccugaagcaguuugagcaccuggacccucagaaccagcacacguuugaggcucgggaccuagagcugcugauccagacggugggugagggugagcgggugagcagaacuggguccugccuccugguagagggcaguggugcugggcugggcuagcucagcacaucucugcuuuucuacagaaaaacaggguggcuagggcuaugugauggaaucuguucucugcauuguagggugcuuagagcaguccugggcuuuauccacuaaugccuaagacuuccaucugauguaacaaggaaaaacuagucugggguugacaacuggcccuugguguacagccaccuggggagugcagcuguccccauagcaacuguguuagucccuuguugcugcaauuaucguuacuaaguagcuugagaaaguaugaauucauugucuuauaagaguugcucugagccagugucuugauauguagcccaggcuggcuuggaauuugccauacucgggaucugagagauggcucagugguuaagagcaccugcugcucuuccagaagacccagguucaauucccagcaaccacauggcaguucacauuugucuauaacuguaguuccaggggaucugacaccuucacacaagcauacaugcaggcaaaacacaaaugcacaggaaauacaaauuuuuaaaaaaaugcuuuugccauucuccugccucaccuuccugagugcugggauuuuucuuggcugcccaagccaugcugcuuucuguauuaagccuacuucacauaccaucccugcucauuccugaaaugcugagcucgcgggggacucgaaagauucacauccaagccgcuacuuugggaaagcaccccaggguuugcuguggacagacccaaccacggagaccaaggaagugaggucaugcaggugucuaaggacaggaggaaugugacccucuugccucuccacaggccacccgagaccucgcccaguaugacgcugcacaccaugaagaguucaaacgcuacgagaugcucaaggaacaugagaggagacgauaccuggagucucugggagaggagcagcggaaggaggccgagaggaagcuccaagagcaacagcgcagacaccgggaacaccccaaagucaauguuccuguaaggacccccauguauguuuuaccauguccaacuccuaagcagaaaaugagugcagaugcagaacuacaacucccaagaguccuuaaggcaaaaaguccaccuaccugagugcugggaauuguaguucuggcuugagggaacuaaaguuuauuggaugggcaccuagggcugucuacccugauacaguggcucucagacucacuguucacaagcgccuguucuucuccacagggcagccaagcccaguugaaggaggugugggaggaguuggauggauuggaccccaacagguucaaccccaagaccuucuucauacugcaugguaagggggggagggggguuccagacccgggcugaugugacagguucugaugguucauagccugacuggccaaauauccugccccuccguguugguaggccugagaucucccauggccaagcauuucucuucaauauuuuuuuccucuguauucuaaggaacggccauguccucuaacugagcagaccuggcuugaggaguacauaaagaacuacaacucccaagagccauggagacaaaaaaucuuggugccuaugugaaacugccgugggagguagggggaaacugccuggaaagauggcuacucuuccagaggaccccuguacucacacgguccucacagcuaucuaauuccagcucaggggauccgaugcccucuugaccucugaaggcacuaagcacacauaugauacacaugauacaaguaggcaaaauauccauacacaauauauacguguggguguacacacacacacacauacacacacacacacacacacacacacacuuuuaaauaacccugccacugggcuguuggguucgaagcuuuuaggcuucagagaaugaagucuguuggcugccauaguagccagaagccuggggccccgagagcccugccuggcaaccugaguuugauguguggaacauacaugacagaaggagaggaccaagucccauguugaccugugaccucuaugcuugaguuguguuccaagugcacccauaccuaggcucacaaaugcauucaagcuaaacaaaauauaacauuuugguuuuguuuugggguuuuuguuuuuguuguugguuugguuuggcuuugauuuuuuugagacaggguuucucuauguagcccuggcuguccuagaacuuacucuguaagccaggcuggccuugaacucacagagaucugucugucucuggcucccgguuacuggugugugccacuacacccauguuguaaggguuuucagguuuagggaauaaggaaaugguucaguugguuaagcacuugccuuacaaguucaaagaaccgcguucagacccucagaacccagguaaaccagguaagguagugacucccuauacucccagugacggugaagccaagggcagagacaggcaggucccucgaagcucauaggccagcuagcugaccccacuuccugcaguuccagagagacccucucuggaagaaaacaaggacagggacgugugaggucuucugaccacugagcugugcugugcaugcuugcauucacacccacacaagugcacacgcagcacacacacccagcagcucacaaacaccuguaacucaccagcugcaagggaucccgugccucuggcccugaaggcagcgcacuucuaugcacacaccuaugugcagacgcaugcacauaaucuaaauuuuuuacuuaaaaaaaaauacuacuauuguaaaacuggaaccucgagccauguacaguggagccgguggagcaccugggcgacccaggucccagugagcgguuuaggaguucacccucaccgugagacccagccucaaaagcaucccagugcacaccguuaaucccagcacucgggaggcagaagcaggcagaucuaugaguuccaggucagccuggucuauagaacaaguucuaagacgaccagggauacacagagaaacccuaucugaaaaaguuuaauaauaauaaaauaauaacaauaauaaugcaacuagaccugcacucccaggcagcuccucguucagcccccaucucaaccccuccauuccauauuggcaucugccauugugcuuccugucugugauuuuggcuccaguuccccuacguaaacacagucuaugccacuggaguuaaugccauugcaacuuuaguccccccgugugaccaguggccgcucaguuggaagguguagucccagagacacauggaaaaagggaggguaaaggggggugacagagcuguguggugcaguuguggcccgcacaaggcccccgugcagucuucagugccauugagaagacagaaagggaguuccagacugaugggcagagccugcugccacacgggcaagagaagcaggcacccgagagugcuccccagacuuccagggcuguggcgcacagagaggauuaggagcagaccgucaccuugaaggguugacagaaucucuggacuguuccagacagucaggcaaaggccagaccuaagagccuugugaguggccagaaaugcugguggcuggcuuguagggaggggacugaagugggucuaagucugccauggcuuugagggucacgcgggcaggcaaggacuaucuaucccaugaugcucaggccucccuagucacuggagugaauuuggaccugguucucagagggcagaggucacaaggccccuggauuccauucuugggucccuguuugcuaaagaaugguuuugguuuguugguguuuggguuguuugugguuuugguuuuguguuuaagacagggacacuauguagcccuggcucuccugaaacucacucuguagaccaggcuagccugaaacucaagauuucugccuggcuguaacucagagaggcugggauuaaaaggguaugccaccaugcccagccagaaugcaugcugauaagaacagguccugcuggccuacaggccauggccaccauuguccucugcugagagaccucacgcccucccacaaucccuucucuagcuucucccuuagggccagacucaugcagcccugucgcuaacauaucucuucucaucccuagacaucaacagugaugguguccuagaugagcaagaacuggaagcucucuuuaccaaggaggugaguguaauggaagcuuugugagcgagacauacuucagccucuuacgcccuaaccuauccucugcuuuccugucagugagggugcaggaaaaacuguaagucccagcagccccuagagacaaagaagccaugaauagugaagcaggcgccacugguccucugggggggggguaagucccccaagaguggcgguguucugcgccccucagcgugucacgcuucucccuucacccugcagcuggagaagguguaugacccgaagaaugaggaggaugacaugagagagauggaggaagaacggcuucgcaugcgggagcacgugaugaagaaugugagagacgccaugcggagggugggcaguggacaacaggcucagcacagucacuaaccuuggucuggcuccccagguggacaccaaccaggaccggcuugugacccuggaggaguuccuggcauccacccagaggaaggaguucggggacacuggggagggguggaaggugaggacacgggaaacccucagaccuuagugucucccggguccagccuuuccuucagcaccucuggcucucuccugcccuuccuucugguuccgaauucugccauucccuaucuagaccccuguucuucuuucuguagucuuuagcaaacacucuguuuccagucagguagcacacacaugcaccccagccuccgccccucucccgcucagugaggcugagcuugcccuaacugaucgccugacccuguccugugcccugcagacaguggaaauguccccagccuacacagaggaggagcugaagcguuuugaagaggagcuggcugcccgggaagcugagcugaaugccagggcccagcgccucagccaggagacagaggcccuggggcgcucccaggaccgccuggaggcacagaagagagagcugcagcaggugaccagugggggaauucgggcccauucucugguucucuuaggacccuuuucuuuauccaaauggguaucuucagggugggauggccuguagcugccauguuaggaaucuuagauacauacaugcaggugauagcugccgucauuaaaggggcagaggauuuuccaugccugacugugcauggcagccauuuuacaugaggcagugaggggagccuagaguucagugugggagcaccugagccacgacaggagacaauggaauccuaacuaguguggaucccagcucagugacgaggagccaaggccauggggaagaaaagggacuguggccccuuagcaguuggcuauagauagcaucuuccuggggccauaaccuccugacugugcaucugccuccugcaggcuguucugcagauggagcagaggaagcagcaacugcaagaacagagcgcuccgccuuccaaaccugacgggcagcugcaguuccgugcagacacagguacggcucugugcccuggacacugaaggaggaagaccgggucccaggccccuaagacagaagcaggggauucgugacugagucucaggcugaggaaggaggccugagaauccuguuucccguguugaggaauuuuaucuaacaucauucuccuguuuccucugcagaugacgcuccugucccagcuccagcaggugaccagaaagaugugccugcuucugagaagaaggucccagagcagcccccugagcugccacagcuggauucccagcauuuauaacuccucagagaccccagcccucagguucccacagacaguguggaagccagaugaaguggccuugcagccucccuggggaccaacgcccucauggccuccugggagcagaacaggggcuacccuguuccucagaugugcuucugcuggucuaccauucucugcucucagccucuggguccagguucugccucccucucucgcucccucccuccacugucagggauuaacuacaggagcugaaguugcaggagagcucgcucaccucaccuggagugcacacuccaggccugcccaccugccuacuuugcucuucucuguuccaggcucagccucucugcuuccuguaccuagugucacuggaucacaggaccuuggcuuagugucucugacucugccuucuguggagccaaugaucucaauuccuuuugguggcuagaggccaccaggaugugggguguucuucaaguagcuaucagcucugccugggacuccuggccuuuaccaccaccccaucagccuacccuaacucccaggcucaauaccuaccccauggccccaggagguacccagauauggcuacaccccuagcugagguccaacccugcucagggcuccugaaaauugguucaccaacuucccuggcuucaggccacacugcuguguccugcucugugccccaguuccauccaaauauagcccggcacaaauaaacauuaguguaucugugugaauauccugcccucuuccaagcccugccugcacgcacgccaccugcucaccucccugguauccuagggcacaugacuuucccugccaggagacuugccaggcggcuuucugugugcucuugccacaagggccucgcugcuucauuuuugccaugggaacagaaaaccuaaaccugagcuugaaaaaaaaaaguuuacuaucuuaaauaauuaaaaauauauauuauuaagggucuguggcucaguuggcauaaugugugccuagcaugacggaggcccuguaucccacaguccacguaacugggguacagggauaaaugcccguaauccuagugcuugggagguagaggcaggaagaucaggaguucauugucauccuaggcuguguuauaaguucaaagccaaccuagacuauaugaagcccugugcccaaagacaaaaacaacaaaaaaaugaccaaacaccaggcagggaggcugagagauguggguggguccuuugaguucaagccagacauguuuaggggccauggagauggcucaguuggaaaagugcucgugcaggcaugaggagcucaguuuggauucuugucacccagguauuacuuaugaccccagcaacagggaggcagaagcaggccacacccugggaucacaauucaagccucaaccacagguucugucucaacaugugcucugaccugcacagugugugcagcgcgacagcgccaggauuacaggaaaugucccagucuccuaucuucugugucaguuacugggacauaacuccaugaucccacauagcugugacaacuccagacugcaccaacauccagacuuuuuugucagugggagacugcuccccaaagcacaugcccaugcggcuucccacucaagucccauuggucuugaggccucccguggccaugagaacaccaggaugguggcuaccuguggugcuuuguccucaucuuggauggggacagucucugaagaaauuaggaggccuucauuuacauaagggcauaaacagcugcacccagaccaagucucaccacaucacguugaugucacaggagcugugcaucccuuaucucccacucuccauauuaucuugaaucucccaagaucaccugaagcugugguuucacagaaaggaguaauggcuggagucuuaggaaccagucuuguggcucuucccuuuuuuaucuaccuggaagugcuuguaggcucauuaccuuagaccuggcuaccccugguuagcagccauggcuucugaguaaauauauucuuauuacccaagauggcaccacauacgugauuuagagagaaaaacaaaacaauaaaacccaccauacaacacaauagcuacagguggugcaugccuuuaaucccagcacucgggaggcagaggcaggcagguuucugaguucgaggccaaccuggucuacaaagugaguuccaggagagccagggcuauacagagaaacccugucucaaaaacaaacaaaaaaacaagaauuacaucugagaaaaaagauauacauacuacucucucucucaguaacaacugccuagagagccucaggagggguggggcuuuucggcuccucccacaccaaggcccauucuguuuguuuugcuuuuuguuuuccgaggcaggcugucacugugcagcuccagcgaccuuggaacucuguggaccaggcuggccuucaacucacugaaaucuaccugccaauugcauccuaugauuaaaagugugugccaccaaguccugccugcauuaagccuuuuuuaaaaaagguuuacuuuuaguucugaguauguguguguuuuuguguguaugccauaagaaugcaggaguccgcagaauucagagagggcaucagauccccaggagccggaguuacaguugauugugagcaauguggauacacgcuggaaaccaaaugcagguucucuguaggagcagcacauguucuuaacuacugagucaucccgccagcugaagaaaccuacacaucaaauccuacacucuccugaccccaugaggagucagagcaguuagcacucccuccccuugacacccccccucgugugugugugugugugugugugugugugugugugcgcgcgcgcgagugcaaa

SEQ ID NO: 3802 - RNA, 3354 nt, Mus musculus
guuuaucacuacaaauuaaaaggcuuuauuucuuauucaaauaaauaaauaaauaaauaauaggaaacuacucaggcuuagccccgccucccucccaaguacaggcugggcgaagggguuucacugggaaggggagaggguguggucacaucuugggucaagggaguggccucagaggaagagcgaggcucggacuguggaagagauggguuucuaaggcgugcccaugcucuggcccuggaaucagggguaagguagggacccagcuucuccucugccugggcaaugcgucgagcaaagcggcuucgaucucgugcaaacugcucccagggaccucgacgggcagcuugggcugguccugcccagacagcaaggaaauggacugugacuuucucagcgaaguguaccuggggacggggacaauaaauaaaaaagucugucacgcaaaaauguuugguauuugaauagucaccugccugccccucugauucacucuaagacacagauguccaggccacaacuaccacucucccugccucuuacaggagauugcaagagagugaacacagccuucccagcagaguucauaugcaagaagucgcaacccauggcuucccuggagucuccgccuccaacacacuuccuuagggauuuucaggucccagacucuuccuccucccgacucagaaucuaggcccuuugaauaaauuauauauuaaagaaaaaaaaaaggcaguguggaauucuauuguaaucccagcccuaggacuauaaauuccugagccacaaaguaagcggcuuuagaaucuagucuaacacucaccuuccgagcuuuuagaggaaucucgggguccugaucccgggugggggcuuugaacaaucugagccgccucugcagucgaaggggcagcuuaggugcagcccaaggugauucuggcuucucuccggguaaauagaaggccaccuggaagagagggggcucuuccccacgucccuuggucuucucuccugguagacaacgcuggggcugaaggcagggacucuggcuugagucagcuguuucugagucaccuggggccacauucucacuguccucuuccucuucugugucaucuucuguguccucuccugggcgauacacccaggccuucaggaagggacuuguaugugggguggcaccggucugagcugugucuuccucagcugaauccaaaucgcuguuuucuuccucuguguccucuccugggcgauacacccaggccuucaggaaggcacuuguaugggggguggcaccggucugagcugugucuuccucagcugaauccaaaucgcuguuuucuuccucuguguccucuccugggcgauacacccaggccuucaggaaggcacuuguaugggggguggcaccggucugagcugugucuuccucagcugaauccgaaucgcugucuucuuccucuguguccucuccugggcgauacacccaggccuucaggaaggcacuuguaugggggguggcaccggucugagcugugucuuccucagcugaauccgaaucgcuguugucuucuuccucuguguccucuccugggcgauacacccaggccuucaggaaggcauuuccaguacagacaaaaguugucucagguccuccuuccucagccucagcauuccgacaagggugacccugcccugcccugugugccucuaccuuggcuucucccuccugcuuaggcuucucucuagaguaguacucccaggcucuggagugggagccugaagaaggagaguuggaggggucagccuuguuuucuguuccuuuuucuuccguggcuugauguucugccucccccaagaaaggcacaggggugcuggguuuguaucccggagcuauggaagcagcagaagcuugguaagucuucacuguuucuccauccucuucauucucagcuggaccacccuccagcugugaugugggauaagcgggcucagccacucccucuucucuagccaccaccuccccaagccucuuaucagccccuugcaggccagcgggcuguaguguggccuugccagcugugcguuccauuuccuucucucuaaggucaucuuguccuggcuuugcauuguacucaucaacauuugaaaguccccaaguuucaggaggggaacuuucagcuuccacaaggcagagccucugggcugcuugacucuguucaggagauccacuuucuucagucuccccaugagggaggagguuaccagagacagggguaggugucagcagagccgcagcuucuaucugaucugcuccuguuacuguuuuugccagccaugccucugggacuucugggccccucaggcggcuccaggcccgacugagcaagcccaucaguggggacaggagauagaaguugugggcgucccuccagugcaggacaugcuggggucuugggcucggggccaugugucugggcuagaaaggggggaaauuuguuuagaagucgcucugggaaacagucucgggucacagcacugagucaugguaacaaauagucacagcagcaacacgugaaugccugccucgaauuccaaauaacauugcucacacccaacucugccacuugguuaaucucucucaacacccaagcucuacauccuuagaaccaagagcccacacucuuaaacccuucccuuagccccagucacaguuccuggccagcccuucucagaccuguaagagucuggcuuuuuagugaccuuucguuccucaagcuuguguucaugccccuaaaaccucccucugccuaccccucggacccugguuauuccuccugggguccuucccuuuauuuggcgcuauacagauauugccggucgagccucccggccccuuucccuuuaaacgaagaguguagacgugggcucuccucucucagaccaaauaagccaucugggcuucugugccuuuuccccaaaccuggaaucgcccuccagcuugcccccucagauuccacaacucucuccagucuccucgccagagaguccucccucaaaggccgccccaucccccacucaccggcgggcugcacgucaccccgggggcugaagcgccgguucugguugccaaaagcgaucguggguccggacugcucgcgaagccagcggguucaugucgcccucaggcguggggcucggggacgcaauguuucacaggcuguagcaaaggcugucccggccggcaaagggaugcggggucgcgcgggauaucgcauguaaucuuccacaaacucagagcugacucaaucugcgccaacaucguccacgcggcuuuuauacccugacgcggcgcug

SEQ ID NO: 3803 - RNA, 2434 nt, Mus musculus
ggcauuuucggcuguagcaaacguggcucaguggugaagaacauggacuuugaggccagaguccugaugacauuuaccuugguggcuuggcagguaaagcaugggucaguuucgcaugucagcauguccagacagucccccaugugacucagaugaagaaggcuccuggaggugauguccgcagugaucaugaacaucaaagaccauuagguuuuaugagcaaaucuaagguccucucuauagaagacagaugggcgccagagaucagacagacacaguuuagggcaaaaagucuacguguuucuccauguguaggagcugaugguugugagccuacugcagaguccacaccugguccuggggagaaagaagccauugaagccucgccagccucguggucacgggcaaaagacaauguucgcaugagcugcugggcagaagaagagauuuggccacguggccaggaggaucacaaguccauggccagccugggcaccucauugagaggagacgcuguuugaagaaaagguggggcuagagguacaacucagggguaaagugguuggcaggcagcaaagggcuugagucugauccucaccacuccuguaggacacugagcccagagacaggaaucugucacgccagcaccacaggggauggagacuggcaagaucugggaggucauugaccugccagccuagagaaaccacugugagccaugauucagcacauaacagcacuugcuguauaagccuggcaaacugaguucaaacuccagaaaccaugguggagagacccgaaucccgaagguuguccucugaugucuaggccuaugcgugacacagcugugcccacacucacacauauacauacacagaaacauauacauauacauguauacaugcacauacacauaaacaccaguaauacuuuuuuuuuuuuuuuuuugguuuuucgagacagaguuuuucuguagcccuggcuguccuggaacucacucuguagaccaggcuggccucgaacucagaaauccgccugccucugccucccgagugcugagauuaaaggcgugagccacaauacauuuuuuaaaaaaguuuaaaacuuuaaaucuggggugugugugugggaaugaagagccauugagaaagacacccaaugcugacugcucaccuccccaugaacacacauuuguacacaauaauacguguauguuccacauacauaaaaucuagccuagaaucaccugaguagaaucucaagguucuacauuagguuguacauuagguuggccugugagagaguacugucuuauuaauugacaugaaaagaccuagcccacuauggggggcaccauucucuacgcaugggguccugaacuguguccguugacaugagcaaacaugugagggagcaugcauguguuuacuucucucugcucuugacugaaugccauguguccagcuguccaaguucuugucuugacuuccccauggagaaggaccucgaccuggugcuguuagcugaagcaccuucuuucuccucugaguuacuuagggcaggguauuuuccaacaacaagaggaaugaaacaagagaacuuuguuuuaaauuguuauagacauugucuuuaacaauuaaaaacauaauuagaauacaauguuagagaagacgggguucauagccuggaaucccaagcccaccugugugcagcggcuucccacggugacaggauucucaaggggcuuagggaaagggcuuuacauggguacauggcuucagaaggcucuggccauggcugccuccuacgagguuuucuggaccugagauaaacagaaccuccugguagcagagcuaccuaugucucugugacagaagggaggaaaggagaggagacacaaaagaaugcgcccugcauagcucuuguuuugaggccccgcuucccagccccacaucuaugggaccuauucaaggcccauuuagccuucaugauccaagggcaacuuuguagcaacaucagcuacucccgugagugggugggggugguucgguagaagagccuagaaucccccagggaggggcuggggugugguuugauggaagaggguuugggcaauuauugagagauuaaagggaagcaagugcuuuucucugacugagccuuaggccagcccagguaaacaagacuaucgcacggucacgugaucucuuccagcucuuccagggccccuggcugucuaugggaaggaucgcugcggaaggccgcgcaggaagcgucggcagauucuaaggacggcagauauugcugaacugagcuuuuaagaggcagagagucagggagggccuugucuuuccugacucugccccauaacuugacccugguagguguuuacuaguguauuaaacuguaauaaacugugacuugggcccagugu

SEQ ID NO: 3804 - RNA, 2416 nt, Mus musculus
gggggcagggggaggggggcggguuacagugaauguuuccuuccauucagaguuggaagaaaacauggucuuggucagaggccagcccauugucagaaggacaucccuagcuaacauccguuucuugaaggaaagucuguguccuaggucagggaaaucuuuguuugguaccuagauccuuguucuggaaauggcggcuuucuugaugggagaaauagacuaauccaucuauaaagguucacgugggaaccaccugaccgcuuguuuauggaggccaggaggcacugaaaccugagugcauuuuuuuguuuguaguuuugaggauugaacccaggcccucacaugagcuaagcaggugcuuuauccgggagcaaagcucccaacccucauugcugggcucuagacaggcaguggacuucggaaucguucuugcagccguuuuauguagauacaggagaucggggcagauccugcugcaucagccucccgaguagcuggcacggcauagcugcaccaucggccauguuucuguguauuacauauucgagugucacuaaaacacaagcaguagguuuauguuagaaagggcaucaggugguguauccauuuuuaaagauggaggcgagcccacuuuuagaccagggucuucugcaguuuaucuuuccauucaguggcucaaauacggcauguagaaaggggcucucuuugaagcaucuauaaacauuucuaaaagagcugcugucucuguggaggucucuggauagcuacuuugggauggggauauugagagcuuccauuaauugacagggggaaucuuugaacuccauccugagucaaggaugagucgacuguagacagucuguuguagaggggggcucuccuuggaagugcacacucauuggguggagauaacgggauccccuugguccuugggguguguccaugaagacauccauucauugcuugcuuugggaugauuccaagacaaacugucaccggauaggaaaauacacuggagaauugacaaguggggcucuagggugauggugcagagcauuuuaggaaggcgguuggaugucuguggaagccucuguccuugggacugcaugguacagaagaguccacuaaaggaacugaacaguucauucaaaaggguugagaaagcgauugacaggagaacacuauuuggaaauaucucucucucucucucucucucucucucucucucucucucucucucucuccaguagaggccaugcaaaugggccggaguuauauccccagagcccacaugguagaaggagaaaaccgauucacaaguuaccuuuugaccucuacaugaauccuauggugcugcccuuccccauaaccccccccccccaaccaucaccaccaauaggagggaaccacaaauuguuuuggcaaaggaugcucaaagagccccuugagaacccaggagauauccuggagguuaucaacauuuggaggcgauguggggugaaagucuaguguggaugauggaugcuguuuggacgcauccauucccgcagcagcaacuucugcuucacucuaggacuucgugguguaugucaugacacgagagcagcacguguucggccggggugggcccuccucgucccgcgggggauccccagccccauauguggacaccuuccucaacgccccagacauccugccucgacauugcacggugcgcgcgggcccugagcccccggccauggugcgcccaucccggggcgcccccgucacacacaauggcugucuuuugcugcgggaggcagagcugcaccccggagaccuguuaggccuaggagagcauuuccuguucauguacaaggacccccgcuccggggguucugggcccgcucggccaucuuggcugccagcgcgccccggggccgcgccacccggaccgggcugggccuuuucuugucguuuguguggccguggccugcaggagcgcggcgaggcgcuggccgccuaccuggauggccgcgagccggugcugcgguucagaccacgagaggaagaggcgcuguugggcgagaucgugcgagcugcagccucgggagcaggggaccugcccccgcucgggccagccacucugcuggcacugugugugcagcauucugcgagggagcuggagcugggccaccugccucgcuugcugggccgccuggcccggcucaucaaagaagccguuugggugagcacccccuuguccuacaagucuuccgguugcccccucucuuuuccaccacccaccugcgucacagguccuuucugccauauuccugcccucuccuauaaguuuuccacaguuucucuucuaccucaaccagcuagcucccuguucaagccucaggcaagaagaaacuguuuuuucccauuaucc

SEQ ID NO: 3805 - RNA, 6829 nt, Mus musculus
uggauugugaucugaccuuuaccaaaguagaaacucaggcuuuaguuuuucuuuaacucugagggcccagguuaggcacugagacaucugauugacaacucacauauauaccucugucccuuuaacacuggucccaucuuucccaauaaccugaucuuagcagaaaaggaaaauuagacaaaauguacugucaggcucaaaggcauaggagauugcccauuucuggaggucucacguguucaggcccagcuucccccaaguccccugucucuuucuuguuugugacacagagucucauguaacucagacuggucucgaacuuucuauauaguugaaauugaucuugggcugauucuccugccccagcucuucaugccuauugcccuaaguguuaggauuacaggugugagcuauacuuucacacuucaaaguccugggcugccauacaagaaguccagcgauccaacuggggucagccuuccccccaucuccaucauuguaccaacauaucugaaggagccaugccagauaugcucagccaucugggcuuagggaugaguauauguccaccacuccccaccccaccccuacccccaccaucuugugggccugcagaguccaguaaaccauagccacuuaugguuacacuuugaauacauauugaucugcacuggcucaugugcagcuguugggugcuacuggagaggucuggaaacuucaggacuaguaggccauugguggauaggucuuagggguuucucauccuagcuccucuuucucuucuucucaccuacccuugcuucccauccacccugaagugaaguaucugcuccauauauuuggccaccaugguguuccccccucuccuccccgcccccagucacauugggccaaacagguucugaaaaccugggcaaauuaagccccucucccuaccuacucucucuggaguaugcuggucacagcuaugugacaggaacugaugcagcuccuguucuguggguuuguuaauagaugcaaaugugaaugcagcuguccagucucaugagccucgggccacacgcgagauccacaguuuaauucacuagacagucauccuuccagcgcgagguggaggcagaggcucccccgggaaacauucuaucuccucuccccuuuuaucuaucuucccaccucauggcucugggaagcccuucaauaagacaugagaacuggguauaauggcucaugucuguaaucucagcacccaggaggaugaagcaggaggauuguaacaaguuugaggccagcuuggcacuacauagcaacacuugcucucaaaaacaaaacaaaacaaaacaaaacaaaaccccaagaaagcuagauaaaaucacagcucugagguggggguggggccauaaguucaaggucauagggaguuuguagucaccucucacuaguagcuucugguccucucaccucuaacuagaacuugggggcccacgggguggggguggggggcgguccuucuacucuuaccugguccuuuccugaccucaaacagcacaaaguuucacauccccagaugacaggcagccacacaaccugcaggucucugagggaggcagcaagcuuguaugcacuggccaguagcaaaugaaccccccaaccccaaccacugggccugggaggggccauacagaggccccauaggcagguccaggcacauaagauaucagcagcagcggugagucaggaggggacgagggcaucaguacucuguaguuggagggucccuguggaugcagaugaccucuccuuagacccaagggucugucaccaaggaucuggcagcaguucccagagcagacugccacugggaucagauagguccgcagagaagaugcuggggccgggaggcccagagcccagugguggacccccacucaaggccuccagccaguccaaggaaucagugagggcccuuggagaaggggacagggagcuugugggggacgguagugaagaagagaagacggaagagaagccuuccgaguccggggagggagacagcaggucaaaugagccagggaaguccaagggcacgggaggcagcaggucugcaggaggagugugagcuuuagggggauggauucugcucacugcgcuguuuccaacccacuucuccuucgacgagacccuggaguucccaaguucaguuccuccccuaaaugugggagcuaaucgccuaccaucuggcuccacuuggucuuccaggaugucaucgauguugcgguuuggaagcagcuguggaugagcacacaccacgugacccuagauccugcuuaggucuaccgcccaauccccgagcacucccagccccucaucccuuuccaccugcgcccuacggaucgcuuccugcagcuccuccuccagagucaggcuagcuggaggugucgggaaaggagcuggagcuggagcuggaacuggagcuggagucggagucggagccaaagcuggagagggagugggagcaggaacagaagccggagcgggagcugcucccaggggauccguagcuccagaaaacuucagccuacgauuugucgcgcuugccuucaccuagaaccaggaaaggugggaguucaauaugcccggcacaccaagccugacccggcccuuccuuggcuuuacccaauucuuucaaaacaaaacuauuuacugggugugcgugagcgcgcguguauguauguauguauguauguauguauguauuauguauguauguaugugugugcacacaucagaggauaacuuucagagucaucuuaucuuucaucucaucuuguggcuguaccuccaguaagcuugcugcaagcgcuccuacuacacaaauaagauuacagcccccgccccuauccugucauugguuuuucucccuuaaaccacgcccucccuguauucucaacuacauccucagaccaaccaaugauuggccacacccucaagcuuuugguugagacccgccccuuaggugcaaaucagaccuccuuuccaacauuucauuggcuaauuuucccgauuucucuuucucuucucuuuauugguccauguguacacagccccgcccucaccgugcuggguagccgaguaguucccagcgccuugggcuugaggcggggccagggagcagcggccucuuuguccucucgccugggcuucggccguucucugggcggggugccaccacgcaugcgcuccaggagcaucgcuuuggucccggacaccgggaguccccgcaggcgcagcugcugccuaagcucugagaccugaguauggguuugggagagaaggugcugagcucuggggagggaugacuaggaaaucaagaggaggaaccacaauccagaccgacuuuccuagggcagaggccuugaguuugcggggucuggugccagcccugaagagggccagcccugggacacugcacacuaaacucaccgucagcucuuccaguuuaagggucugaaguuccagcuugugugaagggggcgagggacuggagacuccugcugaggaaggcuucauccuagcgacaggcaugaggggacggaguaaaggacagggagaaagguacuuagggaccuuaaaacgggccucggaaaagccaggaaaaugaggaauuccggacuucccguggagcaaacacggggugauuuuguggguguggaagauaggaaaauggggugucucugcagaucacggggagcaugcacggccggggucccgggggaggagguuccaggucaagcuucucuucuuugcacuguagguuugagggaggagaauggggcuugaguuucugguccccuggagaaggaaaaugagaguccuaccgaggauguggucucugugaauucuuuucccaaagagguggguccgggggacccaggguugaccucucaacuugcagauuugcccugggcccuugucucuguucuggaggcauguacaggugauaugucaaguucccccugaccuuaggcuccuuccaauguugggaguucuugggagauuccugaaagagugaguaaggccaaguuucgugguuugguggcucaccacaccugucauccuagcuccagagagccuggggcaggauggggaguucaaagacaaccuuggcacauauaguaaguuugucucaacaaacaaacaaacaaacaaaaaaagccaggaugacgcuucagcguggucaccacuuucuuggccuguaggauguguagugucagcuuuaagacaccacaaggcaaggcaaaggagaaccacacuugggcgcuuguccuccugucuaaacuuaccuucuuuggagcccuccaaggacaauaugcuggcucaggggacaagacgccagggcugacaaggaaagaggcaggaacagugggcaaagcuggagccagagcugggccugaggcugagauccauggaucugaaucagaggcugaagagauagaggaggauccugaagaggccaacagacagcuggcuagcuaggguggagagaugccagggggaaaggagggcuggccgagagcaggaagcagaacccaaacugucccgcugggcucccuggguacccagacuuucacauuuuugagaaaggaagagcauuuuguacuuagucugcaaaggguccguuuguuuaggaucacagauaucuagcauaucccugggacaggaccgggugauaucuguauccccugacuccagggaaaaggacacguccaaaagcuauauucagacacugauuguggaagaggcuggaauaccugacuccauccaggaaacguuaggguaucuggggugggauagcugagcaauaggaaacagagcccagugggugggggaaaugacaggcugggguuucgcucucgcucucguggggcuggacaugcaugcucuuuggggacugaggccaccauccccuccccuugggggcccacacuuacugcagucuugauuccgucuguggauccgaagcugcaggacuaaggaaggaaaagggaggugggacagggaaagcgggaagggaguguccagagccugacuuggcuggugggugggagcugcaguuguuggcgggacacacgugcccagcccagccccuuuacguuccccgggccgggcgggugggcaggcagccugcucccucucccuucccagggccucuugccugcuccugccagcuaagcaucuugggccagagccacuccugagacuguaagcuagccagccucagccgagaggcaaccaugcuccuggcuccaccugccacuucaggagucugugaccacccuggcacagucgccaucuugccaaccugacucaucaaccucucacuuccuuuuauccacgcaccccuuugccccucgaauuccccacagccagcacccugcaaacuaaacccuggagcucaaaucucucuggacucuaguuugcacuacaacuuuacaugacuucccaccccaacuuacucuugcuggcaugcacccacaggaaugucacucacauguucaagacuugacccucaguuugggggcaaagaguuuccagugcacauuucugcuccucucugaguguucagaacucuuugcauuggcaacaaauccuggcuaaugacauuuucaaggcuugauagcucuuggucccccugccacacacacaugcacuucaggucucaguuugcuccucugcuuugccuacaggucaguuuaaguccuuugcaacauaugcacucuugggugucaccaccuauggcuuagcaagccaugugcacauucaucuacuacuccacuccauagcacaagugacauuguaugugaacaccacuggucgauucacgcaugccagagaaucauguuacugggacccugggcccuggcuccgggaccccuccccacaugcauagagacaagcaaccucucaccagagcggaacuuggaacggaugauuugggagcgcugggaggaggcugccagggucauugccaaggcugagguggagaccuggacagaggaagccagagccaccagagcgcggcagggucaaaguggaugacgggaggcugccauugggggaauuuuggagacagugugaaagguuagagacaaaaguacugggccagaucagcucuuuugggggaugacuggucucugggcccuugggucugagaaaggagggcugguccugaaccuccgggugugagagacacgggcuggggccuggagcccuaggacugaagaaagguugcggccuggaguucuggcuggagggagaaguacuugggcauggacugcugugucuguagaaggcuuugggccuggaguucugagucggaagcaaaagggcugggucuaaaucccuggaucuuggcgguacaggaaggaccugcgucaugggcuccugcaucuaagagggagagcauuggaaucuggaguucugggccuuugaaagugcaggaagcagucgucuggagucugaacccugaaggaggaggagauuaaggacgagaacugcaugcuguuagggacuagaaucgaagauucuaggacagacgggaaucaaagaauaugacaagugucugggaaacauaggggucccugaaacagaauggguugagugucaugcacggggcucugugggaaagauauugggaccagaagggggaaccagaacggagaaugaaggguaaaaugaaaaaaaaaaauccccauaucuaccccaggggcuucucaccagguaggcuccucucagcuacucagcugugccuugaagcggguggagucucccg
